United States Patent 7,214,786 (NUCLEIC ACID MOLECULES AND OTHER MOLECULES ASSOCIATED WITH PLANTS AND USES THEREOF FOR PLANT IMPROVEMENT) - sequence listing, part 5

SEQ ID NO: 11911 - DNA, 2527 bp, Triticum aestivum
  unsure (1)..(2527): unsure at all n locations
  Clone ID: PAT_TA_11911
gggcttcatctgcttctacagcccctcttcgacacacgagtcattttttcaggacaaagatcaatccagatacacatacacctgccgacgtttagctagcgtacttccagaatccagatacacatacacctgccggtgtccagctagctcgcttgctttagtacttctctgcatcttccgatggagtgcgagaacgcacacgttgccgccaacggcgatggcttgtgcgtggcgcagccggcgcgggccgacccactcaactgggggaaggcggcggaggagctctcgagtagccatttggaggcggtgaagcggatggtggaggagtaccgcaagccggtcgtgacgatggagggcgccagcctgaccatcgcgatggtcgccgcggtggctgccggcagcgacaccagggtcgagctcgacgagtccgcccgcggccgcgtcaaggagagcagcgactgggtcatgaacagcatgatgaacggcaccgacagttacggtgtcaccaccggcttcggcgccacctctcaccggaggaccaaggagggcggcgctctgcagagagagctcatccgattccttaacgctggagccttcggcaccggcaccgacggccacgttctgcctgccgcggcgacgagggcggcgatgctcgtccgagtcaataccttgctccagggatattcaggcatccgcttcgagatcctggagacgatcgccacacttctcaacgccaacgtgacaccatgcctaccgcttcgaggcacgatcaccgcgtcgggtgacctcgtcccgctttcgtacatcgccggcctggtcaccggccgcccaaactccatggcgacggctccagatggtacgaaggttaatgctgcgaaggcatttaagatcgctggcatccagcacggcttcttcgagctgcagcccaaggaaggccttgccatggtgaatggtacggcagtgggctcagggcttgcatccatggtgcttttcgaggccaacgtccttagcctccttgctgaggtcttgtcggccgtcttctgtgaggtcatgaatggcaagccggagtacaccgaccacttgacccacaagttgaagcaccaccccgggcaaattgaggctgccgccatcatggagcacatccttgaaggcagctcctacatgatgctcgcaaagaagctcggggagcttgacccactgatgaagccaaagcaagataggtatgcactccgcacgtcgccgcagtggcttggccctcagattgaagtcatccgtgctgccaccaagtcaatcgagcgggagatcaattccgtcaacgacaacccactcatcgacgtctctcgtggcaaggccatccatgggggcaacttccagggtacgcctatcggcgtgtccatggacaacaccaggcttgccattgctgcgatcggcaagctcatgtttgcccagttctcggagctggtgaacgacctctacaacaacggtttgccttccaacctctccggcgggcgcaatccgagtttggactatggcttcaagggagctgagattgccatggcctcatactgctctgagctccagttcttaggcaacccggtgaccaaccatgtccaaagcgccgagcaacacaatcaagatgtcaactctcttggtctcatctcctccaggaagaccgccgaggccattgacatactcaagctcatgtcctccacattcatggtcgccttgtgccaggccatcgacctccgccatctggaggagaatgttaaggatgccgtcaagagctgtgtgaagatgacggccaggaagacattgagcaccaccaacaatgggcacctccacaatgcgcgattctgcgagaaggacctgctgctcacgattgaccgtgaggcggtgttcgcgtatgcagacgacccttgcagcgccaactacccgctgatgcagaatatgcgtgcggttctcgtggagcacgccttgtccaatggtgaggccgagcgcgacacggagacatccgtctttgccaagcttgccgcgttcgagcaggagctccgtgcagtgctaccaaaggaggtcgaggctgcccggacctccgtggagaacggcaccgccgcgcagcagaaccgtatcactgaatgccggtcatacccgctctacaggttcgtgcgcaaggagcttgggactgagtacttgactggggagaagacacggtctcccggggaagaggtggacaaggtgtttgtcgccatgaaccagggcaagcacatcgacgcgctgctggagtgcctaaaagagtggaatggtgagcccttgcctatctgctgaacagaggatcaagaaactgaagagaagacagtgtgcagaaggctctgtatcttcttagctgataagtgataatagtttttcaattgtattttcttaagatcgatgttttgtaagatggaacattcttacagagctgcaacgttattgccaaatattgcaactgcataacttgtacaacttctantatngtaagttagaagggtac

SEQ ID NO: 11912 - DNA, 1395 bp, Triticum aestivum
  Clone ID: PAT_TA_11912
cgggccggccgaatccggccggtcttgtcctcgtttcggtccggcccacgcgccaacgacctcccctatgcacgctctgtttttcccccctctcaatcaagaactcgcaccgtcgcacgcagccgtggctataagtgggggaggaagaaagaagaagacgacgaagccaacccatccaagcggcagcagagcagacggccggcgacgaaccaatccagccagccgaactcgtcagcgcgcagccgcccttcccgcgagataaaccatgggtggggtacttggtttgatacagattgatcaatcaacagtagccatcaaggagacttttgggaagtttgatgcgatcctgcaacctggatgccactgcttgccatggtgcctagggcagcagattgctggatatctttctctgcgtgtgcagcagcttgacgtccgatgcgaaaccaagaccaaggataatgtctttgtcaacgttgtggcatctgtgcagtaccgtgctcttgctgacaaggcatctgatgccttttacaggcttagcaacaccagggagcaaatccagtcctatgtctttgatgtgatcagggctagcgttccaaagatgaacttggatgatgtatttgagcagaagaatgaaatagcaagggctgtggaggatgaacttgaaaaggcaatgtctgcctacgggtacgagattgtgcaaactctgattgttgatattgagccagatgaacatgtgaagagagccatgaatgagatcaatgcagctgctaggatgaggttggcagccactgagaaagccgaggcggaaaagattctgcagatcaagagggctgaaggtgaggcagaatcgaaatacttggctggtgtgggtattgcaaggcagcgccaggccatagtggacgggctgagagacagtgttctcgccttctctgagaatgtgcctgggacctcttcgaaggatgtcatggatatggttttggtgacccagtacttcgataccatgaaggacattggggcctcttccaagtcttcagcagtgttcatccctcacgggcctggcgctgtcaaagacatcgcttcgcagatacgagatggtcagctccagggcaggatggtttgaggagtgttggaaaatggatgccacttttatatgcatacttttaagtacatacagcttattcttatactatgtgtgaggtgaggtgaggttgtgcctagatggatgttaatatcagtacttgcttgggttgtgcaactcgtatctgtaaaaaatatcagttgtgctatccctgtgttcgcaactatttgtgaattgagagtgttatatgttcctatatggtcactatactataatttctatgttgctaaaaaaaaaaaaaaaaaactcgagactag

SEQ ID NO: 11913 - DNA, 1223 bp, Triticum aestivum
  Clone ID: PAT_TA_11913
gaggaataagaagaagaagaagaagccaacccatccaagcggcagcagggcagacggccggcgacgaaccaatccagccagccgaactcgtcagcgcgcagcagcctctcccgcgagataaaccatgggtggggtacttggtttgatacagattgatcaatcaacagtagccatcaaggagaccttcgggaagtttgatgccatcctgcaacctggatgccactgcttgccatggtgcctagggcagcagattgctggatatctttctctgcgtgtgcaacagcttgatgtccgatgcgaaacaaaaacaaaggataatgtctttgtcaacgttgtggcatctgtgcagtaccgtactcttgctgacaaggcatctgatgccttttacaggcttagcaacaccagggagcaaatccagtcctatgtctttgatgtgatcagggctagcgttccaaagatgaacttggatgatgtatttgagcagaagaatgaaatagcaagggctgtggaggatgaacttgaaaaggcaatgtctgcctacgggtacgagattgtgcaaactctgattgttgatattgaaccagatgaacatgtgaagagagccatgaatgagatcaatgcagctgctaggatgaggctggcagccactgagaaagccgaggccgaaaagattcttcaaatcaagagggctgaaggtgaggcagaatcgaaatacttggctggtgtgggtattgcaaggcagcgccaggccatagtggacgggctgagagacagtgttctggccttctctgagaatgtgcctgggacctcttcgaaggatgtcatggatatggttttggtgacgcagtattttgatacgatgaaggacattggggcctcttcaaagtcttcagcagtgttcatccctcacggacctggcgctgtcaaagacatcgcttcgcagatacgagatggtcagctccagggcaggatggtttgaggagtgttggaaaatggataccacttttatatgcatactttaagtacatacagcttattcttatactatgtgtgaggtgaggttgtgcctagatggatgttaatatcagtacttgctttggttgtgccacccgtttctgtaaaaaatatcagttgtgctatcactgtgttcgcagctatttgtgtattgagagtgttatatgttactatatggttattatactataatttctactcaaaaaaaa

SEQ ID NO: 11914 - DNA, 1633 bp, Triticum aestivum
  Clone ID: PAT_TA_11914
tcaatgaattagttcaccagaatagatggcgtgaagcattggatcgcctactagagacaaacaacttccctgaatttactggacgtgtgtgccctgctccttgtgaggggtcttgtgttcttggcattattgagaacccagtatcaatcaaaagcatagaatgctcgattatagacaaaggttttgaagagggatggatggtaccacgaccaccacttcaaagaacaggaaagaaaatcgctatagttggcagtggtcctgctggtttggctgccgctgatcaactaaataaaatgggccattttgtaactgtatttgaacgttcggatcgtataggaggtcttatgatgtatggagtaccaaacatgaagacagacaagattggagttgttcagcgtcgtgtcaatttaatggccgaagagggtgtaacatttgtggtgaatgctaatgtagggagtgatcctttatactcaattgaacgtctccattctgagaacaatgcagttattttggcttgtggagctacaaaaccaagggacctcagtattcctggccgtgagctagctggagttcattttgccatggaatttctccacgcaaataccaaaagtttgcttgatagcaacctggaggatggaagatacatatctgcccagggtaagaaggtggtggtcattggtggtggagacacaggcacagattgcatcggtacgtctgttaggcatggttgcagcagcattgtaaatctggagcttctcaccaagccaccaagcaagagagcttctgacaacccctggccccagtggcctagagtcttccgagtggactacgggcaccaggaagcatctaccaagtttggaaatgatccaagaacttacgaagtcttaaccaagcgtttcattggtgatgaaaatggaaaattgaaggcccttgaggtggtgcgcgtgaagtgggagaaagtagatggaagattccaattcaaggagattgaaggatcacaagagatcatcgaggcagaccttgtcctccttgccatgggattcctgggccctgaagagaacatcgctgacaaactgggtttagagaaagacaaccgttccaacttcaaagctcaattcggacacttcgggaccagtgtggatggcgtttttgccgctggggattgcaggcgcgggcaatcgctggttgtttgggccatcaccgaagggcgtgaagctgctgctgcagtagataagtacttgtcaagggatgaacaaaatgtcgccaggccttacataggtttgtggtgctgaattcatagcgacgtaatttaggatgggtgattttatccattgatgatgatagcaaattgtggctaagggcttgggctcaatagggaaagaaagagagagagagagagagagcccttttatacttgataggcatacaattggaaattttggttggctattgtttgttggttcattgtctagctaataatgttttgcttcgctgcctaaatgcggctttgtagcctgaataatgtacagtatttttggttgctcaatggttgtaaagtcgtctgggtaaaaaaaaaaaaaaaaaaaaaaaaaaaaaaaaaaaaaaaaaaaaacctgcccgggcggccgctcga

SEQ ID NO: 11915 - DNA, 2909 bp, Triticum aestivum
  unsure (1)..(2909): unsure at all n locations
  Clone ID: PAT_TA_11915
attcccgacatccctctttgtgctccttacgcttcaaggccagattatgcgccctttttacggagaacagatagtgccatgcaataaaagtcattgnccaccgatctttgaatacacacgtctagaatttcttcggccccatgaggatagaatggcgagtgatcaaatttacatcccatttctttttacgaaggatcttgatggagtcgaaccatcattcccagcaatttgtttgctggaatgctctttccagttcagagctgaagatcaaccatttattcatcttttatcttttaaattgaaaaatattcagctcaaagctatttcagactcaagcacagccccaagattctccaatccaattgaatttgaatgacaaacccactttgaataagcctgcttagtaaaaaattgacgaagaaggcagagatatcgttagacagatgttagaagacaaattntctactcgagctcttttctcccacaaatctgctccatcgagacttcaagatccattgttgatcaaaccaatggcggccaacggcaaccacggtttgtgcgtggccgagccgcggagcgctgctgaccctctcaactgggggaaagccgcggaggcgctgtcggggagccatctggacgccgtgaagcggatggtggaggagtaccgcaggccggtggtggttatggagggcgcaagcttgaccatcgcccatgtcgcggcggtggccgccgccgacggggccagggtggagctcgacgagtccgcccgcggccgcgtcaaggagagcagcgactgggtcatgaccagcatggccaacggcaccgacagctacggcgtcaccaccggcttcggcgccacctcccatcggaggaccaaggagggcggcgctctgcagagggagctcatccggttccttaacgccggtgcgttcggcaccggcagcgacggccatgtgctgcccgctgccaccacgcgcgcggcgatgcttgtccgcgtcaacaccctgctccaaggatactccggcatccgcttcgagatcctcgagaccatcgccacgctgctcaatgccaatgtgacaccgtgcctgccgctccggggcaccatcaccgcttccggcgatctcgtcccgctctcctacatcgcgggacttgtcaccggccgcccgaatgccgtggccgtggctcctgatggcacaaaagttaatgctgccgaggcatttaagatcgccggtatccaacacggcttcttcgagctacagcccaaggaaggccttgctatggttaatggcacggcggtgggctccgggctcgcgtccatagttctctttgaagcgaatgttcttggtgtgcttgccgaagttttgtcggcggtgttctgcgaagtgatgaacggcaagccagagtacactgaccacctgacacacaagttgaagcaccatcctggacagatcgaggccgcggccatcatggagcacatcctggagggcagctcctacatgatgctcgcgaagaagcttggtgagctcgacccattgatgaagccaaagcaagacagatatgctctccgcacatcgccgcaatggcttgggccacaaattgaggtcatccgtgcagcgacgaagtcaatcgagcgcgagatcaactctgtcaatgacaacccactcattgacgtatctcgtggaaaggcaatccacggtggaaacttccaggggsacgcccatcggtgtgtccatggacaacacgaggcttgccattgctgcgattggcaagctcatgtttgcccagttctcggagctagtaaacgaccttctacaacaatggcttgccctccaacctctctggtggccgcaatccaagtcttgactatggcttcaagggtgccgagatcgcaatggcgtcatactgctcggagctccaattcttgggcaaccctgtgaccaaccatgtccagagtgcggaacagcacaaccaagatgttaactccctcggattaatctcagcccgtaagactgccgaggccatcgacattctgaagctcatgtcctctacatttttggttgcgctgtgccaagccatcgacctgcgccacctcgaagaaaatgtcaagaatgccgtcaagaattgtgtcacaagagtggctaggaagaccctgatcacaaatgacatgggtggcctccacaacgcacgtttctgtgagaaggacctgctccaaacaatcgaccgcgaggcggtgtttgcatacgcagacgacccttgcagcgccaattatcctctcatgaagaagatgcgcgcggtgttggttgagcatgccctggccaacggcgaggctgagcacaacgtggaaacctcggtgtttgccaaggttgccaaattcgagcaggagctctgtgcaacactacctcagaaggttgaggctgctagaggtgcagtggagaatggcaccgctgcagaaccaaaccgtatcgtagactgccggtcataccctctataccggttcgtgcgcgaggagctgggcacagtctacttgaccggagagaagactcggtcacctggcgaggaggtggacaaggtgttcgttgccatgaaccagggtaagcacatcgatgctctgctggagtgcctcaaggagtggaacggcgagcccctgcctatctgctaatcaagtagatgaagagaagatgccttggttcagaattttagaaactgataatactgttgtttgattttattttacttttcctcttctaaagcgttgatgcatgcaacgttcttccggagctaaagcctagagcttctgctgctgtaagtgacagggtataaatttttatgacaaatgttcaagttgttgaaatgaatccaaagaagccagtctattgttgtaaaagaaaaaaaaaaaaaaaaggccccta

SEQ ID NO: 11916 - DNA, 976 bp, Triticum aestivum
  Clone ID: PAT_TA_11916
gaattcggcacgaggtctcgagttttttttggtttttttttgcgccaacctcatcgccaattcatggtgtacgtacgtacatgcaaaattttgcagtaaccatgcaaatccatggattgcacacgtaaaagtagctttacaataatctactggactgtagcatgaattgtgcatatcgagaggcaaattaacgagtaaaaaaagatctagaaaatacaagtaatcatcatctcagactgagggtccagctcgatcgatcttgcacttgcagctgaatcatcatgcatgcatctttaatttctgctttggtaacgaacgtacgtacgtagtagtgttgattggaatggttggattagtagctgtagttcttgacgaacatgccctccttggcctcggcggcttcgccgtcgctggtgtactttccgagctgcgcgagcgagttggccttggcacgcagcagcagcgcctcctgcgccgccttgacgttctccggccggccgccccacgtcttgaggcacgtgttctgcagcgcccgggcgtaggagaaggagacgtgccacgggttgggcccctggttcatggcattgaggttgagcgtggcctccacctcggactgccctcccgagaggaacatgatgccggggacggcgggcggcacgcggcggctgaggagcttgagggtgtagtcggcgacctgctccggcgtggccctgtccttgcactcggcgccgggggtgaccatgctgggtttgagcaggatgccctcgaacatgacgttgttctgggccatctggtagaaggtctcgggccacaccttctgcgccacctcgaaggtgcgctggatgccgtgctccccgtccagcaggatctccggctccacgatgggcaccagaccgttgtcctgcgagatggcggcgtagcgggcgaggccccaggcggcctccccgacggccagctcggagctcgtgccgaattc

SEQ ID NO: 11917 - DNA, 1564 bp, Triticum aestivum
  Clone ID: PAT_TA_11917
ttttttttttttgctgcccaagcgcccaacctcatcgccaattcatggtgtacgtacgtacatgcaaaattttgcagtaaccatgcaaatccatggatcgcacacgtaaaagtagctttacaataatctactggactgtagcatgaattgtgcatatcgagaggcaaattaacgagtaaaaaaagatctagaaaatacaagtaatcatcatctcaggctgaggctcccagctcgatcgatctttgcacttgcagctgtagtatcatcatgcatgcatcttgaatttctgctttggtaacgaacgtacgtagtagtgttgattggaatggttggattagtagctgtagttcttaacgaacatgccctccttggcctcagcggcttcgccgtcgcttgtgtactttccgagctgcgcgagcgagttggccttggcacgcagcagcagcgcctcctgcgccgccttgacgttctccggccggccgccccacgtcttgaggcacgtgttctgcagcgccctggcgtaggagaaggagacgtgccacgggttgggcccctggttcatggcgttgaggttgagcgtggcctccacctcggactgccctcccgacaggaacatgatgccggggacggcgggcggcacgcggcggctgaggagcttgagggtgtagtcggcgacctgctccggtgtggccctgtccttgcactcggcgccgggggtgaccatgctgggtttgagcaggatgccctcgaacatgacgttgttctgggccatctggtagaaggtctcggcccacaccttctgcgccacctcgaaggtgcgctcgatgccgtgctccccgtccagcaggatctccggctcccacgatgggcaccagaccgttgtcctgcgagatggcggcgtagcgggcgaggcccccaggcggcctccttgacggccagctcggaggggccgttggggatgctgaccacggtgcgccacttggcgaagcgggcgccctgctggtagtaggcggcctcccgggaggcgaggccgtcgaggccctggcaccaagactcgtcattggagccggtgagcggcaccaggcccttgtccaccttgatcccgggcacgacgccctgctccaccaggatgtcgacgatcttcttgccgtcgacggtggactggtagagcgtctcctcgaagaggatggcgccggagatgtggttgccgaggccagggacggagaccagcagcgtgcggaacgcctgccggttcgcctctgtgttctccagaccgatcgagtcgaggcgcttcccgcaggtggcgttggactcgtccatggccaggatgccgcgccccggcgacgcgatggttttcgcggtctttgacggagtcattcgtcgtaggcgccggcgcggacggaccatggacaccctcggggcggcgacctggcgcgcgacgccccattcggccttcttggggaggaaggaggacttgaggagagtagcagatgccatgtcctttcttcttcttcttcttactttcttgcttgcctgcctgccactgacctcaagctcaaggtgc

SEQ ID NO: 11918 - DNA, 894 bp, Triticum aestivum
  Clone ID: PAT_TA_11918
atcaattaaccacggaattgccaggtgaaaccaaattaacacaagtagattcaacatgcattcagaaatgaaactgcaaatgggtatcaaatgtttcacaatctctgatgtcacggcggcagaaggatttcaagtactctaaaacatttagctagaagggactaaaccattgatcataaccaccaacaaaaatattttccttgtttacagaacaccatctcacttcgcacttccgtttcaaacagattactttgaggtcgtcttgtccttggtcttctgtattttcaacaccttcttcacgatcttctgctcctcaaccaagaaagcgcggatgatcctttccctcaccgcagttccagagagcactccaccatagggacggttcacagtcctgcggttcctagacaaccttgatcttttgtattcagtaggcctgaggtggggaatcccctgaatcttcttcccggtcacagggcacttggggccgctcgccctcttcttggtgtactggtacacgagcttaccacctggggtcttgacgacccgcgtctggttggacttggtggcatagctgtgcctcttccggtaggtcagacgctgcaccatgtttccgtcgtctgacggttctggacggtgagcttgacggtgacgcggaggcccttccagtccttggccgtctccttggcgatgtcctcaccgatcttcttgggggagagaccgagggggccgatcttgggggcaagcgaagacgccgcgccgacctcgcctccggtcacccggacgtagacctccaccacctgcgacgggtcgagcttgggcggcatggctgctgttcggtggcgggcggcggcggcggcggcgggagggtttgggagaggcttcggacgcgtgggt

SEQ ID NO: 11919 - DNA, 934 bp, Triticum aestivum
  unsure (1)..(934): unsure at all n locations
  Clone ID: PAT_TA_11919
acaagacagcaaagcaaatgcagcgactaacaatacataagaatcgctcaaaacatcaatgacaaaactcaacatatgatattctagctgccataataacattgattgattccgcaaggtactcattaaaccagtaaaaaatagtctcacaatggaaccactaaagcatgacaaaagtttcttcttcagcacgagtagaacaagtgaagatatcacatccattctctcaactgcatcaggaagcatctagataggagaaactacttcagcagcctcacataacaacctgcccaaagccaagccttcttaagcggggatctccacctcgccgtcgtcgatctccgtctgcagatccttggggtccttgccgtcgacggtgcagccgacgctgacgcaggtgccaaggatctccttgacggtgccggccatctccttggccatggagcggaccttcatgatcttggcgatctcgatgacgtcgtcgaggctgatgttgccgctgtgcttgatgttcttgaccttcttgcggtccctctcgggctccttgagcgccttgatgacgagggctgcggcggaggggacgacggacaccttggcctggcgattctgcacggtgagcttgacggtgacgcggaggcccttccagtccttggccgtctccttggcgatgtcttctccgatcttctttggggagagaccgagcgggccgatcttgggggccagggacgacgcagcgccgacctccccgccggtgacgcggacatacacctccacgatctgggacgggtcgagcttgggaggcatggctgcgagcttgggctggggaggattggctgtggggagtgtgtggcggcggctggagttggagatgctagattttttttttttttttttttttttttttttttttttttnttnnnntnnttttttcccg

SEQ ID NO: 11920 - DNA, 1780 bp, Triticum aestivum
  Clone ID: PAT_TA_11920
ttgggaaacgaggtcggggaagccccttttgaaggactttaagaattgatttgaaaagaagataaaagttgggtatttgttgagggtggagaagatctgggagagtttttttttttttttttttttttttttttttttttttttttttttttttttttttattttttttaacataagtagattcaacatgcattcagaaatgaaactgcaaatgggtatcaaatgtttcacaatctctgatgtcacggcggcagaaggatttcaagtactctaaaacatttagctagaagggactaaaccattgatcataaccaccaacaaaaatattttccttgtttacagaacaccatcgcacttcgcacttctgtttcaaacagattactttgaggtcgtcttgtccttggtcttctgtattttcaacaccttcttcacgatcttctgctcctcaaccaagaaagcgcggatgatcctttccctcactgcagttccagagagcactccaccatagggacggttcacagtcctgcggttcctagacaaccttgatcttttgtattcagtaggcctgaggtggggaatcccctggatcttcttcccggtcacagggcacttggggccgctcgccctcttcttggtgtactggtacactagcttaccacctggggtcttgacgacccgcgtctggttggacttggtggcatagctgtgcctcttccggtaggtcaggcgctgcaccatgtttccgtcgtctccgccgccggcagtagggggcttgggcaaagggttgttgatgttttattcgaattcgaaagggccagacctatatatattataaagaaagtaatccagctcgttgattcctaccacttaatcttaatttattgtgaattcccggagagggaactccgggaagatacaataaattaagattaagtggtaggaatcaacgagctggattactttctttataatatatataggtctggccctttcgaattcgaataatccatcaacacaacttccgcacactttaacaaccaacctcaactcaactcaacttctacctttcacttcccatctctccaacaaaccatcaagatgcacttcactaccttcctcactaccgttgtcgccgctggcatggcttctgccactacctacaacgctgccgctgtcagcagcaacaagaacatcaacggctccgctctccaggcctccaagagcggcttcgctctcaagctcaagaaccaaggcgccgcctgcgacaggggcctcaaggagaaccaagtcacattcagcctcaacaaggacggcgagcttaacctttacaccttccagaactctcaggttgcttacgtcgaccgctccggtatgggccagggcaagctcggctacgccaccattgccgacaagggcctcgttatccccaagaacggcgagacaaagggctggaaggttgctgccaacggcgacctcactttcgatggcaagggtctcatcgcttgcccttacgacggttcttactccctctgggtcagtgctggtgtcaataaccccggtggcaacaaggactgccaggctgttactattcgcgccaagaaggatgacaaggccgttgcctgtcaatactccgtctaagagttagcccaacagtttcatgagttgacggacatactttgattcttactacattattctcattatcagttgaggggagcatcatgttctctacatttgtagaaatctaatttaccatctgattaatacatatacatattgg

SEQ ID NO: 11921 - DNA, 943 bp, Triticum aestivum
  Clone ID: PAT_TA_11921
gcggcaataactgccctaagcacaagacagcaaagcaaatgcagcgactaacaatatataagaatcgctcaaaacatcaatgacaaaactcaacatatgatattctagctgccataataacattgattgattccgcaaggtactcattaaaccagtaaaaaatagtctcacaatggaaccagtaaagcatgacaaaagtttcttcttcagcaagagtagaacaagtgaagatatcacatccattctctcaaatgcatcaggaagcatctagataggagaaactacttcagcagcctcacataacaacctgcccaaagccaagccttcttaagcggggatctccacctcgccgtcgtcgatctccgtctgcagatccttggggtccttgccgtcaacggtgcagccgacgctgacgcaggtgccgaggatctccttgacggtgccggccatctccttggccatggagcggaccttcatgatcttggcgatctcgatgacgtcgtcgaggctgatgttgccgctgtgcttgatgttcttgaccttcttgcggtccctctcgggctccttgagcgccttgatgacgagggctgcggcggaggggacgacggacaccttggcctggcgattctggacggtgagcttgacggtgacgcggaggcccttccagtccttggccgtctccttggcgatgtcttctccgatcttctttggggagagaccgagcggaccgatcttgggggccagggacgacgcagcgccgacctccccgccggtgacgcggacatacacctccacgatctgggacgggtcgagcttgggaggcatggctgcgagcttgggttggggaggattggctgcggggagtgtgtggcggcggctggagttggagatgctagttttttttttttttttttttattccccggccccggccggccctcgaa

SEQ ID NO: 11922 - DNA, 907 bp, Triticum aestivum
  Clone ID: PAT_TA_11922
tgcagcaactaacaatatataagaaacgctcaaaacatcattgacaaaactcaacatatgatattctagctgccataataacattgattgattccggaaggtactcattaaagcagtaaaaatagtctcacaatggaaccactaaagcatgacaaaagtttcttcttccgcaagagtagaacaagtgaagacatcacatccattctctcaactgcatcaggaagcatctagataggagaaactacttcagcagcctcacataacaacctccccaaagccaagccttcttaagcggggatctccacctcgccgtcgtcgatctccgtctgcagatccttggggtccttgccgtcgacggtgcagccgacgctgacgcaggtgccgaggatctccttgacggtgccggccatctccttggccatggagcggaccttcatgatcttggcgatctcgatgacgtcgtcgaggctgatgttgccgttgtgcttgatgttcttgaccttcttgcggtccctctcgggctccttgagcgccttgatgacgagggctgcggcggaggggacgacggacaccttggcctggcgattctggacggtgagcttgacggtgacgcggaggcccttccagtccttggccgtctccttggcgatgtcttctccgatcttctttggggagagaccgagcggaccgatcttgggggccagggacgacgcagcgccgacctccccgccggtgacgcggacatacacctccacgatctgggacgggtcgagcttgggaggcatggctgcgagcttgggctggggaggattggctgtgggtgtggcggcggctggagttgcccacgcgtccgcggacgcgtgggcgaacgcgtgggcggacgcgtgggcggacgcgtgggcggacg

SEQ ID NO: 11923 - DNA, 1867 bp, Triticum aestivum
  Clone ID: PAT_TA_11923
ttttttttttaatcccagaaaaaataccgcattccacacctggcgcttgagattgttcatacttagggtggcaaacaaaggcaacaatgctctagaaaaaccattcgaatacagcagtaaaaccattccaaaagttttttacttagggtggcaaaacacagtatatactctccgtccatctcttccatcagagctggtctcgacctgtaacaacgacgacacactggctggctaaggtgccctcaagctgctcaaggcgctactagcactctccctccataggtagataattagatagatagctcgccgacggatcagtagctgtagttcttgacgaacatgttctcgctggcttccgcggcctcgccgtcgctggtgtacttgccgagctgcgccagggagttggccttggcgcgcagcagcagcgcctcctgcgccgcggccacgttctccggccgcccaccccacgtcttgaggcaggtgttctggagcgcccgcgcgtaggagaaggacacgtgccacgggttcggcgcctggttcatcgcgttcaggttcagcgtcgcctccacctccgactgaccgccagacaagaacatgatgccggggacggaaggggggatccttctctggaggagcttgagggtgtagctggccacttcctcgggggtggccctgtccttgcactcggcaccaggggtcaccatgcttggcttcaggaggatgccctcaaacatgacgttgttctgggccatgtagtagaaggtctccgcccacaccttctgcgcgacctcgaaggtcctctcgatgccgtgctcaccgtcgagcatgatctcaggctccacaatcggcaccagcccattgtcctgtgagatggccgcgtaacgggcaagaccccaggcagcttccttgacagcaagctcagatgggccattaggaatgctgacaacagtgcgccacttggcgaagcgggcgccttgctggtagtatgctgcttcacgggaggcaaggccatcgagaccttggcaccatgactcatcgttggaaccaacaagtggcacaagacccttgtcaaccttgataccgggaacgattccctgctcgacaaggatgtcaacaatcttcttgccatcaacagtcgactggtagagggtctcctcaaagaggatagcaccagagatgtagtttcccaatcctggtggagtgacaaggagggtccggtaagcctggcggttagcctcagtgttctcaaggccaatcgaggcgagtctcttgccacaggtggcattcgactcatccatggcaaggatacccctgcctggcgatgcgatggttttcgcggttttgacaagctcatcggcgtacgcgctggcacggacaaccatggagacggtcatcggcttgggggcggcagcctggcgcgtggcgccccattcggccttcttgggaaggaaagacgacttgagctcgtgccgaattcggcacgaggctcccggaggagacgtgatattcacagatgacgtgagcttcgaggtgttcatggaccatctccagcggttagcggtccaataggggatatatgactgtgcagagagcaattttgtgtagcaccaacgcagtcatctcctgtggtgtacagtaaagaggcattgttcggtcgtgtttgtcatgtcttgttactttgtattgtgttagatgggtttatgcgcttcggttatcaaaaagtgtaaaaaggcgccaagtaaactgtcatttctgttgaccaagtaaactggtctgtttcatgctaccttgtcaaccatgatgtgccatgtcagtttggtatgtgtcgtaaacttgtccgtttcacacaaaaaaaaaaaaaaaaaaa

SEQ ID NO: 11924 - DNA, 2167 bp, Triticum aestivum
  Clone ID: PAT_TA_11924
gccggccggtttccagaaagaagaagccaagcaaaccaagcggagagcagagcagacggccggccggacggggggacgaaccaatccaaccagccaagctcgtcagcacgcggcgcagcccagctacccttgccgcaagataaaccatgggtggggtacttggtttgatacagattgatcaatcaactgtagccatcaaggagacttttgggaagtttgatgcgatcctgcaacctggatgccactgcttgccatggtgcctagggcagcagattgctgggtatctttctctgcgtgtgcagcagcttgacgtccgatgcgaaaccaagaccaaggacaatgtctttgtcaacgttgtggcatctgtgcagtaccgtgctcttgctgacaaggcatctgatgccttttacaggcttagcaacaccagggagcaaatccagtcctatgtctttgacgtgatcagggctagcgttccaaagatgaacttggatgatgtatttgagcagaagaatgaaatagcaagggctgtggaggatgaacttgaaaaggcaatgtctgcctacgggtacgagattgtgcaaactctgattgttgatattgagccagatgaacatgtgaagagagccatgaatgagatcaatgcagctgctaggatgaggttggcagccactgagaaagcggaagcggagaagatactccagatcaagagggctgaaggtgaggcagaatcgaagtacttggctggtgtgggtattgcaaggcagcgccaggccatagtggacgggctgagagacagtgttctcgccttctctgagaatgtgcctgggacctcttcgaaggatgtcatggatatggttttggtgacgcagtacttcgataccatgaaggacattggggcctcttccaagtcttcagcagtgttcatccctcacgggcctggcgctgtcaaagacatcgcttcgcagatacgagatggtcagctccagggcaggatggtttgaggagtgttggaaaatggatgccacttttatacgcatactttcaagtactctaaaacatttagctagaagggactaaaccattgatcataaccaccaacaaaaatattttccttgtttacagaacaccatctcacttcgcacttccgtttcaatcagattactttgaggtcgtcttgtccttggtcttctgtattttcaacaccttcttcacgatcttctgctcctccaccaagaaggcgcggatgatcctttccctcactgcagttccagagagcactccaccatagggacggttcacagtcctgcggttcctagacaaccttgatcttttgtattcagtaggcctgaggtggggaatcccctggatcttcttcccggtcacagggcacttggggccgctcgccctcttcttggtgtactggtacacgagcttaccacctggggtcttgacgacccgcgtctggttggacttggtggcatagctgtgcctcttccggtacgtcagacgctgcaccatgtttccgtcgtctccgccgccggcagtaggggggcttgggcaaagagtggggggagacggaaacatggtgcagcgtctgacctaccggaagaggcacagctatgccaccaagtccaaccagacgcgggtcgtcaagaccccaggtggtaagctcgtgtaccagtacaccaagaagagggcgagcggccccaagtgccctgtgaccgggaagaagatccaggggattccccacctcaggcctactgaatacaaaagatcaaggttgtctaggaaccgcaggactgtgaaccgtccctatggtggagtgctctctggaactgcggtgagggaaaggatcatccgcgctttcttggttgaggagcagaagatcgtgaagaaggtgttgaaaatacagaagaccaaggacaagacgacctcaaagtaatctgtttgaaacggaagtgcgaagtgagatggtgttctgtaaacaaggaaaatatttttgttggtggttatgatcaatggtttagtcccttctagctaaatgttttagagtacttgaaatccttctgccgccgtgacatcagggattgtgaaacatttgatacccatttgcagtttcatttctgaatgcatgttgaatctacttgtgttaatttggtttcaaaaa

SEQ ID NO: 11925 - DNA, 1649 bp, Triticum aestivum
  unsure (1)..(1649): unsure at all n locations
  Clone ID: PAT_TA_11925
aaagacaaataatccaacgattctagatttaaatgcgagatagttattttacatctagatgtgaaatagcaaacccgatagaaataatatctcagaaaaattaccgcgttccaaagggggggcgcttcagattgttcatacttacggtagaaaacaaaggcaacaatgctctagaaaaaaccatgcgaatacaacagtaggaccattccaaagtagtttacttagggtggcaaaacacagtatatactctctgtccatctcttccatcagagctggtctcgacctgtaacaacgacgacccactggctggctaaggcgccctcaagctgctcaaggcgctactggctgacagtgatgcggtagattattagatagacagctcgccgacggatcagtagctgtagttcttgacgaacatgttctcgctggcttccgcggcctcgccgtcgctggtgtacttgccgagctgcgccagggagttggccttggcgcgcagcagcagcgcctcctgcgccgcggccacgttctccggccgcccgccccacgtcttgaggcaggtgttctgcagcgcccgcgcgtaggagaaggacacgtgccacgggttcggcgcctggttcatcgcgttgaggttcagcgttgcctcaacctccgactgaccgccagacaagaacatgatgccggggacggaaggggggatccttctctggaggagcttgagggtgtagctggctacttcctcaggggtggccctgtccttgcactcagcaccaggggtcaccatgcttggcttcaggaggatgccctcaaacatgacgttgttctgagccatgtagtagaaggtctccgcccacaccttctgtgcgacctcgaaggtcctctcgatgccgtgctcaccgtcgagcatgatctcaggctccacaatcggcaccagcccattgtcctgtgagatggccgcgtaacgggcaagaccccagggcagcttccttgacagcaagctcagatgggccgttaggaatgctgacaacagtgcgccacttggcgaagcgagcgccttgctggtagtatgctgcttcacgggaggcaaggccatcgagaccttggcaccacgactcatcattggaaccaacaagtggcacaagacccttgtcaaccttgataccgggaacgattccctgctcgacaaggatgtcaacaatcttctttccatcaacagtcgactggtagagggtctcctcaaagaggatagcaccagagatgtagtttcccaagcctggtggagtgacaagaagggtccggtaagcctggcggttagcctcagtgttctcaaggccaatcgatgcaagtctcttgccacaggtggcattcgactcatccatggcaaggatacccctgcctggcgatgcgatggttttcgcggttttgacaagctcatcggcgtatgcgctggcacggacaaccatggagacggtcaccggcttgggggcggcggcctggcgcgtggtgccccattcggccttcttgggaaggaaagacgatttgaggagagcagcagacgccattgtttctggaggcaagcagatcaggtgctaccctcttctttgacacgccttacaattgcagcctttcccctcgtgccgaattncctgcag

SEQ ID NO: 11926 - DNA, 863 bp, Triticum aestivum
  Clone ID: PAT_TA_11926
aaaaccagcacacccaaggaattgacattgaagaacaaacttttaaccactgaatggtatagattaagttaacccaagtgcacagactacattgcaaagaccaaatatgcagtagtaacaatgaggtctcacaggattactgctaaaacatgacaaaaagaggagggatcacatcgtttggaaggtacataagcaacatttgcaacatggtatgacttccatatcatcagagatgataatcacctcgacatcaggtctttaagcggaggggatctcgacctcgccgtcgtcgatctccgtctgcaggtccttggggtccttcccgtcgacggtgcagccaacgctgacgcaggtgccgaggatctccttgacagtcccggccatctccttggccatggacctgggcttcatgatcttggcgatctcgatgacgtcgtcgaggctgatgttgccgttgtgcttgatgttcttcaccttcttcctgtccctctcgggctccttgagggacttgatgacgagcgccgcggcggaagggacgacggagaccttggcctgacggttctggacggtgagcttgacggtgacgcggaggcccttccagtccttggccgtctccttggcgatgtcctcaccgatcttcttgggggagagaccgaggggcccgatcttgggggcgagcgaagacgccgcgccgacctcgcctccggtcacccggacgtagacctccaccacctgcgacgggtcgagcttgggcggcatggctgctgttcggtggcgggcggcggcggcggcggcggcggcggcggcaggagggtttgggagaggctcggacgcgtgggcggacgcgtgggcggacgcgtggg

SEQ ID NO: 11927 - DNA, 1720 bp, Triticum aestivum
  Clone ID: PAT_TA_11927
actatagggcgaattgggtaccgggccccccctcgagttttttttttttttttttttttttttttttttttttcatggtgtacgtatgtacatgcaaaattttgcagtaaccatgcaaatccatggatcgcacacgtaaaagtagctttacaataatctactggactgtagcatgaattgtgcatatcgagaggcaaattaacgagtaaaaaaagatctagaaaatacaagtaatcatcatctcaggctcaggctccgagctcgatcgatcttgcacttgcagctgtatcatcatgcatgcatgcatgcatctttaatttctgctttcgtaacgaacgtacgtagtagtgttgattggaatggttggattagtagctgtagttcttgacgaacatgccctccttggcctcggcggcttcgccgtcgctggtgtactttccgagctgcgcgagtgagttggccttggcacgcagcagcagcgcctcctgcgccgccttgacgttctccggccggccgccccacgtcttgaggcacgtgttctgcagcgccctggcgtaggagaaggagacgtgccacgggttgggcccctggttcatggcgttgaggttgagcgtggcctccacctcggactgccctcccgacaggaacataatgccggggacggcgggcggcacgcggcggctgaggagcttgagggtgtagtcggcgacctgctccggcgtggccctgtccttgcactcggcgccgggggtgaccatgctgggtttgagcaagatgccctcgaacatgacgttgttctgggccatctggtagaaggtctcggcccacaccttctgcgccacctcgaaggtgcgctcgatgccgtgctccccgtccagcaggatctccggctccacgatgggcaccagaccgttgtcctgcgagatggcggcgtagcgggcgaggccccatgcgggcctccttgacagccagctcggaggggccgttggggatgctgaccacggtgcgccacttggcgaagcgggcgccctgctggtagtaggcggcctcccgggaggcgaggccgtcgagaccctggcaccaagactcgtcgttggagccggtgagcggcaccaggcccttgtccaccttgatcccgggcacgatgccctgctccaccaggatgtcgacgatcttcttgccgtcgacggtggactggtagagcgtctcctcgaagaggatggcgccggagatgtggttgccgaggcccagggacggagaccagcagcgtgcggaacgcctgccggttcgcctctgtgttctccaggccgatcgagtcgaggcgcttcccgcaggtggcgttggactcgtccatggccaggatgccgcgccccggcgacgcgatggttttcgcggtcttgacgagctcatcgtcgtaggcgccggcgcggacgaccatggacaccctcggggcggcgacctggcgcgcgacgccccattcggccttcttggggaggaaggaggacttgaggagagtagcagatgccatgtcctttcttcttcttcttcttactttcttgcttgcgtgcctgcactgccactgacctcaagctcaaggtgctagctatcctctctgcctcgctgaggccaatggactcatatttgaatgggtggcacgaggggatatgaggtgtggggtggaggtttggatggctcaatctcgtgccgaattcggcacgag

SEQ ID NO: 11928 - DNA, 1618 bp, Triticum aestivum
  Clone ID: PAT_TA_11928
ttttttttttttccaggaaacagaacaatatataatcccagaaaaaatacctcgttcccaacggggcgcttgagattgttcatacttagggtggcaaacgaaaggcaacaatgcactagaaaaatcatgcggatacagcagtaaaaccattccaaagtagtttacttagggtggcaaaacacagtatatactctccgtccatctcttccatcagagctggtctcgacctgtaacaacgacgacacgctggctggctaaggtgccctcaagctgctcaaggcgctactagcactctccctccatagatagaatagctcgccgacggatcagtagctgtagttcttgacgaacatgttctctttggcggcccgcggcctcgccgtcgctggtgtacttgccgagctgcgccagggagttggccttggcgcgcagcagcagcgcctcctgtgccgcggccacgttctccggccggccgccccacgtcttgaggcaggtgttctgcagcgcccgcgcgtaggagaaggacacgtgccatgggttcggcgcctggttcatcgcgttcaggttcagcgtcgcctccacctccgactgaccaccagacaagaacatgatgccggggacggaaggggggatccttctctggagaagcttgagggtgtagctggctacttcctcaggggtggccctgtccttgcactcggcaccaggggtcaccatgcttggcttcaagaggatgccctcaaacatgacgttgttctgggccatatagtagaaggtctccgcccacaccttctgtgcgacctcgaaggtcctctcgatgccgtgctcaccgtcgagcatgatctcaggctccacaatcggcaccagcccattgtcctgtgagatggccgcgtaacgggcaagaccccaggcagcttccttgacagcaagctcagatgggccgttaggaatgctgacaacagtgcgccacttggcgaagcgggcgccttgctggtagtatgctgcttcacgggaggcaaggccatctagaccttggcaccatgactcatcgttggaaccaacaagtggcacaagacccttgtcaaccttgataccgggaacgattccctgctcgacaaggatgtcaacaatcttcttgccatcaacagtcgactggtagagggtctccctcaaagaggatagcaccagagatgtagtttcccaatcctggtggagtgacaagaagggtccggtaagcctggcggttagcctcagtgttctcaaggccaatcgaggcgagtctcttgccacaggtggcattcgactcatccatggcaaggatacccctgcctggcgatgcgatagttttcgcggttttgacaagctcatcggcgtacgcgctggcacggacaaccatggagacggtcatcggcttgggggcggcagcctggcgcgtggtgccccattcggccttcttgggaaggaaagacgatttgaggagagtagcagacgccattgtttctggaagcaagcagatcaggtgctaccctcttctttgacacaccttacaattgcagcctttccttagggggggtgagaagtgcagcaaccgctgagatataagggtgagcacctgggt

SEQ ID NO: 11929 - DNA, 1428 bp, Triticum aestivum
  Clone ID: PAT_TA_11929
cccacgcgtccgccgacgcgtgggttaggcacgtgaagggcgccagctcgggaaccaggggtaggtgaccggcatcacccgccggctcggctcggggacgattcggaggagtggcaacagaggatggctggtctacagggttttgcatcagatgaagggggtgaccggcacgggttgagtgatattggagggtcgttttctgtgggtggcgtgtcgttactcgcacatggaactggcttgtttgctgattttagtatgcttcagaagctccgcacagagcagggatttcaagaatatttgaaattccgtgagcatgcattcaagctcgcagcagaagaactggttgctgcatgcaattcgcctgttgatttgtttgtccagaccgagtgtgatgagaggctttttcaagagcacttcctcaagttcagtgactttacgtgaacagtattctgtggcttgttgatgatgttgatggaagtaaagaaagtgttgttgatgatggatcaccacgccgtgtcttgaatgaggatgagttcaatcacatccagcgtaaggatgacaaagatatacttctaaacacattgcatgtttaacatggatattatgcgtattgtccaccccttcttgcaattaaaaatatcgatgccctgtttgaccccgaggaagttttagaacggattaaagagtcaactagatggtttgatgagctggatgattatcagctacaacttggtttaaagggtcatatggaacttttaaagacatatgtgagtgaattggacacaacttccacaagcagcagcatgccctgagtttgaaagtgtagctttggaggagatcaacctctcgtatgagttcagaattagaaaagcatctacatctccgtgaccagtggcttatgcaagaatacttcaatcgtgtgaaaataaggaactttgccagagtgtgttataatgaatcagaaaagactggagtcatttttgagcggccgcccgggcaggtacgacaattgcaagaacagatgttacccaaaagcttgccccagattttgggagaacagctgttacccagaaatttgccccagatgaaacagagagttaagcagtcacttgagtcagccatgggttacctgcatcgacagcgtgctcctcgtccaagggtatttaatctggcatgtgcaattactcttctatcaacaacatgcatggccaacgagagtaagactgtcaactgaagccatgactgacgaggcagttggtgatccagtgttggataaagagttattgtttatacatcttatggttaatgctgtacctcggccgcgaccacgctagtcgtaatgcattactggtaatgtttaacatgtggcttttgttcgttgtccactggaatttgcaaacaaaaatattgatgccctgtttggtccgc

SEQ ID NO: 11930 - DNA, 334 bp, Triticum aestivum
  Clone ID: PAT_TA_11930
ggttcgagtttttttggtactggttacgtacaaaaatcaggtgtttgtcggtttgtgttttcatgagggctcaaagcttcaaaagatgaagtctgaacagggatgccttaaattgacaacttggcaccttttggcctctaggcgaggaagttgttttagcctacctcttagtgtagcaggagagtatccagctttagaggttgtaatattttttttgtagttttaaggtcatttttttatccattaccaacttggtaatgaatttgtaatatgacattgttacttccatcagaaaatggtaataattcattttattaatattttaaaaaaaaaa

SEQ ID NO: 11931 - DNA, 623 bp, Triticum aestivum
  Clone ID: PAT_TA_11931
ggacgaccgctagtgccgacctcctccacagcgccagtccgacgcggccgccgcgagcccgagatcccgtgcccaacgctccctcttcgaggccaagccagcatcaagagtgacacacattaaaatggggtctacacgagcaacctgcgatgagggcaaggctcgtggcttgtgccggctcagaagacgttttggggaacccgccctcggtgcctgttgtgcggttgctcccgctccccttgcatacacccggtcgctgtggcgcaccggatctgccccctgcacatctggcggccctgaagggcctcccggctcttctggttgctcagcttcccctgcaacacctggccctcctggctgccggcgtagatcgtcgttcctctccccagctgccgcacagccgccccgtggctcctgcgccccagcgccgcccccgggttcttcacggcggctccttggcaaccgttggaaccccgggggcgaccccgcggggactgtgggggatctgcggccgccgcccgttccagcaacgcgggagccttcgtcccctgtccccatgctagctgcgcgggatcgggccggtcgtcctccatgtgaggctcctccagggacaccaccatggg

SEQ ID NO: 11932 - DNA, 664 bp, Triticum aestivum
  unsure (1)..(664): unsure at all n locations
  Clone ID: PAT_TA_11932
ggtgatcccatgttgaagcgcctcgaggggagagcaatggagattgctgcacaaagtagggcagnaacgcggtggaattgcgtcagctgagcttgtacagaagatagctagcctagtagttgatgccatgggtggtgtagtggaggatgctgatgccatgaacagggnaatggtccacaaagagccgccagctctgtgctgggctaaacagtattgcccttcctcttggttcacttggaattgggctctcgcgccacagatctctgctttttaaggtactagctgaccgagttaatctgccatgcaagcttgtcaaaggaatatgttatactggaacagatgaaggcgctattaactttgttaaaatcgactttgacagtgctgaatatattgttgacttgatgggagctccaggcaccttaataccttcagagatttctgtcagtcaatttcaggactccaacaatagtcaactgagcagtgacgccattgaagagagtgttgcagaactatgcatagctcttgagcaggttagcggtgtatatgagagtaaaaatgacatgggtggaagttcatctgatcgtaattctgtcctagaacttccgactccacatttggaagatacatgtcacacagagaacccacttaaacaacgcattatctc

SEQ ID NO: 11933 - DNA, 1169 bp, Triticum aestivum
  Clone ID: PAT_TA_11933
agcatcgagccgttccaattcgcgtcctcgtcttccccgccaatcccctctccctcctcctccccaagaagtggccagcacagggacgacgcggcggcggcggcggtgttgccgtttgtgtttgctcgctaggcgagtaggcaatgtcggcggcgggggcggggccggggccgggggcggaggcccagatggggaaggacagggacgtggtgcggctggagcgcgagtcggtgatccccgtcatgaagcccaagctcatcatgaagctcgcctacctcattgagcgcgaaaacgacagggaggaattcgtgaagctctgcaagaggatggagtacaccatcagagcctggtatcatctccagtttgatgatatgatggagctgtatgctctcttcgaccctgtgcagggtgccaaaaaaactgcagcagcagaacttttcgtccgaggaaatcgatacactcgagcagaacttcctgacctatttatttctgatgatggaaaaaagcaatttcaacatattatctgatgatgaggttgagcttgctcattctggacaatacctattgaatcttccaattaaagttgacgaagcaaagttagacaacaaacttttgtcgacgtatttcaaggagcaccatcatgacaacctacctgagttctgtgatgatgtgattcaacaggaaatcaaggaggtcataatcgcatactatatattgatggaaaatggaaaggctactattgaggatcttgatttgcaatgcgaggagctaatccaggaagagtttggtttgcaatgtaattttgaggtgatggatgctcttcaaaagttagagagatttggtattgttacaagagattctataggaagaattgtttgcgttcctctaaagcgatccaatgagatcattggtgctactaccgaggagctggttatgaaattcagacaaagctagtaaactcaatttgaaccagggggcaggtacatcctggctggaagcggaatagttctgctacagaggttgaggagagacgcggctgtgatttggtcgtagattcttctgtattatgtagtatttgaagtgcggtgtcgtagatgtgtggtgtaagaattaaatatctcctactggagcaaatgggagatgttcaaggaagtgctgtgtttgcacat

SEQ ID NO: 11934 - DNA, 981 bp, Triticum aestivum
  unsure (1)..(981): unsure at all n locations
  Clone ID: PAT_TA_11934
cactgctcgnaggtgaccggnatgcctggnancaactgtcgatgcagcagnaggtcagctgttctgcactggnatcggggagatcagtttctgtcagttagagggctataaagagggcacggggaattggtcaggaaggaggtggagaagactgcttgcttgcgccgctgttgtgcgaccgtctgacgaccctcctgaggccgtgggcgcgtcctggtacatggactctccttttagcggtggtgtgctgttctgtcccatgccccctgtgttccgaatcggtcctggaatagcgctctttccgggcggcgattcaatccaaaaggcaagagctattttaggagtacttttcaggaaggcaatatcccttttactggtcggtggactaaaatttcccagtggggttctccgatttaactctttctaaaacctgttttttagaagctatgaaaaaggagaataaccttccacttgtcatgtacatgctcttaaggtcttctatcttctatgtaaaagcatcacaaaattacccagtctatcatttagtgagggatgttccaaggtatacctccctgccccacgtctgtgcgctgtttgtgtgttctactcatttgtgcggggtcttttctgcctgggcgtcgtcctggggcggctgctgacctaccagctcccatttgttggcctgtggggctggcctgctgcatgtagctgctgcggcgcctaacgcatgctgtctcccatttggctgcgggatgttgcctccgccttgtatgccctctgcaccttttccccccggtactctgccgtactctcgggggtaccactattttcttgtgagtttcaagttgatatttgaatctgtctttttcttgtaactgaaatcagttgctcgtatttcttcatactgtttagcatcctgccgatgtgatctgttgcatacctaaaatgtatcaatacattttttgnattnaataatcaaca

SEQ ID NO: 11935 - DNA, 765 bp, Triticum aestivum
  Clone ID: PAT_TA_11935
acgcgtccgcccacgcgtccgcccacgcgtccgacttttcaagtgttgtttctgagttcagtcatttggggggtcagttgcgaatggtctgagttctagtgagctgtacaatagaagtatacacgagatcgtgccactcaggattatttctttgctaagattgctggcagagactgagatccgatcacgagaagacgattacaaatcacttctcccaaaagaaatggatgcccttacgtatgtccgcaaggagctgcgtcctctggatgttgaagctgaggtgctaccaatgagggctctaacatatgcgcttggcattccgttgcgtgtcgaaactgtgggcgaaggttcgaattgtggaattcaagtggagcgccttgatttattcccccggtcggaatcggggaagggtcctcttcatttggtacaaagctactggtcatccatcacaacccctgaaccacatgagatcggaagtggcaacttgttatcatctgacggcacacctttgctgacattgttgtgtaggcctaggcactgtgacattctttatcgcagtgaacaaaactaagtgtagaaatatcacttcctgtagcctacctggcaagaaaaatcctgaatgatggtgtagaaatctagtgatactatgggctttcttttattggcatctgctctcacagtacttgtgattaatctttgagcaaaagccaaaagctgcttcattggtctgtatatgtccgggggtgtagctttaaataggcccca

SEQ ID NO: 11936 - DNA, 171 bp, Triticum aestivum
  unsure (1)..(171): unsure at all n locations
  Clone ID: PAT_TA_11936
gctgcgacggaatttggatgggctggtaggccctgccgccacaccctgtggcggcacgtctccagcaggnagcactgcttgctctctgttctactcgatgttagcaggtgtgaaaataggcacatttgactgagatttaagtcaatttgaaggccgattttaaaaaaaaaa

SEQ ID NO: 11937 - DNA, 779 bp, Triticum aestivum
  Clone ID: PAT_TA_11937
acagcaggttggggctaaaggcaaaatcatcatgcacctccaccgatgattcaaggccatccaaacctccatgtgcatcctccatctcctccaccagtgtcaccaaagggcccctctaatggcagcaaaggacctcgtgtttctcctactcttccaccaattcctcctgaaacagatcccagagcaccatcaactcatcctcctcgcgcccggcccccaccaccacctaatttagattgcaaattgttagtgtgcccagagcctctaacggatccacccgcgggagctccatgtgcttgtgttctaccaattaaagttggaatccgtttaagtgtggacctttattcattctttccgttagtttcggattttgctgacgaagtgggatctggggtaaacatggcacggcggcaggttcgtgttatgggtgcaaatgtggctggcgatcaacctgacaagacagtagttcttgtgcatctggtaccaatgcatgtgaattttgataaagctactgccttgtcgacatttcaaagcttgtggagcaaaaagatttctctcaaaccgtcagttttcggggactatgagattctctatgttgtctatccagggcttcctccttctccgccttcagcaccagctggtgcattcggcaacagcagaaatgcaagggcaatgaagcccctgggggttgatgtaggaagacccaaaagaaaagtgaatgggagcgtaattgctattgctgttctatccactgttatagcattgattatttgcactgt

SEQ ID NO: 11938 - DNA, 690 bp, Triticum aestivum
  Clone ID: PAT_TA_11938
ggtcggctccgcctctgccatttcttcagcgaccttccgccgccgccgggacccttccattcccactagcccccccgtcgacggaagtgccttcgtacccagccacccaggtcccccggtgtcggccccttccccattcattgtctacagctccgtgaccacccaccagtctggtactctggtctcgctctcgccggagtctcacatcgatctgcttctatgcgctgcgctacgctgcactgctcaggactggtgaagaagtgaagaggctgggcctggggtggagatgggagaggccatctgcggcatcctcctacacggccgtgtggcttccgaagctcgtgctctctgtctccgcgaccgcgtaggccaaggttttggccggatctgatgcgccggcgacgcggccggagctggggacctgggctggcagtggcatagctcctatcctacgacggacggcgtccctgtcacagcttccggtcgtcctcgtctgcggcgtcgccgtctgaacgggaggggaggggaggaatcacggctgttggcccacttctctattccttccttccacaagcacaagacggcgcttcagttggattccttccctccactggagtacggcattcgccacagcagaccagcggcggagcgatggcagcatccttctcctttgcccgtgcccgtgtggtt

SEQ ID NO: 11939 - DNA, 819 bp, Triticum aestivum
  unsure (1)..(819): unsure at all n locations
  Clone ID: PAT_TA_11939
ttcggccggcatcgcgctcctagccttaattggccgggtcgtgtttccggcatcgttactttgaagaaattagagtgctcaaagcaagccatcgctctggatacattagcatgggataacatcataggattccggtcctattgtgttggccttcgggatcggagtaatgattaatagggacagtcgggggcattcgtatttcatagtcagaggtgaaattcttggatttatgaaagacgaacaactgcgaaagcatttgccaaggatgttttcattaatcaagaacgaaagttgggggctcgaagacgatcagataccgtcctagtctcaaccataaacgatgccgaccaccatggagttctgtgtaaatttggttgaaatttacgtagtttgagcttctgtattcctctgatttttcttatgttcgaagaagcggccaaggctggacccggtgatggggcgacctgccagcggtggtagtaggggcaggccgcgagcgagacctgtgccacgtccggggcgcggtgagaagctccgccggaagactcgacagatgggggtacctgctgaaaaggaaatacattctcgaaaaagtacatatgcctcgaggtatacacgcgatgggatatagggtcatagcatagacaacctctgattgtcaaaaaataaatagacaacctctgatgttggaagggtagcccagaaaaatgcaagcgagcgaacggtgtgtgagcttgtgtggtgtgctcgatatagtngatgtttcctcccttggattattnattgctcagaccggaccgaggacgacaagcaatcggt

SEQ ID NO: 11940 - DNA, 828 bp, Triticum aestivum
  unsure (1)..(828): unsure at all n locations
  Clone ID: PAT_TA_11940
caccactgcagtctcaannanattaaaaaacatgttttcccacgttgtttcatcgttggcaaacgctttccaatatgccttgttagatggcgtggttcattatttgaggtttcaagcttcaaaacaaatacgactcaagtgaaaggaaatgaaaatgtaaactgctcagaagagacagatggccatgatgaggtggatattcttcgctggaaggattcattgagaagagactttacagtaaacagcctattctttaatccattcaatcacagagtttatgattatgtgaatggagtaaaggatctaagaaaaaacaaggtgtgtacagtgattcctgcccatgtttctttcaaggaggatcctgccagaattttgcgtggcttgagagttgctgctcgacttggctttcagttttccagccgaaacttctactgcaatacgtgatctttctccatccatcataaatatcgacaagacaaggttggctatggaaatgaaatatatgctatcttatggggcggcagagtcttcgattagattacttagaaaatatggacttctcgatattttgctgccttttcaggcagcatatttgtcagatcagttaaagggcaaatctagtgacagagggttgatgctcatgaatctattggctaatcttgacaagtttttctccgctgaccgtccatgccactgctctttgtggtaatcaaggcttttgctgcactgatgcattttggaacatgggacagcgccatcgagttcctgaacgaagatgttggagcaccagttacatatgtcccagaagcttttgggccttctggggcc

SEQ ID NO: 11941 - DNA, 580 bp, Triticum aestivum
  unsure (1)..(580): unsure at all n locations
  Clone ID: PAT_TA_11941
tcgtttgtgaactgnattgatttatccatatataattcatcaggctagtcatcttggctcaaagnaataggattggcttgttgctgtagcattgtttagaaattctattggctcacagttcttattttccagctccaaggaaatcatgttggtgtgcatctttgagttcatcttcatcaccagtgggtaagcggctcttctaccacggagtgatatcataaggagctggcaaggttcttctggcaggctgccgatggccgcccaaaataccacatggtcaaatgggcggacatctgcttacctaaagatcgaggtgggctaggtatgacggcctctcggcacatgaatgtcgccctgatgttgcattgcgtctggcggatcttgcgtggagagggcggtttgtggttgccaaatacttgcggggtgcgcccctcttagacatgctcgcgcgtagctgggtctcaattctggaaatctatccagaagattaagcatgagatccggctcggtgccaccttctcggttgggaatgggaatgacactcaattctggctcgatcatttgttgggtgatgagccac

SEQ ID NO: 11942 - DNA, 947 bp, Triticum aestivum
  unsure (1)..(947): unsure at all n locations
  Clone ID: PAT_TA_11942
tgtcgtccagtcggtcgcatttccttgctccaatgccaagtatggatgcagagagggtcacgcatactatcagnaaagaaggacatgagcagacctcccatatcatgggacggtggctctccgcttagaaccgggcatacatgttctggcaccccgcaacaagggcaacaaccattttttcatgctcaacatggagccagagcgtcttggatatgctatctcagtcgtctgcgtccaacctaatgctacggaaccccaagttcacatgtagtatgagttatgactgctctgggacaggttattgtggaagtgcaagttgccaaataaaaagctctacactctctgatgggctaccgacggactacgacttaattccacccaagagaaagatttctggtgatcgaaaatttatcatgctcagaatcaccattcatcaagcttcaagtgtcagcaaatcccatgttaaaggaaagggcctgacttccactccattgaccctgtttcctcgtcgttctgatgatgatggcgatatagtctgcagatcctgtattgaaggaaagtgcccgacttcctctcaaaagctactgtttcctgattattcttctgatgacgatgatgatgtgccttcaagattcggagcgtgctctcaaacgggtgtcccttgcttgattaataggccgattgatgatgtaccttcaaggtccgatcgtgctcatgtatgctagagatttagcgttggtgtgtggacgccgttaataatatgcctgggtgggtttcacccattctggttccaggatatatgtatgacggagaacctgtatgatctgagtatcggagctgttttgaccttctttatgtgttttgttgtccggaactcgtgccgtggcatgtgaggctgcccttgatgtactagaaaaatattatgctatgtcggtacatttgtatcg

SEQ ID NO: 11943 - DNA, 470 bp, Triticum aestivum
  unsure (1)..(470): unsure at all n locations
  Clone ID: PAT_TA_11943
gggtcgaccccgcgttttcccagcgtccgtcgacccacccgtgcgcgggcgcgtgggcggacgcgtgggcacctttccaggtcatagtgtgtgggatcttgctggtggtgatggcggttggtaacttcgtcaacacggtggagactctggccctgaaactgaggttcaaagcaaagatgaagaggacgaggcccaggcaggacccgggccagggcggtgcgaatcgcctgcatcaaaattgatagtaatccagtatggtgtcactccatgcctggaagcaacaatgctgacaaaaccatctcttctgtaaatccttaaatcggtacaccattttttgttccgtgtgtgctcgtggtttagcaatatggtcccatacgctgttccatgcacgatacggcaactcgacggacaataatcacactttcaagttggtgtaaaaaaaaaaaaacaataaaaaannnnaannnngg

SEQ ID NO: 11944 - DNA, 1503 bp, Triticum aestivum
  Clone ID: PAT_TA_11944
aagcgtccgggcggcctgtgttaccgaactcctttctcgacgaagcgctggagtgcccagccctcgagctcctcttcgtcggcaacagagggcggaacgggcgcagcccggagccgggggtggtaggctgcggcagcctgctagtcgtgagggcagctgggtaacgtcggtccacccctgggagaccttggtgccggcaaactgagctcgcaacgccatcatgaagtcggcaacgccgccgacgtccgccgggtccaagggtccttcgaatcgctcgaatcccaattagttgacaagccagtggggtgacagtcccgggctcggaaagcaacaatgcagacaaacggctctccttcctgtaaaaacttaagtcagtagatcggtccataccacgtttgttgtccttgcttaagtgagtaagacccagtaggggggataatctcaaggtgaaggacgagtaaaacaactaattgggatagggctgccgatatgttcctgaaagtttacactccactctcctcttacagagaatggtgggtgtgggatgggttgtcttccagcattggcagttcaggtgtaccaggcttggttattattcctctacacaagttctgctttgcgggagaatgtgttgcttgtaaatggaagtgatatccgtccttggtggatataccaccactatttagcaatgctaatggctcttgttagccttacttgggagataaagggacagcctgattgctcgagtaagcagagaggggtacaacttttcttgcgttgggcaatcatgcaaggaattgcaatgcatctacagaataggtaccagcgtcaaagattacgcacccgaattgctctgggaaaggctaaaagaatggatgtcgtcgcaggagaaacagctggtgtggaagggcagctattgctactatatcctgttctttttgtattacaggggtttgaagcatatgtcggagtgttgcttcttcagaccgcgtggcacgggctcacctctgaatggcaggtcatagtgtgcgggatcttgctggtggtgatggcggttggcaacttcgtcaacacggtggagactctggccctgaagctgaggttcaaagcaaagatgaagaggacgaggcccaggcaggagcctggccagggcggtgcgaatcgcctgcatcaaaattgacaatccagtctggtgtcacccctccatgcctggaatggagacatcaacactgacaaaaccatctcttctgtaaatccttaaatcggtacaccattttttgttccgttcccgtgtgctcgtggtttttctttctctcttatatcaagtaaattcggccccgtagcaatttgggtcctttactctgtcccgtccacggggcggccaccccggccccgacgcacaattctcccgctttgccttgggtgcgacgctctctcatgtgggggtctgttgcttgcccggcccggttggcctgctcgccgcgtgccttttttgggcgggca

SEQ ID NO: 11945 - DNA, 592 bp, Triticum aestivum
  Clone ID: PAT_TA_11945
ggaactaaaccagacgagcgccacatattcttgcgggtagcatgtctgcgtcctcatcctcaagcggggtcgagcaacccccgccgctaattagctgtcctgattgcggcggtcgggtcttcacctggattgctcgggcggggtagaatgcaggcgttcgtttctacaagtgcgtcaacaaggacgatggaatctgcaactacatgagcaccaaggaggagtaccttgcagagttaagcttccatttggggacggcacaacagctaggacacggaagcagccaggctggatcttctttgaaccatagagtccgtgttgtccagcagcagcgcactgttccagcagttgcccaagccttcagggttaatcaagcaggctcttccgccgccgcgctccgtgttcttgtgttcttggatgctgccatactgtttgttggtgtcctcattttcttggcgttgctgaaagtagtctccctccttagcaggtagaaggtggtcttgttgacagaatagaaggaataattaggtagtctgtcttttgtatcgcagtgcttggtaatcagaatcaggttgtgtgtcctttgtatcccagg

SEQ ID NO: 11946 - DNA, 1063 bp, Triticum aestivum
  unsure (1)..(1063): unsure at all n locations
  Clone ID: PAT_TA_11946
atcccctctggcgatgcggcccaagtccgagnagtcgcctccgccctccgaccagnagnaccgccgtcatcgaggnagttgaggaagggcgcccagctggctgaatgcctccggcaacagctggagctcatcccggagctcggtcgccgcaacgccgcgctggccaacgcgagcaacatctccgcggccctagtgtcgtccgtctccatgctgcagtccgacagagagcagtacagctgctcctccgacgccagggcggcgtcctatgctgccggtgcctccggtgccggtggcagaggcggcagcggggcacgaagtggagccattgcccgcaccagaaaaagcgaggcaccggcaaggcatccatggcgaggagcttccattcaaggtgacactaactgagacaccagaaaatgatgggttccactgggaggaaatatggcgagaagaagatcctgaatgctgtttttccgaggtcatactacagatgcggatacagcgacgagcacaggtgcccggcaaagaaagtggtgcagcagcaaaacaacaacgaccctcccgtgttcatgggtcaccctgatgaacgaccacacatgcagcagtttgttccctgctaatgatcaaccacccagcagctcaaacagtgctacagctaactcacaagtgcttgacttcaccaaagcatcgctctcttcagctgttggtgtctcgaggttgaagaaagaggaagatgcaggaatgtcggtgaccgtgcctagctacacgtatgatgagctggcttcttattcctcgctgccgttgctctcgccaaaggagtgggagatggagatggagatcaagtcactttttagccatcactcgggaggtggtacttagctagctagttattcgttgaaacttattgcttttcgctagcttgatcactttgttgcgtccaaataactacctgaacctgaataattgcatggatgcgcgtgagggtttatgtacacgctctagtgttgtagtgctagtagtatgacagcacaagtacaagaaatgtttttctagacgtataacagac

SEQ ID NO: 11947 - DNA, 678 bp, Triticum aestivum
  unsure (1)..(678): unsure at all n locations
  Clone ID: PAT_TA_11947
ttgtctcaaacattaagtccatgcatgtgcaagtatgaaccaatttgaactgtgaaactgcgaatggctcattaaatcagttatagtttgtttgatggtacgtgctactcgngataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatcatcactcacaagatcatgcacgcgatcaggagcgacctctccgagttcaagtgcggcctggcgcatctcttctgtacgtaatgcagttttatgttcttttgttattgttgttgttgttgttgttgttgtagacaatcagggaggcacaatcttgtgtcgtttcttaaaattgtcagtaagttttatggcgctgctcagtgtcaaagccggtgggtttggtaaatgttgttttgcattggaagctctgttcnaaagcatgtttatcangaaactaaagcagatttcgaag

SEQ ID NO: 11948 - DNA, 823 bp, Triticum aestivum
  unsure (1)..(823): unsure at all n locations
  Clone ID: PAT_TA_11948
ctcgcccagcgccgccaccccttctccgcctccggcgctgcccgccggcctgctcacccgcggcacttagtcaggaaccctaggatggccgtgcccaaaaatttactttactgtgccctccttcagttttgggtgttcgatttgggatctagagttcttccccgcttgattgactccaatagttcgagtgtattttcttctgggctctgtaagtcgaaatggaggccgccaccacatggtttcctacaacccggangtcaaaatcaagagctgtgaacagggaggtactcagtgagctaatcaagttgcacgggaagacgtcccttggcggcaaattgcctgcctatgatggaagaaagagtctctacactgcaggctcactcccttttgagtctgaggagttctctgttacactggttgatcccgaaaagaaagacaaagaaaaggctgaaagggagtacaagatcaccattaggattgctgggaggacagacctgtaccacctccagcagttcctcaaaggaagacagagggatatgcctcaagaaaccatccaagttcttgatgttgtcctcagggagtcaccatcctggaactatgtcacagtgtccagatccttcttctccaccacctttggtcacagaggagacgttggtgaaggattagagtgctggagaggttactaccagagcttacgtccaacccagatggggctgtcactcaatatagatatatctgcaacatccttcttcaagcctgtgacagtggtccagtttgtgctagagttcctcaacttacgtgatgcctcgcggcctctgacaga

SEQ ID NO: 11949 - DNA, 1240 bp, Triticum aestivum
  unsure (1)..(1240): unsure at all n locations
  Clone ID: PAT_TA_11949
tcgacccccccgcccgcttacccgtcagcctgctccacctccgccccggcgctcctcctccgtgccttcccccgcctccgcctccgccgccccctcgcctcgccgccccgcatgtcctcctcctccgccgccgcctctcccgcgccggcagacgccgcgggaggggagaggcccacggcggcgccgttcgggtcctggaggtcgcccatcaccgcggacgtcgtctccggcgcctccaagcgcctcggggacatcgccctcgccggagacggccgcctgctatggatcgagggccgccccgaggagaaagggcgcatggttattgtaaaggaggatgacaagcctgcggatatcatacctcaggaatttgcagcacgcactctggctcaagaatatggaggccggtgcatttgctgtccaagatagtgttgttgttttctcaaactacaaggatcaacgcctgtacaaacaaccaatcggaactggtagtctgcctgtgcctcttacacccgattatggtgcacctgatgtcagttatgctgatggtgtctttgacccacacttcagccgttatattactgtgatggaagaccggcgaacgagtagcttgaatcccgctacaacaattgtgtctataaacttaagcaatggtgatgtccatgaaccgaaggtgctgatcagtgggaatgacttctatgcttctcctcgaattgatccaactaaaaagaggatggcatggattgagtggggtcacccaaacatgccatgggataaatcagaactctgggttggctacttctctgaaagcggagacttgaccgaacgggtctgtgttgctggaagcaatccgatgttggtggaatcccctgctgagcctaaatggtcaccaaaaggagaactgtttttcgtaactgacagagggagcggattctggaacattcataatggggttgaacacaccaatgaggttggtccggatgcccacgcattagatgcctgagttccacaagacccttggggggttttggccatcaactctctcgacgttctccgtaggagcaatcccaccctttcctcccacaggcagcgcgccagagccggtcttgccgttcttggggatcaaaaaagtggaacgcagggaccngaccgagagccgaactcctnttccngatgtcnncggctgcnnacagggcgaaaaaatacccccaattgaagggcgcaaggaaagacccccgcaagg

SEQ ID NO: 11950 - DNA, 782 bp, Triticum aestivum
  unsure (1)..(782): unsure at all n locations
  Clone ID: PAT_TA_11950
caattgcaacaatgggnaacatcatcaaaagnaaaagccaatgcgtgcaaccacaacaagnttgatcaacagaatatggagtgattactatgcacaccatttccctgaagatttgaaggagggagatggaaatgaagcaaaaggaagttgatgatgaacaagnaagaaaatgaagatgaggatgctgaggaagaggtacagnattgaaggaagacaaggttgcaaagnactccaccatcaacacggtctcgaaaattggtatcacaaactagcaaagnaaatgagatggaagggtgagccagctgggaaaacaacttctggagaagctttatacaaatgtgcgtatgcacgggaactcagaatagatgtcggaggggcagtcacactggaagatgattccggagaaatagtcatatgctttgttgagtacatgtttcagaaatctgatggtgcaaaaatggttcatggaaggattctgcaaaaaggctcagaaactgttcttggcaatgctgcaaatgaaagggacattttcttaactaatgactgtttggagtttgaactaaaggacatcaaagaattggtctctgtcaatctccaatcaatgccttggggtcacaagtatagaaaagagaattctgaagctgagaagattgagtgggccaaagtggaagagaggaaaaagaagggtctgcccatggaatatttatgtagaagcctgtactggcctgagaagggtgccttcttctctctacctcgtgataaactgggtcttggtaatggtg

SEQ ID NO: 11951 - DNA, 1588 bp, Triticum aestivum
  unsure (1)..(1588): unsure at all n locations
  Clone ID: PAT_TA_11951
gtcggctcgtcgccgccgcgcccctgcctccgccctggggagcggcgccgccgcccccgcgcccgcacgctcccgcgcccccccttctccgggcctccccccctgccgccgctgcccccctccctcccccccgcctgcggccgcgcgcggcttgggtgcagcgggcgcttccgcgcgtgccctgccccccttccgcggctgccgctccctcccgcctcctcgtccacgcgtccgctgccgccgccactccctccctcctcgtcgccctgcctccgccctaggagcttcgccgcctcccatgcgctcgttctctccctcgtctccacttctccgtgcttccgccgcagcctccgcttccctcctcactctcaccggcttcatctcctccacctccatctccctacctccgcacctggctagcacggtcagaccatgctaagtggacaagaaggcgccatctcaagaggcaggccacaccttccatgacggtgccctgatctgccggatcttcctcctcatcagtccaaagcagaggattggcggatccgcctcatctttggtgtcatcgaccagagaaggtgtttttttcttctaggccgatggatggggtaggcgaagaggagtggcggatctgcgtcctcttcggcatgcagttgtgctctccattgttgtgagctcgccgcctgttgagtttgctgtcgttcttgcaccggtgctgctgccgtggagggcttggtttaatcttgtctacggtgggatggggattcagaggataaattttattggcagtaagaagttaagagatcaagcgtgagacatcaaatgtcaagggagattttagttttttcgtgtctgtgtgtgcagcttgtctacggtgggatggggattcaaaggataaattttattggcagtatgaggttaagaggttgagcgtgagacgtcacatgtcaaggggatttagtatttagtctcttctaacctgtgaagagagactactggtttaaagggaatccatacttaaacaaggtttcttccaattcaacaaagtcagctatggagcttttcgaggcagtgggacatgatgccgcacggagatggggatggccatgcccatcccgatgctgccggccgatgtcggtgagagcatcaccgccgacaatggctccaacgagctctccatgagctcctgggacgacaccaactccaacatcatgttcttcgtgcctggaagcaagaaggccaaggtgctcatcgatggtgacaacggcatggtcaccaacttcagcaaaatcaaatcccaatttggcctgtcgagcacgtctttggacatgcccggcatggacggctacttgcagccgcagcaggacttcgtcgcctgcatagtcttgagacaagcgtgtctgcaccactcacccgtgaagcatcactaagaggcaaagaagaacaaggattagcaagaggctaaggaggctgcaagaccttgtgcccaacatggacaagctattctctgggagaagtcgtgcaatgcaattgctggaaacatgttaagtttcttcttgaagacgcagcanccaantagttcagacat

SEQ ID NO: 11952 - DNA, 785 bp, Triticum aestivum
  unsure (1)..(785): unsure at all n locations
  Clone ID: PAT_TA_11952
ataaattagnncacgtgctaactcccccatcgcacgtaggacaatattgaaatatctgctcactgtttcactagatcgccagaaccaaaatccaacagatgaatttgtgtgatgctgaccgaccatgtataggaacattgcaacttgttcctctaccgaaacatgaaatgtgtcacttaacaactccttctgcctaagcctgttacatagcttgtaaaatacagctcaagtcatccttaattgcttgatgcatgttgcatccgatgtgtcaaagagcctaattagtacattagttctgtagatgtctctctgaactaatggaccatacttcctgcctttacctctaaattttctaccatctctgcttctataccagagggccaagagtagaacaataacacagagagttctccgcttcaacatgttgtaataataatatctttgttgatccatgtccatctgggtcaatatgaaatgtacaaaaatatgaatgagctaacttggtacattattacaaatgattacttgctaaaagatacatgttagaaagcaaacctgcttctaaccagtaccaaggatgcacaatttgtaaaaaaaaaacaccttgatggacaaaaaaatcgaagcatgtctcagtagttaactatgtatatccaacttcaaaaaatccaccttaatgttctaaaaatagagaccatacatatggcacaaaaagggaagaacagaccatactactttcagaaccataccaggttaattaactaattaacatcattattctcatg

SEQ ID NO: 11953 - DNA, 711 bp, Triticum aestivum
  Clone ID: PAT_TA_11953
cccgcgcccggcgggcggcgccccggcatcttccccccccccgcatctgccccgccgtcgccggggggcggggcccccgccggcggcggtgggcgcgccgccggcggcggccggggcgccgcggccgccgcccctggccgcgcccccgcgggcgatctcggcgcggctgccgctgcaccgccccgcgcccgtccttgctgaccccgatggtgtgccactgcgttgccttccaactctcgtcaatccgcccacttgggtgcttcttacttgcgaccctgccctcggcgttccctgcgccgggcttcgtgttgctgccttcttcggcacctgcgtgccccggcttggtctgcgaaatgccgcgctattccgggcgctggtccctcagctcggccggcgaacaatcccgcgcgacctggggctcctcactaacttcatcactggcgctttgccctgcgacctcggaaacctcacaaacttgatcagtttggatttgtacttaaacaacttcactggtccaatacccgattcattggggaacctattgaagctacgattcctgcgtcttaacaacaacagtctttcgggcacaattcctaaatctttaactgctattactgctctccaagttctggatttgtcaaataataagctgtccggagaagttccatcaaccggttcattttcattattcacccctatcagttttggcaa

SEQ ID NO: 11954 - DNA, 688 bp, Triticum aestivum
  unsure (1)..(688): unsure at all n locations
  Clone ID: PAT_TA_11954
ggcgactaccgnactattgctctgcttggaagctgatgctaaaagtggctcctatgtcttcacattgggctctggccggccaccgaggcgcataaggggccctgatgccaaggaactgatgaatttccatggatctgttcttttccatggcagcttgcattggcacactgacaacctgataatggtatttgacaccaccaccgagtcgttccggcagatgcgcactccgattgtttctggccatgtcattgctggcctgtttgagatgggtgacatgcttggcacgttcagccttaatgacgaagagaccattgttgatatctgggtgatgcaggactatcaaggccaagtctgggcctccaaaggccgggttgaatttcccattgaagagctcatggcgcaatctgaagatcttggtagttgctggctagtggaggccacatattgggatggtgatctgctggtgctggccaaatttgacaacggctcgctacatcaggttgacattgatggcaagttggttgacagtctcggtcacagactcctctatcctaccccacttcggctgaaacaatctctagttccacataccttctttccggcactagagggttatgttgtcaatgcttcgtctttcatctgacttcagctcaatgacttgctatatttctttgaatatcatttgggc

SEQ ID NO: 11955 - DNA, 629 bp, Triticum aestivum
  unsure (1)..(629): unsure at all n locations
  Clone ID: PAT_TA_11955
ggcgccccccgcccccctcccggcgccaccgcgctgccctacaccgcccctacgtccccgcacaccctcctgccacctcccagcccgtgctaatgcgggccccctaatcctagcacccgatcgcccccccccccctaccaccggatccagactgccacggtccgccgtgatgcctccggtgcctccctgcgacggatccggctagatccaggccccgccgctcctagccaccttcctctcggccctggccgcgccgcaactggcaccgcagtggttcccccccctgcccccccgcgcccccccgcctgcccccgcccgccgctctctccctccccctgcgcgccccctcccctgtccgccgcgggcggctcccccggctgccgcggtgtgcggcccggccggcaccgccgcccgcctcccccgccccggtggggcagcccgctgtcgtcccccacccgcacaacaacgccgacgtgcgggttggtcccagatccgctaccgctgcgcctccgtcctggcgtagcttccgcaccgtgcgcgagagttcctctgggaattaacttgcagtgcacatggcttcatggcgttggtgttgtgtgtagtttgnacggatggcttcctttttttaa

SEQ ID NO: 11956 - DNA, 1746 bp, Triticum aestivum
  Clone ID: PAT_TA_11956
attcggcacgaggcattagggttctattgctataagagaaagcagaagccttccggaagggtgcagagtccacatgctatggtcatccatccccggcactcagggtcagatcctgacatggtaaagatcacagttgctggtggaaatgccaatggtggcgcggccacgagcgagccatatagccaggcaagcagtgccccccgtgatatccatgtcggtgaggctgggaataggctcatctcgctggaagtactgcgtatcgtgcccaacaacttcagtcaggagaacatccttggtcgtggtgggtttggcactgtctacaagggtgagctccatgatggtacaaaaatcgctgggacgcgtgtggactctcgtgcctggggctaccaggcgcctggcgtgctcggttccggggtttccgtgctcaccaaggtccgtcatcggaaccttgtatcgctgcttggatactgtcttgatggtaatgagaggattcttgtatatgagtacatgccacaggggccagtgagccaacacctgtttgagtggaaagaacacaatttgcagcccttggaatggaagaggctacccagcattgcggttaatgtggcaagccggcagacccaaattcagacgacagttacggcaaacgctcatccacaaagacttctaaccatcagatatacttgcttggtgatgacatgaaggcccaggtggcagactttggattggtgcggcctgcgccagctgatgggaagtgtgtaaccagagagccgaacgcggcctccagggttggctgattccttcacctccgtgcagtgaagatacgtgtggcttgtaaagctgatgtcttcagctttggtgtcattttgatggagctggtgacgggacgcagggcgcttgatgacacacagcctgaggatagcatgcacctggttacatggttccggagaatgcagctcaacaattgatacgttccacgaaggcgatcgacacaagcatggagcttgatgaggagaccttagccagcgttagcacggtcgcacagctcgcgggtcactgctgtgctagggaaccacatcaagaggcccgacatgggtcatgccgtgaacgtgctctctactctttcggaagtgtggaaacccgcagacccagattcagacgacagttacggcatcgacctggacatgacgctgcctcaggcgttgaagaaatggcaggcctttgaggacagcagccattttgacggtgcgacctcttcgttcctggcgagcttggataacacccagaccagcatcccgacgcggcctccagggtttgctgattccttcacctccgccgacggaagataaaccctgtttgttggaaagggaaagccagaagctccgctcgctcaaaatgatcattctgttcattcattcctttagcctcttcacccctcctcctccctccctgccttttaaatgttggtggatttggccttgtgctgccatgccatgttagctgtccgtcgatcatgtatgatgatgtggtctttactcgagaattccctggaagtctgctgcgactaaccgctcggtgctgctgctattattgttagctttgaacctaagtagaagattgttagggttgttggcttgtactcaacattgatctgctccaatattaaattgatccctgtcagtatcctcaaaaaaaaaaaaaaaaaaaaaaaaaaaaaaaaagggcggccctcgcgatctagaacta

SEQ ID NO: 11957 - DNA, 631 bp, Triticum aestivum
  Clone ID: PAT_TA_11957
ccctccctctcgtctccccaaatccgagggcctcaaaccccaattctcgcgctcgccggcgcctcactccacccaagcaccggcctccaacccatccgccgtcctcgtcctcgttcccgtcctcgtcctcccctctgctgggttgggttggcgggcgcggagtggagatcccgccggccggagtggtcatctcccccggtggactgtatcattgttaccagccacagctttagaagaatgatgcatcttgtgggcttattctttctcgatggaccggtggaaatttgttgaattggaagagttactggtctggtaatatgtcactccgacttccacttccgcaagggctctcctttttcaaaagtgttgggtggtttgaagacagtaaggttgattcagctgccaagcagcagttgtctccaaaatttaagctccagacagacaaggaagtgtatagacctggtgattcagttaccgcgactatcgaaatctgtagtcccgctagtttaaaggatgaagtgggggcagcgtcaggtggagatgtcacatctctcttgatagatgggctatctttcgaacttaaaggaattgagaagttggatagccaatggttctctgttccaaagccctt

SEQ ID NO: 11958 - DNA, 909 bp, Triticum aestivum
  unsure (1)..(909): unsure at all n locations
  Clone ID: PAT_TA_11958
ggaattcggcacgacgctcctcccggacccgcaagatcccgacccgccgcggcccccgctcctcgatcgattgatatcagacgcggccgggtgggcggaagaaggcggcggcggcggcgatgagcgcggtgaacatcaccaacgtggcggtgctggacaaccccaccgccttcctcaaccccttccagttcgagatctcctacgagtgcctcgtcccgctcgacgacgatctggaatggaagctcacatatgttggatcagctgaagacgaaacctatgatcagcaacttgagagcgtgcttgttggacctgtcaatgttgggacctaccgttttgtcttccaggctgacccaccggaccctttgaagatacgtgaagaagacatcattggtgtcaccgtgctgctgttgacatgctcctacgtgggtcaggagttcatgagggtgggttattatgtgaacaatgattacgacgaggagcagctgagagaagagcccccggcaaagctattacttgacagggtgcagagaaacattttggctgacaagccccgtgtcaccaagttcccaatcaacttccaccctgaacctggcacgagctcagaacagccgcaacaggatgcagaacagcagcagcagccgacttcaccggaaccacagacggctccagtagagccacatatggcgccactagagaatgtccccattgccgccgaccaatgatcagagttggggtgctaacggtctgttctccatgccttcttatggtgtcttaatgttacgaatcgagagtggtggttctgcaatgtactgatctgttgtttacatttcacaatctgttctgtggcaaatgttgggtgtctagctatttctnataaagagtacttctgcctattttgttgcacatatt

SEQ ID NO: 11959 - DNA, 514 bp, Triticum aestivum
  Clone ID: PAT_TA_11959
caacccagtgcatctctttgctaatccgccgactctgtgcatccgccgctgtgcgccgccatcgccgcccccgttctacctcggtgcgtacctgctctctccaccccgacatcgatttttcagcccctcatagccggcacatggaggagatcatcccagtaggccgcgaacatgtatccccgcagaccccactcacggaagtgatatcaaccagtgaaaccacctctggcgtcgatgagctatgtgcaggagatttctacaatcttcgcggcgttgatgacgacacaaaggcaagtaagaagcgacagctgaggatgagagaggaacggatacaaaacagacgcttaaagaagcaacgtaaaagaagggaggctcaagaaaccgtggagagggccctcaagctaagagaggaactgcgtcaaaacaggctcgatttcgaggcgtcggtaaagggcagagaggacgagttctactacacccctcggtggaggagggcagtccctgttgataaggt

SEQ ID NO: 11960 - DNA, 555 bp, Triticum aestivum
  Clone ID: PAT_TA_11960
tcaagatggggcgcctcgcctactggcgcaactcgctggtggtgcgcgtgctcaccctgctccggatcgcgcccaagggcgtggtgaaggtgcacgagatgctgtacgagaccgcgcagcacctcaccctcggcggcgagaccggcatcttctcgccgatgcacatggtggtcctccgcaagcccgtcgccgacgccgccgaatagagcgagcgatcaaacaagaagtaatttcaatcaatttctcatcagaggtaagaaaaaccgggagggaggacaggcttattattagctaatggagcactactagtacaattgatttggtgttgtagccgagagaggagagaataggagcggccgatgatgcttactgtttgttggtggagttgggctttcgttttcgttttcgtttgttggaggagagaataggagcggccgagggaggacaggctttcgttttcgtttcgatttttgggtggagttgggctgcatgcaggctggattcagatttgtttctgctttgatccgtggattggatagatcttccttttcttct

SEQ ID NO: 11961 - DNA, 901 bp, Triticum aestivum
  Clone ID: PAT_TA_11961
cgtccgtgcccctccccctcctcctcctcgagctgagctgagctcgcgctcgcggggaacgagcgaaccatggagccggcgacgatggcgtggacggcggggctgctgggcgccggcctggtctactggttcgtgtgggtgatgggcgcggcggaggtgaaggggaagcgggcggtggatctcaagatgggatccatcacgcgggacaaggtgcaggacaagtacacgcagtactggtccttcttccgccgccccaaggagacggccaccacgcaggcctccgccgacaaggtgcccgccttcgtcgacaccttctacaacctcgtcaccgacatctacgagtggggctggggccagtccttccacttctcgccctccctcccgggccgctcccaccgcgacgccacccgcgtccacgaggagcgcgtcgccgacctgctgggcgccgagccgggccaccgcgtgctcgacgtcggctgcggcgtcggcgggcccatgcgcgccatcgccgcccactccggcgcccgcgtcgtcggcatcaccatcaacgagtaccaggtgaaccgcgcccgcgcccacaaccgcaaggccgggctggacgcgcagtgcgaggtggtgtgcggcaacttcatggccatgcccttcgacgacgcctccttcgacggcgcctactccatcgaggccacctgccacgcgcccaggctgcaggacgtgtacggggaggtgtaccgcgtgctcaagccgggccgcctctacgtgtcctacgagtgggtcaccacgccgctgtaccgcgccgacgacccggcgcacgtggaggccatccacggcatcgagcgcggcgacgcgctcccggggctgcgccggcaggacgagatcgcgtccatcgcgccagaagtcgggt

SEQ ID NO: 11962 - DNA, 1599 bp, Triticum aestivum
  unsure (1)..(1599): unsure at all n locations
  Clone ID: PAT_TA_11962
gccctcggcccgccctccccctcctcgacctgatctcaagggggaaggaccatggagccgccgacgatcgctcggagggcggggggagggggcgccggcctggggcactggttcttgtggcggatggtggcgggggtggggaaggggacgcgggggggggatgcgccgatgggatccatggcgcgggacgcgatgccgtacaagtacgcgcagtacccgacgataagcgccgggaccggcattcccacgccgaggcagacggccgccgcccacaggcccgcccccgccgacgcatcgcgcaagcggtgcagccataagtaaactccgtcaacggcccagtcgaggtcagataaaaccggggctggccagaccgcgccctctgttagctcacgcggtaccactagtggcactgacttggagctggtgggcgcgaggagagaatagggggggccgatgatgcgctccgttggtggtggctttctgttttccgtttcgatttttgggggggcgttggaccgcatgcaggccgggttcagatttgtgtctgctttgatccgtccgtgcatagatcagcctccttttcctttcctgtctcgtgcgctgtcggcctgcacccgcaaagcgggttggtgtgcggcaacttcatggccatgccgctccatcacgggcccctcgaacgcgccaaggctgcaggacgtgtacggcgaggtgtaccgcgtgctcaagccggggcggctctacgtgtcctacgagtgggtgaccacgccgctgtacccctccgactacccggcgcacgtggaggccagccacggcgtcgaggacgcacgtcgacgccatccacggcatcggccggacgagatcgcgtccatcgcgcaggaggtcgggttcgaggtggtgcaggagctggacctggcgctgccgccgtcgctgccctggtggacgcggctcaagatggggcgcctcgcctactggcgcaactcgctggtggtgcgcgtgctcaccctgctccggatcgcgcccaagggcgtggtggaggtgcacgagatgctgtacgagaccgcgcagcacctcaccctcggcggcgagaccggcatattctcgcccatgcacatggtggtcctccgcaagcccgccgccgccgccgaatagagcgagcgatcgaacaagaagtaatttcaatcaatttctaaatcagaggtaagaaaaaccgggaggaggaaaaacagaggcttattattagctaatggagtgctagtgctattgatttggcgttgtagccgggaggagagaataggagcggccgatgatgcttactgttggtggtagctttcgttttctttttcgatttttgggtggagttggactgcatgcaggctggattcagatttgtttctgcttcgatccgtggatagatcttccttcttttttcttcatgtaatcgtcatctatattttgtcttccgcaactaaatatcggatggatagagtctctcgttgcacactgaaattgtgcaggaaaaaaaaaaaatccttcccctagacnaaaaannaaagaaaaaccnaagggggggcccggtaccaaantcgccnataataanng

SEQ ID NO: 11963 - DNA, 127 bp, Triticum aestivum
  unsure (1)..(127): unsure at all n locations
  Clone ID: PAT_TA_11963
gggtggtgagtgtatgcgcgtgtgtgagcgtcactgtgttctgccaagttgcttaagcaaaacaaagcgtaccaatatgctggtgagtgcgacgnattaggaaccattctttcccataaaaaaaaaa

SEQ ID NO: 11964 - DNA, 634 bp, Triticum aestivum
  unsure (1)..(634): unsure at all n locations
  Clone ID: PAT_TA_11964
ggtttccagaggggagttgcaagttccaatcacattcaaaccttagaggccgccttggtgcagtggctagnatagtttcagaattcagactttcaatgtaattttatgagatgttaatgttcattctggttgatggcataatatttgttcttttgacaagttcattcattatactaaccaagtacataacttgcagacctttggcctttactttatgatttgatttatgggaagtcgagttatctatattgaacacatttttcctttttttccaggatggttgatacatgtctacacattttgtcagagcaatttgcagtggaagaagtagcctcaaactgataagaaggcacctgctatttcacggttattgttgtagatcaaggatgacaagaaggcaactaatgtaccaggtgcaggtaatcagcaacagatgtgatgactttgaagtgttctggagcatttggctgtctatagtattttggaccagccaacttaattgtaatcgtgaatcttatgtgttttctagaccatttggtgctcaagtgttatggagtagaaatcttgtgctcatggatgttactcaattatttggaccatctagtgtttgaactattttagaccaaaaaaaaaa

SEQ ID NO: 11965 - DNA, 571 bp, Triticum aestivum
  Clone ID: PAT_TA_11965
cgtccgtctcaccccagctgctcatctggccccaaatgaaccttatgcatgcccagattctcaacctcctgctcggaccgctcaattcgctgcacctgcttactatgtgaccacaactgggcatctgtatcaggcaagttatcaagcatatggcccatcgcctgccacctatcactacgcccaagcgcctcctttgcaacttgtctatttgcaagcccaacaccctgtgcgaaaacatgttacagaccctgcatgttcctctgatcccaactatgatgctaatgggaatgatccgtatcgatatgacgctgtgaagtctcattaccaggaaactacttctgggagagctgctgcaccacatgaagtggccgcgacaaacctccaacttgtcatgcactatgggtacgccccaggcagtgagggtgcaaccagagaaactacacagtccagtgctgaaggagctgcatcggcgatctactcccatgcgggtgccccagcaaccactcaggccctgccacacatgacgtggccggcagaaacctcacatgtatcatgcactatgggtacgccc

SEQ ID NO: 11966 - DNA, 380 bp, Triticum aestivum
  unsure (1)..(380): unsure at all n locations
  Clone ID: PAT_TA_11966
aacttttcgccggaaancctccnccttctccnacgcnttcntcnccncaatggccaanctcggccnnatcggtgtaaanaccgctgcccggccgccacgtgggccgggtctgcaccgccgtcaactagctaccgttcggtgcggtcgtgtgtgtgttagccttgggcccgtagctaggttggtgaatcattacatgtgatgcagcgcagatgcagggtgtttttgcttgtgtgtgtgcgttagtgtgctcatacgctacgttttgtggtgggattgtgttagccattctttgatggggatgtggtatggaatggattattagtcacatggtaattacgctgaaacaaatgcaagcactctgctggatgtgaaaaaaaaaa

SEQ ID NO: 11967 - DNA, 564 bp, Triticum aestivum
  Clone ID: PAT_TA_11967
gcacgaggggaagcttttgcctttgcagcactgagaagatgagcatgctcaagtgtttcccgcacggtctcgccatgccggcacaggcgacctggtgtaggggccgggctgcggcgagagctgggagatgggcctgcaaggtcacctcgacagctaatttcgaggacacggtgacggggatggcggcgcaagagcaggcggaggcggaggtggtgcggagtctgggcctgagcggctgggtggaggaacagctgctgccgctgctcaccccggtggacgacgcgtggcagcccagcgacctgctcccctgcttttccccctctgcagctggcctctccgccgagcagcagccgtcgatgatgatgacgacggaggagctgcaggcccaagcctccggcgtaccggacgacgtgctggtgtgcctggtgggcaacatggtaacggaggaggcgctgccgacgtacatgtgcatgggcaaccgggtgccgggctaccgcgacgacacaggctgcagcgacctcccctgggcgcgctggctccgcggttggatggccgaggagaacc

SEQ ID NO: 11968 - DNA, 530 bp, Triticum aestivum
  Clone ID: PAT_TA_11968
ccacgcgtccgcggacgcgtggggactagttctagatcgcgaggctgaggcttcagcaaggtgggcgagaagaggagctacaccgtgagcttcgcggcgggcgggaagccgtcgggcaccaacgggttcggccggctggtctggtccagcgaccaccacgtggtggccagcgcgatcctggcgacgtgggcctgagcgagcgaccgccgcccgggcggtagctgctgctaattggcaatgccgtcgaggcgcagaacgcggcggggcagcaatggcgccgccgttctcgatcggaagggagcaagacggatgcgtgcgtgcgtgcgtgtgtgtcgatttggcgtggtgatttactgatttggcttgtcattttctcgctgccggttgccggtgcagctgttctagtgtcaagtgggcatagatttgattgaatggtgagaaagttcgtgattatcaagctgggtgtagtcctaaacagagacggatcaatggataatggaggagcaaatgtgttcatcaaaaaaaaaaaa

SEQ ID NO: 11969 - DNA, 1091 bp, Triticum aestivum
  unsure (1)..(1091): unsure at all n locations
  Clone ID: PAT_TA_11969
gcccacccaagncccacaaaacaaaagcgcccccacgaggaacctcgcgcgttcctccaatcccctcctcgccgncgctctcaaattcatacaccgcccctcccgccgcaggttgggcatgacgcatatgtttccaaatggaggtgcctcgtccagctcaacctctgtgagcagccagaggagcgagacagatgatgacaagatgattgcgggggctctcgttggcctgtctgcgctcccggctcccgccagggccagccgccctgccctcgtgtcacctactccccgtgtcccccggtttatgccatgcttccacatgtattattctcatagttcctaattaatgagaatcttttgtaggttaaatgcatatggcttgtttgaagtgagggtatcaggtgatggcaattgtcagttccgtgcactctcagaccagctatatcgatcacctgagtatcacaagcatgttcggaaagagatagtgaagcagctcaaggcgtgcaactctttgtatgaggggcatgtcccaatgaaatataaacactattgcaagaagatgaaaaaatctggggaatggggagaccatgtcacattgcaagcagctgctgataagtttgctgcgaagatatgccttcttacatctttcagagatacctgttttgttgaaattgttccacagtatcaggctccacaaagagagctttggctaagtttttggtctgaaattcactacaactcactatacgatgcacgagatctcccgagcaagtacaagcctagaaagaagcactggttgttttagattcacgtgttgcttcaggcttgaattttatcacatggccttttcgatattgccggctggccacatcctggagagaggacacctacctctgattttctccactggagatctgagtaattggattattggatgcgttccttggtgcagtcatatgatcacatgtagttcgatactgaaaccgaggttgcttccttgtgcatagatatttatacnaacagataggttnattgtatacatgttcgttcattgttacatttttatgcaatgctgctatatgttattccattca

SEQ ID NO: 11970 - DNA, 724 bp, Triticum aestivum
  unsure (1)..(724): unsure at all n locations
  Clone ID: PAT_TA_11970
ggnctgcaggnaattcggcacgaggcccagcaaggtcgtcgactggctgctcaacgcggcccgccacgagatcgacaagctgccgccgctccagttcccgccgcaccaggtcgacctcatggaccacatgatgacctcctcctccatgccgctcatgccgcacgtcgatgacaagttctgccacttcgcgtccacgctcgcccgagatggtggcgtcaaggccggggccgacgctgacggcggtggagctcaccacaacatggggaggttcggctaccaccggttcatggggctcaacaacaactccctgggactggtcaacagcgggatgccatacaatttcaccggcgaagtcatggaataacaagcagtgtggaccagangcaagcgggcgctggctccccacaagtctccatagcttgccgcccgcccgcgggctcaacaactccggaatttcccgtcgtttactctccttnggctccaaaggncncaacaaacttgggttantaacncgncgggaggccgattcaagttccaagtttgatgacctggggctcccaaagcttatccttgagctcngcgagagctttccatgancanacaggaaagctagctgccaacctagcttgcttgtacaacgcctggntcattcgatatgcttaaaaanatggngcttgattcgatncggtgggtatgggattgcnaacttttatnccccaaaggg

SEQ ID NO: 11971 - DNA, 1047 bp, Triticum aestivum
  Clone ID: PAT_TA_11971
cgctgatcgacggcctctgcactatggtttggtcatcctgtagaggggagcatagatgagcggaaacaccggccagcatttaacagcacggggctttatggaaccgccccgtgttatctgtcttctgttacattttgtaacattagatattgtgcatatttctccagattgaatctttcaatgggttgatgtcctgtgatggctgtcctaaactatttggagtggtttgccgagtttcttgtcggagattgcttttttggttaagatggaagtgaggattctttccccagctgatcgactatgattatactgtgcgcaaatgaaatcctttatcagaggattccaagccagaaatctgatccattgtccaacaatctctatccctctcttctctctatgtttgtaccgttggtattttacttatgtttttctgctctgatttgtaaattcaatggaagtgaagatcctttccccaaatgatcgactatgattataatgtgcgcacatcaaatccttatcagagggttccaagccagaaatctgatccattctaactttgttctcttttagcgctctgtttttacccttttttcttgtgcataacccttatgtattgttctttttattgtgttattgaaatcgtgcgtgtgatacagttatgtgtttataaaaaattggttttggacattctttccaacatgagcactgtccaggtttcttgaggtgatcatagatgagtgaattgtgtcagttgtaagatcttcctggccaagctgtcgtggccactggtcgcatagattgatgctactttaattctacacaaacctagctatacattgttgaggaccatatttcatctaattggatagatatttctgtatttgagccttttgtgaatgtattttgtgctagtgctacattctattcggcttctgcttcagactgttcttacggtgtaatgggtaatgtgtatttgtttgtgttgaaatagtaaattctgtcaatgtaatcagtataaaggttttagtaattatatcattagatttt

SEQ ID NO: 11972 - DNA, 757 bp, Triticum aestivum
  Clone ID: PAT_TA_11972
gttcctttgcccccccgtcccgaaaaccgccgccggcggcggcggcggcggcggcggggagacggcagacggtgagatggcgaccgcagggagttcaaggggaagtagtggcgagttcgtgttaagcgaggagctctatcaggctggagtctccgtgcatgagagtatgcgctggatccaggtccaggaagacaagatggctgagatctcggcgattcgcaataatttgcttgggttgaaatcggatgcactcgagttgtttgagaagatctcccgtcaggcaaattccgagacccagaagaggctctgcgcgatgcagaagacccatggtgtgaaatcgttggagacccagagcaagattggtgacgacggtgagatggaaacgaggtgtgaggagtcgaagcgaaggagtgccgcgtccctggaactcgaggatctgctccatcgtgccgcactccaaacccagatgtggataggtgaaggcgcagaaagtgaggagctgctcgatctggccgcaaaggagacccaggggaggatcgttggccaggttcacagtctgtcctccctacccaaattcgtcagtgaggtcatgttgaaattcggacaagttgccggtgacatttctatggtattagaagcgcagcagacccggaaggaggcactagcagtgctgagcttcggcttcaggctacagttgctctccaagcagattgatgagttgtggcgtgagatgtgcacattactgagatctttctcg

SEQ ID NO: 11973 - DNA, 2201 bp, Triticum aestivum
  unsure (1)..(2201): unsure at all n locations
  Clone ID: PAT_TA_11973
gacgaattcggcacgagctcgtcgcgaccatctgacaggttcgctcgccgggcggaggcatacccgccgccatgtcgaagctcgccaaccagccgccgccgccgtcgtcggatatggatgttgactccgcagccgcggtcgaggagaagaatcccgtcaggttctccatcaatgtgctggaactcatgagggaggcgcagatgcagcacggccttcgccacggcgactacacgcggtacaggagatactgtactgcgcgtctgagaaggctatacaagtctctgaagtttttgcatggccgtggtaaatatacccggaggaatataacagagtcaacagtgactgatgtgaggtttctacatgtggtattttatacggctgagagagcatggagtcatgctatggagaagaaaactgctggtccaaatgcaccgcagcgcatctacatgctgggtcgatttaggaaggcagtcaaatgggcggcacttttttcacagttatgttctataaaaggagattccaggacatctttggaagctgaggcatatgcttcatatatgaaaggaactttgctttttgagcaagagaagaacatagaggcagcaatgttgaatttcaagaataccaggactgtatatgaggagcttgggaagtatggcggcatagaaaatcaacttttatgccgtcagcgcattgaggaagtggagcctatgattggattctgttcacgcaaacttggtggatctgctctgcaagaacatgatctcctagatatggaaaaggaggggcctgcttatgatctttttaaagctaagattgaggctgtattatctgagacaaggtcacagcaggcggcttctatgactgagtttaactggcttggtcgcagatttccaattaccagtgcaaagacccgtgtctccatattaaaagctcagcagctggagagggatttaaatggcgcagccacagaaccaatttcagcagacaaaaaacttgctatatttgataaactattctctgcataccacgaagctcgaagctgcatccgcaatgatttggcttctgctggcagtgctgagaatataagagacgaattgaatggtcttgacaaggctgtcagtgcagttttaggattgaggaccatagaacgtaaccagttacttgttagtattgctaaaagtaagtttgcaaagcatcgggatgagaagaatgagaaaattacaaagccggaagaacttgttaggctatatgatctgctaattcagaatacaacagacctaactgatttagttagctcaggaagggataaaaacgaagaagagaacgcttttgttcgtgagtatgagctgaaagatttggctttccgagctgagagatgtttctatttggcaaagtcatatagttcagtcagtaaaagggccgaagcctatgcattattcagttatgcacattcccttgctgattctgcactgcaagaactggctaatagtcctcacaagaccttaatccaagatctcgaggctctatctttcaattgtagatccaatagttgcattgaacatgcaacaggtattatggaggatgagagtgctcctgaaagactttctaaaggagtctcaactatatcacttggcgacgataaaagaaaggatactaagtacctccttgatatcctaggaagctatgaatcagcacttggtgagcaaagcgccaaagcgccatgtcgcatttcacagttcccaccaccgttccaatcagttccctgcaacccaattgttcttgacatggcatacaacacaatcgagttcccgaaccttgagaacaggatgaagaaggaaaagaagggtctcctccgcagattctgggggtgaaaggaagagagcgtgttatttagttcctcaggatcaccttgctcttggattttgatacattaccttggtggattaatttgtttttgcctgtgctgctcatcgcagtgccggtttgatgtctggaaggtttctaagaagtctgaaccaagtttggcaggcaaattttttttctgtttcaaaatacatcagtttgagtgtcgctgtttacaatccgttatacagtatggaacattaactaaataggtcatacttcttgaaatgttaaattgttgcagtatgattaacttatattccgcaatattaggttccatgtttggctgcagtnna

SEQ ID NO: 11974 - DNA, 140 bp, Triticum aestivum
  Clone ID: PAT_TA_11974
gctgtggcctctttcattgaataagagcggttttgatactgtatcataatagaactatgcgctaatgtaacttgagagcaagttacaataattaatcttggtgttcatcttccgaaaatggagattaaccaaaaaaaaaa

SEQ ID NO: 11975 - DNA, 951 bp, Triticum aestivum
  Clone ID: PAT_TA_11975
cgtccttccacgcgccctcccgccgccgcctcccctccgttcgttcttcttcttcgggttgggtagtttacgtctacccaccagccatgggtaaggagaagactcacatcaacatcgtggtcattggccacgtcgactctggtaagtcgacgaccactggccacctgatctacaagcttggaggcattgacaagcgtgtcatcgagaggttcgagaaggaagccgctgaaatgaacaagaggtctttcaagtacgcctgggtgcttgacaagctcaaggccgagcgtgagagaggtatcaccatcgatattgctctctggaagttcgagaccaccaagtactactgcaccgtcattgatgcccctggtcaccgtgacttcatcaagaacatgatcaccggtacctcccaggctgactgtgctgttctcatcattgactccaccactggtggatttgaggctggtatctccaaggatggccagacacgtgagcatgctctccttgctttcactcttggagtgaagcagatgatctgctgctgcaacaagatggacgccaccactcccaagtactcaaaggcacgttacgaagaaattgttaaggaggtctcttcctacctgaagaaggtcggctacaaccctgaaaaggttcccttcgtccccatctctgggttcgagggtgacaacatgattgagaggtccaccaaccttgactggtacaagggcccaaccctgcttgaggcgcttgaccagatcaacgagcccaagaggccctcagacaagcccctccgtcttcccctccaggacgtttacaagattggtggcattggaactgtgcctgttggccgtgttgagactggtgtcatcaagcctggtatggttgtcacctttggtcccactggtctgacaactgaggtcaagtccgttgagatgcaccacgagtctctcctgg

SEQ ID NO: 11976 - DNA, 598 bp, Triticum aestivum
  Clone ID: PAT_TA_11976
cccgccgcgtgcgacagttcgtctcgccccccctccgtttcaaacccccaaaatttccctcctctcctcccttccgccgggcaattcgcccgcctttttgatcccccgccaggccaccgcctcgattagtctccccatctcccctccaatcccctaaacaatctttcgccttccgatttcccccccaatttccgcggctcccctctcccccatctcgcaccaacctccccctccgccacctacccctgccaaaccctagccggcgattgctgcccgactgatggcggacgacgccgccgccgcgagcttgagccagccctcccccgcgaagggcgacatctcgcgagaaaatggggatgagaaaagtaagcagtgccaaccattcttctccatgtgccaaccgcttcagactgttagctattcaaattcttgggatagcgtttgtgctcctgcagcaacggagccttgtcaaactagcggcttggattcagtggatgatgattacatgccaagtgcaccttcttttcctgatagccagcagccccattctgagagcatttctgctatagtagatgaatcaaacaagttatgttcacca

SEQ ID NO: 11977 - DNA, 1138 bp, Triticum aestivum
  Clone ID: PAT_TA_11977
actgaccagaaaattcaatcgagggtttctccgtccggccgcggccacgaccggatctcgtcctcctcccggccagcagacggcgatggcggcgagggcgcttgggctcgccggccgagcgctcctgcggccgctctcctcaccgggcgcccagcggctgctatccactgacaagagcccactgcagggccttgcgaacgccggtgatccgatgagccgcctcatcatgcaagcacggaaccagactggcggcggtttttcccctcactttgctgagaacggattcaccgcaggcggtggcaggatgggtggaaacgtgttcacagccggtgatggcaggatgggtggaaacggattcacagccggtgatggcaggatgggtggagttggattcacagtcggtgatagcaggatgggcggaattggattcacagccggtggtgccaggatgggtggaaacggattcacagctggtggcaggtcgggccggtttaacatggaaatgctgcggccagcaggggctccgcgagtaaagagggacgttctccacgtcacgctcaaggggaagaagacctttgtgactgtgacggacgtcaaggggaacaggaaggctggggcttccgctggctgtttggaggatcgaaaggggcggtctcgtcttgctcggtatgctggtgaagcaacaggggaacacatggggcgagttgccagcaagattggcctcaagtctgtcgttgtgaaggtgaaaggatactcctttttcaggaagaagaagaaggtgatcatgggctttgcggatggtttccggggcgaaagagtgaggaccccgtctcctatcatgtacgtccacgacgtgacccagctcgcgcataatggatgccggctgcccaaaaaggtaaggaagtaagactgataatagcccccagcaagaagtgtggagatcaatatcctgtcccaaggagaaacaaattaagaacgatatgtatgtatcgacaggttttgtaataatgtcatgagcctggaagtatttatgaatacttattagacagtcttagattggctcttgtaagacaaacatttttgtcatttcctgtaatgttgctgaagtgatggatttgttcatggttgcattgcacgc

SEQ ID NO: 11978 - DNA, 1447 bp, Triticum aestivum
  unsure (1)..(1447): unsure at all n locations
  Clone ID: PAT_TA_11978
cctacctacggcgcccgccccttccggcccatgcaaccacgccccccgcccccgcccccgcccccgtcccccgccccgctcggccgcggcggccaccgccctccgcctcgccggcctcgtccccccacaacgcctccctcgacccgctctgtgtcgactgggaccgaaccaaccgcccccccaggcatccgctccccgccgctgccgccggcccacaccggatctcgtcctccgtccgggccagcaggcggcggggggcaccgtgccccctggtgtctccccggccgcggcccacggggaccgcccggcctcaacagggcgcccaccgccggctggctactgcccacgtcccatggagtgggcgccggaggtgagggcacttgggctcgccggccgagcgctgctacgaccggtcgcctcagcgggaacccagcggctgctgtcaactgacaaggactcactgcagggccttacgaacggcgatccggtgagccgcctcatgcaaacacggaagcagaatgacagcatttaccgtcgctttgctgaaaatgatttcacaggcggcggtagcaggtctggccgattaaacatggaaataacgtggacagcggctctgcgagtaaagatagatgttctacgcatcacacccaaggagaaaaagacctttgtgaccgttaaggacgtcaaggagaacaggaaggcccgggcttctgctggctgcttggaggatcgaaaagggcggtctcgtcttgctcggtatgccggtgaagcaacaggggaacacatggggcgatccgccagcaagattggcctcaaatcaattgtcgtgaaagtgaaaggaagttcctttctcgggatgaagaagaaagcgcacttgagctgccgggcggccaaaaaggttaggaaataggagagataatatcccccataaggttatgtggagaccagtatccagcatccaaaaggaagcaaacaacgatatggatgtaagcgactggtttcgataataatatcatcagcctgaaagtatttatgaatacttattagacaatcttacgcctgcttttgtacgtctgaaccattttgtaatcacctatgactttgctgagctcctggctaggtgtgggtagatcaatatcctgtccctacgggaaacaaattaagaacgatttgtttgtttcgacaggttttgtaataatgtcatgagcctggaagtatttttgaatacttattagacagtcttagattgggctcttgtaagacaaacatttttgtcatttcctgtaatgttgctgaagtgatgggatttgttttgatatggcatggttgcattgcctgccttccctctcctttggnggactcctatatattacagcactgcaagtgtatgtgttgagaaaaaaanacaaaaaaaccnnaggggggggcccggaacnaattcgcccca

SEQ ID NO: 11979 - DNA, 951 bp, Triticum aestivum
  Clone ID: PAT_TA_11979
ttcgcgccctggactcctgcgtttgggcgctgccccccctcgggggcgccgtttttggtccccaataggaacatgacccctgaagcagctttggatcatgtacgatccattaggccccgagtgcttttggccccatcccagtggcaggctgttattgtatttagcactctcacccctggacgtcttccatccgggagtacaaacctaaactgttacctagaaggcaccaaagcctccattcctgacagtgatatcgaggactgcactgtggagtttgattatgatgatagcggtttacctctttgtcaagttatggtaccgaggccaagcagtccgactgggtgtgtcgatgcagtgttcataacggaagcagatctggagggctatgatgcatatgttgataccgggaaggatgttgtgtcatttgaagtagtagcgagtcgcaagcccattatgaggagactatcttgcctctttggatcattgaaagttacaagcaactgtgaaccagccccaaaccgatttaccgaggttcgcgcctgctaggcaggcctgctactcgctttatgcaattttctccgtgttgtgagtcaagatatatgggacatcagtagataggcaggcagtcagccagtcaggcatcgtagaaatatggaggtttctacagccacggcaaacgccaccgggaagaagctttgtgtgcatagggagatggagagtttacagttgtgaatgtgccgattgccttttttttcactcggaaacatgtggtttgatatcaccattgttctttggaataaaaagctgatcatgtttggtgtcagtatatttctgttagttcatgtcttttggaataaaacaatgttggaaaatgtcatatattatgggacggagggagtagtttattgctctctctaatggtgaaaaaaaaaaaaaaaaaaaaaaaaactc

SEQ ID NO: 11980 - DNA, 604 bp, Triticum aestivum
  Clone ID: PAT_TA_11980
gccccacctctcattccctcagccgccgcactctccatcgacatggtcatcgcgctacaagcagcaccgctgcctcccaatgttgccgccccggatcccccacccacgccgctgccaccgccctcgcatcccccacccatgccaccgtcttcgcataccccatccacgccatcgtcggaggtcaacggcgaatttggaggcgacctccgcgaaccgcctggcgatctcgcctccgtccacagcacacaatcgatattgcggcagcaggttcgttcaccatagccgctgcgctggtggggtgagcctggccttacctgccgttcaaatctcgttgcctatggtgtgcccccgccaccgcgggctgtcctacaggtctggcgcccaccacctctctattattctgctttcctcagcatgtgtctgtacgctactccctcttctacctttttgttcctctgttatgcaaactgagtggttcaaataaagtttattctggagaaatttgctggatgataactctgtactaaatgcatgtgttctgttttagcctctctttgcttcttaattaaatcaaatccccactacagctatagcttaatcaatc

SEQ ID NO: 11981 - DNA, 1149 bp, Triticum aestivum
  unsure (1)..(1149): unsure at all n locations
  Clone ID: PAT_TA_11981
gcggaagaaggtcgcctagggcctcgccgcccaatggatcccgccgcaaagcaggtcgcccgaggcaacaaatggaccagacatccacagctcggggacctcgtcctcgccaaggtcaagggttaccctttctggccagccaaggtgagcaggccggaggattggaatcaggagcctgctccacgcaagttctttgttctcttcttcggcaccaaagtgattgcttttgtagctttgcatgatctcttgccatttacggaagaggtgatgagtgacctggtaaataaagctcgagagaaacaattcccgacaagacatgcgaaaggtcttgaagaagccttggtggaggtacagatggcctacgatgaactcccaaaatcatctgaaacttccaaatggtttgtttcctaatcgaactcctgatccgattgaaaaacctacaaagccccttgtaaagccacctgctgatggcgggactcaaaaactggaacagattgatgatttccatgggaggtacctgagcctcaaaagaaaagagagagatgtcccaaaatcatctgaaactgcgaatggtttgttgcatgatcgaactcctgatccgactgaaaaacctacggagccccttgtaaagcaacctgctgatgggtggtactccaaaactggaacaagctgatgattcccatggggaggtacccgagcctcaaaagagaaaagagagttcggtttgctggcattgaggagaggaacttggaggatccctatggcataccaaaatgcattgctgcgcttgaaggattgccggatttacaaatggaagatgtgctaaaagcagctgacctcttcaccgacaacaagggtaatcgcgaagtcttcctctctttttcaagtaatgcattacggcttggctgggtaagaaggaaaattcagaacgcctcatgaaatggctatggaaatatgccccctggagaagaccttttgtatgcggttctagacacttgtggtgctaaactaatgcaatgttagtggtagcaaattagcatcttagtgctaaggtgtagggctaacttttgtgtgtatgtatccctgggcaggtgtgctagtactaacgcaatgttaagtggcgctnatcacaaatccttttaatttaat

SEQ ID NO: 11982 - DNA, 354 bp, Triticum aestivum
  Clone ID: PAT_TA_11982
ttcggcacgaggggtgagcaagagctccgacacgtccgggagctcgcagagcccgcggtcgtctgccaagccgctggggtccaacaagtcgtccggctcgtcgtcgaggaaccggcggtactcggtgtcgtaggccggcgacggcctgccggcgctaccggaggttggctgtacagaggagtgtccgcggactcggtcgccgtcgccggatcaacgggcgccgacgacggaccaaatgctgcatgctcacttcaattcagggtctgtttttttctcgagaaatgtattgatccgaagtgctcgaccgatgatcagctagaaactaatccttattttgtctgatcaaaaaaaaaa

SEQ ID NO: 11983 - DNA, 872 bp, Triticum aestivum
  unsure (1)..(872): unsure at all n locations
  Clone ID: PAT_TA_11983
gggccgggactgttccacatcctcgcctcccgcccgggcggcccgcccagggtcaggctcaccgggctcggcgcgtccatggaggcgctggaggccaccgggaagcggctgtcggacttcgcccacacgctgggcctgccgttcgagttctacccggtggcgggcaaagctgggaatcttgatccggagaagctcggcgtcgacacgcggcggcgcgaggctgttgccgtccactggctccaccactcgctctacgacgtcaccggcaacgactccaacacactcaacctcatccaaaggttggcgccgaaggtggtgacaatggtggagcaggacctgagccactctggctcctttctggcccgcttcgtggaggccatccactactactcggcgctcttcgactcgctggacgcgagctatagcgaagacagctcggagcggcacgtcgtggagcagcagctgctggcgagggagatccgcaatgtgctggccgtgggtggcccggcgcggaccggagacatcaagttcggaaactggcgggagaagctcgcgcagtcggggttccgtgcggcgtcgctggcgggcagcgccgccgcgcaggcttcgctgctgctcggcatgttcccctccgatggctacactctcgtcgaggagaatggcactctgaagcttggatggaaggatctttgcttgctcactgcatctgcttggcgcccatttcaggccttaggccgttagatttacagtgctaaagcatcactagattttacttagtgcaactgtcttctttttctgcctcttaagtgctcaatttgatcaattctaagacaaaggaaaaaggaaagcattcnatcactaattgctactac

SEQ ID NO: 11984 - DNA, 635 bp, Triticum aestivum
  unsure (1)..(635): unsure at all n locations
  Clone ID: PAT_TA_11984
gnctgcaggnaattcggcacgagggttgcgccgccctctgcgacctagtctgcctagttgtggacgtccgccgtccgttcccctcccggcctcccttgcccgccggcgtttcgcctcgcgccagccgccgtgctgctccagccgggcgccgccgcgccggccctaccttctccgggctctccccctcccagggggccaggactgcccccgcccccgcctctgcctgctactacttgcttgctagggccagtgccagccggccaggtcgctggttttgtcatggactctaacatgaaggagcttcaagaggctctggttgacattgaaactgatgcagagcaacttcttctagctaggacatgagcttgtgcaaaatgacaaggatgaggaatgctaacaggggagggcgttgacaagcccctccgggaaaangaagccaaggacaacccaaaaagtagtggttccatctccctttgacatcgtaatgaaagaaatggaaggaacctcaggcaagcagctggtaaaggagatatgctcgacttgtggaaaccacgaccccaaggaacatacctggctaatgtttccaggatcagatatatttgcccgtgttccatttcatgcaacacacactattc

SEQ ID NO: 11985 - DNA, 590 bp, Triticum aestivum
  Clone ID: PAT_TA_11985
ggtctggtgccagcagccgcggtaattccagctccaatagcgtatatttaagttgttgcagttaaaaagctcgtagttggaccttgggccgggtcggccggtccgcctcacggcgagcaccgacctactcgacccttcggccggcatcgcgctcctagccttaattggccgggtcgtgtttccggcatcgttactttgaagaaattagagtgctcaaagcaagccatcgctctggatacattagcatgggataacatcataggattccggtcctattgtgttggccttcgggatcggagtaatgattaatagggacagtcgggggcattcgtatttcatagtcagaggtgaaattcttggatttatgaaagacgaacaactgcgaaagcatttgccaaggatgttttcattaatcaagtgaagcagcccatgagaccgttcgaccgacgagaggtaaggtaaggtaagagtagcagcaagatgagaaccagattcagccagagctggtcagtgatcagagtagtagtctagtagaggttgctgatgatgagtagcagaaatctgagctagcttctagggttactaaggat

SEQ ID NO: 11986 - DNA, 840 bp, Triticum aestivum
  Clone ID: PAT_TA_11986
cgtccgcggacgcgtgggcggcggcaagggcagcggcggcctcgggtggcaggacaacggcagcggtaatgcggcgccggcgacaggcggcggggtggtgagggcggcggcgacgccggggtcggcgtggtgcgtggcgaacgcgatggcgggcgaggcgcggctgcaggcggcgctggactacgcgtgcgggccgggcgacgcggactgcaagggcatccagcccggcgcggcgtgcttcgagcccaacaccatggtcgcccacgcgtcctacgccttcaacgactactaccagcgcaagggccgctccatcggcacctgcgacttcgccggcgccgcctacgtcgtcaaccaagcaccaaagatgggcaagtgcgagctcccctccacggtctgagacaaggcaacagtggccaaagggagaggaggtggaaatatctatgcaccgaaggtcggccaaagcgcagggaaagaggggaggaatgctggacatctctgccccttttctttggtctttgcccgctgcaggcgtacgtagaacattggtggtagtgctgtagccggccggctgtgcgcctttctgcagccttggttcatgggggatatctttgtttaaccgctagtagtctctgtaactatgcttttactgtaagcttggattacttactagtaatatagattaattctaagtataatactaaaaacggcagctttgtttaaatgctagtagtctctgtaactatgcttttactctaagcttggattattacttactagtatagattaattctaagtataataatagccctttgtgcccccaaaaaaaaaaaaaaaaaaaaa

SEQ ID NO: 11987 - DNA, 695 bp, Triticum aestivum
  Clone ID: PAT_TA_11987
cgtccgcccacgcgtccggtacgctctctcctatctctcttcctccccatggtctcctcctccccagggaaaacaaatcaatatctctcaaattggagcaagcaaaatagggaactgatggttgggggattgatctggtgcgctcacgccatggaatctctcctatctctctgcctccccccatggaaaaaagaaaaatctctctcaaattggagaaaccaagttggggaatagatcagatcgcaacatggcactaccaagcctataacgctagcctataaattaactacatcctaacacaaacaatctcaacatcaaggaggctcctgtcggtcgtgaacatcatcgctggtgaagtttctcctgttcggtatgaaagcttcatcgttgcccagtttttcagagattatttgtttcgttggttaattcaaaattttaggctattcacttcatattgcttatgaacttcacaatgggcaagacaaaatctttcttcgcaagtgaagccttggatttgccagagactaagaaattactaagcaacaaatttgtgttttcttacaattcaaattactttttgttgctttctggcccagttctgagagagattatttgtttcattggttcaatcaaattgttaggctctggacttcatactacatgcaaattgcatggccaccaatatgtaatcttct

SEQ ID NO: 11988 - DNA, 579 bp, Triticum aestivum
  unsure (1)..(579): unsure at all n locations
  Clone ID: PAT_TA_11988
tccccggccgcccgtggcagcgcgggctggcggcgaggggccggccctggggatcggtggggtggttccgggcggaggctcttcccggcggtgccggcggaccgccgcggagggagcccatggcgcctccttacaatgtcctcatcaccggttccaccaaaggtataggtatacgcgctggcaaggnaagttcctcaaggctggtgataatgttgtaatatgctcaagatcagctgaaagggtagaatctgtagccaatgacctgaaaaaggaattcggagagcaacatgtgtgggggactgtctgtgatgttagagaaggcaaggatgtgaaggcgcttgtggattttgcgcgtgacaagccggagtatattgatatttggatcaacaacgccggctcaaatgcatatagttacaaaccattggtggaaacctctgatgaggctctaattgaggtgatcaccactaacactcttggattgatgctatgttgtcgtgaggcaataaatatgatgtggaaccaacctcgaggtggtcacatatttaacattgatggtgctggctctgatggaaggccnac

SEQ ID NO: 11989 - DNA, 1110 bp, Triticum aestivum
  unsure (1)..(1110): unsure at all n locations
  Clone ID: PAT_TA_11989
ccatggnagcaaggnagcgcacgagcatcgaggctctcatccgacggcttaggctccaccaggcgcctccctccccttactccggcgatccctccacagcggcgacccccgccgcagccaacctgtttcagccgcggagagccgccgtgctggtctgcctcttccacgacgctgccggcgagctgcgtgtcctcctcaccaagcgcgcttcctcactctccacccactccggggaggttgcattgcccggaggaaaggcagaggagggtgatgctgatgatgcagcaacggcattaagggaggcaaaggaggagattgggcttgatccaaccttggtcactgtcgtctcctcgcttgagcacttcttgtccaagcatcttctggtagttgttcctgttgttggcatactctcagatatacaggctttcaaacctgtccttaatgttgatgaggtggacgacatttttgatgtacccctagagatgttcctcaaggatgagcgcaggagatccgaggagcgagaatggatggggcaggcgttcacacttcaccactttgattatgagaaaggcgacaagacgtatgtaatctggggtctgactgccggcatcttgattcatgcggcttcagttgtataccagcggccaccagactttgcggagcgaagagtacaattcaacctgccgaagtgctcaaaggagccttctccaatgccatgatcaggattaggatgcatgctcagttacgtacctgattcagcctacagaagactacatacaccacaaatggtatagaatttaaaaggtttccaaatcatgtgctgttcttcgatgcgccacgtccccgcgatttatgtgaagcgcgacgctctggtggttcagcaacgacgatgatcgtggaggccgtgccacatcaagcaacggattacggcgcatttgatggtgtgcagcttgccacacacagcgactaaatattgaacgttcgacaaacatatttcttgactattctttgcataatagtccagtataagaacattaaacattcagaaaatcgtttggtgatagcctgagtgcactccaatcattgctccaaaaaaaaaaaaaaaaaaaa

SEQ ID NO: 11990 - DNA, 783 bp, Triticum aestivum
  Clone ID: PAT_TA_11990
ccaccggtggtttctacgcgagacgccggcgatgacctcgaccgccgccgccgcctccgccgccgccgccattaactacgtctcgtcatatgctctctccccgcacgccgctcccttcaaccccccctcccgaccggcttgcgcccctttccagtaccgccaaaatggtgatgtttctaggtcggcgggtgctagctctgtgggttatgccgaagagaagacatcaagagatactcactcagcgtcaccaattgcatgtgccttgatgaaatcaagtggtgccgtttatccaccctctacacatgccatgcacactgggcagccaagttcatggtcagcagtttgcctggatgcatatccctcctcaccatatgtcaggataacatccaattataagcagcaaaattccttgacctcaggaaatgggagcaaatgttcaacagtgaggatagaaaggccaccaaataaaacatcagaaactaacaaaaacagttgtggttctggaagcaagttggttatagcagaaaatcctaagtctaataaagacagtgaaaaagaaacatcatcccgcagtttacaattcaatggtcctgctgatggcaaggacaattcacaaggtaccatgttctcctcctcgggtcaaaaaaacatgttctcctccaaagaggcaaatcccgtcttcagtgcaagccctcttcatattccaactacttgtgctgatccatgtggtgttttggccgaggatgtgatgccagatccatcagaatgctctgttgattcacc

SEQ ID NO: 11991 - DNA, 1127 bp, Triticum aestivum
  unsure (1)..(1127): unsure at all n locations
  Clone ID: PAT_TA_11991
ctgcaggnaattcggcacgaggtctataagtgccaaccgtgcagttgcacgtcagacagaacatcatttcttccgaaaggaagatacgaagtctagcaatcctgcgcccccggtgcctttgctgcctgtcaaggttgaagtttcggagttagatgatcatcgtcccgtattgaaggccaatttacagttcgtcgtcccttctaccgctcagacaaggcttgtgagttgtttagataccataaatagtcttcttttgcagtttcaccattactactattttactactactttcatgtctgtatgctttagtatattgtggtataagacatccatccaccatactatacctagctatcttagtgctttcgaaggttgttatggaacatatgctaagatcgctgtatcacttgatgttgttcaaagctaaagttttaagcgtgcgtacaaagcttgtgagattgttgatgaagatggaaaatccattaagctgtgccgtgtaaccaccacatcagatctcatttctcagaatgttgttatgagtacatcttcatcctcgtgtagtagtcgtgtgttgaggtttatcaggtccttgtggtttcagtcttggcgccatttagctgcccctcaccaaccatttactatctatcaacatgttgcatcttcattgtaggagttacccgatccactctccaatgctgtcgggcgcaaagggaggctggaccagaacattgtaatgctgaaggatcctatgaagagattatggccggtgttctaccatgagacctccttattcgtgggcttcaccggtggctggaaatctttcgtcgcagcaaacaagcttgaggcaggggatctctgcgtgcttctgatggacctggatgaagatgagctagtgtacgatgttgagatcacccggaaatgaggccattgctctttgaggcagtgatcagcatcatcaaggaacatgcttctgttctgtgtggctggaaaacttttgacgaggatgtggtatacatctttgtgtggttcgaccctggaagacgctggctgctcggtgtattttgtaagactgacaaacatcctggaaatgtgaaactcaagcaagggacattttatttggnagaagt

SEQ ID NO: 11992 - DNA, 1479 bp, Triticum aestivum
  unsure (1)..(1479): unsure at all n locations
  Clone ID: PAT_TA_11992
gtttggcataactgttcgctgtccaacctgcatggtggctattgctgtcgcacagcctcagcatggnaactcaggtggtttcttgttcgaagtgccggtaccaatatgaactattttctggnagacgttacaagcatcgagtcagaagaagtgtgcatggatatgtcagcttttgagaaggccttgcaatttataaatgtgatgaaagatgatcttccagctgccgttcactctatcgtgatccgtacaccctcaggaacagcccgcacacatagatttgctaccaagactgtggaactgcctgctcaaggaggagaaagagtgaccatttccttggctgccccagccaatgcttatcgtcagatgggtcccctcaagatcgcggcacgctcaaaagggtttagtccaggagaacccatgtgcctcactaaccatgtcagtggagagatctcaaagttgctaagagtgccatcaaagaatgcgggaccattgtttcttagtccttatctagttgtcggtgctgttgctttgcttgcttctggagatgctgtttctgcattcattgatccaagtctccctagactaattacagcaactgtcattgcatcggctgctgtaggaacaacactaaatcaagtgatcctgccagagacacgaaagcttccgcaaaaggcggtagacatagttgctgtacagcagaaactcttatctcaatatgacatgcttcaaagtcgtcttaaggatctgaaacggcttgttgaaaaagagaattattccatcgaaggtgtggatgcttgcaagaatgtgtcagttggagaacaagatattagcagtaggcgaaccatcatatcgtgctcgacgtggtagagtgaagagggtacgaaaaagcttggaaactacgcttttggcaaagattgagctgatggaaagttacgcaaaattatgttctatgattgaaattgaagttgaaatggactctgatgttatcgttgctgaagcagcaaccggtgcagaaagaatatcagaacaaattgaacagttgatggagattgacagtcttgaagagcaatggcgtatacaagccgaggctaatgatgaagcagaaaggcttcttggttcagattctttggaagcattgtctgctgagcgtgtatgatgatattttggctggtcacagtgacttgtgaagacgatgattctgatacagaagacaaactgattactatgtagaaccatgtatcccccccataacatcgaagtgaatattgcaaagaacttgagatctctagcagacacttgacagtacagaccaggacaagcttatggatagaaacaagagagaattccttatttgacactctcttaaaatcatgttccttatttgacactgaaaaaaatttcttccctatatgacctatagtncttaatttctttccctatatgacattnctagttncatttgtacacgtgnaaaagacc

SEQ ID NO: 11993 - DNA, 1507 bp, Triticum aestivum
  Clone ID: PAT_TA_11993
attcggcacgaggaacgatcagttgctgaagctctgatgagcgcgggacaagttccccctgaccttcctagtcgaacggccatccagcaatatctgcagtcaaaaaaccgtttgctcatattgggtttcaattcaacattgaccgagccagttgaatcctctgggagacggggcggtgatcaaatcaaggagatggaactcaagttgcatcctgacttaaagggtcctttgagagccctctgcgaggacgagagcactacggttatcgttctcagcggaagcgacaggagtgttcttgatgaaaattttggagaatttaacttgtggctggcagcagagcatgggatgttcttacgcccaactgatggagaatggatgacaacaatgcctgagcatctgaacatggattgggtcgacagtgtaaagcatgtttttgagtacttcacagaaagaaccccaagatctcattttgaacatcgtgaaacatcatttgtgtggaactacaagtatgccgatgttgagtttgggaggctccaagcaagagatatgctgcagcacctgtggaccggtccaatctcaaatgcagctgtggatgttgttcaagggagccggtcagttgaagttcgctctgttggagtcacaaagggtgcggccattgatcgtattctaggggagattgttcacagcaaaagcatggttactccgattgactatgtactatgtataggccacttcctaggaaaggacgaggacatctatgtgttcttcgaccctgaatacccttctgaaccaaaagtgaaaccggatggtgcgtcggtatccgtcgacaggaggcagaacgggcggccatccaacggccggagcaactcgaggaactcgcaggcgaggatacagaagcctcaggtcgcgccgccgcctccggagaggtcatcgtcctcgtccgaccacagcaccgcaaacaacaacagccaccacgactggcgcgaagggtcgtcggtgctggacctcaacggtgacaactacttctcgtgcgccgtcgggaggaagcgctccaacgcccgttacctgctcaactcgtcggaggacgtcgtctccttcctcaaggagatggccgagtcgacgacgccccgtgccggtggcctcccccccggcgccgccgctgattacatgttcttggataggcagtaagactaagtttgcctctgctaatcagcaatcacccggccgcccgccccgccccgcctgagaagaagagttgacagcagccctaaataacattggtgttccctgtacgcgcgccggagtagccgccgtggctggtccggcgcggcgtggtgtacaatcctgtacaaagtatgactgagctcctggttttactgttactgcgagaggagactgacgctctgtgactgagtgatcccgagagtttgtgttaggcggaattgatggatatttgttattatgtgatgtgaggactaatcccagcattgacggtctaaaaaaaaaa

SEQ ID NO: 11994 - DNA, 1063 bp, Triticum aestivum
  unsure (1)..(1063): unsure at all n locations
  Clone ID: PAT_TA_11994
ggnctgcaggnaattcggcacgaggcttcccccttttccccactccaccagcaacacaacagacgagcgcggcggcggcggcgtccagcggaggtcagcggcggcggcggcggcgcagattcttagccaggtgttcgtcgatctgcgagccggtttaagctgaattggccggtccaattcaacacggagccaagtctgtcgatgaggagttgctattcttcttcttctctctgtgggatttccagagcggcgtggaggcacgcggtggccggcaccctgactctgagcggcatccgcaaccaacaccaccaccagcacagtctgcgctacctgcccctcaggcctcccgtgccgcccattgcccttggccttgctgagcgtttcttctcttcctcctcacccaagcgctccaccaagagatccgcggcgaagaagggcacgccgccgccgatggactctgccggcggcgacccgttctatgtcgtccgcaagggggatgtcatcggcatctacaagaacctcgccgactgccaagctcaagtcagcaattcggtctgcgatccttctgtgactgtgtacaaaggctattctctccgcaaagacaccgaggagtatctcgcggcccgtgggttgaagaatgctctgtattccattaatgcagcagatgcaagagatgaattgtttgatgatctggctccctgccctttccagcaacctgatggaacctctactttgaaaaggccacangagacggaaaccggaccatcaaagaagcatcccaaagtcgctgaacaggagctattacctgatagtcatctatcctgcattcttgaatttgatggtgcatgcaaaggaaatcccgggaaatcatgcgccggtgtagtattaaggcgtcagatggatctgtgantgctcaactacgtnaggtttgggtattnaacgaataagctgcnaatatctgattgctctgggttanaatcgctatanggattaagatgtncgnctaagngatcaactgttgtacaagtcaaatcctggcntangatgtaatgctanttcagat

SEQ ID NO: 11995 - DNA, 385 bp, Triticum aestivum
  Clone ID: PAT_TA_11995
gggcaatactggatcgccgaatggtcaagaaaggcaacacttccatcatccaggttcgtgtacagtggtcatcgctctctccggattctgcaacctgggaggactacacggtgcttcgtcatcgatacccgacagcccgatgttgggatgatgccgcttccgctcaagggggggcaattgtcacacctgctcccacctgagcagtggaccatgagggagaaagggtctagtgtgagtttgggctgagcccagtgggccgtatgtggccagggtgcgtgtgtgcaatgggtgcatgtctgtattaaacacctggattgcgtgagacagggcagcgagagaaacactcattactctaaatctcatcccctttctcctaaaaaaaaaa

SEQ ID NO: 11996 - DNA, 718 bp, Triticum aestivum
  unsure (1)..(718): unsure at all n locations
  Clone ID: PAT_TA_11996
gcgcggcgcgcaagggtagacccaatcaaccgattccccctccccactccaccccgcgccgcagcgagagcgaactggtccctgcctaccactgccggccgcgtcgtcgtcgtcccctcccgcccgccccctcgtcgcccctcccttcccgcaatccctcccgccagctgctctcccgtccgagattgtgaacattccatatagtgcgttgcaagaaatcaaagctgcctaatcagttgcgcgcgataaaagcaacgtcagttctgtgaaaccctgcagttataagcccgtattaaatgggaacaaatgtgtcaataaggaaggaaatggtgtaccttgatgtgaacaattggatgtgattctgtatttgtagatatcgagtatatcgattctgagaatcacacagagcttccagatgttgacacaacgactgagtggtttgcttgcagagttggattcaaagaattgggtcaagtcatttgaagatcttaatacagttcgtcagttggcgatatagcacaagcaaagggtgccggagctgctggagcctctacttcctcttattgtgaaatctgttaagaatccaaggagtgctctatgcaaaaccgcacttatgacctgcgctgacatctttaaggcatacggtgaacaaatggtcgacttgattcatcagctgctaaaaaaaagcctttgtttgtaaacanttgggacctttagt

SEQ ID NO: 11997 - DNA, 835 bp, Triticum aestivum
  Clone ID: PAT_TA_11997
agcagggcgtggtgaccgagctggtgaagctctcgcagaagatggaggaggtgcgcaagctgggcgccgtggagctgctgcacgccatggcgctcgacgacgccgacgtgagggaggaggccatcggcatgggggtgatccagtcgctcctccagctgatatacccggacctccccctctcctacaaggcgcgcgaggtggccctcgccgccatctggttcttctgcttctcctcggcgagctccatcgacgacctgaccagctccgacgtgctgggctggctgctccactacctcaacaacgggcgactacgccgtgctcgactgcacgctcaagatcctccgccacctcgcggaggcctcggaggagtacagccggatgatggcccgggccgggtacttcgccgcgctcgccggcctgctcgccgcgaagtccttccgggtgcgcgagatggcggcgcaggtgctgtccagcctgctggcgctgcacgggaaccgggtcatcttcatgcaggacggcgacaacctggaccggctgctgcagctgctcaacccgtccgagggcaagctgatggccaaggggctcatcctctccgccgtcacgtcgctggccgagaccggcgccgggaggaagaagatcgtgtcgtcggagcacttcgggagcctcaaggagctcgccgactccggcgaccccgacgccaagaaggtcgtcaagaagatcgccaacagcagcaggctgcagtccatgttcagcaagatatggagcgcctaagttattccctgacacccatttcttacccagattcctttactaaacacccctttatttagcgtta

SEQ ID NO: 11998 - DNA, 965 bp, Triticum aestivum
  Clone ID: PAT_TA_11998
ataagtgtctacaggaacgaaagttgaggatgaactaaggatggtttgcaatgaaatattgtcaatcatcgctattcattgccttcccttggctaatgcgggtgaaaacgttgtgttctttcataaaatgaaaggtgactactaccgttacctggctgaatttagcactggggttgaaaagaagtctgctgctgaccaatcactcatggcctatcagcatgccatggttgttgcctccaccgagctttcgcctgctcatccaatcaggcttggccttgcgctcaatttctcagtgttcttttatgacataatgaactgtcatcagagagcttgccaagttgcaaaacaagcatttgatgaggctactactgagattaattccgctggtatggatggcaacaacgatagcacactaatgatgcagcttctgaacgacaacctagcattgtggaagtcagaactaactgaaggtgaaacctcgaaggatagcgacatcgatatggaggagggataactggaatgtgctgaaggctcccctgcatgcatgtgtgcaaaatgaccagaacataatggtaccaaacctgctggacactgttggtttttgtgacaatgcgctgatacaattttccgacattttagcagggataactggaatgtgcttcaaggctccctccctagcacgtatgtgtgtgaaataaccagaacatagtgctaccattgaaatcgccccaaagtgccttgcctactgtgcagcttgttagtagttctggggtcctcgcttggtgttttcctaggctttccacagtatggattggtaaccatgtgcccagctttgctcatgttttgagagcttggagcagtgaccatccatctttgatgcttttgtttctagttttcctccatgcgtattaagcgttgctgtatactggcgagctatatgtaactagtagtatctcagctatcaa

SEQ ID NO: 11999 - DNA, 400 bp, Triticum aestivum
  unsure (1)..(400): unsure at all n locations
  Clone ID: PAT_TA_11999
gtggccgtcctggcgtccgccggggctgcgctgctcgcgtcggtggcgtggcagccttcatcggccgagtctccggctgctggcctggcgtcgccaggagtccactgggggggcttctgctcgcccggcctcccgcgccgcctctcccccctgccgccgacccgctcccccgcactgtcagtgctgctgccagcgccgcttgcgtcctccccccggccggcccgggagctcggcgcaaccgtcgtgggcatgcgacccgccgctcgtcgcttcctttnggaacatcggctctccttttattttttggttattattagttcatattttgagcccggtagccccctccccctcgctcaccttcccctggtgaacgcagtgcagcgcaacgtgctatgctttt

SEQ ID NO: 12000 - DNA, 1366 bp, Triticum aestivum
  unsure (1)..(1366): unsure at all n locations
  Clone ID: PAT_TA_12000
gcgtccggggaggttgtcttgggtctaacaaggggccatgggatgatccttatatcttgaagctgatacacaatctcgaggctggttctgtgcgggatatcaagccagtttctgaaggcgaagaaagaagcgattcttctcttcgattggagcagttgaagtggcagggcatgatgagtgacacatcaaatgctgaatcaggatcagatgttgatgactttggatcctcagttattccgaaaggtgctgagtatggctgcctcactccagtccatgaggaaagttccctggaaacgtctcttgaaactggtaggagactgcggcgaactactgaaactgtgccaaaacaactagctgataaccggcaattttccaccaatggaagccctcgtgatttagggagcaatgttggcaacctggatggttcaatcgtccgatggggctttgaaaatcttgttaaagttgtgacagccttaatcaagctattctccttcttcaagcttttcatctctagtagagcactgcggaggcttgaaaacgccggtccatccacggtgccagtcccagctgcagagaagccgcagccccgaaccatcggtgctgatgagatgagtgcttgcttacagcgcattgaaaatcttgagtctgtgtgcaaccatcttgcaagcaagccaccagagatgcctgaggacaaggagcaacagttactgaactcgttcgagcgcatcagatccatcgaggccgacctggagaggaccaaaagagcactgcatgcgacggtggcaaagcagaattcgttggcggagactctggaagctgtacaggagtcgtcgagagtcaagaggaggctgttctgctcataggacgacctgacctgatctggtccgaggcaccgaccatgtcgactacattaacagtgaagctgccagcgccatttttgacctccccgtccggctcgagagaacggcgaaagagaagatagcatacgacgatgctcgtcgcttcctttcggaacatcagctctccttttattttttggttattagttcatattttgagcccggttgcccctccctcgctcccctttccctggtgaacgcagtgcagcgcaacgtgctatgttttttgttggccaaaagtgtattaagtctgtgcggctgcctttgcgttccactgggggcgggggcgggcgcgggaatgcaatccgtcgaggtttgactgacccgaaagaacagcgagcgacaggctttagcgctgaactgatgatgtctgtgtaaatggtaggggcactgccacctcctcatctgatgtgaactgaactggatgataggtattgtgatggggaagcagaggtccggnctccaag

SEQ ID NO: 12001 - DNA, 1486 bp, Triticum aestivum
  Clone ID: PAT_TA_12001
ccacgcgtccggagatggcacacaagacgggcaagcagaggaggcgcgccaaagcctcgctcctggactccgaggaggaggaggagcagaaactcagcagccagaacaaggatgagagcggcactgcactgtccgggaggcgcgagcgcaagaagagcaagtatctctcgccgccctacaccaacatcggcgtgtttgctctcgaggacaagtccccagatgattcgccaaagaagtcgccgcccgccagagctgctaacaaggatgagaggccgcgcgtccgggcgtcaccagaggagaagcagcagcacaagaagaagaccaaggtggtgccgccgccgcttccgctggacaatgtcaatgctcaggaggtcctgctgctgctgcgctgcttcggggaggacgtctctcacaagaggcacttccccaaggccgccgaggacttccttggcctgctcaggagctccgtgttcgccgagggtgctcaccatgactcctacaaggaccatgaatgcccggtggccaagaatgctgttgagaaagctgctgctgctgcagatgtcctggtttcagattcagctgctactccgaaacgcgccaggggtaggcgtgggagagggtggcagggccgggtcggctgcggtgactcctccgtcaagacgaagaaggcggagaagaccgcccccccggactgtgcagcggaggatgcttctgaggagaataagaaagaggagaatgtttctgacaagaagaagaggggcagaaagaagaaggagcaggagcaggatggaacctccccaaaaggctctgttatcaacaagaggaagaagatggacaaaacctccccaaaagcaactcttgggcctgcctctgcctccgcctctggctctggctctggcttggttatcacgcccgccattcctatcaggcaggtgcgtcccgcgcgtcccatgagccaagtcgaaccaggcatgggagctggggttcctgatcccaagatgaagaacagcttgttggtgtccaagagccctatttcagctacaatgtctggaggagtaaaatcaggagaggagcaggagcaaggggacggtggatccgttgtgaatgcttcatctgaccaatctgccaaaaagaatgaggaggaagcaacaaagccagcaactgatatgatgaatgtggacggagatgtgccccagattcaagttacagtgcctatgaatgtggatatgaatgtggatactactcttagccaagatgttgctgccaaacatcaggctgacgttaaaatgcctgaagctgctggtatgaatgcggatattcttaacgcagatgttcctgccgcaagtgcccacgcacaagtgatgactgtgcctgaaactggtggtattcagttattacatatgaatgtggaaagtgttgtagatgtgcctgacgtcacaagtgtcgagatggaagccatggagctggaagctagtattcctgtact

SEQ ID NO: 12002 - DNA, 659 bp, Triticum aestivum
  unsure (1)..(659): unsure at all n locations
  Clone ID: PAT_TA_12002
gcncgtcgtcggtcgtcccaatgctgtccgccggccgccgccgtctctgcctcttccccttccccttccctctccgccacttcactgcggccgcgtccaccaccaccaccaccacctccgacgctgccgctgccgaccccactgtgttctacctcgaatccacctgcgcgctctcccccgccgccgccgcccgcgctgcggactccatccgcctcgcctcccntggagtccaccgcgcaggccgacgccgtcctcgacctcctccgccggtatggcttcaccgacgccgagatatccaccaccgtccgcaagttccccatcgtcctggtctccgaccccgtcaagacactccagcccaagctcgacttcctcgcctccgtcggcatcaacgcgccgctcctccccaggctcgtctccctcagccccgttgtcctccaccggagcatccaggaccacctcgccccgctcttcgaatctctccgcgagctcctcggctccaatgcccgcgtcgtcaccgcgctccgccagatgccgttcgttgtccgctgcagccccaacagtaccctcaacctcgtgctccccgcactaagagatgtccacggcttgcccccggaggacgtctccaagctcgtcgccgtccannnntngcgtcatcatgc

SEQ ID NO: 12003 - DNA, 606 bp, Triticum aestivum
  Clone ID: PAT_TA_12003
aaacaaatgaatgcttcctacatcatctctgtggctagaaagcttggttgctccatcttcttgctgccagaggatataacggaggtcaaccagaagatgatgctgactttgacagcaagcatcatgtattggcatttgaaaaggccaacatcatattcactggaccctgacaacagtagtttgtgtgagacaagttctatctcaacttcagatgactccgcatctgaatcatcaattgatgatagcggaactagatagatgaaattgcatggtctgactgctacttcaggactcgagattctatattcttgattctttgctataaattggagagcagacgcattcaagaatgaaggggagaatggtgaaagagttttgtttgtttcatttgaggttctgtagtgtgcaaattgatttggtgagtaatgtacaacatcctgtaaatattgacacaggtagcaagtatatgtaacatcatatagtggcagttgtttattcaaaatccaaccacactgattagtttgttgagcaattttgctcaggcgacgtcggtgactcatgtagtaatttttggcaatgatttaaattgctatgtcaaaaaaaaaa

SEQ ID NO: 12004 - DNA, 530 bp, Triticum aestivum
  Clone ID: PAT_TA_12004
cgcggactccccctccagggaggaagcagctggcgaccacggcggcgcgcaagtccgccccagccaccggcggcgtcaagaagccccaccgtttccgccccggcaccgtcgccctccgggagatccgcaagtaccagaagagcacggagctgctcatccgcaagctccccttccagcgcctcgtccgggagatcgcccaggacttcaagaccgacctccgcttccagtcctccgccgtctccgcgctgcaggaggccgccgaggcgtacctggtggggatgttcgaggacatccagctcgcccgccgcatccgtggggagcgcgcctaggttcgtcgtggtcgccggtcatactgctgggtaccgtagtagctgttcttgtctcgtgatctggatgcgtgtcgggtgcttgtgtttgttggtgttgatatgttgtgtcgtctgttcctatggatcgtgatgttcgaatgaaatggcaatgcaagttcagttatcatttgatgctaattttgtcttccagtaaaaaaaaaa

SEQ ID NO: 12005 - DNA, 469 bp, Triticum aestivum
  Clone ID: PAT_TA_12005
aggaattcggacgagccaggagattcaggagagcatcgagtacgcgaaatcgggagcgcaggtgatcagccacaggaggctgctccacgctatcctgtgctacaatgcgcggatcctggaccggaggcctcaccaagatatgtgagtgaagggtgcgcttcaggcagtggcttttcgctcgcgttacgagagttttttgggttcagccccccacatgagctacgaggggggctgtcgaaagttgacgaatcacacactctactcacccgttaggctatagggtggtgtttgttgttgtttcggtgctggattgctcgtttaccagatttttagtacttgcgccagacggtagtttcgcggtacggaaggcgcttgttgtgaaatggtttaacctttttggcggtgactgaaacctctgttgggtagcatcatatgtttggaattggattgtcaactctgaaaaaaaaaa

SEQ ID NO: 12006 - DNA, 723 bp, Triticum aestivum
  Clone ID: PAT_TA_12006
taccggtccggaatttccgggtcgaccccgcgtccgccaggtgcttgctcttgaggacaacagcttctccggcgaggttcctgcagcccttggcggcctccggcggctccggcacgtcggtctgggtgggaactctttcgcaggccagattccggctgctttggggaacctctcctggctggaaacactgtcagtaccgaagaaccggctcactggtggcttgcccaatgagctcttcttgctgggcaacctgacagtcctggacctctctgacaacaagctcgccggtgagattcctcctgcaattggcagcctgcctgctctccagagtttgaatttgagcggcaatgctttctcaggccgcattccgtcgaccattggcagcctgctgaacctccgagttcttgatctctctggtcagaagaacctctcgggcaatctccccgcagagcttttcggtttgccacagctgcagcatgtgtcgctcgccgacaactcgttctccggcgatgtcccagaagggttcagcagtctgtggagtctgcggcacctcaacatctcagtcaattctttctcggggccaatcccggctacctatgggtacatggcatcactccaggtgctctcggcctcccacaaccgcatctccggcgaggtgcccgcagagctcgccaattgttccaacctcactgtgcttgacctcagcggcaaccatctgactgg

SEQ ID NO: 12007 - DNA, 715 bp, Triticum aestivum
  unsure (1)..(715): unsure at all n locations
  Clone ID: PAT_TA_12007
ttatcaccactgttggnaggaaaaagctagnagcaattatgtttctactttcatgcattatggttgtctattctgggaaggatagagtttacatatttcgtatgcctaaatagtgaaggttaaatggagttagtaagaccatatttgatgctgatcataagataccaacgggctccatgtaatcccaagtgcattgcacaacaattgtcattttgcaagatcttctagagggctatatgtcctacgctcctcttgatgacatatatgaggactcgcaaccctgagcctggaagacaaccgttgaggcggtggtcatggggcaacgatagtcgatagctactatcagaacataaacgtatggccctccttgttgcattgaaggattatcgtctattggatttgcagaaccagttaatgacaagatgatggcagtagcaatggagggtcgtggtttctgaatgctgagacttccagtttttaggatgggttatttagtatgaacaaatatgccaacattcattagtcgtactatttcttgaggtgatgccactgctacaggtatgacattatcattggaccttcaactatatttatattatgtatatgcttccagagagtacttttttctgtactatatactaaatgaaaaaaaaattcttttatgctaaaacatgacatggctaattagtaattgcactacattcctgataacttt

SEQ ID NO: 12008 - DNA, 631 bp, Triticum aestivum
  Clone ID: PAT_TA_12008
ggtctccttaacgtatcagcgcccctccttcttcccttcctacgctactactagctctcttccattgtggctgtggcccaatgacccacacccacccacccgagatctatcttctgctactagcttactactactacgagtttacctacgaagctctctcctaatgtagtacggtacctagcttactgtcgctgtaaatttctacttcttctagagtaagttctaaggagttcccatgttttgtgattcttcttttgttaacctgtctgtctctagtaggtttacaaaattgactcttacattttgaaacaaaaacagcatattccgatgcttcaagacaaatagtaatcctcattatcacagaagttttgatttcctgaacaaaagcataaatcattttttcacattcatgttggtttttggacctttgctgcaacttcctaaaccatggggttcttttctccgtatggcatgcatttgcattatttacaggctgaccacatttcgagtggccgagagtttgtaagaagcagtttagcggctttagccattttgttgcagctatataaggaggttcagtccacactcagtatgtacggtaacaaaggaaaattcataggttacacatata

SEQ ID NO: 12009 - DNA, 1096 bp, Triticum aestivum
  unsure (1)..(1096): unsure at all n locations
  Clone ID: PAT_TA_12009
gcggggggatgctcgacgcgcgctacaagctctggccctgcgtcttcgtgctctgcgacttcgggaggtacccacacagggtggccaacatcgacaaggacgtcatcgccccgtaccggcatgtcgtcgacaacttcttcaatgactccaccggctaccacgaccggccgaccttgctctacttccaaggcgccatttacaggaaaggtggtggtttcatccgacaggnaactttactatcttctcaaaggatgagaaagatgtgcacttctcatttggaagtgtggctggtaatgggattgaggaatcgacacggggtatgagggcatccaaattctgcctcaacattgcaggggatacgccatcctccaaccgtctattcgattccatagtcagtcactgtgtgcccgtcattatcagcgatgagattgaactcccatttgaagatatccttgactactccaagttctgcatcatagtgcgtggtgcagatgctgttaagaagggctttctgataaatctgatcaaagggataagcccagaagagtggacaagcatgtggaacaaactgagggaggtagaagggcactttgaataccagtacccatctcagcctgacgatgctgtccagatgatctggaagaccatagctcgaaaggtgccctcaattcggctgaaggtcaacagattacaaagattttcccggtctgaagctaacaaaacaaacgattctccagcaagatcttcctggctagaaaatcaagctcgttgattttggaccaacaaactctcccagctggttttcagtcctctgcaagaggagagtgcccatagggaagctgagcttgaacctcaaagccgggagcaacagctacaagagattaatggagtaaagtactcctgatacagtttatatcacaatattacagatccgaggacctgatttttgttctcctccaattttcgtcgaaaatgtgctcaaccgtgtagtttagggacaataactttttgtatcagaatctgtatatgctaggcagtagcgtaattactgatcatttccaatgctagtcttatactactcagaggtgtaactccc

SEQ ID NO: 12010 - DNA, 489 bp, Triticum aestivum
  Clone ID: PAT_TA_12010
ggtgctgatcaaatggagtgacctgccagcagacctcgcgacatgggaagaccccgtcaagctacagcagcagtatctagcatcaccgccttgggggcaaggcggtcctcaaggaggggagaatgtcacgactgacaagaggagccatgacagcgacgaggtagaaggcccagcggtcaggcgaatcagcgaatccaaaggagagaaagcacccacgactgggaccgggcagtcagcgagacgtgagtgaaggcctgagagccgtcgtgtgaggataagtatgggctgaggcttctgtatcaagggatcaagaattattgtaatctgaatcgataagtgagaagctgtccttctccttcctggcctccttcctctccaagtttcccccctcctactccttccctccttcctcgatctagatcggaccccttacagggtggtgaagcgagaagttggatcccctgtggcgaagcagcctcaaaaaaaaaa

SEQ ID NO: 12011 - DNA, 1454 bp, Triticum aestivum
  unsure (1)..(1454): unsure at all n locations
  Clone ID: PAT_TA_12011
gcacgaggctgctttgaaggatgatgtttggagattagagaaggttggcaaggatggtgcattccacaangaagttaaatggaagcggaatctatacagttgaagattttcttcggcttcttgttagggatcgacagaggttgcgaagtattcttggcagtggcatgtcaaataagatgtgggaaagccttgttgagcatgcaaagacttgtgtcttaggtggaaagcattatatttattatgtgaatgattcaagaaatgtcggtgcaatattcaataacatatatgagttcactggcttgattgctgatgatcagttcatttcagctgaaaatctcacggacaaccagaaggtctatgctgacacgttggtaaagaaagcatatgaggattggatgcatgctgtagaatatgatggtaaggcacttattggcttcaagcagaaaaagaaatctgtcacgaccagaagtgataccgcatcagcttcaacaagtaagcctgctttgtatggtttcgtcaatgcacaaaaacagttactgccaggaaaagctggccaaacttcaacagacactccgagtgaagctggagtaagaagcacatataatggaaatctggcagcaagaaacactgtgagtcctcaagaataacgctgcaaacattaccatgcaatatgagaggggtgcactgtcacctgaaagccagttcagtgggtcctcccttcagactcaaacttctgggaggctccaatattttggcattggaacctgcacagcagcagcaacagggttttgaattctcagcagttggtcagtccatgcagcctgcagacctggaccctttcgatcaatggtcacagccgcaagagaaccgtgcggttgatgactacttgatggaggagatcaggttgaggagccatgagatactcgagaatgacgaaatgcaacagatgctgcgaattttgaacatgggtggagcatctaccaacatgaatgatgatggcttcacttttccgccctacatgcagtcaccttccccgaacttcaactttgaggttgaccgcactcgtccacctgggaaagccgttgtgggttggcttaaaatcaaggcagctatgaggtggggcatcttcgtcaggaagaaagcggccgagcgaagagctcagctcgttgagctagatgatgactagcaacatgtcttaagttcttaaatgctgtccgtgtaattgtttaaggatccgtaacgcatgggctcagcaatgcaccatggaaagacattcaggtcatgagttcttaatcatggacgaactcctgtttagtttatgtttttctttttctgtatagtttcaccattgtctatgcatttgtttgtttagcgtgatgttgataagacccttttacctaaactgtgtacatttatttgttgctatctcagaaaaggcattaaagtaaaaaaaa

SEQ ID NO: 12012 - DNA, 624 bp, Triticum aestivum
  unsure (1)..(624): unsure at all n locations
  Clone ID: PAT_TA_12012
cgccactccaacctgctcgagaaccnggacgagatcttggccggcggccatggcggaggccgcaagagcaggagcgacgcctccccaccgcggcctcccggatgagatcttcatctgggagatcctcgtccgcctgccccccaaatccctcctccgctgccgcgccgtctgccgcggctggcgcagcgccacctacacacggggcttcctcctcgcccaccacgcccgccagccaaccctccccatcctctactgctacaagctcaagcgacgacgaggacgaggccgagtgcctggacatcatccccttcgatcaccggggcagggctccccgccgccgagcagatccagtccgccgcgcgacttgctcaagcctcccacctctttctggaggcctcctgtgacggcctcctcgtcgtctccgggaggcaagcgcgcaattcgctatctgcaaccccggtgactccgtcagtatgctccccctttccgctggcttttctgacnaaaccgttctttgggcaatgtacccttacccccctacaggggggtatagactactcacgtacccttgccggaagtcaactctgaccagtcaagttgactgctacgtctttgcactggggt

SEQ ID NO: 12013 - DNA, 707 bp, Triticum aestivum
  Clone ID: PAT_TA_12013
cgtccgcccacgcgtccgctcgacccaggtctagaccccactcgtccgcccagccccaaaagtttcctccccctctccggcggtcgcttcacgaaaaaggatttcgcgtcgccggcggcgacgagaccggaatctccggccccagcctccgctccccgcgcgcggaggtccatggagggcggcggcgaggtgggctggtacgtcctcggcccgagccaggagcacgtcggcccctacgcgctctcagagctgcgagatcattttgctaatgggtacctcaacgagagcacaatgctctgggcggaggggaggagtgaatggacgccactatcttctattccagagctgcattctggggtcacaaagaaggatcaacctgaacaagaaactgaagatgatttcgagaaattccagaaggaggttatagaagctgagtcagaggtggaagcgctgaaagcaaaggctgcagatggtgacttaagcaaagagcatgtcattgatgatcccgatgagcggccagcatccccaccagatggtgtggaagaatttactgatgatgacggcaccatctacaagtggggatcgtactctgagggcaatggttcctcaaaatgatgtatcggggtggaaatggacaacaatggagagaatgacatatcacgtaaaaaggatgactatgaactttgagacatgacttttgcactcga

SEQ ID NO: 12014 - DNA, 592 bp, Triticum aestivum
  Clone ID: PAT_TA_12014
ctgatgtctacaaacagtgcttacttcttctacaaacaaaagttgtgccacatgctcacccatgagaaccatctattcagctattatctaattaagcattgaacaatttgattatgatatgcactaatggtggtcttctaacggaatgacatttacagaaatttgcttggcgaagatctgggacactcgggtacattagacccacgaggcaacgcgacggaggccatgcactcaagtgggaggcggagctcgcctcccccaatgacgacggcttcgacctcaagtggaagtgggaggccaagtccaagccatgcgctgccggcaaggtcgaaaccaagtggggcgccgaggaagccaacaaggatgacaataatccggcaagaaagtgcgtccagatcaaggagatctccaccggctgcgacgtccaaatagaggtactcgacagaaatttgaaattgttgtgatgaaatatgggatttccagtgctccagtagctaaatgatgaaatgtgggagtagattcaagagaaagattgcagtaacttactccagtagcttagatggaacttcgctgttttggaatttccagtagc

SEQ ID NO: 12015 - DNA, 803 bp, Triticum aestivum
  Clone ID: PAT_TA_12015
cgtccgcccacgcgtccgcggcatcaccataaccacattaatggtccaagcatgaggtctccgccggatgacggccacccccgcccccctctctgcgcgcgcgtccaggtcgttgtttcttttggtgttaccctgcgttcaaagggatcaagatggtgcctttctttgggtctgcatttcgtctactacttctcccacccagcaggtgtgcttggtctgcagtgacgacctttgggccaacaacacatggacatttcacagataaactattgcatcaggcgcaacgcgacggaggccatgcactcaagtgggaggcggagctcgcctcccccaatgacgacggcttcgacctcaagtggaagtgggaggccaagtccaagccatgcgctgccggcaaggtcgaaaccaagtggggcgccgaggaagccaacaaggatgacaataatccggcaagaaagtgcgtccagatcaaggagatctccaccggctgcgacgtccaaatagaggtactcgacagaaatttgaaattgttgtgatgaaatatgggatttccagtgctccagtagctaaatgatgaaatgtgggagtagattcaagagaaagattgcagtaacttactccagtagcttagatggaacttcgctgttttggaatttccagtagcttaagtattgcagtagatttccaataaaatcttgcccgagtgatgtttgcttggttcctatgaatcttaatcttgaatgtgtgtctctgaatcttaatctgatgggtgctactatgaataaggttagttgttgttgatt

SEQ ID NO: 12016 - DNA, 1185 bp, Triticum aestivum
  Clone ID: PAT_TA_12016
ccccggcaccagcgtccgtccagatgtggatgcctcatcgcttagcacttctaatgccgagaagtccatacagccacagccatgcatggaaagcttagcacccagcggggcgctcccctgcttgccccgtgcaggggcatcatctccctgccacaacttcctgaatagatctgcaggagaggctcacactgggggagggctgaattgtggatgatcctatcccactaggattgcgtcatcaccacctacataattagtcccaggaaaaatataaagcataccaaggtatttgttgtccaggcatatgtcgcttccaagcccgtctcggcccgatcccacagtacttcttcccttcgttgtgccatctgctctaggggaaccgaggctctttgccgccgccggctgcacgctcgactggtgatcgtgtcttttgtcaaaggcctgaatggttcggtgggaaaattgttttaatcatgagacgcagatgaatcctggagcaggactctaccaagcctgacggtaccacgctacctccattggcgcctgaagttatctcacgccaagcgaggttctataccgcccttaacggttaacacttgctgctgccaggagacatggtcggtagcaatggcgaagcacaccagtagtatccccccctgcagtttgggagaaagaacgcaaagaagaccaccagagaaacggtcgtcccagacccagactgtcgactaccgatcgatatacccggatggcctggatggcccgagctgggcagcctttgatacgccgtgttaggcgcctaggtgttgccttcttgataaattcggctgccaccgaccggcacgagctcgcttcggcccctcctcttccccctaacggcctcctcctctgatcttgcagctactgcctcatcgataacctacaacaaaaaaggttcgtgttaggcggtccttctgaagtacatcgacaaggcagatggattatgccacttattagtatgcttagtgattatggctccgtagttggctctatttattatgttcatgttcttattacctccttttgtgtgttcttgcttttggtattgaacttcatgtcgaatggctatattttgttgtcgtatgaacacgccgagattgatcctgccttataaactgatgtttatcttataaaaaaacaaaaaaaaaa

SEQ ID NO: 12017 - DNA, 747 bp, Triticum aestivum
  Clone ID: PAT_TA_12017
ggaccttcaggagcttgtcttgataggggtcaaccccaccgtgcagagtctccggatgcttggtgagcactgccgcgcattggagcgtcttgcgctttgtggctgcgagactgtaggggataccgagatcatttgcctggcggagcggtgtgctgctctcaagaagctttgcatcaagggatgcccggtcacagaccgcgggatgggagcactcaatgggggttgccccagcttggtcaaggtgaagttgaagaggtgccgtggagtgtcgtatgaatgtgttgagcatctgaagatggccagggggggttccttctcgatcagcctggatattgtgttggagcatgatgcagtcgctccaagtgaaaatggtgtgcaagagactggacaacaagcacaggttacagagctaactggtcagatggctgccatggaccttcccactaatgctgctggtgcacaatcttttgctcaggcgaacagtaggatgcggagcgtcatgtcggcacttagaaggagattcggcaaccctccaccagcgtgatgtgggatggaaacctccatgaactcctttgctattgatcgtttctagtctcatgttcgtgttccttagcttgttacatttcatatccagtccatgcaaaacctccattatggataattccgtgttttactgtggagctaatagcatcatcagtagtctccccttgttcaaaaaaaaaaaaaaaaaaaaaaaaaaaaaaaaaa

SEQ ID NO: 12018 - DNA, 1263 bp, Triticum aestivum
  unsure (1)..(1263): unsure at all n locations
  Clone ID: PAT_TA_12018
aattcggcacgagggacgtatgtgcttgcgcctccccatcacgcgccggcgaccnctcgccagcgacgacccgaggtcaccgacgcggggacccaaggattcgttgccgccgttcagaactacttcgtcgacggcgtcaatgggggctttggccagagctcctggccttccgccgccgccgccgggttcgtcccccaggcatacatactgccgatcaggacgccgtcggatcctctgtcgccggtcctctccttcctctcacagttcatgtagcccctacttcctcccctgattgtccaggttagttcctgatttcgaattggttgtgtagttgtgctgcaggcacttcacggatgagattttctcatcctgttctcgcctcctcatgtggtgccacctcctcacgtcgtgcagcctccacacgcgaagccaccgagtcaggaatcggaagtgccagtctgtgcatcgtgttctcacgcgaagccctaggtcgtcttgctatcctgttgcaagaattcctacgcacaatattagtgttcatatcagtctgacatattcatgtgtatcttttcagtatccaaaattaaagaattcaagtgatacatatattgtttggaatttcgctgctatgccatgatcggttcaatttatccatcatttaatgttttcatttttctgttgtacagtagttccttctatggaattgtactaacaagattatatgcagctttgttaatgtccagaagcaagttgaggaatgattgttcattttacttgagaagaactatttcacatgttcaagaacaactgcaggagtatactttcataagcctttgtactgaatgcatgcatactcatcgattaatgttagatatgtagtatacagtgaagtataaatttacatcgccacaccagccagcaggagcggcatcaacagcagggtgtcgtagattgacctggaggttgtcccgaggggcatgacactgccagtgaagatgtagcaggtgaaggaggaggacgtggagacgaaggtggcggtgtgttagatggcagaggtggacaagatgaacaattggttcgagaggaggtggttgtcgcaacggattaacaagattgcggtggctcaagaagagcaaatacatctcttctgtttattttcacagtttcatctagaaatcgtccgccaaagtgtcgtgtgcatagtgtttccagtcagctttataagacgttataggtcacaactataagcttacagagagagta

SEQ ID NO: 12019 - DNA, 515 bp, Triticum aestivum
  Clone ID: PAT_TA_12019
cgtccgcccacgcgtccgcgctcgtccttggttctcctcatccctcctctgctccggctgctacgccgcctctccctccacaacgcgaccagctcgagctccacctcctccatctcaaggagacgacttcacaagacgtccggcgccgtcaccatcgtcctcggctcaagtgaagcacgggatgcttgctgcgtcgccgtcgtcctttctctcgctgcaaccaccaccccgaccgagccatccccgtgctctcgctgagccttcccctccgggctcactgacccaggtggcggagaaggagagggtgagctcgaggggcaggcaagggaggagggcgtgacggggtcggatctggtggcggcagattggagctcgagctcgaggcggagacaaggaaggtcggaaaatgaagagacgggatgaaggtgctcgaggcgaaggaccactcgtcggcgagttctagctggaggcggcgagatccctctcccaatctctcattctctcgattttttcac

SEQ ID NO: 12020 - DNA, 741 bp, Triticum aestivum
  Clone ID: PAT_TA_12020
tcgaatccttacaaaatgaactgtcatatattctttgaacacgccgtcgccgtcgcaaccagccgccttgggcgatgccgacgagctccaatggcttaacgccaccaacgcgcttcggtggatcgatccggcaccaggaaccgtgagcactaggcccacctaccccgccgccggcgccgcctcctcgcaagacccgaccatggttggacaagacaaagtttcatgtcattggggcaatcttatttacggcccagcaaggtgttctgcatccaacagctgttgtgaagactagaatgcagaggatttggcaccagtgcagttggagctctgctcaccgtctactgggtgaaccggggccctgccacttccgccacaaggactgggctagggtcgaggaggacagcaggagggcgctcttgctcgacgacacctccatcaagggacactatttgctaggatgcgcgctgctcttggagggggactgcgctctcaccgtcaaggaattcgacaaggtgtttgatcacttgaagtcctcaaattcaagggacaaatgtcagaggacatttgacagtttcttgccaaagcgaagtaccaagactgggaaaagcactctactcagcgagtttggaagatgcaaagtttaagggaagcatgtgaaaatgctctgccacgcctccaccttctccttcgcccttcaccaccgagccccctgatccatcacactcgccacgccctttgtgc

SEQ ID NO: 12021 - DNA, 696 bp, Triticum aestivum
  unsure (1)..(696): unsure at all n locations
  Clone ID: PAT_TA_12021
aacgccaaggtggatttagtgtctactacctacaagttcttgggttcgaccgcagttttcatcattgcctttgcatcgtgcttggggccgtatatcaaggattcggtggtgcatgatgccgccaaggaggttgatgaaagaatgacgcttcgcaagcagcaaggtgaaggtgttggcaagactgctactccaggagacgcggcacccacgaccaaggtccacacccagcctgatgctgctgctgcaccaacaggcggctcggcgtcggcggctcccggcgcaccggcaaccgtggaggtcaagaacagggctgcaccggcacccgaggatgtcaagaagaagggcgctgctacacccggagcaggctcggcgtctgtcaacaactgatcgagtcccccatactttcattcgatccgaagcaactcaagaagctgtcccgtcgctttggctgagttttggcaggctgtaatgcccacaaactggtgtcttgcttggtgtttcgtcttgtttgatgcacttgctattcgtggcaggaatgccccccagacttgctaaattcgaggcttttatgcccccaatcaatcattcgtggcagaaatgcccccgacatggaaactagtactactactgttaaattcgaggnctttaatgccccccagtccagtgagacttgttttgacctgatcaaaaaaaaaa

SEQ ID NO: 12022 - DNA, 849 bp, Triticum aestivum
  Clone ID: PAT_TA_12022
gctcttaagaaggtgttgcgaggcattctcaagtaccttggagttctatggttgtttgcgcaattgcgtgatattctgaaagatatattggggtcagttttgaaagataatgaaggtgcacttctgaatttggatcaagaacagccagcgttgcgcttctttgtgggtggttatgtctttgcagttagtgttcagcgagttcaactgcaccttcaagttcttaatgtgaagcggtttcaccaccagcaacagcaacagcaagctcctcagagcagtgctcagggagagctaacaccatctgagatacatgagatatgcgattacttcagtcagatgtgttgtctgtgaaccttatgatgcttctaggattgcttcttttatcatgttgcttactctgcccatttcagttatacaagaatttgtaaaactaattacatggaataaaagcttgtccgaggctcatggggacatcgctgctgcagagcgggcacgggctgaactttgtttggaaaagcatccaagatcagtttcagatgattatactgaaccttctttattatccaagagtaatattcagcatgacagagccaacaattcagtagattttaccctaacttttgtgcttgaccataatcttacaccacatgcgaggacatctggtggagctgcttggctaccattttgtgtttctctgagattaaggtacacctttggggatactagtcatatcgcataccttgcaatggatggcagccatggtggttggtcttgctggttgcaacacgaggattgggagaggtgtaagcagagtgttgttaaagcagtgaagaccgtgaatggatcgccagc

SEQ ID NO: 12023 - DNA, 414 bp, Triticum aestivum
  Clone ID: PAT_TA_12023
agccgagggaggaagatatggttcaacagcatggtcgctgcctacacggggtggaaggatgcccgtaacgatccagttaaggccgtcaccttcggcgacggctcgctcttgcctgccgatgtcatagaggcatgtggcaagatcctggaagaggaatgcgtcgcggtcccgtggcagcaaggtgacatccttctcatcgacaactgggccgtgctgcactctcggcggtcatttgagcccccgcggcgtgtgcttgcttcgctctgtaaatagcatgtaaatgtatatcatgagggacaaagccttgcttaagattgatccacacttctgtgtggtgtatgtaccatgtacgtaatctgatttgcacatacgaacctggaataattttgtgcagcataaaaaaaaaaaaaacat

SEQ ID NO: 12024 - DNA, 1323 bp, Triticum aestivum
  Clone ID: PAT_TA_12024
gtcacacacactggcagtctcccagaacagtcagccacagcccaaacatcgcgagccaaaccctgcacagcagatggcgcccgtggcgggcagcagcttcttccaggaagcgcggctgccggagcagcgggccgtcgagggcgtcgccttccccgcggtgctcgtcccggccggcgggcccccggggccgggggaggggagcctcgacgagttcctggcgaccgtgcggtcggagcgggcgtcccgggtggagccgctgctgcgggaggcaggggcggtgctgctgcgcgggttccccgcgcggacggcggcggacttcgacgccgccgtggaggcgttcgggtacgaggagcttccctacgtcggcggcgcggcgccccggaccaacgtggtggggcgggtgttcaccgccaacgagtcgccgcccgaccagaagatccccttccaccatgagatggcgcaggttccaacttttccggcgaaactcttcttcttctgtgaggtggaaccaaaaagtggtggagagacaccaatagtgctgagccactatgtgtacaagaggatgaaggaaaacttccctgaatttgtggagaaactggagaagcatggcctgatatacacaagggtattgggagacgaatcgaccgcggattgcaatccacatttctcactaaagataattccgtcgccgagaaaagggctgtgaaggtcgggatgaagctggaatggaccgacgacggggtcaaaacagagatgggtccgataccagcagtcaagtgggacgagagccgagggaggaagatatggttcaacagcatggtcgctgcctacacggggtggaaggatgcccgtaacgatccgagttagaaggccgcccctttcggcgacggctcgctcttgcctgccgatgtcatagaggcatgtggcaagatcctggaagaggaatgcgtccgcggtcccgtggcagcaaggtgacatccttctcatcgacaactgggccgtgctgcactctcggcggtcatttgagcccccgcacggtgtgcctttttcgcctctgtaaatagcatgtaaatgtatatcatgagggataaaactttgcttaccattgatcaacacaagtgtgtggtgtatgtacattagagacgatgctttgctcgggatcgatccgcacttctgcggggtgtatgtaccatgtacgtgatcggatttgcacatacaaaactggaataattttgtgcagcaggacaggaagaatcattgtgttgttcttgcttgtttgcaacctgtaacatatgaagtccggaaaaaaaaaaaaaaaaaaaa

SEQ ID NO: 12025 - DNA, 1061 bp, Triticum aestivum
  unsure (1)..(1061): unsure at all n locations
  Clone ID: PAT_TA_12025
ctctgctctttcttcctcctcctcgttgccgcagccgcagccgcctccgcccgccttcgccgtgcgctacggccggcgtatgggacccgcaggccggctgtccgtggcggccgctctcctctcctgcctatgtttacatgggctgttggggaattccgggcaggcatttgctcagggcccgccggtgctccaccggatcgaccacgccgaggaagatgacgacagcggcggcctcatgccggagctctcgcccaccggctccccccagcccttcgtccccttcctcgcgcctgcccctctcgcgcccttctacaacaactctacgcccaagttgtcaggcaaatgctcactgaacttcactgccatcaatggcctgatgaccaccacggccgtcgattgcttcgcctcattcgctccgttcctcgccaatgtcatctgctgtccccagctccaggccactctcaccatcctcataggacagtccagcaagcagacggggtccctcgctttggatcccactcttgccaactactgtctctctgacgtccagcagctgctcatgagccagggcgcgagtgatgatctccgcagcatttgctccgtccacctctccaatgccaccgaggggtcgtgccccgttagcaccgttgatgcgtttgagagcgtcgtcgactcatcaaagctcctcgaggcctgccggaaggtcgatcctgttaacgagtgctgcagccagacatgccagagtgctataagtgatgctgcccgcaaaatctcttccaaggacgctgcgttgacaagcgacactgccagtcccaaagttgacagttgcaggaacgttgtacttagatggttatccagcaggcttgagccatcatccgcaaccaaaatgctcaggcagatatcaaactgtaatgtcaatggagtttgcccacttagcttcccagacacaattaaggttgcaaaaggtgttgtggacagttaaaacattacgtagctgcaaggcatgacantacnttctcactncaaaacangttcatacaaattgaagcttgaattgtgcn

SEQ ID NO: 12026 - DNA, 670 bp, Triticum aestivum
  Clone ID: PAT_TA_12026
ccacgcgtccgcaccaccacagtgacccccccggaccacaccacacccagtgccgcttcttcccactccccagctcacatcctccgtctcccccaccgctaatcgtcggtacctctgttccccgagctcctcttcttcctcgagtcccgacctaccaatcccaacccaacgcggctctaccgcccgccgccgcgccgtagcagcctagcgtcgccgccgtcctcctcgccgcaagatcgcgctcctgctgtctccgccccgctgagggtttgagggttggttggttgggttctctccgattgtaaagatgcataccgtatttcctcattcatgacctctggaatatgctctagtcacccttgtatgctccaccaggtggtgacaaatgggctattttctcagaaatcagcccagtttcctctttattctgatcatcctgcactttggggcccgtgcagcaagagcgctaagttcagatggtgaagcacttctcgcctttaagaaggcaatcacaaattcagatgggatctttctaaattggcacgaacaagacgcggatccctgcaactggaagggtgttaaatgcgatggtcacagcaagagagtgatttatctgattctcccatatcacaagttagtcgggcccataccaccagaagttggaaggcta

SEQ ID NO: 12027 - DNA, 776 bp, Triticum aestivum
  unsure (1)..(776): unsure at all n locations
  Clone ID: PAT_TA_12027
gccgcgatcncagcaagctcagagctcctcaccccacccaggcacccaccatggccgggatataccgtcccgagccgcagaaccccaccgcgcgccgccagcgcctcgtatcaatcctcctcggcgccttcttcgccttccagctcctcctcttcgtcgcctttcgctcctcgccgccctccaagcccgccccgaccgcatccgcaatctcctcttccgtaccggagccgcccagccgcggcaccgaggactccgggtgcgggggtgggctcgtgtacgtctacgacctccccgccgtcttcaacgaggatctgctcgccatgtgtgatacgctgatgccgatgtactcggtttgcccctacctcgctaacgacgggctcgggttcccggcggaagggaccagcttgtcgaccgcgtaccttcagtaccactggtatctgccaactgaagacggccaagaaggggagtggtctgtcttcattgatcgcgacgagctgcgcgccggtaatgtgaccgtgcgcggcgtgctggcggccatcccagaggcgcgggtgcggcagatgaaggagcgcgtggtggagatgataccgcggttggtttactccgccgcggacaaggatgggctcggcggcggcatgaaggacgccatggacgtcatgatcgacggcatgctgcggcgggtcgctgagcagcggcggaattgaggaggacgtattttgtcactggagaggaccaaactgtcaaaatatcattcttttgctttcttgttcagattc

SEQ ID NO: 12028 - DNA, 496 bp, Triticum aestivum
  unsure (1)..(496): unsure at all n locations
  Clone ID: PAT_TA_12028
gcttagatgatatgtatcgagatggattatggatgtgatgcataggacgtccattaatttttaggaattgtaggcaccagggaattgctagctagcgagctacctgccatttgtatttgattagcagcatgcatgttagaatgtgtgtaattgagtggtcaatctattcaatgacgtatccaccgcaaattaaatattgggacatgtttatcacgtgctaggattcttaagccatgtctaacaagaagcaactattctccttgcatgaaaacatgttggcccaagaaaaacaaacattagttagagcttctatcttgcaaagcgaaatattatctggtggatgcagtattagacatatatcaggatgatgcattagagtcaatattaaataaaaagaggtacccgctcattaactatgattttttagatggcctaaagtatgaagatgattgagtaaaactttgcagttttgtagatttgttgtgcnnaaaaaaaa

SEQ ID NO: 12029 - DNA, 678 bp, Triticum aestivum
  Clone ID: PAT_TA_12029
cgtccgtataaacttgtccacggaaggcagccggcgagagagaggagagaaaggaaagggagccgaagaaagctctccccccctccccaaatttcaccttatttcttctgcccctctcctcgcctcgcccggaccccggccggcggattcccccgcaggaggaggaggaggaggaggaggtggggatggggagggaggacaggttcccggtctgggaggccgcgctcggcgccggggtcgccgccgtcttcgccgcgggcctcgtcggggtctacctctccatgccggactccgactacagcttcctcaagttgccccgcaacctccacgaactacaaatcctcactggccatcttgagaactataccagtgactacaccgtacaggtgttgataggctactgtgctgtgtacattttcatgcagaccttcatgatcccagcgacaatattcatgtcattgcttgctggtgctctattcgggcaactccggggtgtggctctggttgtctttgctgcctcagctggtgcttcttcatgctttttcctgtcgaagctgattggaaaaccgctggtgttcgtgctgtggccagacaagctcacattcttccagcagcaggttgccaaaagaagagaaaagctgctgaattacatgcttttcctcagggtcaccccaacac

SEQ ID NO: 12030 - DNA, 1465 bp, Triticum aestivum
  unsure (1)..(1465): unsure at all n locations
  Clone ID: PAT_TA_12030
tcggcacgaggagagcgtgcgccaaggcatgaaagggagccgaggaaagctctccccccctccccaaatttcatcttcgttcttccgctcctctcctcgcctcgcctcgcctcgcccggaccccggccggattctcgtcaaggaggaggaggaggaggagggggaggggatggggagggaggacaggttcccggtctgggaggccgcgctcggcgccggggtcgccgccgtcttcgccgcgggcctggtcggggtctacctctacatgccggactccgactacagcttcctcaacttgccccgcaacctccacgaactccaaatcctcactggccatcttgagaactataccagtgactacaccgtacaggtgttgataggttaaggtgctgtgtacattttcatgcagaccttcatgatcccagggacaatattcatgtcattgcttgctggtgctctgttcgggcaactccggggtgtggctctggttgtctttgctgcctctgctgctgcttcttcatgctttttcctgtccaagatgattggaaaaccgaaggtgttcgtgctgtggccagacaagctcacattcatatttttgcagaagcacgtagcaaaaagaaaacaaatgaagttgaattacatgcttttcctcagggtcaccccaacattgccatttaccttcatcaccttggcatcgctcgatgtgcccgtcccttcccattccttcttaactcttatcggtctcatcccagcagcagacgccaccgtgagggttagggctgctcttgcagtgcgagcaccgctcagccacctgtatgacacccagtcagtagccctgcttttcttgatcggcgtggtctcggtcacaccagcattgttgagcaaggacgaggcgcaagacacggcaccagaaatcgcagcaggcgcctcatgaacaccaaagaggagtcacctagcccacctgtacataccaaggcacagcatgcggcggcttcattggatttgggccatacaggccttgtgaggtggatgacacatggtttgcgagttcacatgacgacacagcagcacggcgggaccttggaccccaagtccgcccatcacccgcctgccggagatgtgcgttgccgtgagaacactgtttcatttcatggccaccccccacattgtttgttatgaatgaatctgggaagcacaatgcccatccacaggcaagatgcttcggatgtgtagacaagtagtgtgtgtgccgttcgtcagcctgcgatgctgtttatttagatggaactggcagctagtccaaatccttgtatatatattgaccagattcattcaatccatattcagtggttcaaaaacaatttgtctgttgcagtaccgttccctttctgcttctagtgtacttgatttttcgancaggnaactttcnattttcaaaagggggnccgtccaattccctangtgg

SEQ ID NO: 12031 - DNA, 1644 bp, Triticum aestivum
  Clone ID: PAT_TA_12031
ccgaattcgcggccgcgtcgacctcagaatccaacgtgaatccctcactcacaagcgcaacgccctcaagttgaggagagaaggaaagactgcggaagcagatgcggaattcgaattggccaagtcactagagagccaactggaagagtcagatagccagggttcgaactctggaggaaagtctgaagcaagtgacgcgtttgtggaagatcttattgatcctcaaatgatgtctgccctgaaatccatcggctggagcgcagctgacctgtccacgcaatctccgagccctcaacctttggtgaaagcagaggcaaggccaaccgtcgcagctacaagcaaggctcagacagagaaaagccagctcgaggaacagataaaggctgagaaactgaaggccctcaccttgaagcgcgaagggaagcaggcagaggctctggaggcccttcgctcagcaaagcgcctggagaagaagctggtctcacttagctaagtactccttcaccttccttacctcacaatttttgtttggtaagtcatcccagatgatagtttgtctaataagggtgtaatactgtaatgcatgtctgaattagtagcagaaggcttataacttgtgagccatgtgcgcagcatctttggccatgtgtgtatgtaaaagctgtagcaactgaagttgctggggcaacgattgttttcatgactccaaagtaattactgcatccgtgtaacaaatatttttagctcttttatatactgaacttaagttgatttatttgtataacatatagaacctcacaggagcaacagcggccgcagttgcgtgtggagaatcatttgagtgtgcacaccccaaggttgtcaacgtcgaatgtagaaaggctgatgaggaaattcataaaaaattgaagatcttgaaggcatgcggcataccttgggatcacattagcatcagggccctcataatgttagatcttgttgttcgagatggtgactaccatcaagtttttgaagacgatgttgccctcttgaaatgtagtttatcttccagatggtagatttcattttactaggaagaatcttgaagtggttttcagtttgactgttgttcctagcctgatgtcagattgatggccaaattgcatgttctgagtttccagaaacctccccagttgctgccgccgttgacactgctcgcctatttttctcggaacagaaaacggtggtcggtcctgtgttggacattatccttgctatatcttctggatccaaagtagcttgtttgttgtttgatttccacttagttgaactcactcaaattaacttgtttgttgtttgatttccagttggtcggaacatacattgctatgctcactagttgtcagaaaatctttgctatgtttctgttatcggtattggagtcggggttgttcgtgtgccctgtttgaactgcttacttgtgcagagagtcatgcttcattcgattttagtacaagctgttttagatgttgggagtctcttggatgagatgttgctcgtgtttgtgagcacggaggggaacactctttggtggagaaaataaccgccataataacaaaaacataagggccttggtgtaaaaattcatcaccagagggttcaata

SEQ ID NO: 12032 - DNA, 877 bp, Triticum aestivum
  unsure (1)..(877): unsure at all n locations
  Clone ID: PAT_TA_12032
cgtccgcccacgcgtccggtttgtggccatgtagcgtgggggagttcattaaccgtcttcctagatttttaattcctgtcaacaattaactttgtttttccttgaatcacagtagacagtagatcaagaaacatgcaataggccttacttaccagatgggcacatccataaatacaactctttgagtgagcagcctgacattctacggccactttattctgcactgcaaccatctagttcgctggaagagataaggtactatgattctcgtctgtctgaccaacaaatggcattgctccagtaccagagggagaatattcattatctgagtgaagaggtgcttaggttgcaagaaagcttaagtaagtaccatagaagtgttgctgccagcactcctcaggttgatcttactcatcttttggcatctcgtgatcaagaacttcgtgcactgtctgctgagcccacctgcagtccagagcaggactcacatacgctcagtttaattgggcagcgcatccccatcctctctcccctcctcgggccagttcggcactacgtcgcagagcggagcagggaaagaacgggcctgcgggactagggcaaacgagccagcagaggtgagagagcgctcgaggctgagagagtgtccaacatggaactgcagaagacccgcgcaaagctcagacgccaatcaaccagggagaaaatacctgacattcctcaatcagagagttcctccataggtgtgctctagcttatgtgattgtgtcagcagtttttgtgtaacaatccataggtgaactttgtggcgtcatgtgaagatttgannncttcaaccctcggagatcagttacgtacctcggccgcgaccacgtta

SEQ ID NO: 12033 - DNA, 645 bp, Triticum aestivum
  Clone ID: PAT_TA_12033
gcccctttaccacccccatcgtccccaaatgtcccaaccaagcaacaccaccacttcccgccgtttgccgtcgccgtcgccgtcgcggccgtgctagtcctgctctcaccgccgtctgccgccgacccgaacgacgagctttgcctgtcgagcctccaggagtccctctccctccgcaactggaccaagtcgttcttcaccgacccctgtgacggcttcatctccaagctccagggcgtcacctgcaacaacggccgcgtctacaagctctccctccccgggctctccctcgcaggctccatcccgccggagctctccaactgcaccaacctccagtcgctggacctgtcctccaacgcgctgtccggggccatcccgacggagctatccaagctgctcaacctggccgtgctcaacctctccgccaacgccctctccggtgccatcccgcgggagctcgcgagctgcgcctacctcaacgtcatagatctccacggcaaccagctctccgggcccatccccgacgagctgggcctcctcgtccgtctctccaccttcgacgtctcgtacaaccggctgtccggccccatccccgtgctcctcgcgaaccgcagcatcgccggcggcggcggggcggtagctgcg

SEQ ID NO: 12034 - DNA, 648 bp, Triticum aestivum
  Clone ID: PAT_TA_12034
taccggtccggaattttgggtcgacccacgcgtccggacgcacacacctcctccccatttcgctagggttccggcgatggcgaccccacgatccccgagtcctcgcggcgacgagctccttgactcagcgccgctgctcggcggcggtgggcggcgtcgtggcgcgctgcgccggccatcgctccgtgggacggcgcggctgctgcggcagggcggtcggcgggcgatgcgggagccgtccctgctcgtgcgggagactgcggcggagcagctagaggagcgccaggccgactgggcgtactcccgccctgtcgtggcactcgacctcctctggaacctcgccttcatcctcaccaccgccgtcgtgctcgtgctcagcggcgacgaaagcccgtctgtgccgctccgtatttgggtagccgggtatgccgttcagtgcgtcctgcacatggtctgtgttgccatggagtatcgtgtgcgtcacggccagcgtggcgggtcctctacggccgccgacgaggagaggggcactgatggatcatcctcgtccatagacgacgccggagagagcggtccccatggacgcactggcgacttcgtcagtgtagcaaaacatctggaatctgctaatacaatgttctcctttat

SEQ ID NO: 12035 - DNA, 1278 bp, Triticum aestivum
  Clone ID: PAT_TA_12035
ccacgcgtccgccgcgcggcgcggaccctgctcgcctcccgctcgtccctcctctcctcgcgcgcgctccacgccgccgcggcctcccccgccgcggccggccgctggggcaacgccccgccgccgccgccgacgccctgcccggggccgtcgtcccgggccgggatcgccggcgcggtctccttctccctgacgttcgccacggtggcggtggccgaggtgcaggccaaggagcggctgcccacggatctgctgccccggaacgtcgtgctctaccagtaccaggcgtgccccttctgcaacaaggtcagagctttcctagactatcatgatataccctacaaagttgtggaagttaatccactgagcaaaaaggaaatcaagtggtctgagtacaagaaggtcccgatattgacggtagatggtgaacatctggttgattctacagacataatcaatatattgcagcacaggatcagccctgatgatgaagttactaacgaagaggaaacaaaatggcgcaagtgggttgatgagcaccttgtgcatgtattgtcgcccaatatataccggacgacttcagaggctctagaatcttttgactacattgcaaagcatggtaacttcagtttcaccgagcggtttgctgtgaaggatgctggtgctgcagcaatgtacttcgtggccaagaagcttaagaagaaatacaacattactgatgagcgcgcctcgttgtatgatgctgccaacacatggacggaagccctgaacggaagaaattttcttggtggctccaagcctaacttggcagatcttgcagcgtttggtgtcctgagacctatcagatacctgcaatctggaaaagacatggttgagcatacccaaatcggcgagtggtaccagcggatggaagatgcagtcggagaaccatcgagaatcccagagggccagtaccaggagtagaagaaaaccaccactaatagaattttttgctcgttgaagccctcatttcaaatggatgaaatcgaatggaatgcgtgtctttcattaggcaatcaggttattcaaattttgccaaggttttagtagtatgcaataatgctgccgcacatatgaagttaaatacacggtttgacatgagaacatgcttcacgctgctgcttgagtgtacgcagtgattggttttggagtagggagaaatgagatttcctgcttctatccatctctcgcccagtgcctgcctttgaatgttgcccgggctattgaaattcctggttt

SEQ ID NO: 12036 - DNA, 525 bp, Triticum aestivum
  Clone ID: PAT_TA_12036
gctacggctcgtgtgtgtttacgggaggccaatgatgcatgcaacgggagtaagagtatgcaccagaccacggcgcgcaaagttccggcggccggccggcgcggtgggcgccatgattgattggatttgtctcgaatcatcatcgaataaagccaccacggaatagtggtggtggttaggttgtgcgtggggatacattgctgcatacgcatcccccctgtttcatttcattccattccattccattcatgctagcagctgagcagagcatagcagcagagtagatcatcacgttcacgtccagtctttttctacttgttttttactagccgagctgccttagttgtgtacagtacatgtacatgggcagtgtatgtatgtgtaattagcgttgtgtgcttcgtgtgtgtgtctgtgtttgtactgtacgtccgtaacttggactagtagagcacggctgaatgtactattatttgttcatcattcatgtatacgcattgagcggttggatctaaaaaaaaaaaa

SEQ ID NO: 12037 - DNA, 1257 bp, Triticum aestivum
  Clone ID: PAT_TA_12037
gcagcgcggtggccacgcacgccacctgctcatcgccgtgtgccccgtcctcgtgcgatacgctgtgtaccttcttcggcccgtctctttctctcctctcctgcaagctctccctcccattgtgatgctctcttccccgcactactaccagccggaggtggtcgggatccggccgaggaggggctgcgccgttcactccaagcgcgtcggtggctggagctcgacgagtggacgacggcgtcgcagggagaaaagcccaactctccacagcggagcagcagcagcacctcgtcctcgatgtcctctgctccgacgttgtcatcgccatgctctgctccgacgagtgccttgacatctgggtgatgcacttgcacgcgatcgatggtccactctgcagaattaggtgctgcctttttgcccatgaatttggtgattagtttggtgaggccagagattcctcaatccctgccccgcccctctgctgtgtgccagatgggctgctccggcaagcatgatgaggtactcaacgtggggatacggctggctgcttcttgggaggttccgagtggggtatcccatatctccacttttccagccgttcctttgcccagtgaaatgtagcagactgcttgatgcttgaaagctcttcccgcggatgtctcagttgcttaccttctagttccatgtttggccatgagatcaatgacaaaaaaattgcttccgtcctcagtaaagtagttctgaagcatagttctgtgttctgtcaaatgctgcgtgtagagtaagaaaataaaggtaacgtggtgctcatgacctttttattgtgtgccctgggagagtttgcaattcagtttatgagaaaatggaagtgcaagtacttgttcaatagcatcagtgccaacagaagtgcagttcagtttgcaattttttctgtggggcattctcgcttggctagattaaaacggatatgtcccagttttacagttagtttgactcactagcttggtaagccccagctgtagcatcggagataattgtactaccaggctaataccaacgccactctgctttggcttggcaaccaccagcggcggacaccgatggagaggtggagatggcgggctccctgcacacagcgagcggatcctcggcgacttgtcacggcagtcatcagatatgatcgacacaatgaaccacaagtgtagaccaaagtgttcccggtcactgttagctgtccgccgaagtttccaatagact

SEQ ID NO: 12038 - DNA, 606 bp, Triticum aestivum
  Clone ID: PAT_TA_12038
gcatggatgtagacggacgcggagatgaattggcggcgtcgcctcgccccgcttgcggcaagaagcggccgctttccccctcaactcctcagaacgacgttgcggactcgtccaagtccaccaccagcgacgaggacgacaacccctgggcgctcagcgacgacgaagaggaggatggataccacgggaagtaccgcccttttacagttgacgatttcccaagggttagcagtgatgatgatgagcagacagttgccgtgtataagaatccagagatttctacccgaggcccaagaccgcttaggagatttccagcatttaagccagaaagtcgacattcatgtgatatggagtatcaacttgccgatgaatctgaaatcagtttcagcaatgttgggaccgttgattgctcacataagggttattgcagatcgatggacatggtgcagttcattgatctcaaaatcgctggctatcagcatgcccggcctggatgtgccaaaatatttgggtttttcgcagcgcgggatcgggtcgaacctttgcgcaattatgtctataggcgtgaaattgagaattatgaagctgtaactgtgaagccaaaaa

SEQ ID NO: 12039 - DNA, 693 bp, Triticum aestivum
  Clone ID: PAT_TA_12039
tgcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggccgacttcggcctacgtgcggttcaaagctggaagcgtggagccggcccaccaccacaccttcggccacgacctggtggtgatcaagggcaagaagaaggtgtggaacttgaccaagaaggagagctatggcctggtcgatggggacttcctgttcacgcctgctggggacgtgcaccgtgtcaagtacttggaggacacagagttcttcatccgctgggatgggcactgggacattttccttgatgaagacctcgagaccgcacacaatgccatcgatgcacagctcggtgtggttgacagtgagaagtgaggaggtttgtgaaggttctatcttgtggttccacctttttttctccatcgatgcagagttcagtgtacaatgtttgttgctggtgctgtgcctgtactggttccggtgacatcttttcaaatatgtatgtttgctggatgctgtgccatgctttgtcgaataaaatggtgatactggttgtaatgctaccttgatatgtttatacaattacaa

SEQ ID NO: 12040 - DNA, 969 bp, Triticum aestivum
  unsure (1)..(969): unsure at all n locations
  Clone ID: PAT_TA_12040
ggctcaccgtgcccaancgcgccggtgcggcgccgtccccaccgacgagcatcgaggaaatcaagaagagtgaacccggtgcggccacggaggagaacgccaagccgacgccacccacagaggtcgatggcgccaagaagatgcccagggaggagggtgctgccaagctgacgccacaagcagaggtcgatggcgccaagaagatgtccaaggaggagggtgccgtcaagccgccgccgacgccagcctcccaccagctgccatccaaggacggcggggctggaaagaaggagaccaacggcgccaagcagccggccgctaccagggacgacggcggcgagaagaaggaagccgtcgttggcaccgagcccaaggagagcacgctcggtaagacgacacgtcaggtcgcggagcatgttcaccgcatggaggaggccaagaggcgcaagcaaattgagcatatgccggcgccggcggcgaagaaggaagaagaagtgaagcctaaggcaccccagccagcagctgctgcgatgacaccagagaagccggcgcccaaggcagaggttgccaacggcgagaaggccaaggcggcggttgaccgggagagcctagcggagagggtgagccagcgcggcgaggaagagagggccaaggctgctgccacggcggacaacgcggtggagatggcgaggaggaacaaggaggtggtcgccgtcggcgtcgccgccttctccatcggcttcctcgtctcccagaagctcttcaggaagtgagcagcgctgcatacgtaacatacacagacactgggtaaatatgtaccgaactaagctatttgtgtgatcagagtgtacagagacatgtaaagatatgtgtgcaagttaagtgtgtacatagagacaaccaaagctgactgaagattgatgtgcaacatacaccttcggattggngcttttattcacacacaaaaaa

SEQ ID NO: 12041 - DNA, 1028 bp, Triticum aestivum
  Clone ID: PAT_TA_12041
gcgtccggtgaaaggctggagaattctttcccggcgtaggtgtggaattctgtagttttgaacacagagttgtcttccaggaatctggagcgaatttctatgcaccaacccctgtatcattatcaaacgagcttgttaccgtgtgggatcctgaacttggacgaaccaacccatctgagcacagggaggtaaagcttgccaggagcttgactcgtggaataattgataaagatctgaaaccaagctcaaatgagcgaaagtcgcttcaaagaatcatcaaatgtcctcctacacggactatactaccagatgagaagcaattggtgtggaaattccgtttctctttgatgtctgagaagaaagctcttacaaaatttcttcgctcagtggattggggcgatagccaagaagctaaacaagctgttgaattgatgggaaagtgggaaacaattgatgtggctgatgcattagagcttctctcatcagattttaaaagcgaggaagtccgtgcttatgctgtgagcgtacttgaaagggctgatgatgaagaattgcaatgctacttactccagttagtgcaagctcttcgatttgaacgatcggacaagtcacgcctggcacactttcttgtaaaccgcgctttatcaaacattgaaattgctagtttccttcgctggtatgtggttgttgagctccatgatcatgcatatgcaaaacgatactacagtacgtatgacatgcttgaagatgaaatgatgaaaatggttgctagggaggatggcgatgaagatgggtttcgactgtggcagagtttatcacgccaaacggaactcactgctcaattatgttctattatgaaggatgtaagaaatacccgtggtaatgcagaaaagaaaatcgagaaactgagacagttgttatcaggagttcacagtgagcttacccactttgatgagccaattcgttcaccattagcacctacgcttctccttactggtgttgtgcctcaagagtcatctatattcaag

SEQ ID NO: 12042 - DNA, 1325 bp, Triticum aestivum
  Clone ID: PAT_TA_12042
cgtccgcggacgcgtgggcccagttctcccaggcccccgccgccccagtcctggccgccgcagtaaccgattcgattcgtcgagtcctcccctgctgcagggcaggtaaatgagggcggcgcggcagttcgtgaacgtggtgatgcgcacaggcaccacctactcggtgagccgcatcaagcctgaggagaagctcttctacgcatccgtggaggaagcgcgagccgcggcggcgcccaagaagaagattccggccctgtcgaggatgcccgcgcccaagctcaggctcgaggcgtacggcctggacgacatgcggctcgatttcctgcccttgtacgggcggggcggcggcggcggcggcggcgacagcagcagcgggatcctctccgtcgactcggcaggccacaccatcctctgcgacgcgagctcgggctgcgtccagcctgcccccagcctccgcgagcccaagggggacagccccatctcgttcaccatcgctcgcgccggcggccccgacccccgcgtcgccgtggctctgtacgtcatggacaggttccccaccggccgcagctcctgcagcttcgagtccctcgcctacggcgagaacagctgctgggagtggagccggctcccgccgccgccctatgtcaacgaccccggcctacgactgcaccgctatccactcctacacgctgctcaatgcaggctccaccatctgcatatcctcctccgggcgcagccccatcgggacctacccgctgggcgctgcccttctgcggcagggccgagcatgtccccgagcttgacaacctctggttcggcatggctgacagcagccccaacaacctgtgtgcgtcggacctctccagcctcgacggcggggctcccaggatgctacgcgagtggcaagtccttgccccgcccccgggctgcgtcctgagtggcggctccccgccccgcctcggggccggcaggttttgcatcaacaaagttttcgacattggggacgagggcaggacctagagtgacaagcaggctgctgtcatcaccggtgtggaggtggtacatgatgaaacagcccaactccagatgatcaagcacaagtcctgtgtcagctatgcaggcatccagtgtatcctttagatcaatagtgctcctcccatatgagttgttttcttctttctctaaccatgttcttagactgcagcagttcacagcaccatgtatattaaatttaattgtgctctgttccttcttatatgtatgatacagtttgctgttcaccgcaccatgtatattaaatttaattgcgctctgcaaaaaaa

SEQ ID NO: 12043 - DNA, 1003 bp, Triticum aestivum
  unsure (1)..(1003): unsure at all n locations
  Clone ID: PAT_TA_12043
ttcggacgaggggagggccgcgccgagtngacgtgtacagcttcggcgtggttctgctggaggtggtgtgcggcaggaagccgatgagcttcactgcgaccgatcaggaccagcaacaaaagaacggtggcgtgttccggctggttgagtgggtttgggggctgtacggccggggagccattctagagtccgccgacaagctgctgaatggtgacttagacgcagcagaggtggagagggtgctggtcgtcgggctgtggtgtgcacacccggacccgagcgcgcggccgaccatcagagaagccatggccaagctccactccaaggtcgacaagctgccggtgctcccctccaagatgccggtgccgacatatgctcagccaccgttcggcttggacatggacgacgggctgtcaacgttgctgacatcgtccaccagcaccagcgtcccaccgcacaccacttgtacgacaaccagttcttcggacggacgtggtagcacctcgacgaccagttaaaacaaggaaaaaaaaacttcgatttgttatcgggagtgttggattgatgatgtggtgatctctcgttgtcatatatagcaggcaggtggaacatggttccaagttactaactgtcaccggccggctctagttccatcacttgcataacggtaacttttgacgctgagatagaagaccgagaatggttggtgggcgagcatcaccaggaaacccactgcgcgtgtctataatcagaaaacctggtacagttttgattgtttgatagactgagcgataagacgatggagcgcttctcgatcttctgcagctcagttacggtttagatgggaccctgaagatttgcctcgtgccatggagcatgtttgatttaaaagagtgaaggaaatcgagcaagaagcttctggccatcatggtatggcaatgcaagaaaagcccaagcagacagcagacactggtttatcanaaaggctccaagatncaagggc

SEQ ID NO: 12044 - DNA, 1021 bp, Triticum aestivum
  unsure (1)..(1021): unsure at all n locations
  Clone ID: PAT_TA_12044
aggaattcggacgaggtcngaatgaaggattgacagactgagagctctttcttgattctatgggtggtggtgcatggccgttcttagttggtggagcgatttgtctggttaattccgttaacgaacgagacctcagcctgctaactagctatgcggagccatccctccgcagctagcttcttagagggactatcgccgtttaggcgacggaagtttgaggcaataacaggtctgtgatgcccttagatgttctgggccgcacgcgcgctctcttctccattgatggcgagcgggtgagcacccctttgcccccattgtgcatcctcatctgccggtgagcacacctgctagccgccaccgtagatccaacccccgttgtccccctccgtctgcttccttccccgacggtgacctcactcttcgacagaagaaaaatcgcccaccctctgctcctcgctactctcctctacatggctcaaggggtaggcgggagctccgatccatctcaggcaccgacgagatttgccgttcacctgcaattcattgttttgtgttttcctgaagataaaaaattcaaagtgcagatgtggtccgctgatgtttgcgcttgaggttcagtttatttatttttgcagggagatggtttccgcaatttggtgggatgccgtgttgcattatttttgcatttccctcgtcatgcagtttgggcagcgagccttcctccgtggcgcgtgcgtgtgtgcaatccgcggcgtgtgtgtggtgcgccgctcgtctactctcgcggcccgcgcccgcgcccgtgcgccgcatgcatgcccgctgggctcgtccgttcctgtgctcgtgctctgccatgaccccaggcgctctgcggctactggatagtggactgcgaaaggtgcggtgcggttgacgtaccgttgaagtttgcctgggtcgtcgctgcagtacggctaggtgtcgaaagttgtttattttttatttttcacgttttgagagaactgcagttcattattaa

SEQ ID NO: 12045 - DNA, 790 bp, Triticum aestivum
  Clone ID: PAT_TA_12045
cgacccacgcgtcccacgcgtccgccctcccgcccccgcccgacggggcggggccgggccaagcaaacgcgaagatacggaaacagcgaggctcgccgactagggtttgcgccgctcctctctcccgtccccgtcgacgccgaccaggcgccccgccgcgatgccgcagtccgtcctggtcgatcgcgcgaccagcgagtcgctcatcgggcccgactggtccctcaacctcgagatctgcgacatcctcaaccacgacccctcgcaagctaaagatgtagtcaagtctatcaagaagcggattggacacaagaactcaaagatccagctcctcgcactaacactgctggagacgctgattaaaaattgtggagattttgttcacatgcatgttgctgagagagatatactccatgaaatggtgaagattgttaagaaaaagcctgattatcatgtaaaagagaagatactcattttgattgacacctggcaagaagcttttggtggtgctcgtgcaagatacccacaatattatgcggcatatcaagaactgctgcgtgctggagccgtatttcctcaaaggtcagagagttctgtgccaatctatactccaccacaaactcaacctctacagaactaccctcctcctgctttacgtaatactgactatcggcaagaggcacctgaatcatcttcagtgccagaagtatctacactaagtgtgacagaaattcagaatgcaagtggcgtcatggatgttctctcagagatgttaaatgctattgatcct

SEQ ID NO: 12046 - DNA, 531 bp, Triticum aestivum
  unsure (1)..(531): unsure at all n locations
  Clone ID: PAT_TA_12046
gtggtgaaacactcagcaaattcagcatatggagtttgtacattacttttgtgttagctgttgcaagatttattagactgcaatgctcagacttgagaatgaggataccatatgagaatctcccatcttgcgacaggttgcttgacatctgtgaaggcatttatgctgcgcgggcagagggcgagttagaagtggaagaagttttatattggacattggtaaatgtttacaggtcaccgcacatgctgctcgagtacaccaagccagactaggcctccgattctgcaaaaggagcaactttgcaaatactaatcccagtattttacaagaggcttagctgataggtctttaactgatccatgaggagccacatcactcgaggccctctgtatttttggctttcaggctgcttagaacaataccatgtaaatagacctcgtagttctcgctaaatacagtacattttttctgatagcatgtacatttgataatgtatacgtcaaagtttgatagttgaagttnaaaaaaaaa

SEQ ID NO: 12047 - DNA, 1066 bp, Triticum aestivum
  unsure (1)..(1066): unsure at all n locations
  Clone ID: PAT_TA_12047
agcctgggcactccgagcaatcagaccatggacggcggcggcggcggcggcgggcggccagcgctccagcctgcggcggccggaggaggggcgtcgggcccggacgagccccgcgacgcgcgcgtggtacgggagctcctccgctccatggggctcggcgagggcgagtacgagccgcgcgtcgtgcaccagttcctcgacctcgcctaccgctacgccggggacgtgctcggcgacgcccaggtctacgccgaccacgccggcaagccccagctcgacgccgacgacgtccgcctcgccatccaggccaaggtcaacttctccttctcccagccgccgccccgcgaggttctactcgaagctggcacgcagccggaacaaaatcccgctgcccaagtccattgctccacccggctcgatttccactgccacctgagcaggacaccttgctgagccagaactaccaactcctacctgcattgaagccgccaactcagaccgaggaagcagaagatgaggaagagggcgccaacgcagacgcggccaacgctaacccaaactcctcgcaggatcagaggggcaacgagcagcagcagcagcagcctcagagccagagccagggccagagggtttctttccagctgaacgccgtggccgccgcagctgcaaagcgtccccgaatgacgattgatcagctgaacatgggctgactggctgttgtggatgttggctggtccctggtactctgtgtcattgctgttgtagatcgttggctggtccctgggatcgccctttctggccatcgccctcccatttcaccattcagattgttcaaaaaagtaataattcacccatgagaaacgctgatgcttcaggaaagggagcagcgttgcaaataagtgtatgttgtagccgtgcaccccaggttgattagtttctgtccattattgtcaacttggtttgttttgtagattatatttatttgtggaacttgaactgttccgttgctgtttctgaatataaaatcagtgttcctatttcctaaaaaaaaaaaanaaaaaaannt

SEQ ID NO: 12048 - DNA, 423 bp, Triticum aestivum
  Clone ID: PAT_TA_12048
gccggttcgtctacaacagcgacgacgagatcgtggagaggaaggaggtggagaacgcggcagcggagcacggcgcactgctgaggggcctgccggtgccggaggggaagcatctccggttccacgacgatgatgacgagaggagtaagcaggcctgcatgagttgatggtgatgggtatgggtttacgttgatgggatacagtagtgcggttgtcgctccctgacaccaaccaagcaacacattcttttggtttggactttggacaggctatcttttatgctttttttggatttgatttgttattgctggttccagttattctgagggcatcgatgttattgctggttcagttagtgcaacatatctcaagttgtactgaataattcaatgctctcattgtagttcatgctcaaaaaaaaaa

SEQ ID NO: 12049 - DNA, 737 bp, Triticum aestivum
  unsure (1)..(737): unsure at all n locations
  Clone ID: PAT_TA_12049
ccccgatgggcatgtcgttctgcgtgggggaccccgcctggtccccgaagctgcgcctcccccgggcctcctcgctgccctccgtcgcggcgcacccgggcaagatcggctgctcgcaggggttcacggggctctactccggcgccgccaacccgaacgtgcacgtcggcgccgtcgtgggcgggcccaaccagaacgaccagttcccggaccagcgcagcgactacgagcactcggagccggccacctacatcaacgcgccgctcgtcggcgccctcgcctacctcgcccactcctccggccagctctaaccgagccgcaggatctcggcggtcccgagatgagattcttcgttgccttgattgttccggcgatctaattgatggccgtgaagtgatccggagaacccgcaccagtgcaagcaaaacaagggcacgcccgcgctagtgggtcttgatttatccttcctactactcactggccactttaagcgttcccttgagtacaagtgctagaaagtactcttcgcccaactgtggttcatgtaggtcctgctgccgtcgttgttgcaactcgcaactcacttgtggaaatcaagtcttcctctcatgctgtagtcgaaaaaaaaaaaaaaaaaatactactacttacttctttaggtgttgagtacaagtgctaagtacgtacgcccaactgngttcatgtactgctgccgtcgttgttcaactcgcaactcg

SEQ ID NO: 12050 - DNA, 540 bp, Triticum aestivum
  unsure (1)..(540): unsure at all n locations
  Clone ID: PAT_TA_12050
ccgggctgaggctcngcgtgctgctccgacnaagcgtggagccggacggagcaaccaatctggatccctcaggccggtttctcgcaggaggcagcgcagggcggtggcgcggcacccggcggggtcacgggagcacaggtgcgcaagttagagcgattcgagaagcacaggctttggatttggagtcgtgcgcgcccccgttgacattttttctagctccgccactgcggtgtactagtggaatgcttacgagcaaatgaggaagagctgtggccttaactccggtcccgggcggcccttcaacgaccgccggtggctgctccccttcctcgcgagcctcctcgtgtcggtcaccctcttcctggccgccgcctgcggcctcttctcaccgccctatttggccggcgacgacgccttccttgtcgacgtcgtctcgttcaccgactgggacgatggaggctcaccgtcgcagcgagacagcggccagtcagtggaacccgangccaaggaccggctgctggatganacgacaaaccccga

SEQ ID NO: 12051 - DNA, 250 bp, Triticum aestivum
  Clone ID: PAT_TA_12051
tagcgtggtcgcggccgaggtatccgttcagggcttcaggctcagacgaggtgtgccgcctaaaataaagctcagatgagatgagcagtcatggtgcctatgcttgtgtgtgggtcgtgctatacggccaacagtatgtataatgctatcgtcgtgtcttggtcaatgtgttttctctctcgagaaaggctggtggtgcttgtactctgccatcctggtctggatgtacctgcccgggcggccgctcgaa

SEQ ID NO: 12052 - DNA, 567 bp, Triticum aestivum
  unsure (1)..(567): unsure at all n locations
  Clone ID: PAT_TA_12052
gagcattctaccaccgcaccgcacgagtgaagtgagagctttgcacgaaaagttcatcagcgaccatgaagggcaccaagctcgcggcgatcctcatcctccaggccgtcctggtcatgggagtcctctcacacgtgaacgccgactatttccccaagtgctgcaacaactgcaggtccttctccggggtcgacgtctgcgacgacgcccaccccaagtgccccaaagggtgctccggcgtgccgccgtgggtgtccgacagccccgaaatgtggcgctgcgccggattatgaatcccacccgttcngacggacctgncggtgggccctgccaagaagtactggatccggtcaatgccaagcatgatatttccccctaaaaatgaaataaaantccaagacgaatgacagctcatcntcctatgcgtgtgttgtgtggccaacaatagtttacaatatgcgtgtcttcntcnctgttttcccccccccaaaaantgngnttgctggttgtcaaatatccggaacccccgtgaataataagatggtccttgggnggaaaaaaaaaaaa

SEQ ID NO: 12053 - DNA, 432 bp, Triticum aestivum
  Clone ID: PAT_TA_12053
cgtccgtcccgatgccgcccaaatccaaggccgccgccgccgccgccgcggagccggtctccgtggaggacctcttcgcggcgctccaccgccacatcgaggccggcgagttcccccaggccgtcaaggtcgccgaccaagttctcgcggcgtctccgggcgacgaggacgcggtgcgatgcaaggttgtggcgcacatcaagtccgacgcgacggacaaggcgctcgcggccatccgcgccgccgagcgccttcccatcgatctcagttactacaaggcatactgctactacaggcaaaacaaattgcaagaagctctggatatattgaatggtcaagaagaaacagctgctgttctccagctggaatcccagatctattaccgattaagaagaatgaatgattgcatgagtagctatgagaagctccaga

SEQ ID NO: 12054 - DNA, 453 bp, Triticum aestivum
  unsure (1)..(453): unsure at all n locations
  Clone ID: PAT_TA_12054
actagttctagatcgcgagcgatctagaactagtcgttctgttgttccacaggtctccacgtgcaacaacagaactctcaatatcattgttcctggtgttgtagggcttcaggctcagacgtggtgtgccgtctaaaataaagctcagatgatgagccagcttgtcacagtgtttgtgcgtgcctgtggctccaccttgcataccgacaatatatacactgttgtcggtcgtcgttgtttcatcaccgtcattgttcttcgttttaatttcttcttcaagagttgtctgttgttgctcgcctctcaggtgcctgttgtatcatccgcgaataaaaacgtgtgttggttgtgtgtctcagcttaaaatgcctttggtcatgtcacgccattttcttagggacatggctttaattaaaaaaaaaaaaaaaaaaaaaaaaaaannnnnnnggggcg

SEQ ID NO: 12055 - DNA, 502 bp, Triticum aestivum
  Clone ID: PAT_TA_12055
gatgaaccatatttgcgagagcttcatgttgtaatgcgtactggaaagaattgttataagtattgtggaaccgggcgcagcatcaggcgcctgtgcttctagtaagttctacgctccaaaaaatttaagctattacatgacgatgacatcataaaagagccagcagctcattggggcagagaggaggatataatcagcaccggaagctacccatccttagctcatggcatagcttccctcagctcactcttgcagctcatgggacagggcgcagggtggaataagcaccagagaccattcttcgctcacgccatagcttccctcggctcactcttgcaccctttgcgcctatgcgtgtgtgtgtggccaacaaatatgtataccagtatgccgtgtcttcgtcgctgtgttttctctctcgagaaaaagttggtgttgcttgttggtcagatatcccggaatatcctccgtgaataagtaatgattgtgcgttggtggccat

SEQ ID NO: 12056 - DNA, 769 bp, Triticum aestivum
  unsure (1)..(769): unsure at all n locations
  Clone ID: PAT_TA_12056
atctcaccacaacaacagagagcattctaccaccgcaccgcacgagtgaagtgagagctttgcacgaaaagttcatcagcgaccatgaagggcaccaagctcgcggcgatcctcatcctccaggccgtcctggtcatgggagtcctctcacacgtgaacggtaagcagtgctcatgctcaatcgttctacctgtagttcgatcgatttgggcagtcatgtcttgtacgtagtaagtgatattacctgatgccgatgtcttgcgtgcttgcagccgactatttccccaagtgctgcaacaactgcaggtccttctccggggtcgacgtctgcgacgacgcccaccccaagtgccccaagggctgctcggcgtgccgcgtggtgtcgacgagccccgaaatgtggcgctgcgcggatatgaaatccaccgtcgacggcacctgcggtgggccctgcaagaagtactgatcggctcatgccagcatgatatgttccgcctaaaatgaaataaaagctcagacgagatgagcagcgtcatcgtgcctatgcgtgtgtgtgtggccaacaaatatgtataccagtatgccgtgtcttcgtcgctgtgttttctctctcgagaaaaagttggtgttgcttgttgttcagatatccggaatatcctccgtgaataagtaatgattgtgcgttggtggcaaaaaaaaaaaaaaaaaaaaaaaaaaaaaaaaaaaaaaaaaaaaaaaaaaanctcgagacctcggccgcgaccacgct

SEQ ID NO: 12057 - DNA, 310 bp, Triticum aestivum
  Clone ID: PAT_TA_12057
ttcgagcggccgcccgggcaggtgccgagccctcacaagacgttccggtgcgccgacatgaagagcaccgtcgacggcacctgcggcgggccatgcaaaaagcactgatccgttcagggcttcaggctcagacgaggtgtgccgcctaaaataaagctcagatgagatgagcagtcatggtgcctatgcttgtgtgtgggtcgtgctatacggccaacagtatgtataatgctatcgtcgtgtcttggtcaatgtgttttctctctcgagaaaggctggtggtgcttgtacctcggccgcgaccacgcta

SEQ ID NO: 12058 - DNA, 556 bp, Triticum aestivum
  unsure (1)..(556): unsure at all n locations
  Clone ID: PAT_TA_12058
aagcattctaccactagaccgaccgcaccaggtgaagtgggagctttgcgctaagggctcattagcaaccatgaagagcaccaagctcgcggcgatcctgatcctccaggccgtcctgggtcatggggatcctctcacacgtgaacgccgactatttccccaagtgctgcaacagttgcaggtccttctccgggggtccgacgtctgcgacgacgcccacccccagtgccccaaagggctgctccggcctgccgcgttgggtgacgcccaaccctcaacaagacttcccgggtgcgcccgacatgaagacaccgttcgacggacctgcggcgggcatgcaaaaanactgatccgtttcaaggcttcaagctcaaacaagtgtgccgcctaaaataaactcaagatgaagatgacatcatggngcctagctnggttttggtccctgctatacggcaacatattntaatgctactccttcttgggcaagtgtttcncccccaaaaaagtgggnggngcnatatgttaactactcctgaaaaaaattgatgatttggcc

SEQ ID NO: 12059 - DNA, 1136 bp, Triticum aestivum
  unsure (1)..(1136): unsure at all n locations
  Clone ID: PAT_TA_12059
cgtccgaaaagaaggtcccgaaagctgaagaagttctaagtcggtatgctgagaagcatcctgataattctaaaggagtcctccttgcacttgcccagattgctgccaatgccaaccattttcagattgctgctgattcactatcaaagatatctgacatccagcacatgcctgctacggttgctacactggtagctctaaaagagcgtctaaatgactctaacggtgctgcttctgtgcttgattctgctatcaagtggtggaaaaacgccatgactgaagataacaagttggatatgttcatgcgggaggctgcaacatttaagctcaaccatgggcgtgatgaagaggcctgtcagctgtacgaggaacttgtgaagagctatggaagcaccgaagcgttggctgggctagtagcaacgtctgcacgcactgaccttgcaaaagctgagcaatatgagaagcagctgaaaccgttgccgggtcttcagggaattgacgtaaagagcctggagaagacatctggtgcaaggcatgtagagcaagccatgaaggttgatgctcccgaggaagtgaagaagcaaaaggctaagaagaggaagaggaagcctaaatatccgaaaggatatgatccagcgaacccagggccacccccagatcctgagagatggctgcccaagagggagaggtcgacttaccgtccgaagaggaaggacaagagggctcaggtcagaggtgctcagggtgctgtgagtagagagaagcatgatggatctgctgccaatgccggtgccacctcttcgaaacccaccacctcggccaaggctccagaaccaccgaagggctccaacaagtcccggaagaaaaagtcgaggtcttaggcgacaaagttgttatgtcacaaattaacagtatacaaaggacactgtccattttagtatcttgacttggaatttttgtgttatctgcattggattgccctgcgctgtgcttttagaatcatgtttatggtgacttgagattctagaccgttgcaatttttgttcaaaaaaaaaaaaaaaaaaaaaaaaaaaaaaaaaaaaaanaaaaaaaaaaaaaaaaaaacttcgagactagttctctctctctcacctcgg

SEQ ID NO: 12060 - DNA, 669 bp, Triticum aestivum
  Clone ID: PAT_TA_12060
gccggccgggctcgggactacaacaacagaaagcattctactcctccacacaagtgaagtgagagctttgcgctgaaagttcatcagcaactatgaagggcaccaagctcgcggcgatcctgatcctccaggccgtcctggtcatgggagtcctctcgcacgtcaacgccgacttcttccccaagtgctgcaacaactgcaggtccttctcgggggtcgacgtctgtgacgacgcccaccccaagtgtcccaagggctgctcggcgtgccgcgtggtgtcgacgagccccgaaatgtggcgctgcgcggatatgaaatccaccgtcgacggcacctgcggtggaccctgcaagaagtactgatcggttcatgccggcatatgatatgttccgcctaaaattaaataaaagctcggacgagatgagcagcgtcatcgtgcctatgcgtgtgtgtgtgaccaacaaatatgtataccagtatgtcgtgtcttcgtcgctgtgttttctctctcgagaaaaacttggtgttgcttgttgttcagctatccggaatatcctccgtgaataaacacctgtagtgattgtgcgtggctgccaataatgtgagttctcttgtccacgcagttacatgtttcccgttgtatttatatactctcagaaaaaaaaaaaa

SEQ ID NO: 12061 - DNA, 1733 bp, Triticum aestivum
  Clone ID: PAT_TA_12061
aattcggcacgaggcatgaaggcgcaaaaggttgatcttaccactagagcactcagagatacaaggagcttcgagcttgcatataattcagcttgcaccttgatagaaaataagaagtattcagaagctaaagagcagctggacttggcgaaaagaatcgggaaagaggagcttatggtggaagattacgcagaagatgagattgagtatgaattagctcctgtgtctgttcaacttgcttatgtacagcagctacaaggacagactcaagaagccatggaaacctatgccaatatgataaacaagaaatcaggagacccctcatcacttgccgtggcaacaaccaaccttatttcaataaaaggtacaaaggatgttgctgacggcctgaggaaacttgaccggcttgtcgagaagtcgacggcgccgaaccagctgcaactgatcgagagccttgaattcaagttatcttcaaggcaaaaagaagccctatactctgctcgtgttcttttgctcctccatgcaaataaaattgatcaggcacaagagttggtcagtgggctgcttggtatgtttcgagacagtgtgtttcctgttttacttcaagctgcagttcatgtgagagaaaagaaggtcccgaaagctgaagaagttctaagtcggtatgctgagaagcatcctgataattctaaaggagtcctccttgcacttgcccagattgctgccaatgccaaccattttcagattgctgctgattcgctatcaaagatatctgacatccagcacatgcctgctacggttgctacactggtagctctaaaagagcgtctaaatgactctaatggcgctgcttctgtgcttgattctgctatcaagtggtggaaaaacgccatgactgaagataacaagttggatatgttcatgcgggaggctgctacatttaagctcaaccatgggcgtgatgaagaggcctgtcagctgtacgaggaacttgtgaagagctatggaagcaccgaagcgttggctgggctggtagcaacgtccgcatgcactgaccttgcgaaagctgagcaatatgagaagcagctgaaaccgttgccgggtcttcagggaattgacgtaaagagcctggagaagacatctggtgcaaggcatgtagagcaagccatgaaggttgatgctcccgaggaagtgaagaagcaaaaggctaagaagaggaagaggaagcctaaatatccgaagggatatgatccagcgaacccagggccacccccagatcccgagagatggctgcccaagagggagaggtccacctaccgtccgaagaggaaggataagagggctcaggtcagaggtgctcaaggctctgtgagtagagagaagcatgatgcatctgctgccaatgccagcgccacctcttcgaaacccaccacctcggccaaggctccagaaccaccaaagggttccaacaagtcccggaagaaaaagtcgaggtcttaggcgacaaagttgttatgtcacaaattaacagtatacaaaggacactgtccattttagtatcttgacttgatttttttgtgttatctgcattggattgccctgcgctgtgcttttagaaccatgtttatggtgacttgagattctagacttgttgcaaattttgttaaggctgtctgacttatctggttgaaattcccttctttccatactataataactttccttgcaatttt

SEQ ID NO: 12062 - DNA, 635 bp, Triticum aestivum
  unsure (1)..(635): unsure at all n locations
  Clone ID: PAT_TA_12062
aagcattctaccactagaccgaccgcaccaggtgaagtgggagctttgcgctaagggctcattagcaaccatgaagagcaccaagctcgcggcgatcctgatcctccaggccgtcctggtcatggggatcctctcacacgtgaacgccgactatttccccaagtgctgcaacagttgcaggtccttctcgggggtcgacgtctgcgacgacgcccacccccagtgccccaagggctgctcggcctgccgcgtgggtgacgcccagccctcacaagacgttccggtgcgccgacatgaagagcaccgtcgacggcacctgcggcgggccatgcaaaaagcactgatccgttcagggcttcaggctcagacgaggtgtgccgcctaaaataaactcaagatgagatgagcatcatggtgcctatgcttgtgtgtgggtcgtgctatacggcaacagtatgtataatgctatcgtcgtgtcttggcaatgtgtttctctctcaaaaaagtggtggtgctatactggtcactactccgtgaataacaattgatgatgtttgccnatcaataaaaactcggcgcgacacctaacaattccgcgcgcatggnggcggagatcactcggccaattncctaag

SEQ ID NO: 12063 - DNA, 1318 bp, Triticum aestivum
  Clone ID: PAT_TA_12063
tagcgtggtcgcggccgaggtacacaatatcaagcagtaaaaggaaaagacatactaatgcgttgcatctgaacatcaaattaaaatagaacagacgctgacactaggggatgtttatctactgattacgaattatagttgcttttcttttttttccttttggtgcagaaagtatcgtgtcaatttacatggtttagtgtgagcctatctacaaagattctaagaagatccaggaacaggtgcaggtgggatcctgagcagctgctgcagcaagcgggctgcaaggcgctgcgagacacctccagcaatacgagaaccaaacatacgggcttcacgctcttgtagcacctgtacaattggctgcaaaagacttggatcaaaggtatcagaggatctcagaagaccccatattctgagaacagtgtctcgtagctccaacatttgttcccgctcaacatcacttatcttaaatggtccagctggattgccattggatattaatggcttcaaaaattctggagctgcgttgtatgaatcaatcagtgttccgaaggtgatggcttctgtgacacgaaccgcttctttcacaactagcactcttaaattctccccatctggaccaagtagaagtttcaaaaccggttgtagagcatccttcgctacaaactctctatcctggcgtccttgaacaagaagattttcaagcctattccacctgaatttttcatccttgaagagcagctcaatcagagcatctctgagatatggattgggatctgtgagtaatcttttagcaaagtaaggatatgaggcagcaagcaccttaaaattaggatcagcatagagcgccagaccttccagcacagtgagtgatcgcagtatcaacgcatagtaggccggtacattgaatgggtactgataaagaacagcgcctaatccatcaactatggttttaaagtttagctcacttcactgttgaatccaaagcatcatcaaaaaaaatcttgagggcaggtacgattggggatacatccacttcaggtttcagaaaatcaagtgcataataatcacgagccatcgcttcataatcccgattgaccatgtgaacgacatgccctatgatggctacccttgcatcctctggggtttcactcatcatgccaaaatcaagaaaagcaagcttcccttcaggtgttgccaaaatattacccaggatgcgggtcagcatgaaagtaaccatactctagtagctgccttaggctacactgtataccaatgtttaccaagtccaggaccttcaagccctcgtgccgaattc

SEQ ID NO: 12064 - DNA, 2338 bp, Triticum aestivum
  Clone ID: PAT_TA_12064
caaccctcactaaagggaacaaaagctggagctccaccgcggtggcggccgctctagaactagtggatcccccgggctgcaggaattcggcaccagtttcctcgcagcctccgccctcctcgtgagccatctctccccgacctcccgatgccgcccaaatctaaggccgcggccgccgccgccgagccggtctccgtggaggacctcttcacggcgctccaccgccacatcgaggccggcgagttcccccaggccgtcaaggtcgccgaccaagttctcgcggtgtcgccgggcgacgaggacgcggtgcgatgcaaggtggtggcgcacatcaagtccgacgcgacggacaaggcgctcgcggccatccgcgccgccgagcgcctccccatcgatctcagctactacaaggcatactgctactacaggcaaaacaagctgcaagaagctctggatatattgaatggtcaagaagaaacagctgccgttctccagctggaatcccagatctattaccgattaggaagaatgaatgattgcatgagtagctatgagaagctccagaagttcaaggttgactcaatagatctaaagataaatatcattgctgctctagttgctggtggaagggcttctgaagtacaggcagccatgaaggcgcaaaaggttgatcttaccactagagcactcagagatactaggagcttcgagcttgcatataattcggcttgcaccttgatagaaaataagaagtattcagaagctaaagagcagctggacttggcgaaaagaatcgggaaagaggagcttatggtggaagattacgcagaagatgagattgaatatgaattagctcctgtatctgttcaacttgcttatgtacagcagctacaaggacagactcaagaagccatggaaacctatgccaatatgataaacaagaaatcaggagacccctcatcacttgccgtggcaacagccaaccttatttcagtaaaaggtacaaaggatgttgctgatggcctgaggaagcttgaccggcttgtcgagaagtcgacagcgccgaaccagttgcaactgatcgagagccttgaattcaagttatcttcaaggcaaaaagaagccctgtactctgctcgtgttcttttgctcctccatgcaaataaaattgatcaggcacaagagttggtaagtgggctgcttgctacgtttcgagacaatgtgttccctgttttacttcaagctgcagttcatgtgagagaaaagaaggtcccgaaagctgaagaggttctaagtcggtatgctgagaagcatcctgataattctacaggagtcctccttgcactcgcccagattgctgccaatgccaaccattttcagattgctgctgattcgctatcaaagatatctgacatccagcacatgcctgcaacggttgctacactggtagctctaaaagagcgtctaaatgactctaatggtgctgcttctgtgcttgattctgctatcaagtggtggaaaaacgccatgactgaagataacaagttggatatgttcatgcgggaggctgctacatttaagctcaaccatgggcgtgataaagaggcctgtcagctgtacgaggaacttgtgaagagctatggaagcaccgaagcgttgtctgggctagtagcaacgtccgcacgcactgaccttgcgaaagctgagcaatatgagaagcagctgaaaccgttgccgggtcttcagggaattgacgtaaagagcctggagaagacatctggtgcaaggcatgtagagcaagccatgaaggttgatgctcccgaggaagtgaagaagcaaaaggctaagaagaggaagaggaagcctaaatatccgaaaggatatgatccagcgaacccagggccacccccagatcccgagagatggctgcccaagagggagaggtcgacctaccgtccgaagaggaaggataagagggctcaggtcagaggtgctcaaggctctgtgagtagagagaagcatgatgcatctgctgccaatgccggcgccacctcttcaaaacccaccacctcggccaaggctccagaaccaccaaagggctccaacaagtcccggaagaaaaagtcgaggtcttaggcggcaaagttgtcatgtcacaaattaacagtatacaaaggacactgtccattttagtaccttgacttggaatttttgtgttatctgcattggattgccctgtgccgtgcttttagaatcatgtttatggtggcttgagattcctagaccgttgcaaattttgttaacgctgtcggaataaaaaaaaaaaaaaaaaaaaaaa

SEQ ID NO: 12065 - DNA, 879 bp, Triticum aestivum
  Clone ID: PAT_TA_12065
cggacgcgtgggcaagtgaagtgagagctttgcgctgaaagttcatcagcaactatgaagggcaccaagctcgcggcgatcctgatcctccaggccgtcctggtcatgggagtcctctcgcacgtcaacggtaagctgcagatgctgctcagccattctacatgctcctcaacaaagctcgatcgattgccttttcgtgatcgcggtgagggatcgaggtctgtgtttatgggtgatgctatctgatgccgatgtctttgcgtgcgtgcagccgacttcttccccaagtgctgcaacaactgcaggtccttctcgggggtcgacgtctgcgacgacgcccaccccaagtgtcccaagggctgctcggcgtgccgcgtggtgtcgacgagccccgaaatgtggcgctgcgcggatatgaaatccaccgtcgacggcacctgcggtggaccctgcaagaagtactgatcggttcatgccggcatatgatatgttccgcctaaaattaaataaaagctcggacgagatgagcagcgtcatcgtgcctatgcgtgtgtgtgtgaccaacaaatatgtataccagtatgtcgtgtcttcgtcgctgtgttttctctctcgagaagaagttggtgttgcttgttgttcagctatccggaatatcctccgtgaataaacacctgtagtgattgtgcgtggctgccaataatgtgagttctcttgtccacgcagttacatgtttcccgttgtatttatatactctccgatatgatatttgttggcgtgttaagcagtatcttactagatgcttagcttattttattttgccagaaaaactttcaaaaaaaaacctcggccgcgaccacgctaatcactagtgaattc

SEQ ID NO: 12066 - DNA, 679 bp, Triticum aestivum
  unsure (1)..(679): unsure at all n locations
  Clone ID: PAT_TA_12066
ggcagaaagcattctaccactagaccgaccgcaccaggtgaagtgggagctttgcgctaagggctcattagcaaccatgaagagcaccaagctcgcggcgatcctgatcctccaggccgtcctggtcatggggatcctctcacacgtgaacgccgactatttccccaagtgctgcaacagttgcaggtccttctcgggggtcgacgtctgcgacgacgcccacccccagtgccccaagggctgctcggcctggcccncccgggggnccccgtggtgacgcccagccctcacaagacgttccggtgcgccgacatgaagagcaccgtcgacggcacctgcggcggggccatgcaaaaagcactgatccgttcagggcttcaggctcagacgaggtgtgcccgcctaaaataaagctcagatgagatgagcagtcatgggtgccctatgctttgtgtgtggggtccgtgctatacgggccaacaatatgtataatgctatccgtccgtgtcttggtcaaatgtgttttcctctctcgagaaaggctggtggtgctaagtacttgttcaactacctccggtgaataaacacatgtgatgattgtgtgtgcctactcaataaaaaacctcgggcgcgaacacgctaatcgaattccgcggccgcaatggcggccggnagcatc

SEQ ID NO: 12067 - DNA, 632 bp, Triticum aestivum
  Clone ID: PAT_TA_12067
acaacagagagcattctaccaccgcaccgcacgagtgaagtgagagctttgcacgaaaagttcatcaagcgaccatgaagggcaccaagctcgcggcgatcctcatcctccaggccgtcctgggtcatgggagtcctctcacacgtgaacgccgactatttccccaagtgctgcaacaactgcaggtccttctccggggtccgacgtctgcgacgacgcccaccccaagtgccccaagggctgctccggcgtgccgcgtgggtgtccgacgagcccccgaaatgtgggcgctgcgccggatatgaaatccaccgtccgacggcacctgcgggtgggccctggcaaagaagtactgattcggctcaatgccaagcatgatatgttcccgcctaaaaattgaaataaaagctcaagacgagatgaagcaagcgtcatccgtgcctatgcgtggtgtgtgtgggcaacaaaatatgttataccattatgccgtgtcttcgtcgctgtgttttctctctcgagaaaaattggtgttgcttgttgttcaaatatccggaatacctccggtgaataagtaatgattgtcgttggtggaatatgtagtccctgtcagctacagttccgtgattaacccc

SEQ ID NO: 12068 - DNA, 679 bp, Triticum aestivum
  Clone ID: PAT_TA_12068
cggccgctcaggcggcgggcgggactcactacaagagagaaagattctaccaccagaccgaccgcacagttgaagtgagatctgcgctaagggttcatcagcaaccatgaagagcaccaagctcgcggcgatcctgatcctccaggccgtcctggtcatggggatcctctcacacgtgaacgccgactatttccccaagtgctgcaacaactgcaggtccttctcgggggtcgacgtctgcgacgacgcccacccccagtgccccaagggctgctcggcctgccgcgtggtgacgccgagccctcacaagacgttccggtgcgccgacatgaagagcaccgtcgatggcacctgcggcgggccatgcaagaagcactgatccgttcagggcttcaggctcagacgaggtgtgccgcctaaaataaagctcagatgagatgagcagtcatggtgcctatgcttgtgtgtgggtcgtgctatacggccaacaatatgtatactgctatcgtcgtgtcttggtcaatgtgttttctctctcgagaaaggctggtggtgcttgtacttgttcacctattctccgtcaataaacacatgtgatgattgtacttgttcacctatccgccgtgaataaacacatgtgatgattgtgcttggaaaaaaaaaaaaaaaaaggccccta

SEQ ID NO: 12069 - DNA, 858 bp, Triticum aestivum
  Clone ID: PAT_TA_12069
tcggcaccaggcgaaagctgagcaatatgagaagcagctgaaaccgttgccgggtcttcagggaattgacgtaaagagcctggagaagacatctggtgcaaggcatgtagagcaagccatgaaggttgatgctcccgaggaagtgaagaagcaaaaggctaagaagaggaagaggaagcctaaatatccgaagggatatgatccagcgaacccagggccatctctcgggatctgggggtggcctaccactagaccgaccgcacaggtgaagtgagagctttgcgctaaagggttcatcagcaagcatgaagagcaccaagctcgcggcgatcctgatcctccaggccgtcctggtcatggggatcctctcacacgtgaacgccgacttcttccccaagtgctgcaacaactgcaggtccttctccggggtcgacgtctgcgacgacgcccacccccagtgccccaagggctgctcggcctgccgcgtggtgacgcccagccctcacaagacgttccggtgcgccgacatgaagagcaccgtcgatggcacctgcggcgggccatgcaaaaagcactgatccgttcagggcttcagtctcagacgaggggtgccgcctaaaataaagctcagatgagatgagcagtcatggcgcctatgcttctctgtgggtcgtgctatacggccaacaatatgtatactgctatcgtcgtgtcttgtcaatgtgtttcctctctcgagaaaggtggtggtgcttgtacttgtgttcacctatcctccgtgaataaacacatgtgatgattgtgtgtgcctactcaatattgcatttatactctccgaaaaaaaaaaaaaaaaaaaaa

SEQ ID NO: 12070 - DNA, 614 bp, Triticum aestivum
  Clone ID: PAT_TA_12070
tcggcacgaggcacaaccataagacagaagtgagagagctttgcggcaaaccatagaagcaaccatgaagaacaccaagctcgtggcgatccttgtcctccaggccatcatggtcatgggaatcctcgcacacgtgaatgccgattacttcccgaagtgctgcaacaactgcaggtccttctcgggggtcgacgtctgcgacgacgcacacccccagtgccccaagggctgctcggcctgccgcgtggtgacgccgagccctcacaagacgttccggtgcgccgacatgaagagcaccgtcgacggcacctgcggcgggccatgcaagaagcactgatccgttcagggcttcaggctcagacgtggtgtgccgtctaaaataaagctcagatgatgagccagcttgtcacagtgtttgtgcgtgcctgtggctccaccttgcataccgacaatatatacactgttgtcggtcgtcgttgtttcatcaccgtcattgttcttcgttttaatttcttcttcaagagttgtctgttgttgctcgcctctcaggtgcctgttgtatcatccgcgaataaaaacgtgtgttggttgtgtgtctcagcttaaaaaaaaaa

SEQ ID NO: 12071 - DNA, 938 bp, Triticum aestivum
  Clone ID: PAT_TA_12071
gccggccgggctccggcacaccactacaacagcagaaagcattctaccactagaccgaccgcaccaggtgaagtgggagctttgcgctaagggctcattagcaaccatgaagagcaccaagctcgcggcgatcctgatcctccaggccgtcctggtcatggggatcctctcacacgtgaacgccgactatttccccaagtgctgcaacagttgcaggtccttctcgggggtcgacgtctgcgacgacgcccacccccagtgccccaagggctgctcggcctgccgcgtggtgacgcccagccctcacaagacgttccggtgcgccgacatgaagagcaccgtcgacggcacctgcggcgggccatgcaaaaagcactgatccgttcagggcttcaggctcagacgaggtgtgccgcctaaaataaagctcagatgagatgagcagtcatggtgcctatgcttgtgtgtgggtcgtgctatacggccaacagtatgtataatgctatcgtcgtgtcttggtcaatgtgttttctctctcgagaaaggctggtggtgctagtacttgttcacctacctccgtgaataaacacatgtgatgattgtgtgtgcctactcaataacatgagaaccagttctcttgtcgaaaaaaaaaaaaaaaaaaaaaactagaattgaacttacttttgtactgtgttaaaaaaatcgaacttacttttttacatttgggccttgtccgcgacccgcgacgaaccaaaagcaccacatgcgaacggcacatgtacgcacacaaaactcgactaaaaaaaaatatgtacgcccgcgaaacgcaaacacatagcacacgggcgggagagcgcatacatcgagatcaccgggccggactagctactgcgacgccagcgagctcgccgggcagttcgccggaggggtacccgatc

SEQ ID NO: 12072 - DNA, 1158 bp, Triticum aestivum
  Clone ID: PAT_TA_12072
actgcttaacacgccaacaaatatcatatcggagagtatataaatacaacgggaaacatgtaactgcgtggacaagagaactcacattattggcagccacgcacaatcactacaggtgtttattcacggaggatattccggatagctgaacaacaagcaacaccaactttttctcgagagagaaaacacagcgacgaagacacgacatactggtatacatatttgttggtcacacacacacgcataggcacgatgacgctgctcatctcgtccgagcttttatttaattttaggcggaacatatcatatgccggcatgaaccgatcagtacttcttgcagggtccaccgcaggtgccgtcgacggtggatttcatatccgcgcagcgccacatttcggggctcgtcgacaccacgcggcacgccgagcagcccttgggacacttggggtgggcgtcgtcgcagacgtcgacccccgagaaggacctgcagttgttgcagcacttggggaagaagtcggcgttgacgtgcgagaggactcccatgaccaggacgccgactatttccccaagtgctgcaacaactgcaggtccttctccggggtcgacgtctgcgacgacgcccaccccaagtgccccaagggctgctcggcgtgccgcgtggtgtcgacgagccccgaaatgtggcgctgcgcggatatgaaatccaccgtcgacggcacctgcggtgggccctgcaagaagtactgatcggctcatgccagcatgatatgttccgcctaaaatgaaataaaagctcaggcgagatgagcagcgtcatcgtgcctatgcgtgtgtgtgtggccaacaaatatgtataccagtatgccgtctcttcgtcgctgtgttttctctctcgagaaaaagttggtgttgcttgttgttcagctatccggaatatcctccgtgaataagtaatgattgtgcgttggtggcaataatgtgagttctcttgtccacgcgttacatgtttcccgttgtatttatatcctctccgatatgatatccattgttcacatgtttaaaaaaaaaaaaaaaaaaaaaaaaaaaaaaaaaaaaaaaaaaaaaaaaaaaaaaactcgagacacctcggccgcgaccacgctaatcactagtgaattc

SEQ ID NO: 12073 - DNA, 569 bp, Triticum aestivum
  Clone ID: PAT_TA_12073
cgtccgccgggcttccttgacccgacgctcaagctggggcagctcaggaagggggtgagcttcgcgtccgcgggctctggatacgacgatatcactgccaacacattaagcgcgctgccattccggagacaactgtggcacttctggcgttacaagcaactgatccgagccctgctcggactgagaagagcagagcgaattgttaacagggctaccttcatcataagtgctggtacaaatgacatgctcctaaactacatcgcgtcaaaccgatcagctggccccatcgccatgctgcggtacgagaaccacctgatagcacgcctcggcaactatacccaggtgatgaggatgcttggagcgagaaggtttgtgttcgtcgggctacccccgatcggctgtctaccgatcgcaagaacattgctcggaagggatccagatggatgcgacagcgacctaaaccagctggcggctttcttcaactcgagactgggtcagcttgtcgaatttcgtcaactaccagccccgtatgaggagcgcctacttagattcctacacaatcatacggg

SEQ ID NO: 12074 - DNA, 1196 bp, Triticum aestivum
  unsure (1)..(1196): unsure at all n locations
  Clone ID: PAT_TA_12074
ggctggacggcgtcggtcttgcagaggtntcacaatccttgttccaataggtccgtcggacttcgcatcccttgccttgctgcactctcctggaaggtaatgtttgtcacttattgtgtgtgtgtgtgtgtgtgtaggatacgtcgtgatgaaaatgatattcttaaacaacccttcatgtttgggcacaagttgactcttcccaccgtgtatagagatgattgaattctcaagtcccgtcaattgctttgccatgttttgtaagagaaaatgtatgtgttgattactactgtgtttttggttagttgttgaacctggcaatgtgtgtgtattacttgacactgtacatttgatgcttcatggtgttccaatacggccccatctagctaagcttgttggtagtattggacaaaagcaatagatatttcgactttgacaaattaggatatgtctgtttcaagcgtgttgtgcttatgtttaatttactcttgtgcgtgaggttttctcattgtccctagctctgtacattgttcctgttgtttagtaaagctttataatgatgcattgggtttagaaccacaaccacaatctcttcctattttttatcatcttgtttagaaccacaacctacgatctcttcctattttttatcatcttcttgtttagtaccacaacagataagcatcacttgagactccttctctaaacaagtaagcatcatgggcagtgggtatgaggaggacattggaaaaatgatatttggggtggtgatttccccaaatgctgcttggttagatgatatatctcctgataatgcagtgtgttttcatttttgtgagtttgaccttttttagaaagattttcaattgcaggcctgtctcttatggatggatggtcacatgggagtaatcagttgactaactatgaagattgctaggattgacaaaaacgcaaaaatgatccagtcggtggaactattataaaactcctgaaggaggtaaccctttacaaaagggtgcaagtgttactgtctcctgctatatttgacagtaaaaaaaccagtcaacaagtagtcaagtattcttgattgaaagtctgcaagtaatcaagtggtcttacggaaggccattctagaagatctttgcttgttgtagctatacaatttacctcaattttttgccagttgctagcaccga

SEQ ID NO: 12075 - DNA, 679 bp, Triticum aestivum
  Clone ID: PAT_TA_12075
atttgtttggggaatcttatgggaagtagtgaaactatgatatggatgttgaggcgtcacctaacaattgtgctttcgagggccaacttgcattttcacgtcaagcatggctgattatcagagggcaaggaaagatggagtagcagaagcattgcctatgatgagttgatcggctcgatagctgtctgcctttgcctacttggacgaggacgacaacaggtacatgacagttgacctgctggaagaggtgtgctgggagtacaacatacaagctgacgtcggtatcgtgacatcgtcggcgtgggcgcccctgccaactggcgggcgtggtgactcgatctgagcatgtcagaggcgaggagcggggctgtattattagggcaacaggggtggcccttttggttgggggccctgctgccgcgtgatggtatgctctggctgacgtcaacgggtcgttgtccgtgtctggaaggaggttggcaatgagaacatgcgtatgatgttcaaattaactatgggggttcgtggcaatggtgaagaaggggatcattgggaatggaagtctgaccatcattctccatggagcagacgacctcagctagcctttgattgaaatattcatatacaacacactatgtttgttcgcattgtgctatagatcatatcaatattttaatcc

SEQ ID NO: 12076 - DNA, 588 bp, Triticum aestivum
  unsure (1)..(588): unsure at all n locations
  Clone ID: PAT_TA_12076
attcggncgaggctttcgagaacgtgggcgccttactttcccactcgctagctcgttgacccatccagatgagccatcacctcgcctccaccaccgccgccgctagctcgtctcccagccgccggccgagcttaacctcattcccgtcgccgctccaccgaccaagcgcgctgttccagcagactaacttcgttgccactcgtacagagaggaagcccgcaccttcagtggccgccgcagcggcgtcgccggtatcacccctgcacaggctcgaggaaatgagtgaccatgaggcaatccccgaaaggctcgctgtggttactggtggaaacagagggatcggcatagaggtgtgccgccagcttgctctccaaggtgtgacggtcattctcacagcaagggatgaggaaagaggaaaggctgcggttgagtccctttgccgtgaatctaacctctccaacataatcttccatcagctcgatatactggatgctggtagtcgtgcctcattagcgcgacatatcgagaccagatatgggaagctcgacattttggtgaacaatgcaggtgttggaggggtggcagtag

SEQ ID NO: 12077 - DNA, 799 bp, Triticum aestivum
  unsure (1)..(799): unsure at all n locations
  Clone ID: PAT_TA_12077
cgggtgatgggcctgatgctgagcaggttgtcactgaagttccttccgcggatgtcgctcggatggcatcagtccgttgacgttgacaagttggtcccctggcacactgcagtttgtggtggccagtggcaatgcggctcgtgctgagtatgctccccgtccgaagatatcaagtaagggtgtttcattaccttcttcagaaataaaggacttgaacaagcataaaactgcagtgccccaggctgttgattttgctcgcaagtctacaactaatgcaataaacccttatccagcatacttgctcaaggatgctgcagtgcaacttgatctccaattgaaaaaaccctctaatgtggcgaagccagatttgccaaagaaaatgcgccccaaagaaaactacggtgccaatcactttcctgggttgcactacagcagacaacgtgtattcgacacaaacaacgcactttggctgcaaacaagcgcatagaggatcctgctgtgcaacgccatcgccacctgatcccagccgctattgtcccggaccctggtttgcctgtggggaggcgccccaaccgcatacccttgatgttcccntacattggntccaaattgtcaaagganggtccaaaaaaanacggctccaaggaaattaaacaaaacttncctaagccgcaangtttccnggaatcaaggnaaacncccnaagatganggntaaccctcaanggcanatggggactnttcacgttggcacnaanagaactgaagaatgncaatcggattncctaacaaaaagggnn

SEQ ID NO: 12078 - DNA, 1488 bp, Triticum aestivum
  Clone ID: PAT_TA_12078
cgtccgcattacaatgaccaacctggtcactctatgaaggagataattgtaagtcgaaaatgtgcagagtcagttcttcgaggagcccaggtgtatgtccctggtgttttagcttgcagtgcacatgttgaaaagggtgataaggttgcagtgtcagtcgctattgaacaacctgtcaaggacagtggttgggctgttggtataacacgaggaatcgttctacaggggttgcagtcagatgcacattatgaagagagaaagggtttgtacattggtcaagggattgctgcaatgtcaagggcaggaatatttcgtgttcttcatggagttgcagtagagatgactgagagggtatacaaactaccatcttttaatgacgtgcttgaaggggagatatttcttcaaaatttgccaagtattgtggctgctcgtgtccttgatccccggccaggagagcaaatattggacatgtgtgctgctccaggagggaaaacaacagcaattgctatccttatgagggacaaaggagaaattgttgcccttgatagatctcacaataaggtgatgggtattttgaagttggctgacgagatgggcctaagttgtataagagcttataaacttgatgctctcaaatctgtacggaaggcttatgaggaaagaaatcttggcgtggctgataattgctctgaagcaattgtgaccctagcggagaactctggccctatccgtagtataatcggtgccggggttacggatgcagctgaagacagctcaaccgcaatagttgagcagactgatgccaaaagctatgttagcaaggcagacctcaggaagaatttaaggcgaatgaggaacgggacaggaagaagtaactgctctggaggtagagttgaagactcaaaaggattctttccaagcagctttgatcgtgtcctccttgatgctccatgttctgcacttggcttgagacctcgtctctttgctggtgaggaaacccgcgtttccctcgggccggcgccctcggagcccgggtctggcttggcgccggcccttgggctggtgcgcccgcgtgggagggtgggtgattcctcccgtgcccgtatgccaggtgttgtggacgcctgggcccgggcccccctgcatgcgctccgcggccgggcactgggatctctgcacccgctgggtgggggtccggcttttcttggctcgtggttgctgcccgccgtggcgcttgctcgcccgggggggacggaggatgaagcacaacttgtccagaggtttgatccatcatcatcactggatacgatgggtttcttcattgcgaagtttaatgttgggcagaaggaggactgagcaaaggggtggtttgtgttgagcaccatatgttgggtactacaaatcttcgatagaatcagttaaattgcaggcattttcagtagtcactggcatttattgttgcgactacctgcattgcatccaaacatt

SEQ ID NO: 12079 - DNA, 1329 bp, Triticum aestivum
  unsure (1)..(1329): unsure at all n locations
  Clone ID: PAT_TA_12079
gcacgaggatagtttccttctttctttctcctcctcgttgcttttagatgtagatgtagatgtagattccgttccatctcttctagccccatagatgtagcctattgtctaccaagttcttgccaccatgtcctccatggttggtcgtgctctctgttcttggtttccgcttgtgaaccacagcacagatcttgtttttctgtgttttcgtttggttttctttggtcggtgttttgtgttttggattcggtttagaggtggagctcctatcattccaatgaagggtctaccggaagggtttgtgcagctgctcgttcatggttcccactatcctatctccatagaaaacgaggagagaggcctgtggtttgcatgaccgaggagccgcttcgatccctcgctgaccgctgtttggattgcggcgcgcgctgcatcttgatnctactgtcaagtagttttatctgccgtcgaggctagctagctgctgtaaatcttgaaaatgctccaaggtccagatctgaatgggagctgtttcttcctctcgagatctcttccggagcttcgtttttattgggtatttgctactaagatcccagtcggctcgggattttcttggcttatttgaagccaagatttgaatacccttggtattttgtttttctccccaagttaacgaataaaagattcaggttgtgctttgtactttgcacgcacctttattcccttgcttttgagccgtggtgtcactgttgcttcgtcttcatcccttccctccctgtcggctgttctacaggactggtgcccatttgtggcaggccccttagatctcaccatggatgcatttatcccctcgtcctactcttggccatatgacttttcttggtagatttgcatcagattccttaccgctactgcttggatctgggtgctgagcgcatcacatgcgccattacttttgctgtctctgccccatgcgctcatcacgcgcttggtgtcacccttattccatttgatgtgtctgagatgagggatttgtcttagattcattaaaatgccatgatactgtttacgtatcatatattagtcttttattttttttgcaggttgtacaggaggacggtgatgcttgtgaaagctttgagacgttagctagttgtgctatgcccagtgttgtcattgtgtttgagctgtaaatgttgcattgtatgttggtactagctacagcttgtattcgtgagcacacttttcttttggaagctgtgtaacacgtctgtctgtgtaagctgtgtaatctactagtcgtnctttgtatccttatcgtatctttgt

SEQ ID NO: 12080 - DNA, 187 bp, Triticum aestivum
  Clone ID: PAT_TA_12080
ttcggcacgagggcagacctctgcagtgaagaagaaggacctgattgcttttccattttatgttttagggtcctttttgtaaattttaaggactattctgtaactttagttctactcgcggtaccggtttacattttgtactcctctaatgttgaatgaaaggcactagagacggacaaaaaaaaaa

SEQ ID NO: 12081 - DNA, 783 bp, Triticum aestivum
  unsure (1)..(783): unsure at all n locations
  Clone ID: PAT_TA_12081
gcgctctgcccggtgccagactctaggcaggccatcttcatggacagcacacatcggtctaaggagaagcttaatcttagggataatcttaaggagaagaccctcttgttcagattcttcaagcttgtccagtcacacattgccgcatcgtcttctggcggtaaggatggggagggccaagcctctggtaagatatccgaggaggacttggacctcccctttattgaattcctcaagaaacagcagcttcaacccaagattagagcggttgtgctatatgcaattgccatggcagattatgatcaagatgccgcagacacatgcgagaaattgctaacaacaagagatggaatcaagaccctagctctttattcctcgtccattgggaggtttgctaatgcccaaggtgctttcatttatcctatgtacgggcatggtgagctaccgcaagctttctgtcgctttgctgctgttaagggtgccctatatgtgttgcggatgccagtcacagccctcctcgtggaccaggaaaagaagcgttatataggcaccagattggcttctggtcaggatattttgtgccagcagttgatacttggtccctcgtacaaaattccttcattggacatgcatctgatgcttagactcaaacttgacgagaaagttgcaggggagtatgatatcagagtcataaagagctcataaatgtctgtgtttcccccaaaatatacaganagcaantacagtgttcgggcttactgacagnatgtacagttcctctgg

SEQ ID NO: 12082 - DNA, 389 bp, Triticum aestivum
  unsure (1)..(389): unsure at all n locations
  Clone ID: PAT_TA_12082
ggccttccacgcctaccgcccgctcagcgccgagnatcgtcaccggccgggagacgggcagatcccgcgggttcggcttcgtcaacttcgacgacgacaactcgatgaacaacgccatccagggcatggacggccaggagcttggcggtcgcaccatcagcgtcagccaggccaatcagcgcccccgctgctggagggcatgaacagcaactaggaggtcggccgccggccattaaatccaccagcttatcaacttatcgtctctgtttaagttatcaagtctcgtgtggcagtttaagctatcagtctcgtgtggtggtttagtttatggtcgtcagatgagaggaacctgccgaatgtctatctatctgtgttgcgcaaaaaaaaaa

SEQ ID NO: 12083 - DNA, 1076 bp, Triticum aestivum
  Clone ID: PAT_TA_12083
gcacgaggtgaatacatggccaaggggacattgcgaagccatctctatggaagtggcctaccacctttgacatggaagcaacggattgatgcctgcattggtgcggccaggggccttcactacctccacacgggagcagaccgcggtataattcatagggatgttaagactactaacatcctgttggacaagaactttgttgcaaaaatagcagattttgggttgtcgaaaactggaccaacactggaccagacccatgttagtacagcaatcaggggtagcttcgggtatcttgatccagagtacttccggaggcagcaattgacacaaaaatctgatgtgtattcttttggtgtggttctctttgaagttgcttgtgccaggccggttatagacccttcagtgccgaaggatcaaatcaacttggcagaatgggctatgagatggcagcgtcagcgttcgctggaagcaatagcggatccacggctggatggtgactactcgccagaatccttgaagaagtttggtgatatcgcggagaagtgtcttgctgatgatgggagaaccaggccatcaatgggtgaggtcttgtggcacctggagtatgtgctgcagctccatgaagcttacaaacgcaacgtggattgcgagtcatttggaagcagtgaactggggttcgctgatatgtcttttagcatgcctcacatcagggagggagaagaggagcatcacccaaagaaatcaggtatcagagaagattcagccccttgaaggttttttctgacatgtggtaacccgctgaactatcttgattgcattgtagccgtggtcttgatgtaaaactgtgctatattgttcacttagtttcttcttattcttttgggcgttgtcctgctcgacaagtgtagaataataggatttttgtagattgccaaaaaaagaaaaaacttggacgtgtcaagttcttccttgacatcctgctatatcatgtgatttgttcgacccacggggtttcatgtagttctgcctgtgtgacatgtataaatgttactaataatataattcaatccttcaac

SEQ ID NO: 12084 - DNA, 613 bp, Triticum aestivum
  Clone ID: PAT_TA_12084
ccacgcgtccgtccgcccaggcgtccgcggacgcgtgggtccagctgcagctcgtgctggagatgagcgcccgggacaaccccgaggaaatggagatcgaggtcgccaagcagatgagcctgggcttccgccgccccgcgagctccctcgctgaggtcctcgcggcccgatactggaatttcaacgcccttggctatgatgacaagataacagatggtttttatgatctctacgtcattgggaatgggccggcatcaataaacatgccctctctgagtgaactgcgagcacagccagtttcacataatagtgtcaactgggaaactgtattggttcacagaggtgaagatcctgagcttatgaaacttgagcagaaggcctcaatcattgctattgaacttcgatcgagaaattcagaatttggtggcaatgttttgattcaaaaacttgctaatttagtttctaaccacatgggcggactaatatttgatcctgagaacacgtcgagaaaataccagaatatgatcagatccctgagagcacgtattggaagtgtagttgtgcctcttggccaattaaaaactggtctagctcgtcatcgcgcgctgctatt

SEQ ID NO: 12085 - DNA, 484 bp, Triticum aestivum
  Clone ID: PAT_TA_12085
ggtggattcttcgcagagccagggaaaagattcctgaaattggaggctggctctgcagtctttcacagaaagtacagaccagatattcattggataagaacgtccaaggatagtacattagatctaaacatgacagtttacagacagattccaaaagttccttgaggacgctggttctcatatcacagtgaattcatcattcttaacaagagaaaattatcgtcattgattctcatatgaagttacaggcataaatcacatgaacagccgcctgaatcaccaggattatttcttattaaaggattgtagatgattcaatttagcttatattgtgtggtgtacatgtcttgtcatttattgttgtattgataattatcatttgtacacttatcgacagagcctggaagacaactatttctgatgtaaagaaacactggaacgaaatgttttacttaactttactgtgcatgaaaaaaaaaagccg

SEQ ID NO: 12086 - DNA, 1375 bp, Triticum aestivum
  Clone ID: PAT_TA_12086
gtccccaccaccgaccaccaatgccggccgcttcgtcgtcggccacggcaacgccggcaaccagccgcggcggcagtcgggtctccgctttcacgatgcgcgcggtggcgcgcatgtcgagggcgcggtggttcatcttcctgaggcgggtataccagtaccagaacggcccgaggtctgacctgggctccaaccctttcaactcatccggctggctcgctcttgagctcggcgtgatcgtcgcgcagatggtcatcaccaccaccgttgtggccacctccccaaaggaacgccccgcgtggccgcttcggctctgggtctgcgcgtacaacgtcggcaacgtgctcagcctcccactcctctactggcgccaccgacattcatcggccgccggacgaggcgacgaccccgagatgcacggtgccggtgacgctctaaggaacagctcgtatctgatgaacaaggctcgggcgttcctggagctcttcttcgcgatgtggtttcgtccgggcaacgtgtgggtgttcgacgcgcggctcgggtcgttccaccgcgccccgaggctgtacgcgctctgcatcggcctgctcgcgtggaacgccgtcgtctactcgctccccttcctcctcttcctcctgctctgctgcttcgtcccggtcgtcgggtacgcgctcgggtacaacatgaactcggcctcggtcggccgaggcgcctccgacgagcagctggacgcgctgccgcggtggcggttcaaggagcccgacgtgccgagagaccgcgagaaggacgatcaagagtgctgcatatgcctggcgcagtacagggagaaagaggaggtgaggcagctgccctgcacacacatgttccacctgaaatgcgtggacaggtggctgaggatcatctcctcttgccctctctgcaagcaagagctcagctgaccgatggctgcacatatacggcgcaacggtgattgatcagtggagcttgcattctaatccagagatgcgtcgatcggatggcgcggcgcgctccgacgcatgcagcgcacctcactgacctctttcgccaaccctctactaacctagacactgaccagcgatggagacacctatgttgcagctcgggatagattaatttaccagcttgggcaggtgggaaatgtgtaaagaaattgttgtatccatgagcaggcggcctacgatgcaagtaccgtttgttctcccgttagctcattaattgtaccatgccaacagccaagaactgctagatgctgttgttcttgcgttggcacatctcaacaattacaagaacacagatggacacaaaaacaaggggaaataagaaataaatcactgcaattcttttaaaaaaaaaa

SEQ ID NO: 12087 - DNA, 631 bp, Triticum aestivum
  Clone ID: PAT_TA_12087
ggaaataggaagatacatggtaccatccggaaagtttcatgtaaactagtatttacttatgcgatgtttgttttgcaacccaattttctaagcctagtttgttttggttaatcccaaactagtattgatggattcaagtccaataatgttttaaataatggttgtaatgattttgtgatagggttctcagttgcaaagatattgtgaaaaatattattcatatttcattattcataaaaaataataaataagagaaaaacatggttcatatattaattgagtataagacctgatttatcacaatttaggtttatataaacatatttatgcttttttagttgtttacaactcacctgattaacaccatatgctaatgctgaatatttaatatgataacatttcataaatgatattatttatttgtgctagttgtcaagtcatgcatataattatgataaaatgtgtgttgtttatacgaatataatttacaccttaattttatgattaatttaccattttagtgcattaattaattaattaattaattaaataatatatgaaacaaacaaactaaacaataatggaaaaatttaaaaataaaacctaaaaataaatattttgaaaaaaaaaa

SEQ ID NO: 12088 - DNA, 260 bp, Triticum aestivum
  Clone ID: PAT_TA_12088
gggactataccttaagggcattacccgcagcctcatagcagcagtcaaggaattggaaatggaagaggtgtcaaaagacagccaagaagcatagtttctctagggtacgcttgaagtgacacatccgctaatcagttttggagaatttgccctctttttgctctctgcatctctggtgaggttatgaaaacaccatcttttgtacttgtctgcttgttgttagatgctaaaataatattgcatttgtattaaaaaaaaaa

SEQ ID NO: 12089 - DNA, 1061 bp, Triticum aestivum
  Clone ID: PAT_TA_12089
gggcgtttacaccaccacctaggactaggacagcaagaaacagggcagggcagggcctatggcgctgtagctcaggggggcagcgagcaatggcggggggatgcggcggcgaaggcactctggccaggtggcggcgggcggcggccaagcggatcggcctctcctgcgcctccttcttctcctcccatgccgcctctccctccccgccgcctcccaagaccatctcatgttcagcagtgaatgcgcccgcagacagcagtgatggagaacaggaaaagctggaggagccgaccagcactagaatggctgacaagaacttctgtgcaatatgtttggagaccctcagcaccagcagcagtggcattgacaactgtgacaggccagcgatattcacagcccagtgctcccactctttccacttcttgtgcatcgcctccaacatccgacatggcaatgttacatgcccaatctgccgtgcgcagtggtctcagctgccacgtgacctgaaggtgccgccattgctgcacaaccagtccgatccaatccttcgcatccttgatgacaacattgcgacatcccgcgtcaaccgaaggtcctccatccgtgctacccgctacaacgatgatgaccctgttgagccttacactctgactgagcatgttgatccatgcctgcgctttgcccttatcccgtctccggtggcagctcaccatcatgtgcttggacactacccttgtggacgcatgatgccaccacagcagcactgccagtacagctacagcggctcctccatggtttcgccgccacagattgcttcaccaagtgtgcaaaagcgtgccttccccttgcgccggatgtcctcccatggtaaacgaatggcattgcaggtcatcgaacacctctgctctgctggtggaattgatccagtaggggctttgcagaagggtctgaagatactagaggaccgggcacaccagaacccaagcaactgcattcttcacctctctgatcatccgatacgcagctatgctggggtagacatgaaccgtgcgagcattccg

SEQ ID NO: 12090 - DNA, 985 bp, Triticum aestivum
  Clone ID: PAT_TA_12090
attggtgccgagttctatcagtaccaccatgctcagagtcagagtgttcttgaccataaccagcagtgggagcagggaccaaattcttattctctccggaatgatgatatgtcagggagcattgatccggcggcattccgggatggcatccctctgccggccaagaagtctaagaagtggatcaaggggtggaacatctggggtctcaaacataagaagagcagcaccaaggaatctgaagctgccagtttggccaacagatcattctcggagaagtggcccgagctccgcgcaaggggatacaatgggcagatgctcaggtgcaacagcagcgtaagcgcgaggagctcctttggcaatagtggtgcagcaatgggcggcgtgagcgggaggaggagcaatgtggaaatgcatgttaatggcttagggaggatgaggaaggatgaggttttactcgagaggaatttcagtgcaaggtacacgccttgcacggtcgacaatggcgcgatcccttatccaatcgggggtgcccaattcaatcggcgaaatcagaatgggatgcccgggaaaggaaggcctgcccgttcatccaattctttgcctcgtagctcgctcgggatgtactgatctagcactgatgaaggcaggtttatgttcttctccaccatcttatgtgccttggctacaatgtgcatagctgtggtagctagcgtcatcagaatcaactttttataggctcagatcagaaggaaggtcgtcaagtgaagtggtgatggtgttggattatataccttacttagtcttatttcctactgggcttgggagtggagtatagcatttaactttacacccttgtataagatatgccatatgtatgtttgcttttgtcaattgaattcaagttagcattctggcaatagcaataacatgatgtaagggccaggaatcgaatgccggtaagcggtcggtgtgcaagatttttaga

SEQ ID NO: 12091 - DNA, 589 bp, Triticum aestivum
  unsure (1)..(589): unsure at all n locations
  Clone ID: PAT_TA_12091
caatacgggggagagcaaaaggatcagctggacaagccttgtttaagttcgtgtaatccacacacatacgccaagtgccgtttttcttaaggcacaagcaccgggttggccaaccactctnggatgaaagacttcgacgattgaacccggccgccaagagccggagccacttcctcaccaatggccttccgcctctcctcattgaaccgccgaaggtactgcttgaccggcttaaactttggatcaatattgagagtgtgctcagcggagttctctcggtacacccgacctgtcagatggcttccatgcaaagatgtcccgattctcacggatgaactcgatgagcgcgctttcctatttggcatccagattagcactgatgctgaactgcttggatgagtcgcctggaacaaaatcgacaagcttggtctcatcggccgacttaaacttcatcaccggctcatgctctgtggttgccttctttaaagacgccatgtccgccgggtcaacattgtccttgtaaaacttcaactcctccgtcgcacagaccgactcagcgtaagccgcgtcgccttcctcacattccang

SEQ ID NO: 12092 - DNA, 843 bp, Triticum aestivum
  Clone ID: PAT_TA_12092
gcggcgaggagcggcggcggcggcaggaggaagaggggaggcgatggcggcggctagggtttcgatcccggcggcggtgccgcgcccgatccccggctccacccacgccgccggggacctcaccgacgaggaggtctacgccgcgctccgcgaatgcgacatggatcccaacgagaccgcgcagaagctcctccaccaagataccttccatgaggtgaaaagaaagcgtgacaagaaaaaggagagcaacaaagaatctgttgacccccgatggagacctgggacacaggggcgaggtggaaaaggtggccgtgggaactattcttcacgccaattaagcaactctagtgatggcaccgggagaaatgcgcctgctggaaaggaaaatgacctgaatccgagcatggataaatgtactagcccttcacctgtcaatccaagcacagaaacgaagctatcaacttccattttaagttcgtcaggtggcttatccaatggtccatcacaacctcttgctcccggggcgaaatattctcagcctacttgtcacttgtcaccctcagattcaaaaggactggcggttgttaaaggtaccccagaagaggttgtcttggatttaggttcacatgtaaacaactcatcaattcaggcgctaggagtgggtacttctgtttcagacccactgcttacgccgccccttcaaccccacagtcatggtggtgagatcgttgccaacaaacatgctgtcagaagtcagcggtcagcaggtgaatataaggtggtttccgatgatgcatcagcacttccgaaagacacgccacagtcttctagttcatcttctac

SEQ ID NO: 12093 - DNA, 812 bp, Triticum aestivum
  unsure (1)..(812): unsure at all n locations
  Clone ID: PAT_TA_12093
cgtccgcccacgtgtccgcccacgcgtccggctttgtgaggtaattaagctaggcctaggtacccgtccttgatgatggcttccacaagctaaggtgcaggggtgaactaagttgggattttgcagcagcgacggtcacaactatcggtggagatcgagctaacgacctcacaaaaaattctacagattcatcaaacaccgaaggaggttagtgtgtacctgagcgggaacggtggccgttgtggtcttgctggagcctcccttgccgtggaaagtcaccagcttcagggagcgacagtggcaactgcaaggatttggcttgccgctacgagcaacggcgaccccatttgctgattccgcagctccgagctgcagcaggagctactgggcggccgagatgcagatggagctgctgcacctccgagctgttaagctgcagtgggagccgctctgccgccaagctgcagcatgagccgcccacgaagatggagcccaaggtgccctcgtcggcctcctcctggtgctttcttacttcacttcagtacataaagggggggaaggggaacgggacgaagatctgtttgatggaaccaagggtgccagacacgtggttggtgttctgtgtcctggtgggcagtccgtgaggcaactattgacgtgtgtttttgtccctcaacacatgtatcttgagggcaagattgtaatttctttatctttgaggcctgatgttaccaaattgtaatcttggtggagcctttggttctggtttatgaaacaggangccctccttcgagggagggccaantttgcaa

SEQ ID NO: 12094 - DNA, 559 bp, Triticum aestivum
  Clone ID: PAT_TA_12094
gcttttcccactccactcaccctcctcctccatcccatctcctacgcccgctcgcccaaccatgtccgcctcttcttgcacaggctgccatcgccaaggctccacagcagcgcgtgccaccgtgactcatggtcctgtcacggcagactcaagcccccgcgtcaaagccgctgcatcggacttctccaaccacaggagaccacgacatcggcccgctcgtctcctgttgctgccggcgccgaccccgacagcatggttgcatctctgcccatgcaccctaggtgtttgttggaatgcctccaaagaggagaataaggtttgagagatgaccatgctgatattgggccctccgtacaacttaacggtcaacaaacggtgttgaccatttagtaccatgcaaacctgactagtggtcctgatatatgagaaattagattaattgaccccaaaccgatcatcagtatttttttcactatttgatcatcagcatttgttgagaaattttgtaagggaatcggtaatttgggtccaataaacatgatgtgtgagagtgtgttgc

SEQ ID NO: 12095 - DNA, 984 bp, Triticum aestivum
  unsure (1)..(984): unsure at all n locations
  Clone ID: PAT_TA_12095
cgtggacgatgaatagttactgtaagctgtcgcgtgggtgtgacccacctgtaagtgtagagtggtataactaggaggtgaggagtggtgctcggggtgtgttgtaattgaatcccgcgagcctttctcatcccctttctgctgataatctcatcccttttcgtctgatatctcatccctttctccaaagctatcctctgacccctaagacctccnagaccggggacaccacaattggggtacccctagcaccctcatccctgggattccgacgccacaccatggttcccgtncgaccactgcttcctacctaaccgcctggatggggtgtncccggccacagcctaccggatgggacaaggtcgccctgagcttctccgtcctcaccctccctccttgcccctccccccgaaattctacgcgatcggccgagcaggatttgtagctcgtcggcagcacgccgtgcggtttgtttttccggcggaggcacgactcccgcatccaaaaaaaggcaacgacagggtccactggcttcacccgcagccttgcgcgcgacgacgacgacggcccgaggataaagacgccggcagcatggcgtgcagctcgtcgcggctcagattgcaggtcggtatgccactcgtcggtgaattttttgcagctcgctgaatttccttttgcagttcactgtcagatccatggcgctggtcgtgccttctcctactgctccgtgtgaggtcaggacgggatctgccacgctgggaaccaggataactatcattgaaggatgtttttttaattacttgaacaaaggcagtcctccttgttgtaattgtttttaatatttcctttgctgtttgtgtaaattattcaaacaaaaatgcagtgctctttgagagaagttgaagccaatatcacaataacaagtcatttggaccgaagatgtccgcttgaaagtactgagcagtttgttaattttgcctctgt

SEQ ID NO: 12096 - DNA, 661 bp, Triticum aestivum
  unsure (1)..(661): unsure at all n locations
  Clone ID: PAT_TA_12096
gcaaattgctcgcagtctacttatacttatcccaccgaactatagaatagcgaggagataatttacaaataaaatatgtgacaatctaacagattattcacattttcatttctggctctcacaatccatagtcatgaccccaaaatcattatgaaacagtcttgaaattggtaaggttcaaggaagttactcccggattataatttgttactccctccgatccatattaatttcctttgttttgtacaaagttggtccttattattttcgtttgcttagtacaaagttaatataacttgtatgaaaccagtgacaattaatatactctctccgtcccataatataagagaattttgacactagacgaaaggagtagatcggagggagtaataatcatcggggtggatcttttcgatctgcactttcttcaccggcgacggttacagttttgaattgatggttctatgaagtcttagcacgacaacttcccaactatgtgctacaacaagttttgcttggcccaatgagggaggggagatgatggcggcacgcctttagcttggtccagtggttgtagtcgttgctaggtggtcttcggatctgatgtaatnctttgttacttcttatgttctttgtactacctttttttcaataaactgga

SEQ ID NO: 12097 - DNA, 1171 bp, Triticum aestivum
  Clone ID: PAT_TA_12097
ggaccgtgatacaatgtgtaaagattttctgaagctgattgaccttcttttcaaccgttacgaacttcccaatgctgaagggaagccaacacctccggcgtattttgatattttccatcaagaagtcatgacgatgatgtctctgtatgacgatccagaaccacagaagtttagggcatttcagagatatttgtcccatcatccggccttcaaagcaccgtgggtgcgatcagcattgttcggtgatgtgtggagagttatccaagctcttcctaggatcatcccaggcgaatatagtaaaagagatccttaagatagattgaggcaacatattggggattttcttgcttcggcgaagactgcctgggaatttgctaaggtttatggattttcccatacacctggagaaacagacatcaataggtatcggagctgcctgcttgttaatttcttggagttccttcgtcacctggacgaacatctccttgatcacactagaaataataatggcgaacagaaagtcaagaacattatccatgtcgatctgatgattggtgatgtttatgaagttcaggtggctacattaattcgtcaaatgatgttagacctaactgatgcaccatttgccagctcatggcgacattatgagatgtctgaatgtgagctggacaatactgatcctgaaagtggaaaggaagatgaagtggaagcaaaagatatttctgattctggaagtaatattgttatcggaagtgtaaacgaaaagaatgcgcagttaggaggcatggatacttctgcttctggaagtggaagtaaatgatgggcagtaacaaagcagctcccgcatcctgcatcctgcatcaccaagcctggacaatgctgttttaactttgcagtgaaactttggcgaggcatacgaaacatgcacgagatcgcaggaagacctgttcaatcataatgactgccgagcaatcaatgttggaactatgcctaccctgaaacatgtgttgaatttcgttttgtaaccctcttaactttattaccctactaactttattattatttttatcacataaggagtgcctatttatagaattcaaacaacctgtataacctgctagcgctgagtgtgtcgtagatgatgtttaccccgggaggggaaacgtttgtg

SEQ ID NO: 12098 - DNA, 651 bp, Triticum aestivum
  unsure (1)..(651): unsure at all n locations
  Clone ID: PAT_TA_12098
ggttacatggcacaactgtagcagagcatgccgctaatagctacttgttctgagaatcggcaacaggggatgtgcaggcaactggtggattacattgaggagatgctgaaatcgctggaggtggaaatgctgcttctgttcgcgataccaaacatagtcgatacatggacatcagcattcgggttcaggctgatcgaagaatctgacaagaagaagctgagcaaggtcaggctggtctccatccctggaactgttctactgaagaaggatctgtatgaaagaagtccagaaacagaggcgggtgagctgcgaaccgaacagcagcagccattggaggacaccgggccggtttgcacaacggagaccaacctcgccgacgaactaggaggctcggacaccaacctgcccctcgccgatcctccgtctgctgttgctctcgggaaatgtcatgtagattagtgcttagcgctgagttgcgttgcgcgaatgtccttcactatgctcactgagccctgaacatctaccagggatccggcttgaactcccgctggtgataatttatgcacttacgccctgctgactgagccctgaacatctaccagggatccggccttgaacttccgctagnacaattatgcacgtatgcccaag

SEQ ID NO: 12099 - DNA, 962 bp, Triticum aestivum
  Clone ID: PAT_TA_12099
cggctcgacgccgtctgcctccagctggacgaggcgtgcttccgccgccacgggcgggtaggggcgccggtggcggccggggccgacccgcccccggcggaggcgcagcctccgggcctgctggcgcctctgggggcgcggcccgcgcgtctccgccgcctcgccgcgccgcgccgcggcggcggccccctccgcgccacagggctggccaagatactgaagaagtatgacaagcgtacagggcggttgctccggctgcccttcatcgaggaggtgctcaagcagcccttctacacgacggagctcatgtcgaggctcgtccgcgagtgcgaggagaccatggaggccgtgttcgcctccgacaacagtgctgacccgtgcacgaggaagcgctgcaccggcactgagatgactcccatgtcaacagagcagggcccccttggggtccccctcgcggcccgggcggccgcgccggcgccccgccgccggggcgccgcgcacgcgcccctcccgctcccccccgcgcatgccgaggcccccccgccggtgcggggagaccatggcggccgtgttcgcctccgacaacagtggtgaccagtggacgaggaagtgctgcaccgacactggcatggctcctatggcaccagagcagggcattttaaggaacaccgtcgcggcgctggtggccatgcgggagctccgcagcgggagctccacgtacgggcacttctcgctgccacccttggcaaaggagacggagcatggcctgctgctgtccatccaggttgccgatctcgttcaatctgaggcacatggtattgtccgggtggtttgacagagtgcatgagtataattgtaggtacaggtttcgatggctacttaccggcgtccgattatatgatacgagtaacgcatactgcggactttttatttatttatttagaaaagccgcaaaaaaaaaa

SEQ ID NO: 12100 - DNA, 635 bp, Triticum aestivum
  unsure (1)..(635): unsure at all n locations
  Clone ID: PAT_TA_12100
gcgctcctctcctctcccgtgcgacgctggnatctcgccgccccgtcgcctttgtgcacgtcgtcggcgcgccccctcgctgctgcgcaggtagaactctcttcctctctcatctccctgtccgtctcttcccctttccatccccggttctctgccgctcgcgttgcttcttctgcagatgcagatgggtgagcggacagagcggcggcctcctccggccacggatgagaaggaagacaaggcgagagctccccagggtccccgacccccccgtgggcctggccccgttcggcccccctccctctgcgcccccccggcccgcggtagctctgagcggcctgctccccccctccggctctcggcgcggggccgattgtgcgcaggttggatgcgcccgtgtccgtcgcgaacctgttcttccctcgggccctggctggctcggctccccctcttcgccctcgctagctcggcgccgcggctgccgtcctctttctgtccctccctctacagccgccgtgctccatcggcgtcttctcgccacatggcctcgtccgcggcgggtggcggcgcccatacttccctcgtgcgacttcccccacgctccctgtgctttccctgcctcattccatgcagtc

SEQ ID NO: 12101 - DNA, 620 bp, Triticum aestivum
  Clone ID: PAT_TA_12101
aatgctggaatgccaccacaaacaattcattacaatatcactggcataccatgtaaaaacttcaacctcggtgcagcaaggggagcatcaccgccaggcggcaatgcatctgtgtaatgagatggactgcttttcgtcaaccttcaggatctgggtcactgctcagaagtcatatgtgcatgccctcaacgaatggctccagaagtgcatcctgcaaccaccccaggaacgacgccgtcggaagcggaagacctcatttcctcctcgccaggcagtctcccctccaatattcatcctctgcagggactggcttgacatgatggagtcgctccccactgatgagctatgcaagtccattaaagacgtaatgcagctcttgcgtgactcgttcgagcatcaggctgatcaaactaaactgagaagagagccacattccaggagtgagtctcaggaatgtgtgatgctggaaaataatgagcaggaatcaagcggcggggtagcactggtggaagggttacagtcaaaactgacggtagtccttgattgtctgacgaagttttctgaggcttcactgaagcgccatgagcagctcaagctgaattatgaggaggctcatgaca

SEQ ID NO: 12102 - DNA, 1326 bp, Triticum aestivum
  Clone ID: PAT_TA_12102
gccggccgggttccagaattcccttccacacgtttcgaggcgatctctggctctctcctcccccccggccccctcctcggcgcccgcctcgcgaatccgtcggaaacccctcgccgctccctgttctagcgcagagcagagatggtagccgcgcgcctcctcgcgcgggccacgaggcaatgcgccgccgcggtggtggcgtccgctgcgaggcggccgctcggcggtgtggcggcggtggccgctcgcccgctcggctcttccttcggccccgccagggttccatatatgttgaatcagcccttgagatactcaagcaacatctttcaaaggtttggcttttcatcttctaccccccaacaaaatgataaggaggtacacgaacccaaagaccaggaaagtactgcacatgaatcgaatggtgaagcttcaaaggaagacagtggttcgtctggaagtacagaagatcttgatctgtcaaaggaggatctagtgaagctagtttttgagaaggatgaattattaacctcgaaagatgaagagatcaaagatatgaaggacaaggttttgcgcagctatgcagaaatggaaaatgtcattgccaggacaaagcgtgaatctgagaactcgaaaaaatatgcagtacagaacttctctaagagcttgttagatgttgctgacaatttggctagagcttcatctgttgtaaaggaaagcttctcaaaattagatacatccgaagattctagtggagctgtaccattactaaaaaccctactggagggtgttgacatgactgataagcaactcggagaggtttttaagaagtttggagtcgaaaggtttgatccgttgaatgagaaattcgatcctgataagcattttgcacttttccaaattcctgatccttcaaaaccatccggaactgttgcttctgttgtgaaggtggggtacatgttacatgatcgcgtgctccgtcctgcggaagttggtgttacagagggaggtccgtccgaagagcctgaggagaaatcaggtggagattagattaaaatcggaatctagtaaaatataccagaagcaagaagacgtagctgttcctgcttgacgacgaccggtacctcatcagcgaaggagcttggcgatggcagtgtttcggattgttttttaatggtaaaacacaaggttggcttgttgaaatcccatttgtatgtgtgcacgtcacaccattccttagcagtacaatgtttcggagaattttgctagggcttcgaagaccttaataagagttttcctttcacatgataaaaaaaaaaaaaaaaaaaa

SEQ ID NO: 12103 - DNA, 694 bp, Triticum aestivum
  Clone ID: PAT_TA_12103
attcggcacgagagagaactagtggtaatggcaccagtgttgatccttgggtgtgcatcggagaccgacaaagggcgggagctgccacagcatctcgcaggaaggatggaagtaactgtagaattgagtgctaccgtaattgggtgtttgtggcacgggacgcatatgttgaggtgtggacacaggtggaaattacatcagaggctggggagaagaaggtgatgaggaaaaactgggtagggaatgggccatcgatggtcactgcagacggcgaggagaaggccaagattgtgagctgggccttcggaggcagcaggatggcattggctagagttgatcagcggtctattgaggtgtgggatagtgcttctggggcaatatcaggtaaccgctgagcagaggaacaagactaaacatgtaagaaatctcaaatttgattctgttcttgttcacctctatcaatgtagtttcggttgttgtttgtgatgttacattaaggttaagaacaagttcaccttgttcttccttttttaataggttaacgaacagtctacactataattgtataatctgcctacttttttttattaccgaaagaaaagatcaacaggcatagaccacatttctgtaagcaaaaatcaagtagaattgattgctaatcagaattccttggttcttttgtgtaaaaaaaaaa

SEQ ID NO: 12104 - DNA, 930 bp, Triticum aestivum
  Clone ID: PAT_TA_12104
gaggaattcggcacgaggcagaaacaggtttgcttttgttgatcttactgccggaccattttcctggggccctgctgtcggtggggatggtgttcgtacagaacttactctgccaaatgtggcaaaaactgttggggctgtcgcagaagtcacagaggaagaggctgaagaaaatctacaagatacaatcagagaaagattttcttctgttggcgaggattaccatgccgtagatatcctattggcagagattgatgtatatgaactttttgctttcaagcattgcatgaaaagaagggtacaacttgccctttgcaaagaactcgatcatagaatgcacgagctgaaaaatgaactgaagggctacaacagtggagattctgaagaaattaataagaagaaagctcttgatgcactgaagaggatggaaaattggaacttgtttaaagataactctgaggaacatcatagttacacagtggctcgtgattcatttcttgcacacctggggtcaacattatggggctctatgaggcatgtagttgctccatctgtttctcacagagcataccattactatgagaagctatcatttcagttgtacttcgtcacacaagagaaagtcaggaccataaagcagttgcccattaatgtaaaatccatcagagatggccttagttctttgttattaccgtctcagaagtcaatgtttacccaacacatgctgtcattgtcagaggaaccagcattgatgatggcattttctatggctcgccgtgcagccgcggttccacttctatcggtcaatggtacctatagttccacagtccggacatacctcgattctgctattctcccgcacccattacagaaattaagtgaggcaactgcacttaaaggagaacataccaatcacaggtcaacattgga

SEQ ID NO: 12105 - DNA, 708 bp, Triticum aestivum
  Clone ID: PAT_TA_12105
gggctgcagcattcggtcgagggggttgaggcttaatggctacacctacaagtgcattctgcaggctcatttgaggagcaagggggtgtccaatgggttcgaagtctatgaggaaatgcgcagaaaggggtacaggctggatatatttgcgtataacatgctgcttgatgcccttgccaagtctggaatggttgaccaagcttaccaagtctttgaagatatgaaacaaaagtactgtgagccggatgcgtacacatatactatactaattagaatgtctgggagggctgggaagacttctaaatttctctcattttttgatgaaatggtatcaaaaggatgtgctcttaaccttattgcttataatactcttattgaggctcttggtaagaacaagatggtggacaaggtaatctttgtactttccaaaatgatcgagggcgactgccagcccaatcaattcacgtatagcattacattggatattctggcaacagaaggacaactgcgcagactaaatgaggttctggatatctgtgatagatatatgaacaaatcaatttattcttatttggtcaagtcacttagcaaatctgggcatgtaagtgaggcacataatgtattctgtcagatgtggaactcctatgaaaccggagacatggatgctttcgtatcaatgcttgaggtgttatgcaattcaggaaaaac

SEQ ID NO: 12106 - DNA, 703 bp, Triticum aestivum
  Clone ID: PAT_TA_12106
catctacacgacctctgctcctctccttgcataatccctctcctctgctgatctccaagcaactaaatgcccctctccactagctgcaagtcacatcggtgtgaaggaaggggcacggggggtgctggtacgggagttggggcgagcaggagattgtgggggcggcggccagcgagcttcaacaggccggtcggcgaggttggtgatggtcggcgacgacgctggtaacagccgagctacaaccgcaagctgacgagctaccaccggctggtgtggatgctacaacccttgttgggcgagctgcaacctgcaaggagttgttactacctcgaccggcaggcgcgacggcggagcacacgagatgctacaaccgttgaggcaggagctgcaaccgcccccggattttgctggaaccagtgacagcggcgagctgcagggtgaccatggcggggagtgctgcaaccacgaccaggtttgctggaaccgactgggcgatttgctggaaccagcgcccaaaagtgcttccactggaattcgtttctttttgtaccagcgattttttgctaccaccacagttttgttttggctgggaaccaacattccaaaaatgcttccctctgaatttgttcttcttgttccggcccctaccggcttcatccgctaccttgcctccctggttccatcttcggcttgggttcccaac

SEQ ID NO: 12107 - DNA, 798 bp, Triticum aestivum
  unsure (1)..(798): unsure at all n locations
  Clone ID: PAT_TA_12107
gcgaatcacgcccccggcgaggccgggtgcggagggagtcaggctgggcgtggcggtggcgagtccctctggcggggacgggcgctaggctgcggcggcggcgccgcggggggccggtggtggcggcggggcgccggcccccagtgcggcggcgtccctcatctccggactctggggatctccgcttttccccggttcgagggttgtcgcctggacctgttcctactccccgggggctgctttcgctgggttttcgacaatttgccctggagcaggtgaagtgctgtctgtgctgaaatttgccatctcggcgcaggaatcctgtcgtccttgtgtcttgttgaggagagaatcgcttgggatttgccttgtcttggtcggctcttgcttggtgtttgtgcccttgttatgctaaggtctgaatggagatagtagataagattgcggagcctgaagaccctttggtggtcactgctcggaaggtgcagagcctggagccgccactgccgattccgataaaggcgtcatggaaagggaagacctcccagcagcaggatgagaaggatctgccagatgatggcgaggagagcttccagagcgtggattcctcggatgagggtggccggagttgctttctctggggccagtcaccccctcgagcccattgatatggatcttatgaagacggtgtatgtcgcaattgatgaggagaagcctgagccgccggtgtgtatggtgcgaggactatcagcganagggccattcatggatgacctttcgctccgtgtcacaggcctg

SEQ ID NO: 12108 - DNA, 713 bp, Triticum aestivum
  Clone ID: PAT_TA_12108
tcgcctcgtcgccgccgtcgccggttgcccccccggctccgcctgctctttcccccgccgccccgccggcccagccggacggggtgcgcgcgcctgaagccgcgccgcgtgggcgggcttccggctccccgcctgctgctggtcgtggcgtcggaggtggggaccgcccggcgccaggctctgggccctgtcggcgccccgtggctcgccccggggccccgagtgcggttccgggcgccgcagcctaggatgaggaaatgaaagaaccatctgtggaagaagttgttgttccacatgaagaagttcacaacaaggaggaagctcggcatgaggccggcacggatgatcagcaagaaaaattggtccctaaggacgagccggctcttaagaaatctgatgatctaaatgtcagccaagaagacagctctaatgacaaagtggatgttcaactaccggagaaggataccacattgctagggatgccggaagatgagcctagagcgagcatggagtttgaagagtgggaagggattgggagaagtgaagtggagaagtgaggtggtgcagcagcggcatttgcagctagtgacgccgcggcggctgctctgtcctagcggcgtgccggcgtgcagctgcagctgcagggacttctcaaggttgcagttgatggtccctgttatgacgctgcacaaccacttacactgagaccttct

SEQ ID NO: 12109 - DNA, 511 bp, Triticum aestivum
  unsure (1)..(511): unsure at all n locations
  Clone ID: PAT_TA_12109
gcccgggtggtactggccgttccacatggtgatgtgcgccgcgccggagctcgtcgactggttctccagggccttctacgtctccaagtcaagcgacaaggacggcgacacgctcagcaagaagatcctcatggccgtcggcggcaacaagttctaccccaagaacatccgctcctcccagccccaataagccatcacccgaatcccgatcgacactaagccagccatgcatgcgcgcatgcaccaaatgtatgcttggttggcttggcaccaaagtatagcagtggccagtggtgtgcatgcatagcactctcgttttttcttcttttttctttctttcagtgtgatgtgatcgtgatgtgagtccatacgatgtgagatctgttgtattggtggtacacaacacatgcggtgttgcaaagaggggtgcctncctctaaatgaccgtnctgttgttgncttatacggacgaaaaagcatgagagagacaggttgttcgtgaaaaaaaaaa

SEQ ID NO: 12110 - DNA, 1254 bp, Triticum aestivum
  Clone ID: PAT_TA_12110
cgtccgcttttgcccttgtcttcttcctcgccgctcgtccccttaaaccctcccatggcggcccgcccatgttcccgcggctaccccaaactccggcgtctcctctcctctgccgccgccgccgcgaacctccccctcctgttctcctagaggcgcgtggccgtggccctctccctggtggatttggatgaatgccaccggccggccgccccaacccatcccctccccagcgagatctaggctgcagccccaaagagaactgaatattctccctctccaactcgcacgagcttcgatccggtgccctgcgcccggcgtccccgagaccggccccgaccccaaacgcggtttccaacccggcccgtcccccctcccgcacgcgtgcggcctccgagagcatcgcgcggtcctacatttcgttgcgggtgactcctttccgctcagtggttatggtgccgcctgtgtaccaggagcctagtatcatgccgatcaatacaagaacggagaaggagttggaagaaaaggaggtgttatgcacgcacaaaaagcccaaagctacagggtgtgttgcccaaccgcagcaggaaattgaactcgccattgagagtgataataaagggcatggtgatccttcaccgaaagagtctgcttgtgtggtgctgagcagtggtgaagcaaatggttgcggtgaggggcatgttcttggcggtgcaaatgcagaaccagaagcaagcttgagactgtttccaactctgcagtgcaattggctggaagagtccaacatatgagtttcaagaacatggacatggccatacaaaactgttcacatgcaaggtgagtgttcttgtggagacgttcacagacactgttgtggagtgcatcagtgagcccaaaccccagaagagagctgcccaggaacaaggtgctgaaggtgtgttatggaccctcaagcgccttggccatgtgaaatagctctagacgtcctccatcaggcgcggcgcggcgtctgtctgccctcttgttaccatccgatccaccataagagcggtctctgatctttcttgaatccatgactcaacctgcgatcacgttgtcagctgctgcttatgcatggctaaacacaaaacaccatcgtgttttaattttgttgctttagctctctaggatcctagtccagttatttccagtcggctgtaggaactctcggtattactttgtgttcaagttctgcttaagtaagggctctagcagagc

SEQ ID NO: 12111 - DNA, 563 bp, Triticum aestivum
  Clone ID: PAT_TA_12111
tttttttttttttttttttttttttttagacatatctgtacctttttatgcatcgataacaatgacaaatgtacaatgattacattgttaatcaggagacatcattagcattcagcactacaaatgtactgtagaaacgattcacagggcaatcaggggtgatatctgtacatgttagctgcctaggctattggggaaaatcgtgagctctcagttgcaatggacacagagctcatagtcatatctttttcttgtcttccttaggtctgatcatctgtacaggagcggctggaatacgggcccaccactctttaattcgtcttcggaacttctctgtgtgttgcttccttagtggcatctccctcgtgtaaacctccaggactgccatcaggagcagatgcttaggaggcatcaacacgacaaccgcagctgcaacaagaagtgccactgcgactatttcagttgcctttggaacagctgcaaacagagagctctgaacttgagaagaacaatatttacagcctgtagggtatcttccaacttggatatagcttcctgcaaga

SEQ ID NO: 12112 - DNA, 622 bp, Triticum aestivum
  unsure (1)..(622): unsure at all n locations
  Clone ID: PAT_TA_12112
cataagcagagtgcagtacacgcagcagcagattttttttttccttttgttccaacagcatcttgtttcataaaaataaaaaaacgcctcttcactcgcangtccagaagctagcggggctcaacttcttgcttaggaccttccagttccaggacagtcccagcgcgtgacccagctccagccttagtcactgatgccagacatgcttcatcaaaagccccacttgtccgttgcatttttggatgctcaaaagttgcttcttctgtcctttgatgctttctgaggttggagattttcgaactcacaaccttgcttgtgcctgcatttatcactgacgagatcccagagttctcagcatggcttgtcaagttcactgtctgtgaaactgcagcaacaggagcaccggatatattagcaggaactgtcaatgtaccagacatagtctgcgaaactggagcaacatgagcacctgcatttgtcaatgatgaggtcccagacacagagtttttagtaagatctgtcaaggtattcgacatggtatgcgaggctgtagcaccaggaacaccttccttctccttttcacttgactgaagttccagaccagcttgcaaactttcatcaa

SEQ ID NO: 12113 - DNA, 734 bp, Triticum aestivum
  Clone ID: PAT_TA_12113
ttgtttttgcgtcttccttttgctcctctcgtcttcctagagaagcatgacattgcttttcaaagagacatcggttggatacaacatgagcacccggcaaaatgaggcgaacagcgtcccattcacatgtaaaaatcaaaatataaagcaaaaccaccagacttcccatagagctccaagctccattgacccctcttcttgccccgcttcgccctccggaagaatagcccgatgggtgtcggtgcaccatctccagcaaagatcttttcttctcgccgtcctcaccatcctggatctacttggacgtcaaagactcgggagaagagtcagtcaccgccatcttctcatccagatcatctatttgcttcttcagcctcgaaccatggttagggcaacctcgaaactagtaattgaagattgcaagcaaaggaggatccactcttcactcaaaattgggatttttccagaccgccccggtagatcttcaccacaatctgtcctcgccccccacgggggcgctcccggggccacacctcgccccggcgcccgggccctgggcgacaagcacaatcatgcttgcatctcgtagaaactgtccagcacagttgtagacaaggccgtataccaccgccaacaccatcgcaccccaggagtcccacacggacgagttcacgggcttcttgcgccacaggggggacttcctggtgctgatgttgagcaccttggtgggcatc

SEQ ID NO: 12114 - DNA, 494 bp, Triticum aestivum
  unsure (1)..(494): unsure at all n locations
  Clone ID: PAT_TA_12114
cacgtacacttnatatctctcgggcgtttgtctcggctgccgcccgccgcaccgggttggaggagctttggctcgtccatttaatccccaaggaacatacttacaggtcacagctcactagtactcagggcagcagacggcagcacacgccgtctgctcccagccgtgccaaccgcacatatcatggttcttctatacatacaacaggagagcacagacagatgtgcaggggagtcgggaacaaaccaggacgacacgcgccatgtcgacgaacaaccttgagcagccgtgcacaaaatacaaatgaccgatctgagcaccggttcggcccgcttgctgcgccggtttcgcgccgtgccggtctgttcgacatcttcgacacgcaggtgcggacactatgatgtcaacactgatgagatccggtcggttctccgcaagttgtacttgtcgtacaccttttcgtggttgtcgctccaccatgactccgcttgctc

SEQ ID NO: 12115 - DNA, 751 bp, Triticum aestivum
  unsure (1)..(751): unsure at all n locations
  Clone ID: PAT_TA_12115
cgtccgcccacgcgtccgcccacgcgtccggacatgttctacgacttcaacgccgtcggcgcgagcgacgtcgccgtggtgtacgtgcccgagtgggccaagatggccgacgaccccgtccacatcatgttcgcctacagcggcagcgacggcgctagcctgatgatgtcgaaccccagggttctggtgatagcggagaagggggcggaggtcgccatcgtcgaggagcatttcggggtcggggaagaggacggtggctgctattgggccaacccggtggtggacatcatagtggaagagggtgccagagtggttcattcctatgtgcagcgacagtcacccgctgcggcgcataccaagtggaccaccgtccagcagaatacatctagtaaatatgagttcgttgaggtcagcaccggagcaagactgaacaggcacaatcttcacatccagcaactgggtcctgagacagaaacggaattatcaacgtttcacttaacatctcacaataagcagattcatgatctgcatagcagactaatacttggtcccccccgagggggtttccaccgacacccccattgattgcttgggcntcgtgggttgcaatggttatgggatttttggatnggaaatattncaagttgaacaaggtattgcacaancaaaaccngattcaagggacaacnaaaccaaagtntncctccctgcnccncaaccaaaanggcttntccttgaaatggtnaaaccc

SEQ ID NO: 12116 - DNA, 1489 bp, Triticum aestivum
  unsure (1)..(1489): unsure at all n locations
  Clone ID: PAT_TA_12116
gngtttgnccnttnnnnnnncttntgattccgccnagctcgaaattaaccctcactaaagggaacaaaagctggagctccaccgcggtggcggccgctctagaactagtggagccccccggctccccacgcgcgccggctcccctcttcgcctcctgccacgcatcccacgcgtccctcctactcctctcccccaaccccgccgccgccgcgcgtctgcgcgtcggtggcctccgagtcaggcggccccgccgcctccgcctccccgtacgcaccgccgcgggaggcagcccactcgacgccgagatccccgaccctacagtcgacgacgacgagtggggccgcgagccgcccgcttccgcgccgggttgctcgcgccccggcgtcaccgacgagtggggcgagccgggggtggccgagcctgagcagccctccggcgccgacacccctaccaacgacgacgagtggggcggggagcccacgccgacgccgcccaaggcgaaggaggctccggttacgaaggaggacgaggggcgggaggagctgaagcggtgcttggtggacacggtgtacggctccggcctgggcctcaaggcgtcctcggaggtcaggggggaggtcgtggagctcgtggcccagctcgaggctgccaatcccacgtccgcgcccgtccaggcgccagagctcgacggaaactggatactcctgtatacagcatattctgagcttctaccgattctgcttgccggggcaacaccattcaccagagttgataagatatcccaagaaattgactcgagaatcatgacgataattaatgcttcaactatttcgactccatttgcttcgttttcattcagcgcaactgcttcttttgaagtccaaactccatcaaggatagaggtccaattcaaagaggggagcttccagcctcctgagatatcatcatcggtaaatctacctgaacagatcgccatattcgggcagaagttcagcctggggactgttaaggagctgctggagcctttgcagcgagcatttgctagcattgcagggtccatctctgggcagccacccctcaaggtaccgattcctgggagacaacaaggccaagtcgtggcttttgacaacctacctggacaaagacttgaggatttcaaaaggcgatggaggcggcgtgtttattcttgccaaagaggggagccctttactagattaactgtacatgtgtaataggtgtcattattcatatctgcaaggttgaaaaccacagctacaagcctacaacggggcattcttctccctctttgatacacaattttctggtggttttctagagtctggcagaatcaactaaatattgtcagtatgcagtctccatacacttttttctccctggtaactacctagtgtacattttttgtgttattaaaaaggaatgtgcacattactttttcgttggggtattttcaaaaaaaaaaaaaaaaaaa

SEQ ID NO: 12117 - DNA, 688 bp, Triticum aestivum
  Clone ID: PAT_TA_12117
gccaaatcaaaacggcatatttgaataagccaatatgacaaatagtacaaactggacgcaactatttatagtttgtgtgtctggaatgaacatcgagtctgaaattaagttgttacaaacaaaggagttcaatgaagagaaggcaagagaacagccaaacctagtaataactaatggttcgcaatgggtgaaaagcaggggggaggggggatacaaatttaatggttcttgaattgccagaagcaagttgagaattcagacatgagtggacagattgagagcttcgtctcgacacagccggaagatgggtcagacgcagtatgcttgactgttttggttggaataaaggcggcacccggtttggaggcttacaccatcgaagcccaggtggacgagaatttttagctgctactacctgattgcgacatttgattaatcgatccgagcaatccgcccgcctgaaacttgacgcatgcttcgcttcctctctgcctagaattttccccatgcatgcttgtgtgctagtaacgtaggtcaaggacgggacggttggggtggtcctccactgcggccctcaccgcagcctttgcttcatccacctcccagtcgctagcttcctcctttacaactgaaacctcgacttcctctagggaagggaggtgccgcatgcccaaatcaatgttttcat

SEQ ID NO: 12118 - DNA, 676 bp, Triticum aestivum
  unsure (1)..(676): unsure at all n locations
  Clone ID: PAT_TA_12118
ctctgaagctattntnctggggcatgagagagaacatcttatgtacaagagaaaccgcctaacccagttcaaaaggaaaaccgtgccctcctaaacctgttaccggggacgaaacccacttacacgtgactgtaaacatgggggctattcgccggcccagcggagcccagcgcctaggccacttccaaaattacgttagttcatcatttgggtttccatttcgcaaggcagcggtgaattaaaccgcgattttagttagcaccacgaggcaggtcaccttcccctgccatagccatgatagatcccgccggcgatgtagtaccgctgccggccgcgaccgcctctgtttgaaccgtcccatgaaccacgaccggccgagccgatactgccgcctgcgctgcttcctccttgaccccagaacccagtttggaatgatgatgcgttgaattcttcctcctccctctcgttgtattccaggattttctgcttgatgttttgcttctcctcgagcagagccgcctcttgctgctttgtgctctgaacgagtgagcagtccccaggaatgagcatttgccttgtctgctgcttgtgccctttcttcacaagcaccctgacgcacaccttgacctcactaccgcccccagcattacccttttcctcagctgcaagctcttct

SEQ ID NO: 12119 - DNA, 324 bp, Triticum aestivum
  Clone ID: PAT_TA_12119
ttttttttttttaaagcaacaacagcaaatagttatttaacctaacattcatactgtaccacagttatgaaactacaggccacaactagaacttgtggtaacagcaggcagcgaaggcccataaacaggggccctagccaggaaagatggagactgaaagtggacggaggaaacaccttccccctccagcacaccaccactgcctggatctcactaggcgtggttgcatcacaagctcggacgcgtggtatcatcaacatgacaaaggtaacataaacaataaacctgtggaacaccagatggttggttgcatttgtgacgggg

SEQ ID NO: 12120 - DNA, 1017 bp, Triticum aestivum
  Clone ID: PAT_TA_12120
ggaagccgctgcactcggcgcccacggggatgtgggagtgcccggacctgtacccggtcacggtggacggccggcagaacgggctcgacacctcggtcacgtccagccccaaggtgaagcacgtgctgaagaacagcctcgacctgcgccgctacgactactacaccgtcggcacctacaaccggaagaccgagcggtacgtgccggacaaccccaccggcgatgagcaccacctgcggtacgactacggcaacttctacgcctccaagacgttctacgacccggtcaagcgccgccgtatcctgtggggctgggccaacgagtccgacaccgccgtcgacgacgtcgccaagggatgggccggaatccaggcgattccgaggaaggtttggctggacccgagtgggaggcagctgatgcagtggcccgtggaggagcttgaggcgctgagggcgaaaaagccggtgagtctcaaggaccgggtggtgaagcggggagagcacgtcgaggtcaccgggctacgaagctcacaggctgacgtcgaggtgagctttgaggtgccgagcctggagggagcggaggcgctggacccggcgctagccaacgacgcccagaagctgtgcagcgtgaggggtgccgacgtggaaggcggcgtgggcccctttggtctgtgggtgctcgcctcgtccaagctggaggagaagacggcggtcttcttccgggtgttcaaggccgcgcgcaacatcaacagcaccaagccggtggtcctcatgtgctccgaccccaccacgtcatctttgaacccgaacctctacaagccgacgttcgcaggctttgttgatactgacatagcgaagggcaagatatctctgaggagcctgattgatcggtccgtggtcgagagcttcggggcaggaggcaggacctgcatcctctcccgggtctatccgaccctcgccctaggcaagaacgctcaccttcacgttttcaacaacggcaaggtggacatcaaggtgt

SEQ ID NO: 12121 - DNA, 2168 bp, Triticum aestivum
  Clone ID: PAT_TA_12121
gccgcacccgcccacgatctttctctacttgttcttcttcccatcgccggcctctgtgccccagtgtgagagcactggtagttctcgggggaagagttgcatgggcatgctcggtgctgctgctgttgcagctcgccggggcgtcgcatgtcgtctacgagacccacctcctggaggcggaggcggcggcggccgacgtgccgccttcgattcttgaccccgagctgagcacggggtaccacttccggccgataaagaactggatcaacgatcccaacgcgcccatgttctacaaggggtggtaccatttcttctatcagtacaaccccaagggggcggtgtggggcaacatcgtgtgggcgcactcggtgtcgcgcgacctcatcaactgggtggcgctggagacggccatccagcccagcatcaagtccgacaagtacggctgctggtcgggctcggccaccatcctgcgcgacggcacgccggcgatcatgtacacgggcatcgaccgcggcgacatcaactacgaggtgcagaacatcgccttccccaagaacaagtcggacccgctgctccgcgagtgggtcaagcccaagagcaaccccgtcagcgtgccggagggcggcatcaacgccacccaataacgtgtcccggaggaggcgtgttgagcggtccgccgccggcggctgctcagcggcgcgctcgctcgcccgtcccgcgccggtgcatacgactcccgccctcgccaagaaatgcgacggtcacgggtgcagcaaccgcagcactcagctcccactgtcacagttcgaggcctcggagatgtagaagcccgcgctcatgaacggtccttagaatttaagctggatctacacgcagacttcctatatatgtgcccgaactgagctcatattctgttaaattgatctctagtgaaacgtgatagttctacgtgggtacgtacgtagctaggtttgcacgtagtataagtgcactacgaagggatcattttgcccgtaggaataataaaagttctatgcatactctgccgtgcacattggtggaaagtatatatattgccggacgagttttagtttccaaggttgcactctatctatccatccattatatcgctcatgtgcctgaatttggctcacgttctgttaaattggtctctggtgaaacatgattggtctgtgagggtacgtatgtagctaggtttgcacgtagtataagtgcactacgaagggatcattttgcccgtaggaacaataaaagttctatgcatattctgtcgtgcgcattggtggaaagtatatatattgtcgggcgagttttagcttcaaaaaaaaaaaaaaaaaaaaaaaaaaaaaaaaaaaacgcccagaagctgtgcagcgtgaagggtgccgacgtggaaggtggcgtgggcccttttggtctgtgggtgctcgcctcggccaagctggaggagaagacggcggtcttcttccgggtgttcaaggccgcgcgcaacatcaacagcaccaagccggtggtcctcatgtgctccgaccccaccacgtcatctttgaacccgaacctctacaagccgacgttcgcaggctttgttgatactgacatagcgaagggcaagatatctctgaggagcctgattgatcggtccgtggtcgagagcttcggggcaggaggcaggacatgcatcctctcacgggtctatccgaccctcgccctaggcaagaacgctcatcttcacgttttcaacaacggcaaggtggacatcaaggtgtcacagctcacggcgtgggagatgaagaagccagcactcatgaacggtgcttagaatttaaggtggatctacatgcaggcttcctatatatgtgcctgaatttggctcacattctgttaaattgatctctggtgaaacgtgatagttctacgagggtacgtacgtagctaggtttgcacgtagtataagtgcactacgaagggatcattttgcccttaggaataataaaagttctatgcatactctgtcgtgcgcattggtggaaagtatatatattgtcgggcgagttttagtttccaaggttgcactctatctatccatccattatatcgctaaaggaaaggttcatttttttcaaaaaaaaaaaaaaaaaaggccccta

SEQ ID NO: 12122 - DNA, 847 bp, Triticum aestivum
  unsure (1)..(847): unsure at all n locations
  Clone ID: PAT_TA_12122
agctcgccccgaaccccctcccgtgttcgtcgctaatccccatttcccacaaacccccgtcctctcgctgcaaccgcttcgcccccaccgagtgcgatcgagaagcttccaggagctagggtttcccgtaccgaccgatggccgtcgccgtcgccgacgcggtgctgccgtcgccgccgctcccgcccccgcccccgccggcgcggatcgtcgtcgtggtgctggcgctcgtgcacttggccctcgccccgatgctcgcgctggggcgcgccctctgcgtcgcggcgggagccctcccctaccagggcttcggggtcgcgtgggtcatctccgcggccacggctggacaggtcgtggcgagccgcgcctggggcgagagctccgcccaattcctgttcctgcaggccatcatgtactggggcctcaaggtcctcatctacagcatccttgtgctggtcgcgcttctcgccctgttgatgtgcgtggactacgtgtttgcacttgtatctggatccacttcggcattcaagaagagcgcatcaggagcattcacgcgggagtcggttgcagacatgtttaggcttccgcgcaccgcggtgcttggatatgttgcggatgtggccttcttccttctaatggtcgctggtcttctggtggcgatgctgtcgccgcatgtggagggttcgatatctcagggtgaaatggtcgcctccgtaatcatagatgtggcactatttggtatgcacgcgacagcttgctttgttatcatcccagcgctcgttctaagtggtgtggaggggtggncaggcggacaggaaagtgccatcgcagttttgttgagacgagc

SEQ ID NO: 12123 - DNA, 773 bp, Triticum aestivum
  unsure (1)..(773): unsure at all n locations
  Clone ID: PAT_TA_12123
ctgctttnatagagcaagagttcaaggctgtcaaaaaaaagagttacagaggctgctccaacacgcataagcacccgtggatgatcgtagcatgccacggataaaactagctcaatggatagtgattcactgaagtaactgactgcggtgcgttgtcataggaaaaaaaaaaactgcncggtncgattngatgctttttccccacncaaaagatgngacattatcaagttgctagttcacaaaactcacagggattacattgtatgcgctcgtatttacattgttcaaactaaaatggcattcatctgatagtaccataccgtcagcaccagccttccactcaacttcttcatatgctggaatttgaatttgatgaatccttccacatacgactgcaagtaatccctcccccaaaaagatgacctgataggttgcgtgagcacacttctgttaaccgccaatgcattgcaatttcacaggtatgctacaaacataatagaggaatatgatttctcactcattttggccctcaacatatacttctcttgttgaaggattccattgtcaggttagcagtgaaggctgggatggaattcatctttcttatgaaaatatcaacctgctgagcaatctcatgttgagaagtgtagccattgaccactatattggtgcttcgagtttctctatgaatcaggaagcaccaatatactgattgcagagtaaatcgtgttacatgaatcccatttggctgctgctcatcatcggacgcgtgg

SEQ ID NO: 12124 - DNA, 638 bp, Triticum aestivum
  Clone ID: PAT_TA_12124
tgagatgagccttgcagcagcatcacatagtcacatttacatgtacagctagctatagcttatgcctaaagccagttccataagattcttgccatgtgtgagaatcgcacaaggaccattatatgttggcccagcagcactgctcaaattacaagagaaaaatgaaaagaaacacatcgtttttatcgcgacaagcttgttggctaggctcgccctacgggagatagaggtggctgacgcggcacatagctggccggagctctaccttggccggctgctgccatagccttcagcttatgatcggcaaagactgcatcgtcttgcgaggttggcaaatcggcctgcgtcctcacagggctcctcccatgaagcatcactatacacatagcgaaggcctgaagtaaagcaatggatgatctgaattcgactgcatataacccttctttaaacgaaaccatactgaaggcatgacgatcctcccgtgatcgaccctgagagagcaagtcgaatcgatggctgccatcctgcgtttggttcacctgaatagacttgcatccttggtttccttgggtgttgtcggtgaggacactcagcgtgcaaccttcatcccacccaccacagtcacatgatcctctgga

SEQ ID NO: 12125 - DNA, 372 bp, Triticum aestivum
  Clone ID: PAT_TA_12125
ggccggtgtaacgacgggcaacgtcgcctacttagctaacgccattcatgatgttaccaagtcaaattgaggaccatcttcagcgaatggagggagagcgttttccctttgtttgtagggctattcgctttatactctcacatgctagagaaataagttctaggaagtaaacctgttgcggctgtccaacaacggaaaattctacctgtatgtatggaggagcagagacgtcctgacttattttttgcgagattatcctatttttgattccggtcacattcggatgtaacggcagtggaaattgggtgggtataccttgattttacaagacgccggaggacttcagactcgacgaaatcgaacatttggatg

SEQ ID NO: 12126 - DNA, 1734 bp, Triticum aestivum
  Clone ID: PAT_TA_12126
cgtccgctttatgctctcccctggaatttcacgacccgccccccgcagccagcccacggcgatcggggcactcatctaagcagttccccccactgggggtgctcaagaatatgcaaggcccatgcgcctccacgcacgcacaccaggatgcctgactgtcgcgcgggcgcccgagtccgcaggagtggggcttaagtcctgcccctaacccaggggcgggcgatggcgtcgctcttcggccacgtcgagccggcgcccaaggaccccatcctcggcgtcaccgaggtcttcgtagccgacccctcccccgacaaaatcgacgtgggcgacggcgcctaccgggacgacagcggacagcgggagaagctcgaatgcttgcgcgaggcggagcgatgggaggatggcaacctcaagatttagtaccttctaatgcgatggagtgtcaactgaattaatggatcgctaaagaagtcaataggataggaccctgacttcatcagagagaataaacttgccgcgctgcaggcactttcaggaactggcccatgccggttctttgctggattttaccaggggttcttgccggatttgcagagctacatacctacaccaacttgctccatctatcataatatttggagggatgctcaagtgccacagaggacattctcatattaccatccggaatcgagagggcttgactttgcaagattgatggatgatatcaagaatgctccaaatggttctttctttttgcttcatgcatgtgcccataatcctactggagtagatcctactgaggaacaatggcgagaaatatcctatcagttcaagttgaagaatcatttcccattttttgacatggcataccaaggatttgctagcggtgatccagagagagatgccaaggcaatccgtatattccttgaagatggacaccaaattggatgtgctcagtcatatgcaaagaacatgggtctttatggccagagagcgggatgtctgagtatcctctgcgaggatgagatgcaagcagttgctgttaagagccaattgcaacagatcgcgagaccaatgtacagcaacccacctgttcatggtgcgctggttgtttcaattatccttagtgatccagaattgaagaacgtatggttgggagaggtcaagggtatggctgatcgtatcattggaatgcggaaggcacttcgggagaatcttgaaaagttaggctcacctttatcatgggagcatgtcaccaatcagattggaatgttttgctacagtgggatgacaccggaacaagttgaccgcttgacaagtgaataccatatctacatgacacgtaacgggagaataagcatggctggcgtaacgacgggcaatgtcgcctacttagctaacgccattcatgatgttaccaagtgaaattgaggaccatcttcagcgaatggagcgagagcgttttccctttgttactagggctattcactctatactgtcatgctagagaaataagttgtactgtaggaagtaaacctgttgcggctgtccaacaacggaaaattctacctgtatgtatggagaagcagagacgtcctgacttattttcgcgagattatcctatttttgattctagtcgcattcggatgtaacgccagtgtaacaagatgccggaggacttcaaactcgacgaaatcgaacatttggatgtgtgttgcagttctaaaaaaaaaa

SEQ ID NO: 12127 - DNA, 838 bp, Triticum aestivum
  Clone ID: PAT_TA_12127
gatctcgccgccggcggaacggttggcccgcgcccgatttgatcctcggcctgctccccgccggccgtcgcgatgtggggggactcgaagccgatgctcaagtcccgcggcgggggcgggggcggcggcggcgccgacgaggagggcgactacttccccaacacgccgcgcaaggactggtccacgggcctgctcaagctcgtcaccgccatggtcatcttcatggccggcgtcgtcatcggcctctccgtcagcgccaacgtctcccgctactactacaactcgtccgccgagctcttcttccccaccgccacctacagctcctgcgaccgccggggcgccacgggggactgcggccccggcttcagggccttcgtgcacccgcccaccctcgcgcactccatgaccgacgacgagctcttctggcgcgccaccctcgtgcccaccgccgaggagttccccttccagcgcgtccccaaggtcgccttcctcttcatgacccgcggcccgctccccttcgccccgctctgggagcgcttcttccgcggtcaccaggggctcttctccgtctacctccacaccatcccggactacaagctcaacgtctccaagacatccccattctacggccgccagatccccagcgaggaagtgtcttggggatcaataaccctggttgatgctgagaagcgcctgctggccaatgcattgttggatttctcaaacgagcgttttgttctgctctcggagagctgcattccggtgttcaacttcccaactgtctacgagtatctcataaactcggagcacagctttggcgagtcctacaacatcgaca

SEQ ID NO: 12128 - DNA, 2697 bp, Triticum aestivum
  unsure (1)..(2697): unsure at all n locations
  Clone ID: PAT_TA_12128
gcagaggtgttgaaccaaattgtctacgagctgcctatagagcatccactggcagagacaaagccattgcgtgaaattcttggacacactgtccctcaggtggtggctggttgccatgtgctcaacttgattcatgattgggatatgtgtatgtatttgctctagcctctaggggaatatgcttgcttgaccccatgccaggatggtgggtaactactcgatggattctccaactagtggtgctcacgaatgttgctaatattgtgatctagagatgcttaatctacaatattctgcttcaatttacccactaaataattagtcatggatgtcttatggttgggactttgtttatttgtgtactctgcttttcttcttttatgtttaataattgggctaaagtgtcaacctcaaatatcngatgcgatgtttgcattctttcagtatttaacagntgtgagtgccctccattgtgcggttctgggaccctgnatcaacggctagttttgataaccatattctgatnnccttgtttattgccaatgcaggnaagtgtctttggggggccaataacccctggttgatgctgagaagcgcttgctggccaacgcgttgttggatttctcgaacgagcgttttgttctgctctcggagagctgcattccggtgttcaacttcccaaccgtctacgagtacctcataaactcggagcagagcttcatcgagtcctacaacatcgacacccctcaaagcgctggccgctacaaccgtcgaatggcacctcacatcttgccggaacaatggaggaaagggtcagagtggtttgagcttaaccgggagctggccgtgcgtgtcgtagcggactacaagtactactcgatcttccggaagcattgcagaccatcttgctacccggacgcggccgggacccctcaccacggcacaccgaaggagaacgagagggagaggggaaaagcccacggcagaaggaacgcgaagccgtcccctcccgttcctccctcgcgccgacctcgagcgctccccctcacgccgggccaggaggcctccgccggagactccgtcgcgggcacgcggccctagccgcagctggcagcaggcggacgggagcgggcgcgcggggcagccgtcggcgcactggccgccgagcagtccgccaatgttcttcaccacgtggtatagagagaaagcctagggatgccaggcaattcatacccttctggagggatggcaacatcacatgcagccacagtgacagctctagcagtgcctggccgtggtcaagaaccctttcgtagcgcgacttttccccacctcggtggtgctggcaggtgtgttgatgccaagattgcatttggtgaaccgttgggatgctgggaaaatcatggcttcaggaggtgttcaaccaacatgttcaggaacagccaaagcacttgccgactgtcagagacaacaccattgcttgagttgcgctggattcacagcttcatcagttcttgcctgggtgcatccttggaatccttacggctgtgatcatgctctttagctctcagggagttacacttagatttcggcaatattagatcctcagatatcatctcctggatgagataaagcatttgcgtgaaagtcctgcacttactgtacctcgggaaggggctggttccattcctggattcttcaaggtcgtgactatgctcttagtctgtggggagttacactgaggtatcggcaatatttgatgatcagctatcacatcgccgatcttgtaaagcataaagagaaatgctcgtctttgatgtaacgtgtataagtcgcctgtcaatgctgctgctacacagacttttatctgatctacatctgcgctctaggccagcaggtcctagcttcagttggtgctgtaaatctaaggtggttgccgtcgattcgaacctccgcaggctggatgttagccgatcaactatcagagatatgcagagcttgggaagtcagggtactgagtaacccggaacaacattacataccgacctatcttcatctgttccacgggtcgctcaacgccaacaggaccatcacatgggttgattggtcaagaggaggcccgcatccagcgagatatggtgctggaaacatcaacgtggacttcatcaaggccatcaggaacaatggtacgcagtgcctctacaactcgaagcacacttcggtgtgctacctctttgctaggaagtttgctcccagtgctttgggaccattgatgaacctcacttcgacggtgttggacttttgagcttggcttccgttggcattatattatcgagctatctccatccacgatcactcgctcgcgtgccggtaccggtcaggtggtagaggtactctgctagctcagggacatgtgtctcttcttagatagatgagagactgctgtcgaggacgcttggctggcggatgacgctgtgtgggacggtgaaatttacttcacttatcctgaggctgattcccgagtaatggacgaatggcactacaacatccagagaggacattttcacctcccattctttttaatatatcatagctctgtgatagatcttttttctcttttcttctgcccccatatcacttattgtaatgacctggtcaggatgctaattttatgtgaatataacttgctcaaaaaaa

SEQ ID NO: 12129 - DNA, 885 bp, Triticum aestivum
  Clone ID: PAT_TA_12129
ggagggcttctccagggcccgggatgcggcaagaatcgtgtatgggaaccctgggaggttggggaacaagaggaggggacgtgccggggcgaatgagcaagctgacgaaaaggggggaaacttcccgtggaacgggatggggctggctaccgagaaacctgctaggaaaagacactatcctcccaaggcacagggaggcatggtcttgaagcagagatcacacaggggatcagcgctgcgtggagagagttgagttgtcgtcgcctcaaccatgagagagcaccgcgccatgaaacgcgatgcagtacgtggatccatgactaatccgccagatccatgccgttttgcagtcacacaataaagatgtgttaatttagtatttataattggctttggttcccttttactttgctgttaaatcttgtagtgatttcagtctctcatgcacatggctggtcacactgtaagagcatttccttgtctagatttgattgtctttatgtccatataagcgatggtttgcgtcacgcccagaacatatacggtgctcccgacgaactcgtgcaccaggtgctccggtccaacctcagccattggattaaaaaaagagggacaggatgaggggcaaggggagctgaacgtatcctgtgctcccgacgaactcatgcaccaggtgccccaacccaacaatacggaccttgaagtctagatgaactctcccttccactgtcttctctactatgcctgtcttctacacgtgtgctcttgtatcgacttatgtagctgttccatgattgttcattgttccgcagttttaactctataataagttttaagtctgggggaaccaccttttttttttaaaaaaaaaaaaaaaaaaaaaaa

SEQ ID NO: 12130 - DNA, 666 bp, Triticum aestivum
  unsure (1)..(666): unsure at all n locations
  Clone ID: PAT_TA_12130
agtgtagtantagtctgctaaaaaaatgatacatncnggttaaatccactgcgcagtgcgctcgctcaacgtcatcacatnnaatttacattactggtccaagaaaaaaaaacagtgccaaaagttgtcacctacaatacaacatcgcacgtatattcctttcccctacatcgcaaaagctgtttcctcgatgcctgggtagcgtaccacgcaacactttgctcagcatgtccagcactgagcagatcatgatgaaaagcttcacacaaaatttcgacaattacagttgcagaccggatgtcgagcctcagttcatccgcaaaacttgtgtcaagcctcagttcacaattggttccatatccatgcaaagagcgtgctcgcgcccctggtactgcccgaagacctcgctgaccgcggtcaggttctcgtcactcacattcttggatgggaacaggagcttttgactccgctccgttgctgatccaggcacctcatccgcaggcttagactctgtggtaatttgtgaatagatctcatggcaggcaagcaagaacagagcggcagtgtcttgtcgctggttgccccgccccggcgcccgcgcctccgggagtgctccagcagcaacatatagtattagagctctccacatattttgttcaccacgaa

SEQ ID NO: 12131 - DNA, 2204 bp, Triticum aestivum
  Clone ID: PAT_TA_12131
accggtccggaattttcgggtcgacccacgcgccccgccggcccgcccgaaagaaaagaaaagagcgagacgcacacccgagagctaattcccaaatctgcgagctccaggtcgctgctcggctgtcgcgtcgatcccatccgccgcttcgatctgcgtgttggggattgcttggtggcggcgccgccatgatggatccggagatgatgcggctggcgcaggagcagatgcgacgcatgtcccccgacgacctcgccaggatgcaacagcagctcatgtccaatcctgacttgataaagctagcatccgagagtatgaaaaatatgagaactgaggacttcaaaagagctgctcaacagctcaatcaaacaaggccagaggaaatgcttgatatgactgaaaaaattgccaacgctaagcctgaagaatttgctgccatgaaggcccaagctgatgctcaaatatcatatgcgctatctggcgccaagatgttgaagcagcagggaaatgaacttcatagccatgggaagtatactgatgctgctgccaagtacaagcttgccaaggaaaacatgaagagcgtaccatcggcagctgggcgaactctgcagttgcagtgcacccttaatttaatgtcgtgttacctgaaatcagggatgtttgatgaatgtgtaaatgaaggttcagaggttctaacttatgattcgagcaatgtgaaagcatactaccgaagaggtcaagcttacaaagaactaggaaaccttcaggctgctgttgctgacttacgtaaagcccatgaaatttctccggaggatgaaactattgctgaggttctgagggacacagatgcaaaacttgcaactgaaggaggaggaacaaacctgccaaaaggagttgttattgaagaaattgtggaagaagatagttcagagctgttaagtactcaaaggagttcttctactgagtatactgtttcacaaccacatgaaggagcaggaaactcaagacaatctgactcttcagaaagcctaatgaatgatcctgctactatcaggtcatttcaaaattatgtctctaatagtgatgctgatgggttatcaaagttgggaatgcaaggaatgtcgccggagctagttaaaactgccagcgaaatgatcggcaccatgaaaccagaagaactacaaaagatgtttcaggctgcttcttcattaaccggcacaaaccccgttggttcaaatcttggatccaatatgcccgaaatgtcacctgacatggttagtatggcatctgaaatgattgggaagatgtccccttctgaactgcaaaatatgatggattttgcttctaaaatgggtgggcctggtagtgcgcctgtgagaccagggactgggagtaatatccgaccttcatcaagagcagaaacgagtagcaataacttccaaccttcatcttcgcaaactgttgcggagaaccctgatgaaatagtaaacaaccaaagtatggaccattcatcatccagttccccagtttctacagctgatatgcaagaaaccatgagaaattctatgaaagaccctgctatgcggcagatgtttgcatccatgatgaagaacatgagtcctgatgtgatggcaaacatgagtgagcagtttggcatgaagctgtcgaaggaggatgccgccaaagctcaacaagctatgtcttcattatctccagaagatttagacagaatgatgaaatggatggacagagcacagcagggagtagaagtagcaaagaagacgaagaactggctcctaggcaggaaaggcctgatccttgctattgtcatgctgatcttggccttcatcctacagcgccttggattcatcggtaggtaggtgatggcctaaacatcgcatatgatgccctgtcgagcagtgctccggcaacaaataactattcggcagctacattatgctcgttttccctggctagaagtgatatggtgggcggatgacaatgtggaagcaccgtgggaagagtcgagaactttttgtaccattgtttattctttcggcatatgtgtttataaattgtactattattagaagtaaatggtccagtattgccatttggacagtaggctgacttgtaatgttacgaatgtcctatgttatttcgcaccaaagaatttcgtcgcccttttcaaaaaaaaaaaaaaa

SEQ ID NO: 12132 - DNA, 890 bp, Triticum aestivum
  Clone ID: PAT_TA_12132
cgggtcgacggcggatcgagaaaaagacgtacgactacttcctctacgttgtgtcaacgcttccgttgcaaccaacaagggtacttaaattatgcccttccccccgttgcaaggcaccacaatgatcttgcttgtgcataggaaattttttgaaattacaactttcccaaacatgggaagggggttgacaacaaggggtggctgcgtggcaacgcaaagctaccaaagcaggttcctgctactgaggagcagaagtggctcattgagcccacgggaaaagagtaagtggttcattattttgcttgtcacatgcttattccggttgttatttattttgcttgtcacatgctaatagttcattcttttgcagcaactggatatattctaaaggggtccgtattcccaacggcctcatcaccgtcttgctgaagttatactggccggggttgtactgtccggatccagtcaggcagccggctcgtcgggttttggccacgagctgggaccactgggaagcggcccgccacgcggaccatgagacccatgccaaggccgtgatcactactttctgggtgagttctcttcagaagcacaagtccattctagtttcatgaaaatgatttaactcatggcttcttccattcttgttttcatgcatgattgtagaaattctatcgagttcttcgggagcatagggctggagcggaccagatcgtgctgcgccaatgcaagaagaaggcccgccagatgcagtacgaggtgcgctatgtggccatatccacatactaccacgacgttcttggtgtgaagatgaccaaggaagaagcgcggaggatgggcattaccttggagaggcccgagttcttggcggtaagtataaaagatttttc

SEQ ID NO: 12133 - DNA, 691 bp, Triticum aestivum
  unsure (1)..(691): unsure at all n locations
  Clone ID: PAT_TA_12133
tngcccccgcggccgtggtggcttttctctccccccattgtgtccccttggtccaccgtgtagtaaagttctcgcatatatatcttgtcgtctggccttgcttgcttaataataacacataatttaatctcccagaaagaatctttctagcaacaggtggtaaagcctctctacacaagctacctacggcagaaggggctggctctcttcgtgtgacacagttcctccgcacacagtcggcgggggataagcaggacaaggtattgcttacaaaaacggtgtggcggtgatcccaaggtgtcatggatagacgttgccccggtcggcagcaagatactatgagctgaggtggaagatttgacagtccggttcgtagttgcccttggaagccgcctgctcaaacttcttcaacggcccttcgttctctgtcaagcctgtctggataaagtagcgcgtccaccacgaattactccgcaactttgccggtcttccaaatttcggtagctcggaaactttagccttctgctgtcctggattgccagtaaagataacaaggccatcggtggagacccttgctaaatcaggaagtgttttgttcagataccttggggtcagataatccaaagcatctgacacaacaacaaggttaaaagaatctgggcggtatggaagagagaacttgatatcagac

SEQ ID NO: 12134 - DNA, 738 bp, Triticum aestivum
  Clone ID: PAT_TA_12134
tagcgtggtcgcggccgaggtacctccggcacagctggaagcaccgcatcgagctccaggccaagttcccagccaatcccgccgtgccagcagtccccgccagccctcttccctgcctgccgtacctcccccgcgggctgcccccccgcctccctcacccccccccccgcaccgcattcctggcctcggcggcctccctgggcccgcctctttcccaattcgccctccaaggccccccctttcccctcctccgcctcggcgggcttgcgcggcttgctccccgtggttgccccggcccccgcccccgaccccgctgcgggccctccaccgctcccgcagtccccccccgggccgccgcccgctacagctgctgccttggcagccttgcgggcgcttttgtcaagctcaatcaagctccgggctgccagaattgcctgtggcacaaggtcatgacatgcacgggcatagacaacccgcacagcttctgcggcggcatcccgcacctccattgggttcagtggcgcgagcaagcagtgcccaagaaccctcatcactggctgcagaaactcccacggtagctgcacccttgcctcccttacctcctcctccttaccacaattccgtccactgctgtctccattgacactcagctttgccaattcttcctccagggctttcccattcccattctcagcatcggtggacaatggcgacatggagcccagagaatccccttcc

SEQ ID NO: 12135 - DNA, 615 bp, Triticum aestivum
  unsure (1)..(615): unsure at all n locations
  Clone ID: PAT_TA_12135
tttttttttttttttttttttgtgaatcgtgtcaccaaccaacagaaacttatacatatgctgcaatgcaacagcagccgttaaccatgcacgtactttggctactaaagtacggtattatatgttgccatcgtacttacccgcacgcgcgcacgcacgcgcgcgcgcccggtccaccagtacgtacgcaatatataggcatggctgatagctggctacttgctactgtaccaccacgactaagtacgagtgcaccactaacgcacatgcatacgtgcaacacaaacacatcacatgacggcgcaggcgttggggttctcgtcgctgaacagctgcggcgcgtgcagcatctccacccggtacgacgtcgtccacccccctgctaccactccccctcctccgccgcccacgccgccgtacatcatcgccatcgcgcgcgcctgctccgncacccccgcagcgccgccggcctcctccccgccctcctcctgcctgttcttgttcttgttcttcttcttgccaccgccgcctccttgtccctgctgctgctgctgctgctgctgcttcttcttgtcgccgccgtccttgttcttgggcgctggcgggggcacgacg

SEQ ID NO: 12136 - DNA, 1076 bp, Triticum aestivum
  Clone ID: PAT_TA_12136
gcctcctagtcctggcacacatacagtctgaagaaaacacactagaaaatactagaatagagttctctaatgagacctggttctaatgagccacaacagggcacatagtaatacttaagtatcggtgcagccacaccttcagtgaactcatcacctaacgtgcaggtgagcaggcgtggagcctttttattagggcagcagtagattgtggagcatcatcagcagtagaacatgaccttcttcacgctgtccttgagcgcagggaggggcctgacgaccccggcgccggcggcgcgggtgctgcgggacgtcgacgagccggacttgcgcgcgctcgagatggagccgctgtcggagctgtccggctccatgtagaagcgggcgcggaaggcggccaggtgagcgtagtatgctggagggacgatcgacactgagcgcgtgcacctcgcgtaagtgtagcaaaggttgttggtgagggtctgcagtcccgcacccgtgggcgggcgcgcggcccacaggacatggtaatgcgcggggcggctcgtgcccttgatgccggcatggctgcacaggaagaaatcaaactctgtagggtggcagatcttggagtcaatgacagtgccaggaaggatgttgccgctcttgtcgacggtgctttggtcattgtggttgtgcgcaaacagcctggtgtggtggcgcttctggaccacgacgaacgtaaccagcggctggtagtttgcttccagcgatgcgcatgcctttctgatggcatcaagctcatgcagtagaacttggtagaactggccttcactcacgccatccctatagaaaataatacgctcgggcttttctccggttgttcgcttaaaggatgtaagaagctccctgaccatgccaccatggatggttcccctctgaggatcatgagtcacattgtacagatcctctattaattcctgcctgtgagtctgagcggacgcgtggccagcatacttggtcacctcaggccaatcctgggaggccacaactgcagcaatggaagggctgctgtcttcaccaggatgaggatgggtgac

SEQ ID NO: 12137 - DNA, 862 bp, Triticum aestivum
  unsure (1)..(862): unsure at all n locations
  Clone ID: PAT_TA_12137
ctgatttttatnctgtgaagagaagagggcaaaggcgcatagccatgaattgtaaccnaaaaagtcacttgagaagcattactacatgaacgaataaacctcttccagctacactgagctgctgcagactaccgatgattattcaatggtacatttatgggaaaaggattggtttactcactgtgaaggggggcacctaagacggttatcaccttgccgaagccctccgagatgacccgtgcccactcacagatccccggtataactccttcgaggccggtattccacgcagaacaatcacctcccncatgttgtgtctctgatccttggttctattgtcagctgctcaagaacacaagcatttcccaagatacagcaggccagctcagtctgagccctgtaacagcgaaacccgctcatgaagaccgtcttgagatgatcatggccgcccataccccccacctcaccgctggagacaccactgggttccccgcagaccatatgcaagtgcaatgtctccagtcctggtgcaacatccaaacaattggccagttgaagaacttcattatcaccatttgggtcgttagagttgacaattaattgacaagtcatatgcctcaaatgcaaaaacattccctgttgtcttgttggcagcttctgcaactgtgcatattccgccatccgggcgggcggcccgtcggcctcccctggctggtgccccggcccgccccgcttggccgccgccgccgcctcggccccgggctgctgccgtgccgccggcgctgggggcgggcgacctgcttcgtcttccccggccccggccatctctgctctgctgctcctctccgaccgggcctcgtgc

SEQ ID NO: 12138 - DNA, 1207 bp, Triticum aestivum
  unsure (1)..(1207): unsure at all n locations
  Clone ID: PAT_TA_12138
ggtcctccgacgcgtgggcgcatattgactgcctctccggccttcttcccccccgcccagaagggggccctcctagacaaggtacgcaatcatttccttgggcttctttccttatttatttccattttacatggatgtaagtttgaatccgtttccgactcgtggggctggggagacccacagtgagggctcaatatgccgagcagcttgccaaggattcacgacggacccatccaaaaggaatgaagtcagtgagcattctctaagacacctactgcacagcatctttctcttgataggttttctaaattgttggatgagaagaaacatgaagtaatcgagtttgaggggtgaattcttgctttcagagtgtttcagccgttggcaattgggaaagacaggaagaaatttgctttgaggagctttgatttgagctcagtgtgcttcatcgattggcagccgggcaagtcaagagttaccttcattttggatggtatgttatgaggaacgctgggtatgcactgcgtgaggctatcttgcaaaagaccattgactcttggaatggacatcgtgatgggaaaattcttgaccgcccatagacggaattaggaggaatctatgctaatcaaatgacagacaggtccgcacaattttgtgaagacgaacttatggtgttgtaacgtcctgtttctagactatcctattgcaagcgacaactcacatcatgggtaagctgatgatggctagataggttatctgacaactgaccgggtaaacagttgaaaatagggacgctgagaaacagacgcagccatgttcgcttactgaagaatcgccattggtgacttttgctgcttaaggatggctatctgataaccatttcggcaactggaagagtcccattcatgatggcaaatttggcaactaacggcctctggtatgcctgtcgctgtcccgcactgtgttgtaactgtatatacacatttcctccagctctcagaagcacaggccagctctaggcacatatagatatgaggacttaattccccacagacgcaagtcggatgccgccaagttcagcgcaactcgcccggttgcccgcttctgctgggcgcgcgcccgttctagacgcgcttaagcgctcacatgtcatggcttaaccatgattgctgtatatataatcgaaaacctttccgagaccanaaaa

SEQ ID NO: 12139 - DNA, 754 bp, Triticum aestivum
  Clone ID: PAT_TA_12139
tttgtttgtgccgtcccccacccacgcaccagacttggccttctcgctttcattctcgtcttccactcccatcagccctcacagttcacatttctcatcagtcacaaggcatagcagcaagactgtttcactgcaaggatcaaagcacccacttaccactttacctggcattttcgttcacatgctacttgaaagaaccgtgccaactgctcaggactgtgtcaccaggagcaggagggcaacgcggtggcgtcttctcagcgacggagttggtcgccggaacgcgcgcagagggaggagctgttgtgcagcaggatcagcttgaggcccctggcggcctcaacgggcctcgggacattcctcctggattcacggtggctgttgtagtagttctccgccagcgcggcctcgtccaggcgtgaccacgccgcccccctcggcacgctggccgcccacatgaacctgtcagagcaagggttcatcagcgtctcccggaactccttggccccctcgcacagcaggccctcggacatggctttgatcttgaggttgacgctgttggacaggatgaccatgttctggccgcagcctcttagcttgttgaagaggagggcgcagtcgaggacgcggtcttcggtcttcggggaatcgatgtcggtgaggattcttggggagaagatgccagtgaagctccttggcgagaagagcgccagcattgagttgaaggcgccggcagcggtggcttcactctctt

SEQ ID NO: 12140 - DNA, 695 bp, Triticum aestivum
  Clone ID: PAT_TA_12140
ttttttttttccgaactacagtaccagattcaaactgcacaaaaaagagaagtagcaaggcgtacagaagaaccttccaaccgaaactgaataatacaagcacacgttgagcaataattcagacggcgacattactatttcttcagaccaacaagcagcacaattcctacagagattgtaccatcgcactgctaactacacacaaaacgctgccatcggaagaggcctaggaggaggtgaacttggtgacggccttggtgccctcagagacggcgtgcttggcaagctcgccggggaggacgaggcgaacggaggtctggatctccctcgacgtgatggtgggcttcttgttgtaccgcgcgagcttggcggactcgccggcgagcttctcgaagatgtcgttgatgaaggagttcatgatggacatggccttggaggagatgccgatgtccgggtgcacctgcttcagcaccttgaagatgtagatcttgtacgtctccacgctcttcttggccttcttcttccccttcttctcgcctccgccctccttggacgccggcaccttcttctccgccttgggcttcttgcccgccggggtcttctccaccggcttcttctctgcggccttgggcgccatgggtgcttcgacggcggtggagcttggttggaaggtgtgggctgaggggggctggagc

SEQ ID NO: 12141 - DNA, 679 bp, Triticum aestivum
  Clone ID: PAT_TA_12141
gccccacgccgccgcactccgctccgcggcacgctcctctagagcaagaacatggcgatcgcgatctcgcaggaggccttcgatgacatggtccgggagaacatggaggacctcgggatggaccccgacgaggccctcgccgacgccgtcgacgccctcaccctccagggcgccaacctctccgggatcatcaggcgcgtgcctggggacgccgcggcggaggaggtgaacccggtgatgcgggtgctggacgaactgaaggcctctgccagtggcaggtcgggggaggatcttgacaggctgctctctttgctcgacgagttgctcgagctgtgctccggcgagggggcggagaatgcggccgtggcggcgcggaacggcggcgtggaggcgctcgtcgccctgtgcgcttcggctggggttacacagcagagactgcttgcttcgggcttgaaggcgctgagctccctgatccgtgatgttgggagcactgaaaagttcaggcaaagccaagggtccaaaattgtcatggatatcttgaaaggagccctggaaaattctgatatactcgatggtggttttagtgtcgtggcagcggcatctgctggccatgaagttgtgaacgacgcctttatggacttgaaggtcgatgaactcattctggaggttatgaggaaca

SEQ ID NO: 12142 - DNA, 584 bp, Triticum aestivum
  unsure (1)..(584): unsure at all n locations
  Clone ID: PAT_TA_12142
atttgaacattagcaccggaatattatcccctcatcttcaatagcgtgggcgcggccggcgtacagattattaccaaggccgactgaacaggtaagaaacctagacgaggctatatctcagaccctgttagaaagcctgaaggacatactctacctaagttcgccacaggcaagcacacatccaacaaaattgacagaaccgaacccgtgacacgcaagattttctgtctctactgtaattcgaaaccatggctgctatcagaagtaggtgggaggcgatcatgtctcagtgccatgcctcaatcaatccggaataatgccacctccaggtaaatctacaacaccgctcaagctgcagcctccgaagcaagcttcatgcgctgctgatgctcggcgatcttgtactcaaccacctcgctgaacagctgcggattcaatatgcagtcaggactcccgtagacagcagcctgcacactggccatcagcttcgcaatctctctgccggagaagccatcaatcttgcgcgcagcgtccctgnnnagatcatcacttatgtcccgtacctgcccgggcgnnngctcgaa

SEQ ID NO: 12143 - DNA, 727 bp, Triticum aestivum
  unsure (1)..(727): unsure at all n locations
  Clone ID: PAT_TA_12143
tttttttttttttttttttgaatgtttcagctgcaatatccattccaatnactgaaacttctgcagccgtgtatctacaacagttgcgttttcccgatgatacatcaaagttgtaatgctcggaaaactcagagctagtaaagaactaactaattataaacgcactgggcaacagtgcaaatctacatcgatgacaatgatcctaccgattattataactcacatttgcatgaccaaaaaaaaaactgtagaagcaggaggcagaggaacatctaaagacattccgatgatgtttcagacaagacacacacgatactcgaacttaaacatcattatattgtaaccacttctcctgtcctccttccatagcttcttcccgcatccttgctaattcatcaaaccaatctttgtactcaacttcaatcaaatcaagctccccattcagcacatcttgactatcggtaatggaaattgacgagcaaccactcaccagctccgaagggggtgatgcttcatctatatggaaaatcgaaatgttccttgacccatcacctanaacatggttgcagtctagtttgnggattccctctttgtacccaccacagtacatagtcccacagtcaccagtgccatcgtagctcggactttcanaactcccagcaagctgcgcanaaaaagtccgatccctcanagcactttggcccctctagggttagttgcacttaag

SEQ ID NO: 12144 - DNA, 512 bp, Triticum aestivum
  Clone ID: PAT_TA_12144
ttttttttttttttttttttctgtttggatccccggtccatatccgaaaatgctgagctttctgttccactgctcgtagctacggtacatgtcacaaaagtttaattaatccccttaaaacgtgcacttaacccattctgtgtatcttatgagttcgttgaatcagtgacagcagcagcaacatcgttttctttatccttttcgttcgctggatcagtcgcagcaggagcaacatcgtcttccttatccttttcattcgctggatcagtgccgccagcagcaacatcatcttctttatcctttccattcgctggagcgggggcaccagcatcgtcttgttccttacccccctccggcccctttccctgcccccggccaccgcccccccgcggccggtcccgccggcaacgcctgccgtccatccggcgcccggcggcccggccctcctcctgcttaactgcccaacgggccttatctgttccaacatccacagcgacaacatgggtgatcgt

SEQ ID NO: 12145 - DNA, 500 bp, Triticum aestivum
  Clone ID: PAT_TA_12145
atctgagcaggatagcagacgtgcacaactagctttcgaagcctcgctcgaaacacaccagcatggcgtcccacagtgctgccggccgtcgtcccacggcgctcgtgcatatcgctctcttcgtcgccatcgccgcggtcatcatcaacagctccgtctgtcttggagccgccgtccacgacgccgccacctcaggcaccggtgctctcgaccctaacgtccctgctgttccgacgccgggcggtgccggtcaaccctacaccggccgtgggtgccgcacagtttatggatgtaaaccaccggcgggtagccagccctaattacatccgcgcgcagaccccatctcccagacacaatgcttgcgaggatccatcgatatatgtaattggttagcacaagttaatctactgtcacgcaccaccttatgtacacggtaataccgtctcgtgatgtacttgtacctacttaaactcgaataaatctggattgttgcatgtctg

SEQ ID NO: 12146 - DNA, 702 bp, Triticum aestivum
  unsure (1)..(702): unsure at all n locations
  Clone ID: PAT_TA_12146
gtggcggccgtttcctatggccgatttggcgccgggactccactagcagatcagcgcggtcgcgatagcagacgtacgtacacaggcagctagctctcgaaacctcgctcgaaacgcaccatggcgtccctgggtagcagcgctggcggccgtcgtcccacggtgctcctgcagatcgctctcttcgtcgtcgtcgccgcgatcatcatcaacagctccgtctgccttggagccacggccgtccacgacgccgccgcctcaggcaccggtgctctcgaccctaacgtccctgctgttccgacgccgggcggtgccggtcaaccctacaccggccgtgggtgccgcacagtttacggatgtagaccaccggcgggtggccagccctaattacatccgcgtgcagcatgccccatctcccaagacacaatgcatgcgaggatccatcgatatatgtaattggttagcacaagttaatctactgtcacgcaccaccttatgtactcggtaataccgtctcgtgatgtacttgtacctacttaaactcgaataaatttggatcgttgcatgtttggaaaaaaaaaaaaaaaaaaaaaaaaaaaaaagcccccacactcgagactagacctcggccgcgaccacgctaatcactagtgaattcnatgnaaggacccccgtncggataaccggggttggtnccactac

SEQ ID NO: 12147 - DNA, 633 bp, Triticum aestivum
  Clone ID: PAT_TA_12147
cgtccgggtatgtgtgatgtgaatagcgaaagcgtgggggggacttcactgacgtcatagtgggattgatcatagcaattatttatgtaaaagttgaagaaaaaatcttcatgtaaagcagtggaggtccttaacctgtaaattctgtgcattcttgtattgatttgattcaagagcgttgatcgcctagcagtgatgtcggacggtcttagtggagagtctgtgctgaggtaggaacctcgaaagatttctcggttcctgacctcaccagtcctaaaatatttgtagactcaagtttgttgaaatcttggagatgactggaccgtctgaaatgtaaaaaaaaaaaaaaaaggttggcttacgaggaacaatgcataatcaaggagctatgcgataatgcttcaggtggttcttcagttatttaactagcttgctttagtagcagagaacattatatagaatccatttctgacaaatgtaaaattaaccagcccacatgcactacaaagatcttcaagctccagctctgataagaaggtattattgcccgtgatttgatcaatgtaccgccgccccgtcctcgctaatgggataactggtggaagaacatctgctatgaaagtagaaccgacc

SEQ ID NO: 12148 - DNA, 796 bp, Triticum aestivum
  Clone ID: PAT_TA_12148
cgtccgcccacgcgtccggcgaaaagtgttcaaaatgttctgcaacaacctgctaatcatcctagctggactccaccatcaactgagtatatgcaagctcgtttggactgccaaatatgcaaagttgctgtcatggatgcaaacagtctgcttgtttgtgatgcttgtgagaggggagcacacttgaagtgccttcagcattatggcaacaaaggtgttcctatagctgactggcattgtccaacatgtgtagcacagagcaaaggtaaaccccttgcaccgaaatatggcaaggttacaagaactgttgtaacatcacagtctggtccacctgttggtggagcacagttttctgttcagcgagtggggcaaaatacggttgcaaagggaaatcaccaagggcttgctgcaaatggaaatattatcaagccaaactccacgaaaactggtaacactgtaaaaaacagtcctgtattggctctgaatgctgctactgatctctcgcaatcacaagcagtttccatctccgggcctgcaaaaggaaatgctaataatgctgaaacctcctctaatgatatggaatggaatgagcaatcatgcagcagtacaggatgcgaattcactgctggtagtgaattatctttgcactctgtggattcacccaatgataccgttcacgggcagcaatctacagtcacttctagggcaaattgtccagataattcttctgctattgctgctgatacgaagatcaagtctgaagcacagtctgaagccccgggcggagccatgaaaa

SEQ ID NO: 12149 - DNA, 851 bp, Triticum aestivum
  unsure (1)..(851): unsure at all n locations
  Clone ID: PAT_TA_12149
atagcctacataaactcgcatgtttaggaatgtcgctaccaaatccctacgcgcgcctaagctggtttcttcaggctagcacacacaaatacgcacatacatacacaccagcccttcaaactgtccgccatgcttactgagaaggtaagccagatttcccgcgagaaaaattcagatcatactacatcgagttgccttcctnactgggtactgttcctgacatgaacaagattcctcagctcctcaaatgcatccatggtctccgtgtcgaatcctccggcaaactgatgaattctgaaggcaaatctcacagcctgaagcagcatgtactccagagctagatccttgttcagcggtcccatgtactgaagctccatagcaactcttttcatgtacatatttgctaatttcacagaagcaaatttgatcttgctaatgagattgttgtcaagcatccagtcaactggaatgttgaactccttgcactgcctcatcattgcgtccctcgtcctcagaacgttgtacacacctcgctccgtcttttcagacaccgttatcattttcttaagtgcaatgtcacagggaaggcgtgggtcgtctttatagttagaaacctccgattccaattttttgaggtcttggtagccaaaagccgcctctcgtaaagtgtccgccttcctctcgggccaatcaaaatgcttcagcactgctctctcatccaccaggaaaccgagttcatcgtcaagccacttcacaaatgcaacaacgtcttctatatctttgtaagctgcatcagtcacctccttgatcaatgatttcacaaattcaccttgagtctcacggacgcgtgg

SEQ ID NO: 12150 - DNA, 789 bp, Triticum aestivum
  Clone ID: PAT_TA_12150
cggaggaaatttatgtgcaatgattcaacttgaagctgaatgtgctgctgtaattcattatccaacaggacttgcatgttcttaaaatcatactactactttgtcctcaccactagattagaaacaaatacaagacgtgaaccaaagataatttgatgaatcaacaaatctaccgaccgaagacctaggttagcataacgccatctgcagggaacaatatccgtgtggaccaaggatccctagcaaggggattgattgatcatgctactgctacaaaagagcagattagtgctgaaatacacctatgcccaagctagcatcattgacagtagcaaactcaacgcggcccataccgtaatttccttcttatctccgcggcttctggcgcccgagaaccctggctgtgatgaatttactgccaaaccgaagccgaaagggaagagcgggtcatagtgtgggtctccaaaattcatgggcagctggtctacagacttgaaccaagtgcgcgaaagctttccggtgaagccgtagtccccaaatagcacatcagcgacaccctgcccttctgtgcccggaagccaggcggcaacaagcgcttccatcagaggaagatatggttcaataacgacaggccgtccagacacgacaaccactgcgcatttaactgccgaacagacggttcggattgtgtctgggccagggtctaggatagtcagatcagtgttatcgcctactgtttccgcatatggtgactcgccaacaacaacaatagcaaatgagcctcgtgcc

SEQ ID NO: 12151 - DNA, 1325 bp, Triticum aestivum
  Clone ID: PAT_TA_12151
ggcagcccaagcccacacactctctacctcctaggccggccctcctcttcgtctccccgccgacgcgagggctcgcactctccccactcttctaacccctccacatcgaatcggtcgcagaagtgcccgaggatctgctcgagctcggcatggtcgctgggcgtgggacgaaggccgatgcggaggcgcgggattcatctccatcagatcggtggccgtggaaatcatgcgtcgcaacctccgcgcccggtgccttcctctccatctcgttcgtcgacagctcccaccaccttgtgcatgcgactgcgctgcaccctgccctgcccagatacggcagcagtgccgcagtggctggtcccctactcccctccaagtgcaagccggctccattagacgatctattccccacttcagctttcatatctgcttatttcatatccccattacccacttctgctaatcgctaattgctatccattcatgtatagtacatatgtagctcagtagtctaggtttaagcatgagagtcattttagaatcggggagaaaaattagaagttggggtgatcctattttggtctgcctaatcttggagtaagctgttcgattagacgttcttaacttagttgcagcagctgttatgagtggggattctagttagttaatattcttcaggcaaccatgctacgataaagctgattgattggtggattagaattctaggtggctaggggggatagggaccaagacagatgaggttgatttggcttgatcctgccaaagaaatttacttctattttgaaaaatgaacacgtccgcttagatgtgcagggttaagtttacaaatgcgaggtttatagaaaatcaaaggggatcaagagaagcatagtacgataatacaataggataagcatgtatgactgtaggataatacagtttgaagaatgatgatggtatggttctcatatagaggacgatggttggctcaaagagtttatcacctcaaaaatttcctttcttggaataacttgccttattagaagtccataaacatctctggcatcttcagtactacttacggcagctgcacaagtgttattcatgatatagcacaaccttttagatatatttcttgttgtcccggaccccctgttaaaacagaagtgcttttgcaggcttacaagaaatgtattttgaagaccatctaactatctaagagtcatggaattcgttccatcctatatttttgggactctggaataaacacaaagatgggaatgggggtgcatacctgcctgccatacacattgacagggtttcaatac

SEQ ID NO: 12152 - DNA, 651 bp, Triticum aestivum
  unsure (1)..(651): unsure at all n locations
  Clone ID: PAT_TA_12152
gcggccgcccgggccggtactccccgcatgagcatttcccatctttcatcctatggaacctgttgctatctctcagtattacctcccttccagtggatttacagatatacttgattgcagaatggcaatctgcgcacacacggagattcttaaagatccttattggttttgttggcgatgtagtaatcaaaccaaatgccacagcaatcttctcgctgtgctggagcagacactcctccttgagctcatccgacatgtcatggagcacgatgcttgtgtctggtacctcgcccgcgtcctcgctttctctgatcaacgcagacaactttgcatagatctcttgtgcttgcggatggccggtgtcaccagctctgaactcgtgaattgtgtttccaacatgcatccaactcaagccagtttctttactcaagttcttgtgtctcatcagactccttattcttgcaacttcatcccataaaccaccatgggcatacaagtttgagagaaggacatatggagctggatctcgcggctcgagatctatgacatgattcgctgcaattttaccaatctcaatattatcgtaagtcctacaagcaccgaggagagtcttccaaatcaatgcatnccgctttacagggcatttcatta

SEQ ID NO: 12153 - DNA, 1312 bp, Triticum aestivum
  Clone ID: PAT_TA_12153
ccacgcgtccgtccatgcgtccgccgcatcgccggcgagctgttcgggctcctcatcgcgatgctttttatgcagcaagctatcaagggacttgttgacgagttccgcattcctgagagggagaacataaaagcactacagtatattccatcatggaggtttgccaacggaatgttcgctatcgtgttgtcatttggccttttgctcaccgcgctgcgaagcaggaaagcgcgatcctggcgctatggagcagggtggctgcgtggcttcatcgccgactacggcgttccactgatctttgcagggtgctggggaagagtaccatacaacattgagaccgtgccattcaagacgatagccatgttcacactcttccagaccacatatctgcttgtttgctttgggatcacatggatcccaatagctggggttctcttccccctcatgatcatgctcctggttccagtcaggcagtatatcctcccaaagctcttcaaaggtgcacatctcaatgacctggacgcagcggagtatgaggagtcaccggctataccgttcaaccttgctgcggtgagtccataaactcttgatctgtcctgacaggcaaccttgtttgtcatcatgccattttctaacgtttagctgatgacggctagaagaattttaatcatgttacactagcttgacactgaatggtgtaaaactttcagcaagatattgatgtggcactgggacgcacccaaagcgcagagatccttgacgacatggtcaccagaagccgcggtgagatcaagcgcctgaatagtccgaagatcaccagctcaggtggcactcctgtcacggaactgaaaggcatccgcagtccttgtatttctgagaaggcctacagccctcgcgtcaccgagctgaggcatgaacgcagccctctaggggggcgagacagtccacggacgggtgaggcccggacatccaagctgggtgaaggctcaacaccaaagtgaagcaataatgctgcatcgctcatagctactggaagtaaattatatcgataatttaagcatcagtgctagtataagatgtctacttatgcacggtatgatgccactatatgatggccagtgttgaagtacgaggcccctatatgatgcctactgatgaagtatgaaaataggctaatgtgtatctatctgtagcctcctgatctaagggagcaccgtatgtgtaatctctgaatgagtagaagactattatagcgtcaactttgaaaaaaaaaaaaaaaaaaaaaaaaaaaaaaaaagaaaaaaaaaaagga

SEQ ID NO: 12154 - DNA, 2714 bp, Triticum aestivum
  Clone ID: PAT_TA_12154
tcccggccccgctgcctcaccgccccccaccgtctgccaccttcgctccttctctggctcccccttgcttcccccaccgatccccgcgatccgcaccgaatgctggccggccttgcccgcccttaccgcttctcccgggccgcagatgtcatctggggctcccttcacaccgtggggccacttccagtccctccccgattccgtcgcgtttctcctgggcaggtgagtcctgtgtcgccttccggggacctgggggagggctgcgagctcctcccaccccccaagattgacgtccgcgggcccctcgcctgccacaatcatgactggaccggaggcttccgggcccctatgagggtcctagcgccgaccccccaaacctttgccgcctccgcgctaccgccgatcccgtccgaggggtcggtgacgatgaggaccgatggactcctcacagcagtacagacattggcacccaccgccctgcgtcgcatagtgcactccatcgtgcgatggcagcacctgctgatcctgtgcgtggcggagccgacggtcctcatgtaccaatgcatgtccagctttgccaaggacccggccaacgtcccgacctccctcttaacctcttgctcgggtaggttcgatgcgtcggttgatgagacaatcttcttgctggtcttgctggcggatgatctgctgcctatggaggtcaaggagcaaaggttgagcaactttctacaggctgtgatggttgggggctgcgtggccgccatgcccttactgaagaagatccttgccgcagttctgagggcggacatggaggccatacaggttctacagtttcttccatcatggagctgtgccaacggtatgttcgccttcgtggtgccatttggccttttgctcaccgcgctgcggagcaggaaagcgcgatcctggcgctatggagcaggttggctgcccggcttcacccccgtcccggcctcccaccggcggggctgctttgggatcacatggatcccaatagctggggttctcttccccctcatgatcatgctcctggttccagtcaggcagtacatcctcccaaagctcttcaaaggtgcacatctcaatgacctggccgcagcggggtatgaggagtcacggtgccttcatgcctgcaacaatgattgctgtcctgttctacttcgaccacagcgtggcatcccagcttgctcagcaggcagagttaaatttgaccgcggtgagatcttgcgcctgaatagtccttctcctacgcttcctgacgttgatgtggtgcctgattggtatccctccatccaatggtgtcattccacagaggccgatgcatacaaagagcttggctactctaaagcatcagatactccgtaaccgactagtggccacggcacggcaaagcatgcgccagaacgcgagcttgagccaactgtacaacaacatgcaggatgcttatcatcagattcagacaccgctgatccaccaacaacagaccgtaagcggcttaaacgagctgaaggactccactgtgcacggagtgtcaagcatggataacttcgagtgctgaagtatgaggcccctttgtgatacaaaaagaggaagtatgactataggctaatgtgtatctatctgaagcctccagatctaagggagcaccgtatgtgtaatcgccgaatgggcagccgtcccttttcgcatcaacttccctacagcagtgctgtgggggtattttgcgttcatggcgattgagagcttgcctggtaaccagttctgggaacgaattttgctgctcttcactgctcccagcagaagatacaaggtgctggaagagtaccatacaacatttgtcgagactgtgccattcaagacgatagccatgttcacactcttccagaccacatatctgcttgtttgctttgggatcacatggatcccaatagctggggttctcttccccctcatgatcatgctcctggttccagtcaggcagtatatcctcccaaagctcttcaaaggtgcacatctcaatgacctggacgcagcggagtatgaggagtcaccggctataccattcaaccttgctgcgcaagatattgatgtggcactgggacgcacccaaagcgcagagatccttgacgacatggtcaccagaagccgcggtgagatcaaacgcctgaatagtccgaagatcaccagctcaggtggcactcctgtcacggaactgaaaggcatccgcagtccttgtatctctgagaaggcctacagccctcgcgtcgccgagctgaggcatgaacgcagccctctagggggacgagacagtccacggacgggtgaggcccgaccatccaagctgggtgaaggctcaacaccaaaatgaagcaataatgctgcatcgctcatataagctatggagctactggaagtaaattatatcgataatttaagcatcagtgctaatataagatgtctacttatgcacggtatgatgccactatatgatggccagtgatgaagtatgaggcccctatatgatgcctactgatgaagtatgaaaataggctaatgtgtatctatctgtagcctcctgtgtgtaatctctgaatgagtagaagatattatagcgtctactttgaaacttttttgagtctcacttttctacataactgcaaattgttcatattattctttattttgcaccaaat

SEQ ID NO: 12155 - DNA, 690 bp, Triticum aestivum
  Clone ID: PAT_TA_12155
tttataatgtaataaacctgacaatcttggatctaaggatctcacacataatatatgtaaggccaaaaaataaggagatgatttctaccgctctcagggcgatacaatccatgaaaaaagtaattcacaatttgttcacacgctttgttggatatatacactaacgacttagtaaatgtgaccataaatcaaaagacattttcgtccagtaaaaaatgcacacatgtatgctttggttttcttttcttttgtgtcagaccaaataaaagaccatgttacttccttatgcatattgcatcattcatatgttcacaaacacaaaactagtacaattaagatatctatgccctgtagtacaaagtaatgcaatttgtgaaaagtagtacagtcccaacgagcttttcttattctagtgtgcaaagatgcaatgtaataaattcatacgctaagaggaatatatctgaacatacatcacaagatagataccatgttgtttgcgtcacttcgacagtatatctttgacgcccacccgtggaatagctctgagctgcaggtcatatcttcgtcttattgtcaacccaaatttctcagacatgtcaaatgaagtcagacaagccccttcaggaagcatccaattgaagtgatacaacatgtttgccaatggtgatgtgcactgtcgacatgccaaaa

SEQ ID NO: 12156 - DNA, 1162 bp, Triticum aestivum
  Clone ID: PAT_TA_12156
cgtccagccctgtcttgtaagacgggatctttggagaggtttccagattgttgctccgccgtctacctcttcttcctgttccaccaggcaattcccccgagtgccgtttcaatcaccgcaaccgcgcacgatcagaattctcgcgcctgaggcggacaccgtgatccagccttccagccctttcgtgtccggcggcctctccaccccagtccccagattatgtcgacgcagtccatctcgcccgcctccgtgtccgcgcagttcccctaccctgctaccgccgcggcggcggccccgtcgtacttccccgtgcccttccacctccagacttcgcagtaccccacctggccgacggtggcccccgcgcagccggcgccggcgtacaacgccgtctaccccatgccccaagtccagcaggcacaacaactgttccagagagactcgcagataatcagccctgaggctctcgccactgtgaaggctgctattgcagataatgacaaagacaagaaagttgaagcaaacaaaaaggcagtccctcgaaaggcagctgggcaatgctgggaggatccgacgttagctgactggcctgaaaatgacttccgtttgttttgtggtgatcttggaaatgaagtgaatgatgatgttctgaccaagactttttcaaaatatccatccttcaacatggctaaggttatacgggataagtctaccggtaaaactaaaggctacgggttcgttagttttgccaatgcatcggatcttgcagcagcactgaaagacatgaacggtaaatatgttggaaatcgaccaatcaagctacggaagagcacatggaagagtagaatagactacgaagctttgctgaagccgaagactcggccacagaagaagctcaaagtgcaaccaagaagtgttttacacaagtgaagcaaataattctccttgttcgtcatcacagtatccacaatgatgttcaatgcgcatattcaacagttgatgtaagcctttagctttgcacgtgtcagtgcattccagtttatgattgtaatgtaggtgtaaatatccaaatgactagtgtctttgtggacatcaactatgtattttgatgaatgattgattgcaaatgctatggattgttcttctcgctagaaaaaaaaaa

SEQ ID NO: 12157 - DNA, 1558 bp, Triticum aestivum
  Clone ID: PAT_TA_12157
gccaggcggcgtggaaagggcgaggttgcgtcccgctcatccacttggctctgctcgcatcttccctccttgccgattccgattcccctcgctagctaagggaagggaagggaagggaagggatcccgacgacgatgggggaggacgggcagatccgccgcgacagggtcatcatcgacacggatcccggcatcgatgacagcatgacgaacctaatggcttgtggaggacgcggtcgcgcatccattgggctgtcatcgctacttccctgtggctccattccgtatcccaccggtagcgagcggatggtaagggagagagccccgcagacggtggggccggacggccagatcggccgcgacgaggccatcatggacgcggatcccggcgttgatgatagtatgacgagtctaattggatttggagaactaagtcttgagaccattaggccgacaaccatatacgaaaatgtcactgcagtgtatggtacacaaaatgcgctccttgctgggtgagagagctgtgcctcctttgggtcccctaacaaatggcagcccggagcctcttaagggaggagagtttcgcgttgctgactttgaaaatggatctgatggtcttggtaatttgtctcttcctgcacctactactaagaaggttgaggaaagtgctgccgagttcgaggctaataaggtctctcagtttcctggagagatatctgtacttgcattgggacccctgacaaatgtcgcattggccatcaaaagggactcgtcatttgcaagcaaggtcaaaaaaatagttgtgctgggtggagctttctttgcagctggaaatgtcaaccctgctgctgaagcaaatatctacggagatccggatgcagcggatgtagtttttacatcaggagcagatattgatgttacttgcattaacataacaactcaatgctgttttacagatgaggatctcttggaactgaaaaactcaaaaggggtgcacacacagttcttgtgtgacatgtgcaagttctacagagattggcatgagaagtctgacggcttccaagggattttcctacatgatcctgtgagctttacagccttagttcaccctgagtacttcacattcaagaagggtgttgtgagagtcgagacccagggcatttgcaccggccatactttgatggaccatggattgaagaagtggaattcagaaaatccatggtcgggttatgcaccaatttcagttgcgtggacagtcgatgtgccaaaggtccttgcatatgtgaagaagctgctgatggcgccctgagaatagaaccagaggtctattctgactctttgagctgaagtgtaatggttcaggtcaactctcatggccaaagcattttttttctctgtttttagaagcaagcataggaggaagggaagcttcctagtgcaaatcaaactatggggtaaattctgcatatgacagcattgtgacaacattgattccaaatatctatatataccaagtacattacaaaaaaaaaaaaaaaaaactcgagactagttctctc

SEQ ID NO: 12158 - DNA, 2513 bp, Triticum aestivum
  Clone ID: PAT_TA_12158
gctcgtggcttgccacgtccgagccaagccgcccaccgagaaaggaacgcggccaatctggtggcctcgtgctcgcagccaatagcccgcctccgatccgcatccggccaggcggcgcagcctccggggccagggccggtcgggcgggcccccctgccaccggcggcgacgcgccatggccggcgccatggtggaccgggccaccagcgacatgctcatcggccccgactgggccaagaacatggagatctgcgacatctgcaaccgcgaccccgggcaatccaaagatgtcgtgaaggctctcagaaaaaggattgcacacaaaaatccaaaagttcagcttctcgcactaactttgttggaaactgcaatcaagaactgtggggatatattccacatgcatgttgcagagagggacctgttgcatgagatggtcaagctagtgaagaaaaagtctgatcaacgcgtcaaagacaagattctggttctaatagatacatgtcaagataccttggggggacctcgttcaagtccatggcgcttcccatgaggccaccatgacttaaggacaagctcttcggcgacctcctcagcatcgccaagacgaagcacaacagagcttcgtgatacgaccgagtgaaagtgtaagaggtccaatatatatttgtgtctgttttttcttacaaattttccacgtggcttgatcatatacacttgtgtagctctcttctcttgcgttggatgtgtaagcttcagtttttgacgctgcttccccacattgattccattattaaattcgttacgacgtgtgtacggggcacgccagagaggaaacccaacgtcggtaaatggtgatttaatgctggttagttcggcgtcggacgtggaaccctggtcgcaagggcttgcactaaatgatgatttgcagcgtgttctagcaaaacatgacgcaattgctgcaggcattgctgttcgagtggagaaaagaccaaagtctctgcaggcgctagttgatactgaggattctgcgaaccaagactctaagaaagagcaagcactagtagatattgatgaccctacaagccaagattctaaaacagagcaaaatcaaagcaccagtgagccgtctccttttgagcaactagcgcttccagcacctccggtatcgaatggctcagcaaacgctgcaccaaaacctgattctggcattgatcttcttagctgggatgataccccatccactgcagagaattcgctggctcttgtaccggtcactgatccattggctgactctacttcaaatcaaaatgcactggcaattgtcgacatatattctcaaaacaatactgctaatagcaatgccaaatcacttgacccctttggtttcgattcaagtcccactcctcttggatcacagccatacaacactgcaacccagcatcctgtacaatcacaacagcctcctcagcaggtggcgctctattctaatggaagtgctgtaaaccctggaacatcttacgacccggcgtcgcagtataatcacacgaattccgggtggaatggtcaagttgccaaccatgcagcacccccaccacagcaagtaaattatgatgatcaaagtggagcccttccgcctccaccttgggaggctccggcagcgccaagcaatgaaatgccaaatggccaattgggtgctatgcaacctctcccaactccagcaagccaattcggtggtgtgcagccactacaaccgcagaacaatcacatggcaggtctacaaccgcagccaatgtataacaaccaaccaggagctatggtacctcacgcaatgcagtccaaccaaactgttggagggcagatgcagccaggttatggaaaccagtatggacatttggcaccacaacccatgccaatgccaggcatgcagttcgctggtatgcaaccatcgccgatgccaggagcgcagccaggcatgatgtatgcgcaaccaatgccgggggcgcagtttggaggaatgccgcaacagcagatgtacggcggtggtggtcggatggcgacgcagtacggttatgtgcagcagcaagcagcacagtactacaaccagggaaggccagcaatgtatgggtaccctggtaccaacggcctctctcagagtatgtatggtctctccatgcaagacagctcctacatgggggggatgaactcgacctatcaggcagcaccctcttcatcctccatggcgcaacccatgaggccgtctaaacccgaggacaagctcttcggcgaccttctcagcatcgccaagacgaagcagaacagagcttcgtgatacgaccgagtgaaagtgtaagaggtccaatatatattttgtctgttttttcttacaaattttccacgtggcttgatcatatacacttgtgtagctctcttctcttgcgttggatgtgtaagcttcagtttttaacgctgcttccccacattgattccattattaaattcgttacgacgtgtgt

SEQ ID NO: 12159 - DNA, 818 bp, Triticum aestivum
  Clone ID: PAT_TA_12159
ttttttttttttagaaaccgcaccaaaccaccataaatgcgtatcaacacagccagtacactgagtactaccgagtttttttgttgcaccagccgcccccctcccatacagtaagacttttcatcaagcaggctgtgaaaaactgagcttgctagaatggaattttcggcacacagatcttctaccaatcagtttctgtaaatgtacactgatctactacctctacagatgagagcatcaatggactgttagccgagcaatgcgggcaatctctactttcttctcctgctccgctcctacacatgagagctgtccataaactgttagcggcaatcaatcctgacattctaaccatccatcagctcttactttcgtctcttgcccctgtagctactaagcgacgacagcccccctgcaaacaccgacatttccgagggagggggtgatgacggtcgaatcatcgacgggagtggcgaaaagcagcccacgtcgccatccggaaggtcaagatcgtataactcgtcagcgaagactgcaaagttcgaaccagtgcttcttttctgaaggaggcccgcatcactggctctcaagtctagtgctatgtccctgggttccagcagcagtcctagtccaggctccagcaccacgttgtcgatctctgtcagtgatttcaattggcgtcccagtgaagcaatggtcttctggcactctgcaagcttcccggctgcactagcaagctccttctcctgcttggtctttaggtctccatttgagtttgcaagcctccagagcttcgcgtcccgaatatcccttgacaa

SEQ ID NO: 12160 - DNA, 1005 bp, Triticum aestivum
  Clone ID: PAT_TA_12160
ccaaacgcagaagccgctcacgcccacgccttctccgccctcctccttctaccaatttttcgcatctcagcaaaggaccacccgcggaagctgaaaggcacatccgccgcagaattacatggactttcctcgcaggagattagattcggtcatctgcttgatgtgagaattgcttggactttcctgtttagagaagccattacagcatggagtcctgaagatgatagctcttccatgtttgtttacattagttccttgaccaaacagtcctggtattctgaaaagcgccatctctcttcaatatggcaccttgaccaaacaactcggctattatgaggggaggaaactcaaatgaatattaaggttggcagtgttgcctcgacgccttcacactacttggtctggaaagaaaagccaagattggcaatgttcgaaagacgccttcccttctttggttgtggaattggcatctttattgcttcttttaggtcacctgtgcccgttaatttggtacatagcacctcttctttattgctgcaagtactacaaccgtgatcctcgagaacggcctgggcttgccgcttctgctcttctggcaatcatgcttacagcagcgactatcattaccctttctgttttactggtaatgtgtacacacaaacggttcttgaatagctgtggtagctgactgaagaatgtacagtagctagctgcaagatattcgatgcatgtccttgaggaatgaagtacttgacagaaatactctttaggttcctttgttaatcaattgcttaaatccacgggagaaatcgaaggattgcccttcgcgtggtagcatgtcagcatgtccgtcatttgctcgagtgtagattactgtacaattttgtgctggcagatgaacctgttgcataacattttttgtactggcaaccaattggagtttattctttcaggcacaatcagaagattacatgcgcgagctgagtaatatatcagctaccactg

SEQ ID NO: 12161 - DNA, 1065 bp, Triticum aestivum
  Clone ID: PAT_TA_12161
ggccgcccccgcgcagtggcagcgctcggtggattgtcggggcaaatggattccagttccagggccgcgctcttctgcttcctggccgtcgcctcctccctcctcccccccgctagatcggacgggggggtccacgagctcggcgcgttgtcggggcaattcggttcctcgcccgccctctcctgcttcccggccgacgccaccgccctcctgcaccccgccagatctgacgggaacgacaacgagcctcattaaagggaccaacacgcaacaaagactggctcaaggaccgggcggccgcccagaaaagcaatgccgtctgccggcaccgagcacctcaacacgacggtcaccgaccacggactggacaaacacgcccgggtcccccgccttgccccggaccctaggccgcagttcccccaactagtcccatgactctcggaccgccaccgcctcaacgcgtcggtggcggccggcgtcgaggtgatgccggcgtgcgtgcccggcatcgtggcccacattgtgctgaccaactacgacacaatcccctgcaccaccgggttcctcaaagcgacacaactgtgaggccgtccagctgggcaccggcaccgacgggggagtctgctgctctgctcctccggggtccaactcggcgccttcggtccagtaattcagctggctccttggctcgctggtggggttcgttgttttcctgatgaagtgataagataaatgttgtgttgctaatcttgcgtgctacacccctgataatgagcgtgttgatcttgctgcccgtgtcagttgtttcctgtatcttttagaatgtcatgtctactcggtacaagtgggacaccccattacagtatcatattcatgccatgtgctttattgaaccacaactttcatttttgtaacatttacataaagccagatttgcaaccactattggttatcgcgctctgggcatgtgccttctattgccaaatctttttttgcatattgtggtcaggtgatgtgcagtattgaaccacatctttcatctttcaacattagctaaagccagaa

SEQ ID NO: 12162 - DNA, 1353 bp, Triticum aestivum
  unsure (1)..(1353): unsure at all n locations
  Clone ID: PAT_TA_12162
caccctccccccccctcacagcccccgccgcccccgccgcccggctccgcccccctccgtccccgtccccccccttcccccctcccgccccctcccccccccccccccccgcccccggctgcccctcgccgccgccgcccaaccccctcaaggcgcccgcggcctgccgcccccccccgcccagccgcccgaaccgggccgagccccccgcggcaggggagggggagggggagagcgaccgccccgcgacgcccgcgagcagcgagcgcgcagccaccgcggccgacaccgcgaccgccctcccgccggactgcgccgccaccgaccccacgccccccgcgtcccagggcctggggacgctgcccgcgccctcccccgcctccaaccccccgccccccaccgcctccggcggccgcgtcctgccgaactccactcccggccccgggacctcgccggcctcggccaccgcggcctcggacagaccaccggcggcaccgtcgggcgacacgggcgacgacgatgaggacctggtcggtctcattaccgtgctcaatttgggaagatacggggagaaccgctgcatcaaggcatcttaaggagtatctgcttgctgtttgcggcgacaaggacaccaagaagaagctcaagtcgctgctggaagacaaggcgtctacagtcggcctgctggtctgtcgccgatttgtgaatttcccgtatgaaatggtccctaagatgtatgattctctctttgacgaggttgcctgggcgacagaagatgagccaacacaagaactccaggactccttccgattcaagcagtacctgttgcttgtgagaatcttggagagaaaaactcctccaaagcagaaagcaaagaacagcaaagatgaggatgaacctgttatctatccgaagttggaggacgaaattttccgtgagcttagttcgtggtctttcactttcccaattcgtgccgaacagtcagctcagcaggagctgaagaactacaaggagatgggcttggtgatgtgcgttaaagccgaagcgattccgaagttccgcaagaagctggaggccttggtatctgaatagcaggtctctttgctgataagagaagtaggcccaggtggtggaatttcgctgctgtccgcatagcaagaaccagtcgctttttccacgctggtagttgcgccgttaggggcaaatgtgcaatcatcactgccgttgcgtggaggctgttctcgcctcgcgagggatcgttttccggctgggtttctttggttgcctgaaacctgcagggggttcatttctctgcgcaacgaatgcgctccccanaaaatgctaggctggcnc

SEQ ID NO: 12163 - DNA, 999 bp, Triticum aestivum
  unsure (1)..(999): unsure at all n locations
  Clone ID: PAT_TA_12163
gcaggccgggccgggccttccccctcttccgccccgtcccgtctccctccccccttcctcggcggccgccgccgcctcccatcgcggcgagtcaccccgcccgcagccgacctaagctgccgccgcgtgcacccgggatcaccgaggaggcggcgccatgaggttggagaagtgctggttctgctcctccaccgtctaccccggccacggtatccagttcgtccgcaacgacgccaagatctttcggttctgccgatcaaaatgccacaagaacttcaagatgaagaggaaccctcgcaaggttaagtggaccaaggcgtacaggcgcctgcgtggaaaggacatgacacaggatgccacgtttgagttcgagaggaagaggaacaggccggagcgctacgaccgtaacgtcactgagcagactctgaaggccatcccgcttatcacgaagatcagacatgaacggcagaagaaacacattacagagagacagaagggtggtaagagcatggtgcgaaagagtgacgctaaggagctggatcagtttatcgacatggttcccaagcaggaaaccgagaactatgtagccaagcagaaggttctagtttctcagctgaagaccgaagagaatcttatggaagagtaatggaatcaaacagtttagtgtgtgcgcgtgcatgtgatcctttctatatgaagttgtttgtgtttcatcagattgtaaacgacagtgaacatttgttttctacttactatgagctagttatgtatgggatgttatgttatggactatacgcaggtcagatttgctaccgttccgtttaatagagtttgtcgaaattaaccaaaaaaaaaaaaaaaaaagcaattcggtatcggcgggccctcccgcccaagaaggacctacaccgnttcgtnaagtggccaggttgtgcgaatccancgccagngccgatctcaagcngngcctnangtgccccggtttcaacagttaccgca

SEQ ID NO: 12164 - DNA, 765 bp, Triticum aestivum
  Clone ID: PAT_TA_12164
ggcagctacttataatcctcagttatacacacgggcatggcgatcaaattttgttctagacagctccggtagcttcctctctcaggattgcagatttgtacactcgcaaaatatcagactctcctcccctttttacacctagacagctctgatagctttctctctcaggattgcagatttatacatgacgcctatcttctccgcggtggcatcaggtagataaactcgctgagccaaaccctgacacgactataagctcaaactacaaaatgtacaaagtctcggtacaacatgtttatttctaacttggcttgcagcagcccaaaagcaggcggcagaaggtagatctcggtggccatggttagctgtacatggtcattcctatgccattaggagggggtcggcaccgccggtaggcccgtcctcctcgcgccggccgcttcatctccccccgcccgtccaaccgtgtgcttccctcagggctatgcccccggcccctctgtatgaccctgcagccgtgggggtgtctgctctctctgccgacctccccatggctcgtcgactttttgtactgcatggtttcctctcggatcctccctcttcgcctcgggaggccctggctcccctgttgttcccgccctctccgcttggtttgccccccgcgctcagggtcctcctttggcttctcgccccgcgccaccacctctagcgcctttcggttggctcgtctgcctgacctctccagcctgcgtgtcagtacatgtc

SEQ ID NO: 12165 - DNA, 1563 bp, Triticum aestivum
  Clone ID: PAT_TA_12165
tttggttggtctaatcataatcattcaagtattggggaccatctcgtctattgatgctgatgggaagctggggattcacctacttatgattggaacagcttggttgaaatacccataccaggtggagatagtggtggaagaggaggttacttggattggagactgggtttaggttaaggagtcggttgtaacccctacatatcaatggggtgatgtgaaccacaacagcatggccttggcccacagggctggggagggggagctctgggtttctttctgtttctgcgagagactatggttatgcaagggttaattgctggtgtagatgctgatggagcgtcaagggtgcagagtattggtgcgcctgggttttggagaggtgatctggcggatcttgagagagacatattctttcaaaggggaggttataggtgtggatgcaaatgggcagctgaggatcaagtttcggtggagggacagactttgggttggagaccctgctgatgtcattctcgatgataccccatcaccgacggaagcgcctaatgcgggctgttggaaatatggatagggttttctaggccccctgacatgatcagcaggtttgtcgttgggcagcgtgtgcggatcagaggttgtatccgtcagccaagatttggttggtctaatcataatcattcaagtatagggaccatctcatctattgatgctgatgggaagctaaggattcacacaccagctggtgcgagggcttggttgatagacccagccgaggtggagaaagtgatggatgagcatgaagtctgcattggatacttcgtagtagcaaaggactctgttctgatccccacatatcaattggtttaagtgatccacaacagcataggggctggcccacagggccggggatggggagctctgggtttctttctgtttctgcgagagactatggttatgcacaggcttggaggtggagaaggttaggcccttccggccaggcgacagagtacggatccgacctggtcttgttgccccgaggtggggatggggcatggagacatatgcgagcaaaggtgaggttataggtgtggatgcaaatgggaagctgaggatcaagtttcggtggagggacagactttgggtcggggaccctgctgatgttattctcgatgataccccatcaccgacggaagcttctaatggcggcttttgttcatagccttgggcattcttttgaccccatacatgatttcttgctccctcccattgtgcatcatttcatatttaatgcagcggagttgcaagttgcacataggtatcatcatcggataggcatggcgtgttgataggcaggaggggaaagaagaaaaaagagggtgaaaaccaaaccttgaaatagacatgataaccagcacctagggttcttgcatgcatgtataattatgcgcctgactcgtttttttttctctttcagcgtatcatatagcagtgtacaggtttggacctgaacattaatttaattgatagtgcccctgtctgtatcaaaaaaaaaaaaaaaaaaaa

SEQ ID NO: 12166 - DNA, 972 bp, Triticum aestivum
  Clone ID: PAT_TA_12166
ggcacgaggatctaagcgcgccccgggtggattcgttgctagccgctcacgctatttgaaggatgcagagttctgcccaatacctgaaaatttaggttctgtggctgatgaggatctctggatgcaattgaataaaggatgcatcactgatcttgatatgcttgaaatgacatctgattttaaatgtcctccgtccccagaagatactacagcggttgttccattagaggatgggattgacgtgagatgccttaggctagaaactgcatgcagctccgataggcaacagctcgaggattcaaaagcaagatgcacaactctcgagaaggagcttgagctgctcaaggaggaaaactcatccttgcgacaagagctctccaagtcgaagcacgacacagatcatgagaaagaggggctgcttaaggagctggagaccgagaagtacaagatggaggagctcaagcaggatatcaggctctttcgccaggccttctcacagaggcagggtcatctgacgtccctgtacaccaaatccaaggccatcgtggagaactgcaaggcctcccgggtggcattgccctaatgagagcctcagctgctttggaagtttttccatttctgcaacactgctttactgtagatttcgtggtgcctgtaatacaagtgtgcgtgtcgtgtgtgtgcagtgtgcttggttttctaattcagtcgttatcattaagtgtgtgtaagcaagatctggaaaccggtgtgggtatacctaggaaaagggcatcggttttatttgtcattaggaatctgaaaagtgtcaagtgtagttgacacatggttgtcctagttaattaatgtaataaacaagatgaatttaaaaaaaaaacggaagaaacaaatgcttacgtgctgtcgtatcacttctctttgctgatgtgaagcataacatcaccaaagcagccatttagtactaaaaaaaaa

SEQ ID NO: 12167 - DNA, 570 bp, Triticum aestivum
  Clone ID: PAT_TA_12167
cgtccgcggacgcgtgggcggacgcgtgggcggacgcgtgggcggccacagtggggacgctccacaatcttgagtgctacctacacggagtggccggggagcaaggcagtgccggagggttcaagctagaggtggaccgtgacatatcactagtgaacaagggcgccgacgctctcactgacgagcacccggtgccggcgtgttggtgggtccctagacacaagtttatggtcaagggggaagatgggcgatggacgctccaggacttcaagcacatctgagttactcacatcggccactgagaggacattagaccttgatgtgattcacgacatcgtactcgttacaaggttcgaaataacggctacggtttgtcaaccgttcctagtatctttccctttttatgcaaaataagtgagtgttttcaaaatacaatatgtgcgacacatgaatatgatgaaacaacttcccctcaatagtttcttccaaaataaactatgctcgacacatgaatatgatgaaaccacttcacctcgacaaaaagaaaaaaaaaaaaaaaaaaggccccta

SEQ ID NO: 12168 - DNA, 1565 bp, Triticum aestivum
  Clone ID: PAT_TA_12168
agcagcagcacctactggcacgcagccaatcccagccaaagatacttggacgtaaccgagagcaggaggcggcccgtcaagtacaacgaccgggaggcatgccttaccgtccgaggcctcggccattcggcggcagccgcgaccgcaaacgccgtggacctgagcgacagcggcgtcagcaaacgccgtcgtcaccctaggccgttgcctgcgacagctttcgcgtgagctcgcgcggacggccggtcccgaacctctgggtcggcctcctggtcactcccgaaccccactgcagcgcaagtgtcgagtgctgccgcgaccgggtccacgccgccgacgccggcttcagtggccggggccgttcccctcaccacagcacgagttccgtccgccacgaggccgtccccgccggcgacggggctaccccaccaccgcgaccgctacggactcgccgtggccggcgaccccgccggtgcggttccagctacgggtgccgtggttcgtgtcactgtgcagccgaggcgccgacccgatgccctacgggcccacggccccgggccggtgggcgggcgcgcgccggaagcccagggtcggggcggggggggggagatgcatgcggcaccccgggaggcccagcacacttgagttcatccccgcgcccgcggagacgggacttggctctgcggcgcgacacacgaccttgtacgtcgtgcaccgtggcttcctgtcggtgtccacttctcgcaccaaccgcgcctctttccccaaaaccagcgcctaagtacaggttcccaaggaggtcacgcggcttgtggagttgtacaaggacgaggaggtcagcatcaccgtttgcggtcatagcctcggtgcatcgctcgccaccctcaacgccgttgacctggtgtctagtggcgccaacaaacccgagagctccactaaatcgttccctgtgactgctatcgtgttcgcaagcccccatgtcggggaccgcttctttaggtcggcgttcaactcattcccagacctgaaggcacttcatgtgcagaatgctggcgacattgtgcccatgtacccacctttgggatatgtggatgtggccgtggagctgaccataagaacaatccgatctccgtatatgcgtatgccggccacggtgttgacactccacaatctcgagtgctacctacatggagtggctggggaacaaggcagcgctggagggttcaagctagaggtggaacgtgatgtggcgttggtgaacaagggtgccgatgcgctcacgaacgagcacccagtgccggcagagtggtgggtccctaaacacaagttcatggtcaaggggaaggatggacgatgggcactccaagacttcaagcacatctgagttactcccatcggccatggagggtgcattatcccttgatgtgattcatggtgtcttactccttatgaaggttcttaaataaaagctacggtttgttaatgttcctagtatatttacactattatgcaaacacaaggacggtaatacaaaatataatatgtgtgacacatgaaaaaaaaaa

SEQ ID NO: 12169 - DNA, 696 bp, Triticum aestivum
  Clone ID: PAT_TA_12169
ctcggagtccgcggcacgtaaacgagtcttgtcgcgtcgccggggagtgttcttctcggcgcaagcggcttcgcagcgcatctcgtttaacctagtgctttttgtctctcagcgtaagtggcacatagcttatgaggtgtcggaccttactcagaccacatcaggagttcgagattcaagaggaatgttcgctaggcacatggatggtcatttaacttgccgctaagactaagcaaaatgagacgagaaccgtcacctgtgcaaaaaaagtgggtttccaaccttcagtcctcaaactgctgaacggccaatgctccccatcgcattaagaagctcctgctcaatttcttgtcaggggatagaccattgttgcgttgccataggtgccccagcttctgtataagacggcgccacttcagctggcgcttggtgcaggccttaggcatgacctcgtagaacggtacttctgaggccatgacgatcccatcagcggtaacttcacggatctcgatgggtcttgttgtgcgggtgtgcgcaggcctgtctgagggaaggtccctctgaccacgtgggagctgtttcccccgagccatcacctcacggtcttctcgtcggcggtggccacaggcgggtgtggccggcggagcgaccccctcccgcctgctgatcactgacctccgcaaaatcagatgcaga

SEQ ID NO: 12170 - DNA, 1006 bp, Triticum aestivum
  Clone ID: PAT_TA_12170
actgctgtcaacggtcatctggaccacaagaatattttgcattgtcctcagactaaatctgatattattcagacagcaacatctttggcacgacagctgcgatcacgaggagttgctcctgaacttgcagtaacaggtgacttgtgcaggcacttgaggaaaacactagaggccatggagtcagccagtgttcaagagctgagcttgaatgagtctcttcaaaatttcctggagggctgtcttgttgaagtcgtaagaggagttaaagatgtgcggccactttatgacatgatggcaattacattggagaatttgccttctattcctgctgttgctagagcaactattggaagttcgctgatactttgccacataatctctttgacatcagtatcttcggacgctcctatgcaggtgtttccggaagcactcctccagcagatattgagatccatggtacatccagatgcagacactcgtgtgggggcgcaccacatattttctgctgtaattgtccgaggcccaagccatcagaggggtgattcagagtacctatttgcaacaaaaaagtgtcaatctcgatcaccgtcagtgtttgcttcagctactgctctacttgagaagttaaggagagagaaagaacccacgcgtccgcggacgcctggacatatgatgcatgatgatgggaaggaaagaaacacccatgaagaggataataagcatgtttgggcacgaaaaagcccggcttatttttcaaagttggtcttctctttcgtcgatcgatgggcaacactagctagttctgctgaggaaaccaaaatcgtcctgttaactgaagatcaaacaaatcaattgctgtctgcgttttggatacaggccaatcagaccgataacactccttttaattatgaggccattggtcattcatacagcctcacagttctttcttcccgccttaagaattcaagcaacagtaataacattcagttcttccagttgcctctgt

SEQ ID NO: 12171 - DNA, 1469 bp, Triticum aestivum
  Clone ID: PAT_TA_12171
agagagagagagagaactagtctcgagtttttttctactctctccaaaatcgtcctgttaactagaagatcaaacaaatcaattgctgtctgcattttggatacaggcccatcagaaccgttaacactcccttttaattatgaggccattggtcattcatacagcctcactgttctttcttcccgccttaagaattcaagcaacagtaataacattcagttcttccagttgcctctgtccctccgaagtattgctttaactccaagtggaggcctgcccccttcttgccaacggtctattttttccttagcaacgaatatgctggcttttgctggaaaagtctgtcatattgttgaattggcagagttgctaaggtgttttacctcatccaacattgattcttatctaagaattggtgaagacttgcaactctatgtaaggttgcaatcggatcttggcagctatggttctgaaagtgatcaagacgttgctaggtctgtactttctgattgcagaaagaaagtggggataaatgatcagcgagtgcttgatgtgattgcctgtgcactttcaaatttaacagagatggacaaggatgcactggcgaaggagctcacagagatgtttactcctgaagaagttcccttgtttggttcaaattcagcccttgactgggccaactttcatgcgcaggcattttccgatgaatccctttcttttgatgaggagtgttcaagaacatcttcggtagatggtggattgcacgactcaccaattacaaatactgctagctccacatccaagattacgcttcctcattctgctccccgtgtcctgggtgttggtcagttgcttgaatcggcgctgcatgtagctggccaggttgcaggggcatccgtttctacctcccccctcccatacggcacaatgaccagtcaatgtgaggccctgggatcgggcactaggaagaagctatcaagctggctcgtgaatggccacaactcgactccagacaatcctgtgccaagccttcccgctgccgatcatttcatccttcctaaggtaaattcctgtggcttcgagatgaaccgcacgtcatcagagccgtgctccatggtgaagcttccaccggccagcccattcgacaacttcctcaaggcagcttatcgcaccccgcaggagatgtgattacccttgccgtcggaagaagtgctagactgtagtatctaagctttgaacactagtttgtcttaatgacttggcctcctggctgcgagtaacatggtatcagttgttgtagcgtatgtatgaccacgtgtatctatctatgtactaaaacggttgtagcgtgtgtgatcatgtgcaccgcagtactagacgactgtaacctagcgtgtcgtgtctgttgtctgtagcgagaagacttgtgatcgagactaatgccatgatctgggcatctctcaaaaacc

SEQ ID NO: 12172 - DNA, 1070 bp, Triticum aestivum
  unsure (1)..(1070): unsure at all n locations
  Clone ID: PAT_TA_12172
cgtccccacgcgtccgcttcgtcttctgggttcgccgtaccttcgagatagacccttctccgctctccccaggcactccatcgattcttcctccctagcccagccgcgtcgatggagcccgcgccgctctcctcgctgcaggaggaaggggaacccgacgaatcgtcctcctcctccgccttctccgccgccgccgtgccgccacgccccgccacgcaccactcgctccagaagtacgcgccgctggactggtcggcctacttcgacgaggagcgccccgtcgccatccccgacaccgaggacgttttcaatgtgtacatggccggatcggaagggcccgtcgtgttctgtctgcacggaggcggctactctgggctttcatttgcgctagcagctaatcagataaagggaaaggctcgtgttgttgccatggatttacggggacatgggaaatcttccacaagtgatgatttggatctgtccattgaaactcttaccaatgatgtaatagctgttatacgtacattatatggagatccgccaccagcaattatacttgttggtcatagcatgggtggttcagtggctgtacatgtggctgcaagaagagcaattcataatcttcatggtcttgttgttgttgatgtggttgagggaacagcaatggcttcattgattcatatgcagaaaatcttattaaatccgagcacagcacttccccgagcatttgaaaaagcaattgaatgggagtgtccaaaggtgggccccctacggaacatcgattctgcgcgtactctatccatctaccttgaatatgatgaacaaaggaagccatacataccgtaccccccttggaaaaacagagaatncnggaagatggtacaangctttcaaacattctaactgtcccgtaaanagatacattattantggaccataattggcagactttacaatggcaaatcaaggaattcaatgaaatatcacnacggantgcatcagganattctaaaattnacaantacgactnattcccanaaataggccatgnttnanacacccaaaaatgg

SEQ ID NO: 12173 - DNA, 1095 bp, Triticum aestivum
  Clone ID: PAT_TA_12173
cgtccgcccacgcgtccgagcgggcatgctgccgagtttgctcatgcagggctatggaccacagtcagttgaagagaaacaaaggctgtatatgctgctgagaaacttgaattttaacggagaatctttgcctgcatcagtctctgagccctatacaccaactgctcagaaatttggcagtgggacttccgcagagggtctgtattcacctgaacttagaggtgaacttggagctggtcttctggatctccatgctatggatgacactggacttctttctgaggatgtagattcagaaccatttgagccttcaccctttatgccaaaggaaattgatgatgatgaggatgatatgataacaggaagccagctaggtccagctgataactataatgcagtgacgagtgaaaaggagatcagtactagagaaaataatgtagcgaagatcaaagttgtggtaagaaagaggcccctgaacagaaaagagttatctcgaaaggaagatgatgctgtagctgtgcatgattcatcttctttgacagtttatgaacctaagctgaaggtcgacttgacagcttatgtggagcagcatgaattttgttttgacgctgtcctggatgaggatgtttctaatgacgaggtgtatcgtgagacagtggaacccattataccaataatattccagagaacaaaagcgacatgttttgcttatggacaaacaggtagtgggaagacatacacaatgcaacctttgcctctgagagctgctcaagacatgattcgtcttttgcatcaacctgtctaccggaatcaaaattttaagctgtggctcagctacttcgagatatacggtgggaaactctatgatcttctatcagacagaagacacttactgatgagggaggatggcaagaaacaagtttgcatagtcggtctgcaggaatttgaggtttctgatgtccaggttgtcagggaatatattgagaggggaaatgcagcaaggagcacagggtctacaggggccaatgaagagtcatcgaggtcacatgccattctgcaactggctgtgaagaacatattatagtaactgaaact

SEQ ID NO: 12174 - DNA, 701 bp, Triticum aestivum
  Clone ID: PAT_TA_12174
ggtccccggcagctcccggttactgccatgccctgctgctctgtgcgcccctggcctaccccccccctgggctttctgctacatgacgaatctctcgtaaccagggcgccgccctagagactctttctctcctctccatggtcctggccatatactcggtgtcttctctcatccctgctgccgcgtgtgctcctcgccctccccctccttggtgcccggttcttgtcgtcgaggccctcctctcctctccggcgccagagggtcccgtgcagcctctgggctcgggcagacgataggatcgctgcctgcgctcatattctgtgccccatgtgctagtccagctgctccggctgggggccgggctgttttcgtcgtgccctccctcttttctccgctgtgcgtgggggcggcgctgccccctgtgatttcgcctcggcttggccttgacgctgccctcgccgctctctcttcggccgggcccttcgccagcccgggcctcactctgttgggccggatgctactcaaaacagttttagattcaccaagccgactcgtggcggtgtatgtaatttgtttcctctgcttttcgccacaagtcagtttttctctttcctttccatcagggcatcttccagtttgcatcactcgcctattttcacccttcagtgctggcatgatgttcttctcggcgaccgtcggtt

SEQ ID NO: 12175 - DNA, 749 bp, Triticum aestivum
  unsure (1)..(749): unsure at all n locations
  Clone ID: PAT_TA_12175
ggccaaactcagatagatatatttagctgctgatgttctatacaaaaaggcaatcaatccaccctcccacggtcccagggtgcgcaagcaaaagcttgtacttccaaccaaccatatatattcagtctagcgtcatatgccgcataactaggggggctattatgctatctagaggcgtctccagcacccgcacggcggattggttcggtgcggtgcggcaaaaggcgctcgctcatccaccacggttacggttcagggcgagcggcggtgggacggttcatttccacagcttcacgtgcttgtcatggctcactgaagccaccaggccggagcttgaggaggccaaggcagagatgaggccgtcgtgcgccgcgacggtcatgctcctgttctccaccatgtcccacagctccagagactggtagcaaccgatgatgagcaaagatggatacttagggtggaaagcgcatgcatgaaacttgctcccggtgctgttgagctctcgcacgcagggcccgtcccccgcattcacagaccttactcctaccgtggcgcctccgctgcagaccacgtagtcacccgtgcggctcctgcaaactgaatcgccgtgctctgtgtgaccctcaaatatcctaacacaagcttgtgtttccacatccagtatagatacaacattctctgaagctgctgcaagaaatccaccatgacgtggctgaaatctcagctggcttgaacctnccttgaaattt

SEQ ID NO: 12176 - DNA, 1015 bp, Triticum aestivum
  Clone ID: PAT_TA_12176
tttttctccgtctgttttgccggggcggccgtgcatgacccatgcttctggccggacaaaactaaccttcgcctgttgcccgtcaccgcgcccgcccatctgttattcctaaccgagcctaccaagatcaacaagacatcacggcagagttccgcctcatatattgcacaatctccatctatgtcgtttgttgcacaacctccatatccagcccccgtctttccagtccccatcttcgcctatcatcttccggcttgctctccggcctcctcgccggtctcgcggcgaggtggccccgcggtggccccttgccgcttcgtttgccatcgcatctgcctcacccctatctgcctcctcatagcctttccgtaggccttttccagggtccctcctgcctccccgctgcccgttctggaccacgtgaataagaaggctgaggttctaatggatggctggtggaagtacttgcttctcctggttgcgaagtacttggtgtagcgtgcagaggtcctgagttcctattcaaagtgttcactggaggataagcaaatgatctcccatataatgaagcagctgaagcagcagcctcaagttttgcttgacgcatgttcacgttctcagttggtgctcctcctgaacttggagtaccggtgccaggctgaactccaggttgagctccatgctgctgtgctgatgctgcacgtccattatctggggggataattggagctctacatgttgggcaagtatgttggcgctgtagccatgacctcaaacaatgtacatggaacaagtgcccaccaagcgccctctttgctgcggccttcccgtcgcggcaaataatacatgtgacatcacccgcatcaagctcatctggtgtggcatctggaaagcgttcattcatgttggaagtcacctttctgtagcgtatataatctgaaatgcgaattctgaagttgcggaaggtctcatacagctcacgaatcaagtgcaatgggacaccatcctcgtgccg

SEQ ID NO: 12177 - DNA, 725 bp, Triticum aestivum
  Clone ID: PAT_TA_12177
aaccaacaacgtttccgaaatcttcatttgccaattgaagcggacataattcagttcttgcaggtggccgacgagccaacaaagcatttacaatgattcggcaattttcatccaaaagtaggactactattacttgcagataaccagagtccacggacaagcactaagccaacagtatagaactacatttgctactagatacaggcgacgcagtctaagaggaggtgaacttggtgacggccttggtgccctcagagacggcgtgcttggcgagttccccggggaggacgaggcggacggaggtctggatctcccgggaggtgatggtgggcttcttgttgtagcgggcgagcttggcggcctccccggcgagcttctcgaagatgtcgttgatgaaggagttcatgatggacatggccttggaggagatgccgatgtcggggtgcacctgcttgagcaccttgaagatgtagatcttgtaggtctcgacgctcttcttgctcttcttcttgcccttcttctcgccgccttccttggaggcggtcttgcccgccggcagccgcttctcggccttgggcttcttcgccgccggggccttctcggccttctccgccgcgggctcctcctctgcgggcttcttcgccgccggcttcttctccgccttgggggccatcgctgcttcgggagggggagaaaagtgggtgggttgcttcgccgccggaagg

SEQ ID NO: 12178 - DNA, 718 bp, Triticum aestivum
  Clone ID: PAT_TA_12178
aaacagcaacgataacaagggaatgatgttcaggttctttccccgctgcaaaaatacaggtatcaaaagttcacaacaaaaatgttaacggccagaggttatcccattgtcttcaccccaaaagtgcttctgctatgggtctcctactagattacctcccaactaacggtacatcatcttgatcccaagctacttgactgacccatccaaaacatcaaaactacaagacctgccctatgtgtttctgttacagccacaagcatcaggtgtcatcggatcggaacatcaccgtcgcggcggaaatcacctcgggtacctctgcaggtagagatcatgaggggcgtatccagcagacacggtcctgtcgccgaagctgcgcccatgcaaggaatgtgcggccatgcatgcagcctccttccgcatgaactccaccagtatagagccagcttccagcacgatgctgtctgaaatcggagcaacgtctcttgtgtcagccacaggtagtttttctgcaccactttcactcacatcatcagtgctctgttgctccttctcagtttcggatctctccgacacatcgccaggtgtagtagaaagacaggcctccaaagttgttgggcctgcatatccttctcctaaactatcttcacccactgcagaaacatcttgctcagtttgtgtagaatccataagaccggactccatttgttgatcacat

SEQ ID NO: 12179 - DNA, 669 bp, Triticum aestivum
  Clone ID: PAT_TA_12179
ttttttttttttcctggagtggcctccctttactggacaaattacaggtcacattatgtctcttccttctaactttacatagtatatatcttttaccagaaaagccttgaacgtatgattgggatcctaggtactcacactgatcacacaagcaagtctcaggtgttctgtaaagaaattcttcatgtgaccatgttgacaacaacatgctagggcgacacaattccgggcgcaacacagctattgcgtgagcgggacgcactcgagctccatctcgaggtggccacgctcgacgttctgaagcctgacagtcacctcctgcttaaccttgttgtcgatgatggtgatggcactgtcccttgggatccagatgccgtctttcgccatccatttgttgagctcggcattgtcggtgatggacttggtttcataggctctggctgcagcaactagtggttgaatgtttatctcagcctcccccattcggtcgtcggtggtgaatgtgtccttgtcatagacttgcacttttagcagtggaaccggatcgggtatcgatagcagaagtcttccattccatacaggattcaggctgctctttatcaccttcgttttcatcgactggtgtcctaggtttaggataacataagggtcgcttgacatcacatcacg

SEQ ID NO: 12180 - DNA, 700 bp, Triticum aestivum
  unsure (1)..(700): unsure at all n locations
  Clone ID: PAT_TA_12180
cccatttgttttaaagtaactatatnngagtgccaaaatcttttgttattcgccccctctccctgagtttaggtgcctgttggccacctgtgctgggtaactgccgctccttcgttgggggacggggcgagcacctccgacggccttgcggcgtgcttgcgcccaccggtcgcgccttattcgccctctgagttggcttcctcgcctgctgcgagctcgggccgcccgttccgccaagcgtcgcgccccgcgcagcctgtttccagcaagtggaatcaatgccttaatccaactccatctcattatcccgcgctgtgcctctgcatgaccagatctttatagttctatcatgtgaaacagtcacaatctgttgtccatctccactaatatccagactagtgacctttgactcatggcctgccaagcatttaattgccttgtaatcctgagttgaccatagcgctgctttagtgtcataggaggatgtcgctaaataataaccctcctggggttcaaatttcacatgcgagataagactcttatgtgccggtatagaatataacatttgtctggtcctcaaatcccatattcgacagaaattgtcttcacttgcagttgcaactagatgaccattaggggagaagctgactcctaggacaggtttcacatgtccaatgagagtacagtacaatcttnctga

SEQ ID NO: 12181 - DNA, 733 bp, Triticum aestivum
  unsure (1)..(733): unsure at all n locations
  Clone ID: PAT_TA_12181
ttttttttttttttttttttgagaaaagagaatattggatctagaatataacttgcaaaaaagttacaaagaatttaaataaaattaacatccatgatcctgaattagtactgaagatactctagaaaaattttgcaatcaataatgtacatcctgacctagaaacttacagaacattttcctataagttacaagacagcacttgcattttgctgtcctctgtccctttatgccagatgttacatagaagtcgggacttatggatgtaacactctccaccgcgggagtgctaatgagccctatgcagcatgaacagaagatgacttcctttattggggcatcagttatcaggacaaaagaattgactttctttcactacaaatctgggagcagaattctgccttgatccccaaacatgcatcttctatgatgtgactgcagtattgttacttcagcttgaatgtacatcagatggggcacgaagaaatacatcggacaaactttcatctgaactagcaagctccatctgtcagtccttttcctcccgtggacgtagcctctccttctcaaggaggactggccagtcctccccaagctgttgagggtttagctgcatggctacactgaaatcatgagcagagatcaagtgttgacttctgctatcatttgtagcatctgattgtccactgcttgactgcatctgaacttgnttcggcaaccaaacaccattaat

SEQ ID NO: 12182 - DNA, 712 bp, Triticum aestivum
  unsure (1)..(712): unsure at all n locations
  Clone ID: PAT_TA_12182
cccacggggttcattatgtattacaggaccggaaccccaagtgnttggacccacctaacatcacaagtccaaggacancaggagcacctgcctagcgtaaacgcaatttagtcttagggctaacatatcccaaacggatgatagttccagggagaaatggaagccgtcgcagtacaagtagtgaaccatcgtaggcggaacttaagtgcaggaaggtacgaggctgaagtgcaagaaacctgatcacaacaatctgatcaatatacatcccagaagtttctatcttcatcttccaagggagttcttgccaagcagagcaagaaggtctgaggcaaaagtgcaaaaaccatgttcacaacaacctgatcaatagacctcccagacatttccaccttcatcatcccatggttggtcctgccaagctaaagcagaagcttcagcctcagcggcccgctgtcttgcctcagcaacacggcgttgcatcacacgggaatcatgaacggtgcagcgcccgtgggccagctttgctcttcacaaatccaagcaggccgtctggccccttgctcttttaacctctaaggcgcggaattggganaaagtgaaactgggattgattggggaaaattgctccatatcgntaanccacatcgntataataanccaaagagaatcactctgggattgctgtcgtaaaaagccangtgcatcattg

SEQ ID NO: 12183 - DNA, 870 bp, Triticum aestivum
  Clone ID: PAT_TA_12183
tcaacccacgcgtccaatgatccaatgcagtcaagcttcaatgctacactagaggataaaaaccttgagatcccaaatttcagattactactgaagcaagttgttaccatggaggtgatccagtggacaaagttgtgggaattcttcaaggatgaatacgagaacgagaagaatctccttggaggagctttaggcacaaaagctgcggaggatttgaagctgaggatcattgaacataatatcttggttgtttcgaagtactattcgaggattaccctgaagaggctggcggatcttctttgcttgagcttgcaggaggcagaaaagcatatctcggacatggtgaactccaaggccctgattgccaagattgacaggccgatggggattgtgtccttccggacagcccaggacagcaacggggtgctcaactcgtgggcgtcgaacctggagaagctcctggacctggtggagaagagctgccaccaaatacacaaggagacgatgatccacaaggcggtgttgaaagcctgaagtgaaccattttgaattgaatgtggccttgtttaggttgtgtgcgtagtagactttctcatggatctgaattcactttcactgtatgggtaaaactattctctctgctcaagtgggcatcgcctgtttgctttgggaactcgtgtgtgaaccggtctcgaaatactgtaaccacagggaatgacgaatactatttgctgtatttttctgaatattattttgtaaaaaaaaaaaaaacatcaactcttgctgaacctggatgtatctgctcatcagagcgtagagccagtttctgaatgatttgctgggagacgcgcttgttccgttttgagtggt

SEQ ID NO: 12184 - DNA, 1877 bp, Triticum aestivum
  Clone ID: PAT_TA_12184
gcgacccgtcccccgagtccggccccacgcccaagcaaacccaaatcggccgccgtcccctctcctcctccgcccacccccgccgccgtcgccgcctcctcgcgagatcccgaccatggagggcggcagcagcagcctcgacgcggcgatcgagtcgctcctgaacacggagaagcagtgccgcctcgccggggatgtggccggcacccggaaggccgccgtcgacatcgtcgagctctgcttcaaggacgccgcctggaagacgctcaacgaccagatcgtcgtcctctccaagcggcggggccagctcaagcaggctattactgctgtggttcagaaagcgatggagtacattgatgtgacaccagacgtggaaacacgtattgagcttatcaaaacattgagcagcgtcgctgctggaaaaatatatgtggagatagagagagctagattgatcaaaaggcttgcaaaaatcaaagaggaacagggaaagattgatgaagctgctgaaatcatgcaggaagttgctgttgaaacatttggctcgatggccaagacagagaaacttgcattcattctggagcaggttcgtctgtgcctggatcgtcaagattatgtgcgcgcacaaattttatccaggaagattagccctagggtctttgatgctgatacatcaaaggacaaaaagaaaccaaaggaaggtgataatatggttcaggaagcccctgcagatgtaccttcactcttagaactgaagcgcatctactatgaactgatgattcgctattactcacataacaatgattacctggaaatctgccgttgctacaagtcgatctatgaaattccatcaataaaagaggatccagcaaagtggacaccgattcttaggaagatctgttggttcttggtgctggcacctcatgatccaatgcagtcaagccttctcaatgctacactagaggataaaaacctttctgagatcccaaatttcagattactactgaagcaagttgttgaccatggaggtgatccagtggaacaaagttgtgggaattcttcaaggatgaatacgagaacgagaagaatctccttgggaggagctttaggcacgaaagctgcggaggatttgaagctgaggatcattgagcataatatcttggattgtttcgaatgtactattcgaggattaccctcgaggaggatggtcggatgttctttgcctgagcttgcaggaggcatgagaagcacatctcggacatggtgaacacaagggccctgattgccaagatcgacagaccaatggggattgtgtctttccggacagcccaggacagcaacggggtgctcaactcgtgggcgtcaaacctggagaagctcctggacctggtagagaaaagctgccaccaaatacacaaggaaactgtgacccactaggcagtgctaaaggcgtgattaacgtgcatacattttgaatggaatggccttccttttagtgtgttttgtgggtagtggattttcgagtatttgacttcacaatgtgggtgtgggtaaaactctaatttctagtgaaacatcatgcacgcgagctcgtctgggcatcgcctgtttgctttgggaactcgtgtgagtaaccggcctcgaaatactgtaaccacagggaatgacgaatgctatttgctgtaattttatttgaatatttttttgtattctttgggcaaacatagctgtatactgctttttcagacccagaaccagatcaccaaccccggggagattcccctggccgggtgtcgcgcgtgtgctgccgttgtgatgcagtcagtcaggtgttacacggtttatcatgtcattgttggtaaaacaaaaaaaaaaaa

SEQ ID NO: 12185 - DNA, 470 bp, Triticum aestivum
  Clone ID: PAT_TA_12185
cgtccgcccacgcgtccgcgtgctcccggcggcggtcggaggcggcgccggcgtgccgccatgcgaccgtcagatgaggggggggttccatctcaccagggcacagctcatgagagaccttgtgcacctgtacaggcacgtgctcaaggagccgagccaggcgctcaccaccggcgcgttcggcgcgatcccagtggcggtaagaatgatcttggacatcaaacacttcgtcaaggactaccacgaaggcatgaacgccaccaacagtggcgtagtcgggcatgtctacatcagcctttgctgcaccttgatcgtgaggaacgggagcccggagctggttccgccgtacgagacggtgaccgtgccggcgcatgccaccgtgggcgaactcaagtgggaggtgcagaggctgttcagggatatgtacctcagcctgaggaccttcacggccgagtgcgtcgtggggatcg

SEQ ID NO: 12186 - DNA, 727 bp, Triticum aestivum
  Clone ID: PAT_TA_12186
ttttttttctcccactccgcccccgattctccccaatcccctctcgccgccgccaggaggcagcaccggaatcgcggcgaccgaagatcccctccgacccacgccaaggaatcccgccgatccgctcgcgcctcccggatggccctgcaccagcaccacgcggggtcggcgtccgggtcggcgtcggcgtccagctccagctcggggctgcacgcgtccgcccacgcgtccgtcggggacaccacccacaccaagctcttcgtcgggggcctcgcctgggagaccaccagcgagaggctccgccgcttctacgagcgcttcggggacatcctcgaggccgtcgtcatcaccgaccgccactccggccgctccaaaggatacggcttcgtgaccttccgcgatgctgaggcggccaccaaggcctgcgaggaaccgtcgccggtcatcgatggcaggcgggccaactgtaacctggcgtcgctaggtcgcgcccagccttccacacccctcgggcggccaagatcagctggctcctactttggcgttcccgtcccaaggggcatttatgtagggggttatggtcagcagcgaccacttccgattgggtactaccagtatcagggattcccggttccacaatacagttactccacatatgggactaagtatttatcaacagggtacattaaacccatatgttggccagcaatatgttccagtttatggt

SEQ ID NO: 12187 - DNA, 643 bp, Triticum aestivum
  unsure (1)..(643): unsure at all n locations
  Clone ID: PAT_TA_12187
tttttttttttttttttgcacacgtagcaagtcactggtagatctgtcgtgctagcttcccttccgggatcccacggtcagggtccggcctgttactccctgccttttgcaagtaatttttggcaatctctcgagtacatgnggagagcctagagaagctcacaagttacatcgtctgggtcagtcttgtggtatgtacagagccactacattctcctatttcttgtgcacacagaagcgagtggcttcagactatcctactacatcagtatctttttccctgcttcttgggatctttgcttctgttaaccacaccgacgccgcgccgacttgtatggtgtcagtagacggggataaggcgtggttggtagcggggcggcgcaggatcggcgtcggcatcctcttcttcctcctcctcctcgtcgtcctcgtcctcggtgtccgagaagaacatgtaagttccctggtttccctgcagcatcaagtgatctggtccccacggcgacgctgcagggttgcctttgcgctcacctccgccgtgcttgggaaccgggtcccagcggtccgcagcacaagaagcaaaaacagagcaaacgagtactccccgtcgccgccgaccatgagaggaagagtgtgccggaga

SEQ ID NO: 12188 - DNA, 994 bp, Triticum aestivum
  Clone ID: PAT_TA_12188
cgtccgagtaaattcagggatgataccaaccccatcagggctgatacaactctgtcaaaggcagatggcaacatcactgctgttgctgcaggggctgacatatctgaagctggtgcagaaaggaaccccttgagcaataaaccagtacccaccaatggccaagatttagctatgggctctacagaggatggacgtgtcaggaaagggcgtggttttacgcagaagtactcatttgcacgtcgataccgaacaccgtctccagagtgttcacatgttcgttctagctactatggaggaagaaatgatagatggaataacttcaataggtatggaagaaatggtctttatggtgcacgatcgccggtgaggagataccaaggttccccaagagctagtagcccaccaaggtacacaaggagagaccgaagcaggagcaggtcacgcagtccagtgagacgccgtgacggcggaggaaggcatcgccgccctagcccaagacgcagccgtagctccgcagaacaacataaacgtgatgcggcctacaggcctcgatcaggtcgtggtggcgatggtggcccctctgctgctaatagaggaagatcaagatccaggtccaagaaccgtgatgcctcgaggtctaggtctcctaatgctgccccagccaaaagggtgagctcaaagtataaccgcaggcgcagcagcagctcaagatccagtagcccctccggtagtaaaggcggtttggtgtcatactgagatgtgatggcaggagctggaaagtcgggtttcagtactctctatactctgaagcacatgcctgttctgtatcttgagatgctgaatcatgtagctactaaacttttcttttgtaaacgacttaatggctttgtgcatgagatgttgagagtatgatctcctgaccggtgaagtttatcgataagatgcaactcttttcaaatatattgatttcttaccacggggttccacgtggtat

SEQ ID NO: 12189 - DNA, 439 bp, Triticum aestivum
  Clone ID: PAT_TA_12189
cgtccgcgtcgacccgccccacgccatcgaccgcctccacaaccgcatctccatgctccaggtcgtctccgagctcgacgtcccgctctccgacgccgcctccgcctccgctgacggcgaaggccaccgccacaccttcggcatccccagccaggtcgtcgtctacgacgccgccgcgctcgccgactcgggcctcctcgccgcgctccgcttcccgctcatcgccaagcccctcgtcgccgacggcagcgccaagtcgcacaagatgtccctcgtctaccaccgagaggggctccgcaagctccgcccgccgctcgtcctgcaggagttcgtcaaccacgggggcgtcatcttcaaggtttacgtcgtcggcggccacgtcacctgcgtcaagcgccgcagcctaccggacgtctccaaggagatcctagaggacgcc

SEQ ID NO: 12190 - DNA, 1434 bp, Triticum aestivum
  Clone ID: PAT_TA_12190
cgtccgcccacgcgtccgggaaatagcaggccgacccgaccagacctcccgacgcaacaccttccgcctccttgagtcgccgtcccctttagctcgacccgctccggcgagacggttccgaccggcggcgaggcgtacagggaggtggattccggcggccggaaacgacccgctccagaaagggcagcacccggagtcgagctttggaccttacctgactgctgggagctcgcattctgagtatgcgaaagaccggtggttttaaatgctggaaatcatatcacttccgtttataagtgcacaaatatgttagggaattctttgctagccgagaaagaattggcgcttgcaagtatatgtggtttgttctcatcaagcatgcaaaagtctcatacaccgtcctgtcctactatcacatatgaagaagctcttagaagggaactggaatatcggcgaaggttggaacgtactcatccacatctgttgattgctcttaatgaagctcctgcgctatccagagtagacctgtacagattcaacacctgatgtgtcgaacagaaagttaactcctgagactagtatccatccaccgaattcatactctccattcaccactgcaagtggccgacagcctacttcacaggccatgcaggctgttctaatacccagaccgcattctgcaccggccttgcgggccgttctatgccccgtggcttgtgccgctccttccttttgcggcgccctttgcggagggaaaaagcacaaacttaagaagcaactgattcttggtaatatgaacactggaagacctggaaactggtcagtcttggtaatgggaacactggccgtcctgccacgggcagtatgcagtttctggaagtaagaaatgatgaaccaaatgcaggtagcagcagtattgctggaccaagcagcagcgtgtcctcgggatgcagacccagcgaagcaaacccctgaagcattaagctaggcaatcaaccttgttacggacggtggaaggcgggttccaaccacaagaggttctcaaggtcacggaagctgtgcaagtctttgcgtcttggcagctgtgaacgaggttgtagttgccgtcctcggatctgcgcagttggctgtccccggctcgcctctctcgtcgtccttgagcacgcgtctctcattgagcttgtgcatgagaagacatattgcgcaattgcacaggttgagatggccaaggagtctgtgtctctcatctccgcaaggactcggcgacctttacaaggttccgcaagaattaaagcatcatgatacagatctttcttcataaatcccatgttttatgcttgtaactgttacatactcaaatggttgattgattagatcttgagtttgatattgtcgataatttatcatgtcatctgttctcatatgtcaggacag

SEQ ID NO: 12191 - DNA, 1419 bp, Triticum aestivum
  unsure (1)..(1419): unsure at all n locations
  Clone ID: PAT_TA_12191
gttgaccggaaaactaccttggttccgggcggtccagctggaccctctagttctccgtggttcgagttttgtgtgtcgctcgatcgcttcccgagtcggccttcccgatcacggcccccacgcccacgctcactcactctggcccccctccaaccaacgccggcgctgcggcgaggttcgtcgtcgctggggacggcgcctccggcaggcagccgggactggccccccccaaccaacgccggcgctgcggcgagcaggattcgcaaggaaagagcttgtaggaagagcgaacagaacatagagagcctatttcagcagcatgcaactggagtaggttcagcagcttatccgcaggggagagacgaggcggcccgccagttacagctaatagctatggagcctcaagctgttcagaacagagatgacctgttcgtttggccctggatgggtgttttggtcaatgtgcccaccgaatggaaaaatgggtgccatgttggagaaagtggaaaccgactgaaggagaagctctcgtgcttttgcccacagaaggttattcctttgtggaactatagaggccacacagggaatgctattgttgagtttggaaaagactggactgccttcaataatgcacttgctttcgaaaatcactttgagtcagaaggatatggcaaactggactggaaggcgtacaagcatcgacgaccggggatgttcggatgggttgcaagggctgatgatcagaaatatccagggccgatcggggattatctgcataaaaatggtgatctgaaaactattgcagatgttgagaatgaagaagcacgcaaaacaaacaaactggtagcgaatttagctagccagattgaggtaaagcgaaggcatgtggaagaacttgaatgtaagtacaatgagacgaccacctcacttgacatgataatggagcaaaaggatcagctgctccgggcatacaatgaagaaatacacaagatgcagcaacttgctcgtaggcattcacagaggatcattgatgagaatcaaaagctccgttcagaacttgagtccaagatgcagaaccttgactcaagatccaaacagcttgatgagctagttgcgcgtagtgaatctgacagaaggaaccttgagcacgagaaggaaaagaacggtgttaaaacaaagcatcttaagatggcaacattggtgcaacagaaggctgatgaaaatgtgctcaagcttgtggaaaaacacaagttagagaaacaagtcgctctagataagattatcaagttggagcatcaactggatgccaagcagaagcttgagttagaaataaaacagttgcagggtaaannnnnagtcatgaagcatatgccaggtgaagaagactcnnnatcgaannnnngaatagatgaacttagt

SEQ ID NO: 12192 - DNA, 636 bp, Triticum aestivum
  Clone ID: PAT_TA_12192
tttcttcatctgcgtccggagctcctcctcgtcaacgtcgtcggcggagccggagccttacccggcaccagagattcgttactcgggccatttccccgtccatgtagatcactccgtcgcgccgaggttttgattttggatgggaacctcatcaggcgcaaatttccatcaacagcttccacaggggatgccgcccccacggcacaacaggggcaccccaaacctgcagacttccctctctttggcctcgtcagaccaagttggtacgccagatatccaggagcgtgcgtcaaattctgacccgggtcatgactctgccactgagagtgccagttcaagggagacctggcctgtagagccaaacaaaagcagtggtggtggtgctgcgaccactattagaatagtggataaagataaggaggtagccaccaaaggtgttgctgaacggcaagtcattcgtagtaccggtagagtgactctccgggaggttgctcgggaaagggttgatctagtcgctgagaaaatgaaggttatgctagatgaggtgttggatgaaatcaagagtgaacttcggtcaattcttgaaggaactgagggttctcatcatgttgaggaggtttttgacctgcagaagct

SEQ ID NO: 12193 - DNA, 829 bp, Triticum aestivum
  Clone ID: PAT_TA_12193
caactctcaacgcagcgactttccactagtttttgacgctgcaactgatggacaccgccgctgccggctccccgcgtgaggggcacaggacggtgtgctcggagccgcccaagaggccggcagggcggaccaagttcagggagacgcgccacccgctgtaccgcggcgtgcggcgccggggccggctcgggcagtgggtgtgcgaggttcgcgtgcgcggcgcgcaagggtacaggctctggctcggcaccttcaccactgccgagatggcggcgcgcgcgcacgactccgccgtgctcgcgctcctcgaccgcgccgcctgcctcaacttcgccgactccgcctggcggatgctgcccgtcctcgcggctggctcgtcccgcttcagcagcgcgcgggagatcaaggacgccgtcgccatcgccgtcctggagttccagcggcagcgccccgtcgtgtcaacgtcggagatgcacgacggcgaaaaggacgcccaaggctcgccgacgccgagcgagctgtccacgtccagcgacttgttggacgagcactggtttggcggcatggacgccggctcgtactacgcgagcttggcgcaggggatgctcatggagccgccgtccgccagaacgtggagcgaggatggcggcgaatacagcgccgtctacacgccgctttggaactaattatccgactaattaagccatgtacagttttggaaactactccctcggtaaactaatataagagcatttaaatcattaaaatagtgatctaaacactcttatattaagtttacggagggagtaggctactagtggttgtgttg

SEQ ID NO: 12194 - DNA, 1672 bp, Triticum aestivum
  unsure (1)..(1672): unsure at all n locations
  Clone ID: PAT_TA_12194
caacaatttgctggcgtccattggtgagatttcttcattggagtatgtcaacctgtcaagcactgggttgcatgagcgaatccctggggcgttgtcttcccggttggttggcttacatgtgctggatttgtcacggaacaatatcagcggggtggtgccggacttgagcactttgccgctgcgggtgctggacctgtcggtgaacaacctcactggggagatccctgtgtcactggtcaagaaattggtgtcaatggatcgattcaacttctcgtacaacaatctcaccgtctgcgcctccgagctctccccggaagcgtttacagccgcctttgctaggtccaggaatgactgcccgattgctgtgaacccggacagcatcaagaagaatggggggcaccgcaaggggatgaggttggcgctggccattgtgctcacgctcttcttctcggttcttgcattgctttgcttggcacttgtgtgcaggaagccgaggaagaagaggggtgacacatttcccgttgataagcagccatcgtcattcaaagacgagcctggcacatcagggccatttgcgttccagactgattcgtccgcttgggttgccgatgtcaaggttgccacatccgttccagttgtcatatttgagaagccattgctgagcttcaccttcgccgacctcttggcagccacatcaaactttgacaggggaactttgctggcagaagggagattcgggccagtgtacacaggattcctccctggtggaatccaggttgctgtgaaggtgctggtccatggttcggcaatggcagatgaggatgcagcgagagagcttgagcggctggggcggatcaaacattccaatctggttcctttgaccggctactgcttagcaggaagccaaagaatcgcgatatatgagtacatggagaatggcaatctgcacaacttgctgcatgattttgccactaggcttgcagaccaccgaagactggagcaccgacacatgggaggacaacaatggtggcgtggccactgaaaacatcacccccagagggcactgcgggcatggaggttccgacacaaaatcgcactaggcgctgcaagggcactggcgttcctccaccatggttgcattccgcagatcgcgtccggggatgtgaaggcaagcagcatctattttgactatgcaatggagccaaggttgtctgatttcggcttgtcaatgatcgccgggacaagcacagacggcgaccattcccctggctatgtgccgccggagttctccgacccagagaacgccacggcgacgtcgaagtccgacgtttacagcttcggcatcgtgctgtttgagctgatcaccggcaagaagccactgggtgatgagtaccctgaccagaaggaggcaagcctggtgagctgggcaagggcaatggtgaaggcaaatcaagggtcgagcatcatcgaccccaagatccgcgacacgggactggacaggcagatggacgaggcactgagggtcgcctacctttgcaccgccgagctgccatccaagaggccaaccatgcagcagatcgttggcctattaaaggacattgagcctagagtagcagatgagaactgaagttatatttatttattagtgtattttaggcgtgnagcagcgagt

SEQ ID NO: 12195 - DNA, 2311 bp, Triticum aestivum
  Clone ID: PAT_TA_12195
cactccactcctcctctaccggcttccgctgccggccgcggccgtccccacccaccaccaccaccgcgaccgcaaccgcaagtgcgcaaccaccgcgggacagcggggcctgcggcgagctcgggggagcgaggatgagcggggcggcgctgtgcgcggcgctgacggagctggggttcgacggggaggacccgctggacgcggacgcgctcgagtggcccttccagtacgaggaggcgcgcccgctgctcgcctggatctgctcctgcctccgcccctccaacgtcctctccccgtcccacctctcgcagtatgagcaactcgtggaagagggaagactgctagagggtgaggatttggactctgcttttgatagtatttcagccttttcaagcaagaaagacaatcaagaggctgtctttgaagcagaagaaactattcttgacattcgagaagcaaaactagcatatagagctgaagtttttgagttgcagaggcagcttgcacggcagcaagcacaatttgatatgcttgcagggcaagcatcttcgcttattcaaggcagacgagcacgtgtatcagctatgtctgcagttagcgtgcaacttatatcactagatgagatactttcatccagaaacttggagatgaatgcagttcttggaagaattactgctacaacccaagaattggcacattatcattcaggagatgaggacagtatatacttggcatattcagacttccatccgtatgttattggggatttggcttgtacaaaggagctaaaccggtggttctcgaagcaatttgagaaggggccatttcgacttgttgccgaggagggaaaatcgaaatgttcctgggtgagtcttgatgacatcacaaatggcctgacaagaggagattctgaaaaatctcatcatcaccaacgtgtgactgagttgcaacgacttcgttcgatatttgctacaagtgaaagacaatggattgaagcacaagttgagaatgctaaacaacaggccatactccaaattttaaaatctcaagtatcctccgacgaggctcacatacatagggatatacattctcttaggagaaaaagttctgagcttgctggagaattctcaacacttactcaaaaggtgcagcctttcatatctgagaccataccatgcctttgttcggaacttgctcaacttcaaggcacatatattttgcaaggtgattacgatttaaaggtcatgcgccaggaatactatatcaacaggcagaaaactttcatcaaccacttggttaatcagcttgctagacaccaatttctgaagattgcttgccaacttgaaaggaagcacatagccagtgcccacgcattgcttagagtcatagaatctgagctacatagctacttatcggcagtcaacgcccgtctgggccattgcaattcattaattcaagctgcgtctgaggtacgtgaacaaggagcaattgatgatcgtgacactttcctccatgcagtgcgagatctactatgtattcactcaaattcccaagcagcagtaccaacatacatgtcagcacatgctttagttcagcagatatcggcacttcaatctgacttgctttctcttcagtctgaacttgaaactactcttccagctgacaggaaaagatgtatcaatgagctatgcactctgattcaaacagttgaacaacttctatttgcatcgtcaacaactgcagaaccagtattgacgccctggccactgatgcgagcacttgatgatatggaaaatgcaaatgctcaagttgaagttgctgttgaagaagtaaccaaggctcgcactcaaaagataaagatctttgaaaatcgcgcacatgaggtggggagggaaaggcaggtgtttgttgattttttcagcaaccacgagcgtctcaagaatcaagtcagagagctgacctcccgcgtgaaagctctccaggaatgaagccgttttctcccgggcggtcttaagaaaaatcagaagcaatggcccaaagctcacatctcctgtgtggcaattctatttcttgtagagagctccagtgcaaaattgggcatgtgtgtggtgccggtatgcaacatcgagtgatttagatggatatttaggacataggagtatatgccagtggccacctgaatggttggcgtcattgttgtatttatgcttctttgtatgttgtaaactatgctagagatcacgagcaatcttggactaggttgtgggggtggtgtgtaaaatacaattgagttagtttgtattaggtggtt

SEQ ID NO: 12196 - DNA, 788 bp, Triticum aestivum
  Clone ID: PAT_TA_12196
gaattcggcacgagaagaggcgacccccgcggccgggggaattgcatcctgcccaagcccctcccgtagggttcctctagggttcctagccgccgccactactgccggccctccgccgcggcgcgcccacccggctgaggccccgccgccccgcctccggtacaggagcccagcaacgcctcccgccgtcgagcaggcgctcccaccagcagcgcctccctcactggagcagccgctcccctccagttcataggcaggggagatgctgaaatttaggcgaatgtcaagaagctcaaatggaaggcaaaaaattcgtaaacgggtggtaaaaaaagaggtgtccagcattgtaagtgatcggcgtaaagctgtggtggagaacatcactcaagaacttgctacaaagttgtccccaagcattgtctctcttgcttcatttgatggagacaaaatgcattttagaagcacgggcatagttcttgcaaacagttcatctggtggtgcatgtgttctgacctcgtcagctttggttagcacatcagataaggaacgcatgcttacccctgcacttaagataaaattgcgccttcccaataacgaagttgttggtggctggataaaacgttatcgtttgccttgcagtatggttgttattgaaactagattctcccctgatcttcgtgcagcatgtctcaataagaccgtgcaagtcgagccccatagtcagttattagctgtaaagcattgtttccactcaggcaaattaatggatacacgtggggaactga

SEQ ID NO: 12197 - DNA, 636 bp, Triticum aestivum
  Clone ID: PAT_TA_12197
cgtccggagaagagtaatttcatatttgcatcccgctccgtttcatccccggtggggttcatcccatcgatttccttgcctcgtcccctctccgtctctctctcacatcttccttcttcccgacccccgaccgcatcaccgcgcgctgcgcgcccgctacatccggcggcgctctcgcgttggccgacgatgggagcgataacctcggcggagctcaacttcctcgtcttccgctacctacaggagtccggttttgttcatgctgcatttactttagggtatgaagcagggatacataaaggtgggatagatggaaatattgtccctcctggtgctcttatcactatcgtgcagaaaggcctccagtacatagaattagaagcaaatactgatgaaaatgatcaagaagttgagaaggattttgctcttctggaacctcttgaaatcatcacaaaagatgttgaagagttgcaacagattgtgaagaagaggaaaagggggaggcttcaaattgattgtgacaaggacaaggggaaagcgaaagagtgcatcgaggagcatgaacaccgtcttggtggtgaacggagccagagcgccatgacaaacaaaagacccatagatggaaagagatagaac

SEQ ID NO: 12198 - DNA, 978 bp, Triticum aestivum
  unsure (1)..(978): unsure at all n locations
  Clone ID: PAT_TA_12198
ccacgcgtccggcaagaactggcaactgatcttgattttacccgtcaaggtcgtgaaaatgctatgctggttcggcgactagagctgcttggtgaagttgcaaaactggcaagatcccttcatcttcctgaagatgtgagctacacatgtgaaaatgctgcatatttttggttattacatgtttatgcccgctgggaacaattcttggccgcctgtgtgccaaataaggagaatccctcttttgttaaagaccgttttccattttctgagttctttttggataccccacagcctgtgtttactggtgagtcctttgagaaagatatgcatgcagccaaaggatgtttcaaacatctttctacgatattccaagagctggaagagtgcagggcttttgaggcacgggggtcaacagctgagcgagcaaattatctaatgactaaacaagctaagattgttgccatgacttgtactcatgcagcattgaagagaagagactttcttcaattgggtttcaaatatgacaatttactgatggaagaaagtgcacagatattggagatagagacttttataccaactctcctgcaacggcaggaagatggctatgctcgtctcaaacgttgcattttaattggtgatcaccatcagttaccccctgtcgtgaagaacatggcttttcagaagtacagccacatggaccagagtctcttcacaaggtttgttcgccttggtgtcccttatattgaactcaatgctcagggtgcgtgccagacctagtattgctgcagctttataattggagatacagagaactgggagatctgccttatgtacatgaggaagctatattccataaagctaattctgggttctcttacgagtatcagctggctgatgttcctgattatcgggcagaggcgagtctgctccttctccttggttctaccagaatgaaggggaggctgagtatattnn

SEQ ID NO: 12199 - DNA, 324 bp, Triticum aestivum
  Clone ID: PAT_TA_12199
gcttaggaaatcgcgagtcaacttttgagaccttggttgatgcatttgtcgtcttggataataataaagatgggtctctgagtatggatgagattagtctggcaataactattagcataccaggggaacgctctgctggccgtacaaccattaaaagacttgagcgagatggattgggacacgagtgggatggctagccacctcgaccttctgtctgcatacaatcgccgtctctggataggcgataaccaggatgacgatgactgatcgatgtgcaagcgacacctcacaaatatggtcgaccagaaccttgatgcatagtgg

SEQ ID NO: 12200 - DNA, 753 bp, Triticum aestivum
  unsure (1)..(753): unsure at all n locations
  Clone ID: PAT_TA_12200
ttgttnttggtganaccgacggggngntaaaacaacccatggctgacttgagggccatcgaagttgacattcntgncnttgggacaatacttacgccaacnggaagacatttgagagtcagagaatatgtgactccttgagaagtttgatttcttgaaaggagtatggagatctttgggatttgtgtatgttgctagtggactctggtccggtcntcttaccgcgcaggggagatatttgtcccaaaattttgtccagacagaaaaaggcccagcttatatctgctgcatcctagtctgattctcgcccagtccattcntattccgtgccagagtttcgtccgggaagagttagttctgaggcctccagagcttagggcgatgttgatccttcaaagtttcgcgctcgtcagttttatgattgcttacacctgatattcaatttctctgggcactttggcgcgtgtcgaatatttttgtttgtatcacttgcttagacagatagttgtgtgcctgtatggaaatccggcagatgttgcatctgctgcttcgtctatgatttatagtgctatatatagcggtgtcctgattgtttctgaaacagtgtgttttggcatgtctgctggagttccttagagttgccattacgtgcctaaactgaaaaatttgttgcacttgcactggtgtgtgccagctccttgcaaaccgagtactcactctgttcacaaatataatatgttcttttttttttttt

SEQ ID NO: 12201 - DNA, 866 bp, Triticum aestivum
  unsure (1)..(866): unsure at all n locations
  Clone ID: PAT_TA_12201
ttttttttttttttttttttttttaggggggtgggctatttatagccacttggcaacctgacctgatttgtcctaaatgaccctgnggttacgaaggaactgacatgtgttccaacggtcagatttcaaactcacacggcaactttacttgggctacaagcaaagctgaattgtccgactctggacaagattcgctctcatagtcttcactcgaagacatagatttttggtttaggcatcacttcagtcattctgactggttctcttggaccccacttaacagtacgggtggttcctatgactcaacacaaaagaaaaagaactacgaaagatctaagtcttcgagctccataggcttcatgtcgtgtcttctcttgtcatagtcttcaacgtgaatatcttcatataccacctttgacttcaatgtcttcatacagttttaggggtcatctctggtaggaaaaccgaatcaatgagggacttctacctgtgttatccttcttagcacatccaagaaaccccctgcccgtgtgcatcccttcaaatgctacaaagcgttcggccggctcaccgtgttcacacaagacattcacatctgcgtcagtaccattaaaatttggatcgtgcatcgtagctggaagcttgatgatgccatcgcaggaggagattttcaggactgaatcctcattggtctcgtcgctccacgacaccatggcaccggggagcaacagaacggcggtcggcagtctgtttttacccacacggtggagcagtagcggccgtctcgccgttagacggcgtgagctcgcggccgtgacgccacatccccaaaatcaggccccacctgtcataatagtgcttaaaat

SEQ ID NO: 12202 - DNA, 778 bp, Triticum aestivum
  Clone ID: PAT_TA_12202
ttccacgcgtccgcttctcccctgcttctctcggccgaaacccccagcggagcgagcggcggcggcggcggcgatatgcagttcctccgaggcgtcggcggcgggggtggcggaggagcgggaggggcggggtcaatggcgtgggaggtgttgaggaggcatttctcgcggaagcgggcggtggacatacggcggatcaaccccaaggtgcccaaggacggaggacgaagtcattttcggtcggctactccagatcctcgccgaccacgggccgctcaccgtcggcaacacctggaaccacgccaaggatgctgcgatcgatggcctgaacagcaagacccacatgaagatcctgctcaagtggctgtgggggaggaggatcatcaagctctcctgcacgcaggccggcaacaccaagaagttcctctactccccgttcaccgccgacgacgccgaggcggccgaggagccatcgccagccgaggagcagccgaagaagaaagggtggaaagggaaacacccaaagtaccagaccaagaaacagcctgcggcagcagcttgaccctggtctgctgagcattctttcgggcattttcccgctgctgttggcttttctgttttacttagcacggaagagttcaccgccatatctgtttgacaacaaaacatatattttgtgatggaccatttgggtgggcacaaattacgctggcaggccgatttgttcggctctgtgttgtagactctgtctggtagaataatgatgacacgataatct

SEQ ID NO: 12203 - DNA, 884 bp, Triticum aestivum
  Clone ID: PAT_TA_12203
cgtccgcggacgcgtgggcttctctcggccgaaaccccagcgaagcgagcgggcggcggcggcggcgatatgcagttcctgcggggcgtcggcggcggcgggggaggaggggccaccttggggtcgacggcgtgggaggcgttcaggaggcatttctcgcggaagcgggcggtggacatccggcggatcaaccccaaggtgcccaaggaggaggccgtggccatctccggccgcctcctccagatcctcgccgaccacgggcccctcaccgtcggcagcacctggaaccacgccaaggatgctgcgatcgacggcctgaacagcaagacccacatgaagatcctgctcaagtggatgtgggggaggaggatcatcaagctctcctgcacgcaggccggcaacaccaagaagttcctctactcgccgttcaccgccgaagatacagaggcggctgaggagccaggccgaggagcagccgaagaggaaagggtggaaagggaaacacccaaagtaccagaccaagaaacagccggcaacagccggcttgaccctggtctgcctgctgtgagcatccctttcgggcattttcgcgctgctgctgttatttttttctgttttttacttagcacagaatagttttctcgtcatctgtttgacatcaaaggattttgtgatggaccatttgggttggcgcaaattacgcctggcaggccagttttgctaggctctgtgttgtagactcgctgtctggtagaataatatgatgacatgataatctagtactccctcccggtactcccaccagaaacaactatccgttcgtcctcagtaggcttctataggctctgtctctttcagtcttaaaacaaaaaaaaaaaaaaaaa

SEQ ID NO: 12204 - DNA, 726 bp, Triticum aestivum
  Clone ID: PAT_TA_12204
ttcgagcggccgcccgggctggtaccaaaagtaactgattcaaacgtagcgtcggctactttctcaacaatcttcgctacatggggcataattcacactcccagcaacctacaggcacgacacgatctggaaggagcgagccctccatagtttttgagccaacatctgccaccaattccctttctcgtgccgagaacatgggtgcgactcaaaaccaagtatcaccgactacagtactactgctgttccttgttcttgagctcagtctcgatggcccgtagtttctgattgttctcctcgttgaggagcgacagcctctctagcgaagatttcatcagcgacatctgggactccgaaacgtggcctcttccggccttcggcgcctgccatggcgccattcctgtgccggttgcaccaccccccaaagacggttgggtgaaccgtttcatcctcgtgctcagggcagcaatggaagtacgcagagcgtccagctccacgtccgcaaacctatcaagctgtgacttgaactccagctctgcctgtgacaatggtttcttgtttgcggcaggcagcatcttgaagctttctatgcgcttctccaacagatcatacaccttggaggcccgttcgacccgcctgtttatctcctcatctttggcttctatggatagaagtgattgcttcactgcttgtaggcgtttctgcttgtcttcaatctctgtcttc

SEQ ID NO: 12205 - DNA, 1471 bp, Triticum aestivum
  unsure (1)..(1471): unsure at all n locations
  Clone ID: PAT_TA_12205
cgtccgctaaacttggcgaggcgagtggattcggcatcaggatcacatacgccgatggccggcaacgagggtttcgccaccaagcgcgtgctggggcggtgcacggccgaagagatttcctccgatcccgcgcagcagaagtcagccatcgacgggttcggcacgccggagcgatgcgccaccttacctacggcggtaacccgcgagtatgctcttctgaaaaggaagtccaaggaggcagatcaggatcatgatgaagagcaggagcaggaaaaggagatcaatgagattctggccacggcaaaactccccagacgcgctgatgttgtgtctgtggccgccgccgagcctatggtggtcgaccccttcctggagcaggacatcgctaaggcaacggtttctgagcctcaggctgacgcagagattgaggagcctgtttctgagcctcaggctgaggcagagattaaggagcatgtttctgagcctcaggctgatgcggaggacgaggagccttatgctgagccggatgccgaggcagaccctcaggaccgtgctgactatgatggttattatgatgaggatgaggatgactatgagtctgaatatgatgatgattatgaccatgaggatcaggatgatcatgattatgactgggagtctgaatttgcgaagcaccggccagtggtcagggagacgttgttaaactttcccgaggccgccaatctggaacctcaagagctggacgccgcggtagagagggtcctcgagcagtccaagcccgagtacagggacgtggccgccccaggcaaggttcgtctgctgaaaaacgacataaggctgatcttggccgacaagtgggagccccccaacatccacatccttccgtccacaatatcccccgctgatatgatcaagagaagcgaggagctggacaaggagctgccgccggggaacgacaaggaggccgatgacaggtttggagagttgcaggccaaggtccgcaaggatctgatcgagaaggggtacgccgaggttgacgaagactactatgacaacagtggcaaattttgggaggagctgagggaagagtggaacaagattgacttcagccgcttccgcttcgccagcagcgaggacgggatcctccgttattccgaagaacttggggattttatatgatgctgctgagcctagccgttcaacatcatatctgtcccatctattcaagcttgtatgcagcaaagttggttggtttcttattagctcgttgtgcccatctgccttattcacctgtccatgtttattatgttgatactgtgatccatcttatgttgaacctatggtatgtgttcgcccggctctggtaaattcgacgcctataatataactactgtacggcccgctgcttgcnaaaaaaaaaaaaaaaaaaaaaaaaaaaaaaaaaaaaaaaaaaaaaaaaaaaaaaaaaaaa

SEQ ID NO: 12206 - DNA, 811 bp, Triticum aestivum
  Clone ID: PAT_TA_12206
attcggcacgaggcgaacccatgtcgtcgtccgacgccgccgccgccgccccgcccgacgacgacgccaagctcaattgaagtgcggtttgaggacttcctttgggcaaactcgattttctggactcgagcgctcaacatcccattgcctcattcatacgtttttccgggctcacttgatggacagcagatcagaactggggaagttttgggtgattctgatctcaccacccaacaggaaactgacactacaacaaagaatagtagctgcgacgagaattctgaatctcataatatggagtcaatatgggtcgagggcctcgtgccaggaatcgatttctgtaaccataatgtaaaggctctggcgtccggggaagttgattcggagggaaatttaacaggaattcctgcttcaatgtacctcatacttgcgcaagctggtaaaagctctgttgagactgggacagagatctacataaattatggcaacaaaggaaatgaggaactgctatacctatatggatttgtggttgacaacaatccagatgattatctcatggtaaccctcacattgattcattatccagtagaagctcttagacagcttcagtctgctgacattaaaatgaagctaattgagatgcagaaggctgaattgagatgtcttctacctacaagtttgcttgataggggatttttcggaaccagtaccagttctggtgaagatgatgataacaagaaaaagcatttttctagttaccagttggagtggtcaacgcaaagttccatcatatctccaaaaaaatgttttc

SEQ ID NO: 12207 - DNA, 621 bp, Triticum aestivum
  unsure (1)..(621): unsure at all n locations
  Clone ID: PAT_TA_12207
cgtccgctgagcaccaagccctcactgactgactcaagctacaagctcagcaagcccaaggagaaaaaaatatctgcatctgacggcaccaagccccgtccggccgtccattgctagctggagaggaaggttcgatggacaagacggtgtacaccgtgaaggtgggcgaggcgacgccggccgccggcggcaggccggcggccgggccggtctaccggagcatctacgccaaggacggcctcatgcggcttccgcaggaaatccattccccatgggacttcttcagtggggcagtcaagaagtatcccaagaacaagaatgctccgggccggcgccaaggtttccctgggcggcgctggcgtcgttgtacggcgttcgggcgaaccagtgtgaaacaaanttgttnccaaaaaggttnatcccaaaatttngncggcaancctatcaaaaagggcttccgggggtttaaancccgggctttgcaacaacccaaagggaatttgtttttntnnccacctgttattgccaaccctccgggcaaaaaatcctcnttgcccganttccgggnacnaangggngaaancncaaaggggccttttacattcnnccnaccatnaaacc

SEQ ID NO: 12208 - DNA, 724 bp, Triticum aestivum
  unsure (1)..(724): unsure at all n locations
  Clone ID: PAT_TA_12208
agtaatggcttctgggatgatttagcattttggcattcacgggtttccctatttggggcgcattcgggtacctcggcccccccccctacccgtgtaaaaaggaaatataaacgtttccagcttttcaagggacagcatggaaagtacttgccaaatacttacntagaggttccaggagtttacactataggataacttaaagcacagtaactaccaggtattaaggggtccaaaatatgaacaancctggagtttcacagatgataaaagaagctcaaatttggctaggttcttgattcttctgagcgtgcatttgttgattcattgcctgcaactgattcatcttcagttgtgcactgttgcccttcatcgacaacggcagtttgtacgcagtccgacaacagataaacaggaaaaccacactccgatcttttgtctgggatccaagttggtgtttcacgttcaaatggtctaacatctctgtagtagcgtggtaaattctttctgtagttgcgtgagaactcattgaattttttactccaggtcctgcctagacaagtcaggctgtagtatggggacatgtattcagcagcactaaccccaatatgacaacagacggcaatgacatgagagcaaggcttgtgaagcagctgcggcttgttgcatgaacaggtagcagtttttcgagctgtggatcctttagacttatccatgttgtgggtat

SEQ ID NO: 12209 - DNA, 1506 bp, Triticum aestivum
  Clone ID: PAT_TA_12209
cccgcgctcgcccccacttcccctatcccttctttgctcgtggaaaaagctcgacctgctaatggcggcggcggcggacttcacgcagagcaagcaggccatgtcgtacgcgctctgcaagcacctgaacctcgatccgaatagcatatccagtacacttatcaaggagaatgatattgcgagcctattctcacatatcgtgacctcaccgcaggatgaggtcaagaagtgggttgagttctccagcaattttgttctaagtgatggagaacagcatgcattacttggtaatttgaatcaacatttgtcccagatgtcggtactattagctggtttcaaaccatcagcggcggacattattgtgtttgcaaccgtgcatgttttcatgtgtcatcttagtgacagtgagttgcagaaatatccaaatatattgcggtggatggactacattcagaatgttgttgattttggtatgacactgcaaaagataaacttgacgaaatctatcttcaacccacctgcacctgcaccttctcacccaaagaaagctgataaaggagatggtgatccaaattccaagaaagctgtttcaggacagaaggttgcggataagtcagatgtagctgctgactccaaaaaggctgcaggggagaataaggttcctggggataagggcaaatcctactcctaccaaaaacaacaaaccttctggggaaaaaaaccaaagtcaaagagaagactgcaggcaaagcggaggcagctgcagaggaagctccacagagaagtgcagagaagggttctgagagtgttattagcatgcagattcaggtcggcggagttagcaaagcatgatggcaacatccatcagctggtcttctggtggaggaggtagttttgggaggtggcaataatgtgcgtcaagttgttagtggtcttgcgtagttcttcagcccagatgaacttgttaatcgccatgttgtcttgatcacgaatgtgaagcctgggaagctgcgtgatgtaatgtctgctggattggtcttgtgtgcttcaaataaagatcatacagtcgtggagcctttgattcctccggaaggagccaagcttggagaacgcatttcttttgctgggtttgatgggaagccggaagatgttctaaacccaaagaagaaacagttggacaagataacaccgcatctccgtaccgacgagaatggaattgcaacgttccgaggggtaccattcactacatcagccggtccgtgtagatcctcagttccgaatgcggatgttaagtgagcaactcgttaaacatgctgatttcaaacattgatgtgctaagacacatgcagatgtaccattttgtcttaatgcccatattaaatgttaccatatgttaacagagttgtcagttcttgacttatagtatccgaaaacaaattttgttttgtctatgcgcaaaaaggaaaaaatgaccctgatgaaaaaaaaaaaaaaaaaaggccccta

SEQ ID NO: 12210 - DNA, 1606 bp, Triticum aestivum
  Clone ID: PAT_TA_12210
acaggggaaagaaacaaaaatatggccttgccttgctcctccgggcgggccgggggtttggctccggcgccgccaggtgcttcgctttcgctctcgccctggcccgattctttgcctgcggccgtcgccgtcgtccgtcggctccaagaaagaaggcaggtcaagtcaactgctatctcaggcacacttttgagctctcaatgttactcttagcccgttgcctcttcccgcgacgccggtctaggtcgatggcaaactgagggaggctgttagtctcctgccgccgcctctatgtcatgggctccgcgcgacgcccagcaaaacgcgagcaaccaccatgtgtcgaccgacagcaccgtcaggcacgacggcctagctctttgcacggtgtgctactaaggggtagccgccatcgcagcggtagctactcttggcctccttgtctttatccgccgctatatcgtgggtgcgtttatcatggtgtaactgaattatattcacatgtattccgttggcccgagggatcctgcaacatgtctcgatgttctactacccgtttgagatgcagatagattcgctgctagtttctcagcattgtggatcccacgcgtccgcgatgtcgtgaacctcggatgctcttgcaagaatgagctcgccctcgcgcactacgcgtgcgcgctcaagtggttcatcagccacgggtccaccgtgtgcgagatttgcggaaatgtcgctacaaacgtgaggcccgaggatttcaacatggtgctcgcctccttgaaggactacgaagctctgagggaaaggacgtctaccggggatctctcctacttgcactacagggcggacgcgttcgtcgatccggtcgcccttgccgcagtacggagacagcggctttgtgagatatcatcatggttcaaccctcacaatacacatttcgtgttttctcagaggcacaatgaagaagtgccagttagcccaagtaataattctgtagactatagtgttacggctgcaagggcagcacatgcgaggcggaagtttgggagtagtggagcattttgttgctatcgctctgggttttgttcttcttgcatggtttgttgctccacatgttggcaagagagcggctgcaatcattcttcatatgcttctgggaggcctctgctcactgactataataatctcactaagatttgtcttcccgaggatccagtttgggtcgatacgatgctgggcgatcctgttcgtgtcctggttcctcgtgtttggagtgtgggcctcgcgaacccgcaccacccgccgcgcgtcatgatgattacatcgagtgtgccctcagtcaggcgttatgaggatttaggaccgcgtcgccaagggtagcgtccacgagagcgttaggtaccgcaccccctgtctatattcgccgcgagctatctatacggacgtactctattttttttagctggagtatgtgagatgtacaacatgtttgggcaagaaaacaaggggagttatgttactgagtgttgggtttcagacatagctggagtagtacggtcggtcagtgttgcaaaacaatacagtaatgtctatctttagcattttt

SEQ ID NO: 12211 - DNA, 1032 bp, Triticum aestivum
  Clone ID: PAT_TA_12211
ggagagaatcagaggagcagcagccaatagccgcccggggagacagccagagccagagccagagaggaaggctggagttcgagagatcggagggaggaggatgatggagcggcagggcgaggcgtggtgctcgtgctcgccgaggcagtgcaggatttgccacgaggaggaaggggacgacggctgcgcaaccgccatggagtctccctgcggatgctctggctccctcaagtatgctcacagggggtgcgtgcagagatggtgcgacgagaaggggagcaccgtctgcgagatttgcctccagaattacgagcctggatacaccgctgctcccaagaaaactcaagttgctcatgtcgcagtcaccatcagagggagcctggaggtcccaaggcaggattatgaggcaccggaggatgccccgttgatcgggctcgacgcggcggcgggcgacccggcctacgccgagtgcgcgagcgccgccggcagaagtgctgcatggtgccggtcggtgacggtgacgttcactgttgtgttgctgctgaggcatctcatcgccctggtgaccgtcgtcgccgcgaatcagtacgccttcagcctgctgacgatatacttgctgagggcgagtgggatcttgctgccgttctacgtcctcatgcggctcatctccgcggtgcagcacggccagatgcagtaccggctgcagatgctccaggtgatcaaagaaggaacgcatcaagaatgcaacacggggtgcccggtcagagacaacagcagcatgtgattcttgttgtgtgaggagtggatgttgtccgctagaatagtcttaaatgtattattattgatgttgatcagggagcaattaggaaaaaagaaagagaaagaaaaattgttcataagctttccggtgtgtatgtgcacatatatttcattcagtgatgaatgaatcaacaactccaaatccagcttttcttttatcaagactgtgcaaccctcagctcttgataatctcaaaatatacaggctgcgaag

SEQ ID NO: 12212 - DNA, 1823 bp, Triticum aestivum
  Clone ID: PAT_TA_12212
ccgcgcgggcctcgcccccgcctgccgggcccctcccccccatccgcgccgcccccgggtccgcgcgcgtggcccgcgcccgcgccctcgcggccgcgcgccgcccccgcgtcgcccccggcgccggcgccggccgcctcgccggcggcgcgggcgccctggcgtcggcgccgtccgcgaggcgccgcaccgccgcccccggcggcggctcgtgcggcgtccccatcggggccctgggcggcgcgccgccgccgccctggccgctgcacggcgtgtgcccccggcccggcccggcccgggccccgcctgttctcgtccgcgcccacgcgctcgggttcctggccttcgtccgcggcaagaacttcctcatcaccggcgggactggcttcctagcaaaagttctgatcgagaaaatcttgaggacgaaccctgacgtgggcaagatatacgtgctgatcaaggccaaggacagcgagacggcattgcagagactgcaaaacgaggtggtggacacggagctgttcaagcgcctgcaggagatccacggcaaagactaccaagatttcatagcgacaaagcttgtccccgtggttggcgacgtccgggaggccaacatcggcattgcccccgagctggccgatgagatcgccgagcgggtggacatcatcgtcaactccgccgccaacaccaccttcgacgagaggtatgatgtggccatggacatcaacaccgtggggccgttccggataatgagtttcgcgcatcggtttcgaaggctcaagctcttcctgcaagtgtcgacagcgtatgtgaacgggcagaggcagggtgtgttggtggagaagccgtttcggttgggagacaccatagggaaagggtcggctggatcctcggattcttcggagcagcacaagaacgccgtgctggacatcgaggccgagatcaagctggccttctggtcgagaaggcgcgccgatgatgactcggcttcgttctctcaggagatgaaggatctagggatagagagagcgaagctccatgggtggcaggacacgtacgtgttcaccaaggccatgggggagatggtgatcaacagcatgcgaggggagatccccgtggtcaccatcaggccgagcgtgatcgagagcacctggagagaccccttcccgggctggatggaagggaacaggatgatggaccctgtcgtcctctactacggcaaagggcagctcagcgggttcctcgccgatccggccggcgttcttgacgtggttccggcggacatggtggtgaacgcgacgctggcgacgatggcgaagcacgggcgggcggcggaggggggaatgcacgtgtaccacgtggcgtcgtcgacggtgaacccgctggtgttcggcgacctgagccggttcctgttccagcacttcacgaggagcccctacagcgatgcggcggggcagcccatcgccgtgccgcccatgcgcctcttcgacaccatggagcagttcgccagctacgtcgagacggacgcgctgctccggagcgccagggccggcatccccgccgacgagcgcctctcgcagcgcctccaggagctctgcgccaagtccgtcgagcagaccatccacctcggcagcatctaccagccctacactttctacaccggcaggttcgacaatggcaacacggaggggctcatggcggagatgtcggcagaggagaaggcagcgttccacttcaacgtgaggagcatcgactggacggactacatcaccaacgtccacatcccagggctcaagaagcacgtcatgaaagggaggggcatc

SEQ ID NO: 12213 - DNA, 759 bp, Triticum aestivum
  unsure (1)..(759): unsure at all n locations
  Clone ID: PAT_TA_12213
ggncncnttttcccccggggaaactttttccccccctggggggnncccctggatatcgtgtggccgtacnctncccggatnttggattccgtgcttgtttgcttttnccgcccagtggtccggacngcaccttntaagcggctccgttggtnttntgcaaggaccggttgttaacttgctcggattnttcagccngtcttatcaanggcaaggggtttnnatcccacttgggtcaaattntgaaagtgtcctgtaaagggtaaantagcttacctcgtcggcttgacncggcgagatgatccgcaatcttcggtagcggacgcgggagcntcgtcgccctttgaacagcaccttccaggcatcttcgtacgtagtgtcgaagaacttgctcaaggtttggtgatgtgccagatcaaactcccacaatttgaaggcccgttgttggcatgggacgatccggcggatgagcatgacctggactacgttgacgagcttgatattcttgttcactagcttttggacgcaggcttgaagtctggtcagctcttccaaatctccccacattaggcccgtctctttccaggaggtgagccgtgtggggaaaccagataggaattcgggggccgccgcccatttggggtcacgcggctcggtgatgtagaaccaccccgactgccacccctttattgtctccacaaaggagcccttgagccataggacgttggccatccggcccaccatggcacctccgcactccgc

SEQ ID NO: 12214 - DNA, 820 bp, Triticum aestivum
  Clone ID: PAT_TA_12214
cgcttgctggccatttatctcgagaatgaaaaaaacaattcaggacctgaaaaggaaaatttgactgttcctacttctacacaggcttctcctgctacctctcctgccatgttaccaaataccaaagaagcatccaaatgtgagcaagataaccacaaaagaggcccatatagtgacagagatgatgatgatgcgtccgcaccattaaagcataaaaaagtgtctagaaaacaagcagatagaaaattgaaaagtgactctggtaccagaacgagtcttcctccgatttctagtaacaatggcaaaggagactgctttaattcatgttctggacaagggatttctcataatgtgaaacaaactgctgatggtattgcaacgtgctcgacagccccaaagcttaatggaaatcatgtttcagttgctcctgtgaatgacacaatttctttcgtagcaagtcatcctggtcctaatggtgtggcatcaaagcctcccagccatatgaaagctggtacaaatggcatagataagggcagtggcttgtctaatgagaacttggcaaatgtaaaatctccttttaaactttttctgatggatgaagatggaattgatctatttgttgatcttaattccactccaggagattgggttggcagcttcaagggtggagtgaacctccctccaagcacacataactctgaaactgatatgttcacccattctattagcagccttcggaatagaatgatcagaccacaatggtgccatcagataatattattatagacctacaagataagggacctgagagcattgctgc

SEQ ID NO: 12215 - DNA, 870 bp, Triticum aestivum
  unsure (1)..(870): unsure at all n locations
  Clone ID: PAT_TA_12215
actttnagataacaatgatgtacacaattcagctttggctatattaggttaccaaaaagaagttgtgctcacaggaactaaatctacatgttgtaccaaagcaatgatatccagaagcctgcgtgtctgaaaaccactcatagctgaaacatagtcagtttcacgcatcttccattttccatgtgcggaacttcttccatattgtgcaaggccccaggcagatcgaacattgaattaaccgaagaaatacaactgcaactaacattggacgctcagtgccgggggtagatatcccaacctgagtcaggttctttccgtttcgataccaacccagtaccagagctgccaccttgtgatgtacttctcatacgttcatcaagaaagacggtatgaccttggaatggcacaggccaatagccgccagcttcccttcgtgcgccttcagatgagagagcatagttgaaatccatgcttgcattcatgtagccaaattcactaggcacaggttgaattgttctgctggtgaaagatggatgagaaatgccaacacctaggcccggcaatggaggcaccactgctgcacccctagcatcaaccatgtaaggagcacctccaggtgcatagagaggaggaggcaaagacatggcagcaggttgagaaggatagccgaaaacactgaaatcaggaggcgtgtgtgcatatgactgcgttgacctcacgggcagactagattccatacttggccccagaaagttatactggtttgggctgcggtgctctttctgtccaagtgtgactctcttgcccataatcatgacttcagaatggtctgatgtattgttcgtggaagtcttgacataggactccccc

SEQ ID NO: 12216 - DNA, 699 bp, Triticum aestivum
  unsure (1)..(699): unsure at all n locations
  Clone ID: PAT_TA_12216
acttttngtgctgcaacatctgtcgtccttgacagcatgcttcttaagaaaatggaaagagtcttacaaaatgttaggagagaagagatatttagccaaacaagaagggcatatacagaagctccatcaggtaggagaccaccactaacactgcaacctataaacatgccagttaggaatagcaggattggatgcaagttcctgtcaaaatcaaaacgaaatccacggattaatgctcctgtataatattaattacccaatggggataagcacaagcatcggacgatgtgaaaatgcattaccaacaacctagaattggccatcattcgtcataatgatccttcgaaaaaatgtgtgagagcaaacacatcatcatcagtatagctcagtagaattagaagctagtaagatcatgtacacccaaattcaaattcagggtaacatcaagtatatatactctgccattttctcgccagcacaggattgcctcgtatccaagtcccttgcgtacatcttctgctctgagatttctttgctgaatttcaatcctcattgcctaataaattcacagaacataaagctggtgtcatcacttcaaatcttgtcttacgaatagcataaaactaaattccgctctgatttgaagctcgtaagtttgtgcatatttccattaacaaattcatagagaattagtattgc

SEQ ID NO: 12217 - DNA, 696 bp, Triticum aestivum
  Clone ID: PAT_TA_12217
ttttttttcgcctgtattgtccccgttggggccttgtgggccctttgcggtctctctccaaaccgcacaactgcacttgtttcttctgactctgcgtggttttggcacatttctagctattagacagaatgggtgaacaggtttcagtcaacacaacatggtatccaaagtaaataaatccacttttaccggacactagccaaaagatctagtgagccagaaatacatgatcatccacaaagaaaggtcaaataccgctctttgcaacaactgaatattttaatgtcagctccatgaacgaccacctccatgccccctgtatctatcacgatgacccaaagaaggaggtggtgcaccacggcccatattagctaattcagggctgaccttttgcccagcttcaactaaaatgctaataagatccttggcaaatctggcgttagcagccgtgaaaaagctgtaggctgtccctgttgctccagctctgccagttcgaccaatgcgatggacataatcctccagagaccccggaaagtcatagttaatgacatacttgacatccttaacatctaagcctcgagcagcaacgtcagtagctgtcataatagggcttttccccgacttgaatccagaaagaacccaatctctttcagcttggctcttgtcaccatggatagacagagcaggccaaccatc

SEQ ID NO: 12218 - DNA, 746 bp, Triticum aestivum
  unsure (1)..(746): unsure at all n locations
  Clone ID: PAT_TA_12218
ttttttttttttagtttantgtaccngtacaatgnttatctttcgggtacacacgtgacctttcccccccctcagggtgtcctgcctcggacgggcattaaatataaaatagtcccagtaaataaatattaaagtttcagttcacacaaagtatagcacacagaatacttgtcaaatggagatacagcaaacaaaacaagattcaaacgggcttattttgtcggccataggtcaaaggcccaatatatagataaatggaggctgaagcagccagcccatggatcgagcaaacaagtccgataggtagcttagcacgcgccacggcggaacccgacggcgctgccgccgacgttgaagagcacctcgatcgtacgctgctgaacgtagccgatgatcccggtggatccgtcgccgccgccagtggatgcgaaggcgaggcagctgttgaacagcacccctgacgagtcaagctccactgcagcaccgccgttgctccggctgtcgaacaccagcgagatcttgggcagccttagggtgcggatgccggtgaagtcgtagcaggtgtctagctggcccttgggcggggcgacgcggtacgcgcccatctgggccctgaaggcgtcgcgcagcgcgcggtacgccgtcggctggaggcgcgtgatgacggtgcgggagtccatcaccctcccgccggcaaagaccatcggcggaacagcgacccgttgncccgcgacggtgatagcctg

SEQ ID NO: 12219 - DNA, 1321 bp, Triticum aestivum
  Clone ID: PAT_TA_12219
gaactcaatatataaacagacttcactcggtagaaaagtgcacagaactcaatatatgacgaggcagtcgaggatgcgaaccccctgtctattatatacagtcacctgtgatttcgatgcagaaaaatgtcgaaacacgggacgcactttgctctaccctactctcaagcatatatagcagtgaaaaaggaagtagcagtagcacaagattggcacgcgaaatacgccgtacacttcacaggtagcagtcgaggtaggcgtgacggtgcctcctgcggaactcgagcaggctgccgtacgtacggtcggcgacgcccacgaacagcgcctccgcgccgtcgtcggggctgaaggacacgccggcgatctccccgaacagatcgatctcctgcgcgcgggcgtacccggccgccacgtcgtagacgcggacgaagtccgccggctccgccgcggccaggaagcggccgtccggcgagaacctgagccccctgacggcgccgatcctcccctccagcaccgcgaacgcctcggacgggttgcgcacgtcccacagccggcacgtcctgtcctggttgcccgtggccagcacgcgcccgtccgggtgccacgccgacgcgaacgagtagtccgcgtggccgcgcaggctcgcgatttccttgccggacccggaatcggcgatgaggcagtcggaactgtcgccgaccaccgcgagcagcttcccgtcggggctgacggacatgttgttgacggaccacgcaaaggggaactgggtgagcaggctgtacttctccgtgtcaaaagttctaacaacgcagtcgttgttggcagccaccacccgggtggagccgttaggtgattcgtagatctcgacggcgttggtgatggacttcttgttgccggccaggttcgtacagaacgccactccaggttgatcgacatacttgcagatcaactccccatggaaaccaccagccgccaggaggttgtcttttaccgtcatggtgctgatctgcacccttgacaagggccgacctccccgcatatcctgatttgggcctgccacattgggcacttcttttcctctccggagtagggatgaccaatgcatcacagaatagttctgtgtcacgtacacatcatgcttggacgtagcccacaggaggttcctcagccatcttctatggcgattcacgataatgccgcattctggggatccttcgtccacctgcttgtagacctgatattaaaggaccgaatattgcagctgcccttattatcacagtttaattgctgacaccaaaactacagatccatctaggac

SEQ ID NO: 12220 - DNA, 655 bp, Triticum aestivum
  Clone ID: PAT_TA_12220
tctcaccccaaaagtcctatcagaaacttctcggcatttggatgcacctgagcagaaccaaatgagggcagatgttccagtggatgtaacgggagcgtccgcggacgcgtggggggtggaggaagcttctgatatttctaccaatgttcagaatgatgatccattgagccgtttccttcctccgcccgtgactacaaaatgttctacagcattacagcaaagaattaacaagttccttggatacaaaaggtctggaaagagctttaatgctgaagtgcgtaacagaaaggactacagaaatcctgactttttgcagcatgctgtgcggtaccaagaaattgatcagatagggacctgcttcagtaaagatgttttcaatccatatgggtacgataaaagtgactactacgatgagatagaagctgatatgaagcgtgaacttgagaggaaggaacaggagaagaaaagaaatccaagaattgattttactagctctggagtacaacctccaatcaatccatcaatagcgaagatttcagccgccatatcagcagcagctgtagctggtgtatcggttccggcatcggcagatactgtacagaaagaggctaggccaaacaaaaagtcaaaatgggataaggttgatggtgatact

SEQ ID NO: 12221 - DNA, 813 bp, Triticum aestivum
  Clone ID: PAT_TA_12221
ttttttttttttttttttttctaaagaaatgtaattacatataaggcctatacaacatctaatcaattgagaaacacctataaagctattcactgcatgaagagcatgtcaaagaaatagagtttaaattatcacacccccgtagatctaaacatcactatttctctactgctatccgtgagcacctaaacaatctctcgattagatacatttacatcagtgagcattttctttgattctaacattagccgaggcacatactgatcatattttttcagccgttcagtaaaatcagagatgggacacgatggagctcagctgacctaggcaagtgctcgcagacagctgttagtgggggaagcggaacccggcgagccgtgaacctggagctcttcttccaccatagtgacctgaacagaatatatggatccaagaaatccccagatgtgggcacacctttagagcttagaagaaaaaggaaccatggatgtaattgaacataagcacagactgacctggtcgccggagctgagttccgaagggataatcgaagaggcgcaacagaggtctgatccaaggcggcgccgccgcgccgagaagacgatgtattcgcatgagcaaaggaaaatgtcggagagagaacgtgtaaatccttctaggtttgacctatgtatcagacaggaagatgaccgaaatagccttgcccaacggccttctcaaaggtaggctcaatggtggagcgccgctgtgacttttgggccggcccatgaagttctcttccatctttttcctgtttctcatttactttctttg

SEQ ID NO: 12222 - DNA, 700 bp, Triticum aestivum
  Clone ID: PAT_TA_12222
ctttcttattgattttttgcaatgcacccatgctgacagcactctaactctagctcacgtcacttacatgcctagtaaacggaagaaattgaacaagataaaccttacatgtatcttgtctacagcctacgcttgatcttctgcacaaccaggagggcatcctcccaaggtaagttcagtgaccgacataatcttagcattgtgttcgtattggccatcctgaacttcacgccatcaaatctgagggcttcaatgtgcttaccaacattgattaaaacagatggggtgttgctacttcagtccgattcaccactatgaaataacgtggacagtagacaatggtttgcatcagtaacatccgccgctggccttggcaaagcagcagcatcatcggtggatgcacacggtgactcagcactcatggtgtccatgatcacttttccgagaacaaatcggacctcggcagtaactccgtcttccagcaacttatagtcaatcccatgcatccctcttctctcgtcatatgaagttaggtcagaatcaaggccgttaaatatccccaacactctgcccttctccctgactgatacaaaaacaagtcctgaaaattgtgatgcccccggatatctgaccactgattgtttgagagtatttaaacatgtcaacgtatcaaccgaagatttcactagtgacgctagat

SEQ ID NO: 12223 - DNA, 988 bp, Triticum aestivum
  unsure (1)..(988): unsure at all n locations
  Clone ID: PAT_TA_12223
ncaacgcaaccgagcggccgagcctgatgcggccgtcgaccccgtccgctggacctaagccgtcccctccccgcccgaccaccgcgccgcaccaccgtcccgcctcgccgcactgtccaccagccaccgctttccctccggcctctatcgctccgccgcctgctgctgcgccgtcgaacccccgccccacgatcctcaaagccctacccgtcccccctaggctctgccgctgctgttcctgacgtcccctgcggcggtgacatgactcggtcccacggcgagggcagggaggaggaccggcccgtggcttgcgagacggggccgcggaagaagggcaggaagaggaagcgtgggagcgccaaggctcagccgcctccacccgccccatcccaggagcaccgcgccaccaccagcgacgacgataggtcggctcaggtcagggctatggtgggcgagcaggtgcggcatatgcttgccgtccgcgacgctaggaagaaagaaactgccgagctacttaaaagactctctggggaatccgacctttctgtggaggatacgtttggtgactgcaatgatggcagccttgagagtctccaggctcgtaaagttgcattattggtctcaaagtcagtcctctgccggtcttcttgtgccggtgggatgtggttccgtgtatgttcgcgatgtgtgttgcatggaacagacaatactggtgcaaatatgattttaacctcagcaacacttgttagatctctgaatggagacagtaatgtgatatctgatgtgacggtcaaggttcttctacctgatgggcatataacagatggccacatctttcttgtggattttcactataatgtagctgtcgtcaaaattgcagcttatttagcgctcttagaagaaggcactaccaacaatggcgccgtgttagcacttggacgtgcatatgaaggtggtcttctcatgtgttcacggggtcaagttgtaa

SEQ ID NO: 12224 - DNA, 749 bp, Triticum aestivum
  Clone ID: PAT_TA_12224
ttttttttttttgatgaatttttttacttgatgattgaacagaggatcagctcctcatttcaaacaaattcttcccaagatttctctttcgaattcaagataaaccactagacaaaatatactgctgcctggctttgtgactgaggacacatgaacaaaattggaagggggcacaacacacacccattccatccccattcacaaaggtctgaaccttcggccatcttccctacatactactccctccgtccgaaaatacttgtcatcaaaatagacaaaaaggaatgcatctagaactaaaatacatctaaatacatccacttttatttattttcgtgacatgtattcccggacggagggagtactactataactactaccaagggcctgaagctacactactactgctgctactatacaaaaccctggagtactcccatggcagcaaaggagctccatcacttgaagagcatcttgagctcctcgatgcgcgagctgcggacctcctcgtccgtcagcgccccggcgatcatccgctgcttgcgcgcctgcacctgctgcatccgctcctccaccgtgtccctgacgatgaaccgcctcacctggaccgccctcttctgcccgatgcggtggatccgcatgatggcctgctcctccaccgcaggattccaccatggatccatgaggaagacattggaggccgcagtcaagttcaggccaacacctccagcttttgagtgacatcagca

SEQ ID NO: 12225 - DNA, 808 bp, Triticum aestivum
  unsure (1)..(808): unsure at all n locations
  Clone ID: PAT_TA_12225
ctaactggaacgggtcttagtgtcttacaagttgaaatcgctcaggcaaaccatgtatgtcccaactaagcaaagacaaggacaaaaccaaaagataactctatgcttataagacctcacaactctcagtgaatgaagcttcagattcatggaagacgatcacgagctcaggacgccttcactgagactcagttgccgctggtacttctggcatcacacccggagtctcctccttgacctcaggctccaccttctgcctgccaaatgcctgccacccagggctttatgaacttcatagccctttagcatacgaccccaggaagaatcctgaacaaaatctccgaagcacgcaactgaggcatagtcaagcaattcccattccaacactttgccgtgctcattatggtttcgcaaaatgagtaaacaatcaaagtgctcttctaggtatgtatcgaagccacgcttgttcacttgataagtaaccagaggttcaaaaatgcagtaactttttgcagcaggccagttggggcaatcgatgctggccaatgttgaccggaaagccttctgctgagtaccattgagccggaaataaatcttcaaaagattatccaaagcagcagctcttttctagtggggacataaaaaccaaggggcgccgcttgtacggtagcagttctggatgatttctaaatttgctcttntcgataaatgtaagaaagccttcaaagtatggtaaattcttcccctttggaaggaatgtacctgtcaacattaatacgaggacatggatatccttgtcaaaatcatc

SEQ ID NO: 12226 - DNA, 1490 bp, Triticum aestivum
  Clone ID: PAT_TA_12226
gagctttactctgaggtagaagtgaaggttgcagatccagttgtgacattttgtgaaacagttgttgatacttcctctatgaaatgtttcgtccgcccacgcgtcaacacacgcgaaagtaccatgttagctgaaccactagagaagggcttggcagaagatatagagaatggccttgtcagccttgactcaaggcagaaagaagtcactgacttctttcgccaacgctaccagtgggatgtgcttgcagcaaggtcaatatgggcttttggacctgacaagcagggtcctaacattctactggatgactctctttcggttgaggtggataagaacttgctgaatgcagtcaaagattcaattgttcaagggtttcagtggggtgctagagaaggccccttgtgtgatgaaccaattaggaatgtgaagttcaagatcctaaatgcaaatatcgcaccagaaccattgcaccgtggtggcggccaaataatccccaccgctcggcgggttgtctactcagcatttctaatggctaatcctcgactaatggagcctgtttattatattgagatccaaactccaattgactgtgtgtctgctatatatacggtcctgtcgcggcgacgtggccatgtgacagccgatgtacccaagccaggcactccagtatatgttgtcaaggcatttttacctgtcatagagtcttttgggtttgagacagatctcagataccatacacagggacaagcattttgtgtgtcagtgtttgaccactgggctattgttcctggcgatcctcttgacaagggcattgttctccggcctttggaaccagcacctatccaacaccttgcccgtgagttcatggtaaagaccaggcgaaggaagggcatgagcgaggatgttagcatcaacaagttctttgacgaggccatgatgaacgagctggcgcaacagactgcagatatccacctgatgatgtagtttgatgatggaagtccattgtcctggtgcgctgggaacatatcaagtactttcatggggctatcatgacgcgatcttcaaggagacgcaatttgccgcattttgatggttgggtattattatgattcgtaacagatcattgtagactgagtaccatctgtagtcatgtatgtactatcgctctaacacctacgtcgtctaaccagttagtgtaaccatcgacagagagctgagacttgtggttgatttttgataggcgatggcatttccagggacaataatgcctttacttgtttgatcctttcttcacaaattacaaccattgtagcgccgagcacctttccaagtttctggaggatagttctgtttcttgccatgcctatttgatctgtgtttttatcaggattgattactggacgtaatgtgccttcctggtaaactcctgtgaggtggggtatgtctattggtatggtcatgctgtgtcagacttaaatcttttatctata

SEQ ID NO: 12227 - DNA, 977 bp, Triticum aestivum
  Clone ID: PAT_TA_12227
ggcagcagcatcctctgacctgccaaactgcccccagcaccggcagcggagccttggccatttcctcccttccaagcaccgccaatcttgtccgacctccctccgcgtccgccgcggtgccaaacccaagaaaggcacagcatcgccaatctgtgcagcgggaagctcggggagacagaggattagactgactgacgcgacaatgggggcttcctcttgctcctccgtgcggctgctgctgccgctgctctgcctgctgggcttctgcttcgcggcgagccaccagaagtcggactcgtgcgacggggacctccaggtggcgcgcctcgtgcccttcgacaccgacgccttccactgcatcacgctctggaaggacgaggacttcatcctcaggtacaagaacacggggacgagccagtggagcttcgtgctgtcggcgccggagaagagatcctacgtggcggtggggttctcgggcaaggggggcatggtgggcagcagcgccatggtcggctggtcgtcgggcggcaagggcgccgccaagcagtactacctgcagggcaggagcccggaggccgtgacgccggacgacggccggctcaccctggtcaggaaccggaccgtcgccgtgtccaagtccggtcggctctacctggccttcgagctcagcaccgaccgcccgcagccgtacctgatctactccgtgggctacgagggcagcctcccttcctcctccgactacacgatccagatgcaccgcgacatgggctcccgctccttcaagttcgcctccgcgtcgccgtccagcgccggcggcgagtcgggcgaggaggggttcccggcgaagaggtggcacgggctgctgtccatgatggggtggggcgtgctgctgccgatgggcatgatggtggcgcgctacttcccgcgggaggacccctactggttctacggccacataggcgtgcaggggctgggct

SEQ ID NO: 12228 - DNA, 1698 bp, Triticum aestivum
  Clone ID: PAT_TA_12228
acacgctgacctcgcgaccttccgcaagcgggagggcggggcgagccttgcacagtgccgcggttctggatccgggagcaccagaacgccctgcgcgtccacaccgtccccagcagcaccgaccggagccttggccgtttccggccctccggacacgagcaaccacgtccgcgcccgctccgcgtgcgtcgcggtcgcgaccatgggagacgccctctacgggtggcggccggggctccggggcggggagcttggggagccgcttatactgactctcccggcaaagggggcttcgtcgtcctcctccgtgcgattgctgctgcggctccactgccgcccggccttctgtgtcgcagcgccccccccagcgactccgactgcggaatacgcggactgcggaggagaacgcaccccgttgcggcatcggcaccggggcccgtccaatgaggtcactgtgctgggcaagggggaagggtcccaacctcaacgtcgggcgcggggccaaggtgctggcgattggcagcttcgtcctcggcgccaccatcgccaggggggtgggcgccgacatcgtctcctacggcgtcggcatcgccgtctggatcatggcggtcgccgccttcgagttcacccgggactgcgacgacgacgactgcagactcatccatcgcccgtcatccttcaccgaggcggcgattcgcatagagagaattaatttggtagccgccactaccaaacggcatagtttgtggtagctcacttcgcagtttggggcggatggcgaatttgaggaggcctcttcaacaaaatattcttctctgcagggctaggatacggaaccagcggtgacggaggtcgcgaagcctaattgaaccggtcgcacgggctgctgtccgtgatgggctggggcgtgctgctgccgatgggcatgatggtggcgcgctacttccggcggcaggacccgtactggttctacggccacatcgccgtccaggggctgggcttcctcatcggcatcgcggcggtcgtcctcggcttccggctcaacggggacgggctcaagaacatcgtcgtgcacaacgtcatcggcctctccatcctgtccatggcatgcctccaggtgacggcggtgctggcgcggccggacaagacgtccaaggtgcggcggcatcgggcgcgtggccatcctgctggccatggccaacgtcttcctcggcctcaccatcgccagggaggtgagcgcctacatcgtctcctacggcgtcttcgtcgccgtctggatcatggccgtcgccgccttcgagttcaaggcgctactacgaggacgacgactgatgacccatccatcacccttcatcctacatggaggcggcgattcgcatagagagaattaatttggagcggctactaccaaacggcattgtttgtggtagctcacctcgcagcttgggcggatggcgaatttgaggattctgttgaaaaatatattcttttgcggtataggatacggaacaggagtgactgatgtcgctaagcctaattagccggacgctctgattcatatttgtacattggtacatggtgttattattcttgtaccctccccgccttttggttgcttggtagattgctcgagttttcttcctccttttacatgtatgtacatcgatcgattttattctattccctgatggattcccg

SEQ ID NO: 12229 - DNA, 496 bp, Triticum aestivum
  unsure (1)..(496): unsure at all n locations
  Clone ID: PAT_TA_12229
ggaagggaaaccatgcgaaacaagaacatggaatagaagtgttaatgaatttaatctgatgatgataacaagattcgcttcgaaaaaattagggaaaccatcgccgccatgccgaagcagaaggcggcctctcggagcagcaagcaaaactgaggaagcggcgtttgatgaagcccccctcgaagaagcatgctccgccgcgcttatgatcttctcgtagaaaatgttggaaatacctatgaaccctacacagctactacaacaacaatggctgaacgaacactctgctgctgctctcatatctgcgactccggcgtgctactgtcttgctacatgggatgcatttgatctgcaccgaggatgccaagcacctataatcttctcacaggatcttcacaaatggtggaacatcctcccttggcccctccagcgaccgatacatgtannngatgtcgacgccgtctgtcttctcgatctcnnnntggntnnnnatcag

SEQ ID NO: 12230 - DNA, 573 bp, Triticum aestivum
  Clone ID: PAT_TA_12230
atctccccgtggggacgcgccgctccactccaagctccggcgaccgcgccgccggcgccgctgaatcatctgtgctcccagcggtaagcagggctgtggtccaaccagtagattgtgaattgcaattcacgagaggcgcatttgccacaatggctctaactcttctccgagggatcagaacaccaaccttacttagagcaaatttcagcctgttctgtaccactcaacgccatccactagctcacttcacaactagggtggagagtgtgcagaccactgagcccaaagcagtgccaaaatcaattcaacaggctaccaaggaggcggcggagcagaagatacaaggttttgaatctgttatcggcatcgagacccatgtccagctatcgaccatcacaaaggcattttgctcctgcacaaacaactatggctcccagccgaacagcactgtttgccccacctgcatgggccacccggggacattgccggttctgaatgcaaaggttgttgaatgtgcagtgaaaatgagcctcgctctcaactgcaagatctccatgacatccaagtttgatc

SEQ ID NO: 12231 - DNA, 1021 bp, Triticum aestivum
  unsure (1)..(1021): unsure at all n locations
  Clone ID: PAT_TA_12231
gaattcggcacgggccccgttcccccagccccggcgaccgcgcccccggcgccgccgcatcttcctcttctctctgccgccgggtcgccccgccggtggtgcggccattgcagtttgcggcccacccagtggccggcgcatttctcacgatgccccgaacgctccccacaccgaccctaacaccaacattacttagcgcaaatttcaccctgttctgtaccactccaggccagttccgaactacccgccctactccgctggccagtgtgccgactacggtgcccaaagcactgccaaatgcgaccaaacaggcgcccaaggagacgccacaggcgaccaaacaggctgttgagcccgagacccacgtcgaggccccggtccaccgcacggccatccctgtcccgctctcctccttcacaaacgcctatggctcccggccctacgactatggctcccagccaaacagcaccgtttgccccacctgcatgggcctgcccgggacattgccggttctgaacgcgaaaattgttgaatgtgctgtcaagctaggcctcgctctcaactgtgagatttccatgacatctttgtttgacggaaagcagtacttctacccagatctgcccaagggataccagatttcgcagtttgacattccgattgctgagaagggttaccttgatttggatattccaatggagtttggtggtggtcacaggcgatttggggtcacgcgggttcatatggaagaagatgctggcaagctgcttcactctgaatctgggagtttttctcaggttgacctaaatagagccggcgtccctttgctagagattgtctcagggccagatatgaggacaggcatagaggctgctgagtatggtgctgagatacaaagggttgttagatacctgggtgtgggcaatggcaacatgcaggaaggttccctccgctgtgatgtcaatgtatctgtccggcccattggacaatcagaattcggtacctgtgcgggcggccgctntaa

SEQ ID NO: 12232 - DNA, 647 bp, Triticum aestivum
  unsure (1)..(647): unsure at all n locations
  Clone ID: PAT_TA_12232
ttttttttctaataaacgagatagtaattcatcaangaactattacaatgaacccanacttctccagacttcctccaaaatgagactttaacaaactgccgccagcttccttcctagtactactaatttagtgctactgaatctcctaatctgagcgctgaaaccacagccagatttccatctaaaccatgatagttcatagataatcaactaggaataaatccaaactcatccagattttctctctaaaatgagagttcaaactactgccagcttcctaatataggcgcaacccctgcatccattaagttccaggaacccgccgctgccgcggcgagccggctcgatccaggccaccgggggagcccgcgtcgtccatctggcccggccgcggccgcgggcggagtcgccccgatccccttcccctcgctcgtggcccccacggcggggacgggctcgccctccttgatgtaaatgacactggcatcgagaggacggcgatctgcggcgacgactgcgccgagttctcctgccacgggtagcctccgtccgccaacaccttactcagcgacacctggtgctccagcttccagccgctgccctcgccgtcgtcgagcgcataggagctgagaagaaacggcccgtcc

SEQ ID NO: 12233 - DNA, 1004 bp, Triticum aestivum
  unsure (1)..(1004): unsure at all n locations
  Clone ID: PAT_TA_12233
ttttttttttttactnccaacatcatttattgctgactcacgtgtangccgattcatntcacctgtngntcgtattgaggttcggacacgggncatgtcaaacttgtcaccaacaatnggtccaaagngcacaaacttgggatgcggccctcttcatcatcacggccagccgtcacagtcaattaagtacatgaccaaatcatttgagaatgaagggcatctctatttctccaggactacaacagacacattccatccggtttggtaggtcgccacaaccccaatgggaagaaaccctcagagatgttcgccgccacagctaccgcctctgtaccggcttgtagagcacgacggtcacatacttggccttgaaacggtgggtgatccccagggcgaccacggatctcgagttctccttctctatgtagaggtggttgagcaccacgggttgcggcagagggaggctgctcccgtcgtcatggctcggcgggaagctcagcagtgtgtgctgcaggtgaggaggaaccaatgggggctctcgagcttcgtcttcgtttccagggatagggttgctgtagcttgagtctggtgatgatgggacttcgaatccaacaacttgcaccccttcatggtcatccctgccttgtcggtggtccatattgcagcaagactctgttctgttgcctttgcttcttgtcttcggggccggcgggggctgcggcagttgctgctgggcggcgaaggcggaggcggttggtgctgccgtcggggaaggaaggaaggaaggaggcgcgcgagtggagagcttctgccgactcgaggggggtgcttgtctcagccgacagcgaggtgggcggacgaggctggctggcggcgaggtgggcgatctggcggggacgggcggtgggagggactggtggcgacagagagatgcggggacgggcggggcggcgtctggccggcggcgggcggcgggcggcggcgggggaggaaacccgggccgc

SEQ ID NO: 12234 - DNA, 736 bp, Triticum aestivum
  Clone ID: PAT_TA_12234
gccccaggcactcttctaggtctagccaacccgtacgtgcaagcacctctgcaccatcgggttttcagcagccatggtgccgaaggcctccctcctcgtggccctcagcctggttctcgtcttcaccgtggccaacgcgtgcggcgatagctgcccgacgccgactccggcgaccccgacaccgacgccgtcccacagcaagtgccccaagaacgcactgaagctcgctgcgtgcgccgacgtcctaggcctcgtcagcgccgaggtcggccagccgccggccgagccgtgctgcagcatcctcggcggcctcgccgacctcgaggccgccgtctgcctctgcacggccatcaaggccaacgtgctcggcatcagcctcgacatccccctcaagctcagcctgctcgtcaactactgcggcaagaacctcccaagtggcttcatttgcgcttgattaaactacgtagttcatcatgtattcatgtacttgcatgcagcgcgcgcacacgaaaacaacgttcattcgtgactgcatgcatgttgggttcgtcgatatccttgtctacttactctgttggttctgaatgtagaactgctccagatctaactggtgtgccaattgttgtgcatgtttcgtgtgtgttgcgggggagatgcaatgatgtttgtacttgggggtgtatgtgcaattggtgtgtctagccatccaatgaatggagtattaagtattattttg

SEQ ID NO: 12235 - DNA, 597 bp, Triticum aestivum
  Clone ID: PAT_TA_12235
agcgatatcaaggattcacttattcatcacgtttcatcatccaaactccaaagccacattacatcataagtttgcgaacacaaacatagcagcgatagaaacacgaccagagcacacgctgaaaactccattggtgttaaccctgagacagaagccgcaccacgagaatgcacttactggccaccacgcaggcggagcaccaggtgaagggtagactccttctggatgttgtagtctgccagggtgcggccatcctccagctgcttgccagcaaagatgaggcgctgctggtccggggggataccctccttgtcctggatcttggccttcacattgtcgatggtgtccgaggactccacctccagggtgatggtcttgccggtgagcgtcttgacaaaaatctgcatgcctccacgaagcctgagcaccaggtggagggtggactccttctggatgttatagtcagccagggtgcggccatcctcaagctgcttgccagcgaagatgaggcgctgctggtccggagggatgccctccttgtcctggatctttgccttcacgttgtcgatggtggccgaggactccacctccaaggtg

SEQ ID NO: 12236 - DNA, 1110 bp, Triticum aestivum
  Clone ID: PAT_TA_12236
cgtccgcccacgcgtccgcccacgcgtccgcccacgcgtccgcggacgcgtgggctccggcactgagattccatcctcttgcatcaatccaatcctcctcacacgacgaccatggtgagcgctaggggtgtcgacacgacgacggcggcgaacaagcagcagcaggccacgtgcctggcccccaaccccggcaaggccacgatcctcgccctgggccacgctttcccgcagcagctcgtcatgcaagactacgtcgtcgagggcttcatgaggaacaccaactgcaacgaccccgagctcaaggagaagctcgccaggctatgcaagacgacgacggtgaagacgaggtacgtggtgatgtcggacgagatcctcaagagctacccggagctggcccaggagggcttgccgacgatgaagcagcggctggacatctccaacaaggcggtgacgcagatggccaccgaggcgtcgctggcctgcatcaaggcgtggggcggcgacctgtcggcgatcacccacctcgtctacgtctcgtccagcgaggcgcggttcccgggcggggacctgcacctggcgcgcgccctggggctcagcccggacgtccgccgcgtcatgctggccttcacggggtgctccggcggcgtggcgggcctccgtgtggccaagggcctggccgagagctgcccgggcgcgcgcgtcctgctggccacctccgagacaacctcggccgggttccgcccgcccagccccgaccggccctacgacctcgtcggggtggcgctcttcggcgacggcgcgggcgcggccgttgtcggcaccgaccccactgaccaggagcgcccgctcttcgagctctactcggcgctacagcgcttcctccccgacaccgagaagaccatcgacggccggctgacggaggagggcatcaagttccagctgggccgcgagctcccccacatcatcgaggcgcacgtggagtccttctgccagaagctgatcaaggagcaccctgctgctgctgctgcggagggtgaccatggcgagcagctgacgtatgacaagatgttcggggctgtgcaccccgttggcccggcgatcctgaccaag

SEQ ID NO: 12237 - DNA, 1451 bp, Triticum aestivum
  Clone ID: PAT_TA_12237
ttgtgttgtttttatttatcttcaattttatagagttttacatgatattaagggttcacttattcataacgttttaattacccaaactcaaaaccacatcacatcataagtttgtagacacaaacaaacatagaagcgatagaaacacaaccagagcacaccgctgaaaactacattggagtacaccgacaacaccagaccctgttaaccctgagacagaagcggctatcacgcacttactggccaccacgcaggcggagcaccaggtgaagggtagactccttctggatgttgtagtctgccagggtgcggccatcctcccagctgcttgccagcgaagatgagacgctgctggtccgggggaatgccctccttatcctggatcttggccttcacattgtcgatggtgtccgaggactccacctccagggtgatggtcttgccggtgagcgtcttgacaaaaatctgcatgcctccacgaagcctgagcaccaggtggagggtggactccttctggatgttgtagtcagccagggtgcggccatcctcaagctgcttgccagcgaagatgaggcgctgctggtccggagggatgccctccttgtcctggatctttgccttcacgttgtcgatggtgtccgaggactccacctccaaggtgatggtcttgccggtgagggtcttgacgaaaatctgcatgcctccacgaagcctgagcaccaggtggagggtggactccttctgaatgttgtagtcagccagggtgcggccatcctccagctgcttgccggcaaagatgaggcgctgctggtccggagggattccctccttgtcctggatcttggccttgacattatcgatcgtgtcagacgactcgacctcgagggtgatggtcttgccggtgagggtcttcacgaagatctgcatcttgaaggaggacgagagggccttggctttcaatcggtcgaggaatttcccggtgagatcgcggagaggggattggattggtctcgtgcatcctgcccgagatgggagggcggctggggctggacggcgggcggctgcgcgcgagccggagcgcgctccgggactttgggaacgcgagcagcaacaccatcgtgtacgtgctggagaacatggtggaggagagcaggcagagggcggaggcgccggagccggagccggagccggagggggccgatcaggagtgcgagtgggggctcatactggcgttcgggccggggatcaccttcgaggggatcctggcaaggaacctccaggcgcgcctaggcgccaactagcacgaggacatgaattgcttgcgcgcacattataagttggtttcgtgccttctttggtttctggggcgcatgcactagttatcctaccaggaagaaaggtaatcaaatagcgagtttgtttgcttttagtgaaataagcaatgaaatatc

SEQ ID NO: 12238 - DNA, 1175 bp, Triticum aestivum
  Clone ID: PAT_TA_12238
ccagcgggaaccggcggcggcgacggcgacggcgacggtgacggccgtggtcgcgcatcggcagtccggcgtcgcatcgagcctcaactcaccccctctcccagatccggtcgccgcgcgcccgaagaatccaccccctcctcgacggacgcccggcgagatgccgcgcgaccgcgacgagccggcggccgtgcgcgtctacacggtctgcgacgagtccaagtacctcgtcgtccggaacgtgccggccctcggatgcggcgacgagctcggctccctgttctcggcgtacggccccctggaagagtgcaagcccatggacgccgaggactgcgaggagtacaccgacgtctacttcatcaagttcgcgcaggtcggcaacgcgaggtttgcaaagaggaagttggacgagtctgtatttcttggcaaccggctgcaggtttcatatgcacctcagtttgaaagtcttctggataccaaggagaaactggaagtcaggagaaatgaagtcctcagacgaataagatcacctgctggaagcagacctgaagggatatctcagtattcaccgggtcagggagcttctagtgggatccctcaccatcagttgcacaccaatcagtgataactaataaagacagatcgtgctacctgtctcgcaggctaatgtgttggccagctactctcttgtgaggactatttcccgtccgagtcgatgaatgcaactgtaaatctacgtgaggcaggaagctttgataaggtaagactcggctggccatcccccatgctccgtccgtcagcgtcgtagacgtccatgactgtctatgtgctttttctcgggattccgtccggcggcatgactgccgatgctgctgccgctgcatccacgtatccacgggttgataaccgcaggcgtatttgaaccattggatgacacaggcgttccggcctgtgttttagcctctgttttgtgcacttagacttaccctgtcatcattgttgtgtgcacttaccttgtcgtcgttcgcagtaggtctttggcttgtcgcttagcaatgtatgctccagagaaaatggtgtattgatgccaggctcagcagctgttcatatgctgcttactctgttgtgttgtccataagatttgtctttctcgctaagcgcgtcatgtcccttgc

SEQ ID NO: 12239 - DNA, 943 bp, Triticum aestivum
  unsure (1)..(943): unsure at all n locations
  Clone ID: PAT_TA_12239
ccacgcgtccggttcccccatctaaacaaaatcagtccccccaccaaaagctagggttagggttagcgaggcggcggcggcggctgctttattcccgatgccgatcgccatggacaccggaggcgcgccggagccggatgaggagtccgtcgtcttccccagatgggcgatgctggatcgcagaggccgcacccgctgccacaacggcctaaacgctgcccgtgtggctgccaacaagaacaagaccgccgctccagtcgacatggacggcggcccctcctgctacgtgtccttcaccctcgcggctcctcaaaaaaggatctcctgcctcaacctccacttgccggaggaacctccacttaccccagccaccccgcccgcctatgccttcgtccgggcaacggacaagaacctcgtccttttcgacatcaccaacccgagccggtcttgctactgggaccccccgtcagatctgttcgtctacacggccggcggtccttccccctcggtgcagccgctccctatgtacaccaaggagagggagaggccgttcctgatggacaacctcaccacaggcatcctgcggctcgcggaggaccgctacatcgttgctgacctcaatgtctaccccaaaagaaagggcaatggcatgcgtgccgaactctgcgtcttcaactccgagactggaaagtgggaaatcatccgcaaattggacccaggcaatggcggacaagttccccgaactctggtcaaccgataatgtgctcgcctgtgatggncgtttccccgtgctggnttgactacttcaacggtgtcctgctatgtgacttctccaacgtccantccaaaactcctcnggcgctcccgcttttgtggcttttccctggagaaaaataantttctctgtattgagggtacggtgttgaaaagggtaactcccccc

SEQ ID NO: 12240 - DNA, 780 bp, Triticum aestivum
  Clone ID: PAT_TA_12240
cgtccgcggacgcgtaggctcgccgccgccctccttggctcccgctgctctgctgctgctccttggctcgctctgggagaagacgaagaggagaaaagaaagctgaccatgaatccagatccaatggaagtgcaagaaccaccaccccataggaacgagaaaaccatctttgagatatgcagagaagccagaaactttcgtaataatgctaggaggtgtggcactcttcttcagccctacgaatttagctgtccacaaactgcagaacttggatttaaaaatggttatatctattattcaagcaaggcaataaagtttgctgcggatatagaacaaggatttgtctcagaggaactgcagaaacgagctgccaccttctgggttctgaatgaagtgccttttggtcagctaaacccattggggctaaatccatccgttgatgtagggattgttaagacctacggcgtggcctataatacccttattggaaaaacaattattgccttcgctcgctctcaacacaatcattgcctttgctcgctctctccaaagtgtgctctcctggatagcaaatccagataacagtatgttcgttcgtgatcagttaggaattagtattagtggtctgctgctagggcggctgactggggtacttacgctattaatgagaatatgatccaaattatgccattccgagttcgtggaaggactcctgatgatgtgatgacacctaggcagggtttgcaactactgatacagaccaatattttgcaacattgg

SEQ ID NO: 12241 - DNA, 977 bp, Triticum aestivum
  unsure (1)..(977): unsure at all n locations
  Clone ID: PAT_TA_12241
gnacggctgatggctatttatgcattgctacaacaccaaaaacatgtctacacaacaggattgctgcctgtgaaactctgtcggcaaccaacaatgacaacggccacagttcagttcagtcaaaaaatcagctcggtgtacgcaagctaaggtaatcttctttccgaacaccaaacagccagctacactatccatgtcaactatactgaccagagtcagttaggcggcttcagcatcactaactaaaacaacctagggttttgtttcatcagccagagcttcattctcctttcgccctgctctttctaggacgacggccctcaaacagtacttcgtacaaaagcctcttgcttccccatttccaccacacaggccctggtcctcccgtaagcatccttctcttcagcttgttttcagcgttaacatatttggaagaagtcggcccctgctgcccctgacctgatgcaaaggttggaactaaacctgcccaatattgctgctggatgcccaggacttgtaagacagtctgcatgccctcctctgatggtgctgctgcatctgtgccataacctggaccgtccccgagtaggaccttgacaactttcagttgctgatgaggatatagaccgaagattgtatcctccctcaagtataaccaacaattttccctctgagcaaagcagttagcatggacaccatcctagaatatccagcaggtgtgacatcacaacaacccagagggtcacccctcgctgcatcaaatcctgcagatatgatggtgatgtctggagcaaattctgcagctatcggaagcaccacatgcttaaaagcaaatatgtagtcattgtctccaacaccaccacggctccaaggtatattgactgagaatccttggccatccataactcccacctcatttgctgccccagttccagggtagaagcttccatcctcatgccgatgtaatgatatgtaca

SEQ ID NO: 12242 - DNA, 627 bp, Triticum aestivum
  unsure (1)..(627): unsure at all n locations
  Clone ID: PAT_TA_12242
aattcccgggtcgaccagctcctgcagcttaatgacgccagcgagaatgtcgtcatcgccggccaaggacttcaggaacgccagctcgtcgcgatggccgacgccgcgagtgcgcttgtgagagccctcgcgtgcccgtgagagctcgttcgagggctccgcggcgcaccgggacatctctgctgcggctgcggcttcgcggcgggacctctctagtgcttccgcggccttggtctttgctgcctggttatatgtccaccctaaactcctcctaccggtcatggcggaatgacttgacaggaaagaccagttttgtgggtgatgaggagaggaactgtgaagtaattttcgagtgggtagtttttatagcccggtgctaagtgtgaacacatattagtttgataggtgtgaacagatttgcaattacttattacgttgtaatctgcaatgtgacgagaaacaaggtcaaaatttattgatagcagaaggttgaccgtgtggttgctcgtcgttgaggcggtcgcggcgnctccgctttggtgtccctgcgtgtgctctttgctgatgatgagctgctgctcgggcttggtcgtttcatttttctgtgagtcccattcgagtatgctc

SEQ ID NO: 12243 - DNA, 3649 bp, Triticum aestivum
  Clone ID: PAT_TA_12243
tcctgccacccggggccgcccccggcggaacttcatacctgttctagcatcacgatcccaagcactaaggtacttgtatataaggtggggtgtagagctgtcgaacatgacggtggttgtcggtgaaagcggcgatacagattatgaagggctgcttggaggcgtgcagaagaccatcgtactcaaaggctcgtttaattctgcgccaaaccagcttcatgcccccggaagctatgcccgcgatgaggagccctgctgcagcgaaacacgcggctggagaacaggtccttatgcatctggaaccccgacaggaagaagaagcagattgggtgccaggaagccctacaatcatcaaagattcttattgtcagcaagggagcaaagtaggtgtgtggagccactctgtgttatgaggtagcacacgaaaaaagaggacaacatattaatgaatcatctattcacgcggagagtacaaggggacacatgccaaggataggttcaactgatgctattgatgtttgggcaaatcagcacaaagataaaaaactgtacatagtgctagtaagcattcatggtcttatacgtggtgagaatatggagcttggacgtgattcagatacaggtggccaggtcaaatatgttgtagagcttgctagggcgttaggtgaaacacctggagtatatagagtggatctgctgacaaggcagatttctgcacctgatgttgattggagttatggggaacctacagagatgctgagtccaagaaattcagagaatcttggggatgacatgggtgaaagcagtggtgcttatattgtcaggataccatttgggccaagagaaaagtatatccctaaagagcagctctggccccacatccaggaatttgttgacggtgcacttgtccatatcatgcagatgtccaaggttctcggagaacaagttggcaatggccaaccagtatggcctgttgttatccatggacactatgctgatgcaggcgattctgctgctttattatctggggcactcaatgtgccaatggtcttcacaggtcattctcttggcagagacaagttagagcaacttctaaagcaagggcgtcaaaccagggatgaagtagacgcaacatacaagataatgcgtcggattgaggctgaggaactttgtcttgatgcatctgaaattgtaatcactagcactaggcaagagatagataaacaatggggattatataatggatttgatgtgattatggagaggaaacttagagcaagaataaagcgtggtgttagctgctatggtcgtgaaatgcctcgtatggttccaattcctcccggtatggagttcagccatatagtgcctcatgatgttgatcttgatagtgaagaagcgaatgaagttggctcagattcaccagatccacctgtttgggccgatataatgcgcttcttctcgaaccctcgcaagcccatgattctcgctcttgctcgtccagatcccaagaagaacatcactacgctggttaaggcatttggtgaacaccatgaactgagaaatttagcaaaccttacgttgatcatgggtaacccgtgatgttattgatgaaatgtcaagcacaaatggagctgttttgacatcagtactcaagttaattgacaagtatgatctatatgggcaagtggcataccccaagcaccataagcaatctgaagttccagatatttatcgtttagcggcaagaacaaagggggtgtttattaactgtgcttatattgaaccatttgggctcaccttgatcgaggctgctgcttatggtctacctatggttgctacccaaaatggtgggcctgtcgatatacaccgggttcttgacaatggcattcttgttgatccccacaatcaaaatgatatagctgaggcactttatagacttgtttctgataagcaattgtgggcaaaatgccgtcagaatggtctggataatatccatcgattttcttggcctgaacattgcaaaaactatttgtcacgggttggtacgctcaagtctagacatccacgatggcaaaagagcgatgatgctactgaagtttctgaaacagattcacctggtgactctttgagggatattcatgatatatcacttaacttgaagatttccttggacagtgaaaaatcaggcagcatgtcaaaatatggaaggagttcaaccagtgataggagaaaccttgaggatgctgtacaaaaattttcagaagctgttagtgctggcacaaaggatgagtctggtgagaaagctggggccaccacaggctccaataaatggccatctctgcgaaggagaaaacacatcgttgttattgctgtagattctgtgcaagatgcggacttggttcagattatcaaaaacatttttcaggcttcaaacaaagaaaaatcatctggtgctcttggttttgtattgtcaacatctcgagcagcatcagagatacatcctttgttaacatctgggggcatagaaattactgattttgatgccttcatatgcagcagtggcagtgatctttgctatccatcttcaaattcagaagacatgcttagccctgccgagcttccatttatgatcgatcttgattatcactctcagattcaatatcgttggggaggagaaggtttaaggaagacactaattcgttgggcagcagaaaagaatagcgagagtggaaaagaagcagttgttgaagatgacgaatgttcatccacttactgcatttcatttaaagtgaagaatactgaggctgtccctcctgtgaaggatcttaggaagacaatgagaattcaagcattgcgctgtcatgtattgtacagccatgatggcagcaagttgaacttcatacctgttctagcatcacgatcccaagcactaaggtacttgtatataaggtggggcgtagagctgtcgaacatgacggtggttgttggtgaaagcggcgatacagattatgaagggctactcggaggcgtgcagaagaccatcatactcaaaggctcatttaattccgcgccaaaccagcttcatgccgccagaaactattcgctagaggatgtcgtatcgtttgacaagccaggaattgcttccgtcgacggttatgccccagatatcctaaaatcagctctacaacaatttggtgccctgcagggctagaatcaccagctttgtcagagtcagcagaggaataaagtaggtgtgtggaggcacacttttgctgtggggtcgcacacgagacacggcggcctcgtcccgtgcctggtatctggatagggcgcgaccgtggcggcaatcgagcacaagggtgtggcttgcatgctcggtttatcccttcggattttgtgacctacattccattttcaacgcatggtgaaattgttcataggttccaaataaatacagttagtatcgaactatggtcataaagcgtgtgctatagggaatgaagtaccctgttgtttggaaaccatatatatacccaacaatgtgcatgcatctctacgaataattagcatctccaaggagctagagctggagccgagcaatcttaattttagtggattgtgtaaaaacaatttcctcaccagttgtttc

SEQ ID NO: 12244 - DNA, 631 bp, Triticum aestivum
  Clone ID: PAT_TA_12244
tttagaagcagttattgtgcctcttctgctcctcttactcaaaagcagaaactaggcatttcggcataattaaaccacacgagtcaattacatagcttcagcaacagaatattactgcgacaaagttcctcaaccctgtgttgactgaatgacacgcaggcgtggaagttacagctaagcgttacattacatggatgacagattgacaaccaaagataaatctgcatccttacaatgagcatatgatcagctcacttctttggcatttgtggccttctcgcgtgtagttttggtcctggtctccatttgcattgtccgctcaatgctatcagtaccaactgcatcttcagtgctacttgtttgatcacttaccttgcaagactcacttatgctttcagaggagctcagctgctctgcctctttggtggaggtagagaagatgcttccctcgtcttcatcgcctcctttgctcacatcctgccattctagcctcctcaagaaaccttcttcgatctcgctaagcgatggatatttatcctcgtcgttgtccgatggtgcaaggcaaacgaaactcaaatgaggtgtgcctcctggacgaaccagagtagctgttcgcggacgcgtgggtcga

SEQ ID NO: 12245 - DNA, 880 bp, Triticum aestivum
  Clone ID: PAT_TA_12245
cggagcgtggccgcggcgccgatcccccgtggaagcctccgcgtgtcgcgccccataagggggcgacctcgccggcgcccgcgacctccgagaactccccttctccgccgcgcccgccgtgcccgaaccctaacctgccgcccgcctagcaccagtgcccccctgctgctactagtcctactaccctcgtgccgcggcagcgtcggctgctcccgctgctgctgcttgctggcgccgaaaccctagccccgcccgatgtcgcagcaggatccagctgcggccggggaggagctgccggggggcctctcgcggagcagctccgccagccggctcaacgcgcaggcgccggaattcgtgccgcgtgtcgccgcggcgccgccgccccccgcgccggtgcagcccgtgatccacgtcttcgccgcgccgcccccgccgccgcccgcgtcgttcttcgccgcgggcccgcccccgcccccgccccggccgccgttcgagttttacgccgctgtcggtgctggtggcccgggcttcgttgccgtgcccgagcatgagatggggcccgagcaagcggtgccgcctccgccgccgccggcccaggcgcaccagcaggggagagagctgaccacggacgacgtgctgcacaagatcaccaagcaggtggagtattacttcagtgatataaacctggccactacagaacatttgatgaggtttatttctaaggatcctgaaggatatgtaccgatgtcagttgttgcttcctttaagaaaattaaggctctggtgcaaaatagttccatgcttgcttcagctcttcgaacttcatcaaagcttgtggttactgaagatggaaacagagtaaagcgtgtacagccattta

SEQ ID NO: 12246 - DNA, 1104 bp, Triticum aestivum
  Clone ID: PAT_TA_12246
agggtgtgatggctgctgctgtagtatctaatactgcagtgtctgatggtattatggctactgctgcagtgtctgatactgcagtatctgcacgtgttttgaactctactgcagtgcctgatgttatgactgatatccatgaagctgccggtggcaatactgttaagaagaggagcagattagaggttgcggtggtgactgaacattgtcgaggaccgtccggtgacaaggagggatgtgcgccaatggagctcccatctgagaatcctaaaaggaagaaatcttctgttgtgatgaccacaggccaacagtgccttcagatttcagcagtgcagcaaatgggggttgaacagtgtggtattgaagtctgttccaacaatctcatgggaccttctcagcgtccctatattctacccaagaagacaactctacctagtgaattggagaaaaaagtaaaggagaaagtcaagactattcaatctaaacttcccatcttcgtgagagagttgaaaacataccctgttgttggcacaggccaaggaggatgtgctctggtcttttgcaaggaatttgcttcggcatgtggcctcccgcacacaaagaaaacaaccatacatcttcagctggaggacaaaacgaaggggccatggcctgtcacgttaatccgcagtgagcataacagcaaccagaggtggcttaccacggggtggaacaaatttgtcacggacaatggcctgaagaaaggagatgcctgcctcttccagccagacaagagcagcaacactcagggccttacaatgactgtttatctgattcgcaagtcgtcggaaaaggagctgtagctcaagcatgttgacttgtggtttcttatcaatcgtctatatttagtatggctctaataactctcttatgccctcctatgagagctgacttcttgaccaacttgatgttgagttcatttaggtgacttgtagctgttaaacaactacctagtattagtatgtatgtctgtgccgtgtgttgctgcttcagatgggattaggagctactttattattcagagtgttgtttggtgcatcaatgcatggttcaaatttgattaat

SEQ ID NO: 12247 - DNA, 1097 bp, Triticum aestivum
  unsure (1)..(1097): unsure at all n locations
  Clone ID: PAT_TA_12247
tattctttttctgcattgatnaagctgctggcaaagaaccctggaaataaacagaaaacacggtcatggagcaccggagaccccctcttgtaggcagcatcatctgcctctaggacttggcactcgtagcaatttacaaatggccaaataacagcaacaaacaagagagactactggggggtaaacatggcaaattaacagtagcntggagactgcagtctgcagaacccatctcttaattatatacgtaggccagggccggccggtggacgtcccaatcntgcccatcttaaatgtgaacgcacttcccagnttgcgcacacatgcccaaaatcaaaccaacatgtagctagcatgcatgtggggctttgaggacatgaaagcaccggaggcgagactcgggtcaacgagccaaacgcagacaaattgcttcatgtacgtgtcgcccttccttgcaatcatcaaccagaagcaaagtgagtccaatacgcagcggattaagcccccttcaaatagttggtggagacaaggatggcgggaaacccgcatacagtagttggctcttcaatggcattatccacccagtctcacagaaccactcaagattcatagtttggagatccagcgaaatgcagtccggctcgggcaattcaaacgatgactccgggttgtctggatacccatgtaggagtaagtatcccccagctacaccaatgatgtcataggcgtaatcacgggacaacgggactacagcccccatataccacagccttgggtcatcatcccctatgctccccaaaatggtatacatgaggcgattgtggctgacagcaaacaacccaatcctcccttcccttgcctccacaaaggccatctgggaattgctccagggactaggcgggaggttgacggaggagaactccatcgtggcaatgtcgagcatgagcaacttgccgatcccaggtatcgcccagcagaagcatccgtgcgcgtagtagcgctctccgaacacagtggaggatcgcacatcttcgccttgactaacttgtgcaacccgagcgctccaaccatcaaatgcgacggcatgccattgtccg

SEQ ID NO: 12248 - DNA, 1919 bp, Triticum aestivum
  Clone ID: PAT_TA_12248
ggcccagctgccccgccgccgcattccccccctctcgcatcatacagcagttctgactatgattctgggcagtacaacgaggacatgaagaagttcaagaagatggcctttacgacgaacgactacacgagcagccaatacagtgccccgacaagcgagcgccgccgcctgcctcctcccctccaccagggttacccgccgcctcctcctccgcagtaaaaagaggatcattatggagcaacataccagaattggcagaataatgctcctcctcctcgacctgatcatgtggttaagatgcacccatcacctcctcccgcatatgccaatcgtcctccacaggcaccaccgccgcctccaccgcctatgataaacagcagcggggggtcagtttctaattactcaggtggtgagatcctgcctccaccatcccctggcaccgcccttggcttcccgaactctaagagcacattcacttatgatgagctggtgagggcaactgatgggttctctgatgctaatctcctcggacaaggtggtttcggatatgttcacaaaggagtgctgcctaatggcaaagagattgctgtgaagcaattgaaacttgggagtggccagggagagcgtgagttccaggcggaggttgagattatcagccgcgttcatcacaagcatcttgtgtctctggttggttactgcatctctggggggaagaggttgcttgtatatgagtttgtcaccaataacacattggaattccacttacatggaaaaggccgtccaacgttggagtggcccataagactaaggattgcccttggtgctgctaagggtttggcatacattcacgaagattgccacccgaagatcatacatcgtgatataaagtcatcaaacattcttcttgattttaaattcgaagctaaggttgcggattttggtctggcaaagttcacctctgataacaacacacatgtgtcaacaagagtaatgggcacttttgggtatctagcaccagaatatgcgtcttctggaaagctaactgagaaatcagatgtcttttcctttggagtgatgcttcttgagctgataactgggcgtcggcctgttgattcgacccaaacatatatggatgacagcttggttgattgggcaagacctttactgatgcgagcacttgaggatggtaactatgatgagttagtggatgctcgtctgggaaaggatttcaatcctaatgagattgccagaatgatagcatgtgctgctgcatgtgtacgccattcagcacgtcgtcgccctcgaatgagtcaggttgttcgggccttagaaggtgacgtctctttggaggatcttaacgaaggtgttcggcctggtcatagccgctttttcggatcatacagcagctctgactatgattctgggcagtacaacgaggacatgaagaagttcaagaagatggcctttacgacgaatgactacacgagcagccaatacagtgcgccgacgagcgagtatggtcagataccatctgcatcaagcagtgagggccaacaaactcaagaaatcgagacagggacaatgaagaaaggtggccacagtggctacagttcaggatacagcgggccgtcgtgagggaattcttttttacccccccttttttgactttctcgtcgatgcaatttgtaaagtccggttgaatttatatgctgacttgacttgtgtgcgaggaagggatgtttgacccaagtatagcttctggtagctgcagccgttgattctttcatatgttgttgaccgatctgcccaccgccgtttgctatgtaattcaaagagctaattgagtgctgtactgttcatacccactcagggttgagtaagagtaacccaacgattctttttaccaaaaaagatgcata

SEQ ID NO: 12249 - DNA, 850 bp, Triticum aestivum
  Clone ID: PAT_TA_12249
ggtgttttttttttttttttttttttttttagaggggaaaatgctggcacagaactacaatctatactcctcccatgtatacggtgttcatgggttcggacctggccttcgtgaatgcaaatggatagccgttcgtgtggccacgcgggacaactccatcctatattcctcatgtatacgtcaatgtatttaaaggctaaataaatagaatggaagagggagaacaaatggtgaatcaaaggcaaaatcctaacatcaaacctagaatctgaactcgctattccacattgataagctaacccaaaactatatgctgggtggttctttttcataagttacttccaagctgtttctgcctatgatgaagatgcaacctcaatggcactaccaaggggccatgctgcttccacaaacgaattgccattacgcaccttctttactaacgtaataggcattggtaggggtccaaccaccaagatccgatcccacagagtacatgtgtgctggtaaaacaaagcatcctatgcaataggaaatggatatggcttcctccgtagccactccggcttgggggctcgcgcctcctgcccctcttcacatttacatacacgtcgtgcagcttcttcgaagtctgtatggtttaaccttagcaactgctgccttagggtttacaaaaccagcctgccccgccccgtcatccagcaggcccgcggcatccacttgtttctgtccggcccccccgccaccattccacacgccaccaaatgtgcatttcatgtgagtgcatgccggttcatcaactttaagagctctgactgcaacagccctgcacttggaataagtagcacca

SEQ ID NO: 12250 - DNA, 911 bp, Triticum aestivum
  Clone ID: PAT_TA_12250
cgtccgcccacgcgtccgcaaaggtggaaggaacacagcaccaagccctcccctgcaccctactccctacccacctagccggaggagaaccgaagtcgccgctgccgccgctcgccccagtaaaatggacaccgtgggtgcccggctgagccgctcctccacgcgatatggccccgtcggcagcagcaacgcctccttcagcgggcccgtcaggaagtggcgcaaggcgtgggtccctctcgccggcggcggcgcggggtccgcctccgccggtatgggccccattgggtgccccaggggtaacaaggtggtgctgctcaagtgggcgccggtgagtggcgccggcgacggtaacggcaaggaggtcgcctcggcggtcaccagacggcgatacgttccggtttcgggtgtgccacagaaccctaccagaaaaggcggcagcaccgagctgaacttgaacctcggtttggaggacccggatgatgacagcgacgctgatttgagcccagacgaacagcgtgacatgggcagcaccccgcgttcggagaaccgactgaagaggaaagtgttttaaccgtcgacctcggatactagaacctaagcagcagcagcagctccatgttccacatgagttctgcaccatctttgccatgcgaggtccctggagtagccttattattattagtgtgtagcttctatctgctgtgctcccgtgtttcagtagatgaattgatgttgtttcatgccaattgggaggcttatcgccttgttattgttgtattaatgtcatgaacttgtgaggaaactggtagcgtactgtgtaccagcacgttggtctatggaatccttttcagtcgtgagaggtgatcggcgccctcaatggccatcgttcgtggatgctaaaaaaaaaa

SEQ ID NO: 12251 - DNA, 709 bp, Triticum aestivum
  Clone ID: PAT_TA_12251
aagattcgaaaattacaaagaactatcctttcttcactatatatcttccccgggaaaattaactactccaatcgcgtgcccgcggcccaggtacacctttccggtttacaatccggtcatccttgacaatatttttcaaaagaatgtaagtcaagtatcattgggcatgctacagatggtatcagcagcatcagaatgagaagtttagtcttccatactcaagttaatctggtaatcctggtgacacaaaatggatgcccaaacggaaggcctaagagcccttacctaacctatgttatgttcccaggtattccattaaatcatcatcatgcagcagcaaatcatcaatatctgggatcgggctgctcatactgatatagtccaaaggtaacccctcaaaagaactgccaacaaacttatcttgctcaccgtagaatggaaaatctacgaggtgttgcatatctccagggacagaagttgaacttccaccaccaatcacatgatcaccataaggactgttgtcagctggtgccctgatacccatgggaaccacatgatgatccatcataggtaatggcactgattgtttcggaggtaaagtctgatagttactgggaaaactattaaaaccagaattggcatgcagtggaaaggggtttccagactttgacctggcattatcactacttccataaagtacaggctgata

SEQ ID NO: 12252 - DNA, 581 bp, Triticum aestivum
  unsure (1)..(581): unsure at all n locations
  Clone ID: PAT_TA_12252
gaaatcatacattccattcgctttttgcttccaccaaatccaatcccagcacgtagctagatcgaccaaagcgaatccagtgagtgtcagagctccatttccatctccacctcgaccaggaaaagaaacgggagcagcaatggcgggcgtgggtcgcaacatggtggcgccgctgctggtgctgaacctcatcatgtacctcatcgtcatcgggttcgcgagctggaacctcaaccacttcatcaacggcctcaccaaccgccccggcgtcggcggcaacggcgccaccttctacttcctcgtcttcgccatcctcgccggggtcgtgggcgccgcatccaagctcgccggcgtgcaccacgtccgcacctggcgcggcgacagcctcgccacctccgcctcctcctcgctggtggcctgggcgatcaccgccttggcgttcgggctggcgtgcaaggagatccacatcggcgggtaccgagggtggcgcctccgggtgctggaggcgttcgtgattgttctnatgttcacgcagctgctggacgtgctggcgctgcactcgggcctnttcgggaaccagt

SEQ ID NO: 12253 - DNA, 1033 bp, Triticum aestivum
  Clone ID: PAT_TA_12253
aatctcccatccttgtcgattcgatctgttccacaaagccacttcagtgctcgatccaagccaacaacaacaacaacaagaagaagaagaaagaagcaaggcagcagcaatggcgggcgtgggtcgcaacatggtggcgccgctgctggtgctgaacctcatcatgtacctcatcgtcatcggcttcgcgagctggaacctcaaccacttcatcaacggcctcaataaccgccccggcgtcggcggcaacggcgccaccttctacttcctcgtcttcgccatcctcgccggggtcgtgggcgccgcatccaagctcgccggcgtgcaccatgtccgcacctggcatggggacagcctcgccacctccgcgtcctcctcgctggttgcctgggcgattaccgccttggcgttcgggctggcgtgcaaggagatccacatcggcgggtaccgagggtggcgcctccgggtgctggaggcgttcgtcatcatcctggtcttcacgcagctgctctacgtgctggcgctgcactctgggctgtttggtaaccatgctggtggatacggcgcggagcacggcgggtatggcgccggcgatccgcacaataagggcatgggcaccggcggcgtcgccagggtctgaatcggccgggtagatgcctcggcggcgacagtgacaggctgataataaggtgtatgtataaatgtgtgttccgtcacgtatggtgggagcgtacgttgtatccatacatggtgtgcatgtactcttttcttttttgtagggacgacgcgcgtgcatgcgtacatgtggtagtactgcaggatggttcttcttagtgtgtgtgtgtgtgtgtgtgtgtgtttattatctagtccgagatcgagatagagatcgatcagtccatgcttcttctccgaccagaccacagcagtgtctggatgtggatgaatggcagcacttgtttcatttatcactactactctacttccgttccgattgtgatgtgctccggttgtcttgtgcccatgcaagtga

SEQ ID NO: 12254 - DNA, 934 bp, Triticum aestivum
  unsure (1)..(934): unsure at all n locations
  Clone ID: PAT_TA_12254
atcccatcctcgtctacaatctcccgtccttctcaattcgatctcttccaccaagccacttgagtacgcgacagaagccagtgaatcagtgagcgacaggcagagagctcggcctcgaccaagaagaagaagaagaagaaagaagcaaggcggcagcaatggcgggcgtgggtcgcaacatggtggcgccgctgctggtgctgaacctcatcatgtacatcatcgtcatcggcttcgccagctggaacctcaaccacttcatcaacggcctcaccaaccgccccggcgtcggcggcaacggcgccaccttctacttcctcgtcttcgccatcctcgccggcgtagtcggcgccgcgtccaagctcgccggcgtgcaccacgtccgcacatggcgcggcgacagccttgccacctccgcctcgtcagcgctggtggcctgggcgattaccgccttggcgttcgggctggcgtgcaaggagattcatattggtgggtaccgcggatggcgcctcagggtgctggaggcgttcgtgatcattttgatgttcacgcagctgctctacgtgctcgcgctgcactccggcctcttcgggaaccagtttggcaaccatgctggtgctggtgggtacggagccgagcacggcgcgtatggcgccggcgacccgcacaacaagggcatgggcaccggcggcgtcgcgagggtgtaagccaagccggtgatcgatctcggcgtggtcgggcgctgggataataagtagttgtatgtatgtgtcagtgttagtgtgtgtcacgtacggtgtgggcttaatgcatactgtacttgtggnnngnngtgtgtgcatggctgtagacatgtagtacatgtacacgtacctaaggggggtgtgtcctttttggcagggacactagtaacttgcgtactagtacatgaccc

SEQ ID NO: 12255 - DNA, 1127 bp, Triticum aestivum
  Clone ID: PAT_TA_12255
cctcaaggcaatcatcatcctcgtctagccattctcctccatcctcccccccgatctctccacgttcacaagcgatgcagtgaaagaaagggcccgatccgggaagagcccagcaacaaagaagaaagaaagaaaccaaggcagtaaccaagggggggggggggtcgtagcttggtggcgccactgcggtgtggcagctcctcatgtagatcctcatcatcatcgtcttcatcagctgcccccaccaccacctcaaccgcggcctcaaccgcccccccggcgtcggccgcagcggcgccaccttctacctcctcctcctcgccctccccggcggggccggcgggcgccgcttccatccccgccgtcgtgcaccaccgccccccccggcgggggcacagccgcgccccccctccgtcctcctcgctggtcgcggggggcggtcaccgcggtttgcgctctggcgttcgcgtagatggagatcgacatcggcgggtggcggtcgcgtgagcgccgccgggggctgcgggcgttcgttaatgttcaggccttctctcagcggctttgcgctacagtgctgccccttggcgtccgagtctgccagcagcgctggtggtcgtgcgtcgggggccgggcacggcagggcgcgcgcggcggcgccgccccgcacgaccaggggcaccggctgggtggcgtggctgggatcggaaccggttatggatcacggcgtggttgggcggtgggatcattggccggtggatgtagtgtacgttgttactatggttggtgtacgtagtgtgtttactttattgtggggttggtgttcgtgtgtgtgtatgtctggtggtactttgtagtagtgcctgcgtatagtgtgtgtgtacatgtgtggtggtacaatagtattttcctacgagtagatggcgatcaatcagtgtatgcctttttacacgccttgtctcagcagtgtctggaggtcagcgatccgaagtactaatctgatgtatggatactcttctccgtccgctgcctcagtcccggcaatgtctgcttggacgaagtttaatttacaagtagcatgatattatcgattaaaaaaaaaaaaaaaaaaaaagtcgacgcggccgcga

SEQ ID NO: 12256 - DNA, 622 bp, Triticum aestivum
  Clone ID: PAT_TA_12256
cgtccgcggacgcgtggggcagactctcatcctgagtggaaagaaactttggaggatttgttaatacttgcacgcagctgctctgtaatgacacccggggaactttggctgcaatgtgaaggtatagtgcaagatttggatgatcaacgtcaggagctcccaatgggtgtgctgaagaagctttacactcggatgctctttatccttacaagatgtacaaggctgctccagtttcacaaggagagtggatttgctgaggatgaaattgttatggatcagcgagataagattatacaatctgctgataacaagattttaacccaatcaggtccacatgctacaacaagcagaagtagcaaaagcgatgcaagaaaatcatacagtcaagagcagcataatctgaaatggagaagaagccaggagataaaacctgttaagcttctgccccttgacactgatatcaagaaagaggttgaatctccaaccagagaacggatttcttcctggaaaccttttccatcacctgttccaaagcccccaaaagaacctacccctattaaagaggaatcgcctactaagaaaatagatacactcgctacgattcctagcggcgttgagttaa

SEQ ID NO: 12257 - DNA, 681 bp, Triticum aestivum
  Clone ID: PAT_TA_12257
tttttttttttttttttttttggaggaacagaacaatataatagttatggttcagtacaaacagagaactaaatgttgcatggtattaatatctcagtatgatccacattagcaggttaaaatcacagtacaaatgcttaacacaagccaattctacaaaatcctcgaagtttagtctttagaccatgtcatggtagtcagcgttaaaataaatcatgagatagttggtgtacaggcagatgatccctaacgtcaaccggtacgtggatccttttacccacaaaagccgagatgccttgtcgaatggttacagaacttttggtcaaattgcgaaggcaagaaagcaaggtcctcaccactcaaggatgcactggagatgcaaatcatgcttgcagcttgtaaccgtgcaggactcactatcacagaaggcctgaaggcagatgctgcaggcgtggtcacaggcgtcgtacacaccacccctccacgaaagctgccgccgatgaaagcttctccatgcctacagcccccagcccccctccctcagatgggacctaccggctaccggagatggtcgccgtcgtccgctggaccttgacggatctgacgggaaggggaggggacgaccaggatccggtcgtcgccgcgggcgtcagcggcgagtgtgtcagcggtgaggctgcc

SEQ ID NO: 12258 - DNA, 496 bp, Triticum aestivum
  unsure (1)..(496): unsure at all n locations
  Clone ID: PAT_TA_12258
ttttttttttttnttttgacgtccaaaccgaaaccatatgcttccaggaacaacatttcagttgctcaacccgtcgaatcacatgtttccagaaacaacatttcagttgctgaacgcattgaacagttcaggtgtgaatttcatgtggactactcggcattgaggcgagctgcctttgcctcctgtaatgtgcctagctacttaggtttatctgtgaggctgacaagggatttcacgatcccagggctgatcttgtcagcaagggcgcctttctcggagatcagaaatgacttctccttcacaaagctctgcagcttcttggtgtcgaagtctaggcgttcttgatcttcttccagaatagtgtgtgttgcatgaaatggaacacgggcaaaaatatctgatcctggaaacattagccaggtatgttccttggggtcgtggtttccacaagtcgagcatatctcctttaccagctgcttgcctgaggttccttcca

SEQ ID NO: 12259 - DNA, 650 bp, Triticum aestivum
  Clone ID: PAT_TA_12259
agccttccgccccgccatgacattaaagaacaagacattgcttagtagtagcatcacaagttcatatttatacaaccattgtttccgagaagattcataacgggggcactgtttttcgcccgatgagaaacgcaccattttgcctagtgccgttttcagcagcattagttagcaacaaaaaggtaaccagaatccctggcttcctgcaatcctacttcctcatatacaggtaccaccatccattggcagatttgttcagctccagccgatttcttcagttagcacatgctcccagtctgacgatccatacttcgaattgctacgcaaaatgccatcttgtccggtgatgtatgagtgggcagccaccccatccaaagtgcctccattcaacccttgacaagctccatatggcagaggcgcatggcgctgcgtggcagtttcttccaagcctgataggacatggccatgctgcaaattcttgggcagagcagtgtaccctttggtgcttgaagaacagctaagggcggcgtcgcctgctgaccgagtgcagtcaccagcataaggaagatattgaccgtttcttgctcctgatgtctccccgctgcccggggctgaggcaactccatacagattacttggatcggtactca

SEQ ID NO: 12260 - DNA, 600 bp, Triticum aestivum
  unsure (1)..(600): unsure at all n locations
  Clone ID: PAT_TA_12260
gcacgcggctttcgtctcgccgccggccggggtcccgctccggctaacccagccaaatggccaccgccgccgtccccaacggccacccctccgccgacggcgacgatagtcccccgtccccaccgccgtcctcgtcctcgtcctcgctggtgttcctgggcactggctgctccagcgccgtccccaacgcgcggtgcctgatccagccctccgacccgccctgcgccgtctgctcccagtccctctccgtgcccccggagctaaaccccaactacaggtgtaatacttctcttctgattgattattgccaagatgaaggtgcacacaagtatattataattgatgttgggaagacattccgagaacaacttctgcggaggtttgtttgccacaaaatcccctgtgttgattctattattctgactcatgagcacgcaaatgcaatcttgggacttgatgatattcgggttgtacagccntttnnncctacagaatgatattgatccaacccctatttatctctcccaatatgccatggacagcatttcccaaaagtttccatacttggtcaaaaagaaactaaaggaaggggnnnaggtn

SEQ ID NO: 12261 - DNA, 495 bp, Triticum aestivum
  Clone ID: PAT_TA_12261
aaaaactgaaaattcaaaaagattcttgcatgcatgcatgcgttgtcttggctttctgttttctttagagacgtgtgatgcgtcttccttcctgccacacgtgtggcagttagcgcgacccttattcttatacagtctggagaataataatggcatgctaccgcgtcacgatagacgtggcctagtagcctgtgatcggtgcaaatctttccctactaataaagcacggagtgcttctggtcgtacgtcgtcaccaatttacaaaaacgtccctctatttctgcaaaatcaacccgcaatccctattaagtggatctgggaaactattcgttttaaaaaaaaactagcgtcgcggcggtggccttggccggcatggaggtgagcttgcgggcgcgcttgcggtaggcgagcctagcccgcaagccctcccgttgcttggtgagggccttggccttcctgcgcgccttgtcggcctcggcgctggccttggcgggc

SEQ ID NO: 12262 - DNA, 886 bp, Triticum aestivum
  unsure (1)..(886): unsure at all n locations
  Clone ID: PAT_TA_12262
ccaaaattagcaatttgnagccacctantatgactatgtatcnttgggtcttaaatccacgttttgcccaaagactttcatgttctataantaangtatgctactaaagacaacaagctttaanggcatacatacacntaacaatgggtcaaaagaggtatgntattcatttacnganttatgcatcatctttggacngcagcctngcattaaaacaacatttgaaacaaaaagagcaaatcattcagcagggcgtccgcggacgcgtggggttacatattgctaataaatggtcaatgtttgtgggtgggtaattctggagaagcttgaggtttgcagtgaagtcgccagccaagagccgtcttcgaacaagaattagcattgcacagcagatccttaacaaggtagcctggggcccctctggatcacctaataacgcatcccacaggtggatgcagtcacggaacttaaactcctgtgtcaatagcagggtgatccatctgaacgcatagaactgtgggttaaccttggttacgacctctaaatgccgccagagctcttcatcatgccttttcaggagctgggatagtttactgattgtggagcgtataccaacaacactgttgtcaagctgcttgcaaaagttatctcgaaatccacttagcacctcaacanaacagaaaaaagcttctgactctgctgaagcctgttcatacaaaagaaaaatggaatctacacggtcatcaagcttccatgatgcataatgcaacgcattacgcatggtacaagggctaaagctatttgatattagcagccataaatcaataagatattcgctttggaaaattcaggagcggggtggccttgtgaaaatagcctcacaaag

SEQ ID NO: 12263 - DNA, 1253 bp, Triticum aestivum
  Clone ID: PAT_TA_12263
cgtccgaaatctggtcactgatggcccccccgcgacgccgctgccctgctttgggtttcaatcctcctgacaaggacattcatgaagaaaccaccaaggaggagcgcgactcactgatcactccctggattttgttctgttacctggtcattggcctcgacatcgtgtctacgccactgaggtcgctcgacatctcccccacccccccatctattctgggccctcgtctcgccgccggtgctcacgctggggttgcatcccagcgcatctttgtcatctggtacacccatggatctttcatgggcattgatctcactggagacggccacacgcttgtcagctactcgcagctctcaaactggggccagtcctctacctgggataacttcactgcctcgcccttcactgctggtgctagaactttcaccttcgacgacaacccctgcgaccacttccaggccggtaaagtgaaggctacgacgctgtctctatctgtgctccgtggcgatcgagatgttcaactcggctcaacgccctctccgaggacactagcctgctgaggatgcctcctgtgggtccagcccgtggctgctcctggccatgtcggtgtcgttcgggctgcacttcctcatcctcgcacgtgccgttcctcgcgcaagtgtttggcatcggtgccgctcagcctgaacgagtggctcctgggtgctccttgtcgcgctccccgtggtgctcatcgacgaggtcctcaccttcgttgtcaggtgcatgaccgcctcaggtccgaagcggcgtttaaaagggcatttatgcagcgtaaagtagctacatagacaaatatagtttgttaaatgactacgccgtggtaactaatcatcaacaaaaaaatgcaatttgttcagaatgttcggaccatgtatcagtggtcgccaaaggaagggtgtttattcagcgtataatatatatatatatatatatatatatatatatatatatatatatatatttctctgagatgcctaagaagatattcggggaactggaccccagctctcgcttctccccgaggctgcactcagctccgctggccgtgtttctttttagttgttattataggttccaaacctttgattatatatcctgtgaattacatgtaggtagtggttccttggtctcggagtgttggaatgttgctttgtttttgttgcgagctatttgcctgaacaggagtgcaaataattatacgtcaaaaaaaa

SEQ ID NO: 12264 - DNA, 619 bp, Triticum aestivum
  unsure (1)..(619): unsure at all n locations
  Clone ID: PAT_TA_12264
ccacgccggtgcgcggcaaccggcagctcgttcgatcttgcctgcgacgccagttggaacttgagtgtcactgtcactagtagtgcgccgatggctctgggaagaggcagtgcgaggaacggtgccgccggcctcggcgcggcggtgctgatgctcggcctgcttgtgatgagcgccgaggcggccaagtacacggtcggcgactatgggggctggaagttcaacgtcgccggttgggccaagggcaggaccttccgcgccggcgacgtgctcgagttcaagtataacggggcggtgcacgacgttgcggccgtggacgcggcggcgtaccagagctgcgtggtgcccaagggcaaaagggcgctgcgcaacgggcacgacaaggtgaggctggtcaaggggatgcactactcatctgcaccgtgcgcgggcactgcaaggccaacatgaagatcccgtcagggtcatctactgaaccacaagtggctactactggtttcctactgtcggccaacctggccattcgtcagttctttgctttgctacgccggttctcccttaattgctgctctgtcaatcgnaatcncattanaatccgtaattaaatgtcnagntncta

SEQ ID NO: 12265 - DNA, 1355 bp, Triticum aestivum
  Clone ID: PAT_TA_12265
catctagccgtagctagtactagaaaccctagggatttcccccggaaattagtcgtagttagcggtagattagagtccgtagctgtatcaggggttcgaagcgggcgagattggaggaagggccgagcaaatcatctgttctagggttgggattagcggcgcggaatcgaagcgggagtcgggacaggtctggaaggatctcgagatacgaatcgtacaggaaagatccagggaagaagagaggacagatctccaagatgcctgagcacagggaactcaagaggacggccctcaccgacctctctggcggcggcttctttatcaggagggtggcctcgccgggggctctggcagggaggcgggctgggaagccgctgccccggcggttcgcgtcgccctccagcaacaaggagaacgtgccgccagcttgggctgtgaaggctacgccgccgaggaggaggagcccgcttcctggctggtacccgaggacgccgctccgtgatatcacggtgattgtaaaggctattgagagaagccgcttaaggattgctgcagctcggcagcaaagcgaaacgcctgagcaatctccgcaacctgcgaacttgacgactccggtaccagcagagcagggcactcctcattctactgaagctcagggctcccaagctatcgcctctggttctggcttaactgaaatggttgcaaaccctgcacctagccaggcagagcacggcttcaaggtctattcttcgccatccaagagctcacagaagactccaaccaaacccatcgatccagcgctcgctgatctcatggagaagaaactgaccagctcaatagagcaaatcgagaagatggtgaagaagaaccagaagaaggccgctcagccttccaagagggccaaccaaaggcgcaccctcatgtccatgcgatgagttgagtactctgcttcactgcagggagaggagaaagtccatctcagactagtcctccagcccgccgtgtctgctgctttcttagccgctatcctgaccagtcaatcctgctcttcttctgtctgcccttcaccccaagacttaccatagcatgttatgataagatggggattcgtggttctctgcttgagggcctgggattatctcggttgttggttctctgcttgaggatctgggattatggggccggcctgttggttccctctgcttgagggtctaggattagcaactctgctagtgtcaggttaatgctactgcagtagaactgtttgtcgtgtactctagcacgcagcctaacaaatctttgttttgtgctgtaatttcagtaccataaaccattgctatacgctagctttatca

SEQ ID NO: 12266 - DNA, 1306 bp, Triticum aestivum
  Clone ID: PAT_TA_12266
cttcaagtccgcccctctaacccgctcctcctactactcctattcctaccttctacgcctgcacaccagcgccgatccactccatcctccccctcctaaccaccgccgccgccgtacctaacccccctctcccctgctctactacgcgcgcgatggcggcggcgacggctccggtcgaggtgcccgcggcggcgccggtgaggactgtgaaggtcacaaatgtttccctgagtgcaactgagcaagacattaaggagttcttttctttttcaggagacattgaacatgtggatatgaaaagtggtgacgagtggtctcaagttgcatatgttacttttaaagatgcccaaggagcagagactgcgcttcttctttcgggtgcaacaatagttgacctttctgttatcattgcacctgctccagagtatcaaccgccccctactgccctctgctccactgatgagtggaaccagagtaccagtgggtggtgacaatgtggtccacaatgctgaggatgttgtcagcactatgcttgccaggggtttcaccatgggcaaatggcctcacggcaactcgaaatcttttgatgagaggcatggcttcacatccactgccaccgccaaggtggcctccatcgacaagaagatagggctcagcgagaagttcaccatgggcactacagtggtaaacgagaaggtcaaggagatggaccagaagttccaggtctctgacaagaccaagtcggcgctggctgcggccgagcagacggtgagcaacgccgggtctgccatcatgaagaacaggtacgtcttcacgagcgcgtcgtgggtcaccagcgcgttcggcaaggtcgccaaggccgccaccgacgtcagcacgatgactaccgggagcatctcagccacgcccatccgctgatcctcaccccccatcccgtatatgtgcattgccatgttgtattacttatttggttgcatcagatgccatcttttatatttttttaacgcatgagatcaccccttccatatgtgaacttttgcaacccaggattattttctctctttgtagaagaacaggaaatttactttggggttttacatgttacagaactgttcaaggtagaattggaatgaaccttttacttggttattaagttgtggaagggtgctgtaataatattgctagtggctgtatttgaattgctcgcacgaaagcttatttcgtatggttgttgcatctctcgtgctccatatgtactgaattgctcgcacatctatcaagtgatggtgtaatagtgcttctattt

SEQ ID NO: 12267 - DNA, 954 bp, Triticum aestivum
  unsure (1)..(954): unsure at all n locations
  Clone ID: PAT_TA_12267
caacacattctgatgtatgagtacatgagcaacgggaatctggcaactcttctgtatggtgataatacgtcgagtttgagctggcaagagaggctacaaatagctcacgacgtctctcatgggattgagtacctgcatgaaggggctgtcccgcctgttattcaccgagacctaaagtctgctaatatactcttggacgaatcaatgagggccaaggttgcagactttggtctatcaaaggaggaagtatttgatggaagtaagtcaggtctcaagggcacctatggatatatggaccctgattacatgtccaccaacaagttcacaaagaagagcgatgtttacagttttggcataatactttttgaactcataacagccataaatccacaacaaggcttaatggagtacattgacctagcagcgattggaggggaaggaaaggtggactgggatgagatactcgacaagaacctccttggcgggagcattccggaagaggcaagggtccttgccgatgtcgcctaccggtgcatcaacaggagcccaaggaagcggccatggatatcagaggtcacccaggccatttcaaggctaaggcagcggcagatgactttgccgaggagcgagaccaggaccgtgctaaggaggatagagtaccagcacgtggagctcagcgatctcgccggcatgaaagaactcacgccggtaggagcctgaagtccctccttcctatttgatgaaatcatcaagttagttttgggcctttgaaggtgtctaacttgggttggaatagatgtaaataatcctcaaggtagagttttggcaaggatgacccgtctctcaatttgataaactgggcaaatttggtaatatgaacactcctaagtaacaaatgctagaaagtgtaaatcgatgaaaaaaaaaaaaaaaaaaaaaccncnggggggggcc

SEQ ID NO: 12268 - DNA, 569 bp, Triticum aestivum
  Clone ID: PAT_TA_12268
gggtgtatcttcaccgtccgccaacgcgtgggcggacgcgtgggatctgggaaggatgatatagttgatgacgttgtggacatgagatcaggcagtagtacaggtcagggggcgattggtgaacctttcaatgccactggatttggagagaactcaaatgcttctgagaataagctaagttcaatgcaagaagatgctggacctccatcgggttctgaacaggaagaacctgctgctgccgtttgcagtgagggccatgttgttggtgccgcgcaaaaccttatcttgcgtgccaatgttgattgccaaattgggaacgacgctttggaccctgcagtcctgcaaaaaattgctggcatacctgtgcccgtcactagtgttggagagaagcgttttagtgaattcgaagcaacggacacacttgaaaaggagacgtctactggtgatgggtatcctgatcagtatgatgaaatatctaccaaaaggaggaaagtggcggcttcttggcatgaaaatgcaggggccccagatactaaaatagagggaaatgcgaaaactgatgatcaaac

SEQ ID NO: 12269 - DNA, 946 bp, Triticum aestivum
  Clone ID: PAT_TA_12269
cgccagacagtatagtcatgactgctatgggaggagcagacccgggactttccagcaaaggtgaagaggcatgcactccacaagatcccagcaccaattgcagtgatcgacatgcgctgacgatacatcgacagcaagctcatcacccccactccccatggcccgtgcccgcgaccgggcccccccttcgtctcctaggttagttttggctccagtccccttcgctgcttcactcctgcagtgtacccgcgcttccattgctctgtttcactcgtacaaagaaccagtgcaacaaatgaaaggcgccgcatgtagcttgtgcagtaacaactacaggtactgccacaagccatacaaccatcaacgttgtctgtgctctcgctcactgagcagatcatccatgttggtgcgatgtatctaaaatgccttcatgtatcttctgtagaatatttgtccagaaaaacactaaccctctgcaaacatgtttctactctgcaagatcagagtcatcatcggcatatttaggagctgcgtttctaggcaggaattcttcgtcaggataagtatctgtgaataactgttttgttgattccagtatatctctgtagtccaggttttcatcaggcatggggcatgacaatacagtaccagatgttccctgtgtgatctcttgaacatacacacaactccagattagcactggctttgtatcctcgatgtttttgctggttgtctccaaatggccttctgaatcatctgaagcctgagtactgaaaagaacctccatagccttgtttatgtactgctttcccgtaaaggcatcggtgcagggagtagacagatatatcatgaacattccaggagggcatactgctacattgctgctcagcctgaagcgcccgaacagctgtagcttgctgctcttgtaatgattttggggggaaaa

SEQ ID NO: 12270 - DNA, 750 bp, Triticum aestivum
  Clone ID: PAT_TA_12270
tttttttttttttttttgcaggcaaaatcggtatttccatcgagcatggaaacgatggtagtatatatttgctatattcgtgtattgtccggtcctctcatcgtataaagaaaaaagggcaaaaattatatggctatctgtcactttgtcggtatgccgagcgccttcagggtaggcgtcaggtcgtcggcgctgcagccctcgaccccgatgatgtttgagcaatcgagcgcgatgacgtcctgtagcgggtaccgcctgaccgtgtggatcctgtttgcgggcgtgttgaactcgcccttcaggacgatcgtcttgtgaaggcctccaaacagctcttcgtaatctgagtcgccgctttcaccgacaagaatcacgacgtttcgcaactctatgccccaacgaacagacaagtaccttagagcctgggaccgtgatgcatgaattggaattacagatagcctggtagcactgtggttataaagagcatggcaacgcagtgactggattctcatcaacttttgcagctccttcaaaggaggtaaataatttggattgaccactctaaatgcaaggcaacttgttgaggagtgctctgcatcttcaaaaatgacttgtttttcagttcttccccttctttctactatcgaggaagcccacttcactaggtacttccttaaaccttctcctccccaacgatactcgatatgagactggtaagtacggtctaatgcaaatgtcacacgggaa

SEQ ID NO: 12271 - DNA, 415 bp, Triticum aestivum
  Clone ID: PAT_TA_12271
cgtccgcccacgcgtccgcgagtgcgtgggggcagggcgggagaaagtggcagcaattttcaagcatcagggatatgatgttgcagaaattccagatgataaacctcggcagctcatcagtagtaatggttgtctgaaggtctggctggtggaccgtggttgtgtaacactcctttgcaccgaggagctggagcaactttacaacggagattgctatatcatacagtacagctacgctgaagatggaaaagattatcatctgttccttgcttggtttggacaagatagtgtacaggaagatagagttgccacagtttcattgatgccaagcatggctgattcagtcaaaggacgtgcagttgtggggcaagtgcttgagggcagagaaccagagttgtttttcctagtattcaag

SEQ ID NO: 12272 - DNA, 754 bp, Triticum aestivum
  Clone ID: PAT_TA_12272
aaaattagaataacatgccacattggggctagaagtcttaagtaggattcacaactttatcgattattacatctcttagcacttgagctccagctagccatactagatagatggtcatacaagcattcaggaaatacatagctttagattatatgatgttcattaattccagcccccacatgtgccttctaggtcacatatatcattgtcatattccgcaattcaccatatgtgtagttgtagtagtcctcggctgggtacccttctcctcacctgcagtatagaaatttctatagggataaatgactgggtgacgtagattagttcttacagaaatatctctgatttgcatagaatcaagttggagcatgaacgtgctagtcatcgtagacagaacaatcacatttgtgtcctcatcataccccaccaaaagtatccacatgtgaccactaagcatcggctccggaaacaacccatccaatggagcaactttcttcaaaaactcccagccaacaacaccatcacggttggatttcctctcccataatttgattgtaaaattagacacaatggcgagaccaagtccattatcctctgtccgtaagagatgataagaaaactcggcatgtccattatgtgtgtctgctggcttctcaatcataccaagactctgcctttcaaaatcatgcacaaggacttcacctccaacaagcaaccagtaaagtacatttccaatcaggatgctgggtctcaa

SEQ ID NO: 12273 - DNA, 731 bp, Triticum aestivum
  unsure (1)..(731): unsure at all n locations
  Clone ID: PAT_TA_12273
attcttgcctttgcttctcaatgaaacatgtcacactatgtcaacactaataatagtgtgacatccttacaaagccctattttcacttagttacatatatgaaagtgacatcagcaatgcaattaaagaacaattaaaggatggagtatctgatgcaactaaagcagatggattaatcaatggcatgtggaaagctgcaatgctctcggtgggcggatgagctccttcaaccgttggtgctttagatactcccaattcttgcagccaagaatcaatgtcagcttcagtcggttcagtgcaaagtacagaaatcataggcacttatcatcacagcaacatcagtctctcatcaatctgattacatgaagatgaacatatgtgaggactaaactgaactaaattaaagatgcattagaagggtaatattgggataaatttgtagacacacagataagatgcaacaatgccctatgctcttgacaacccactgtagaggttccgaataacacaagcatatactttaggaggatccatttggtaggaaacccaataaaatgtaagagctatttattctaaaaataatgtaacaaaacaataactctagaaatgaaaggaccatactactataacatccattcatctaaatatcttatgaatcaanggggtgtttattcaaaatactaatgtaagaagaaaaaaatgatgcctagaaattctttatactgcaagat

SEQ ID NO: 12274 - DNA, 553 bp, Triticum aestivum
  unsure (1)..(553): unsure at all n locations
  Clone ID: PAT_TA_12274
cccgcatcgcggnatgcctcgtgggcgacgagaccggctccatcatctttactgcccgcaacgaccaagttgacctgttgaaggctggtgctacagccatcttgcgcaatgctaaaattgacatgttcaaagcttcgatgaggcttgcggtggacaagtgggggcgggtagaagctacagaacctgccagctttactgtgaatgaagagaacaacttgtcgcaagtagagtacgagctggttaacgtggccgagtaattgttgaagtttccctgcccttttcccgccataaaaacgaagcactatgaatgaatattgtcaagccgttggtaagcttgtttatttcttatggtggtagtagataagatcaagattgtatcacttgagctagaatgttcgatggatcaaactgagctttccatgcatcttactggattgtgattcctcttggcactgcttgtattgctgttgtaatggaacaagctcagcgtggcgccatgttgcgctgagctttagagatcaaacggaatgaactgccattacatgttgtgttg

SEQ ID NO: 12275 - DNA, 946 bp, Triticum aestivum
  unsure (1)..(946): unsure at all n locations
  Clone ID: PAT_TA_12275
cgtccctgaactctagggtttcccaaccccccccgaaactctagggtttcccaaccacccccgcaaccgcaaacccccacccaggcacgactcgatccgaaaaccaccccaccacccccggcgatgtcgacggcggcggcgcagcgcggcgagaagacgccgctcaggaagccggtgttcgtcaaggtggaccggcccaagccgggcaccaacggccacacccccccccgtcacggtccgtcagcgccaaccccgtccctggccgcgggcgcactgcgcgcgcccgcctcctcctccgcccgcgccccgcgcctcgcggaatgcctcagtgggcgacgagactggctccatcatctttactgctcgcaacgaccaagttgacctgttgaaaggttggatgctacagccatattgagctacgctaaagttgacatgttcaaagcttcgatgaggcttgcgggggacaagtgggggcgggtagaagctacagaacctctcagctttactggtgaatgatgataacaacgtgtagcaagtagagtacgagctgggttaacgtggctggagtaattgttgaatgttttctctgcccttcttcccgccataacaccataagcactaatgaataagtattatcaagcctttggtattctttatgattgtttatggtagtagtaggtatgtacaagatttcaagattgtatgatagaatgtactatgttctcaaactgagctttccgtgtttcgttcccgcttggcgatgctttgattgctcttgtaatctggctgtattactgttgcgaatggtagcgcggagcccatgttgtccaccgctttagacgatcaagtggaataaactgaaattaaatggagactgccaattacataaaataaacaatcaaactgctccctggggccggcccccttccnaatcccttcgcactgg

SEQ ID NO: 12276 - DNA, 659 bp, Triticum aestivum
  Clone ID: PAT_TA_12276
aagtaatgtgcttgcctccgggcatgccttacggcttttcccttcttgggcctttcatttgatccttacacacaaaagcaaaacacaccggccaaggccagaaaggaaagcctctgcacacatattggacaacatggatggactctgaacccacaacaaaagccaagaaaagaataacaaacacttccctgaaatgcttgcaagaatgcaaagaaagaaccaacaagaatcacattttggtcaaactggtaaccagactttgtgttcagccgatcatcaagctcctccacctcttcaatcactcactctcaggatctgtacacgttgaaatgtttcgcccatcgccgcgccatgaacgggtcaaggtgatcccagctctcggcgcagcagctgctcctcctctcgccgccgatgctcgtccccatgtctctgcccccgcagtacctgctgtcgctcttctcctcgaacccgacagcgacctcgcccgtccttgaacggtcctctcttccgccctccaggtagctgtaaccaaccagtatgaagccacagtctgccacaaggtcaagtgggatcctcctctcctcaccacccctcagctcccctagcctcaccactccaccatgctcccctatcctcaggtgggtgtcgcctatgacacc

SEQ ID NO: 12277 - DNA, 1222 bp, Triticum aestivum
  Clone ID: PAT_TA_12277
tagtgagcaggttgccgcatcaactaataaggaggttgattctcaaatccctaattatccaaatcttccccctcagctgatctgccagcttcataatgtcaccatgcatgccgatgcagagactgatgaagtttatgcccaaatgacactgcaaccgttgagcccggaagagcaaaaggaaccttttcttccaatcgagttgggtgctgctagcaagcagccgactaattacttctgcaagactttgactgcaagtgatacaagtacacatggcggattttctgttcctcgccggtctgctgagaaagtcttccctccattggatttttctctgcagcctccatgccaggagctcattgcaaaagatctgcatgataatgaatggaaatttcgccacatattccgtggtcagccaaaaaggcatctcctgactacaggttggagtgtctttgtaagtgcaaagcgactagtagcaggggattctgttattttcatctggaatgataataaccaacttctcttggggattcgtcatgcaaatcgtcctcagacaattatgccgtcttctgtgctgtcaagcgacagcatgcatataggccttcttgcagcagcagctcatgctgcggccacacgtcctcgtttcactattttctataacccccgggctagcccttctgagttcatcattccactggctaagtatgtcaaatctgtttaccacacacgtgtgtctgttggaatgcggtttagaatgctttttgagacagaggagtcaagtgtcagacgatacatgggtacaatcacaaccataagtgatcttgactctgtgcgttggccaaattcacattgtcgttctgtgaaggttggttgggacgagtccaccgctggtgagaaacaaccaagagtgtcactctgggagattgagccattgacaacctttccaatgtatccaactgcttttcctttaagactgaagcgtccatgggcttcagggctgccttctatgcatgacatgttcaatggtgtcaagaatgatgatttttctcgttattcttctctcatgtggctcggagatggggatagaggggctcagtcgctgaacttgcagggagttggagcgtcaccttggcttcagccaaaaatggattctccattgctgggtcttaagccagacacataccagcaaatggctgcagcagcactggaggaaattagaactggg

SEQ ID NO: 12278 - DNA, 768 bp, Triticum aestivum
  Clone ID: PAT_TA_12278
aaaagccgccactggatgtattggcatggtgcctctaagtccgtgtaatacataggatgatcatcctaactactgatatgttacttgccaagaagcggtcgtgttcaaacagcatactcacatagaacaatcagttgccataccatactctctgaccagcaccgtctatttccagaaaatctttcaatcatggaagagcaaggatgggaattcctcaagaaagatctgtagggatagatgcactagctcgtgcctgttcatcgcatcacaaccctcatcatctcagtttatccgacacacccaaatgtgaggtgctgctggcctagtcacgtaggatgactgagtccgcaatctccatcagcggctcgaggcactctggggcaaatttccgtgcaaacatgtatgagtatttcgcatttgacttcctcaactccctgatcaagttggccgacacctccccaggatgatacgtgtgtgggtggccctcgacttgatctgtccagttcaccctcgtgaggctatactgggtgcatccagcagggtcctgcatatccagcaatgtggggaagtagtgctcctccggatagcacgactaattgcgctcgccccgacaacgcaccctcaacgtcctcccctgcccctgggcccccccggccgtgatggctggccccccagtcggcacggactccggcgatccgccccggcactcctcagacggcacctccggcaacatcacagcatcaccgcgggcatagtacctatcatgaa

SEQ ID NO: 12279 - DNA, 748 bp, Triticum aestivum
  Clone ID: PAT_TA_12279
ttttttttttttttttttttttttttacgaatcctcacgtgcacatccttccaagagacaaaacaagatatgaatcctcacgtgcacctacttccaaatcgggcacatgcacaaaaaactacaacccagggacggactcaatcaacgaaactctacatggattcttgatcgaaagggagaaaaaaactccacatggagtcagtgcggaaagaaaatagaacaacacccaaccagacacaccaagcacacgcccaagagtcttaactggacaaactagcaaatctactacccgaccagagaaccatcagcaaaatcaaggtcttccgattcatgaaggctaccaaatctgctaccagaccagagcaccactaacaaaatcgaagactacgggttctgtgacgccagacaaacatctgaaaccgccaaaactgtgatgtgactgcaactcgacgcccaatgaagtcaacatagaccttctgagctgcctctcacctgaattatcaaggctcatcacttatcaggataacaactgcataggtagtgactaacaattttcgaatccttttgcagccaaaaaactatggcgtgcaagaagcttagtgcttatcaacaacaggacaaactagaacattcaagtgaaagtaccgatcatatgcaattcgctcaatcatgcaaccgatcagttcatgagcctcgatatgattttgatggacaaaattgtttgctcattaaacattctattacagac

SEQ ID NO: 12280 - DNA, 584 bp, Triticum aestivum
  unsure (1)..(584): unsure at all n locations
  Clone ID: PAT_TA_12280
gcggctgaactgacgggacgacgggatggacgaaggatcctcatccggggaggtggacgagggacatcgagctgttgcggtggacgatgtcgtcggggaagaggctccggctgggcagcggtgacgtggcggacggaggagggtggggtttcgcggctggagcggagaggttatggcggcctgggatttcgaatggcgaaaagggggcgatgggagggggtgaagcatgacttagggacgcgcttgtccaaaatgtagggtgtgttacaaaagtaccccccaccaatttgaactagcggccctttcggctcagggttagaagggggatttcgcgtgtcgggatttggcagctggagggagttttcgcgcgcgttgtaatttcgggatagcaaggcgcgggttgtgaaggcgccagttttgggagcacgatatctgaattttcgggatataacaagacgcgggttgaatttttgggacaagcctaacatgtagtaatattgtacttgtacgtaccaaatcaattcgcacttccctcaaccaaaaagaaaacgacaaaaataaaactattcacaccacacanagag

SEQ ID NO: 12281 - DNA, 946 bp, Triticum aestivum
  unsure (1)..(946): unsure at all n locations
  Clone ID: PAT_TA_12281
ggaactagtctcgagttttttttttttttttttttgcataccatgagaatttcattatatcagtaaggactaagaacaagaatgtactgtacagatggtatgaaagcttcgctctaatgacaaaattgcatgatgaaatctatacagtttcagttgtacattattgtggctttacttttctgatttctttaagctgcgcaacaatgttagcaaagcttccttcacattttggctccttgtttgcctcgtttcctctgaagtgacacgcaagctctcaagaccacggcccagggaggcaatcatgggaacagaaggtgcggcctcagcagcacactcaatcccatctccatgcttcaggaggccagcacatgcaaccaagctaaaactaaatgttgcccaaggagctattcggaaaggtcggttgtgcttctgcctcttttgcattatttcgtagaacgatgtccgcatcgccaccaggctagttctctctacagatgatattacggtgtgtgtcaccgcccgaatcttctctgctgaagctgtgaactgtaaaacagatgacttcgaaccagcacttaacaaccccatgagagaggagcttgcttaatacaacgccggcatgcctttgcagctgcattaagccatactttaagatcactggagttttataaggngccaacttaagaatggcagatgcctggatggttttcgacaaagatgaaaaaccnagaattgctgttcctcccgcaccaactgcgaccacaggtttctcagctatccagctctttttatcagtgctgtccgatggcacctcattgttatcactctcattttcgctctcatttttgttgccataatgattgaagcaactgccagctaattgtgtgatctccgaaggaacaggagtgttccagtgtctccttattccagctaagcagctggcatc

SEQ ID NO: 12282 - DNA, 843 bp, Triticum aestivum
  Clone ID: PAT_TA_12282
cgtccggttgagacaacatccatgaaaaagacgagaagtactaatcaaaccgagttagatcaatcaaaaaagtcctctcggaagatgcttacagagaagaactccggttcagacaaaaatgatattttgacaaaacggcagcatcacagtcgagcagctgagttgagcagatctgttaacccctctaataaagatgcctgcaagctttcacataatggatctgatgttgacggaactgacatcaatattacccacaagagaaattgtagagggtgcagagaacgtggcgttcctcctgtcctgataaaacaagagtactctagtgaatctgtggaagttattgaagtgagaaaagaccagcgaaaaaggaaacatccataaacaaaggtctggatctagaccaaactaaccttctggttctcccaaagcaagtgattccaaaggcaatagaaagacagaatataaagatagagcaaagcctggaaacccaggtgctgatgtaggtgctttcgaaaagatcattacccacaagagaaattgtagagggcgcagagaacgtgatgctcctgcggtccagctaaaacaagagtattctagtgaatctgaggaagttattgacataagaaaagccaggcgaaaatgtaaagatccagtgcataaacaaaggtctggatctagaccaaaccgttcttctggttctcccaaagcaagttgttccaaaggcaatagcaacgcagaatatggctccagagcaaaatctggaaacccaggtgaaccaacaggccgttttgaactaaagcgtcaaataagtgaacagataaagaccatacttctggatgctgg

SEQ ID NO: 12283 - DNA, 1004 bp, Triticum aestivum
  Clone ID: PAT_TA_12283
cgtccggttgctgcccaacacgttcacctacaacaccataatgacggcgtacgggaatgccgggaaggtggacgaggcgcttgccctgttcgaccggatgaagaagaatgggttcgtcccatacacaaacacctacaatcttgtcctcggcatgctggggaagaaatcaaggttcccggcgatgctagagatgctcggggagatgtcgaggagcggatgcacgccgaaccgggtgacatggaacacgctgctggcggtctgcgggaagcgaggcatggagagctatgtcactcgggtgctcgaggggatgaagtcctgcagggttgagctgtgccgagacacctacaacacactgatatgtgcttatggccggtgtggttcaagggccaacgcattcaagatgtatgatgaaatgacccgccgccggcttcgccccttgcctcaccacatacaatgcgttgctgaacgtgctgtctcgccaaggggattggaccgctgcgtgttccatcgtaagcaagatgaagagcgagggtttcaagccaaacgacatgtcatactcgctgctgctccagtgccacgcaaaggggggcaatgccgcggggatcgaggccatcgagagggaagtctaccaaggtaccatcttcccgagctgggtcatcttgagaacacttgtgatcgccaacttcaagtgtcggcggctggatgggatcgagagggcgttccaggaggtgaaggcccggggccacaagccggacctcgtcatcctcaactccatgttgtcaatatatgcgaagaacggaatgtacagcaaggcgatggagatgtttgagtcgatcgagcagtccgggctgagcccggacctgatcacctacaacagcctgatggacatgtatgccaagagcaacgagccctgggaggccgagaagatcctgaagcggctcaggacctcccagtcccagcagcagcagcagctcaaacccgacgtggtgtcttacaacacggtc

SEQ ID NO: 12284 - DNA, 755 bp, Triticum aestivum
  unsure (1)..(755): unsure at all n locations
  Clone ID: PAT_TA_12284
agcattatncgtaaacaaatcccggngaaaacaaatggcttaagnctggcggaaagatcggcagcagtcagcactcacaccatgtgtaagtggaataaattctctactgctaccaatatacaagcacaggtgggtgtcaccaaagcctaactctgtccctctccctcactcactaaactccagagggtcgtactaaaaaaaagccaaaaacaagttattaataccccaagctgaaagagaagagaaaacaatgcaccaattaactccaattggattagcttctgacactctgatgacggctgctctgctagctagccatgctctgatcgatccagccttttccagccagccccagggtccaatcttggctcagagaatccaaccacgcccggattaccaggcccgaatctatcgtctggagttaaattaaatcaaatccgtactccaactcgatgcaaggagctggttgcatctgtgagagtaccaccggcatcagcatgttgcctagttgcagttgggctgggttcagtaggccggcatgaggtgtgagatcttgccctcctcgccgggcgtggcggccgtgcggtcggtggagcggagccagatgcagacggcggagaagctgagcacgaggctgagcagcccgctgccgaggccgatgccgacgatggcgagcacggacagcccgtgccctcgcattggcggcagagggtacccgtacaggtcttgttccccggcgaacgagcggcattgaa

SEQ ID NO: 12285 - DNA, 794 bp, Triticum aestivum
  Clone ID: PAT_TA_12285
ctcgtccgcctcgcccggcggcggcctagcggttccggctcgccggagtcgcagcagcaggaggaggactcgtcgtcgtctagcgggtggcggcggggatgtacgtgccgcagtcgtcccgcggcgggggcggctcctccggggagcagcctagggtttaccaagtctggcggggaagcaacgagtttctcttgcaagggcggttcatatttggacctgatgtgagatccttgtttctcactatattcctcatccttgcaccagtgttggtcttctgtatatttgttgccagacatctgatgaatgattttcctgatcactgggggatttcagttatggttgtagcggttgtcttcacagtatatgatttgacgctgctgcttcttacctctggtagagatcctggtatagtacctcgtaacacgcacccccctgaacctgaatcccttgatgggaacaatgatactggaaatggtcagactccacaacaattgcgcttaccacggacaaaggatgtttatgtaaatggagttgttgtaaaggtcaagtactgcgacacctgcatgctgtatcggccacctcgttgctctcactgttctatctgtaacaactgtgtggagcgttttgatcatcactgtcccttgggttcgtcaatgcataggactgcgtaattatcgcttcttttatatgtttgtcttctcgaccacattactctgcctctacgtatttgggttctgcggcggctactttatttagttgaagcagagtttttgcttgataaaaaaaaaaaaaaa

SEQ ID NO: 12286 - DNA, 989 bp, Triticum aestivum
  Clone ID: PAT_TA_12286
ttttttttttttttttttttttttttttaagttcaaagctgcagggggccatggccccaccaacttttgataaaatatgtgaaaatatatttattttgtttaaggggaaagattcaagaaaaatagtctttttgccatcgcctgccccttattttcaaatccccatcgttcgtcttcctccgcccaggatttcaaatcctccgctgctccgtggcttctctcgtcagcctccgccctgctcctcgctgccgtctgcctccgccctgccccagcttctcctccgcacaggcgctcccagcccctgcttctcctccgccgacgctgctcccaggcgttgctgcttctcctcatcatccaggcgatggtgatccaggcaacttctgatccagcacccctgcggatccatcaccaacccttctccttctctgccccaagtgcagcagtttgatccgcagccatctccgtggccttctccatgaggacgacgaggtaggcattgcagcagcaggcttctccctccatggccctcctctcctcttgaatcgacatgagcatgagcttttctctccatggcctggcctcattccttcaccacgcaagaagatgagatgggaggacagtgcctgcacacgaccgcacaaaccgttgagatgtgatgtggagagaaagaacaacagaggtacaaggggcggaggggtctgatctgctacgcctcctgcgggctcgccatggccttgggtggaagagtctggacgcggcgccgtcgaggagggagggaggctggacgcggcggtcctccacggcgaccggagaggcgaagagacggggctcaagccggcggtgcttggttgtggagaagaaagaggctccagccggcggtcgtgtgctccagatccgccccttgggccgcgctccaggtccgccgctccacatccaacgcctccatcgctcacatacagcaccggcgcacatagatccagcgccccctc

SEQ ID NO: 12287 - DNA, 1213 bp, Triticum aestivum
  Clone ID: PAT_TA_12287
gttttgtaagcgatttcgtgccccttccgcgtgcgggcgagcgtccttctcccctttccccttccctcccgctgccttctcccccgcttcccgtcggggggcagcggtcggagctggccgggtgtgcgtcgtcgagtttgcccggatcccccgaagcgcgcgcggttccggcgggccatgggcacgccggagttccctgacctggggcggcactgcagcgtcggcgactgccaccagatcgatttcctccccttcacctgcgaccgatgcgacttcgtcttttgccttcagcaccgaagttatacatcacataaatgtccaaaggctaataacaaggatgtcactgttgtcatctgcccactatgtgctaaaggagttcgtctgaatccaaatgaagatgcaaacatcacctgggagtctcatgttaatatcgattgcgatccatcaaattaccaagagagcaacaaagaaaaatgggtgcagagaacagctgacattagcgaacataacattttccaacacaatcatgtgcaaagattgcagcaaagagcactgcctcaagcacagaatttggtcctgatcacaagtgcccgggcccaatcccctttgaaaacaccttcccctttgccaacatgctaagaagaagtcagaaagttgagccacgcgcgaacagcagtggcagtggttcttcctggtggagctccagccttttgaatgcagcatcaagtttcagatcatcggcagaagcaggaatgcagaaactgagcattgccaccagcgaagccgtccagaaggctaaggatggggtcaccccgagcagcagtggtggtggcctcgtggagcaatgtgttcagtgtccagcaaggttttccactgtgggggccctaatcgagcacgccgagaaatcccatgggaacaactcgcaaccgagccgtggcaaagtgacgattgatgcttgccccaaatgtagcaagggatttcaagatccggtgttactagtggagcatgttgagagggaacatggaggaacttcaaaagcataaacctgcccgtgagtcatttcacatgagtatgttatatgcctgattgctgtgtaatttactcctcatttactcgatttgattgtacctcggccgcgaccacgctcgaatcgtgcacatgaaagaaagtcttatctcaaaaaaaaaaaaaaaaaaggcccctaaaaaaaaaa

SEQ ID NO: 12288 - DNA, 816 bp, Triticum aestivum
  Clone ID: PAT_TA_12288
gccccccgaccccgcgaacgaacgcccaaacctctgcccccctcccttggctcctcctcctcgtgactccctcctgcggcccctcccccctccctcgccggtcaaaccctaacgcgcgcacccacccacccatgcgcccgtccgtccgtcaatcccttctcccatggcggcgctctccgtgcctctccgcaccgcggcggccctgtcctcgtccggcgccggatcccgcgccgccgccgacccctccaaggtgtcatgcgtgaggagcaccggctccgctcattttgactgcagcttcccctccattgcggcttcctcttcatctgccaggaacattgagccacttagagctatagctacacaggcacccccggccgtcccacaatatttgagtggggagaagacgaaggttggcatcaatgggttcggacggattgggagattggttctgagaattgcaaccagtagagatgatattgaagttgtggctgtcaatgatcctttcattgatgctaagtacatggcctatatgttcaagtatgactccactcatggcccctttaaaggatccatcaatgtcgtggatgattcaaccctggagatcaatgggaagaaaatcactataacaagcaaaagagatcccgcagagattccttggggtaactttggagctgactatgttgttgagtcttctggtgtttttacaaccatcgataaagcatcggtaccccggccgcgtcctccctagaaagtggtgatatctgctccatccgcagatgctcccatgtttgtggttggagtaaatgagatgagcta

SEQ ID NO: 12289 - DNA, 620 bp, Triticum aestivum
  Clone ID: PAT_TA_12289
ttttttttttttttttttttaggtcgtccagataatcattcagtcagcgagcgatgcctggcataaaagacttgatacaaaataaatcccaggaataattataatgaccataagcatcctaagggcaggtattatatccatactaagatatccggagcacagcagtagcatgtatctaggaaatcggaactgacaggagatacagatgtttcagtctaaattaaacaaactggcgggatggtgggcctttctgaggagactagtcagatgggtcaaattcttttatgctcttgacagtagccctttttcttgaatctgagtctaattcatccagatcagaggaaattgctaggcacccataaagtattctctttttctcacccctgctatcagtctcaaccagcatagggtttgtatcagggtctaagttgtgagtagcctgtgcacgtgaccaacctacacgtccatgatcttgcctctcaaaaaactcagcaaggcgctcagcctccttcaagccagatgggttgttcgcgaacttgataagtgtcagacccaaatgcccttcctttccatacaaggacttcgacttgccaccagcaaaccctagttctgcaattttc

SEQ ID NO: 12290 - DNA, 599 bp, Triticum aestivum
  Clone ID: PAT_TA_12290
cgtccggtcgccccgatctgcgagatgtggcgcagccgcgtgtcgcgggcctccgggagggcaaggccgccgccgccgccgcgtccaggcgcttctccaccacctcgtcctacacggtggtggatcacacctacgatgcggtcgtggttggagctggaggcgcggggctcagggccgcgattgggctctcggagcatgggttcaacactgcctgcatcaccaagctcttccccacgcggtcgcatactgtggcagcacagggagcgtataacgctgactcttggggaaacatgagtgaagatgactggaggtggcatatgtatgatacagtcaaaggaagtgattggctcggtgaccaagatgctatccagtatatgtgtagagaagcaccaaaggctgttatagagcttgagaactatggattaccattttccagaactgaagatggaaaaatttatcaacgcgcttttggaggccaaagcttagattttggaaaaggtggtcaggcctatcgatgtgcatgcgctgctgacagaacagggcatgctatgctacacacactttatgggcaggcgatgaagcacaatactcagtttttt

SEQ ID NO: 12291 - DNA, 2343 bp, Triticum aestivum
  Clone ID: PAT_TA_12291
tcccggcccgcgcatcgttgcacctgctggactccctcgtccacatcttaactctgtacacttccatccttcaggcgtttatggggctgggggcgtctttcctggaccatcccgtcgggatggagggacccctcgaaacagtcgccgtggaggagtccagggccgcattggtctgactgcgaaatggcgtgcgctcaatgccgtcttctcagggccgccgacatatgcaatgtgagatgcaagatgaagctgcagatttccggacccaggaaactgtcatcggaacgggcggccgggttaggaaagcaaagaaaagcttccctgatctccagctaagggcacaatgtgtcatataggagacgtactaacgaggcactttacagtttgaacgactatgaataaaagcatggtttgtatatcaacgaaacatgaagggtttggcagggagtagaaggggctatccctcgtctaagattggaagaagaatagatggtgacagtggcgttggaagtactgattatcattttggggataagaagatggtaagattagactaccaggtcatggaggcaagaacatcttggttagacacgattcgcaagactttcaagccgcatgagcagcgtgtacctaatgctcaggaagggtgacaacgtttcgtttgcttagatgagggatcaaaatacccagtttggtgtttaacttaatgcgctggaacttaccgtgaacctatattgtttcagacgattcagtaccgggatatatatacggtgattgatccattaacctttccggatcaacgaacactggttttcaacctagtgatgatgtcagtgcttgcttctttgaacgtttagcccatacggataaagatgatgcctatggtgaggttgtttctggatctatgaccatggaaattagagaaggacgtggtgtaggtcctatgaaggaccatctctacctgcaccttaatcatcttcctccagaagttctgaaggaaaggcttcctggtatatctgagactgctgctatttttgctggtgttgatgtcaccaaagagcctattcctgttttgccgactgtgcattataatatgggcggtatcccgacaaattatcatgggcaggtggtggatatcaagggtgataacccagacacaattattcctggtctgatggctgctggggaggcagcttgtgcatctgttcatggtgcaaaccgtcttggtgcaaattcacttcttgacattgttgtatttgggagggcttgtgcaaatagggttgctgagatttccaagccaggagagacacagaaacctcttgaaaaagacccaggggaaaagactattgcttggttggccaagctgagaaatgctaatggatcactgcctaacttcgacagattcgcttcaacatgcaacctattatgcaaaataatgctgcaggtttccgcacacagggaactctaacagaaggttgcgagcagattaagagaagcacatagaagattccacaatgtcaagctcaagtgccagatgtctcatatggaaatcggaatttgatagatgaccacagaattagaaaacctgcaaaaagatgcgtgcttaacaatgcattcctgcagagtttcgtacacagaaaactcgagcacaagcttgtgaggtgattaagtgaagcgcataaaagtttccatgatgtcaagctcagtgacagaagtctcatatggaattcggacttgatagagaccatagaattagaaaacctgctaataaatgcatgcataaccatgcattcagccgaggctcgccaagagagcagaggagctcatgctcgcgaagatttcaagacaagagatgacgacaagtggatgaagcactcgctagggtactgggaggacgaaaaggttagactagaatacaggccagttcacatgaacaccttggatgatgaagtcgagactttcccgccgaaggcacgtgtttactaatccggacaaggctgtgaacgcctgtctcggttgtttgataagggtatagctcacagcgcggtgtcttccaagttgaaataaatttgcagggaccctccattctctcaaaaggttcagaactgtaatataatcgggaatcgccagtatactttccctgaccagtgtaaccttgttgcaaagcttctgatgattatattttggtcctgtatcaccctttggttggtaggaataaagacgtgtacccaaattttgatggtgtttgacactgtaaataagtagatctctgttccaacttcacactgtcggggccccgtgcctttgccccctgggtgctccctcttccaccgccgggggcct

SEQ ID NO: 12292 - DNA, 925 bp, Triticum aestivum
  Clone ID: PAT_TA_12292
ctattccaccgcgtaccccgttgccggggcgggctgcgcaagcccgccctgacgactgtcatagtgaatgttcactcatattaatcccgtcggcgtcggagcgacgagattgttcatcacccccaaccgctgcgcccaccgcaggtttacctcctcgcgccgcgccccctgtacctccgcatcccttgcatctcccgctccccttctggacggcccgctggcgcccgcgggcgtctccgccccggtgcgaacagaggagccccaaatggtaagtcgctggcgagcttggagaaggtccactgccctccgtcttctcctctccctcacctcggtgtgcccccccctcccccttcttgcgacctgcttccgcccccggctcactggccggggttggcatgcccagaccccgcactctcttgtttactttccacccctattttaccaggttcgcctccccatggtatccccctcctcggcaggtccctgctccaatataatgcatgaatgcaccccatccaaatcctctgatgaatggcaagtttgaaaatgagaatcatgaccaggggcgtaatcttcaactgcaacgattacctgagatcctccagaataatttagtgcgtaaccaagctcatatggatcttgattcttaacatcagtagttggttcgtccacgggaattactgccaactcgtcgaagtgcccctattactcttgataaaatttatccatagttcctctctaggagatccggccggtgaagcaaatagggctgattggtgaactgttgtgatcgactgcttgatacacatatcataggtggaaggagctttgtggcagaaaaacaaaaggagtcctggagcaatcagatcagaagcaacaagccaaccatcatgttcccggtaggccgtctgaatgtcgcaacccg

SEQ ID NO: 12293 - DNA, 540 bp, Triticum aestivum
  Clone ID: PAT_TA_12293
ttttttttttttaatctcaaaaacatgcactctgaacttttgaacgtttactctgctgctctcaactcgcaactgcttttcacgttcagatttaaggcaaataaaaaaggagtggaggggagcagatttgtccagaaatacgactggctagaacagaataatctctccctctctcttagaatacacacacacatgcacaagcaagtaaatcaaacttcaaaactgaatgaaccacacctgcagtcatacttttgttgcgaccaggccaggcggaggcgggacacggtggcactggcggctgacaccgccgaggtggacaagctcgcatacattctcttctctgggttcacgaatctcgtgtccgcctttccctgttcccccttggctcctaccgcacgtgtccgcctttctcgacgcggcgtaggaggcgaaggaggtggcacgtggaagccttcaactggcctcaatcagacccgtccgcacccttttctgaagtgcccatgcctctactgctgccttttccctgcctcaacacttgtt

SEQ ID NO: 12294 - DNA, 901 bp, Triticum aestivum
  Clone ID: PAT_TA_12294
tgcggcacaagacccaaacagagtcagaggaaagagttggagaggcaaaaacgtctggagggagagaggaaggagctggagaagcaaaagcagagggcgaaggaggaagagacattgaaagagaaggaacatgagcggaggaaaggtgagcatggtgtggaaaggggcagcaaaagaaaggttggagaagataggcacgacccaaattcaaacagactcagcgatgatgaaaatagggaccgaaagacgcgtgaagattatggtcgacagaaaactacagattcagataggtatgacccaaattcaaacagatatagtgatgatgaaaacagggaccggaagaggcatgaagagtacggtcgacacagagctagatattcagatagccatgatttaaagaggtctagatatgatgactcttataatcactcgaggagggattacgaagagcgctattctagagatgagcacagagacaggaggcatcgttgaacgcagaagttatcttaaaatgcatctcatttctatgaagcgaagtgccacgctggtacatcttattgagcaaggacagtaacattggcgccattgaagaaggctcagtcacctagcgcaagatttcggccatatgtttactgctagttgtccagcaacgctgttttgccgctgcggtgaagttttgtttgctcatgtttgtatggactttctcctctcttttgtcagtcttgagtatgtaatgtggaggttatattgttacaccggtggcatcatgttgcccagcagcagtgtgggagatgtatctaacctatgtttttttgtcgttggagatgatgacccttgctccgacgctgtcttgaggccttagcttgccttgatgctcactttacaaaaaaaaaaaaaaaaa

SEQ ID NO: 12295 - DNA, 1578 bp, Triticum aestivum
  unsure (1)..(1578): unsure at all n locations
  Clone ID: PAT_TA_12295
accaggcccgcgccgccacctaaaccctagcatttctccttgccatgatccgtttagagaagtgtagtcgcctacaccgtccaccaccacactagtccgcacttcctacggcacgaccatctccacactccagatcccactatcaacgacgactgcatcatccggtgttgacgactcctttctccgcacgccaggaccgccatcgacgatctgcgggtgcttcaggccggcgacggcgactgagttctccacagggccggcctcgacggcgactgtgttctccacagggccggcctcgacggcgactgagttctccacagggccggcctcgacggcgacttcttccttgccccccgtctgtccagatccgacctccttggctatttccggctgactttagccatccagctctgacagataatggcacgtaaaagagccatctttagaaacttccccaagtggtggcttttcaaattaaggaagcggaaagcacgtaggcttgctccactgcctcccccatcacctccaccactgcctcccccaccatctcctccgccaccccaatcacctacaccacctcccccagctattcctgagccttattttagccctgttacccacaatcaagagcgccgtgatcaaattgccaatgctctagttatgcttgctattggtgatcctgaagctgaagatgagagttatgatacattcattcctgtcatcaatcttagggcgcatcaaggatcgtattgccttctttttgagagtgctctaatgaaacagcgtgaagacgaatctccatttggtcatcatgtcctaaactttcctcttcctgatgacactgatgttttacctgtgcccacagatgctatgcaaacaaagacctttgagaatacagaaggggaaataagtttgactgtgctatcttgtaaaacagaattccatcactgtgattccattgaatttggaggagaggttgtagtgggtcagaagttgttcttatatgacctcagatatggcactccttcactcgtcgatggccatgtgacctgtgtaggttcagattcttttgtgctggatgctaactacatgtgatggttttgtgaatggagctcttgtatttgatgatgaaaatagactcgttggagtggtgtatcatcaagtcggctctccagtagctgtcaatattgatcgtttagaggaactcttgttacaaatctttcctgggaatcagaatatggatgacttttaccagagtttagagcaaatgtgagtggccccagctccacctcagggctaaggcggtgcttaaattggcgccttggctgtgctttgctgctctgcttcggctgtgtttttgccaatcaatgttgtacttgcgtgtctgctcaacaacttctggcagctacttgtgttagcctatgactatncccaagctacttgtgttagtcctatggactatccccagactacttgtgttaggcctatgactatccccagccacttgtgttgactctattagcctatggctacccctttttattttgaagttgttgccgtaaaaaaaaaaaaaaaaaa

SEQ ID NO: 12296 - DNA, 870 bp, Triticum aestivum
  unsure (1)..(870): unsure at all n locations
  Clone ID: PAT_TA_12296
gctttggnaacgccttcacacctcttcttcttctttttgcttgttctcttgtttttttcatgtggaagggactgcagtcggttccactgcgcggtcccactgacgtggccgctcttcttcttcttcttcttctccggcttctccgtctcctccttcttgtcctcggcgattgttccgcttcctgcgtcgcgtctctgaggtagtcaccaggccgccgggcaactcctgcctgttttggagtgtatcatcaatgtcaaccagaactttgccatgacaagcatcctttaatccaacaacctcaaaaatcaccaagttctctctttttgatgtcatgactcgtctaacctgtctcagttgcataacataggataaccaaattacagacttgcagtcatcgtgttggataccctgtaagtcttaattgcaagaacccacatatctgcaggaacttggaatagggatacttgcttcttgaactgttgattttgaattttacccaatagcttatccagtatatggttcatgatttgttcaggattgcaacccaagtacccatgtattatgcctgaccaagtgatccctaacttgtcattcaaaggaggaaagccaggaattttcaatggtgactgaacacatagtttgatatcattggagcattgaaatacaattcaacattgtaggcagactccagtacacaagctgaagaaccagggcagatccctgccaccatcatcttagaggactgacaacccaacttgtagcccgagctgactttcgtattcgtactgttcgctgagatctactttccaaccgctcaagtattgagtaagttatcgagtcaggagttaacccttgctgcttcatagtctc

SEQ ID NO: 12297 - DNA, 675 bp, Triticum aestivum
  unsure (1)..(675): unsure at all n locations
  Clone ID: PAT_TA_12297
tttggncacaangcaagattaattttgaaaggaaaggacttgtagtgaacatagaaaaaattgatgctcgagtgacttctaatatcatctaaaatgtgcaagataaaataagaggtcaagccaatcaagtgaaagacgtttgaactggaattagacacattgtacatcatcaatcattaggagttggaccccataggagtgaaagacgtttgtctcctggtctcaagtagatcacattagaatagaaacaacatagggagtggcggtggcacttgtcgacctttacgctgaaacgggaagtatctgatctcaagtcgaaacacagtagcatcaacagatgcaatgggcctatcctctgtgaaaccaaatggaatttgctagccagaaaatgtgccaatccattagcttcacttggacaatgcttgaaacaaattccaggaatttcatgagcaatatgaaaacagtccgcaagtattgctacattgggacccaaaatctcaatttttccactacgtgcttcaatcagttctagacaatttgattcgactgtcaccttggtgcacccaatctctgaaagaagcttcaaaccttgcaacagcgccaaagtttcagaagtttgggcattaagaacatggtcaattagctcggaagctcctgcaacagcttcccctcgag

SEQ ID NO: 12298 - DNA, 1496 bp, Triticum aestivum
  Clone ID: PAT_TA_12298
ggacagaggcttccgtcaagatccaaactcctccccctcccggctgctcgctgctttaagactccaccgtccgatccgggatctaccaacccagcgcgccggagatcccaccggagcccgccgcagcctacctcgccgcctctgtcgctgagccggttctagcgggggcaccgcattctattccagattctacttttgcctttcgaaggactggtgatactgaagttcttgtgatggctgccgcaaacggactagtccatgcatctgccaagaagcccttgttcacatttggcgtcattgctgatgtccagtatgccgatatcccagacggccgctcgttcctcggcgtcccacgctactacaggcacagcatcagcgtccttcaaagagctgtcagcacatggaacaagcaaggcaatatcaagttctcgatcaactttggagacaccatcgacgggttctgcccaaaggacaagtcgctgtgggcggtgcagaaggtcattgacgagtttgagaagttcgatggcccgacctaccatatgtttggcaaccattgcctctacaaccttcctcggagcaagctggtggcattgttgaagatgccgacggattctgatcgcgcgtattatgacttctcaccatgtcccgagtacagatttgttgttctggatgcttatgatttcagcgcacttggctggcctcacgatcatcctgtgactgcagcagcattgaagctcctcgatgaaaagaacccaaacaccgacaagaacagccctgacggtctttttggtgtcgacaggcggtttgtgaagttcaatggtgcagttggcaaggagcagctgtcctggctcaacgatgtcctccaggatgcatcggaccgccggcagaacgtcatcctatgcagtcatctcccaatggaccctggcgcagtgtacccagcagctcttatgtggaactatgatgaggtgatggctattgttcgacggtacaactgtgttaaggcctgctttgccgggcacgaccacaagggtggctactcagtggactcccatggcgtgcaccatcgcacccttgaggctgcgctggagtgtcctcctggcaccagtgcattcgggcatatcgaagtttatcctgacaagctattgcttgtaggctctgatggaatggctgatactgaaatgtgttttcggtcctctgatcgagctgcgttgtagtgtaaaatccacgtgacttcattattttgacttctggtgatgccattgagagaaaactcatgtgacttcctgttgtctgacgacactattacttgtaaataacattgaaagtggtggaataaataatggaactgttgtaatgctcacttcaccatttggccactgctgaagggagcatagtgttaggctctatcattcacgtgtcgtcgtgggtaaatgtaacaaatgcaatattattttggatggaaaattcatgtaagtggtttcagtaaaaaaaaaaaa

SEQ ID NO: 12299 - DNA, 678 bp, Triticum aestivum
  Clone ID: PAT_TA_12299
cgcagaaagtatgcgtgatcccatttatcaaaccagagatttgaacatttgatggcatccattagaaatacaaggagggaaacataaggaggagcagacaactacagagtcataaacatctagcgggattcaagggcagctgacacagggcggatacagagcctaggcgcgctccccgcggatgcggcgggcgagctggatgtccttgggcatgatggtgacgcgcttggcgtggatggcgcacaggttggtgtcctcgaacagccccaccaggtacgcctcggcggcctcctggagcgcggagacggcggaggactggaagcggaggtcggtcttgaagtcctgggcgatctcccggacgaggcgctggaaggggagcttgcggatgagcagctccgtgctcttctggtacttgcggatctcacggagcgcgacggttcccgggcggaagcggtggggcttcttgacgccgccggtggccggcgccgacttgcgcgccgccttggtggcgagctgcttcctgggcgccttgccgccggtggacttgcgggcagtctgcttggtgcgggccatcggagctgcgggaggcgggcggcggcgagggatggcctgctgctgcggtttggagatggagatggagactgagattgagattttcgcggtagtcccccggccggc

SEQ ID NO: 12300 - DNA, 633 bp, Triticum aestivum
  Clone ID: PAT_TA_12300
agaataaaagaagcgatgcgtgattccatttatcaaaccagagatttgaacattcgatggcatccacaggacatacaaggagggcaaacaactacagagtcataaaacagctagcaaccaagcgcggcggacggggcgcgtgcagagcctaggcgcgctctccgcggatgcggcgcgcgagctggatgtccttgggcatgatggtgacgcgcttggcgtggatggcgcagaggttggtgtcctcgaagagcccgacgaggtacgcctcggcggcctcctgcagggcggagacggcggaggactggaagcggaggtcggtcttgaagtcctgagcgacctcccggacgaggcgctggaaggggagcttgcggatgagcagctccgtgctcttctggtacttgcggatctcacggagggcgacggtgcccgggcggaagcggtggggcttcttcacgccgccggtggccggggcggacttgcgcgccgccttggtcgccagctgcttcctcggtgccttgccgccggtggacttgcgcgccgtctgcttcgtgcgggccatcggggctggggggtcgtcggcaaggaggggtgctgctgctgctacggtttggagatggagattgagattctcgc

SEQ ID NO: 12301 - DNA, 2416 bp, Triticum aestivum
  Clone ID: PAT_TA_12301
ttatctttttatttgcgtgttgccaaaaataaccctgcttccttttatttatcaagacatttgacggaaagatgacatgcattaacaatacaaggagggagaacaaaaggaggcaaagaccaccaaacaggaacaaacatctgccgggatccaagggcgactgccacagagcggacccagcgccgacccgcacgccgagctgcttgggcgtgcgagcaggggcaacaccgtcgacaggggtcggcaacaggtggggggcgcccagggcgcctgccgaagggagccgcccgacccacggatgcgtcggcggggctggggggcgcggggcggggggcggacgggatgcgcgtgccgggcccggcgagtggggcccgcagggtggcggacgaggcaggcccaggggggtttgcctggaaggcggagacgtccgcggcctggacgcgggggtcggaccggaggtcggggtcgatgtcccggagcgggcgcggggaggggagcctgcgggggaggagcgcgatctgcttcccgcactggtggctctcggggggggcgacggcccccggccggaagcggtgcggcctctccacgccggcggcggcgcgggcggagttgcgcgccgcctgcgtcggcagcggcttgctcggcgccttgccgccggtggacttgcgcgccgtctgcttcgtgcgggccatcgaagcttgttggagaggggagagatgctgctgctgctgctacggtttggagattgagactgctgccgatgcatagtgggacttcctttgttgtgaatgattctcataatgtggaagaaactcagaaggcagagcttttgccaccaaaagaggagcccactgctctgctcgaaaacaaggggtcgttgtcattatggaattttgcacggaacagggagagtggtgttcatgagccattctttcagggaagaaacacaagagataaatctgaaactgctgactcaaacactgggtactatgttggcttaaacgttatagacattgacaaagataatggcaatccacaaatgtgtgcttcctatgctgcagagatatacagaaacctaatggctgcagagcttataaggagacctaaatcaaattacatggagactttgcaaagggatatcacgaagggcatgcggggcatcctgattgattggcttgttgaggtttctgaggaatataaacttgtgccagacacactatacctcactgtatatcttattgatcaatttctttctcggaaatatattgaaagacagaaactacaacttcttggaataactagcatgctgattgcctcaaaatatgaagagatctgtgcgcctcgtgttgaagaattttgtttcataactgataacacatatacaaaaaatcaggtgctgaaaatggagtgtgaagtgcttaatgatctggggtttcatctttcagttcccacaatcaaaacgtttctgaggagattccttagagcagcacatgcttctcaaaaagctccttgtgcaactttgggctatctgggcaattatcttgcggagttgacattgaccgattacagtttcctgaaatttcacccttcagtggtggcagcctcggcggtgttccttgcaaaatggacactcgaccaatcagacctgccatggaactctactctcgagcattacacctcatacaaaagttcagatattcaaggatgcgtacgcgatctatgggagctgcagcaaggcaacaccagcggaagtccccccctcaatgctatacgtgagaaataccggcaggaaaagtttgaatgtgtagccaacatgctgtcgccggcgatgcctgggtcgctcttccatagacaagctaacggcaccagccccctgctgatcaacaactcgtagcagcgcagcgtcagccccctgctgatcaacaatttgattttttccgaagatcttgtagcatccccttcccaccaccctctccccctccgatctggctgtgttgttatttccccccgacctttttcgagtcgtgcagtcgtaggcgatggctcacataaatgttgattgagttcctgcgtaggctgctgatggatgcctagggctggtaattgtatgatgatgatgatgatcctgtctgtctgtctgtctgtctgtatgataactgagtgagttccgcttgatttaacgtaggtttgcgggcgtttcccagagtttagtgagtgcaattgcagtgcagtgctcgctcttgagattaggagagcaactctagtgagtccaggatggttgatgtgatctgatgtgatgtaacctgttgttacaagaacattcattattgcttggtttgtaaatgaacataaatgtagcctgactgtctacatcatgctgaaaaaaaaaaaaaaaaaaaaaaggcccctaaaaaaa

SEQ ID NO: 12302 - DNA, 598 bp, Triticum aestivum
  unsure (1)..(598): unsure at all n locations
  Clone ID: PAT_TA_12302
tagcgtggtcgcggccgaggtacaacaaaactgtcaaatctgtctgtctgcaaccaagaaaaagactagctacaagttgctcattgctgctgcctataactacatcataccataccataccagaccagaccatcaaccaacaaccgaatccactatttccatcatagatccgcccgaccgaccggcgccaacatcttcggttaaactgatcatactcgacgacgacattcattatactaactagacttcttcttaaacccacgcaggagaggaacacaaccaacccaaccaaaccctagaatcatccatccatcatccactagctaagctagcctaggctcaacttccgccgtaccaaactaaacagtctacatcgttcactcccggttcgagtttgatgtccgatgccgcaggaccgcgactccatctgccgcatcatgcccgtccacccgctcatcatcccgtccgacggcagctcctcctctccgcggggcatcggcatcagcggcgaagggccctcttcctccgcctcgcctccaactccgactccgtctnccaaagactttgatttctcataaggtgccggcggagtcctata

SEQ ID NO: 12303 - DNA, 1332 bp, Triticum aestivum
  Clone ID: PAT_TA_12303
gaattcggcacgaggcgcctcgggctctctcgatacaattctattcatcactcagtatcagcacgctcccgactgagcgattccagcgtggagagcccttccccggcggcggcggccaaggccacggctctcatccgaccctctgcagcgactccctccgccaacggcggcgcccatatcgacggtcttcgtcggcacggtcgtctatgacgacaacgctctcgggcgtggcggcaccggagcggccaaggacaaggccatccaaccttccagcgcgggcggaccatgagcggccgtggtggctgtagcggcgacgccctcgggcgtggaaaacggcggccctcaccccggcagaagagcttccatgcggcaacctcacctcgtgaatgaagaacagggcattggcgtccatctatctggaaagatcgagaggaaaatcaagggatcaaggaatgaatcggagtcataccttgatttcattgctacaaggtgcttctttccgatttattaacgcatatactaattgctatctgaaattagtacctgtagccctcgtcattgcagcgcacgcatcggctgccctcagccatgcgacaacacagaggcatcgagcccttgacgcaccagcggccggcgtcggcgaagacgactagcgcagggccgcgcctcacgccctcgtcgccacgcggtcgtccgcgctgctggactcgcgccctccgcgccgccgtggcaacaagcggcaacgacctccggccggcaagcttatctcaagtggccgcgacggcgttggtggtttgctacgaatcaatcgattgggttttaaccacacgaacagatagagggatagtgaatcttatccttttgtgacacttcaatttagtcttccaactttattgtatgtccggataagcccttgcatttcttccgttgggacctctggcttgacgtgtcttgcggattagtccatagattattctgtacgatgcaaatcagcctacggcttactgtaagttgcagtttaggctttctctctactgcaaattttactttgaaagatctcatatctctttatatcacatttacaatatgtaaatgatgatttcagatatactttgtgaaaatgggacatgttcaatgtatttgctctctagcaattcctataacatgttatgcattgcgattgagattacgttttcgtgcacagcaatattgatttgcgattgaggaaaaaatctcacaaaataattgaagttgagattaagatgtattcagatcttaagttgatgtaacatattttcacgtttatcacatgttgagattgattatgtccat

SEQ ID NO: 12304 - DNA, 700 bp, Triticum aestivum
  Clone ID: PAT_TA_12304
gaccggtccgctcccccccgctcgccccaccccccccgccgcaccacaattctcgatctgaatcttcatctcacgccgacgcgatgtctcccgatgatcaccagattttgtttcgcagctaggtttccccctcccggcgtgctcccgcatgttgtccctcgccgcccaacccgccctcacgcaccacctccattggatccgtcgccttgctgctgcgggcgtggatcaagagcaaggaagccgggagggagcgatggccactggccgcctcacatcgaggttgaaggccatgaccgctttgtcactgtcgtcatgcgctccgcgctgggagtcgccgcctctttggccgatgtggcgccagggtcgactcgggctggagcttcctgtgcggcgagaagccatatgtctaatgccctgatctcgcgccggagcgtgcgcaatcgtcctcgcgcgtggaggcgcagatgcggccgtcgcctccaggttgttgggatttgcaaaaggccacgaccacaatagtgcaaggatctgctgaagcagtggttgtaaaggctccgcgtgagtgattccgtgcaaggggaatgagagttctagaaagaggtggaagataatctgttcaatcttttcaaagatacattggtgaaatgcagcaaccagataaacgaaatgcattactccatcaccacactgatgctccatc

SEQ ID NO: 12305 - DNA, 650 bp, Triticum aestivum
  unsure (1)..(650): unsure at all n locations
  Clone ID: PAT_TA_12305
gggtaagtattcccgccttcgccagggctatggttcccgcagtcgccgtcggggctgctctcaccgtccggattctttcccttgctgagtccacggtggagagatatgtagcatcggtcagcagtcgcccctgtaacatttgacggtagggaggtagctacagtgatgggaattggttcatccggcggaggtgaaacaggtgggttgtagctctcgacaccaatatttgttgctgttaattgctgctgtgcggttagcatcagtctgtaaggcttcggtaaaggctgttggttacatatttgtaattgtataactggggaaatttttcaatttgttcactttcttggctgcaaaaggaggacagtaagaactgggaatgttgtagtgtagattcttgagtggataggcttgaaacatgtaattgtacttttagttcaagaaagatgagctctttctgacaaatatttcgctcatgattgctgttggtatgcctattcagggaacataaatatttcccccccttttcttctacttgtattttcgagagggaaggtaacttgtcattatatcatagccctgcttttctggnaaaaaaaaaaaaaaaaaaaaaaaacacctcggccgcgaccacgctaatcactagtgaattc

SEQ ID NO: 12306 - DNA, 596 bp, Triticum aestivum
  Clone ID: PAT_TA_12306
gcaggttcaaagtcatctgcagcatgatcagtctggcggcccacgaataacaggtacattccaggggcttaagatcatcaaacaaacacagggatggagacaattatttgctggtctgagcctcaattatatcaaggtggtaccctcggtggctattggtttcaccgcatacgacacaatgaagcatttgctgaagatacctccgagagagagcataaagcctgagcaaggttctggttgaagcttctatccacaaaagaaggcacatctatgaagtgccagttggaggcttcaagcctcatcaagtccatgattgttattctccctccgtaaaggaatataagagcatttagatcactactatagtgatctaaacactcttatatttctttacagagggagtacgtagtaattgtgttgcgtacttaccccagctgacatattcttttcgttatattttttcgaattcatttttattttttcaccaacatgtatactttatccactaggtggaatgttgtcactgggtagtatttgatgatgaaattacagatacgcgaaacagacttgcagtgctaaaaaaaaaaaaaaaaaaa

SEQ ID NO: 12307 - DNA, 648 bp, Triticum aestivum
  Clone ID: PAT_TA_12307
gcgcggagcctccaaagttgggttcaatctcttctacagatcaagcacattcaagaaacaacgtagatgcaaagaggggagccgcctcccaacaagtcgttattcgcacagaggacttgagggctgaagttactgttccatgctgggatgatgttgccgtgccaagcagtgagactagagagtacaaaagttcagggaagaagagcattggttatgtgctggatgagtgggatgaggagtacgaccgtggaaaggcaaagaaggtcaggaaagcgagggaagacgacgacgatgacggcatgaaccccttccaggcggaggccaactacgtgtcagcgcgtaagacgaaacagaattcctacaaatccaagccttgggacaagcccgccagaccgagtcgctagactttgctgaaagagatggcgccccgaggctccgtagaaagagaagagaagtgttgttgtattgccaatttttcgaaatataccgtctgctgttcctttttttcccgccttgttgctcctttttttcaccttgttgtttgactagacggctcgaaatagacagaactcttgatcggggcctgtataaaattgtgagattctttgtagcgcagccggagtagtagaacatgttgccgtttttcgc

SEQ ID NO: 12308 - DNA, 2987 bp, Triticum aestivum
  Clone ID: PAT_TA_12308
gggccgggttgcaacatttatgagtgattctaaaggcacagattacaaatacagtctttatggtgtcttggttcatgctggttggagcactcaatctggtcattattattgctttgttcggacttccagtgggatgtggcacaatcttgacgataatcaggtacgccaagttcgcgaggcagacgtactgaaacagaaagcctatatgttattttatgtacgtgacagaattgggaacacaatggggcgcaaagacaaccgcactcctaatctgcctgtaaacaaaatgatccctgggaagatttcatctatcaatggtgtaatcggaagtggtgtaatgtaagcaaaatcgagtggtctgacatctccttatgcaaataagaagttgcagagtactagcaatgcccattccggcgttagcagtatgactttagtagaccattgttcaacaaatgatggcaaagctgaaattgctgcagcccctcaaaacagtgtcctgcctgccgcacagaaagcccttggatctcaaaatgatggtgctacattgtcaactaaatcaaagcaagttgcttcaagtagtcataaagagacatcttcatcaggtcaaccggcgagcagcaatcagacaatggctaagatgtcattgcagggaccaaaggctggtggtgcatttgccaagctgggaaataatacttctattgcctcatctatggtcagtggtcccgctggactgtcagagacagataaactaacttcttgctctcaaacatgttccaagccaagctcgaacttggttggcacgattaccgggtttaccgtgcaaactttccaaactaaggatgctgttgtttccatgggctccccccgccgccaggccggcgggacccctagtcaagaacgaaaacgaaaaggaggaacacagcgcaccaccccaatttccgcccgcccaccgatcgatcgaagccccggatggcctgaagttactgttcctcgctgggacgatggtgccgtgccaagccgtgcgcctagagagtacaaacgttcacggaagaagagcattggttatgtgctggatgagtgggaggaggggtacgaccgtggaaaggcaaagaaggtcaggaaagcgagggaagacgacgacgatgacggcatgaaccccttccaggcggaggccaactacgtgtcagcgcgtaagacgaaacagaattcctacaaatccaagccttgggacaagcccgccagaccgagtcgctagactttgctgaaagagatggcgccccgaggctccgtagaaagagaagagaagtgttgttgtattgccaatttttcgaaatataccgtctgctgttccttttttttcccgccttgttgctcctttttttcaccttgttgtttgactagacggctcgaaatagacagaactcttgatcggggcctgtatttaattgtgagattctttgtagcgcagccggagtagtagaacatgttgccgtttttcgcagcatttttcgttcttgtttctccagcaacatagttatgatttgttatgaataaacatttgttctcgtttcaaaaaaaaaaaaaaaaaacactcgagacctgcccgggcggccgctcgaaatcactagtgaattcaactccaaatggtgtcatccctagcactagcggtggaggtccagtttccagtgagaaaaatgaaggacttaacaggatctctcaagcaagatgaccacatagtgaaggctttgacataggtcgagccgctggattctgtccactatgtgctcttcagaagaaggagaaaaccatactaccaggacttgaacaagttgatgttggaaaacagatctcctcgcaagtttccacgaaggtggttccaggcgattcatctcatggtccgtaattcaaggcagaatgatgctctgactaaaagggtaacttgtgtgaatccataatgaagtcgtggctgacgtaacaaaagaagaagcataagaaaaccaaaaagcgtgttaaggacacggccagtgttgattgttctggtgacaacagcagtgagcagcaaacatcaacatcagcaactgtgccgcccaaaacagcagaatctacatctcgtaaacggaaatattcccatgccagtgtaagttctgaaaacaacacccaagcgctcaaagacaggcagcaggctgttggagcaagtagtgctggtgccggtgatgataacatgaacaccaaggaacaagaaagagtggaacttctgctagcgcggtagcctccaaagttgggttcaatctcctcctacagtatcaaggcacattcaacgaaacaacgtaaatgcaaagaggggagccgccctcccaacaaatcgtcattcgcacagaggacttgagggcgtcttggttcatgctggttggaggactcaatctggtcattattattgctttgttcggacttccagtgggatgtggcacaatcttgacgataatcaggtacgcctgggtcgaggggcacacccgcggaaacgcaaagcctgtgtggtatgcgatggacgtggcggacgacgacggcatgaaccccttccaggcggaggccaactacgtgtcagcgcggaagacgaaacagaattcctacaaatccaagccttgggacaagcccgccagaccgagtcgctaggcttgccgaaagagacgacgccccgaggctccgtagaaagagaagagaaagtgttgttgtatcgcccatttttcgaaatctaccatctgctgttcctttttttcctgccttgttgctccttttttcaccttgtttgactagacggctcgaaatagacagcactcttgatcggggcctgtatttaattgtgagattctttgtagcgcagcgggagtcgtagaacatgttgccgtttttcgcagcatttttttgttcttgtttctccagcagcatagttatgatttattatgaataaatatgagttctattttctctaa

SEQ ID NO: 12309 - DNA, 1072 bp, Triticum aestivum
  unsure (1)..(1072): unsure at all n locations
  Clone ID: PAT_TA_12309
attcggcacgagggttttgatnccactgtccttgggtagggcagtgtattggaaagagaaactaccgcttcttccttatgtttgtatcttcagcaactgtgctatgcatatacgtgttcacattctgctgggtcaacatcgggaaaataatggacacccatgagtgcacatttggtagagctatcttgaagtcgcccatctctgccattctcatgttatacacatttgttgctgtgtggtttgtcggaggattgacctcattccacctctacttgatttccaccaatcagactacttatgagaacttccggtaccgctacgatagaagaagcaatccttacaaccgtgggctggtccaaaatttcatcgagatcctatgctcaaggattcccagctccagaaacaatttcagggctaaagctaacgaggattctgcagccttcgcctcaacgcttagcatggggcgggtcctaagcccgccgaagatgagcgtggaccttgagatgggtacgaaaaggcaagctgtgggtgcagaagacatggaggacttacacagccagattggcagttctatggggcttgagcgatgcggcacagaacccccacattttgtcagccgaaagggttgctctgaaattgcatctgacattgagacgtttgcagaagagtttggcatggacaacaagttcactgagaggaaaaagactgtgcgccatacaaatgataatccttaaggcacttacctcacaaaccccaccttaaccttgggtcgatctctatccctagctcggagcggcatagctcagaaagaagatgagaaagtagggcgaatggtagaacagattcgcctttttggctgaatctaggtgttatttgtagatcaactgattagcaatataggcatgatggaacacggattgatggaccggatggtttcactggatccatcttggtttagaatgggttgtactgctagtgatatggactgtacctgttagttcatatgttgtaggttgcgtacgtttgtgtgtgccccagttatcgcttttacttgagttgtactgtaacttat

SEQ ID NO: 12310 - DNA, 1169 bp, Triticum aestivum
  unsure (1)..(1169): unsure at all n locations
  Clone ID: PAT_TA_12310
gccagaaagctgtgccgcccctctccgcccccgagcctcccttgccgcgcctcgcgtcaccatggcagttgcatccgcgccacgccgcctcgcccctccgctctcctcgcccgcgccgccggccgcgcgccggggcagcacccccttccgctccccctccccgcctccctggcccccgcgcggggcacggaccgcgtctacgacccgtgcaccgacaccaagatccagcgcggggacgctttcaccttcgggccccgccttcgccgccaccggcgccttctactccggctccaccccgtctctccccctgcgcccggccgcctcacccatcccctcgacagctctcccctcttccgaccccaaggtcgacgagatctccctcctcaccgacaacaccaccaccggcatcagccccgcctcagctggtgggtacatggtagcatttgctggtaggaagtatgcagccagatctcaaccagtctttgtctccaattcctcagttacagtgtccaagcttcaccctggttcttgaattcaacaaaggcaagcttcagaacctgcactggcaagaaggaacagggtgtggtgcctgcacagggaagccaaacttcatctgcctcggcaagcaaacctgcgccatcagaacaaacatctgcaagagcaataaccagggatccatggactgcagcatcggcatccagctggccttctcgggcacagacaagcacgagtcggtcctcaactcgtggtacaaggtgtcgaacctgcagcagtactcgctctacgggctgtactcgaacgtgaaggggtccctgagcggccagttcaacaagttcttctaggctcctggaaggctggaatgaccgtttgtccgtagccctctcctgccactgcctgtcgctgtactcaaggggagccctaggtttgcctgcccgtccagctgattgtacgcaaactgatctagctcgtgtgggaaaatcaaagctcatcgatatgcatgcatgtacctattgcgagtcattttatgctgagtatattatttgtattaccctttgcattgaacttcaaatcatgtgacggatcgatcgttcgctgtcgatggcgtcgtgtgccgtactgaagaaacatccgtcatgcccgatcagaatgcgcgttgatatcaanacaaa

SEQ ID NO: 12311 - DNA, 1080 bp, Triticum aestivum
  unsure (1)..(1080): unsure at all n locations
  Clone ID: PAT_TA_12311
gtgcccatccgccgctggtccgacccggacccgctgccgccgtccgcggcgccgacgtcttcctcacccgcgtccccgacgatgaagacgaagggtccgacgatgaggacgacggggaaagcgacagcctcgggtggtccgggtattacggaggcgaaggcgacagagccgggtggtcgatgaccgggtgtcgcgatgggtacgtggttctcgtcaaccggggaaccaagcgggcggctgtctacgaccccctcacacggagcctgcatctcctccccgcgccgcccgttgagatctgcgaagaccccgaagaggcggaagtcgagttccacgtgatcacctcggaagaggaccgccggtcactccgcgtcgtcttcgtctgcaaggaaagggggaaagtgcgggtcgccgtcttctcgctggacaccagggagtggcagatctccccaaaaggggcgcgcctgcagctgcaggacgatgacagtggtacgctagtgaacgggtgtgtctactgggcatccgtaagcgaagacgctattcatctgctgaacacggcaacactgcaattctcccggatggttctgccgcggcgtatgcggcgaatgggtctcaaggtcggtcagaccagtgatgggaagctctgcttggcctgcgcatctgaactcactcttgatgtctgcttccggagagcagatgacaatggtgtcgataaatggatactgaacaggacatttgagttggtggacgacatcgacaagctccggctacagtttgtagatcgtttcccaagactggaggtcgtggccatcatcggtggcattgtgtatctgtctactttccaggtagagcatcctagttcttctggctgcttcctatcattctgcattgaaacagaggagctgaaggaggtctgccctatcaccaactctgattcttcatatccctacatcatggcgtggcctcctgttttggtaggcaataaggtgagctctctcggctagaaggggcttgactagtaagaggaataagaaaacttgaagtcggtcattttatctgtactcggatattaccnttttatta

SEQ ID NO: 12312 - DNA, 776 bp, Triticum aestivum
  Clone ID: PAT_TA_12312
acgtcctgtcttgcgacaccaatccgccgaccgccggcgagcccctcctccttcacgacccaggccctcctctcccttcgtttccgaccgcctacctcctccccaacccccggcccggcggcgacctcctcttccttccccggccgaccctaacttcctcggcttatatggattcaccgccctgatcgcacaaccagacatgaaggcattcgtgcaaaacctcctcggtcagatgcaaacaaggtttgagtctatgtccctcgaagaacatctcgaaaaatagatgaaatgggaaccaagaatcgatcagctgggagcagagcgtcaacgatctcaaaggctgaagatgggccaccaccgaccgtaccagtcagagaagcgcgacgaggcaaacgcctgccgcataactcgcataactcatggagttaggcaaggagattgggtagtgaaagatttggaggactatctgacagattgtttcgtatcattcatgtgttatctcgagggatcatagcgcttgtattactgtgatgttctacctactgctgcgggtgctacctgtagctctcaagagcccagacacctttataagtcgatagattgtttccttatgatcatgctcgtacctgtaggtttgcctgttcaaagctgttgctgcaagagccaggcgatgcctcaaacaatttttatggcagtcgggcctattgggttgttcccctatgcaaggttggtgcccctaactaattttttggtaaaaaaaaaaaagtgagccccta

SEQ ID NO: 12313 - DNA, 1132 bp, Triticum aestivum
  Clone ID: PAT_TA_12313
ggttgtacagatgaagaagaccagcgcaaactttggtaatctgtttacagaggaagtacttcccatgtgaagctacaaatatcatacttcagctgcctacaaagaacaaggaatggaagtgcagatttaatccaggtcggcgcaacctttatttgggctactttgtccgtgaaaactgtgttcaagagggagatatctgcctctttcaaccaatagcaaaggctaaggaaggaagatttacagtaattgtccatcttcttcacaaagagagcgttcatcattcccctggtggaacagcagggatgacacacacggctaccgacggaagaacaggcgcaaagacatccttaacagcccgtgttaaggaggaaccaaccactgatggcgaagatatgtcatcattgggacctaaagaggatggagacaattctgagggagctcctgaaacccccttcgtactgccagacagagcctctataacgccagcacaggagcagaaagtgtgggagaaagtagaagccattgagtcgacagtaccagtttacgtcgcgatcctgaacaagtgcaatgttgctcgcaaatccggcatgatgataaacatgggaaagcagtacgcgtcaaggtatctcgaaaaacagtactttactgggcatcatggaaagaagaatgtgatcagtctggtgcttcagcgggaggggaagagtaggacgtgggacacggagctgcgacgcgggactgatcgtatgatgatctgtaaaggatgggttgctttcgcccgtggcaaccacctgcgggtgggtgacctctgcctcctcaagctgatggagagcgaggagccgctgaagatgatggtttacatcattcgccgtgagaagtgcttacattgagtcctggttgggcacttgggctcttgctattctgattatctctaaatgtttgggagaggaaggaacttgtttatttatctactgtcagaggttatctcaatgggttattagttctgtgtgcgccttgttattatctagactctagaatgtctttggatggtcaagtatgaactactagttatgtggttctgaattctgatgagttctgtcagcactttgttatgtagggtaacctggggttaagt

SEQ ID NO: 12314 - DNA, 1085 bp, Triticum aestivum
  Clone ID: PAT_TA_12314
gcccccccccccccccgcctcctcctcccccgctccccgcccccccgtcccctcgcccccccgccgtcggggcggagccgcagcgcgagccgcgccgccgcggcggacgagacctccgtatccgctaagctcggccgcgccgcgcatgcaatgagtgccgccgcccgcgggccaatccgtccatcaaccggtggaacggccggccctactcggcgcggtacctagagatcctcgagaagcgccgcacgctccccgtctggcagcagaaggacgagttcctccgcgtcctccgcgaccaaccagaccctcatccttgtcggagaaaccggaagtggagcgagaccactcagatcccccaattagttctcgaggctgaaggtctgagcaaccgctctatggttgcctgcacccagccgcggagggttgctgcaatgtcggtctccccgcgtctcgcggaggagatggatgtcacaatcggggaggaagttggttacagtatccgattcgaagattgcagcagtcacaaaactgttctcaaatatttgacagatggtatgcttcttccggaagcaatggcagacccacttttagagaggtacaaggtgattgttcttgacgaggctcatgagcgcacattggcaacggatgttctgtttgggcttctgaaggaagttctaaagaacaggcctgacttgaagcttgttgtcatgagtgctactcttgaggcagagaagtttcagggttatttcagtggtgcaccattgatgaaggttcctggtagacttcatccggttgagatcttctatactcaggaaccagaaagggactatctagaagctgctatcaggacagttgtgcagatacatatgtgtgaacctgctggtgatatccttgtattccttactggagaagaggagattgaggatgcgtgtcggaaaataaacaaggaagttaataacatgggtgatcaggttggcccagttaaagtcgtgccattgtactctactctcccccctgcaatgcagcagaagatttttgaccctgctccacctccattgaaagaggaaggtcctgctggaaggaaa

SEQ ID NO: 12315 - DNA, 1215 bp, Triticum aestivum
  unsure (1)..(1215): unsure at all n locations
  Clone ID: PAT_TA_12315
ggttggcttcgctcgaaaaanaaaaaggtccatccccaccaggctacacatccagatgcgccaccgcgctaccgcctccgattcgcagccggggatggaagatgtcgttgctggccttcacagaagtaattcccatgctacctagctctactcgttggttctttttctctaatttctgtttgcgaacataggatgcaagccctaatcatggcgattggcgatctggggtggaccaagaagcagggtcgaactctttgagttgggtgttaggtcgttggtagcaggccatccatgtcacggcggcattgagaacaaaaaaatggttgctgcagggaggctgattgtgatggatctgaggcagaggatacacaccggccatggtccatgaaaagtatatatcggagtatatccgtataagcatattgggggagaaatagctatttgcggcccttttagttgctcatgtttctggatttgtaccaacgtcactgtaaggacggtttggttttggagtacatattcatccaaataataagcaaacattccgatatcgtaactttggttcagccgaagatgttaagcctggaaatttaatgccgaccgcaatggaggaagttagaacttaagacattggtgagaaggaaactcagatggctgggtgtaacttctgtagaaatcgagttgcataccacttcataatttgggctggcttcgatatttgctgtgcgccgagtctgaacatctcgcgtcagagtctgttggcttctattgtcctggtggtggcatagttgagtcatggcatcgtagagctggttggcttcaattttcttggtgtggcgcagagtcgtgagttgctgggtatcttagatttccatggtgggcgatggctgggtgtaacttctgtagaaatcgagttgcataccacttcataatttgggctggcttcgatatttgctgtgcgccgagtctgaacatcttgcgtcagagtctgttggcttcaattgtcctggtggtggcatagtcgagtcatggcttcgtagagttggttggcttcagttttgtaggtgtggcgtagagtcgcgagttgctgggtatcttagatttccatggtgggcatgtgcagctgatggatgtggcaggctgtgtatttttatggatgagttctcgccgttgtctttatggagtccttgtatgtttatatttccaattaaaggc

SEQ ID NO: 12316 - DNA, 1256 bp, Triticum aestivum
  Clone ID: PAT_TA_12316
gcacgccttcaagttgctgataagtgagtgagaagagaaggcgctcatcctgcgccgccgctgccgcaggatcctccatgcccatggcgatcactgggcagtacagctggaccttccagagcccgcttgcctggagggcgtacgagaagagcggtgacgctgccctgggcgcgtggtgtgaggaccgcatctcggccatccagttggtcaccgcgagattcatcgtctgcatccactggtcctcgaggttggcgccgagcattttgacgagggtctttgcagcgcctctgcactttgggctggtcagctgggtcctcagtgagtccaggcacccacggcggaggtcgcggggcccctcgtagatgcagaccaggaaagcaagtgacaagaagactatgttgaacgcgtcgctgaagctgccgccatggagttgctgcgccccggggaaccggaaggacggcttgctgctgttgtccggcccgtaccacagcacctggttcacgatgtccacaaacagctgcaccatgtcttgctcgtccagggattgctgcgccttggttttcaggtggaccggtttcgacgtccacaggaatatcggctcgcggtagttggcggagatggagaaggtgaggtaggaaggctgggtgggaggtgttttggcaaccgagagggtcattgatgtcggctgtgatgacgccgacgctgaaggcgtggcgcagatgcagagggacatggtgttggtgcgccactgggagaatgggggcaggctggtgatccaaccccatgcatcaggcaccaagttgtgagccattgtggtgttggaagaagcctgagctccttgctggccttttataaagagggaaagaaggcgatggcgcggcggatagaacttcggtttatcgcatatgcttgagcccaatgagcgcacggcaaagtctcgggtaaagtagattcttggttggagggagagatttatctggtctagatgctgattggaaaatttatctgctactaattgagactcgaagaatctctctttatgctgccgtgcagtgctgaacgtgaactgctgttatatataccacgcgtttcatgctcaagttggtgaccctgatgacaaattgtactgttcgggaggaaacttgtgccgtggctgctgtcaactgggaatcggaacccgaggaatctcacattgtactttcgtgaagctttgcaatttatcaactccagacgcacgccatttatccttctctttg

SEQ ID NO: 12317 - DNA, 542 bp, Triticum aestivum
  Clone ID: PAT_TA_12317
cgttccgcccacgcatccatgatagcgttcctcctattcctcttactcgctctcgccgccagcaacaccgagcacggaggtgcagttgctgccgccgacgacccacctgccgcccttaccatcctgacactgcacggtagccacgaaaacacctccctggccgtgcagacccacgacctctccctcgccggcttcaccgacgagagcctccactggcacgccttcccaggccacgagcatctgatccccacgtccaagcccctgccgttcggcagcagctacagcgagctcatcggcggcctcgccaacctgccgggcctgccgctagggcgggacgccatgatgcacgccgtccgtgtgctctccgcctacgacccggccggcgacgcaaagccagtcaagtgggctctggcggccgtgaaggtgatgatctgcgagtccgggcggctgaagcccatcagagagaccgtgagaagcggatgggacaagcgagtccgcgtcgcccccgagcatcttgcctacatcgagcactgggacaccat

SEQ ID NO: 12318 - DNA, 886 bp, Triticum aestivum
  Clone ID: PAT_TA_12318
cgtccgcggacgcgtgggcggacgcgtgggccgtcctggcagcgttcctcctattcctcttactcgctctcgccgccagcaacagcgagcacggaggagcagttgctgccgccgacgacccacctgccgcccttaccatcctgacactgcgcggtagccccgaaaacacctccctggccgtgcagacccacgacctctccctcgccggcttcaccgacgagagcctgcactggcacgccttcccaggccacgagcatctgatccccacgtccaagcccctcccgttcggcagcagctacagcgagctcatcggcggcctcgccaacctgccaggcctgccgctagggcgggacgccatgatgcacgccgtccgtgtcctctccgcctacgaccccgccgccgacgccgagccggtcaagcgggctctggcggccgtgaaggtgatgatctgcgagtccgggcggctgaagcccgtcagagaggccgtgagaagcggatgggacaccgagtcccgcgtcgcccccgagcatctgtcctacatcgagcactgggacaccatgggacgcgcaattggacccggcaacccgccaagatgctggagacccaagccaacatccgcagccaggaggaggcgctcgccgtcgtccgggtgctgctccatgccgacttcgagcaggtgctcgaggctcacggcaccaagatcaacttccagtgaacatgcatgcatgcagctgcttttagacttcagatttgtgctccatctcgtatcgagtcctatgtttctttaattaaccatgttcgtgttgttacttcaatcagcttgtgagcttcaatatgttctgctcacgaaatacaatggtgctaaaactttgacatttgaaaaaaa

SEQ ID NO: 12319 - DNA, 834 bp, Triticum aestivum
  Clone ID: PAT_TA_12319
cccaaccacccccactccggccgaaaaactgcacgattcaatccgttccaaaacaagggtagccgtcaccatggcgagggcaacgacactggtgctcgtggccgcgctcgccgtcctcctcctcctcgcctccggccccgcgggcgccacggcccgcccggacctcgcccaagggacgtggcaacggcatctcccgacgagaaggtcgctgtggcggcggcggaagaccacgagtgcgagatgatggccggcgagaagcagcgggatgagtgcatggcgaggaggacgctcgccgcgcacaccgactacatctacacccaggagaagcacaactagtagccttcatatctgcgtccatgtaatgatgttattgttagtcggcactgcgtctgcgtgttcgatctctatcctatagcttcctccatgaacaagggatcgatcccaccgtgcatgcatgcatgcatggcgcaattatgtattgcctaaaataatttagtaattcgataatcaaacttggttttaaaacaaaaatgtacaaattccatacattttgctcggccgatccttatacaacggtatgtacatggtaaaaaaccttggctgttaccccataattaaatcagctctggcgtacacactcaccttttagtcacctgttgtgtctctcttagtatacatagggttctctcccaattcgctctatttcacaacatttccgtctaatcctattaggttcagtcgctatttgcggctaatccgtaatatatttggctaaaaaacgtggaattcactctttctttcgcaccaaactacactaatatctctccatagccg

SEQ ID NO: 12320 - DNA, 1070 bp, Triticum aestivum
  Clone ID: PAT_TA_12320
cggccgcgtgggatccaaagttttggatttgtgaatttcgaaagtccagatgaagctgctctggctgttcaagatttgaatggcaagaaatttagtgacaaggaatggtatgttggaagaagcgcagaaaaagtcagaaagggagatggaattgaaagagaagtttgaaaagaaccttcaagaggcagcagataagtaccaaaacaccaacttgtatctgaagaacttagatgatactgttgatgatgaaaagttgcgagaactttttgctgagttcggaactattacttcctgcaaggttatgcgtgattcaaatggcgcaagcagaggttctggatttgttgcttttaaatctgctgatgatgcttcccgagctcttgctgaaatgaacaacaagatggttggcaataaaccactttatgttgcactcgcacagcgcaaggaagacaggaaagctaggctgcaggcacagttttcacaaatgcgtcccgttccaatggctccaaccgttggtcctcgtatgcaaatgttacctcctggtgttccagtcggtcagcaaatgttctatggccagccaccagcgtttattaacccacagcctggatttggcttccagcaacctttcatgcccggaatgaggccaggcggtgctccgatgccgaactttatgatgcctatggttcagcaaggacaacaaccacagcgcccagctggtaggcgagctggtgctggtggaatgcagcaatccatgcagatgggtcagcagcagatgatgggtaggggtggtggtcgtggttaccgctatccgaccgggcgtggcatgcctgatcctgctatgcatggtgttgggggtgtgatgacatccccatatgagatgggagggatgcctatgagagatgccggtgcgtcacagccagttccaattggggcattggcttctgcacttgccaattcacccccagagacgcaaagaatgatgcttggcgagaacctgtaccctcttgttgatcagctggagcacgaccaggctgccaaagtgaccggcatgctcctggagatggatcagactg

SEQ ID NO: 12321 - DNA, 697 bp, Triticum aestivum
  Clone ID: PAT_TA_12321
agcgcccagctggtaggcgagctggtgctggtggaatgcagcaatccatgcagatgggtcagcagcagatgatgggtaggggtggtggtcgtggttaccgctatccgaccgggcgtggcatgcctgatcctgctatgcatggtgttgggggtgtgatgacatccccatatgagatgggagggatgcctatgagagatgccggtgcgtcacagccagttccaattggggcattggcttctgcacttgccaattcacccccagagacgcaaagaatgatgcttggcgagaacttgtaccctcttgttgatcagctggagcacgaccaggctgccaaggtgaccggcatgcttctggagatggatcagaccgaggtgcttcacctgcttgagtcgccagacgctctcaaggccaaggtcgccgaagccatggaggttctccgcagcgctcagcagcacaccaaccagtcccctgagcagcagctggcttcgctctcgctgaatgacggcctcatctcttcctaagctccacggcgacaatttttgcaccatatcaaacttatctagactgaaaatgacttggtttattggagacttagcttttgccagtagttgaactagtcttttaggcttcccatggattggctattttatttgcatggattggttgttttgtttaagttatcgtctgcttgtcactg

SEQ ID NO: 12322 - DNA, 2399 bp, Triticum aestivum
  Clone ID: PAT_TA_12322
cgccccggccgcaggtgcgagccaggcccccaactcctatcattctcaaaaccaaaacataacaaaaaatcaaaaaaatccacaaaatcaaagaaaaaatactcttcgtttggagcgggcagggcggggggcgcggtcggcgtggcggcgcggcgccgcggccgggccggggggtgcggcgggggcgccgcgggtccatggtccctcccggctccatggctttacgggggcgatcgcgactggacgtgcaggtcgccgaagtcttcggacgtatttgcgccgagctccgcgggcgcgtctgcgggcgcgtcaacgggcgtaagtcccccgaagtcgcttgcatcaaccaaaacccaccggcacaccccgcacgacgcctcacggtgctctagatctgcccaattacactcctatctatgaacgatactatcactataatgtatcctaaccttgacccgagcttgcacaactattatacttctaaaaaattttataagtatcatgaaaattaaagtgtcaactgacacatgttttatgtatgttatgttttttgaatgtttctttcatacatagctgcaacgggtcctgatgggctatcggggggttaaggcttcgttgggtaggagcgggttatggtgctttcggctaaaatcaagggaatgattatgaatgtcaaggatggcgaaagggggaatgttggttcgttcgttcgtgagcaggagagcgataccaggcaatgtcaagtcaaaatcaataatgtctatattaagaacctagctgagactcccactgaagatgacttgaaggaaatctttgggaagtttggagcaataacaagtgttgttgtaatgcgggatggggatggaagatccaagtgttttggatttgtgaattttgaaagtccagatgaagctgctctggctgttcaagatttgaatggcaagaaatttagtgacaaggaatggtatgttggaagagcgcagaaaaagtcagaaagggagatggaattgaaagagaagtttgaaaagaaccttcaagaggcagcggataagtatcaaaacaccaacttgtatctgaagaacttggatgatactgttgacgatgaaaagttgcgtgaactttttgctgagttcggtaactattacttcctgcaaggttatgcgtgattcaaacggtgctagcagaggttctggatttgtcgcttttaaatctgctgatgatgcttcccgagctcttgctgaaatgaacaacgctaaaatgagcaataagccactttatgttgcactcgcacagcgcaagctcgcacagcgcaaagtaggctgcaggcacagttttcacaaatgcgtcctgttccaatggctcaaactgttggtcttcgtctgcatatgttaccgtctgctaatgttgtttccctggtgttgcagttggtcaacaaacgttctatggccagccaccagcctttatttggcttcagcctgcatttggcttccagcaaccgttcatgcctggaatgaggcccgatggtgatcctatgcatgactttgtgatgcctatagttcaacaacccacaagaaccacaaggtcgagctggtgggcgagctggagctgggcaaatgcatcaatacatgcagatgggtcaggatgggatgatggggaggggtggttgtcgaccgtaccgcgacccgaccggtcctgcgcatgcctgatctggctgtgcatggggttgcgggagatatgacatcccgggatgcgagagaggagggaccggtatgtcagagccggttccaattgggccattggcttctgggcttgtgaattcaccacttgccaactcaaccccagaggcgtgacgaatgctggtagcctatagcttgtcagctgtagcacgacagcgcgaccaagggtgaccggcaagcgtcaggagcttgaccatggagagggacttcgcctgcttgacttgccagactcgctcaggcccaagcttgctgaagccagttgaggctatgcgaagcgctcagcagcaccaccaaccagtccactgagcagcagccggcttcgctcatctggtcttcgctcggcctcatctatgcctacatctcttcgtcgacaatatttccaccagtatcaaactttatcaacgtctgaaaatgtcttgaggactttaattggcatggctttagcttttgccgttagttggaattagtcttttaggcttcccatggttttggttattttatttgcttgatttgggtggtttggttttaattagagtgtccagctttgtcactgaatttatcttgctttctcgttaaagaaaaaaaaaaaaatgggagcactctctggtttgagcacctgacgctagggcggccccgtgagtaaggcccgtcccaaaaaaaaaa

SEQ ID NO: 12323 - DNA, 722 bp, Triticum aestivum
  unsure (1)..(722): unsure at all n locations
  Clone ID: PAT_TA_12323
ccgcatcgcaccgcaccgcaccgcacccgcgtggtgggatggagcggcgcggcaccgccgcgctcgcctgcaccttccgctcctcctcctccccctctccggtttcccactgctcgcctctcctccgcccccgtagacgcccgcccgcggccgccggggctcctcacttcctcccgccagccggccggcgcttcagctactgcagtcaaaataggtttttagacacaagcaaggggcttaagcggcacccattgacgacattcagcccatttgggcgtccatcggttagtctgaacgatgcagatttagtaaaagataagatgctaattgattgtggagaagagcaagactgtgtgcttgatgggatagttgccttgnggaaaatttgatgcccttcacattggccaccgggaactagccatgcatgcttctaaatcaggaaatccttttcttctttcttttgttggaatggctgaagttcttggctgggagtataggcctcccatagttgctcattgtgatcggaagcgtgtccttttgtcttgggctccatattgtagaaatgtggtgcctcttgaatatcaagttgagtttgcaaaggtcaggtacctaactccacgccagtttgttgagaggttatcaacggatcttagaataaaaggtgttgtagcaggtgaaaactacagattcgggtacaaagcatctggtgatgcagctgagtt

SEQ ID NO: 12324 - DNA, 4158 bp, Triticum aestivum
  Clone ID: PAT_TA_12324
gagcagtctactgcaccaactcttccttcctgagggagtcttcatctgctccatcctatcctttatctgttgaggccgaagaagtacccaaccagatccaggagaagagacctgtcgatatatctaggagaggcgctgaaaattttacctccaactcttcgatggagcctgacaggaataactttagtatgatcccaagttattctaatagaggaaaagaggaaaatggtgcatctggtttgaatgatagggagagggttgattttagttctgtccgaactgtttacaacagtaaagcacagttaattcagaattcagcaaatgcacaagaggatgaaaaggttaccagagtctcacctcccaggaggaaggtcataagggaagacaaatctgaaaagcagaactacatgaaaaaggatagtggaatcgaggcaagtcggcctggatacaaggtgcagcaggtaagacagttgcaacagcagcaacgaccaacatctgcttcagcttctcaggtttcgtcaaggcaatctgaaaaagaaagttcatgcgatgatgtggagatagatgccattctcgaggaagaggaggccctcattgcagctcacaggaaggaaatcgagaatacaatggagatcgtgcgtgaagagatgaaccttttggcagaagttgaccaaccaggcagccttattgacgactatgtgacacaattgagctttcttctgtcacgcaaggctgcaggcttggtcagcctccaagcacgcctttcagtccgtcaacagcgccgcaaagagcaggagatccttagccgtaagaaatcatccagatagctggtcatcgctcattgactccggccttttgcctgctcagtaaatttacaggagcttgaccgcatttcttgagatgtttctcttctgtggtctcctgtaatgttggacctgagcaaggagctaaaagaagacatcgcattggctcaggactggatgcatggcttgccctcaatgccgttttcctttttttttttttttgccacacacacaaacacacattttcatttgttgacgaaaacaatatcagtaaagaatacaacaataatgtatctgtgtccacaatagtacagtagccgctgccaaaaatcaacccatccatatctgcaaacagttacgtcggatgtctaatgataggcagacatccgctcaacacgcaaacctcaccactaccccccctccccccccctcctctcgggaagatggccgcggcggcgctggcgaacggggacgtgcgcgccggcggcggcggcgcggtgccgcggccgacgaacccgatggtcacgcccctgctcaccgacctctaccagttctccatggcctacgcctactggaaggccggcaagcacctcgaccgcgccgtctttgatctttacttccggaagagcccctttgctggtgagttcaccgtctttggcggccttgaagagtgtatacggtttattgccaacttcaagttcaaagaagaggaaatcaattttctgcggactgcactgcctacatgtgaggatggcttctttgagtacctcagttcgattgactgctcagatgttgaggtttatgccatccctgagggttctgctgtgttacctaaggctccacttatgataatcgaaggaccgatggcggtggtgcatctggtttgaatgatagggagagggcggtgtacgttcctccgttcggttctacaaatgctgcaacggcaccgcctttgtagcaaggaaagccaaagaatttaacttgaatttggacttcgacgggctcaagggccagattggaggaatcaagtgcatcaagatattcttatatgggaggatttgatgcaacaagcaatgttgcagcaggaaggttgttcgggataccaatacgtgggactcactcacatgcatttgtgagctctttcctgggtcttgatgaaatcattgacaaagcactttctagctctgatggttcgaacaaatgtgaaaattttgtctctctagtgcagaattggctggttaagattcaggatgctagttcattgcgtggttcctttggcgaaacaaatcaaagtgaattggctgcattcacgtcatatgcactggcatttccaaactccttcctggccctggtggacacatacgatgtcatgagaagcggagtgccaaacttctgcgctgttgctttagccctcaatgatatggggtataaggcagttggaattaggttagactctggtgatttagcatatctgtctatcgagacacgcaagttcttctgtgcaattgaaaaagaatttggggttgttggctttggaaaaacaaatattacagcaagcaatgatctcaatgaagaaacaattgatgcattgaacaagcagggccatgaggtagactcatttggcattggcacctacctaggttacctgctatgcacaagcagcacttggttgtgtattcaaagttagttgaaattaacaaacagcctccgtattaaactctcttcgaaagacgtcacaaaggtatctgataccactgttaaaaaacgatgcgtacaggattgtatggaaaagaaggttatcctttagttgatataatgaccggacaagacgagacaagtccaaatgattggggagagggttctgtgtcggcaccctttcatcgagtcagtgagtcaagcgttgctcctatggaaggatttgatgcaacgagcaatgttgcagcaggaaggttgtttgggataccagggcgtgggtcccactcccatccatttgtgggccctgtcctcggtcgcgaggatctaattgacacagcactggcccggtccgatctgaggaagttaaacccaacaccataccagttggagcgtgagcgcccagctctacgatttcatccatttcctgtggctcaacgaagctccaagtcggcgaacttgcgatgaagaaagatgacaacgggagcatccagcacggatcgaatcccgatagcctgtatttgtttttcaagaatatggcgtgtgtatcttccacgatgcactgtaaggtgttcatgttgaaaggacacggcctcaacgtagttggaattaggttagtactctaggtgcatttagcattatctgtcttattcgagacacggtaagttcttctgtgcaattgaaaaagaatttggggttgttggctttggaaaaacgaatattacagcaagcaatgatctcaatgaggaaacaattgatgcattgaacaagcagggtcatgaggtagactcatttggcattggcacctacctagttacctgctatgcacaagcagcacttggttgtgtattcaagttagttgaaattaacaaacagcctcgtattaaactctctgaagatgtcacaaaggtatcgataccatgtaaaaaacgatgctacagattgtatggaaaagaaggttatcctttagttgatataatgaccggacaagacgagccaagcccaaaggttggtgagaggattctgtgtcgtcaccctttcatcgagtcaaagagagctcatgttgttccacagcatgtcgaggagttgttgaagtgctactggcctggacattcatccgtacaaagggaggagctgccatccctcaatgagaacaggagtcggtgcatgcgtcagctggaacggatgaggccggaccatctgaggaagttaaatccaacaccatacaaggtgagcgtgagcgcccagctctacgatttcatccatttcctgtggctcaacgaagctccagtcggcgaactgcaatgaagaaagatgacaacgggagcatccagcaccggatcgaatcccgatagcctgttttttctttcaagaataacgcatgtgtatcttccacgatacactggaaggtgttcatgtcgaaaggacacggcctcaacatatatagtgctcatgtgctcaacaagcatcacaccagtgtatgcactatcgacttaacagagtaccatgctgttgtgctttgaaaaaaaaataatctcttgcaaggatatgaaaaaaataatggtgagaagctgaggtaaaatatggaaactatctttgcctcactttctatgaactgcactctggtatacattgtgttagggacttggggtgtctttgattc

SEQ ID NO: 12325 - DNA, 770 bp, Triticum aestivum
  Clone ID: PAT_TA_12325
ggggctactaccgggcgctggtgcggagcgacctccagcggcgagaacgcaagcaccagctcctcttcgtctccgaagccggcggcatcttctcccccggcaacgatttcggctggttgtattacacatgggtggatgtcgggacaccgaacacttcctttatggtcgcattggatactggaggtgcgctcctctggctgccctccgtgtgtcttgggtgcgcccccttggctggcgcccctgttacgctggatagagatctcgggatttacaaaccagctgaatcaacaacgagtcggcatttgccctgcagccatgagctttgctcatcgggttcaggctgctcaagcccaaagcagccttgcccatacagcactgactatcttcaagaaaacacaaccagctcaggtttactaattgaggatgttctacacttgaactccagagagagccatgcaccagtgaaggcttcagtcattataggttgtggtaggaagcaaagtggtagctatttggatggtattgcaccagatggacttcttggccttgggatggcagatatctcagttcctagcttccttgcaagagctggattagttcgaaattccttttcgatgtgtttcaaggaatattctgggagaattttcttcggtgatcaaggagtgtctacccaacagtcgacgccatttgttcctttatatggcaaatttcaaacttatgccgttaatgttgacaaatcttgtgttggccacaaatgttttgagggtact

SEQ ID NO: 12326 - DNA, 1710 bp, Triticum aestivum
  unsure (1)..(1710): unsure at all n locations
  Clone ID: PAT_TA_12326
cgtcctgatccgtcccgcgcggccgcagttggacaggatatgattaattcgctggctaatgaagaggataaggaaaagtatgggcgatatcttcgcagatcttacatcgaggataatcgaaagacaaagtggtgtcctgctcctggatgtgaatatgcagtagaatttgtcgtgggcagtggcagctatgatgttaattgcaattgttcatatgggttctgttggaattgcactgaggaagctcatcgtccagtagactgtgccactgtttcaaagtggatcctcaagaacagcgcagagtctgagaatatgaattggatactggctaactcaaagccttgccctaagtgcaagcggcctattgagaaaaaccagggatgcatgcatatcacatgcacacctccatgtaaatttgagttttgctggctgtgtcttggttcatggtcggagcatggagagaggactggtggattttatgcttgtaaccgttatgaggcagcaagacaagaaggagcgtatgatgaatctgaaaggagaagggaaatggcgaagaactcccttgagagatatacacattattatgaacgatgggcagctaatcagtcatcaaggcaaaaggcattaggagaccttcagagtctgcagaatgacaagcttgaaaagttaagtgatatacaaagtcaacctgagtcacagctcaagttcatcatagaggcatggctacagattgttgagtgtaggagggtattgaagtggacatatgcttatggttattacctcccagagcacgaacatgccaaaagacagttctttgaatatctgcaaggtgaggctgaatcaggtttggagcggctgcatcagtgtgcagagaaagaacttcaaatataccttgaagccgagtccccctcaaaagatttcaatgacttccgtacaaagttggctggattaactagcgtgactcgcaattattttgagaatcttgtccgggcactggagactggattaaatgacgttggaccttccactagccaaagcacgggcatcaagaacactacttctaagagccttggtggcaagagcaagactggcaagaacagggcatccgctgccggctccaaatcaggcagctccagccgtggtgtggacgatagcaacatttggacgtgtgatcagtgtacatatgtaaaccccagatcggccaaggcctgccaggcttgtgaccaccaacaccgatagcagtagtcagtccttgtttaacatctcagctccgtcgatcgagaagaatcctctcaggtcatacagctgtggtacccaacatatgcaaaaattgcagttgctaaggatatttggggctactggagtgaggaggcatcagtagagtgctgcatacaaagggacgagatttgtatctgcattgtttgcccactgactgactgcaccgcctcgcggcaccatccagttcgttgtgtacataaactatatctgtaactctgttttgtttcgttgatgtagggtgtactaggaggtgtgtgctccaccagagaacaagttttttctgttgtaatgctgttgtaatctttcaataatgcattgacaattttaaggagggggagtttcttggactgaacggctaatgtggaaggattgacttgaagtagaagggacttatgggaaggatnactgacccggcaaatgnagtaaaagtactaa

SEQ ID NO: 12327 - DNA, 876 bp, Triticum aestivum
  unsure (1)..(876): unsure at all n locations
  Clone ID: PAT_TA_12327
cccaggccccgccgccctcctcctccgccgccgcagtcgcctcctccgcccccgccctcatccgccctcctgcccgtccggccgcgtcctcggcgcctcgcctagcgggtgctcctcccccgcccgtcccgcctccgccgcctcgccgcccgctgcccctccttccggtggcgccccgccccgcgcaccaccgccggcgcgccgtccagctgatcccggggcactcggggtgtgccagcttgggtggcgttgtggtatctgcttcattatcgtcttagcctatatttgcccttggaccaaaggccgtttgagattgataatatgaaataaagaatcatacaacgtccatgcattcatccgcagacgtaaccatgctggtgggtctgcccgggcacacctatatggtgttcttgacaccgccttccgtgctccagttctatgtaaaccgtaagattgttgctgttacttgtgacgttctataagtttggaccatggagcgtgcaccacgtgaaaggggatttccaactgatcccaaggaatataagttatatgaggaagttggagaaggagttagtgccacagtttacagggctctttgtgtcccgctcaatacttttgttgccatcaaagttcttgaccttgagaagtgtagtagtgacctggatggaataaggcgggaagtacaaaccatgagcttgattgaccatccaaatcttcttcgcgcatgctgttcatttgcaaatgaccatcagctttgggttgtcatgcctttcatggctgctggatctgccctgcacattataaaaactaattttccanatggttttgaggaagcatcattgcaaacttttgtgggaagttccaaanctcnctcna

SEQ ID NO: 12328 - DNA, 1066 bp, Triticum aestivum
  unsure (1)..(1066): unsure at all n locations
  Clone ID: PAT_TA_12328
gtcgtctctgttgtcgtcagcgaggggctgggcgagcgcggcgttcgtctaccacaacttcctgtctaaggaagagtgtgagtacttaattggattggcgaagcctcgcatggtgaaatcaacagtggtcgacagtgagactggtaaaagcaaggacagcagggttcgtacaagttcaggcatgtttcttcaaagagggcgggacaaggttatccgggccacggcacgggggatagcagattacaccttcatacctgcagaacatggagagggactccaagtactgcactatgaagtcgggcagaagtacgaaccccactttgattattttcttgacgagttcaacaccaagaatggtggccagaggatggcaactattctcatgtacctgtcagatgttgaagaagggggtgagactattttccccgatgcaaatgtgaacagcagttccttaccgtggtacaacgaactttcagagtgtgccagaaaaggtcttgctgtcaaaccgaagatgggagatgcgctgcttttctggagcatgaaaccagatgccactctagatccactaagtttgcacgggggctgtcctgttatcaaagggaacaaatggtcatcaaccaagtggctgcatgttcacgagtacaaagcataggccttgtgaactcattccaaagatgacacgatctgagcatgtgacctgggctctttacatgatggctttacagttacagatccacccccattgtgttcattgcttgtggaggacatatatataccaggagggcttcatgctggaatactgactcggcatttttcttcttcttctccctcgccgcagtgcccccagcaacttattatagaggaatgaatatgatatgatgtgatgtatgtagcgtcgggggctgtaggatccggagttccattttcggttcgtgttcttgtcctgtttgtagcactagtactataatgcagtactgatgtagcagcctcgaggtgagtcgttactnaacaataactattgaggattttgcttgtctcggcattttacacagttattataccatgc

SEQ ID NO: 12329 - DNA, 688 bp, Triticum aestivum
  Clone ID: PAT_TA_12329
ccacgcgcccgggcgcccccggccctcggtaggagccgccgcccgcttgggcgatggcgccggcgtcccggcgagcgcgtgcgagtcgcccgcgggcaccgcgccgtccgcgaggtcctgcccccgcggcgccgacgccaccctgggcgccgagccccgattcggcagggccccggccccctcggcgcccccgaggtccccgccgcctcccgcggacgccacccatcggggcttcccccgcctccgcttggcccctgctcgcgctccgctccagccctgcccggcgccacccgggggatgcctgcttggccttgggccaggggcggtccccggatgcctgcgtttattggtgcccggcccccgcgtgcagatggctggctttttgctgtgctttgcttccggcgggggtggatttgggactgattttacaaataagaaaagaattaaaagcaggaagagggcaaaggatgttgtacaggacccaagcaaggtagcatctgcagactcaaagaaccagggacagtgggcaccagagttaggaattggaagagaaaacaaatctggtaaaacggtcatggataagaaatttctggaaaaagttgaagctgttcgaaggtctgcacttgataaaaagaaagttgaagagaacaaaacttatcaagctattgattatgatgctccaatcgaa

SEQ ID NO: 12330 - DNA, 852 bp, Triticum aestivum
  unsure (1)..(852): unsure at all n locations
  Clone ID: PAT_TA_12330
ccacgnacagccttgtacattttgattcacggggtcaagcggnagctcaggnaggtggggattgtacgagggcctgacctggagcgtggaagaaaagatccttgtctggcacatcgccaccaacatctacatctactccatgatgagcagcagcagcgaggagaaggaggagcatgaggtgagtgatcttgccgaggcggtccaggcgctctccaactacatgctgtacctcctcgcctcacgcccctacatgcttggtcccactgccaaccacaattcctacatcgaggtgtgctttggcctcatcgcgcgtggtccgcgtgatgctgctgctacgccttacagctcacccgaggaggtggccagatttctcaagacctacggggatacagggaggggcagccgttttccgctactacgtgttgatcacacaacacaaggccatctcgtatccatgttggataaaggatgcgagcttggtgccaagatcgtccaagatgacgcagtggacacgctggagctgctcgcccaggtgtgggtggagacgctatgctacgcgggccagcggtgcagcgcactttgccatgccaagcagctcagcgacggcggtgagctcatcaccgtcgctgccattctagtggagtacttcaaacgaggaaaattccgttgaaacaggaagaggcggggacgaggttcagggaggaaggaccttttgatatcccttgaaacatgggcagcacttctttatcccattttccattaattctccatctgatgagggccaagggcaattggatccagaacagggatgagatcatctactagtgctcccggtgtccttttaattactgc

SEQ ID NO: 12331 - DNA, 613 bp, Triticum aestivum
  unsure (1)..(613): unsure at all n locations
  Clone ID: PAT_TA_12331
atcttcggagacnggctgtgttccatgggttcggctcgagtcngttatccgatgcaagcagacggtacgctccaacagtcangacttggtcaataataaaaggaccttcccatttgggcttgagtttgtcctttttcttgtccggcaggcatagaactagctcgccaaacttgtaagttttggcccgtacttctgtgctttgatatcttcgagcctgctattgatagaatgcggaacgggcttttgccacgtcgcgctcctcctctaaagcgtccaaactgtcctgccgatccaactcggcttctctttcctcgtacatgcgcacgcgaggtgagtcatgaattatatcgctgggcaaaactgcctcagcgccgtataccataaaaaatggtgtgaatccggttgtgtggtttggtgtggtccgcagcccccagagtacggagtcgagctcctctatcccgcgcgtgttagattctgtgagggaccgcactaatctgggtttgatgccgctcatgattagaccatttgctcgttccacttgaccattagtttgagggtggtagactgaagcgtagtcgagcttgatgcccatgtttttgcaccagtgtttaac

SEQ ID NO: 12332 - DNA, 1025 bp, Triticum aestivum
  unsure (1)..(1025): unsure at all n locations
  Clone ID: PAT_TA_12332
attcggcacgagggtgacgatgctgacgttcatcctatcggtgataatcgcagtggtcattcttctcttccgtgacaaaatcagctacatctacaccggcggcgaggatgtgtcggcagcagtgtccaagctgacgccgctgctcgcgctcaccctcgttctcaacggcatccaacccgtactgtcaggggtagccgtcggctgtggatggcaagccttcgtggcctactcagcttctactttgacctcggcactgcggtaattaaggcttccgtgcatggcttactcttattcaattgatgcaattttctgttatatgagagaggtgattgacacaaaatcgcagggcttatggagtggtatgattggaggcaccctaattcagagcatgatactgatgtgggttatcttcagaacagattggaacaaagaggtacatatgggttcacctgcaatgagtttcactgaaactgaaggttacatagtcgtttgaagacaataatactctatctgatacgagttttgaaccaacattaatacgatcgatattataatgaatatgctagacattgcacagttagaaaccaatatgcaccgtactcagattaaaacattctatttatattctttgtaaagggcatcgcataagatagtcaccttgttttcccaaacaaacaaaaaaagatggtcactttgttgtctactccctccatcccaaaatatgtgtcgtgccattagttcacataacttatgaactaaagccaggaccttattttaggagatagggagtataagataaaccctccaagagtgaccttctgatttaattgcaggtggccgtagcgacggaacgattggacaggtgggaagagaagacacctctattagctgggcaaaaatgaaacatggatgtgaattttattgtaaccttccacatattttgtacaagtcgatctccctaatgtgtaaaatgcataagtatcatcgtcanaaattcaccatcgnagnaaatttcatattccaaa

SEQ ID NO: 12333 - DNA, 1628 bp, Triticum aestivum
  Clone ID: PAT_TA_12333
tcggttgtagcccgcgcgccctcgccagcgccggggacgccgttccccgcccccttcgccgcgccgcgtgcggccggccaggtgcgcggggttcgtgggcccggcggtggagtcggcgtccccgggcgcgagggcgccgtcgctcccgagcagccgcggccgtaccacctcgtccctggtgatgggcggggtactcaccggcatgttcctcgacaccggcgggtggggccctttcgccggcgccgctcccgtcaccccctcgctgcagaagtataacagggtgatcgacgcttggggtggcgccgacctcttccgaccggcgctccatttattcggcatgttctccaacaaactccggcgcccgcgcccgaccgagcggcttaaagatatatggtgaattaccaagtcggtggcgccgccgatgctgggggccagacgccgtctggtggagcacatcaacaggtccagcaagagcctgtacgtcgctgccttggacatgctgcagttccattggtgggactatgcaaatcctggctatctagttatactaaagcacatcacttacctgaaggaggaaggcaagttatggactgtagctctgacaaacttcgataccgatacgctgcaaataattctagaaaatggaatacctattgtcagcaaccaggttcaacattctattgtggatatgcgcccgcagaaaaagatggcggagctttgcgaccttaccggagtcaagcttatcacgtatggcacggtgatgggcggactcttgtccgagaagttcctcgacaccaacatcaacatacctttcgccggacctcctctgaacaccccatccctgcagaaatataagaggatgatcgacgcttggggtggctggagcctgttccaggccctgctccagaccttgaagaaggtgtcgctgaaacacggcgtccccatctcgaccgtcgccgtaagatacatactgaaccagacatcggtggcggggtcgatggtgggcgtgaggctgggtctctcggagcacatcagggacaccaacgccattctgtcgctgctgctggacgaggaggacatgggcaatatcaccgaggcgtcgcagcggggccggaacctgatggaggtcatcggcgactgcggcgacgagtacagagcctagtgatcttcacatggccggggatcgagtctcgatcctcgatccccccagcatgtgctcccacgacgataaatacatatcaccttaacaaatgagtgacaatcatggagaggaaagtttgagaggcatggagacagatagacagagagacagagggacaaggaggatcatgtgctccaccgaaagcaccggcgaatgtggtggtggtggacagatctccctggccaacagggagcatatcccggccttggagaccgatctaatcatggcatatgatattgtattttaagtgtagtagtacaaaattcatggaatcatcgtgctgatggtgatgcttgccgtgcaaattgttattagttgctcccctgtttgggaatatatgaggatctggacagcaaagacagtgtctaaaatactatacaatatatgcacaaacaccatgacaggtaccttgaaaaattgtagtatg

SEQ ID NO: 12334 - DNA, 426 bp, Triticum aestivum
  Clone ID: PAT_TA_12334
gcgctgctgaggtccatgacggagccgaaggccgacggcgcggccgacaccaaggacggcgtcgacggcgcgtgagccgggccgtccggaccccggagtggcgatcgccgtactcaatcaaatcttagcctagatgctagtagcatttttaatactactattagttggtactcgcatcatgatgccggattaagaaaacgtgcgtgcatacgtgtgcgctctactctcttgtcttaacgtggcaaaaagcttgtcttttcggccgcgatgaactcctagcgtatcccctcgccaccgtctggatgcaataatctggcggtgctagtacgagtagtatgcatgtaaaatatttccgtgcccccaatgtgaagtcgcttttctagtaaacttcttgctagaagttggcatttcattcgaaaaaaaaaa

SEQ ID NO: 12335 - DNA, 1265 bp, Triticum aestivum
  unsure (1)..(1265): unsure at all n locations
  Clone ID: PAT_TA_12335
gcagcgccgcccaactgccacctatgacctgcgccctccctgccaccccaccctcccaccgctccatccttgggttccctcaccgaacgccctcccgacgaccacttctccaccagcggcgccaccccgctcctcagatgcacctccaccagcgaatggctgcttcgatcaacatcgacagtttcacggtgggctgttccgcggcaggaggattcgcggcgtgcttggtggtctcagtgtccgatgccatcgcgggtggcctccactcccccaccgtcgctgctcaactcggtcttcgtcggcaccgctcaattcagcctctgttgccgctctccgatcctcctgcttcgacccctcaccggatccgtccttctccttgccagcgacatcttcctccccacgccacttcctgttcccatctggttgattattgattattaactttccgattttctcacagttctgacgagaagaagtaaagctgggaggatgcggagtgatgtggtgaggagcaacaattgcagagcattagcactgcggcaacacacttctatggtggtgtagtgcagacacggacgaggaaaagaacgcatatacaagctcatatatttgttatcttctttcctgaatcatgattcctgttccggaactacttccatgtacaatattttggtgtccgaccttggtattggttttccatttcctttctgaacacatgagctttggtatggatcttgggagcaagtcatcctcagtttgcttccagtggagtagtggcggggaagtgggggaatattaggtcccaccacactaaggagcacatgtctgtagggaaggagtttatcgaggatctgtgagccaataaataatacggagagattagttactaaagaaaatggttcgaggtcaatagttgaaagcctgaagccagatgttcctacgatgacgtacacaactcttgagaaacaaaaccaatacattatatgtgcctgcaagattgaagatcgtacatatatttactttgctccaggatcctatagcagtgcattactccatgcagttccctttatcatccattttattattcatatctctatatggttgttatatatagatcctattacagggatgtagcactatattttccagccattgttgtaaacaaaacaccctctgtattgatacatatgtttttttttcttttagttatctcttttcagagtggacnaggtttctagatcgaagaaattattttnagatcgccc

SEQ ID NO: 12336 - DNA, 1594 bp, Triticum aestivum
  Clone ID: PAT_TA_12336
tcgctgcaaaattctactagctgaacatgataacaatgtaacagatgcagaggcagtcgaagtagagattgaacgagctcttctcgcctgcgatatgtgcccactatagcaggtgtgctcggcccgcgatgtccagtcccgcagcttgttggcctcgcgtagtggctccctcggttttttgcccgcttctggtgaatggccgccctgttcttccagggcttctcgctcttgatataattgccaaagaggttcttgggttgggttcaattgatgccggtctatgctgctgagcttgttgagaatgttcgcacctttcttggaacgtccacatgaaagatgccgggcatcatatatggaggctgttcttgagaaacaaagttatattctcctctcacggagtgatgttgaaagtttaatgtgtctggaccctgcaaatgcttctttgcaaaactcttttggtcaacttgataacgacattccagatgcaggaatcgaagtggagattgaactaagtgatctcctattggatatgtgcccgataaaacaggaaaacttgatccatgatgaccagaaattgatattgctggcatctcttagcgactccttagaatatttagcagattcagttgaaaggcttggtgagtcatttataagtccatccaccatctcagaaaacaaaagtgacatacaccaaagtcaccatactcgcacaactagtgcaattccgaaaagccttgcgtctcttgctaatgagtacagaaggctagcaaccgattgtgttagagtcttgagattggaaatgcagttggagacaatatatcacatgcaggaaatgacaaaaagagaatatgtagaagatcaagacgctgaagatcctgatgacttcatcatctctcttacaactcagattgcacgtagggatgaagaaatggctccttacatcgcagaatcgaaaaggaactatgtatttggtgggatttctagtgttgctgctaatgcatcaataaaggcactcgcactaatgaagtccatcaacctgttgggagttcaacaaatatgcagaaactcgatagcactagaacaggcacttgcagccataccttccattgatagtgaggcagtccaacagagattagatcgtgttcggacattctatgagctactaaacctgcctttcgagtctttgcttgggttcgttgctgaacaggaaatattttttttttcaaaaaaattaatcggcctaaaagacaactctacctgtcgggcggaaccaaacgaatgcggaccccccgccctaccgcatttgggttcattaattgaattgggccaggcgagtttagcccagacctggcggcgggcgcctccctcactctttctcgctcgcctttctgcctggctttagtttgtttttttctttttgttttttttttttctgtctataccgtcggtgtagtgtgttttttgttctctctctcactcaatgtgtattgctcttgctctgacgcgcacgctcgttcttggtcgatgtggatgtccttttggacgtaattttaataaaattcccagattcaaaaaaaaaaaaaaaaaccccggg

SEQ ID NO: 12337 - DNA, 717 bp, Triticum aestivum
  Clone ID: PAT_TA_12337
gaggaattcggcacgaggagactccctgccctgccctatcgccgccgccggccgccattgccagtaaaccttcaaccggcgacccccgccgcccccctacgccccctcccgcccccccccccgccccttcccccccccgccccccttcgccgccgccgcagcagcacgggaacctcgccgcggacgccatgtcgtcgcggctgtgcgtgaagaatctgcccaagggcgccgacgagaagcggctgcgggaggtgttctcgcggaagggcgaggtgaccgacgccaaggtcatccgaaccaaggacggaaagagcaggcatcttgcatttattggtttcagaaccaatgaagaggcagcggaggccctcaactatttcaacaatacatacattgacacttctaagatcacctgtgagattgcacggaagattggcgatcctgatgctcctcgcccttggagtcgccattctttgaagaagccagaatataatgctaaagacaagtctaacagtggcgatgttaatgcaccgctgaagagttccaagagccaagggaagtctgctgatgtgggagcttctaaaggcactatagctaatgatcccaagttccaagagtttcttcaagttatgcaaccccgatctaaagcaaagatgtgggcaaatgatacaacgggtacccttgatgatgctgccaaagatagcacggtagctactggat

SEQ ID NO: 12338 - DNA, 1763 bp, Triticum aestivum
  Clone ID: PAT_TA_12338
gccaaccggcataccaaaatacattatggcaatcttgcaccagaaggttcagtagcaaaaataaccggcaaggagggactgtttttctcaggtcctgcactagtttttgacggtgaagaatcaatgattacatctatatcagaaaacccagcaaatttcaagggaaaggttgtactgatccgaggagaaggaccaaaaggaggtcccgggatgcctgaaatgttgactccaacaagtgcaataatgggggctggtcttgggaaggagtgtgccctgctgacagatggtagattttctggggggtcgcatggatttgttgtgggccacatatgtcctgaagcacaggaaggaggcccaattggtcttgttgagaatggcgatacaatcacgatcgactacacctctttccgaactctctcacccccagaccaatcacaacccctaaacccctgcggaacgctcccctccccctccgggcccctgccgggcctgccgctcccctcccgccttctccacctccgctccccatttcccgccgcctcctttcctaaaaatctacacaaagattcgtaggaaaatcctgcccaaatcccccacctcccgtttctgctcccgttcccaccccaatcccctccaagaaaccctcgcccccctcgcctcgccgccatgggcagcgccgcctcgccgccgcgggccctcgacgcggcgacgcaggaggacctcaagcgcgtctccgcgcaccgcgccgtcgacatggtggagtccggcatgacgctggggctcggcaccggctccacggccgcgcacgcgctcgaccgcctcggggacctcctccgcaccggcgcgctgcgcgcggtcgccggggtgcccacctccctcaagacggaggcgcacgccgcgcgcgtcgggatccccatgctcgcgctcgccgacgccgccgagatccacctctccatcgacggcgccgacgaggtcgacccggacctcaacctcgtcaagggccgcggcggctcgctcctccgcgagaagatgatcgagggcgccggcgcccgcttcgtcgtcatcgtcgacgagtccaagctcgtcccccgcctcggctgcacgggctccgtgcccgtcgaggtcgtccccttcggcagcgcctacacgctcggcctcatccgcaaggtgttcgacaaattgccgggcttccacgccaggctcaggaccgtcaagtccaaggccggcgacggccaggaggagctctttctcaccgacaacggcaaccacatcgtcgagatgttcttcgaggacggcatacacggcaacctgcgcgacatcagcgacagcctgctgcgcatcacgggcgtcgtcgagcacggcatgttcctcggcatggccaccaaggtgattgtcgccaagaaggacggcaccgtggcggtcctcagcaagaaggtagcctagccgcctggggaagagtctgcagaggagatgacaataagccaagattgaagctgttcttgctcctgcggtgaacttgctctacgttactgttacagcgtttcctcctattcatgggtaatgcgatggtgcccagcttaatgtggtgaagctaataaattttggacttcgctccataaaatgttatcaagtcagttttgttcaaaaaaaaaaaaaaaaaaacaaccaggggcggggccccgcaccccctgcgcccgttttgggcgcccaagctaccgcgctctggacttcgctccataaaatgttatcaagtcagttttgtt

SEQ ID NO: 12339 - DNA, 758 bp, Triticum aestivum
  Clone ID: PAT_TA_12339
tcaagaacctcagtgatagtataatttgattcttgtgctgttcttctgaatacaaaaatcttagacgaggcagatgtaactatctttgttcatgtgtggacagtacaccttctgtatatctgaacagtggcatcaagcataagtagtactagcgtctgtttttgtctatcctgaaaagtacgacatgctgctgattttggcaaccaggtctgtttaagaaaactgcaagtattccatgcaatgtttgtccagaatattgggctcgatagcctagtatacccgatcgagcaaatctgtgacgattctggtgaagaccccacttgcagcaggtctgtcagtggaaatagcgtgcaagaccatatccactatcttggcatcagcatgcattccgagtcgcggggatcatgcaggatcgtcacggatgacaatatgctcaggtacaaagttggcactgtagacggtgctattgtcttctcgaagcagcctggtttatcagttgatcagctactcagtgcacagtaaacaagctgaagattacatggatttgtttttatggttcttttctgccaaagtacaatattcttgttggcaatcaaagcactatctcatgtatatatacgcgcgttatcctggctggattaaattatcatagctgagggtgtatttctgaaatgtacaaacatatttgtgctgattaacttgttcatattcttgtatataatttaatttatttaagcatggcggttgctttcattaac

SEQ ID NO: 12340 - DNA, 1300 bp, Triticum aestivum
  Clone ID: PAT_TA_12340
ctcccgcctccgcttctgtcccctttctattccggcggcagtgaggcggacaatctagcacaccactacagcagggggtcgccaggaaccgcaccgacgaggaggcctacgccgtgctccgcgaatgcgacatggctcccaacgagacggcgcagaagctgctcctccaaggagcccaaaatgcatgggatatgctgtctgaggagcaatcacagaaacacatcactactggctctggtgacctgaacggcatacttggtggagggattcattgtaaagaagttactgagataggtggggttccaggaattggtaaaactcaactggggattcagctagcaatcaacgtccaaattcccgtggactatggtggccttggcggcaaagcaatttatattgatacagagggcagtttcatggttgaacgcgtctatcaaattgctgaagggtgcatcagtgacataatggagtattttccatgccaccatgacaagtcgtcatctggccaagaaaatctgcagcccgagagtttcctggcaggaatctactacttccgaatatgcagctacactgaacagattgcggtgataaactatctggagaaattcctcggagaacataaagatgtgagaatagttattattgatagtgttactttccacttccgacaagattttgatgatctggctctgaggactagagtgctcagtggattatcattgaagttgatgaagctttcaaagtcatataacttggcggttgtcttgttgaaccgtcttgccactgatgcggcagctggttcctggcggtggactcgtgctctaggcggctgcggctccctctcgtgcacaacccggctggttctgtactggaaagggaacgagcggtgtgcatacctggacaagtccccttcacttcctgtagcttcaacaccgtatgcagtgacaagcaaaggggtgagagacgctggcagttcaagctgcaagcgagttagggtaatgtagcaacgttgaaatgcatggtctcgcatccaaagaattgcgccgttcgcttaggaaaagtgaagtagctactggaaaagtgaagtagtagtagtagtagtagctactggaaaagtgaagttcaactcatttggttgacccagtgattcaaagatgcacccagtgccccaacattaaaatgtcatatgacagcatatctgcaatctgccgtgaacatgatcggaaatgggtagtagtagcacgcagtgcctcaactattgagactagaagcgttgcgcgcgcttcactgtgccggttgt

SEQ ID NO: 12341 - DNA, 899 bp, Triticum aestivum
  Clone ID: PAT_TA_12341
ctcgaaccagcagagtcctcaccgagcgcgacagctagggttcctggccggtcctccgccgcggccgaacctccgctgccccgccgccggtacaggatcccagcggcgcctccctccgtcgagcagccgctactaccaccggcgcctccctaccgggagcggccgctcccgcccggcgacgccgccgcccggggccacgctggcgaccggtccgtaggcagttggaacagggcagcgacgttgtcaattggaggggcttggagctgcttcggcatctacagtagagcaaactagaaggttatgtttgcagacatagattttagaaagcaccaaccttctggtaatgcaacctctactagtatggtgcccctggatgttccaagtcaggcacctgagaagattaattctctgaatcaagtgatttcaagcagatgtaccatgcgaggctcctgttgactttgatacgagagaactttactttctcattgcgcacttcttatcacatgggccaattaaagcggactgctggagaactttgcagtgaactccaggagcatcatctgcttcctagaagatatcatgcttggtattcgcgtggtggtttccatagtggcgaagaaaatgatgacggtgtatcactccctttggattacctcaagttagttgagagatatccccacattggtaaagaccacttggtaaagcttttaaagcaactgatggttggttcctgccacccagagagcttgattggagctgtgtctccaaatgctgctgatgttccaacccttcttggctccaactcattttcccttcttgcatctaataggggccggcaagaaaaggaaaatcacaggttgccgacgtatctccgttggccacatatacaggctgatcaa

SEQ ID NO: 12342 - DNA, 691 bp, Triticum aestivum
  unsure (1)..(691): unsure at all n locations
  Clone ID: PAT_TA_12342
ctagtctgagtctcacacgggtcctccccccgccccgcctccccaatctcccctccgatttcctcgtctgcccaatctgcagctgctgccgctgccgctgatccttccgcagcttgggattcgtcggattggcctcctttttccatttcaggcaattagactcgcagagatggacactactgctggctaatagtaaaacgattatatggccaaagatattaaggcaatgcgcaagggaggaaacggtttctacttcatcaataaggagacaagtgctgattcaatcagggaaaacaattccaaaaattctcatcggatggccgatacagcaagaataactaaaacagagacatcaaagttgaagaacatcatttcagcatcattcaaacccttgtctcttaccattcccataggagacggattccacgaatcgttccattcgagccattgctatttatagtatctactaaggttcataagtaagccaaaggttttcagtactattggctaagaaggggaggcaaacattgagtgcaatggttacaatncgttggtacacgggaacagtttgttcaaccacagtcattcctccgtgctacaatgctgctcaagtccccaacaaggcaactttccttctgctttgcgccacaaggggattgcgatcaatactgtgctttaatccctggcttgc

SEQ ID NO: 12343 - DNA, 1858 bp, Triticum aestivum
  unsure (1)..(1858): unsure at all n locations
  Clone ID: PAT_TA_12343
tgtccctctaaaagacgaatctccgccctctctaaaacatgattctcctccccctataaaggattcatctgcaattaccattgaacacctttcccctctgatgcaagaggctgtaatttaacaggtgcctcctcttcaaccaccggcgccgacggcccatctctccttcactacccccgccttcctacctgggcacggacttaatcgggctgcggctaggcgacgtcggcagttttccgagtcagctccgaggcacctttgatctgaacatgtaggggtcggcgatgggccagggtgtcgtcgagatccaggcacgcgtgctccacatgaccttgaaactgtacaagaagagatcatgttttgtacaaattgtcgacaaaactgttgaataggcaacttgtaagtttaagacaactacgcctaaaagatactccgtcccaccagatattggttgttatcattactttgggcatgatgtgaattcacgtgtctccatgcaaagcacagtgttcagcgcctccaggacatgtatctacaaaacaaatttatggtgatgaccacagttagtactcttggagttatccatgattatggcctcattcctgctttttgctccaaagaaacctatgcttccatggagggaagtgaattgagagttgtccgtgttgatgcatctcgtccttctgtggaagcaactgataaataaggtcccaagcactgatgcggcagttgaggttccggtgttaaaagatacaccaaatgttcagaatgaagtgccagctatggagaaaaaggttcctgccccccaggagaaaatttcagctgttgttcctaacataccttcccctcctataaaagatccatctcctccccctgtacaacttgaatctccttcctatataacggttacgtcagaatctccccctgaacaactttctcctctgaaggaagagactgtaacttcaaatggtgtctcctctggaagaaactcttccgaaagaaactgtcaccgtaagtgaccgaggttttttcagtgtgcagaatcatcaattatctcatgtgacggaagatgttcagaatctgaagtcaaaactcaacaaccttgaatcaaaattggaaggggctgaaaagatgataataaaactgagagaagagagccggactacaacccaggagcgggataggctgcagcaagagatggtatttttaaagaagggaaccccaaagagtcagctaggcttcccgttgctgtttgtggtctatgtggcgcttctcggcacctccctcggctacctcttgcgcctatgagttggagtatgttggagatccaagccgccgggtgcttcagtcttcgtcaagagttgaagggcagctatatacataaatgttgcaggagcatccctgttagcagcaccatcgtttgttattaattagttgagacggttttgaacataccagggttattgccggtagcctgcctgtatagaacagcgtttacattatatagaaccgcctaataagtttgagacggttttgaacataccggggttattgccagtagcctgcctgtatagaacagcgtcatttacattgtatagaaccacccgaaaaagtggcttgggtacgccctgtgggctaattaacctactttagtcggtgtctgatttgtgaactattgagtatgtatcaacaaggtacaaaccttggtgaatttcatttagtactaggtaactaggtaatattgcatcaagcttttaaatagctgccgctacctctgcaagcttttgcggctgctccatcatgcagctattattctgggattggatattgttcaaaaaaaaaaaaaaaaagcccctan

SEQ ID NO: 12344 - DNA, 582 bp, Triticum aestivum
  unsure (1)..(582): unsure at all n locations
  Clone ID: PAT_TA_12344
gggggacgccgcagctcgccgctgcaacgccaaccataggnaacgggcgggatccaccagccctccgtccggctcgatgtccacgccccagggtccaacatgcaggcctgcagtgcaggacgccgcccaaacttttggaccgaggccgccttcctctgttccgtcagctgccgttgcaacgccaccgcggtcgtcctcctccccgagtaactccaggaaccatgacgggctccgcgtctcctctggaccaaggattcgaagccacaagtctctcctacttcttcctcgacactgactgccattgctgccgtcctgaatttgctgtcattggtccctgtgccatcgggcatcgccaacagcagggtgagaagctgccactgccttcttgtgccttcttttctttgtcagcgtcatttctctcattctagccgttgctggagatggttgtggcgctgccacctgagaccattttggtccaggccacatggttaggccacgagcttgttgctgcttactgctgtttgatgctgctacttctgttgtttgttgtttgttggctgctcgctattgctctgcttgctg

SEQ ID NO: 12345 - DNA, 601 bp, Triticum aestivum
  Clone ID: PAT_TA_12345
gccgccctcttcctcttcctcatcaccacagccgctctagtcgtggcgaatctgacgcctgcaggcagacgcaacaggagttcgtggagcggcggatgcagacggggtcgttgacggagctgcaggagcaaggagctcgagttggtgcgccatgaggagtggaaggccgagttcgtgcgacgaccagagcaacaggagcaaggagcctcctctctctccctctcagtggttgaggacttcctcaagaagaaagaagaaggccaaatagaagaagaatttggctcaaaggtcttgcggagagtgcataatgtcccctcaggtttgaattgctctgaagttatcatggcatttccttatagggcttgttcacatttattcatggaaggtgaactacctgtttcaagattgtaacccacctaaaaaatcccttctgccttcctgtttttgtttgtgtatgtcgctctgtaaagattggtcagcctgaccatgaaagggtgcttcagattagaaaagaatggtttttctttgtgtaattttcaggacaaaggaggctgtggaggaactcataaatgccgtgctaaattattaattaaaaaaaaaa

SEQ ID NO: 12346 - DNA, 435 bp, Triticum aestivum
  Clone ID: PAT_TA_12346
ccggccctccacggaaccgagcggcattgctcgctccgcggttccatgtgcttcttgtgtagtctgttgctccccggcggttctgtcggtcactggggtccacggtgagtattccatcaggtaaattcagctgctatctctggatcactatcagctgctctgcaatgcgataataatttcactgtgtgacttgagttgcgtcatcctggggaaaattggtgtgcattttgttgtatgtgttattgtatcttgtagacgtttgaaacattcggctcctctgctgtgtgataataatttcactgtgtgacttgagttgcgtcatcctgggggaaattggtgtgcattttgttgtatgtgttattgtatcttgtagacgtttaaaacatttggaactttttgtgttcctgtggcccgtggggaacgaattcttgcgaa

SEQ ID NO: 12347 - DNA, 1704 bp, Triticum aestivum
  unsure (1)..(1704): unsure at all n locations
  Clone ID: PAT_TA_12347
ccacgcgtccgggctcatggcgttctccatgggggagacccgggtggtggtgaccgccgaccctgacgtggcgagagagctgctggctagcccggcgttcgccganccggccggtcaaggnagtccgcctacgggcttatgttccatcgcgccatcgggttcgccccctacggcgcctactggcgcacgctccgccgcgtgtcgtcctcgcacctcttctcgccgcggcaggtggccgcctccgccgcgcagcgcgcactgatcgcccgcccgttggtggacgcgtgggggcccgtcggcggcgctggcgtcaagcacgtcgaggcgcggcggttcctgaaacgcgcgtcgctgcacaacgtgatgtggtccgttttcggccggaggtacgagctggacgaggcggggagcggggaggccgcggagctgaagagcctggtcgacgaaggctacgacctgctcggccagctcaattggtccgaccacctcccgtggctcgcgcgcttcgacctgcagaagatccggtccaggtgctccgccctcgtcccccgcgtgaaccgcttcgtcggcaggatcatcgacgagcaccgtgccgccctgaacgacgacgacgacgccgtggtagacttcaccgacgtcctgctctccctccaaggaagcgacaagctctccgacgccgacatgatcgccgtcctctgggagatgatctttcgtggcaccgacaccgtggcagtggtgatcgaatgggtgctggcccggctgatgctgcaccaagacgtgcaggcgagggtccacgaggagctggaccgggtggtcgggccgaaccgggccgtgaccgagtcggacgccgcctcgctcgtctttctccaggccgtagtcaaggaggtcctgcgccttcacccaccgggcccactgctgtcgtgggcgcggcttgccacgtctgacgtccacgtagatgggttacatgttcccgcggggaccactgccatggtcaacatgtgggccataacccacgacccaaccgtgtgggtcaagccggcggagttcaagccagaacggttcctcggcgggtcatcgtcggaccacgctgccgccggcgctgagttctctgtaacgggttccgatctcaggctcgcgccgttcgggtcgggcaggcggagctgccccggcaagtcgctcgcgatcgccaccgttggattctgggttgccacgctgctgcacgagttcgagtggacgccgccgtcgtccgacgggccaggtggcgtggacctgtctgaggtgctgaggctgtcgtgtgagatggcagctccgctggaggcaaggctgaggccgaggcgtgctgtgtgatgacgtggctgggccatgcgggcagggtagacgttggcctcctcttcttctttactactcctactactatcagtgcgtgtagtgtagtggtaatgtagtgtcccgctttggaaatgtacctgctactaaaataggtccggtcctggtacgtgtactgctgtcctttactgttattagcagggtagatgtttaattacgtagttttgttcgcgatgtttaattacgggtagttatgaactactatcaggaagtgagtgtgacagttttcttgtgcttccggtttgctgcctagagatgtactacaagttcctatgtaaaaatatttattttaatgcaagtatcccttgtgttagagtt

SEQ ID NO: 12348 - DNA, 903 bp, Triticum aestivum
  Clone ID: PAT_TA_12348
tcgccacgcgtccgccacgcgtccgccacgcgtccgcccacgcgtccgccctcgcctccgcctccctcttctccgtccgtcaatccccctctatctcctccccgcaccagctcttgtactactcggagcacctccacccctgaccccgactccgaccacccatccatccgcttcttgcttcttccgctgtccgggccaagaatctgagatcctgtccggcgccgccgcttgtttcttgatggccgcatagatggcaggatcaacttcattttgagcttgtcccacaaggttgcaatcaccagtatgtcagctaaggcttcagaacgtacatatagatgctcagatgattcacaaatggcgtactacaacaactcggtgcctttagcagaaaatggacggttctatatgatgcaaaatcatctggatgttcactacacatcttcaggtgatgggtcacagaaaattagttccagtcctcaagtatttgaagcacagtactgcacactcgaatcatcatcggcaaatggtgtttatcctacacagagctccacatcttctcatagcatctcccctataagtgggagccccctgtctcagaatgatagccactcataccacacatatgattcacccccaactgcttcatgtgttaccgagataccggatttccagagtaaactaaaggagctagaaaatgcaattcttggacctgaattggacatagcctctgacagccccgagagcttattgcaagccaaccatcctttgaaacaagataactggagacagcttctgggaataacacaggagacttgaagcaggtgatcatagcatgcggtaagggttgtgctgggaatgatatggatgccacagaactattggtatctgagctaggtcagctgg

SEQ ID NO: 12349 - DNA, 478 bp, Triticum aestivum
  unsure (1)..(478): unsure at all n locations
  Clone ID: PAT_TA_12349
gggccgccttcgtgtcgcactgcgggtggaactcgacgctggnagagcgtgggctgcggcgtgcccatgctcgcgtggccgctgtacgcggagcagaggatgaacgccgttctcctggaagagaagctcgggatggcgctgcgggtgccgccagcacgagaggacggccgatgcttggtgacgcgccacgagatcgccaaagctgtgaaggagctcgtggagggcggtcagaaggtgcgccgccgggtcgaggacctgcagaaagcggcagcacgtgcgtggttgccggaggggccgtcgcgccgggcgctcgagcaggtcgccgtaaagtggaaggcggcgctcggcaccgcgaagtaaaacacatgcaggaatgggcgtgcgcatgcatgtactgcatggtctccatggcgctcatcgtatttatttgcagtgtcgtgcatgaagtactttattattttgttgtcgaaaaaaaaaa

SEQ ID NO: 12350 - DNA, 774 bp, Triticum aestivum
  unsure (1)..(774): unsure at all n locations
  Clone ID: PAT_TA_12350
ctccctctccctgtgcacacattcctccacgcccgagaggatctgctgcgctcgcctccattgccctggccctcgcgctcgccggcctccaccgagccaaatcctgcgccggagcccctccttcctcaaccgcacgaggcaccgatgtgcccccacaccccgaccggcaacgaagcaccccgcatgagcggacgcgttcccctgctccagaccggcggcgaagcgaccccgcgctctgcttctccctccccggcgtcatcctacaccccgcggcgtcgatccctcgctagattgatgcaaaccgtggctgggacctttgcttcctgtttgacccagtcccttctcatccaacaacaacaacaaaaggaggaagcggctgctccggccgccccctgcagattccaaccaacgacggccccttctgctcacgcgccccttggagatcccctacagttcaattccctggctgcacagtatagggaggattctcttgaagcattgcctcaaattcttcgtccacaaccatgcctgcaggggtcatgtggacggcgacgagaagcacggagcagtggatgcggtgcaatacctcactgtagatttccctcccgctcttcgtccacaggggcctcactaaattctaaaaggatgtcaaagcaatatttttgaggttttgtgcacacgcccaagcaagaagcttcnnnntncacttctnnnagtcacctacaaaaatctcaagctatcaaagaaatgcccannnnnnngaaacnnncannn

SEQ ID NO: 12351 - DNA, 536 bp, Triticum aestivum
  unsure (1)..(536): unsure at all n locations
  Clone ID: PAT_TA_12351
cgcggcggcgcccaagctcggcaagcgcgtgtgcgtcacggcgccggtccgcgtctaccacgtccccaaggcgccggnacctggacctccgcggcatggaaggtgtggtcaaacagtatgtcggtgtctggaagggcaagcgcatcacggccaatcgccctttccgggtggagttcgagctgaagctcgacggacaggacaagccggtccggttcttcgctcacctccgggaggacgagttcgagttcgtcagagacgaataggatccctctgtttgtctgtaaaataatgcgcgcttgggggcggatgcagcatatgtacattagagaggagactgaagaggggcgacgagatgtcaagtaagttgatgtttgtttacttgtcatgtctcctgtgctcctcactctcctgcccagtgctcaacatctaaattttcagatgtgagagttgttcgagatgatgaagattatgaaccaaagcaattatactgctgtatctgttgttgtgttcaatagttttatctgtttactctttca

SEQ ID NO: 12352 - DNA, 885 bp, Triticum aestivum
  unsure (1)..(885): unsure at all n locations
  Clone ID: PAT_TA_12352
ctgggtttttaaaaactagcaatagtacagnanacagtagnagccactatgccacagcacttgaagnaagaagaaattgtacctgaggaattagtgctcctagaaaggacactacctgatggtagcacagaacagatcttattttcttcagctggtgatattgatgtatatgatctccaggccttatgtgacaaggtaggatggccacgcagacctctgacaaaaatagcggcatccttaagaaacagctacttggtcgccacactacattcaataactaggtcttcggaaacagagggagaagagaggaagcaactgattggtatggcgcgggcaacttcagaccatgcgttcaatgctacaatctgggacgtccttgtcgatccttcctatcagggtcaaggtcttggtaaaacactcatggagaaagtgatccgcactctgctccagagggacatcagcaacatcacactatttgcggacagtaaagtggtggacttctacaagaacatggggttcgaagccgacccccagggcatcaagggcatgttctggtaccccagagtttagtagctccggtggcggcccgggcacccgcctcgtttccgcaagaccgacgcccgacgaccggcacagtctgctccagtgcagaagaatattgccaggagctgagctgtgtataacagtgactcgagtggccgatggccatttgcaacatctggtgcgaccggctctcagtcccaagtcctgttggtctgtatgtaactgctaggaaagtaaagtatccctgttttcgtactgcgaaggagacggccacaccgaacattattataccactgtggaagtcgagaaattgctcttccaatcaaaaaaaaaaaaaaaaaa

SEQ ID NO: 12353 - DNA, 1100 bp, Triticum aestivum
  Clone ID: PAT_TA_12353
cgtccggttatatcaacatgccagcagatcagtcttgtttggacggaaaacgcttaagttgttcttctgttgctgtgccaactacgatctttcaggaagacgcagttgaaccaaaaactggaatcaagttccctgcattccttgaagatgactcctgtccagctacaacggtcctcgttggggtgggtttcaaaggcatgaaaataatgagggtcaaaaatttgaacctgtacgcttttggtttatatatgcaaccgaatactatttgcgagaagctgggtcctaagtatgcttcagttccaaccaccaatctgaaggatgacccagatttctataattatcttctgagggaaaaccttcatatcaggcttaggttggtagtcaactacaaaggccttagcattggtgcagtgagagatgtattcgagaagtcacttggcctgcgtttgcgaaagataaatcccaacactgactatcattgcttgaagacctttgcttcttacttcactaaagatatccctatacctgctggcacaaagatcgacttctgccaaacgtctgacggtcagctaataacagaaattgatggcaggcagatcagtgctgttcagagcaaagacctttgcagggctttcttcgacatgtacattggcgattcgcccgtatcgctagaggccaaaagggaagtcgcccggaacgtcgccgggctcatgggcagatgtggcgggtgagacagggccccggtgggtcagagaattcttttgttcttccgttacagcatgtggataggagaaaactaggcgaggatcgttgcgtcgtgtacatacgctgagagatctggtaacctgtaaagtggaaagggcgatgttgtattgttgtaacacacacacatgggagatgcgcatcggcctgctgtgcaaggcgcccccgtccccatttggatggagctcttgcctttttgtagatgaggagttgaggatgcttctcccatgatgaaagaaaacatacaagcctgcaggtctttccgttggtggcttgctgccgtggtctttgcaatgcgatgtgcctgttgttgtgctctgcaaaaaaaaaaaaaaaaa

SEQ ID NO: 12354 - DNA, 404 bp, Triticum aestivum
  unsure (1)..(404): unsure at all n locations
  Clone ID: PAT_TA_12354
gctcccaaccaagcgagcaatggacgcggatggggcccaccaagctccacccaggcctccatggcctcctcggaagcaccaggtggacgcggaggagaaggtgccaggcccgcgttgatcactcggaggagccgggcgtccaccggtggtgacgcctgctcgatcaaagagcgagggagggaggagaagtcgggaatgaagccgtattggtccgggagcgtatacatagtactcatattcttttgcgtaacgttagacagtactaccagatggtataagtttcagttttcaggtagaggtgcaatcagtaactggccagctaagcctgcctattctttgaatttctatctactctactattcgcgctgcgtctttaaaaaaaaaaaaaaaacccnnnnaaaaaa

SEQ ID NO: 12355 - DNA, 798 bp, Triticum aestivum
  Clone ID: PAT_TA_12355
ccgcctcctgccctggggccgtgcggcttcccgcgtcccgcccccgcccccgtctgcggctgggtattgggctgctcctgttgctcctggccttgcctccgatcccttcgtttcggccccgcgcccctggggctgccggccaactggtgtcccgtgctggccgtcgggatttgctcccccgctgggcttatttgctaggattggtaaaggactgctcctgttgcgccctctctctcggtttgactctctctctatctttctgctggcgccgctggattagagggtggagcctgagcctccgctggagcagggaatcagacatttgtttgatcccaggcatcttcgagggcatcaacgtgactgtgtttgcttatggagcgacggacagcggcaagacctacaccatgcagttgcttcaagttaaaagcgcatgaagggcaggtgggcgggttggcgaggaccaggcatgaagggcggggccaaggtggttgtcatgccacacaagcacgacatcgtcttcatcgccaaggccaaggaggacgcactctgcaccaagaacatggtcgccggcgagtctgtctacagcgagaagagctaccttgcctggcgctggtactattatcctatactattttactatctgtatgctcttcactgcccctggaagtacctccatgcaaaataaggttgaacggaggagagtttgtgactgctatagaaggattgaaggaggtccatgttgaagaagatcgacagaagcaatagagcttgtaatattgtcattgccattgtatttgt

SEQ ID NO: 12356 - DNA, 636 bp, Triticum aestivum
  Clone ID: PAT_TA_12356
gaggggaaatcttttgtcgcggggttcgattcgcctctcgattcaggcccaggttttcccatcaatttgggttccattctcgcgaaagttgggaattcggagcattttctggtcgatttgaggccagcgggggtcggaaggtgcgaccctttgatcgaatcggccgcgcaaatgcttgtattcggctgtaatttggctccgcatgtgtgattcttgatttgtgctcgccctggtagaaagccaattggcggtttcttggctccaatcctaccttcgctcggcaaatctgaagcgccgggtgctacgtctgcaaggaaggctgccataatccgcgcagtttggtcttagatggggacgggatcgagcatccttggcgcggatgccgattggggtgagacgtctctcggcgacatgccggagagctgcgtggcggcggtgctgctcaaccttgacccgccggagatctgccaagtagcctgcctcaaccgcgccttccggggcgccgcatctgcggactgcgtctgggccggcaagctgcccgctaactaccggtaccttgcggccctcgcagctgccgctgatgatgagggcgatggtgacggagacggcaatgtcaagccctgctcccctatatcg

SEQ ID NO: 12357 - DNA, 778 bp, Triticum aestivum
  unsure (1)..(778): unsure at all n locations
  Clone ID: PAT_TA_12357
tcgctacaataagtcgtcttaagaattggagaggaagagagaagattgtagcgacaccgggtagtgcggggttgattttaaactgcggcaccggcaacattaaaagtgggagcaattgggacgaacgtgggcggcggagcctggtcaaagggctcgcctcctggtgagcctgcgtagcggtctgctcgcacgcctccctgacagccagcgcagcggtctgctcgcacgcctcccatcgactcacacgcttgctcggacggcacctgccgatgagaagcggggactcgtggcggcacgtaaacgcccacggtttcaatagtgaaagcgttcgccttaacgtgacaggtctttgttccaaaataccttggctcttcatttgtgcaacttgtcataagcagcttgtctcaaattgaagaaaaaacttacgaagtaatatttgtgccatatcacgtgaccatgcttagtttcaagaatttatgctcacttttggattttccttgaagatcgctaagcggaagcgttacaagaacgcggttgatggagtcgtactcgcggcgattcaaatcgcggaagatccgatctagcgccgaaaagacggcgcctccgcgttcaacacacgtacagcccggggacgtgtcctccttcttgatccagcaaggggagaggagaagttgagggagaactccagcaacacgacagcatggtggcaatggagctcgtggttntcncggcagagcttcgctaagcactacggaggaggagaaggagttggaggagg

SEQ ID NO: 12358 - DNA, 1095 bp, Triticum aestivum
  unsure (1)..(1095): unsure at all n locations
  Clone ID: PAT_TA_12358
agggccggtggaggcggccaagaacgccgcggcgcggtaccgggaggccgtggggctgcaggtcgaggccttctggcggcgcaactacctgctgctcgtcggcgccggcggcgtcatcgtctgcatcgcgctctggcgggtcatgttcggcatcgccagcaccttcgtcggcctctccgagggcatggccaagtacggcttcctcgcgctcgccaccgccatggttgccttcgctggcatgtacgcacgtgcaaggttcaccataaatcctgacaaggtttacaggattgcaatgacaaagctcaatacatctgctgcaatccttgaagtgatgggtgcgcccttagctggcactgatgtcagagcatatgttatgtctggtggagggtccaaactaaaggacttcaaattcagggttggtggcaaacggtgctttcttatcttccccatcaaaggatcagaaagaaagggtcttgtaagtgttgaggtcaagaagaaaaaaggacagtatgacatgaagctgcttgctgttgacataccgatggcgacagggcctgaccagcggctattccttgtcggcgacgagcaggagtacaaggttggtggaggtttgatatccgagctgcgggatcctatagtgaaggctatggctgcagaaaaggagtttgattatcttgatgaaagagaggacgcggaggatgagcgcagggagcgagaggaggccgaggaagaggcggccgaagcgttgaggcgagaggaggacagattacgcgaggaggcgaaagagaggcagcggcgagaagctgagaatcttgagaaaggcngctgacccaattgacgacaccgtttttttctttgtgttgtgcatttctccactttacctcctaactcttacaatgcgtagcgatcagcattttcgcggcgacggaaagattgcatctgagtttcagaaaggtggtttcgcctttcacagcgtgtcgatagggtaataaatgttggctgcccctcaaaatggtttactccggagcgcattgtgtaatttagtggctgcgtgaatgaatgatggctgtagccttcccattttggtgcctactg

SEQ ID NO: 12359 - DNA, 651 bp, Triticum aestivum
  unsure (1)..(651): unsure at all n locations
  Clone ID: PAT_TA_12359
gcaacaaagagctatcttcaaattattctggagagtttaccagtggnatgataatgttactgctggtattcataaccaacaagctgctaggctacaggaactagttgagttcatccagtcacaaggnagggagcttcaattctgatttatcttcacctataagagaaaattcttcaacagatggtgtgcttgatgatttgcaatccagaataaagaggcttgagagatggaatacaataaatatggttttatggactatactactgtctgctcttgttgggtattcactataccagaaaagacgtcattaacaagtcacaaaattgactcaagcaaaccacgccaggatttttctttatttccagatgttttggcatggttgatgaaccgaatcatttgacagtttattgataggttagtgcatataaaatcgtggtgttagtttcggagttgacatgtaaagtcatgcataccacaggtatactgtagcttagttgcgagcgctaactgaaaataaaaaggatgtatgttatacagggtgctgtcagagtttattcttgacatggcctttctacaaagggacagatgaactgtgattgttttcatgaagaagaggggacattatctggcattaaaaaaaaaaaaaaaaaa

SEQ ID NO: 12360 - DNA, 702 bp, Triticum aestivum
  unsure (1)..(702): unsure at all n locations
  Clone ID: PAT_TA_12360
gggctgcaggcggactccctaacntccttcaagaacagatccggccttcccctcggcccttccctgnactctgtgtcatggccgcactgcacactgctgcatgcgtagtccacgccctgatggcgtgcccccatgctcctgtgtgctgccccgacgacgggtcgtcacccgtttcaacaggtgcgtcgctcctccgcgtgcagtccccaaccgtcgctaccgtctgtatcaagtaatccgctgagctggagctgaaggtcaatggccgccccatgcaatccatggtgctggccgtgctttctcctgctgctctgtgtgaggtgaggacgggttctctgttggcaagttcattgcgagactccatggtgctggtcgcgccactccttttcttgttgctacgtctgaggcgaggacgggctctgccacaccgggaaccagggtgttcgcgacaccggcgaagacggcgtggtggttcccttctttcccaacaatagaagttgtcctgcagctatgtaattgttgaagttcaggaatatgtttggtgtctattcggatttcgtttgggcgcaacactgtagttcgcccgggtcttcactacggtgcggacgggtgtgcagtccaccgacgagggtgctagcagtgcgatggcgtgatgctcacggtcttgaataaatttttttgatgcgatggtgcgatggcgca

SEQ ID NO: 12361 - DNA, 612 bp, Triticum aestivum
  unsure (1)..(612): unsure at all n locations
  Clone ID: PAT_TA_12361
tccaacgatgcgctcctgcgcgcccctccccaacccacccttcaaacccgcgcccgcgccccatccaaacctaaacccaaatcccaacgccgcctccgcgcacagaccaacactgctccgctgcgccctcgtcgcgcgcgcggccgcaagggacgatccgccgccggcgccgtccagcttcgacttcctggcgctgaagcgggagctcgaggagcaggaggatgcggtggtccctgtggatgcgacggangggaggaggagacgaggttgttaacgaggaagatggcgagagggagccggagaggattgttagcggcgggaggaggacggggaggcaaatggcgaggcggtcggggctgctcgcgaagcaggtgatcagcgtcagctcagcgcggagcctcgggttcgtgtctcagctgtgggtcgacgcctcgtcgtgggttgtggcattggttgaagtgaggccaagcttgctttcaggagatccggacaaattcctttttcaggttttttatctggttggtggcggtgttcttgttctgggtgaatccgtggttctgatcggcttttgcctggtggggctgctgggcttcggcggccactcggtcggct

SEQ ID NO: 12362 - DNA, 593 bp, Triticum aestivum
  unsure (1)..(593): unsure at all n locations
  Clone ID: PAT_TA_12362
actaacggntggcttagccctttgnttcgctgtagtagcgatacttgctgcattggtcgcatctagcccaacaaaaggttggagtgggcgcagtttgagtctacttgacccgatggacataattctggttcctgtttatgatgaattcttcttctgttttctatataagttgatgccttgaattccttcgctttgttccattctgacagaacatatgcaagcaagtacatccctatcattgctagcgtgagcgaacatcaaccacctacctggccttcttactttatggctatcaatgtgctagccttcttagttcctgctgggatcatatcatgcttcttacctttatctgatgcaagctcatttttggtcttgtacttggtaacttcagtatatttctctggggtaatggtacgactgatgcttgttcttgcccctgctgtgtgcattttgtccgggattgctctgtcagaagcttttaacgtcctcacacgatcaatgaaatttcagcgcccaatatcagatgatacccttcctactgcaggagatagtaccccagggagttccagtacagccacnatcacaacttccac

SEQ ID NO: 12363 - DNA, 1424 bp, Triticum aestivum
  unsure (1)..(1424): unsure at all n locations
  Clone ID: PAT_TA_12363
cttgctctcacacgtctccgtttggtgctgctgagaatcctgctgagagggggaaagaaagagacgtcggcgatggcgccgctaagcgggcggcgagcgcggcggcggtgctgctggccctcacgggactttttcttctcgtgctctctcccgcggacgcagcaacggcggcggtggaaggaggagagctcaggatgaagcaatctgatggtggttactcttacaatagtactcttgctcatattcttgtcgaatatgcatctgctgtttatacatccgacctaacctcacttttgaaatggacttgtccaaggtgtgaaggtcacacgaagggttttcagatgatagagatcattgtagatgtagagaaatgtttacaggcttttgttggagttgcccctgatccacgatccataataattgcttttagaggcacccaagaacacagcgcctcaaattggattgaagatctcttctggaagcagctagatgtaacttatccaggcatgccggatgcaatggtccaccatggattttattctgcatattataatacaactctgcggcatgagatcttgaaatctgttcagtgggcatggaagacatatggaagactacccataaatgttgtaggtcactctatggngaggggctttagcttcattttgtgcccttgatctctctgttaagtgggggtcacacaaagttcagctcataacttttggacagcctcgggtaggcaatcctgcttttgctgaatacttcaacgagcaggttccaagaacaatccgcgtgacccatgaaaatgacattgttccacatttgccaccatacttttattacctaggcgaatggacatatcaccactttgcaagagaggtttggcttcgtgagaccatagtaggaaatgtggttacaaggaatgagacagtctgtgattgttcaggcgaggacccaacctgcagcagatcggtctacgggagaagtgtggcagatcatctcgagtattatggtgttaacctacatgctgattcaaggggaacctgtcaatttgtgattggcacatccaactcagcctatggtgacattcttcaagttgatggagctatcatcttatcaagatatccacaggagcgatatcctgtggaatctatctaaccctttagctgagggtaaactgtacaatatattatttcgtgttttgtgtaaatatttcatgtaatgtagacacgttgggtgctgtaggaggtctcctgaggataaggtttcgcctttagaatgtgcccccctttactctagtgagaattgtacatgaagctcagtcgacattgtaggcgcgccgccattgatgtacctgatgatatcacaggctcaaataataaaaacatttgatagtatcaaaaaaaaaaaaaaaactcgtnccg

SEQ ID NO: 12364 - DNA, 238 bp, Triticum aestivum
  unsure (1)..(238): unsure at all n locations
  Clone ID: PAT_TA_12364
ggccgattgtcgacatttcagaagttcaggaacaggaggattgtaagtgagctgctctggnaggtttcgctctcagctccagttttggattaatgttctggactggttgaatcttgatgcttatggtgattacatgttctgtttgttcatgtttattatctcattgtatctagagcttgccaaattaaggataaattggaagcgcgtgagatgctttaatgcgtgctcaaaaaaaaaa

SEQ ID NO: 12365 - DNA, 567 bp, Triticum aestivum
  Clone ID: PAT_TA_12365
ggtccttcagtgaaaagtgcagccccacacccccttcctgaggcggcggttctggccggcggcccgacttgctcatcttcagacttccgactcggaggctatgggattgctaggattcaggccagggggaaagccctactcggcttgccgatgctggcagcggcgacacccgcaggtgccgttttccttcttggaggcgctgccatggccttcatctacgcccctcttcaagctcaggggaaacccttggtccggttcttcggatcggatggcgacggcgtcacgacgtcgttctccttcttgaaggcgccatctttgattgctcgcggtgtccccatggttggctctggtgatgttggctgttgtggtggtttcgggctgcccctctacttcggggcatgttgggtttagccgtgttgtaccctctgttcgggccagagtatcccctttctctctgcccagtgcactatgtccacgccttcttgcgttcgtgtattgcgttgtacccttcctgtactctttctaatttcttctattctatcaatgaaatgatacacaaaaaaaaaa

SEQ ID NO: 12366 - DNA, 775 bp, Triticum aestivum
  unsure (1)..(775): unsure at all n locations
  Clone ID: PAT_TA_12366
accggtccggaatttccgggtcgacccacgcgtccggcatcctggaatagaaaaattaatggatatccttaagagcattcttacatatggtgatatttccccaaacatgatatcaagtgctagtgataaggcccatttgaggctggctgcagcgaaagctgttctccgcttatcaagacaatgggaccataaagtgcctgttgatgtgttttatttgactctaaggatttcacaggatgatttccctcaaatgaggaagttgtttctcagtaaagtacatcaatacatcaaggnagagggctttggacgcaaaatatgcctgcgccttcttgataggcatagacgattatcatacaccacagtacgaagagttccagcacaacctgatcgaagtgtcacaaatatgccaacaagttaagatgcgtcaactatctgtccaagcagatgtgaatttgctcacagcttacccagaatatattattccatatctggttcatgtcctcgctcgtgatccttcatgccctaacatcgacgaatatgaggatgtcaaagcatttgctccaatttactggccattgcatctacttctttcaaccctcctgggagaagaaggtttgcagtatagtgtacctggtatgaaaaaggagagcttcatgacaacattatctatattcagaagcatcaaatgttcaaaagacgcggtcgatgcaaataagaccaagactctacatgctatatgtgatcttggtattcttattgcaaagaggttatgtcc

SEQ ID NO: 12367 - DNA, 2046 bp, Triticum aestivum
  Clone ID: PAT_TA_12367
gccccaccccgcccgagcgcccccgccccccggccgcctggaaggagcccgcgggccgcgtcttcgccgccaccacgcgcaccgatgtcgccgcgcgccttggcgagctccgcgaccagatcctcgccggttgcgcctccttcccgacctcgccgcacagcactccggctgctcctccgcccgccgcggcggcgacctagtgtgtatggtagaaccaatcgatttgcagaagatagcatgaaccggaagggtaatcggtgccgccaccggaaggctctggcactgctaaccgccggaaactacactaccggcagtgccatccaaatcctcgggagacgctcaagctaccaggaatttggaccgtcctgccaagaagaatcagttggagaagattgggctatgctacttctcttaaggctgtagtatacactctttgtttgcttaattgtagtgatagttacaatgattgaattgctaaggtgacaaactgacagttattgcttgacgagcttacccttgttcatcacattgcatcctccttacacgggctccagcagatgttctaggactggttgttgcccaaagtgatgatatgaccatcagtttatggcctttttgagcttgatgtcttctgtattggagaaatgaagtcttcggcatgtacactgtgtaaacaatcattggaaaaggcgagaggaagataagaggagcatatagaagtttctgatttgtataggaggccttgttggtatgatttattttcctgatggtatattcatctcattaggaaggccttgttgtgtggctttggtcttcctaaatttgtgtgtggatttttctcttttctttttagctttgtgaaacaatgactatcctagtgcaagatctaatcatggaaatttccctattgtactcctttccttcgtggactgcttgtccgctctccttggttctcttgctgcccaagatgggcaatgtgcagatctagaaatggtatgtcccctatgcgtgtatgactgttcggtggagatgttcatactttaggatctttggttcctgagttagtgaggtgcatgctctcgaccctgacatctacttactctattgtcatctatagtctgtattgtgctctgcgcttaatgtgcattgggtgcatagcagaacatgaatttcagatgcccttatttgtttgatgaaatgcctccttgatctgcatgccaggtattatagcatactgtatatggcttctaagctctttgaaagtttaggacacaataggaagtcatattacagcggttgccgctctgccacgttcccgtgggcactgcctctatgtttcgcgagcccctccatggtcttctagtactgttggcttcctccggatttcttcccctgctttctgttactttataactgaatatgaatatgcagttagcttatttttcttttatgtgatatgtgagtaaatagcagttagctgcatgggttaccgtggtttcaagctcaacttttgtgttatctagctgcagttctaggactggttgtttcccaaagagatgatatgacgtccggtttatggtctttttgagcttgatgtttctgtattggagaaatgaagtcttcggcatgtacacggtgtaaacaatcattggaaaaggcgagatgaagataagaggagcatatagaagtttctgatttgtataggaggccttgttgaatggatgcataatggtcctggctactggcgagcttgaagcaagtggtgcgtgttgtgactcccactgtggcgctgtagtcgactccatcaattcaaattctgaagataacatgtagcctgaatccaagagggaacaaatccagttgttacaagactgcgttctgttttgcatattttgttgacagtttgcatctctgccatgttcatcttggattatgatttctttttcatctgctcccacttatatatgtattataagtccttcgaagtacacagaataaatcagacattctgaaatctttagtatacaactgcaatttcatctaaaa

SEQ ID NO: 12368 - DNA, 824 bp, Triticum aestivum
  unsure (1)..(824): unsure at all n locations
  Clone ID: PAT_TA_12368
attcggcacgaggctgagatcctcgcggccgcacggagacagagctcgcagccgcggcacacagccgagcggtcggtccgcctgcctccgccgcgcctatggattcctcgtcgcagccgcagccgcagtctcctcccgccgggggcgacccgtcggaggacggcgcggccgcggagctgccccggctcaccgtgacgctggtggagcagatgaaggtggaggcgcgggtagccgacatctaccgcgtcctcttcgacgccgcgcccaacgccaagtccgtcatgctagagctgtggcgcgatcagcatgtcgagtatttgacgaaagggctgaggcatcttgcacctagcttccatgtgctcgatgccaatcgaccttggttatgctattggatggttcatgggcttgcggtgctggatgaaacgcttgacgatgacctcgagaacgatattgtggacttcttgtctcgatgccaggacaaacattggtggatatggtggtggacctgggcagttacctcatctcgctacatcgtacgctgctgtaaatacacttgtaaccatagggagtgaaagagcactatcatcaataaaaagggacaatctgtacaagtttatgcttctaatgaaggacaaatcaggtgctttcagaatgcatganntggtggtgaaattgatgtccgcgcttgctatactgcaatatcggttgccagcctcgtgaacattcttgatgatgagctggcaaaaggtgttggaaactacatagcaagttgtcaaacttatgaaggtgggattgcgggggaaccttctgctgaagctcatggt

SEQ ID NO: 12369 - DNA, 750 bp, Triticum aestivum
  Clone ID: PAT_TA_12369
agcaagtcatcctgaattttccagtatgaggcagcaggatgcccttgacttcttccttcatcttgttgacaaagttgatcaggcaaaccctggaagccatgagttaaatccttttacgggcttcaagtttatcattgaggagcgggttcagtgcccctctgggaaagtttcttacaataaacgttgtgacaactttctttctttgagcataccattgcatgaagcgactaacaaagagcagctagaagtgttccatgagaagaaagccgcaatggacttggatggaaaagaagtgtctaatgaggaaattgtgagaccaagagtcccactggaggcatgcttagcacgtccgcggacgcgtgggcgggaataatcattttactgaacactaccagcagactaaatatcctttagcggtgaagcttggaacaattaccgctgatttggaaggagcagacgtttactcatacccggaagatgatagcgttgaagatccaatattagctcagcacttgtcgcattttggtattgatttttcttcactccagaagactgagatgactactgctgaaagagaacttgaccacaacactaattttgattggaatagaatacaagaaagtggcaaagatgccgaacctttatatgggcctggctatactggccttggaaaccttggaaataggtgtacatggcctcaagaatgcaaggtatggtttcaacccatccctttatatcacggtactttga

SEQ ID NO: 12370 - DNA, 1800 bp, Triticum aestivum
  Clone ID: PAT_TA_12370
ctgcgggcccgctcagcgagtcgccgagccggaggcccccggcctgattgacgcagcccggctccgccgtcgcccgccgcggcccgcggccatggatctcctccgcctgttcctgcacaccttgcgcatcccgggcgcaagtttgcaatgggacaaggatgggtgccaacgaatcctgatgtttctctggacgtgccggatatgatcgatatcgcgcacatccccagcaatggtgtacagcctggggaaggagctactgcctgaaggagcttcttgtggcaacaaagccgaacctgctcgtcctgttgccgacgagggatagtgtagcccggcttgcaaccatcggggttcaatttctttgcctgtcacaaagctgctgtttttacatcaaatgcacgacttgaggaggcaatgaattggctcctctcacacacgcaggatccagatattaatgagccgatatcttccaagatccaatgcctgcagaagacactattgatgaagcaagtcttcaaactcttgtttcctttggctttccagaagatgtttcccgaatggccttgaaagcttccggtggcaatattgagagagccacggagtgggttttcaggccacccctgaagcatctagctctgtatctgctgactcttcaacaaacaatgtaaaagatgacgactcgcacatatcagatggaagtggcagatacaagctgatggcatttgtgagccacatgggaacctctacacactgtgggcactatgtcccaaatatcctcaaagatggaaggttggcgatattacttgtcattaagattgcggcatcggtcggcctgaccttggacatgagacacgtcggttgctttaagaggatgatcagtaagtgcagaagatggagatgtagtttatgcctccctatcatcccggagctgggcggatgcgcgaagagctattggaccaatctgccttgtttcgatcacttcgtcacatcctgacgtgctgtgcctaggctgatcacgtgggaataccgctttgttggttcagacgttatatgcattggcaacttcctttacgtttatgcttagtaccatgtgacactgttcatgcaaagtgaatggttgtgttcggagtcgtacaatctgtcaacgttccgttggctccttatgcaattcctgcagaagtcacttttgatgaagcaagtgttcaaactcctgtttccatcggtcctggtaaatattctgcacccagtcaagagggacaagaaggaatacgtccccgtatgtttaagtcagtaattgcagcaagtcatcctgaattttccagtatgagacaacaggatgcccttgagttctaccatcatcttattgacaaagttgagcaggcgaactggcagatataagatgattgcatttgtgagccatatgggaacctctacccactgtgggcactacgtcgcccatatcctcaaagatgggaggtggacaatcttcaacgacaacaaggttgctgcatctgtcgacctgcccaaggacatgggatacctctatttctttcagaggattagcagttaaagcagacatcacaagcaaaagaagatgaattcatagttcatgcccacatatcatccaggagcatggtggacggtcgaaggactagtgcaaaatcgacttgaagcgactatctcgccacatcctctgatgctggttttaggctgatcacgtggggtactgctttgttggttcagacattatgcatttgcaacttcagttacatttatgcttagtaccctggactgttcatgcaa

SEQ ID NO: 12371 - DNA, 760 bp, Triticum aestivum
  unsure (1)..(760): unsure at all n locations
  Clone ID: PAT_TA_12371
ggcctccttcccgagcgcgacagctagggttccaagccgccgccggcccgcccgcggcgcgtccagctggccgaagcctccgccgccccgccgcccagccgccggtaccggagctcccgcccagcaaggccgccgtcctggagctacgctgccttccagtccatagtgcatcaacattctcaattgaagaggtttggagctgcttcggcatcctcaggagaacaaacaagaagttgctactccaccgtcgcaggaaggggcagacctcacctggattcgtacagcctggattaagcaggnaccagttcattatcggtttatacagnaaaattctgattgtagaagacaataatgagctgccgccgctttgttaatatggttgttgacaccgtcattggtgaccgccatgcctacgctcttcactgcatcaatatgtcgggcttattttacccaaccaagccaacaacaacacagctaggaggagcagatgcaaaagatggtaatacggttgagtccagtgagctgcctcgccctgccatgtccttctacccctgccgaaataacggggctccggtcgggagtgtggaattcatgcccgtcagcagagacaagaacgacatcctcaccatcgaccaggatggccgaaccttgatgtacagtgttgcctcacgtgccttccacatcctaccgccactgcagacacccatatgggagcctacctccgtgatcgctggtggcaagctctatgtgatgaaaagct

SEQ ID NO: 12372 - DNA, 785 bp, Triticum aestivum
  Clone ID: PAT_TA_12372
atggattaccgaaatagctaccgatggtgttcatttggttggacataccaaagggtatatccaggtccttgtcattgctccagatagtatgctaggaacatcagctgatgcgaagatcacatctgtcggaagatggtctttatttggtgaagtgatagaaggaaccgttgccataaaggaagcagcgcttgaacaaaattctgctgaagtgcaggtaaaaaacagcccaaatcgtgtggaggaagccgcttgttctacaaacacctgcgattcctgtgcatgctcgggtgcagaaagcgtggcacaacaatgtactccacagcgatgtgaaggtccatctgatgcaccgacaaattgtggtgatgctactcgtcaggaaacacctcaatctacgcttgtgagaagaaatgtcgagggggcagggaaaacaagtggaagtgatacagaaaaatctagaggggacgatcagcaggtaaatgtgattaccaggggagcagtaaacattgacaggattctttggggtggtctggccgtaagctttgccacaacagtggccatacttgtgctgcttacctgcaagattttttacacgtcctcctaaggctggtggttgtaactgtaatttttgtccccattttggtgacttttcatgtggaaccatcgtatcaccaagttatgttgctgaaatacaaattctcatgtatccttataaacttgtatacgacgagaaatggagtttttcatctccccaaaaaaaaaaaaaaaaaaaaccccccaccccccgc

SEQ ID NO: 12373 - DNA, 1108 bp, Triticum aestivum
  unsure (1)..(1108): unsure at all n locations
  Clone ID: PAT_TA_12373
ggaacccgaccacctccctcgtaacccgagaccatccgttgagccacacccaatctccgccatggccgaacccctccaatttccagatcactccccgcgccgcgttcgtggagatgcaacgagctcaacttccgcagtctgtacctgttccacacttccctcggcgcaaaccagacccagtccaccgtaatagacccgaatgctagtaccggtttgggtcagacggctgttaacaactgggcgatatgtgatagccctagccccggtgccaccgtcgttgcacgtgcacatggcctgcatatctatgccggtaactggcagaacaccttcagcataaccttgggaagttgagaggtttaaggggtcagcgcttgcgggtgttggggagatctgttgaggatggtgagtgggctattgttggagacgcaggactggccacgatgacaggtgttgtcaaaaaaaaaaactttcatgagaagaggtccgatgctaacatcgtcccaccgccttcgcactttggttggaccatggggtggaaatggaggcgccgataaagacatcgtcgaggcaccgggacgtctggagagcatcacagttagcagcggcactatcattgattcaatcaaattttcttatgtcgaccaagctggtcagaagcgcactgttgggcccggccttggggcaggttctggaggaaaacaaatcgtgcccggccccgccgcgtctgtgttggtggtggctggttccggaacattcggcctttatggcagagacaaccacaacataataacatcactgaaatttgtcaccaacgtgaagacatatgggcctttcggacaagcgaagggaaccactttcaccatacccgtgcaaaagaatagcagcatcgtgggcttcttcagacgcagtgggatatatctcgacgcgcttggtgtctacgtgcaccctctctaagctactagctagcggctaatgctcttatttccggtgtgtatttctcaatcaatttgaataagcggaagggatctagtagacttttctcttgtctagaagatcctatcaagccacccaacggctttttacctttgctgtanaataaaagnatcgg

SEQ ID NO: 12374 - DNA, 590 bp, Triticum aestivum
  Clone ID: PAT_TA_12374
cgaaaaatggcggagatcgccggcgacgagaccccgccgctaccttcgtcttccggcgccgaggagtcctctctcctctcgtcccctccctcgcctaccgccatcagcggggacgagccgccgccgcgcacgaggaagcccggcacgaagcgcctcgtcctcaccgcctcggtcctcctctccttcctcgtcggactgcccttgctgctcaaatccaccgagatccaccggtcgccgctgccctccgacgcaatcgccgacctgtcccgccgcctccagtcgcaccctccctccttcccctgcggtctccacgcggtcttcctccgctccggccctggctcccccgtcgcctcccttgccgaccagctcgagcgggcaatctcgacccagcaccacctcctccccgcgtcttctactgctgggagcatctcagtgtcagtcaccgtccagtcgggcggcggctgcaccagcagcacggctgccgcttcgccttggcgatgtggctcggtgaccgctgcggactcggtccgtggtgacgaggtgttcgatgaattgctgcactccgcattgggtggtggtgatggggatgg

SEQ ID NO: 12375 - DNA, 703 bp, Triticum aestivum
  unsure (1)..(703): unsure at all n locations
  Clone ID: PAT_TA_12375
gctcttttctactctactggacaaggctacagcaaggagagctgcgtactggagctgagatgatcagggctagcacaatgcagctgatgaaaatgtgtggtgctgccaagcaaccaatccaaggtgcttgatgatttcggagatgcgttgtatgaagagatgacgggcgtgctctttcgctgctgcttcatcccggagaggatgcctactatctgcttggcatgctactgtgttttgatacttagtctgattttttgagaatataataggctagattttatgtcgtgctactcaggttttcgttccatgatactcgttttgagaacgaacgagtatggtgggtttcctggtagtgctagaactctctatacctctttccctcctccaactctctatacctctttccctcctgactctttcgtttgaactggtttatttccgttctttgcaatggaaaggagtaaagcctggttctagaaaaaagatgttctattagggctcgaggacaggagatttctttttaccaatgtgtgaagattagtgtgtatttgttcgatgggtagtgcagcaattgattcttggagagggatgagtagatgtcagtgataccaaccctagatgatatcaagtttgaaaagttctttgtaaanatcaagaaaactatatagtttttttttcacattgtnacacaaaatcaatctnt

SEQ ID NO: 12376 - DNA, 430 bp, Triticum aestivum
  unsure (1)..(430): unsure at all n locations
  Clone ID: PAT_TA_12376
ggtagtatgcatcaagaggatcaccgtaatgctgatggcgttgcagaaaatggtgacaacaatggtgatcagaatgttccagagactgcaaaagaggctgaagttctggtggacattaaagatgagcattctctaaccaagagaaatgatggtttcgagcacaagccgcagcaccctagtgatgcaccaaagcacagcgtgagccaccatgatgctcagcttggtggtagacatgaagaacataaaatgcctcgacccgaaggttgatgggtcagaattgatgtagaacctacttggtagaattctcggtacgaacataggcacgtgtgactggagatgtagctgctctggactgttgatgagacatatccaggtcttaatgtttgtacccagatgttttngaacccatcaactnattgcaacggagatt

SEQ ID NO: 12377 - DNA, 482 bp, Triticum aestivum
  Clone ID: PAT_TA_12377
ttcggcacgaggggaagatgaaaacctgcatctaccagttttaaaggatggatatgaactcagaaaacaaatttcgggacagctactgacattcaaggagaatgaatgtgaaaacaacatgcctgctggtatcctggaattcatcagttgtatacgggaaatccaaaataaagctgcacaactttgttctccaatatgaatatgtggacttacgggtcaaaaggaaaacaaagaccaataaagaagccccatctccagcagttgctcctcctcaactgcctacatgctagagactgtgacgcgcaacctgaagcccacctcttatccaaactctgtagtttagtttgttcacctttcagggactgcatagatttagttaatagtgatgttttcctttgtgtcaaaactcttatgtaattcgagttagttattatggcactatgtccttttggggggaggcccctgattaccgaaaaaaaaaa

SEQ ID NO: 12378 - DNA, 809 bp, Triticum aestivum
  Clone ID: PAT_TA_12378
gagggccgcctccctcgcttcctccccctgctactctagcctcctctcctgccagcgccgccgccgcgcccttcccacccgcacgcaacccaccctcctcctcgacttccctcctagccgccgctgcctctccttctcttcctcctctctctctgctgctccgccgtcctccccatccacccatgctccactcctatcctgaatcgatcccgctggatctaaggcttctccggcggtgacgacgacctgtaggcaaagggcgatggcgggagaggtgagggaggtgcggcagcatatcggcctgtgatggtgatgtcgggctccaccattcccgcccctcgtcctcacgcggcctctcttggtcaccggcgctgcagttgtgcggggcgtgaggagagcgaggagagggaggggaagagtgggaggcgcgaggacggacgccaggcatgcggtgctggtcgtggaggactacatgccccctcttgctcgctttgcgtacgcgtcgctgctgttcttgcaacggtgccgctgctgtggagggcttggtttaagcttgtttatggcgggatggggagggcatgaggcatcatcgccagatcgcgaaggatgttaccaagtggggactacgctccggtcgcggcggggtgcagccgcggggaagacaaacttggtccgtcgtccgtcttcgcctctccgccccgtgcgggctgcctccatggccaagcgtacgtatttttttcctcttcctccgtggccctcgttgccgtcgggatctcgaggaacaggtgacctccatggtgctcgctgcc

SEQ ID NO: 12379 - DNA, 1113 bp, Triticum aestivum
  Clone ID: PAT_TA_12379
gaaattcatcaattcaaggtgttggaaatacaccaaactttatgcctgctggaccagtgaatgcacaagctccagttaattatgccccatcattgccaccggattatggaagcaacaatatctttctgccacagcaagcttctaatggtaattaccagtttcagcctggtgtatcttttcatcaaggggctttcagtgctttcccgtcggcacaaacaccaccagttcacccccacaatcatcacacacacatgaaccccatgggccaacaatctgtaccacctccatgcaattcttatggtgtacagccctttccaaatagtcaaagccagtatacatcggaagaacagtggcgaatgacatctggtaacttcagtccagatgaccagcataatacttggttaccaggtggcagatcactatcttgttcagatgggtcattcatgcaggatggatatccgaggtcgaacatcgacagatcttcaatgaatcaaatgagtcatcaacatgctgtacttaaccatttgccgtctggagcaccacatccaggccatgttgttcctcacatgctgccagccaagcctgatattcatgcacttaattgctggaggccttctggatgaacctgtataattaactctgcggttgtgacatgggaaattggagacgttgggagccattttaaatggggattcaacaagaggtgcttatgttagcctgttctgcgatgaggatgcacttttgcctggggagtaatgatgagatctggtgttagtaattggaatggacattttacattgtaattagtcttgacagcagcatccaacagactaatctcttagtgtctggaaactatacaagtcgggcggcgtgcgtcatgatgtggttgcgatggctgttacctgttggtggagttgaggggagctcatgtggtgagtcgagtgttttccttttacctgaggggatggatgttgagtgcttagtttgtagaggtaagcctcaatgaagaattgtacaaaagagatactcaatgtacagctttttgggcaaaacttttaaaagggaagttgatgtataaaaaaaaaaaaaaaaaaaaaaaaaaaaaaaaaaaaa

SEQ ID NO: 12380 - DNA, 998 bp, Triticum aestivum
  unsure (1)..(998): unsure at all n locations
  Clone ID: PAT_TA_12380
aggccggctattgctggcgcggnagcaccccactgagctcgcttcgctcgggtccatcctcccctccgcaagatttccccctcccggcttctacccgctcgccgaaaatccagtcccgtgctagggttctctactccggcacacccttcatcgtcggcgcatctccggcggcctctggcagctcttattcgtcgtctacggcgcccgcagttgtcggtccacctcgagcaggtcggcgcggaggatctcctcccgcaggttccatggacacggcgcaccctgcagttgccggtccgggacgagggcgggcacggcgagccttgtcttgctcaacgatgatgccggcgaacgccggtgctcctcctggtcgacctctaaggaggagcgccagtacagcatcagcacgccctgcggctgaaccccccttctccacccatccagtggcgtacaggatgtcagcaagtccaacacccccttagccctacggccctgcctcctgtcctctagctccaacagtttttatttaccgttaaggtacatgaatcactcgtggaaatattctgatatttatgtactgacttggttcttgggcaggaggagttagtgcagaatcaatatcagaaccatcaaaagttcaggattggacgtggtgttattttgttccagtttctagacagagccatatatatattggtttatgggagcagtttcaaccacaacgacatgcattttgatgacttcggtgtgcagccagaaacatgggatcacccatagttgctgtttgatgagagttggccttgctgatttgggtggtactgcctggagagtagcatagtgttctttgagacatgcttgtaaaattagtgttttctgggtcttccttttgctcctgtactaatatatttttggtgtatatttgtaattttctttttttagtgaaatgagcatatatttttcggcaaactcttaatagccnaaatttccaggaccaagagaaa

SEQ ID NO: 12381 - DNA, 602 bp, Triticum aestivum
  Clone ID: PAT_TA_12381
aggaattcggcacgaggcggcatcgacaagctggcgcacaggcaggtccggcgcatcctctggtccgggctggggctgatcatgtcccagatcggcctcttcttccgcctcaccttctgggagctctcctgggacgtgatggagcccatcgccttcttcaccaccgcgtccgggctgctcgtcagctacacctacttcctcgtgacatcgagggacccgacgtaccaggacttcatggagaggctcttcctgtccaggaggaggaagctctgcgccaagcacaggttcgacatggagaggtacctggagctgcacaggctttgcaagtgccctctcgaaggccactatcctcatggccccaagcttcacaacttgtaacgccagggctagaatttcccagctggactctctggattgtgcaataggcaaatatatagcttccaaagtgttcgctgcatctttgcagaagtcaccagttacctgctagattaatcttgcagacatactaaaggctaatctcagtgatgggccactgtcattatgccattatggttctctatgttttaaagttgaaagctactttctccgtccaaaaaaaaaaa

SEQ ID NO: 12382 - DNA, 1105 bp, Triticum aestivum
  Clone ID: PAT_TA_12382
agcaacgaaggcaaggcaatcagcctcaagtagtactcctcctcgtgtgtgtgtgtttgtcctgagctgcactagtgagtacgtgtgttactagtgagctgagtgcaagtattaccactaaatagtcaggaccctctggtctcagtagttccgggccaacatcacgcactcgggagagctcaagctcggtgactggatcttcaccggggagaagaagaagctgggcgacaaggtcctccctccgtcccacccagctttcgtccgtgtcagcggcatcgccacggagatcatccgcgccgccgcacgcagcctcgccatccacgacgacaataagctccttgaagataagctccttgacggcgaaatatgggtcggcgacgcggcgccgagccccaagaagaaggctcgctggggagcgccgaggcagccgacgaccaagcacctcgacgggttcaagtgggaggtgatcgtcgtcaacaataagcaggtgaacgccatgtgcgcgcccggtggcaagatcatagtctacaccgggctgctcgacaagttcagcaccgatgctgagatcgccgcggtgctagggcacgaggttgcacacgccattgcaaggcacaccgcagaggggctcaccaagaacatgtggattctcatgctcacggttttcctcggcatctttatcgatgagccaaagatgattgataagctcgccaaatacctcctcagcctgcccttctcacgaaagatggagatagaggcagatcacattggaatcctgctgctcgctgccgctggtttcgatccacgcatagcccctaaggtccacgagaagctcggagagctcggtgggaattcatcatcgctcaaggagtacatgtctactcatccttgcagcaagaaaagaacgcggcttttactggattccaaggtcatggataaggccatggcgttatatacagaagcaagagcgagaaaagaagaaattgatcgatgattcttcatcttgtatcaaagacacagtcttgacattttcttccatacaaagccacccttaaaaacttgtaaagggtgatgtttttctgtccaaacacttgttatcttaaaataa

SEQ ID NO: 12383 - DNA, 1154 bp, Triticum aestivum
  Clone ID: PAT_TA_12383
ccacgcgtccggcgggaggaggaggaggtccgacgggccgtgcaccaccgacgccaccaccggccgctccaacctcgacccatggacgatctgggaaggagggccacggcatggaagctgattgccctgtgccctggtacacaaggacgctggtggcgcttgggatcaagtcccatggcgacccttctggtccattgaggcatgctttcacattgagccaacattcttctggtgcattgaagcagggaactgttgatccgttgttgggggttgttgtcacctctgaggggtacctctcaaggtctgaatttgaaaggataaacaactaccttgaatgtgttcttaatgaagtgaaatctgcattaggttcttctgctgaggatgtcgaggatgaatacgggtgccaagatactgtcccaccagttactcaggagtcttccagtggcccaggcttgaagaccatatcggcaattgttctaggtgctgcgtctaggaatgcatgtgaaagtcctcaaatcagtcagggtaccagtgtgaggggggagataatgccaaacaatgcggagcacgtgcaggttattcaacaatccacccgggaaatcacgcctttcattcatgatgctgccagaagaaatctgattgccccccactgtgcacgggacctggttttcaaaatagatgagctgggcaagtgtacttcaagggccgtctctcgaaatggaacccgcatttttacattgaatggattgaagaagagactgaaactaccagactttagttctctaccagacaagattatagcttttggtggttcattccattctgttataaccattactggagctgcgtaccgtgtatctaaatctgatggcccaggatattttcatgatgtcgggaaagaagcattagaactgatcagggatcctttttacctacaaaaccatgtttggaattctggtcgtaaatcttctctgatatgtggcagtgaatttacaactagccaaaaattggtgaagaaattgatgttgagtttcaagaatgatggctccttcatgtgtttcaaagcttctgttatcgatccccttgaagatgttcctgtaaatgacccagaacatgatgtggctgtcaatgacattcctgatatggaagatcct

SEQ ID NO: 12384 - DNA, 836 bp, Triticum aestivum
  Clone ID: PAT_TA_12384
aggcctgttagtacacacaagtataatcgaaaggctcaaggaaacagaaactacagatgaggtatccagtgtcttatccagcattgtacccaccaaactatttgtccatccgcatctcctctgctttccctgcgtaccgaacaagctgatcccaagttcgctgaaccttagaaacttcacagatgaacattttgcatttaggcttgtggaatcctatgcagaagaaactcagcgacgctttgccaaattgccactgtacggagtcgtgtcgccgaggtcaacacacactcttacctcgcctcccctggtacgggtcgttgcctcctttccttgggtaccagagtgccgtacacttatggttgcgctgatgccactgtactgtagcgaggttagcggcgacaaatgtttcgttgtgaccagggtgaatggtaatatggtgctgcttgcgttgggggttgctctcgcgacctcccccctgcgagacgggtcctctgacctactcccctatgaaaccttctcctgcttcgcgtagagcccggtctcgtctcggggctgccttctggtttccctcgcctggcgctggataataacaggccatacacggggatatgtttgcatttgggacggtcaaacacaggcgagtgttgcttcctttcagggctccaatataaggactaaaagcactatatttcttatcaacagacttatgctacatctatacttaagtaccatatgtagggctaatgacaatacataccatgtaaggctactacccaatttgggggctcaaattgtctacatcagcagtgtcgtcggagtagtgaattcactttggc

SEQ ID NO: 12385 - DNA, 824 bp, Triticum aestivum
  unsure (1)..(824): unsure at all n locations
  Clone ID: PAT_TA_12385
gaggctcgcctgcaagnagtgcgcagnggtcttgataaagccgagnatatacagcattgcactgtcaccaaatgtgcaatggttggcagtgtccagcgacaaaggaacggttcatatattcagtctaaaagtcagggttgcgggtgaagattcaagtaatgatcagcgtacccttgaagctccacggatggatcatcagaattcttctacctctatggatcctcttatacaaacaaacactggatccaatgcaagctcatcactgtctttcatgaaagggattctgccgaagtacttcagctcagagtggtcatttgctcagttccatttgccggaagtcacacgttacatcgtagctttcggcgctcaaaacactgtaatgatggttggcctggatggcagcttctacaggtgcatctttgaccaagtaagcggcgggcagatgacccagaaggaatactcacggtttctgaagactgactaccctcccttgaggacattgaccgcgtaaaccgcgtgacgacgctgcaccgacatgtacatacatagaaggttgtgctctgtccattgtacatatatcgccccccttgccagcaaggctctaggccggtcgccggaataaggagcgccgggggtgtccggccgcaaccgcaacctgcctgcccattttgctgcagatgcccttgtcccgtccaaatnttgcattgtttgttcgacgtgtgctggtccaggccctcctgcccgtgcgttgcatcggggtgttatcaggatggaccgctaactcgccttttctgcgcccggcaccccaaaaaaaaaaaaaaaaa

SEQ ID NO: 12386 - DNA, 713 bp, Triticum aestivum
  Clone ID: PAT_TA_12386
gaggaattcggcacgagggacagatactgggacatcgctcacttgcacattgctgttactgaagtccacatacatgagcttcctcaatccttggagacctgaggaatcgtttgcttcagaataagatggtttataatgaaaaaagctcccaagtaaaattaaagtttcacccatgcaacagtacgagttacataccctaaaaaatttgaaaccaagcgtgttgtccagaaaagttcagtagctgaagctcccaaaataggctcgcggggatccatgtcatcttccgttcgattacacagggtttgatcttcttcctttctcctttaattctttgtctgctctttgatgttctacttgcggattggagctgctgtcagaacagcggtatatgtgttctattccgtttaagtataaggttgtgcggccttttttgctccatatttcctgaactcatagttcatttccctgttatgtgtagatctgcaggcagcatgcaagatcatttggttcgtcagtttagttagaactcccattgttgatttctcttcctaatgtaagccttggtgttgcattcatcaggtgtgttgctatttcgtatacagttctgaatgattagtgccaagaagtgagctccaaactagggcacatgtctttcaagtacaataaaaagattacagttaacttgttgagtaataatatatgattgctggtgc

SEQ ID NO: 12387 - DNA, 635 bp, Triticum aestivum
  Clone ID: PAT_TA_12387
gcccccccggccgccgcccgcccgtgccccgaccggccacccttcgccggcctccgccggccccgcgcctcccgggccgcggcccgcgccagccgccggcgctccgcgggaggccacggcgggcgcgccgcgacggagccgcccgcggctcgcctggccgagccccggtcaccccgcgcggcgccatcgcggaagcgcgggcgccggacccgccgccagcgggagcttccccttcgcggggtcgctcggcgaagccccctccgcgcacacgcgcagcgccgtggcggtcgcgcaggagatcgcgcaggctgcctatgaggacgacgacgcctccgtcagagttgtactgatgatggccttcggcccagcctcgaccgcagtcctgccgccccccgacgatcatgtgaatacggtgagcgtcacgttcgtgctggagaagaagtgcgcgttcggccagcggttcctcgtgctcgccgacgacccggagctcggccgctgggagccgcaccacgcacacgcgctggacttgcacactgttgccggtaggaacccctccgcatggaagctgttaatcaggttggcagtggtttcgacttctcaaaaaaaccaaaaaggccatgaaagcttgcagcacg

SEQ ID NO: 12388 - DNA, 859 bp, Triticum aestivum
  Clone ID: PAT_TA_12388
gaggaattcggcacgaggcgcatcgggtccccgaggaagcctcctgcaacggcgacagtcgggccgggaggaagagcccgccgtgcgcctgctcttctcgacgctctcgggacgctcgtccatggcgtgatcttcgcagcagctcccgcgtttcttccccgacgctgcgctccggaacgcggccgacccctccagcacgttgacgcacgcgtcactaccttcgtggccctcctccaacgtccaccgcggtgggagcagaggtgcagccctgccacgacggacacctccttcccgcgctccccccgcctcccggcgtctgatggtcgtcgtcagccaccacagtgggcaaggccaacctccacgacgactagatccgccaccaccgtcacgacgatggccgtcttccacggccaccccctacccgcctcactgtcggatcagtcgtccagggactccacccgcgcatgattgagggaaaggatggcatttcttgaggaagataaaggcatggttgatgcgtgtgctaggccaagggatgcacatattgcattgggaggacttaattgtgagacttgaagcacaagagagagtgcttgaagagatggagaagaaacaacaagaagaatttgaagctgtgaagaagagccaacaagacaagagtgaagccgggggaaagaagcaacatgaaatggataaactaatggctttttctctcaagtgctcaagcaactttagtctgagtccaaacctgtgtgactgatttgtggttatctaaatggtactttgcaacttgtctattgtagcgagtgctaaaacttgtaattggctaagatgattgcacttataatgtatttgtctt

SEQ ID NO: 12389 - DNA, 640 bp, Triticum aestivum
  Clone ID: PAT_TA_12389
gaggaattcggcacgagggataaacttgaattgcctacaaagaaggaggcttacttaagacgtgtatcagcatgcttggcaacagatggaatcgtgattaatatggtggttggtggtgaggtggctcttctaaggtctctggaagaaaccagtggattcgtcattgctgagatgccaatacatgtttctgagatattatgacagcctcaattcgcttcagaaattactgttacacttcaggactaactactccagtttctgttggtgctactttgacttgtgggattactctttgcttccttcatatttggatttgtctttaaattaggtttcagaataatgggattgatgtttataattctatttattgagaaatggacctttttttacttaaaagtttttatctgtctatgtatttctatttcgtacagcatttctgtttttgtgtctgttattaagggaatgaagattttcagactagtacgacaatcaaacctattcctaagcagtggaactcgcacgaacatgtttagttctaaccggatcagttgcaaagagacagcccaattggtattgccatgaaatgcttcagctatgttagaattggtgcgcctcagctgtagctttgttgtattatctt

SEQ ID NO: 12390 - DNA, 1148 bp, Triticum aestivum
  Clone ID: PAT_TA_12390
gcacgaggccatcgccagtcaggcctgctccatcctgccgcccagccccccggaggacgaccatcaccaccaccacgactcagtagatggcggcatcggcagcccacgtcgcggcgctggccgccgtcctcctcttcatcccttccctcctcgccactgtcgccgcgcagcagggcaaggccaaggccttctgcatcagccagttcgccatcgccagtcaggcctgctccatcctgccgcccagccccccggaggacgaccatcaccaccaccacgacgatgatgatgacgacgacgacgacgatgatgatgacgacgacgacgacgagcaccatggcggtgacggtgaccgccgcctccgtggacgccatggccacgcggcggtcatcaacatctcgtcccttggcctgatggccacgcgtcctgacagcaacggcgttcacgttgcaagaaacggcaccggtcaccatggtggcaaccacacccgccacgggcgcgggcgcagacgcgggcgcgggcgtcttcgtggtactggacacggccggcgtgggcgtgtgcgcgacggtaatgaggaccccgaccatgacgacgaccacgaggaggaccccgaccatgacgacgaccacgaggaggaccccgaccacgacgacgaccatgacgacgaacatgacgacgacgacgacgacgatgacgacgacgaccacgagcacaatgacgacgaccacgagcaccaccacgacgaggagctccgggcgtaccgcgactgctgccggtggctccaggaggtgcagaaggactgtgtgtgcgaggcgctcctgcggctgccgccgttcctcgtaaagccacagcacaagtacgtcgtccgggttgggcggacgtgccggatcgtctaccgctgcggcggcgtgtagccagctggccggttcacacgtttggttaactgcactcgttgtccctgcttcctctctacgattacgtgcatgttttgctcttcagtctacgtagatggataattaggtaggcagcacgtatggatcgggtgtaacttttctactaagtattgtcctcaaagtttttcgatgtgcttccattcggatagactaattgataataatactacatgttatccccaaaaaaaaaaaaaaaaa

SEQ ID NO: 12391 - DNA, 838 bp, Triticum aestivum
  Clone ID: PAT_TA_12391
cgagggatcgtcggaggcggagcaggcggaggcaaggaaggaaggggagatagtctgaacagcgccgcttcagtttgagttccataagtacgaaacaaactcagcgcgggcccgtccagcaagaaaagttcagtgagcgaagatgctagttcttcccctcctaggcaggatctcggtgcgtcgccagcgcccctggcgcgtgtggcagtcggatgacaacaaagagtctggttgacggcctaaattacgcgaagtcttgaagaatgctgcagggctatgccgttccgcgcgctccgggtaaggtgaccaggagcagccaacttggtgatgggtgttgctggagtcatggcaactttgttgctcgtcggaagcactctggctgcttctctttcctgccggttccacgaactctctttttctttgagcacgtctgtagagctgatttcgaaggagttgtcacatgcattcctttagatgaaccagtgattgaagcctacacctttcttggtttccgtcttctgtggggtactcgtcgtcttgcggattgcgtttgcaagacatgctaccgtctcttcaatattccacacccttgtttgaagaggacatgtacatgtggacatagcagggtggagaaaatatgtgaaatgtgttataatcgaagcggtgtgctgcatccattcagaggagaattccagtttggctatcacaaatagggttacccctactgctcacataatatgctaagctagacttggtgagttggtggtggggcagtatgtgtgttcgaatgctcaatgtgtatcattcgtccttacatcactctggcaatcttatgtac

SEQ ID NO: 12392 - DNA, 820 bp, Triticum aestivum
  unsure (1)..(820): unsure at all n locations
  Clone ID: PAT_TA_12392
ctccaccataccttctcctccagcctatccccaccgtcgccccaggctagaaggcgggtaccgccgtcacgagcatgaccccctccttgctggcgggctcagcaacgacttcgtctccatctggaacccatcgccgccgcggctgccgcggctaccatccgacccgagaggagcagctcgcagtaggtcttcctcgtctccatctccaagccccacgcgagcgccggcagtccccccgtccgggcgaagaaggtgactgtggttggatctgtcgcacgagaggcggcggcgcgatgtggccttgcaatactcttaggcattggtgaaatccgttctgcaatctaggaacgaggccaacttcaggagctgattgaagctgcactaaaattagctacaaagtaacatcaaaacaatttgtgggcaacctcctacaggaagaaaattacagtttggatgaggatttgtagtccataggatggtcaggtcctgataggttcaaaagatcaggtcataccatcatgactatattcgatttggatccttaggtacatcaaatgtgtctatccaagaggagcacaattttagaggagtatttctttatggttctgattccccacccccatgttaatatctctgtatgattaccacgttacaagtcttcttttatatccaaaagggggactagcaatctacatcaagcttattggattggttgttcatgcctacatcaatgtactgttcaacatcaagcttatcggatcaactgttcatgcctaaatcaaccaaacaagtnntggagttatcttatgttatttcaagg

SEQ ID NO: 12393 - DNA, 706 bp, Triticum aestivum
  unsure (1)..(706): unsure at all n locations
  Clone ID: PAT_TA_12393
aggaattcggnacgaggggcgggtngcgaaggtgcagtgcgtgagggtgttggtggtgttgggatactccgggcgaaagcttggctggtcttgccggccggcggcggcggcgtctgtggacgtcgtttaacctccttggaggcgtcgttgtggagtccggcatcctcttacacccttggatcttgctcttcgggtgaaagcctaaggcccggttgggtcgggcgacggcgtcgacatcgtcgcttccctctttggggcgtcgccttgaagagcttcggatcccggttgcgtgcttcatgggctggacgctcgcggcattgtggtcggcaggtgcccgtctggcaatgcggatgttgcgcggcttcctgtttgtggcaacgatggcggcttcgggcggagtcaggtttgctgatggttcttggtagttggtctcttctggcgtgttcgaggagtcgccgctctggcgctggctcgacgcaagcccaacgctttctcctgcaatgttcgtcgacggagtcgaagctgcctggtcgccggcgcgtgtggttgactgtttggcatcggccggcgcaagcctcgacgcttcccctcggcggcgtgtgtgcgttcttgtgtgggttgccaggtcaccctgtgtgccttgtttctgcgggccagttgtgacggttttcgcccggttttccgtttattaaccgggcaattctct

SEQ ID NO: 12394 - DNA, 680 bp, Triticum aestivum
  Clone ID: PAT_TA_12394
caaggtgcgggcggggtctcggtttgccgaaccccgtttgctggacgacccggggttcgtcagcgtcctcagcgacgaatccgagtcggacgacgacgagcagggcgcccggggcgtggctgtcaagtcggcacgtcagcccgagagaagagctcggagagtgagggcggcgatgaaggcggctaaatctttcagtgatcggaggcccgtcacggcctcctcgaggaagaagagggtcaagggctgccggaattctctgggctgcttctacaagatgtccggacggaagcttctgacggcgaagcaagaagttgagttatcacaaggcattcaggatctcctcaagttggaggctgtccaaaaggaggttgcacactacatcggtggcgaaccaaccttcggtcagtgggcagtagcagctggcactgatgagaacactttgaggaaacgtctcagccatggaatttactgcaagaacatgatggtcaaatctaacgtgcgacttgtaatctcatttgccaaagagtttgaaggccctgggacagagttttccgatcttatccaggaaggaattcagggccttataaggggcgctgaaaagtttgacgcctcaaagggttttaggttctctacgtattctcactggtggatcaaacaagcaatacgcaagtcggttctag

SEQ ID NO: 12395 - DNA, 686 bp, Triticum aestivum
  unsure (1)..(686): unsure at all n locations
  Clone ID: PAT_TA_12395
ttggatttttccngcagtttttgaattagcancgtgcaaataatgttccagatngttacagggcccagcaagttccagtaatattgagcattgaattacttgncccaaatatccaatgtaacaataagtaaggtattgttgntcttgttgttgaaacagcaggaaatccagagttaaggtcttgcaaataacaggctcttgtaatacaatgcccaatgaaataatcccacagtttcttagatattcttcaggtgagggtgttagcagtcattttttagggggtgtcgtcgtgatatcagagacccggaacgacttctcgaggagctgcggaacggttagtttcaactcgaacgtcaacttctggagtacataacacagggcagtcacatcatgcattgcacggtgcgctttgccatcgactgggatcttgtaacgctctaccagtgtcttcatcgacgcggagctgattttttccccatcggaatcaactaactgtcttgcaataggaagtgtgtccacaaacagccagtcagcaggcatctcttgtttgcaacgttggaactcaaagatgagaaagggcacatcaaaggttttcccgttatgagcaacccacataactggtttaccagcaacttgacgactccaaacgtattgtagtagaatggggataaactccccaaatcttg

SEQ ID NO: 12396 - DNA, 662 bp, Triticum aestivum
  Clone ID: PAT_TA_12396
tatatctttatttatgtacctgaaagcatcctcagaatattttacctgcatgataataaatatagttgtgtacggattaataacaaaaatgacccggaaattatgttttttagtacaagtgaaaatacgacgatgcttgtcccgggaggcatccctttatggtctgcacagagaaaatcaataagaagtatagttatatatagattactaacaaaattggcaggaaactaagtattttcagtacaatgaaaacatggcattgcttgtcctctgagatgcatctcttcatggtctgcacagagaaaactgtttgtagcttttaaaacgcaaagtagtatgtaaatgtcagtaggaaaacacaaaaaaaatattgaccattgatatatgcaaatatgtaaaaatggcgtcagatctgcatgtacctccaccactatgacaatatagagagaggaaacatgtcattccagcccactcctcgcagcgtaccaatctaaatatttcacatcattttcttaacgcagtcttgcagatgattataaacatatatcaagcgcttgatgtatcaaatttgcattggagcattggtgccaacttcaggcctctatttcaaatttcaaaaccaatagcttcatccctttgtcacagaggaagaggtgtgaaag

SEQ ID NO: 12397 - DNA, 605 bp, Triticum aestivum
  Clone ID: PAT_TA_12397
ctatcagaggcacagaagcaacaggaggaacatgatgatagtgaagaacccattgctttcagtaagaacttgttggcggagaagaagaaaacaaaagctgcaaaggagaagagcaagaaacgagcccgtgacgacgatgatgtgcctgcggaggaggatgtggttgaggatttgatcttgagttcggacgaggaagcggaagatgagaacgatggcctcggatcagacgaggatggctccgcgcccgttgaagatgacagcgacgaggactttgtggacccagacagcgcgtggaagaaacagaagaaggagaagctaaagaaacggagcaagtacaaaccgtcgaacaaggcatcctccaaaaccaaaaggaaaccccaccctaagaagaaagcaaaacattaatcaaggtagagctagggctcggcaaaggctgttgacgaagtgctatgctttcagtcatgagaaacacctgcctgtcacgggaaattttgtttaagttgagaattacacagcttcctttgtcatttaccatgcatttatatcgagagttattcatatgctgatcggttcaactttgccgatattgatgatttcctttccat

SEQ ID NO: 12398 - DNA, 683 bp, Triticum aestivum
  Clone ID: PAT_TA_12398
ctccatttaagatccacttgtttactgttttgccgctatttttaatttttatttgtcgcagaattcccagaagcggggtcatcaggtttaagagagcccactcctgctgggacttcggctggtacgtttcttcgcgccagcgcagtttccgtggttgctacagttgtcattatgtgcagtcgcccacaacgtcgagtagttgcgaggcctgcagtactgtcgaggctttctgtcaaggttgatggtgtgagatccttcacgttggaagaaatggctacagcaacaaataatttcgatgattcagctgaaattggtctgggaggttatgggaaagtccataaaggaaatctagctgatggagcaaccgttgcaatcaaacgagctcaggaagattctctgcaaggctcaaatgagttctgcacagaaataggattgctcccgtgccggctgcggcgggatctgggcccgctcattgcccctcgggtggtgggggttctccagttgctcgtgtttcacctcgcgccgtagcgcgctctgcgcgctcctcgttctggttcctgctgttccatgctgcactatactgaacgtgtgttcttttgcctgggccgccgcgatccagaatactttcagtggggtttttcagtggagttatactgagatatggtgtttgctcaacatacttg

SEQ ID NO: 12399 - DNA, 603 bp, Triticum aestivum
  Clone ID: PAT_TA_12399
ggaaagtcttacaagtaagacctgaagcaaaagtgatgccagttacataccccaggttcaggcttaccgttgataaaccgagataaccgcggactgtcttgagcccctgaagacagctccattgcaaaatgaggcttggctgtctatagggaggggtattcgtttagactagatagcagatagtagtagtagaaaacagcattacttgtgctgttctggactcgtggtcggtgttcgccacgcaaaatggccctaactgtacaaaacacctcatgtcgaacgttgcgtcgtcatcttggaaggacagagtttctctgctctagtgagacccttgcagcagagacacagcctccaaaatgatccttcaccgcccaccgtagaactgaatcagcatttccagcctcccccgcctctgatccgactccctgtagcgattctcaaggaaatcagagtaacccaggctggctcctccaggcatcagttgcctctcaatctcatactcccgctgcagactcctctggtattctcctgagtagtagtcgttgcttctccatggtggcacaactggaggcctctcttggtgccaaggctgctctggatgca

SEQ ID NO: 12400 - DNA, 648 bp, Triticum aestivum
  Clone ID: PAT_TA_12400
ttttttttttttgacagcacataaaggtactttctctgggggtttctttcctttcttactcggttgcaggtgaagaataagaatagccggatcgaatgtttcagattaccattaccatcacattttggcaaaggaacctaatgtaaaacaaaatgaaaaatacacagcagagacataacactgttacgaactgccttcttttagcaactgccaaactcaaatataataatgagtataaagaacaggatagctgaaccctactacactaaacaagccacaagcatcaaatcagaacgtcaggcgagagcgaaaccgcaggacaagggagatcagccaggggtcaggtcggtttcggccaagccacgggtaaccaactgaaccaagtgctaaactgccccacgcgcacagatgagcagcttggtagtgctgtgcggtgcgtcgaatcagacaactctgcggtgaaccttttgcaccttcagtcttcgaacttgttatggcttatgaagtttgaagccaaaaaccttggggacgtactgctgtgacggtttctggggcttcaaatgtgggtacgtcatcagaaacaagtgaggaaacgttgtcccaaagtaagctccgtcaatgttgctttgatatttggatctcggatag

SEQ ID NO: 12401 - DNA, 715 bp, Triticum aestivum
  Clone ID: PAT_TA_12401
ccccccctttttttttgacaaataataattatatattagcagagcatatgtctcttacagtgaatacacaacccaagcaaagatgagaagattccaagatcgcaaacagcatgtgctgcggttaaaaaggtcgtaaattacaacattttctcttgtacttttttccgcgcagaaaaagttggcctacaatggcctacagtggatgtttacatttgaacataataaaatgaaaattgaaagctctcgttgtaattgtcctatcctcggtatcttcatgacgcgttggcctggtgttggattcaggagcttcattcagcttgttttggttgcggcacagttgacaatctaagcctgaggggctttctttgaacagttgatgttgatgcacgagtagcgccaactggcgggccagcaagctcaagtggctccagctcttcctcagccttgcgcttcagatgattattaccatgagaactcaaattacatgtttgccccacggtccttccagaacatccttccaaagatgttccatgaacaggaagcacatgtttatcgtcaggcttagcttggtacgatgccagctcatcaagctcatcaaccacagccggagagaaattcacaggattatttgcaggaatcctctcagcttccctgtgtaagctactgaaacaaatgtccaacccatttgttggagcaccattgcttgaagtagatg

SEQ ID NO: 12402 - DNA, 286 bp, Triticum aestivum
  unsure (1)..(286): unsure at all n locations
  Clone ID: PAT_TA_12402
actgccgagcccccgcccgggccggtacaaactaaaagcaccaataacaggggcaagacgatgctacttattattgctcctcaggccttccacggaaggctctccgactacctctagcacaccggattattggccgacaatcactcactggcgccggtgcaggaaaccctacactctactaggtcaaatactaaaaaatgaagctgctgtaaaccggaggccattagtcggtcaccatcttcatgtcagggtcgtagcggccttgacctcggccgcgaccacgtna

SEQ ID NO: 12403 - DNA, 664 bp, Triticum aestivum
  Clone ID: PAT_TA_12403
gttcttcctctcagccttaagcgaaaaaaccctagcactggacgacctccaaaaccctagagccggccccaatggcgagccacgaaaccgacccgtcccctgccgcctcctccaagaagaagaagaggcactccaagaagcgcaaggccatcgaagtcactgtagatgcctcctttcctggcgccgccgcccccgtcgtcggctacttcccgacgggctacgacccccttgcggccgcagagcccccacgtgcgcggttgttccgccacgagaagcaccataaccgcgtcgagctagtggtcggcgcccctggtggaggccccgacttcgtcggccggagctacgccggcgaggccgctgcgccgcagctctgcggctacgccctcggcgtcctcgacaaggccaccggcaccctcaagattgtccccatcgcctccaacaagattttgaggctagagccacactttgaagcgcagcaaccggctcattcacaacagtcagcagcagaagcaggttcttctgtagcagatactgaattgaacaggcaagatcttacccaggcttatgggaccaagaaagataaggataaggataataagtggaagtcactaaaagaacaaaggaatgacccttctgcttatttggaccttgatcttggagagtc

SEQ ID NO: 12404 - DNA, 901 bp, Triticum aestivum
  Clone ID: PAT_TA_12404
gcaacaccacccctgcactgatacccccagcagctacttccaggatagtgctgcttcccattaccagtagtcccccagcacacaaagaagcacccggcgccagtcaccactcgccaccaagaaagaatgtgcttggagttcggctcgtgcttcggcggccgcagacgtgacgactacggccgcagcagagggcaccatggccacggctactggtcagagccggcgccggtgtaccgacagccgcccatcgtcgccgtccacgaggccgggcacaaagcctaccaagaaggcgcaccgaaagccgagcacgccgcctacttgcaagaccaggctggcagcgagacgccgccgaggcatcctgcgtggcacagcaaggtcggcgtcgaagctggcaacggcgactacacaccgcgcccccacgaagctgcgactgatcaccgggtccgggagcacgccgccatggattaccaccactacccaaccactaccactgctctcgcgaggtacgaggtggctagtcgttaggattagctagagcacgcacggccatggcagttcatcaattccccctaaacactagtactgcctctgcttctgctctgtacggcagctctgttttgttctgtagttctgtctctttttttttccttctctttctctgtttgggttttggccagtcgtcttccaatctgctgaaactgaagtagtgtgtctgtgtgtgagaggaacatgaggctgtggattttgacaaagagcctccatgatttttccaggaaagcttttgttggcagatggttttacttttaccagtctgtttgtgtagtgtagttgcttgtaatttagctacagctgctttcgccttgtgtcatatctcatatataatcaagtaaagaaagcactg

SEQ ID NO: 12405 - DNA, 1279 bp, Triticum aestivum
  unsure (1)..(1279): unsure at all n locations
  Clone ID: PAT_TA_12405
ccccactggatcagcaagctagctacccagtggagagccacagccgacgccgctgccgaggctacacccggcctcctctcgctgcggcggcgcctcctgcccggccccctggccgcgccagctgccgcggcggcgccacctcgccccgccccgccgccctcccgcccgcgccgctgctgctcccggcgatggccgccgcctcctccgacgcgcagccttctcccggctactacccgagctcgaggttccggccagtggcgttcaaccgcgggtaccgcaacaagtggggcccgcagcaccagacgctctccggcgaccattcagccatcaccatctggctcgacaagacctgcgggagcgggttcaagtcgaagcatgcgtacaggaacggctacttcgccacccgcatcaagctccccgccggctacaccgccggcaccaacaccgccttctacctgtccaacaacgaggcacacccggggttccacgacgagatcgacatggagttcctgggcaccatccccggcgagccctacacgctgcagaccaacgtgtacgtccgcggcagcggcgacgggcggatcatcgggcgggagatgcggttccacctctggttcgaccccgccgccggcttccacaactacgccatcctctggaacccggacgccatcaccttcttcgtggacgacgtgcccatccggcggtacgagcgcaagacggaccgctcgctcacgccggagtgctgaagagcccgtgaaccaacggtggcgcgcgtgtcttgattaatttcgtcgtgccggctccgggccgccgtccgcctcctgccggccccggcccgctccgtccgcctcctggtcgctgggggccgcgccggcgccccgccctcgcgcccccccccccgcgccccccccgccggcgccgggccctcgccgcggctggtcgcggcggcgcggggcgcgcgcctgcgccccatgggcgtctcctgccgccccgtctcccgcggggtccgcgcgccctccccggcgtgccgcgggttggtgccccccgacggggcggacgcgcgcgcccgtgcttggttaattcgtcgtgtgtttgcttgctatactacggggctcctaacggganctcctcctactaaatttggttcttctttggggtggctctcagagagtaaggtgtggctgccctaacgtggtgtgctgctngtgtggtgagcatnagctaggccgggtggtgagcgtggtcgttgcctattgncacagggtcgggtcttccaccc

SEQ ID NO: 12406 - DNA, 969 bp, Triticum aestivum
  unsure (1)..(969): unsure at all n locations
  Clone ID: PAT_TA_12406
aattcggcacgagggatatacggaaaggtggtggtcctgctcttgaagagcttgccctagaaggtgatccaaattctattaatttcagagttccgatgcgacaacacaaagattgcaatttctcttatgctggtctcaagactcaagttcgattggccattgaatccagaaatctgtgcacagatgatatccccatttcatctgcaacagaagaagacagacaactaagggcaaacattgctgcctctttccagcggatagctgttctacatttggaggatagatgccagcgagcagttgaatgggcattgaagatggagccttctattaaacactttgttgtttcaggtggtgttgcatcgaaccaatatgttagggcacgcttgaatcatattgctgagaagaatggcctacagcttgtatcccctcccccaagtctttgtactgacaatggtgtcatgattgcttggactggaatcgagcactttgttgccggtagatttgaagatccacctccagctgatgagcctgacgatatgcagtatgagttgcgtccaagatggcctcttggcgaagaatactcagaaggaagaagtgtttcacgatcattgagaacagctaggatccatccatcacttacatccatgatgaagagctctcgcagctagttcggtcggaccatcgatcttggctgcgtgctgccattgagttccacataatccagttttgggaccattacctgggtagccctgctcccctttatttgtcattgcagtaattatctgcaaaggcctgagctgattttctgttcattgtacacctgagcagcaaacaagatgtttgctgctccatggcttgatatttgaatctatattacgtttatacatatgaggtatagtcctcgtcagattgtttatgtctcaagctccttctgtactaagaaacccntccaatgngaanacaaggccn

SEQ ID NO: 12407 - DNA, 824 bp, Triticum aestivum
  Clone ID: PAT_TA_12407
tgctgagatactgaccactatggaagaacttgaagtgtacatgcagaaccacaaaaaagttatggttgattccttgtggaagcttaatgttgctgacatagaagccaccatatcacatgtctgccagatggtgcttcaggaccccttggccaggaaggatgacctgcgtcttcgtgccaaaggactgaaaactttagggaaaattttccagggtgttaagctcaacagtggtgagggggaagggtcgcacatgaagaatatagataacatggatgacaatgccggtagctcccctgattcgtcaccaaaacgggagccatcattcaatcccattcctaaccctcctcttacccagagtccatatgtggaggctccccagtttggcggaacctattgttcgttcaacttcccaatgccgacggctccaccaggtgcgcagagggatccggtgccttgacggctgacaccagatttcgtgtaccattaattatttcatgtaatgtcgcttgtgcatggtgcatcatttgtacctgtggtagtagaggagatcggatgagtccgaatcagtcagatataacctcactatttctccggttgtgtagcagccgcgcattgtctgtctattgtgtacagttgtgttaaggctgctgttacagaagcagcagcaggtcacaattgttgtacatgatttggtgttgttattcctgagctgaggtctcttgctgacattgaggtttacatgtctctgctttctgttgtgactgctcttttttgctgatgaagcgcgttggagttgatgtcctgcttaaaaaaaaaaaaaaaaa

SEQ ID NO: 12408 - DNA, 540 bp, Triticum aestivum
  Clone ID: PAT_TA_12408
gctctgagcaggatttttttcttttaggcacattcgggcgtgatgggattccggtccactcttctggcaggaccctcctggtgaacgagggtggcatcctcatgaagagcctgcaaatgggggaattttactacctaattcgtcgcttcttgtgctgcatccaacaagatgaatgattctaatgaacaagtgggggaatgctacttcaagttgattggttctaatcttctatttcattgcaaaatcaacataactatttacttgttcctatgtttgtaggtactcatatcgatctaattaatcagctccatatctagccggttagaagaatgaaggtttctgtatatgtataaaaggaaaccaaagaagcttgcatttctgatcaagcttcaatgagtgctagtgttcttgctttccatgttgatgtatgttacctctggatgaatcgtcttcctgctgagagtttcctctttcagtgttggagatgttgtagcagcttacaattactaggagaaataagttaccaaatcaaaaaaaaaa

SEQ ID NO: 12409 - DNA, 743 bp, Triticum aestivum
  Clone ID: PAT_TA_12409
cctcgccccccccggccgcgagccttccgatccccaaaacagagcgcggagaccggaacctgcacaggttgggcatgattcattgaactatgggtcgtctcaaggcaaggatgcgggaagcctctgaaagcaatcaaaagaatgaacatcgctccatatgcttacactctttttctgatctgtcacatgtttctgcagctacttttatgtatcttttgaaggactgctacttctatggaacccacaaagcaaccgcaaagttcaggatccttcagcagcaggttaaaagggcattaaataatgatcctcagccaggcccattcacatacattgtccaatgcatgtacattatacctttgttgggccaaagtcatgctgaagggttcagccatatgttgatatcttctctaaggcatttgaaatccgtggagtcagtacagaaagattttattgatgcaaagtgtcttgctgcacggcttgttctcgatgtccttgcttctgttgtaccccatgaagaacgcatactggtaaagctccttgagacattcgatatcgagttgaaagatatggcccatgctttctgtggttcagggttgggtgatgaagatctagcggcagcaagagaacatcttcatcagcatgtacagtacttcatgtcttcagaatcatatgtgagtgctgtggccctgatgacacgcttttccatccaatgctgtgatgagtcatttctcataaaactgatt

SEQ ID NO: 12410 - DNA, 898 bp, Triticum aestivum
  unsure (1)..(898): unsure at all n locations
  Clone ID: PAT_TA_12410
gcaggnaattcggcacgaggcctcttgggtacaccccacatccagtgaccatgtcgcgctgagacgtcccaggtacaccgcaccgcccaaccagtcccctctttcttccccgtacccacctccctccccttgttgttgactttccccctcccaccgccgctctggctatcgtgccacccggctgccccacttccccctcccttacatccccatcccgagctccacgcgccattggatcaatgtcggccctatgccccataacctccaacacgcgccagcgattgtggatgcggctccaggagctcctcgctcagctgcgtcgtggccggattcatggcggactgtggcggcggcggcacggtcctgcatccacgaaacaaaaagcgatgattggtttttttttcagtgcacgccgtgtactcgagcggttcagctaatgggtgaatgcagcccggcgctgccgtttgtgggcgatgcagttgggttgcctgcagctcaccttcggcgtgtagttcgccggcatcgggcatgcggtccggctacgcgcgtgttgcagagattgggcccggctgcagtgctgatgcccggcacttgaatccgctattgttaattgctgcggtttcagattaatatcttttgcaggagagaagccaagaagcaaataaagagaaaagaagtgcacaacacactcactaaaaagaacttgtcgatgatcgtttgctaattaaatcgttattgtgtattatgaaaaaagcaaatagtgaaagaaaaactgcactgcacacgagtgcagtgcactaggcgtgtgtttgcagtgggcaatgcggcaaaaggcagcccatgtggtttagttagttgctggtggtgctcgaaagctaattctgctctgtagagatat

SEQ ID NO: 12411 - DNA, 908 bp, Triticum aestivum
  unsure (1)..(908): unsure at all n locations
  Clone ID: PAT_TA_12411
ggccgcatctcgctcattcctgaaatcctgccccatcttcttcaactagctaatccaagatctccaagaactcaagtatccaagctgaccaatggcgcccaagatctacattgtgtactattccacctatggccatgtggccaagctagcggatgagattctgaagggtgtgtcttccgtccaaggtgtggaggtcaagctatggcaggtcccggagactctttccgacgaagcactcgcaaagatgggcgctcctgccaagagggatgacgtgccggtcatctcgcccgcagagctcgacgacgccgacggcctcatcttcgggttccccactagattcggcatgatgcccacgcagttcaaggcgttcatggacggcaccagtgagctgtggtgcccgcagcggctcgccggcaagcctgccgcattgttcttctcctccggttgccagggcggcggccaagaaaccaccgcgttgacggccattactcagctggtgcaccatggcatgctctttgttccggtcgggtacacgtttggcgcaggcatgtttgagatggggcaggtgaagggtggcagcccgtatgggtctggcaccattgctggggatggatcacgagttcccactgagcttgagctgcaacaggctttccaccaagggaaatactttgcggggatcgcaaagaagctcaagggttctccatgatcgacggctaccaagatcgtgtcgacatgaataaagttgagtttagctctgaatctagtaatttcatcggttcattgattgtaaaatacctagtcctatcatatttttggtgattggttgtgtgcatcctaattatgcagagaccggataatactctaaatgctttatatggctngatgctacattttagataataaaagcc

SEQ ID NO: 12412 - DNA, 505 bp, Triticum aestivum
  unsure (1)..(505): unsure at all n locations
  Clone ID: PAT_TA_12412
accatctctcattctttgcataccgtcagcgaactccgttccttttgcagananatgtgtgcttctcagagcttgagacctttgtaaagtgcatgcacggggaggctacccagaactttgtagattgaacttgctttggcgacgcattccctgatatgctgcaacttgcgttntgcaaatttctggattcccttcgtggctatcgcaanatttaactcatattgctgattaacgcattccggccatctccnccttatgctaagggtcagccgaccagatggcactgaaactgttgtgccggtggtgggcagggattagtatcccttatctgcggctacagggctggtagttcagcaagtttttaccgcggcgtcacctagcctgggctggaagatggaaagaatggcgaggcatatatctaatagcactgcattatcatgctcttaagatgcaaagaaaccctctcctgattgggtggtaaaccatctgtctctgaattcncgat

SEQ ID NO: 12413 - DNA, 351 bp, Triticum aestivum
  unsure (1)..(351): unsure at all n locations
  Clone ID: PAT_TA_12413
ggagagagagggagggagggagggagggagggagctctgagnagaaacagaggagtcgaggattatgttacaggacactagcctattggatgataaaagcaagaagtggttgaaagcaagaagtggttgatgatcatgaagaagaaagatcaacgaacgaaataatagaaacatctgattcgtttgtgtatgaactactccttctgtcccataatataaaaacgttttgcagactatgttagctcaaaaaatgttcttatattatgggatgcagggagtatctatgtatggattgttgaattttattttggcatatgttgaattatggttcattttggtttaaaaaaaaaa

SEQ ID NO: 12414 - DNA, 678 bp, Triticum aestivum
  Clone ID: PAT_TA_12414
ttcggcacgaggcagtacgctcacgctcgactccactcccccatcctcatctcgcgggaaacccagccagccagcccgaccaagaaaccggccacgagtccctctccctcaccctcgctcgctccctccctccgtccggacggagcaagagcgaacaaggccgcgagactgacggccggcgccggccggcttccaaaccgggattcgatttcggtcttggttccgctttcccgcaggagccagccagagagtctgtgtggacttcgtttcgtcccgctggttaatgctttcccgaattgctcctccgccccgccaccgctggggccgccgctgtcctcctcctcctactccccactgctgctgatgccggcgattacttcttgcctaatttgcgcagccccccggccccggcgcgctgttgcctgctagccccgcaatccctcgctcgcccgctcgtcggccgccgctcgatcgatcggtccaaccaatcccggcccctggattggagttcccccgggacggggcccatgccgacgggttcggtcgcacatttatagcccccctccctcccctgggcgagcgagattgatcctcctccctgccctcgcgccgcaagtatctgacaggtgttctgatttgggggggatgggctgcttcggctgcttcgccccggcggcg

SEQ ID NO: 12415 - DNA, 715 bp, Triticum aestivum
  Clone ID: PAT_TA_12415
aggaattcggcacgagggttgatatgtcctgtgggaacgttggaagagttagctctatggggttaatcggactagaaaatctcggaaatacttgcttcatgaatagttcaatccaatgtttggctcatacaacaaaacttgttgattatttcctcggagattatgacagcgatataaatcggacaaatccacttggactgaatggggaacttgccttggcgtttggagaattgttgagaagtttatggacgaatgatcgaaacacagttgcaccacataactttaaaagcaaagattgcctgctttgctcctcagttcagtggctttaatcagcatgattcacaggagcttctggctttcttattggatggcctgcatgaagatcttaatcaggtaaaatgcaaaccatatgaagaagctaaggatgcaagtggccgtccggacgaagaagtagctgatgaatattggaggaaccatttagcccgaaatgattctgtaatagttgatacctgccatggacaatataagtctacattaacttgccctacctgtaataaaacatctgtcacttttgacccatttatgtacttatctttgcctgtaccttccatggcaaagaggacaatgactgtgacagttttcagcactgatggtagcagagagccattctcatatgatgtcagtgtgccaaaatttggcactcttagtgaccttg

SEQ ID NO: 12416 - DNA, 906 bp, Triticum aestivum
  unsure (1)..(906): unsure at all n locations
  Clone ID: PAT_TA_12416
ttgcgcgggcgcgccagccgtccgcccacgcgtccgcgcaaacctccgccccctcccctcctccggcgaatctccgacgatgctcccccgcgccggcgcatgagcttcctccgcgcgctcgcggactccctctcgtcgctcctcttcgcgccgcccatggacgcgccggcgccgtcggcggcggccgtggtgggggagcgcgtggccgtgaagctgcggggctacttcgagctggccaaggaggagatcgacaaggccgtgcgcgccgaggagtggggcctccccgacgacgccgaggcgcactaccgcaacgccctccgcgtcatgctcgaggccaaggccgcccgcgtccccgacgccgtctcctccagcgagagggggcaggtgagggtgtaccaggacaagatcgccaagtggcagacgcaggtggaggagcggctcagggtgctcggcgggaggagcggagcggctgcaccagtccccaagaaggttgttacaaacaatcaagtaaataggcctgagagaccagcatcaactagcttccgtaagtcagctgtgcagtctaaccccacctttaacagaggtggtcaagcgtcctctcatcagaagaatagcgatggtggatccaagccagtgcaaagagctggtggaaaggatgatgacaaacttgttgaaatgataaatacgacaatcgtggatagaagtccatctgtcagatgggattgatgttgctggtctggacaaagcaaagcaagcactcatggaaatggttatcttacctactaagcgaanggatttattcactggtcttcgganggcctgcgaaaggctgcttntctttggtcctncggggaangggnnaaacatgcttgccaaagctgttgcgtnagantctgaagcacattt

SEQ ID NO: 12417 - DNA, 1731 bp, Triticum aestivum
  Clone ID: PAT_TA_12417
gaggaattcggcacgaggggaatctgtaggggccggagctaaggctggtcctctggggtgaccgcgcagttgaatttgaagcagaggcagtgcacgcaagggacaaaaagtaggctgtcattgcaattttcgtgggaacattgcctaagatgaatcaaggtgttaaaggacttagcggtagttctgcctgtcgctggtacatcgatgaggatttgcctgttataaatgacttccgcaacaggcttggaactaattttacacctattgatgtcaatgctgctattgatggagggtcgcttcctgctcgtatctatgatgctccggtcgaaatgactgtgtcagaactccttaagctcgacccttatgagagcgggctatggttattctcttctcatgctttccagatgttcctttttacttttgttgtttatgtacccaatactgaatgatgttgtttacacaagaaaaaaggttcatctgcaccgttacagtccaaaggcttactcctgatcagtgctagtggttcttctcttgctcttcctacagcaagacctcaacaatgatgggatcgcagtaccgatgcactaatcctagctgctcagctaaagaagcacaagaaacatactgtgtttctgtccttacacgtgatgatgtggatgaggctgagtttgttatgtttgataaggtcggaaaagcagctatgggaaagcctcttcttaccttgctgaagtttaggaacccagggcttgtaaccatagaagaaattgctcgcgtgccaatggttgacaggattgctccaccggaagttaatcaggttgttgggcagaagtataagctcctggtgtccatttcaaggagaagcttttcaaccactagccaccagttgtcattccaagttgtaaagattatggaaacctacaagcctcagttaagctcatctgcttttgactatattcctgggacgtccggagcatcatcttctacctcactaattgatggtccagcaacttctgcaatgtttacaccaaatacgccaaacatccatcaagtgcaacctagaagctcatcaggaagccttgctataggctatcagacacctacaagcgagacgcgcacaccaacttcaaagctcagtgtcaatctccttccaactgcatccccaggcaaatcgccatgcccaaccggtagtgccagacgtgccttgtttccaggtcttgacaataaagcagctccactagaagagcctatgaagaagcctgatgaaacagcagaggtgcaccaggaggaatctgatggcaaggtcgaagctcctttagttgctgttgaggaaaagaatgacaaggatgagcagaaccagacgaccaaaaacaaaaggaaccctactgctagaaaggggactgggacaggaaagaaatcaaggcagtaactactccgcgctagctacgcagagatatattacctatagattacctatgctgtaatgttagcttctctgcgatgacatcatgggagaaagacgatagtccatgcaactagcctcatcctcgacagtgctccaccgcagtgctctttgaccagcttcaagacgagcccgttgatgcctatgctacctgcgtgaacttttgtgtaactaaatgctccttattaagcaggtctgaaactagagtctttagctgctcaagtagcagtgtcaaagcacggcaaaacaaaaaactcccctatataatcaag

SEQ ID NO: 12418 - DNA, 934 bp, Triticum aestivum
  unsure (1)..(934): unsure at all n locations
  Clone ID: PAT_TA_12418
tgcaggnaattcggcacgaggtccgccccgccgcccttctccctccccccgtggtgtggctgtcctcgcctcgctcgcgtcgtcgtcctcatcggcatgagcggtttcctccgctgtggccggcaagattgtcacgctcctgctgtgggtgctctttctgatcctgcagacagccaccaaggttgtcgggggcctcctgcaggttgcaccgccagccgagccacaagaagagccgcaaccagaagcagcaccacgacccagatcgccgccggctgcgaggaacagcgccggcggcggccccgcggacccatacgatccgcggtcacagccgtgggacccaccaccgcccccccacaccgctccggtgacggatgagtatcactcgtcctcgatctaccggcggcgggtgagcgccccgcaggctgctgaggatttggtggtttcctccagcagttactctcgttcggccgtggcagcagtgccagcctctccggctcatgccgtcccagcgccaccagtgtcgcggacaattaagacaccggcagttgccagtaagcggcccaagctggagaggaagtactccaagatcgtggaccagtaccgctccttggatgaggttattgaagcattagcgcaagctggcctcgaatcttccaatttaatcatttggaattgatttcacgaaaagtaatgaatggacaggaaagaggtcattcagtggtgtgagcctgcatcatattggtgatgcccccaatccttacgagcaggcaatctccatcattggacaaacactgtcagcttttgatgaggataactttaattccgtgctttggtttngganatgcntttacncttgaccaaaatgtatttgccttnaatcttaacaaaanacnatgctntgggtttnaggagggtttgnttcntattaaaaaaa

SEQ ID NO: 12419 - DNA, 391 bp, Triticum aestivum
  Clone ID: PAT_TA_12419
ggcgcggtggagctggagcggctgctgcggtcgtacctctcgctcaacgcgccgcgccaccaccccgtcatcctccaggccttctccgacatctgggtcgtcctccacggcggctagccagcgatctcactggctatccactcactcactcactcagttattaatccagccccaggacgtttccttaactaccagtaggactctatcataagtaatcatgctctgcgttcatgattagctccaacgatgttcatcagtttgatcttagttttaatcttggctgtaactggccgtgcggttctgctgtaatgtactcctagtactagtagtactactgttcttggctctgacccagtgtgcaaaagctagcttctgatttggaaaaaaaaaa

SEQ ID NO: 12420 - DNA, 606 bp, Triticum aestivum
  Clone ID: PAT_TA_12420
caagaaacggagtacgactaaaacggacgtgcggagacggacccgtgcatgataacatgtgcatctcggtacaggatattgttgtaccattggtacagatgagatggaattgtacgtgacgacgttcttatcctatctgttcccctccccaccttcacgcctacgtccgggtcgacgtcttctacgacgacgacccaagggccaacctccccgacgaccagtacgaggtcatccaccacgacagcgacgaagaagcttgatctacttagctgagcaagatctatctacctatctatctatctaatgtgcgccatggattagagtgtgattccttctagtgatctactgcgtcttaaatttatgtttgcaagtgatgatcttgtatcgtagctatatgtagtgtgtcctctggcttttgcaacctggcaagctactatctatctaatgtgttactgaaactctctgttatgttgttcttcaaatcagcgatcaaaaaagtcacaaataaacatattttcttttcgatacgcaattacttgttctagatgtatttcaatgcgagatgaatccatttgagcgaaaagtaattccgagtggaggaaatac

SEQ ID NO: 12421 - DNA, 807 bp, Triticum aestivum
  unsure (1)..(807): unsure at all n locations
  Clone ID: PAT_TA_12421
gcacgaggctccctcccccgccccccttctctctcctccaactttcaccagacagcccgaccctgagctcagctggacatcactgacgccatagcctccttttccccctttcgcttttgctccgtctctctcctcctccgtggcccaagattcaccgcccccctcgcgatccctccgagttcgctctcgcctggggaggcgggaggaggggcgagacattgcggcgtgagatgatcttctccggtgccgtggtcttacgagcacaagagagtggaagataactgtggtgaagttcattattgtcatcagggggtgatgctggtaccttttcactgaagtgcatctaccttctgtaaccgatatactgtggcggtgaggagatcatgtccatggaagctcagaatcttcggttcgtcaggtgccccaaatgcctccagcttctcgtggagtacccgtccattccggtttaccagtgtggtggctgcggcaccattcttagagcgaaaaatcgaggtgcgcaagtaactcagcctgattcggcatccggtgaacagaacaattttccacacagcttggaagggntcccctcagaccagcaagtctatttgttccgatgaactgaaagttgtctctgctgatatgcagcctagtgaaaatatggttgaggaaaatatttcctctgccggcaagcatgccatctccagtgagaatgttaacgcagaaaggactatgtctgttggagagagtgcagcatctggcgaggttgacggtgaggacaattgttccctaagtgttggcaatgcccga

SEQ ID NO: 12422 - DNA, 740 bp, Triticum aestivum
  unsure (1)..(740): unsure at all n locations
  Clone ID: PAT_TA_12422
attcggcacgaggcattactaaccctggtacttgtaatcgtggtgaacttggcccttgggatactccccagagtggataactttgctcatattgggggtcttatatctgggttccttcttggatttgttgtcttcattcgaccacagtttgcatggattaaccagagaagagtagcacctggaccacaagctgctcctgccgaacgcaagcacaagacatatcaatatatattgtggatagttgctgctattctgctgattgtcgggttcacactggccatagttctgcttttccggggatataatgcaaacgatcactgttcttggtgccattatctcagttgtgttcctactaaaaaatggaagtgcaactcgtcaccgacaacatgcacggcaatgctacagggaaataccttgaacttgacatgtgaaggcaaagggatataccggagctacattgtggccgaagctacgcaagataagatagaccagctctgcaaccagctttgcagttaggagaaccggattccctgagctctcccagcttctaacatgatttttattctttctgtacatgaagagaatactacatattttaatagaaggttacttatggagggaaatatgcagtgttgcatattactccctccgtcccgaattacntgtcgcagaaatggatgtatctaaaatgtctagatacatccatttctatgacaagtaattccgaacggagcgagtag

SEQ ID NO: 12423 - DNA, 662 bp, Triticum aestivum
  Clone ID: PAT_TA_12423
gcccgccgcccccccggcctgggggtcccctccggggaggcccccgccccccggcctggccgccccccccgccgggggcccctccccgccgccggcctttccctggccccccccgccgtgcccaccggggttccccgcccctggggtttgcccccctgcgccgccaccccgacctccccctcccgtcgcccaccgcccccgctgggcgcgccggagtcctccgccccgactccctcgcgcggcccctcgtccggccccagccccccctctgcctcccagcgggcagggccgctaacccgtcgcgcctcacctcctccatcgccctcgcctcctctccccccagcccggcagccttcgggtcgcccgacggcgctcctcctccgacgcgctcggcgccgctcttcccaccccgatccccgtctggggggcccattccgctgctcggcggaagcggtcggggccgtcctttcccctcgtgtccgcctccgcgcgcccctttcccgcgctgggaggatgccgccggtgccatctgcggcccgcttgcgcccctgcgcgccccacggctccgcgaagatgtcgtcccgccgcaggtatgtgcgctgcgatagcgccctttcgggcctggcggcacgcggtagatacaatgaagatcaccatctttt

SEQ ID NO: 12424 - DNA, 774 bp, Triticum aestivum
  Clone ID: PAT_TA_12424
gtcgagcggccgcccgggcaggttgcgtttggattttggtttaccgccatatttttccgcagcgttgatcgttcgaatgagcagagcgagcatgatgttcctgccactgagagatcaaacctcagcccactgcagggcgatggtatccatgactttgcacactgctgaatgcccaatgatgtctgtcaagcatgctgcactttttcttgcgtagctgcattatttcggccgtacctgcagagcaagaacaatacatctggcttcatgatggatacgttgattcgcacatttgtctttgatcaaggtagtcatcaatcttgatgtctttttctatcagagcggacttagtgcgcctgtacctcggccgccacccctcaggccgttgcttgatgatggaaacgatgaagcgcgcacttcacaatgatcagtgaggtcatcaagcaagacgtcttgttcttgcttagctgggttctttccgccggccctgccttcatgtgggatgcgatgttgcgcgcccgtcgcctggacctcggcagtcatcaagcaagatgtctttttctttcttagctggattatttcggccgtaccccgcaacagaccacgtgccaattggcatgtctgggggctgtacctgtacataaatcgtttgctctcttgggtcgtcttgggcttttgtgtacagactgcagatactgcaaacagtgtgtatcaatggtgtaactgggttgattagaaagggtgggtaatgtttgcacatgtcaaaaaaaaaaaaaa

SEQ ID NO: 12425 - DNA, 992 bp, Triticum aestivum
  unsure (1)..(992): unsure at all n locations
  Clone ID: PAT_TA_12425
atggattggagctttncagaacattattactgtctagaaaattcatggcaatagggccaatggttgaacatataaatctttttgaagtaaattcttttgtaactctcagtctcagtactaccttgtcgattgatacttagaggaccagagggaaaaatccaaagcaaagccctacacatgcagcccctgcccaaaaggagcaactgcattttgtctacaatgcatgtttgactgaaattcctgtttctattttttgcagagcgctcacaaattaaacaatctatgaaatggctagaagggactggatatcctacttggtatgtggttttagaagcaacttaggttccagcttgctgtgaattttatgatttatcactgttatactgttaactacttaacttgatactgaaacattggaaccatagtatttgaagtggaattctgagcaggcttcaacaattcagtaaaggcctatgaaacatctatgatttcactagagagtggatttgcactcgaggagcaactcgagcagctttgcgcacatgcctaaacctactttcatgtcggtgatgttcatatgtgtgttgttctgtatcattctttacctctagcatgtgattgtaatccattttcaaactttttctaatagatgctcattgagcttatttttcatgtaaacgcacatgtacattctcggcaaaaacaaagaaagtgtggtgtgctcgaccttctcccagtccaaccttgacctggaagcatgtcaaacaaaaacaccaaactttacaccagcatcaagcccctagaaatagtctatcacctgtatctttgcgtatcactgagatggagccagaagacagttttttttatcagtttaggtgttaactccttgtgacaggtacatgtgagtatcattgttgtgtagagagaaaaatattcagattagaaaacatttagcttaaggtgtaactngtaaccaattactctggtctcac

SEQ ID NO: 12426 - DNA, 945 bp, Triticum aestivum
  Clone ID: PAT_TA_12426
ccccggcgcccttggcccgcccgtggcgcacgtgattagcgtggtgcgctggccgaggaccgatgatctccaagagaagacgatgctgttagatggcctaaattcaggttaggatgagggcgataatcctccgacagtggcagaggtggacacatcaagcgcaaggggaaaggcaatttcccgtgcacggttctgccatctctgcggcacgggtagcggctactggcagctggttttctcagaccccgggcacgatcgtggcgctctggcgattcactgggcaggcaggtccgccaccaccgatcgggtggttgtccatcacttcggcccggattcgcggtgcgttggcggagccgcttgtgaacgatttgttcagatgaccaattgggactacaccgagtccctgaaaagattacagcatgttttggaggcgtgcggtgtcaacaaaactcttgtcaaacttggagttaaggagggcgacacggtagttatcggtgagatggaaatgttttggaacgaagagcccaagcgggtcacggcgaggacgatgatctcgagagacgacgatgccgtcagatggcctaaattcagttagatgaggcgataatcctcgacatcggcagaggtggacacatgaagcgcaaggggaaaggcaattgccggtccccgcttccgccagcgctgcggcaccggccgctgcgcccgccccgacgccggccccgtgagaggcgccgcgtgagaccgttggtcaggcaggtccttgaccatcgatcggattgatttcgcacagttgtagctggatagctgtgccgaccagagttctcgactgggtagcaacttgtttttgttctgttgccccaggctagtacacattgtacttgtataacattgggtaatcccacctccagtaatggaaatttacaaactctgattaaaaaaaaaaaa

SEQ ID NO: 12427 - DNA, 590 bp, Triticum aestivum
  Clone ID: PAT_TA_12427
ccacgcgtccgatcgaaatcgtcggcccttgggtcttctcccgaccgaccgctgcctggaccggtgagccatggcgggcgagggggaggaggacgaggcggcggagatcgagctgcagctggagcagcacctggaggagcagcggtcctccctcgccgccgtcgacgctgaaatcgccgccgacgagtcgaacggggacctcctcgaggtgcacggggaacttctgtccgcgatcaaggatgcggaggaagggcttctgcatttgaagcgttctaggctagtgaagcaaatcgatgagatctttccaaatcaggagtcagcatcgctatcaactgaagctgctattgagccattagatccagatgatgttgagccagaaccattggagccacaggaattttcagtaggatcaaagtgtagattcaggcacaatgatgggcgttggtataatggatgcattctgggacttgaaggttcaggcaatgcacgggtctcatttctgacacccacatcagaaaaaaaggcgattggcaagttctttctgcagcaacggtgtcggtttgctaataactgccgcttgtcccatggtg

SEQ ID NO: 12428 - DNA, 912 bp, Triticum aestivum
  Clone ID: PAT_TA_12428
atcgtgaaaaagaatctacttttgcagctggtagaaccaggcgtgttgaagtggagcgcacattgactgagacacaacgtgatgaatttgaggacatgctgcgtgcattgacattagagagaagtcagataagggcggctatgggatttgcattggataatgctgatgctgctggagagattgtcgaggttcttgcagaatctttgacactcaaggagacacctatcccaactaaggttgcacggcttatgctagtgtccgacatccttcataacagtagtgctcctgtgaagaatgcctctgcatttcgaaccaagtttgaggctgctatacctgatgtcatggagagcttcaatgacttgtattgcagtatcacaggaaggattactgctgaagctctgaaggagagggttttgaaagttctacaagtatgggcagactggttcctgttttctgatgcatatctgaatgggctaaaagctacctttcttagaccaggcaactctggggtcacctcgttccactctctatgtggtgatgcaccagaaattgaaaagaaaactagctccgaggataataatgggtttaggcttgatgaagatggtgccctggccacaggaaaggcagcagcgacgaaagagctgttgagtcttccacttgctgaacttgaacgtcgttgtaggcataatggcctctcactttgtggtgcgtaagagatgatggttgccagattgctcagcttggaagaggctgagaaggagcaagtatatcagaaagacgttgccatgaaatatgtacaaggcgaaccgcatagagctggaagagaggatgttggtttgaatgctcgtaggcttggagatagtactggtgacagtgaatcagatatgctggggctctctcgtcacagtatgc

SEQ ID NO: 12429 - DNA, 695 bp, Triticum aestivum
  Clone ID: PAT_TA_12429
gaggccctcccacccttccctctcctcctcgccgccgccacaggacaccgccggggtccctctcctccctccagcagcggcggcggcacgagacacagcggactcggccttcgttggcggcagggttcctctcctctgtcgagcagcgcgatcggtctgcgtcggcggggacgggtccctctcctccgacccgtccgctccgcacgagcgaggggctgggcactggcggcttcctcacgtgacgggtcgccggtgttgcgccggtcacgggcagcggcggggcagccgatggctgctggtcaaaccgaccgggacagcggcgcatctttgcgagagggggagaggggagaagaaggagaggcctgtcggcggttgaggaggtgctgcgcgccgcaatctcttcctcgacgcgccgccagatctccacctcgacgctctgctggtcctctgcatccacatgccgccggaactccgcctcgaacttcagtttttgtggggttggtgaagcacaaacaagcgacaaagggcttggagtagacacccagctccatggttccattatgcaagatgtggcttggattgccgtgctgctgaaaacaaccaacggtggctccgcttggttttgaaattgggagggtttaatttaagattttatattttcccctgtttttgtatggacaatgtgtgtccgtcca

SEQ ID NO: 12430 - DNA, 616 bp, Triticum aestivum
  Clone ID: PAT_TA_12430
cgagggccgccgtcgcgcagtacgaatggcaaggggaggatcgcggccatgctctggttccagggcgagaccgacaccatccggcgcgaggacgcgctggcgtacacgggcaggatggaggcgcttatccgggacgtccggcgggacctcggcatcccaaacctcctcgtcatccaggttgggatcgcgacggggcagggcaagttcgtggatctggtgcggaaggcgcagcgggcggtgcgggcgccgaacctgaggtacgtggacgccatgggcctccccgtcgccaacgacttcacgcacctcaccacgccggcgcaggtccggctcgggaagatgctcgccgacgcctacgtcgccacgctccactgattgataatccagtggttagcgcgtgcgcctgcctgattactgataagcacctggactgtttagttggactattactaaaccatactagtagtagtagtatcattgatccgctcaagagattggtgatgattagttgtggtggctgacagattaagtggctgatcaacgattctgctgaattagtcagtctgtagcagcagcggcagtataccatgtactatgtcaggctcccaattcccaaagg

SEQ ID NO: 12431 - DNA, 645 bp, Triticum aestivum
  unsure (1)..(645): unsure at all n locations
  Clone ID: PAT_TA_12431
ggttacaagnagtgggcagtatatgtttgttcaatgtccagatgtttcaccatttgaatggcatcccttctcgataacttcagcacccggggatgagtttctcagtatccatgtccgacaacttggtgactggacacgagagctcaagcgtgtattctccgcagcctgtgagccacctatgaatgggaaaagtggcctccttagagcagacgagaacaccaaaaaaacgtatggctatccttcttattcagaggcaataatatgtttgtgcaatcgggatcttgataattattttcaaaatgcagtttcccaaaacttttgattgatggaccgtatggttctcctgcgcaagactatagcaagtatgatgttttactacttgttgggttaggaattggtgcaactcctttcatcagcatattgaaagatctgattaacaacatcatcaaaatggaggaagaggatgaagcctcaactgatctttacccaccaattggacccagtaaggcatctgttgaccttgacacccttatgaggattacgtcaaaaccaaagagggtttttaagacaacaaatgcttacttttattgggttacacgcgaacaaggctcttttgattggtttaaaggaatcatgaatgagatt

SEQ ID NO: 12432 - DNA, 1171 bp, Triticum aestivum
  unsure (1)..(1171): unsure at all n locations
  Clone ID: PAT_TA_12432
gaaaacgcagactcgactacagagaaatatctgtggacagggatttgcttgactgcttagttttagatttcctcaaaggtggctatttttcaagggtgatggaggttataagttacatgccaacccataatatttactgcgacaagtggaaatacaggcaggcctttctgaggctgcacaagaatctgtataggaacttgaattcattgcatgacaaaacagaagctcagagcaaaaggattgatgatgtccgagctttcaggacatgggcaggcatcaaatagataaagccgagtacagtgctgtaattctcttgctttttggaaacactttctgttgcatagcccagcagtgcagcattcttctccaatgtaacatatcatcaaagtctggtaattctagagagtggatcacatttgaattgggcaaaccgttggagagagaagtctctattttcataaactgtggcactatgctgcaaccctatgtggattgtgcccactgcccagtatgttctattcatgtccctgatgatcaattgtgttgatgcatggttatcactgctcgcggtagcagcagcttctgtggcagtatgatgcacacatgaatttgtacgatatctcgaatttatgtaggtgtggtgtggtccaacaagttttgaacctttgatgtgtaggatcatgttggcactgctcggttatatttggagtatacggatgccgtggtcgatttccagcctcttagttacagcatgctcggtcatttcaagccaaccctaccagattattctcaggaacttgctcttccagcagagaaacagagcagtcgctcttttgcagtcagtgtaggagatgttcggggtggcaagagctctgaagtttttacagttagttctgtagttgagtgtttgactacttcctgacagatgttcagatcttangtaagagatgtgtcactgctaccaagttcggtgtgctgtttaactacttgttgattctgttgctggaaccgacgagtttcaggtgtagttttgccttaggctgcatggtgcggccttgtggaatttatgaatgtgcgaacaaggaattcattctccttcangcgcatggtttaatttcaaggttgcatgcgttgaaatgactgaatgggtacatgtnccggaaaaaaaann

SEQ ID NO: 12433 - DNA, 824 bp, Triticum aestivum
  unsure (1)..(824): unsure at all n locations
  Clone ID: PAT_TA_12433
ggnctgcaggnaattcggcacgaggctttttttaggtcgggtaaaaaagcactcgacacgagtctaccgagggcgtcgccggcatagacacggtagactcaagggcattgccagaagtctgcaggaggtgcagcagagaggtcctagcgaccacggcggcacatctgcggctggtccacctcgggctgcttctccaccaccaagcgcttgccccgcgtgtgcttcttttctcccaggagtggaccgtagccatggagagcggccagaggagcaaggacggtcagcccctgcctcctctcctgcacggctgcacgtgatggggattacgagcgacgtacatgattttgcaagtacaggtgataaagattcatgatttggctgcgcgcatgcttgctggctggagggaatttaaattatgtctgatctgtaccgggacgacgccgacagtaaaaggaactaaggaagggttctcgaggtctgctccttctccaccggtagagaggagcctccttctcatgattcgcatgtctgccccggccctccccggctagagctgacgccatggaaggtctggcggctccatggatacatggaagccgccatcattttgtcggacagccgccatcattttgtcagactaagtgtggagttacttgtgcaagttccaccatcaacaaacacaaagttctgcatgctatcatcgcaagtaaagcagtcagtctgttagggagaaaacaaaggcttgtgtgctcattagttttttttgttatatcatgnggtctccttatctatctgtaacatggacctgtgcaactgcaaaaatg

SEQ ID NO: 12434 - DNA, 853 bp, Triticum aestivum
  unsure (1)..(853): unsure at all n locations
  Clone ID: PAT_TA_12434
ccggatatagcttggaagaacttcccaagaagacaggggccaaagtcagggactggcagaggctggggagcttccctcagaagattgacggtgtcgagctttttgggttcaaaaatgcatctgttcagagactgcttcgtcagcttctagtagattcgactggatttggaatagacatgccttctccaaaaatttatggtgctgcttcaccgtcaactgatacggttgcagctgatgtttctgatgatcacaaagagcagcatgtttgtttggacaagacagttgtaactgctaaaagaagtatgaacccgatccaggaggaaggtactgctaagagagcccacaaccaggatatgttgacttcagttgataacagcacagtagagttggataaatctgctcgtcaaagtttcaacaagggagatcctgtaagcaactcacagttgtctgttgtttctactccaatatgcatgcctccggcccccccggagctaccctgtgattcaaaatagcactcttggttaatgataaagtttgggaagactatagttccaaattcatctcaaggaagatnggtctatcttccagttcttatttaggctctgaaaagtctgacctggaagcagcagagaaggaagtagccaggtctatgatgacatttttgcttccccaagctatcccccttctggagaaaaacttacagaagaaggaaggttaagcaaaaaaagaaagaagatgcagttttagcgagaagtgttgcagctcaaaatccctctgctgatggttgcaaagcaggtgccactttgcctacaagtgttggtgaagggaacatgaatggctctcaagcacatgt

SEQ ID NO: 12435 - DNA, 466 bp, Triticum aestivum
  Clone ID: PAT_TA_12435
ttcttcctcatgccaccgtaagaggaggaggaggagaggccgtggtctcgcgtggagttccctcaatcatcacttcttggttctagtctgtcgttgttcgctctcgctcaggtagggtgggggattttgctgttgtgatcgacccccctcgtgttgttcgtagggattcatggcagatgcgactccttttctcctcttggctcttgctgcgtgttgttgcggcagcttgattgtatgtttgttgtatccaagcaaataaatgtttgatgagtagagaaactgcttgatcatgttccttgtcccttttgattgtttttgtttctttcgctctcttgtctgattgtgtgtgcgtgtatgtgtttctctactccccatctgcagctgaagatgtttccaatgctgcaacggttcatgatccaatatattctgacgccatccacgccgttttgagagggtaaaaaaaaaa

SEQ ID NO: 12436 - DNA, 1281 bp, Triticum aestivum
  Clone ID: PAT_TA_12436
gggaacatagatgacgcagttcctttctttggaagacgcttcaacaggatctacccactaattatggttgtttatacactacttgttgctagtaacttctttggacgtgtgattgactattttggaagctggaaaatgtttaagttccagcgtgaagaagaacatatggatggttttgatccgtctggaattattattctgcaaaaagagagatcttggattgagcaaggatataaagttggcgagcaggttattccattggcaagattcaatggcgcgagcacagatgttgaatctggaaagattgaagatgcagtggagatgaaagcggggacaacttcttcgagagttgatggaagagccggtcaatctaaatatattcacaacagggaaatgatttccaacaagtattcatctgttagagatcagagtcggcaggcaacaaagccagtgaaaaaggaaactgtgtcgacatctgcatctctgcttgaagaagggaatcctgaaaatcgctcggctgctggaatctcccaaacatgggcttcagtgaagaatggttttcagaacttcaaagcgaatatggggtgccaagaagttcactcctttgcgccaggatccaggatttgctcctcattcgaacgcctcctcgcccgaatctctcgatgacatcttccaaaggataaaacggcgctccgcagaatcacccgtagattaccttgacgatgatgacgacgacgatgacaataccggagacatggatcctccgtttgcaggatcgagaagataggcagtggcttttcccttagaagttagatcattaaaatctgcgaatcaaaaggatttggtaccattagatgcagcatagaagatacaggatgtatagatcagatgatggttttggtgtgcttcgaggaagctcgaggcgcccttgcccatctggaaaggtgcagacgtgaacgaaagcatatgacatgatgacacaggccctgcagaaaggacagcgaattctcccaacaagagatcatgggagcgtggccgtatcacacttttctgctttacacacattgtgggagtaggcattgctgacgtgctatttttacttgttattagatgttgaatctgtattggagataaccgattcatactcgaagctgacgagtgtaggctgtaaaggtggtatgcattattgtgatgtgcgttgaaaacatgcggccgatctaatgaattaaatggaaaatttgaaaaaaaaaaaaaaataaaaaaaaaaaaaaaaaaaaaaaa

SEQ ID NO: 12437 - DNA, 1239 bp, Triticum aestivum
  Clone ID: PAT_TA_12437
tcgcggccgcgtcgacgttcctagagcatttcttcagactttattggttcaagatggcaagccttatgggcgagacttgttttgtgatgtaatttcaagggctctgtcattaccggatattataggagataaggaattccagtcgaatgagtttgtagtgcagctaggtcagttggttaccaacttgctcaaaattctctgtacaaacactgcatggcaacggcgcaagcttgggaagagcttgcaggattggagtaccatttccatacagttggagcttgcattgaaaagagagtttggtgaaactagaaatgtcttggccgatgagaacatgtgcatgagagtatcaaagcaactacttgtttggtctcaagaacatacgtactggattgcttctcggtttctcatattggggtttgagcttgacctctattctccgagtgaatactgtatggtgtactggtatatgcatgtggtgtttataaagctgatagagaagatgcagttacgaatccttgctagcaacgaaaactcgcgaagaaaagggaaaaagaagaaggatcattcaaaggactctgtacgagacacaccatttcctccttcatgtttattgcttcagtgctatgttctattatcagaaggactttcaatgttgctggctgccctgaggaaggaaagcaagtcattccagtcaccaagtatcttcaatactgaacaagagagattcatgcagcatttcgatcttctccagaaagcacaaatacccgagtgcattacctactacagtttcaaggaagcggctgcccaggcatacatggcagacgtaatgaaatacaactttttcaaggaaatccagaagataatcccctccttgaaaggtagttttgcgagcgaaccagaaaagcttgcagagctccgccagattgaacaggttgccgagcacaataggatagccctaaacatcatcaaccacgttggtgctagcgatccgaaactgagggtttcgtttgagtttacgcaccacccccactttgcggtcgcagttgtaaagagatcataggttcttctcaagacagggtaaaagattttccaactctgttttagtgatggcacagctcgggtctgtcattcttgattgttcatttggttcgggcaaatctctctttaggctgcacgaacgtgacaattttgtagacaacaggaagaatatagcaaatgccaggaaaggctgacgccccg

SEQ ID NO: 12438 - DNA, 959 bp, Triticum aestivum
  unsure (1)..(959): unsure at all n locations
  Clone ID: PAT_TA_12438
gcagacttctgggtggccttctgatcgagggatttgatgaaagatcgtgtcgcagcaggtaccagtttgcacgttatcacaggaatgcagcaagagtaccttctccatacctcatagaaagattaaggagacaagaagcactgcagaagaagtgtggtccaggcaccaaatcatacaacaatgctgcaaaacagctcatgtccactcagagcatcaacggcatatcggattgcaactatctcttcctgacaatccatgccgggatggggaaccggatgcttgagatcacttcagcgttcctttacgcacttttgacaggcagggttttgctcgtggaccgttataagcagattgccaacactttctgtgagccttttcctggaacttcatggttgattccttcagatttccctctgagctataatgagttcaccaagcatagtccagagagctatggtaacatgttgcaggaaaatgttatccgtggcaacacatatcggtctctagccagtgctaggcctccctatgcgtacctccatcttgacggtgactacgctttccacgacaagcttttctactgcgaagacgatcaacagttcctgcaaggtgtgccgtggctgatcatgcggaccgacatgtacttcgtgccgtcactgtttcttatcccaagtttccaagatgaactgagcaagctgtttcctgagaaggacaccgttttccatcacttgggccggtatcttcttcatccaacaaatgatatctgggtattcggcgacaacgtactacagggcctaccttgctaaagctgataaagtagtggggatcaagtnaagaatatttgaaaagaagggatcctgcaaagaaatgggcanttcacacgttttagaacagattcttcctgtgctcaaggtgaaaactgctgcaaaaacgtgtgacgatgaactgcgctcggataaccg

SEQ ID NO: 12439 - DNA, 610 bp, Triticum aestivum
  Clone ID: PAT_TA_12439
ggtccatggggaagtggatcgactcgctgctcaaagggtaccaggacgctgtccgtgggcagaaggaggtggtgagcgcaatgcaggtcgggacgttcatcgccatcaaggatttggacaacatcagggtgctcatcaaccgggtggagatggagatcagctcaatggtcgactgtgtggacttcgcggagcgggacgaggaggcggtcaggctcgccggggtggccgtcacgtccgccctgcaggccccctcgtgctgcgtcggggcccccggcgtcccggctgaccggcgtggccgaggcatccgccgggcagggaccgtcgtgctgcgttggagcctccggctccccgaccgtgtggccggggcgatgtacattggaggggctccggggagactcttgcaccggaacaggtcgatatagtctgtagcgtcgtacaccagcaagcaaaggaggtgatcagtatcataaagcaataaatagttcactgcttgcggacttctgtgacgaatcgccattgctaacctggttatttcctagcacaaatctcggatggggctggaggcttttagttattattctcctaaaaaattttattattagaactgggt

SEQ ID NO: 12440 - DNA, 299 bp, Triticum aestivum
  Clone ID: PAT_TA_12440
gcgacggcaataaattcgctgttagtccgttaggcgtctaacggcagcctttgccgtccgccgctgatgtcaagcctttgctgtctgccactgtaggcaaactgaccaaatgggtcagctgccaggaagcacaggtggttgccacgtggcttctttgccgtccgcggcggacggcaaagagcccgttgccgtcggtggcagacggcaaagagcctgcattgcctcttttttctgttttttcttatacccaaccattttcacagcaatagatgatacatatatatttttcaaaaaaaaaa

SEQ ID NO: 12441 - DNA, 717 bp, Triticum aestivum
  unsure (1)..(717): unsure at all n locations
  Clone ID: PAT_TA_12441
aggaattcggcacgagggtcttatntgattgctccttcttccagacgaactcgacaatttgcttggagagcatgtgttggtttaagccagaattcatctcaacttgctctccgggccggatttcccggggcccccctcgcgtccgaggaattcttgtctccagatcaaatcccttctgatggaagaagttcagatgctgacttttctgcactgagaaatgcagtagtttgtgataaaaagatagtcgataataagataagatatgcacttaagttccccaaccagaagcatctcccggtccgtgtaacaaagaatattttggaagcagaaggtaaccaggatcagaatggcaaattttggttttctgaaaatcatgtcccactgtacatggtacgtgagtttgagcagaaacctggggttagctccttgcctactccaggaattgtacactctttcatgaatttgtacaaaaggcgagtaaaagcatctactggagatgtcttttcttatctctttcacaagggggatatctatccctgctcttcatgcaagaaagatgttcccttcagggatgtaataagatgcagcgattgtcaaggttattgtcacaaggagtgcacagtaaaatctgttggtggcaaaggaggcactgctgcttccagtttgatatgcaagttatgccttcagaagcgtaatcttatccttacaaattacagt

SEQ ID NO: 12442 - DNA, 824 bp, Triticum aestivum
  Clone ID: PAT_TA_12442
gcccttcctcccgggccgctcgcgcgggcggctctggaggccaaatccctagccccgcaagcctcctccttgtgctaccccaagccgtcgaaggcgacgggcggggtcggcgtgccccggtgggctcccctcccgcgggggtgggacgccaagcgggcagcgcgggaggtttcttctggtgtggcggcgcatggcggggagcgcagcggagtggcggagcttggcaagggagtagcagcggaggccttggcgcacgggttcgggctccgagtggagccgggaagggtcctggaggcgggtgcgcggctgggtcaaggtgacgccggcgagggtactcgaggtggtcacggcgctgcgagcccggccaggagatgctgcttcggcagcggtcgggtgtagcagcggcgtcgagcgccctcgattggctccggagttgggagatggcggcgacggcgtgcgatccggatctggccgttccgggtccttgggccatctgctgcgtgcccgcctgcctggattggtgtggctggtggctgcgtgttgtgcaggctgcccttggcgtgctgccatggagatggaccaaagctgcggtcttttcttggccgggcgggagatggaggtcgggttgcttgccctcggtcgtgcagggtcggggtgggcactgtcacaccgaaaaccgaaaaaccgaaccgaaccgaaccggattaaccgatttgtctgtttattcggtgtacggttgtttggttcggtgggaacttccatcgctattcggtgttcggtgtacgttcagtttccggacatcaaaaaccgtaatcaccgaagaa

SEQ ID NO: 12443 - DNA, 1155 bp, Triticum aestivum
  unsure (1)..(1155): unsure at all n locations
  Clone ID: PAT_TA_12443
gctctcctggtgatatgaatactgtagttccctcctgtgaaaagttgtctccccagaccactggatgccacaaagtcagcaagactgcaaaagtagtaagaaatgaagcttctgctggtagtgaaggatgctcattatctgatcaacaaccaaagaaacggacatatgaatcctcatcgtcttcactgaagtcaaaaagagtaagatgcagcggtcacactgaccatacacaagacatgagacagaatgatatctgtgacaaatctctgaccataaatagcacacctttgactcctagtatggtagtccacgttgacaacaaaatatcaggagatgctaaggccactacctgttccaatggaaggccttcagttatgctcatgaatattgcagatgaaacaaagaagacgcggcttacagaggtagttgaaacgcttgggggagttgttacgtgcgaaggaagttcatgcacacgtgtcgttactggaaaagctcgaaggactatgaacttttgtattgctttgagctctggggcttggatagtttctccaaactggctgaaacagagcttcaaacaagggaaatttgtaggtgaagcagaacatgttctggatgatgaagaatataagatgaagtacaagtctgaaatgagagatgcggttatgagggctaaagagaggccttgcttgttattttctggctacactttctgtttgaccaagcacatcgaaccctctcctggtgtcctctctccagttatcaaatcctctggtggcaaagatcaatcagttaagcctcgatgagcatagatgaagccctcaaagacaattttcttggcatgtgaagaaggcatggagcttgcaatggatgcagcaaaaagaggcataaagacattcagcagtgagtggctcatgacctgtgtcatgaggcaagaggttgaccttgacgcgcccccgtttgcagaatctctctgacgtgcctcaacttcatagtttagtggccgaacttatactcacttttgcgaagttatctccttcgttggctattgtatatctggtgtctcaaagctttagggcatttgtgtacatatgcccgtcgtgtggccgcatgtagaaactatcaaacnggtcaactttcngcattgnggcctnnctn

SEQ ID NO: 12444 - DNA, 1245 bp, Triticum aestivum
  unsure (1)..(1245): unsure at all n locations
  Clone ID: PAT_TA_12444
ggcagtaaattatggtgaaggattacgggtatcgggagaccaaaggcagatgcattcatctcttcctagccatctaatggaagtacttgctactggagacggggctcataattttggtgataattctggcgcctatcccaaaaatacaccagcattttcacctaataatgtcagcgcccagggaaatccaatgcaggcatctggaggacaattacttggcagatctgctccatcgcctggaactgccggaacccctaattttgaaaatgtgtctactcctccaatgccatatgctaactcccctaggtcaggcaccaatatgatgaataccccttcaccacagcaacatctgacaccacagcagcagaggcaaaagctgatgcaagcatctcagcaacagcacgtccggctgaggccatcagctgctgggatgctagcacagagctcggttcctcagttacaagatctacagggacaagctcaacaaaaagttgctggccaacagcagatgcagtacagccaagcacaagccttgtcacagtttcagaataggcagatgcaggctgcacgcatgcagccaggcatgtctcagagccaattgaaccaaggaaatcagttgagaagccatttgggccagttcactggagctgcaaacagtgcaatgtttactgctgcacaggcatcttcaaactcacaaatgatggcaaacatacctgggactatgcaaacaatgcagtcacagtcaatgatgccgcaaatgcagcagtttggtttgactggtgggcatcctcagaggagtcatcaaatgatgaccgaccaaagtatgtaccattcatcctcttttaggctttcgtcattattaataaattaaggaaatgcgtaattttctgtacagctatatagtgtacttgtgtcatcctgcttggactacttagctggtgtgatatagtcacaagttcagaagaaaacatacattaattaactattcttcaagttaaatttggagcaaaattcagcatgtatttacaaaaacggttgtcccgaggaaaagttagatgcgcctggtttttgatgcactgctaattgcaagatataattggggtttcctccgtgccanggtaccaacccctggtagttgttttaanatangtnggngcagggcgaaaaagcntccaagtccacgttatggaatccaanaactggngccgcccccggtaaccgttcccggggtcaattttantttcc

SEQ ID NO: 12445 - DNA, 552 bp, Triticum aestivum
  Clone ID: PAT_TA_12445
gcgccatggttgtggcggactgtaattggattgcctttgtggcagcagttgtggtgggcgggctgacgatcccggcggtgtaccagaggttgagcatggagaggtacatgaggctggcgtcgctcaacctctacagatacgaggtcttgtaccagagcttctccctcacctgctacctcagcgccagggactacctcgtcgagctgctcaaggaaccatgaccttgattcattccttcatgagcgatgatggatgatgcgacatcgatgagcttctttctgcctgcacacctctcagattgtttttcgattcatgagtgatgatggatgatggatgttttttgatccacgattgtttttccagagtgtgcctgcttagatagattgattgattgggttgctgctgcttagggctgttagtttgtgaggttgctcgctcgctctcagtttttctacatagatagatgcaggaaatggttgtgtctgtgatgtgatgaactatttatggctggagattgtcataaataatttggttgattgattaaaaaaaaaa

SEQ ID NO: 12446 - DNA, 1020 bp, Triticum aestivum
  Clone ID: PAT_TA_12446
cgtccggtcatgtgacagcaacttcttgaacatggatctgctatggcaacatattgtttcagatcatgcccacgagttcgggcttcttgatgccccacaacgacctaaaggtcaatctgtaagaacagaagggacaagtttcaaggccctctatgataaccatgaccttgggaaggatgatggctcacaaaagttgacctgtagactatgtgggttgagattcgatctactggcagatcttggccgccacaatcaagttgcccatatggaccaaggtacggttggccacattccaccaggacgtgggaagtatcaacttaaccgtggtcgacactactattctgcattcaagaaaaacctacgaccatcaggttcattaaagaagaggagtagctcaggggttgagaaacattttgatatttcaagctctgatctatctatgataacatcgcaagttgcggaacctgaaacagctaaccttggtaagttagtggatttccaatgctcagatgtggctcaaactttattttcaaagattcaaaagacaagaccccatccaagtaaccttgatattttatccgtggcccgttctgtatgctgtaagacaagtcttcttgcagcattggaagtgaaatatggaacaatgcctgaaaacatatttgtgaaagctgcaaagctttgtagtgacattggcatcccaatcaattggcatcaagaggaattcacttgtcctaagggatgcaaatctggatatgctttaaataccctgccgcctttacagcttacccatgttgatttccccacagtagcttctgtgatgaatcctccagaaaatgatggaacgtggggcatggaagaataccattatgttcttgattcagagcacttcatgtggaagcttaaaaatgagagggttgttctttgtgaaaatgtaagctttggcagggagaaagttccaattgtctgtgcaattgatgttgatgcaaaagatctctcctatgaaacctgaagattattgca

SEQ ID NO: 12447 - DNA, 153 bp, Triticum aestivum
  Clone ID: PAT_TA_12447
ggaaagatttctctagctaggctcgaaacggtgagagtgacgagtgcgtgtgctgtgctgcgactgcaactacgatgtaatactacgtagcttgtgcggtgcctgcaatggaatactactaaaatcggtggggctttgctggtaaaaaaaaaa

SEQ ID NO: 12448 - DNA, 1082 bp, Triticum aestivum
  unsure (1)..(1082): unsure at all n locations
  Clone ID: PAT_TA_12448
accggtcggagaagtaggagccgtgagcgccgccgcagcctctgcatccaccttgctccgcatagtagcatgtgtgcggaagcgcggacaggtgaccatgagcagatggcatcggcggcaacgacaacacgcacgatgcgcgaagtccggtaagatgggtgcggcctgcccgcaggcatttcacgatggtgtgcccgacggctcggaacacgcgcgcccgtcgcaaaggaggtatgcctcggagcacgccgacggcaatgtgcaccgcgaggtcccagagcagcctagccagtacagagcccctctgtaatggatgaaccctgtgactccatcctcgcctccactcacagatgaatcaacaagtgtcctccgaaaggctgaaggtgaatatcaagggcaccgctctttgatgatgcgcacccatggtttcctcaccatgatgcaacgacaagatgttcttgatgggtatgtagcaggaatctcttgtagagttcaaaaccagccttattagtaccaatcatttatgatgtggttgttcttgtctttcagtcgaacaaaagaagtggaacaaatgggtttaacttgtatgcctactcctgttgtgataagcattcgctttccatctgcaagacaagtttctgcttgtgtaacaacaatattgtccggtccgtcttgcttcgacctgtcgtccgcgccaggcccatcctgaccattgggttcctcgtgttctccttggcggttctctacgttgtctcaagacgtattggcctgttggcactgcaaaggacgctggctgatgctatcagatcaggctcagtatcagctggagacatcttggcgaaagtgcaggagggacctgccccaacagatgctcctcccatctatgatgaactgtgattttacttccacccattctttgtacatgagcttacatccagaagcaagcgtacctctcagagttcttatttcttagtagtacatgttgcctaaagtaacttttgcccaaaagggtatactggtgcattgacctgctgttagactgagttgaatcggagtatgctttatgtgcttcnataaccccc

SEQ ID NO: 12449 - DNA, 679 bp, Triticum aestivum
  Clone ID: PAT_TA_12449
gagcaacctgacgctgcagccacccaaggacggcgagtggtacgagcggctcgcctacggcctgcccaaagccaggaagagcgcggtgctcgtcacctgccgcagcgaggacggtgctagggtgatggtgcgcaccggcggcgtgtttcaccctcccaagctcgagggcgaagaagggtggaagcttttccaccgggagtacaaggaggccaaagacaaggagaagaaggagaagggcgagaaagaggaggaagacaagctttacaaggaactccaagagatgaaggaggagatcgtcggaaagtgccttggccttccggtggccatcgtccaggcggccaagggcttcgccgcgctcgagcacgagccggaagctgacgccaaggataacgctgccgcggatcagactgcgacgagcaagaccgaaccagctgcaactgaggcgatggaggccaatcagtctgctaattgattgagtcactgactcactactcactctgcgtgcttatgtgctctgctaaatgtttgtttcgtactgtcgagtgtgctttttgtttttcttgtgtccttgatttaccttttgttttcgagaatcaattggatcatggagttttggtgtgtatatgtaatgtttgttcgaccgactttgtggagacttccccaaatttgattttttttc

SEQ ID NO: 12450 - DNA, 734 bp, Triticum aestivum
  Clone ID: PAT_TA_12450
gctggaatggagttcagctagtagaattctcacccccgtgactgactatgaagtactagaaaacctacagccacatcaaaacttgaaggaacttcacattgtgaggtatcttggtgcaacagctccgagttggttacagtatgctgcgctgagggagctgcaatccttgcaccttgttaattgcaggagcttgggcgttctacctccactggggctcctgccgtcactccaacaattacacatgaaggagctgtgcacagttaaacgaattggacatgagttctatggtacagttgacttgtcatttccatccctgaaggttcttgtgtttgatgactttcccagcttggttgagtggtctgaagtgagggccgttccatttccttgtctgcagaagctagagattgtagactgcccaaagttgattcaagttcctgcatttcccccatctgtctctgaacttacagtggagcgaacattgttgatatccaatatgaggcttgctccatattcttcgtcaagattagagatattcacactgagtgtttccacaactagtgtactttgcaggggactattccatcaaagccatctcgaatctattgtggttttaaacataaacgctggctgcaagcagcttgtttctgctgagggactgcacacctttacgtctctccaaaagcttcagctgtgccactctgacatatcagatcagaatttgggaagtcttcttc

SEQ ID NO: 12451 - DNA, 588 bp, Triticum aestivum
  unsure (1)..(588): unsure at all n locations
  Clone ID: PAT_TA_12451
gctgcactgcccgtctcatcccgctcatgtgctgattccgaaggcatcgaatcgactgctctggcggttgcagatagagttgtgaagggagggcaccggggtgttgctacgggagacgggcgagcggcgaccgggatgttgcgtccacggtggtggaggggtcaagctgcgagtgcgccgcccgtctgcgtccagttccggaaccagcgagtttcagtgctaccaccggctccgccgggtgctggaaccagcaagttttgatgctaccacctgctccgccaagtgctggaaccagcgatctccggtgctgctatcggttatgtccggtgctggaactagcacgccggcgagtttcgaccgatgctggaaccagacgccgtcgagaactgctgggaccagcaataaattttgctggaactggtaggaagttttgttgcgcacaggcaaagattgtttttggctggtgatcccacgccaagatgctggtgaaccatagtttatttttgctggaacctgtgtaccactttgnttactaccgtggttgtgttttgctggaaccagccccgattgttgctaccaaaaaaaaaa

SEQ ID NO: 12452 - DNA, 587 bp, Triticum aestivum
  Clone ID: PAT_TA_12452
cccacgcgtccggtcagactatgatgaatcagacatgatggttgatgaagagatggttcattcagagtctaaaggtgatacagctgaggaatgttccgacgtagatgttgaaaacgttatcatgggcctgagcggctctcgggttaaatacaaggaacttcacagcgttgtcgggccaatcgacaggagacacctgagtgagctggaaaggcagctgagcagatacgcgaaagtcgttgggaaggagctgtctgaccgtatcgtctattcccttagctgagcagcaaacattctgcatggcaaacgcaacacagccgtccgaaactcgtctccgattgtttgtgcaagtcatgtaggaaaccagaaactcctctccgattgtttgtgcaagtcatgtaggaaacgagatatagatggctggaaaccgatgatgctttcattatcaatcgattcataaaaaagtctctcttttggctccggtggcaattgcccggacagcgacttgtgctgcgccacaagcgacttgatgtgcacgcgtatatggttgttgggattatcacgacggaaagcgcatgcgtacaagtctg

SEQ ID NO: 12453 - DNA, 2680 bp, Triticum aestivum
  Clone ID: PAT_TA_12453
ccacgcccttgcattcgcacagccctaccaggacagatccggggacccaacccaaccaatccgcccaaccaacatcgtgactccggcccggcggcggcgaaaccaccgcgcggcgatggcggacggcgccagcagcagcggcgcccgggccggcggacgcgggggcggcggcggcggctgcggcgagtcggtggtgattgactacggccggcggcgcacgacctgcggctactgccgatccaccggtcccacgagcatctcccacggtctgtgggccaacagtctgaaagctgatgactatcaagctcttcttgaccgtggatggaggaggtctggctgttttctctacaagcctgagatggaacggacatgctgtccggcatatactatacgtctgaaggcaagtgatttcatttgttccaaagagcaggaccgtgtacttaaaaggatgcaaaggtttcttgatggagagcttgacccacaggttggaagtccacagtgcaagactaaccctacgaaacgttcactcaatgaacctatgaattcaccaaccttgaaagtatccagggtatcagcatatgaatttcaaacaaccacaggtccaactttagaaaaacgaatccgggggtctgtgcgtgtcctgtcgagcaccagctaggaggtggctgcgacgcgctccctggctggcgttgcatgttctcgtctctcttctccctccaggcgcttgtgcccgctctgcgacctctgctgcgccacaagcgttgggggttgcagcacaagaaaagaaaggaggagcactgcaagatttggtgtactcatgtaattgttaagtttccaaactggctgcagctaatttaaacgtgcattgcctgaagaaaaaccgtggagtattaggggacctttcaccaaattgtattgcagaaaggctggtgttgacaatggaacatcatggagaaatagctggttttgcagtgaaagcctgtaatggccatctgaacttctactcagccactattcagccaattcagaatcatactagcattgatgcatctgcacaagcttcttctgataggccgactagctcaaaacaaagctctgcgaacaaaaatgatgcaagacataataaaaaagcaagaaagctggaatttaagatggcaagatcgcattttgaccctgaggagtttgctttgtaccaaagatatcagacaaaagttcacaaggaaaagacagttacggaaagctcatacaagagatttctggtggataccccaattgtacctattcgcccaaggagtggtgataatacagttccgccatgcggttttggttcatttcatcagcagtatagaattgatggaaaacttgtggcagttggtgtagttgatatccttccgaaatgtctctcaagcaaatatttgttctgggatcctgaccttgctttcctatctcttggaaagtatacagctctaaaggaaatagattgggtcaagacaacacagaaaagttgccccagccttgagtactattaccttggttattatatacattcctgcaacaagatgagatacaaagctgcatatcgaccatcagaacttctctgtccagtccgttatgagtgggtgcgctatgatgctgcaaaacccttactagataagagcctgtattctgttatatctgatttctccaccatggcgcaagatgaaatcccccaaccacacgcttgtggtccttgtgatggatcttcagcacaaaacgaccacagtgagactcctattgatgaggatgatgaggactcagagtcagactatgatgaatcagacatgatggttgatgaagagatggttcattcagagtctaaaggtgatacagctgaggaatgttccgacgtagatgttgaaaacgttatcatgggcctgagcggctctcgggttaaatacaaggaacttcacagcgttgtcgggccaatcgacaggagacacctgagtgagctggaaaggcagctgagcagatacgcgaaagtcgttgggaaggagctgtctgaccgtatcgtctattcccttagctgagcagcaaacattctgcatggcaaacgcaacacagccgtccgaaactcgtctccgattgtttgtgcaagtcatgtaggaaaccagaaactcctctccgattgtttgtgcaagtcatgtaggaaacgagatatagatggctggaaaccgatgatgctttcattcatgcaaatgcaattggaataagtccattttaccctcatcaactctttcccgagttgtaagtcatttgtcaacttctaagccgggcatttgacaaccctcaaaccatgaaaaccggtttaggctgatgtgggtacagctgaagagagcgacccggccctgcgctctctctctctctcatgttggagactcgcatggccatccctaccatattaatcattgagttccgtgccttactgattgctcaattgcgacttctccactggccttgtcccacgtatctcttgagttggggaacaatcggcaagggctggatctagatgccacctttcccaagtctgctccctggtatccaccctcgatgcactcgagcagaaagaggaatttgtagaaatacatgggagggtaacatggtatgctccattgctgctaatccagaaagggacaaagttgag

SEQ ID NO: 12454 - DNA, 466 bp, Triticum aestivum
  Clone ID: PAT_TA_12454
gcggacgaagcgaggcatgcgattgagtttcaggcagcccgagtgcttaggtcgattcatcgaatcttgcacccaggtagcatgagttaataaatttcgccgacatggactcgatcgtgcgttcctctttccaaccaatacagtcaagcacactgcgtttgccttaccgtttgatctgtctttgttccgcaacgagatgatgctctcgttctgtccaccacccatgcctgaagtctcttcttgcttccgtcagttcaacaacagtcaagtttgtagggcgccccctacattttgccctgatgaaccattaattttcatgtactgaagatgtctggtttggatgctccccagcattgttcattacactcctttatttgtaacaactttatttcagactcgatgtttattccagactcgtaaactgtaaagtcagagttcagtttgtactatggtctgaaaaaaaaaa

SEQ ID NO: 12455 - DNA, 582 bp, Triticum aestivum
  unsure (1)..(582): unsure at all n locations
  Clone ID: PAT_TA_12455
accggccgcctctcctccacttgcccagnaaccctaacccccatggatccccagtaaaaacgcattctctagatttgccacacccgccagcaacatttgacgcgacggaattgccggacgggacgacggcgcctccagaggaactgcacatcacagcaagcaaagagcaatggcgtcaaccaccgaatcggcatgcacaactcagacggtgcaaggcacacatcggttccagatatgtcagttcagttatgggaatgttggtgatgaggattacatccgctccggcaccttcagggtggggggattcgactgggttattgtatactgcccggacgctgatggcgatgatggggtggaatacatatcagtttatctggagttgatgagcaagtatgcggaggcgttggcgttcgtagacctgagactgatcaaccaagtcactggagatgcgtgtacaatatatgcagagaacagggtgccgaatcagttcaagtctaccagcttcgaagaggcttcctgggggcgtgaaaaatttatcagtaaacgtgctttgaaagattcagggtatatccgagataaccg

SEQ ID NO: 12456 - DNA, 1120 bp, Triticum aestivum
  unsure (1)..(1120): unsure at all n locations
  Clone ID: PAT_TA_12456
gacccacgcgtccgaggggctcttagcccttttgggcaagtgttgcaagcaatacattgcaagagaatggggcagctcctcaaagatgtggacgctgcttcatcaagttatcagggagcaacggatgttagttttgatgtgccaccccctcgcagcaatgatgtagacaagtcagatcgtcatggttgtgtcaaggaaagctatagcaagaaagccgcagatgagccaacaacagacaaggtggttgagccgggtgaaggagctcgaagcaaccatgcaagcggcattgatcatgagtctaatggcggccgtccggttgagatgggcacacgaactagtggtgaagatattgagcatggtgaccaactcatcgagcgcaatgactctgttgtcagtgagccccctgcacagtcttttgagaatgcaagggagaaagtgtctagtggtgaagatattgagcatggtgaccaattcatcgagcgcaatgactctgtgcacactagcgtgactggacattggagtgatgcgccatcaatgtgcctgttccaagagggcaccgaggagtacgattggtggattagtgtccaaagtcaagatccgaactccaatgctccaactcatggcaacactgctacaacaccaaagtcttgtggtgtttttgatgtcactcctcaaggctgcaatatcaagagaagtagaagtcctgtgtatgatgtcacaccatctccatgggtccattatcaagtgggggctgcagatggaccatcaaaagcacaagaagagacagttgtcctagttnagcagcagggaaccaagcccaccttngacgaagagaagttngaagagcaaggatggagaacaaatccaagagtaagaaaagagtangganccacntcaaccgggtncnagtacaagaaattaagcagttcnacacggaacatgtacaacactattcatggaagagnacaagngagagtgaanagagggagtgtagcccttnattaggatgatgattcanatactaacaactcaaatcntnancactgctanattgaggannagnatatcataagttcaantacantgcgctaatancaaaaattcttccgttagncctacc

SEQ ID NO: 12457 - DNA, 748 bp, Triticum aestivum
  unsure (1)..(748): unsure at all n locations
  Clone ID: PAT_TA_12457
cctacgaccaccccgtctctctctctctctccgtagtctccctctctctgtctctctctgcaagtcgccatgaacattccaagcaaatgcacggctcatgggcgccactttgcacttgcaaagtgagataggaagctgcgacctgccctgctccctttaccactaccgtgcaaggacgtccctgtgaactacaagctacctagctagtgcggctattagttcgtacgtacgtgctcgagccactgagctgagctagtttgtgcgtgctattacgagctgttgccaggtggtcagcggcagccatggagaggacgccggtgatggtgaggcagggcggccaggaggtgctgaggcagctgccgcccgggttccgcttccgccctacagacgaggagctggttgtgcagtacctccgcccgaaaggccctcgccctcccgctcccagctgctgtcatctccgatgtccacaacctctacagcctcgacccctgggacatccccggcgcgagagagggggagaagtactactttgcggtccggccggccgccggcgcaagagggtggaggacacaaggcaacggtgtggaactcagccaggaaagccgggtggtccgtcggcggcaatctcggtaaaatcctgcttgccccactggaaagggcaaggcccggtagaaccggcgcgtccacgccccgctcgactagattcaccctggantacnctttttgcaattttaggggancccccgnn

SEQ ID NO: 12458 - DNA, 1762 bp, Triticum aestivum
  Clone ID: PAT_TA_12458
ccgctcgcggaggccgacccggacgtgcacgcgctcatggagcgcgagagggagcgccaggtgcgcggcatcgagctcatcgcctcggagaacttcgtctgccgcgccgtgctcgacgccctcggcagccacctcaccaacaagtactccgaggggcacccgggcgctcgctactacggcgggaaccagcacatcgacgccatcgagcgcctctgccacgagcgcgcctgcaccgccttcggccttgaccccgcctgctggggggtcaatgtccagccctactcatgcacctccgcacacctggcggtcgacccagggcttctcctgcccaatgaccgtctcatgggccttgagcccccggctggtggccatgtctgcctcggttactacacgcctagtggtaagaaggtgtctggggcctcgatattcttggataccttgtcgtacaaggtgaatccacagactggctatattgattatgacaagcttgaggaccgggcaatggatttccaccccaagattcttatctgtggtgggagttcctaccccagggaatggtacgttcaacggatgaggctgatagctgataagtgtggtgcagtgctcatgtgcgacatggcgcatattagcggacttgttgcagcaaaggaatgtcgcagtccattcgactactgtgacgttgttacatcaactactcacaagaacctaaggggtcctagaggtggaataatatttttcaggaaagggaagaatatgaggaagcgaggtggatctttttctcaaggggatgaaaatgattatgattttgaggataagataaatttcgctgtattcccttcactgcaaggagggccgcataataaccatattgctgctttagcgataacgctgaagcaagttgcgacgcctgaatataaagcatacattcaacaagttaagaaaaatgctcaagctttggcatcggccttgctcagaagaaaatgcagattggttactggtggcactgataatcacttggtgctttgggacctcagaacttttggcttgaccgggaagaactttgagaaggtctgtgagctgtgccacatctctataaataagacaccgatatatggggacaatggctcaatatctcccggtggcgtgcgtattggaacacctgcaatgactactagaggttgccttgaagatgacttcgaggtgattgcagacttcctcatcagggcgacacagatagctggcagtgttctgaaacaacacggaaaagtgcagaaggaatttctaagaggcctggagaacaataaggacattatagagctcggtaacctggtcgaggctttcgcatcacagtttgcgatgccaggttttgatgtatgactgtgcatatatatcacatcttcttggggattgtccagatttatcagcaaatagcaactattttgttatcaggctgttcacacaaaactggaagttgttgctctcaacagcaacagtgtaggaaacgatttttttagttggaaattggttttgactctttgactctcaagcaatcatgtacaggtctataccctaaagtccttttatgatttatgtatgtagtaaatcttcacgtaatgagttcttatatgatatgattcgctgagcttttttactagggtgagacttcttctggatccttttgagtgtttcaagtttgaactttgtggatgaaaggttatttagcgagcctgtgtcgttttatactgggtgttctatcttctgg

SEQ ID NO: 12459 - DNA, 858 bp, Triticum aestivum
  unsure (1)..(858): unsure at all n locations
  Clone ID: PAT_TA_12459
gcacacgccccgaccgacggcgagnacagattctccgtctccattcccccacagcagccagccatggagagaaatggcgggaagcagcagcagcagcagcagctggagacggcggcgccggcgccggcgccgaggaaggcggcgtggcgggacggcgccgtcacctacttccacctcctcttctacatcgccatctccggcggccagatcttcttcaacaagtgggtgctatcctcaaaagagatcaacttcccctatccagtggcactaactttgctgcatatgctcttctcatctgtagtatgctttgcagctacaaagattttcaaggtcataaagattgatgaaggaatgactacagatgtgtgagtcttggataatacaaaattcataaggctgtattgtagtttcttactctctcaattgttctctgtcagtatattatgttccatgacgtatcacctcatgattaagacatccataatgcctgtctctccatgtatgaaccgatatgaataatttgtgaattttccataacattagcatattctagcatgtctccgtaagatgctgcacaaacaccaccccttcattttaaatatcgaggtgggcggtctgctgtctctgtggggtgggcttgtaccggagccccgggctctgctctttgtcgtgttagttctgtagccggcgggtgctggccggatctgggtgcccgtgttgccctatggttgcccttgcaggccctgtcgcccgttcatgccctgcttgttcgtcgtcgggccatagttgcgtgcatgtatttcgtggaactttccaccagttacattgtatctaaactgcatgtgcacattcgtactt

SEQ ID NO: 12460 - DNA, 665 bp, Triticum aestivum
  Clone ID: PAT_TA_12460
ttcggcacgaggtggaagggtcgtcgctcagcggatgaaagccccctccccctccccaaagcctgctcggatctggtgacgacatgtcatggctcccccctcgagcaggggggcttgggtggtagccaacgatgcagcgttccctcggcgcgcatcgctgagctctgaggtggaggtggtggtggacggcgatggttgtgggcgtgggccatttcttcggtgctcccattggtccatgcgtgggcggcgacggcggcagcgtcggtggacaggggggctacagctactaattcgtccgcgtgtgggcggcagcatcgacggaccgaggggctgcagctgcggcggcgttgttgatcggtggtgcgctgatgcggagcttgggggcgctgtgtcctggattcgtggggtctttctggatcttcaggtcggcatgtgggatcctgtagcggatggtgtttgtgtcagtcatggtggtgcgatgggcgtgcggtggtgttgagctcaaccagaaatgttgttgcgcttgggcgtgtgggccggatctagctgggcagcgggggaccctctgccactcgtcctacggcttgttgtgcaacgcgggcctagcaagactggctcgacatgttttgaatcttaatgctagcacttcgtggcgaaggcgaaca

SEQ ID NO: 12461 - DNA, 720 bp, Triticum aestivum
  Clone ID: PAT_TA_12461
cacgaggagaactccctcccagtttccacgccgccggcccctcctctctcttccccggtgacctccagacttgagttggggagcgcccccgcccccctcgccactccctccccttgtgtagtcgccacacttgtccttctagatctggcacaggccctcacgaagaagattgaggcgattgctacaatgtccaggaccgccatgactgcgcccaggtcttttgctggcgcggatgatttcttccggtggcgagctacttgttcttggcggtgtcagtgccaactgccttgagccactgtgtttgttctgatccatgatcatacctccataagttctctgttttcacccaagaagttggtcaaatttttggagtgtagatgtatatcagatccgtgcaaatgagttgttgaatttttggagtgtagatgtatatcagatccgtgcaaatgagttgcaaatgagatgtatatcagatccgtgcaaatgagttatctgcaaagtacctcatgaagtgtaggtttagcattcgtgaaattcactgaactccaccccctcgggtagttactagactttttattcaatgtccagactgtttctttcattgagatatgtttcagattttgtacttgtggatttggtgcaaggaaaatagaatagcatgatcaagtgttgcttcatgtcttcttatatggagaagtcctcaagttatattctcaagga

SEQ ID NO: 12462 - DNA, 921 bp, Triticum aestivum
  unsure (1)..(921): unsure at all n locations
  Clone ID: PAT_TA_12462
cggacgcgtgggaaaaccaagtccccacgggcagaccgaaccctagcttcgcctcttggaccttcacccttgccattcacgcgtaagacctattgtgatgtcgtcgtccggcgggggtggggctgggcagcagttccggtacacgcagacgccgtcgaaggtgctgcacctgcggaacctgccctgggagtgcacggaggaggagctcgttgagctctgcaagcccttcggccgcatcgtcaacaccaaatccggcgtcggcgccaaccgcaaccaggccttcgtcgagtttaccgatgttaatcaagccatttcaatggtttcttattttgcatcatcttcagaaccagcacaaattcgaggcaaaactgtttacattcagtattcaaatagacaagaaataattaacaataagagccctggtgagactgctggaaatgtgttgcttgttaccatagagggtgttcaagctagtgatgtcaccatcgatgtaatccatttggttttctctgcttttggatttgttcacaaaatagccacttttgagaaggctgcaggttttcaggcactgatccagtatactgatgcacccactgcatcagcagcaagagaagccttagatggaagaagcatcccaagatacttgcttccggatcatgtagtatcctgccacttgcggatttctttctctgcgcataaggatttgaacatcaagttccaatcacaccgcagcagggattacactaacccttaccttccagtcaactcctctgctatagatagtacattgcagcctgctgttggtgctgatggaaggagggtggaggctgagggtaatgttcttcttgcatcaattgagaatatgcagtatgctgtttcagtgggatgttcttcaaatactngtgttcctccggcattcgg

SEQ ID NO: 12463 - DNA, 1167 bp, Triticum aestivum
  Clone ID: PAT_TA_12463
gtggccttgctggtgggcgtgcccgcccctcttgtgatcacggcttcaataaggcatcagctgttgtgaactctgggttgttgttgatggctgtcttgggtctaatgtttccagcggtgcttcactttacacattctgaagcgcactatggaaaatccgaagtttctctttcaaggtttagtagctgcataatgcttgtggcttatgctagctatctttttgtccaactacgcgtccggcgcagtctgtacagcccaattggcgaagaagaagaaagcactgaggatgaggaggatgaaaaggagatagcacagggggaagctatctcctggctttttgtattgactatttggatttcaattctctctgggtacctggtagatgccatacagggggccgctgaatcattaaacatgccactggcctttattagtgttattctgcttcctatcgtggggaatgctgctgagcatgcaagcgccattatgtttgccatgaaaaacaaacttgacattacattgggtgtcgccatagggtcgtcaacacagatatctatgtttgtgattccattctgtgtggtaattggctggatgatgggggaagagatggacttgaactttcaattgtttgagacagcaactctttttataacagtacttgtggtggcatttatgctacaggaaggcacgtcgaactattttaaaggctttatgctcatattatgctatctcatagttgccgcaagcttttttgtgcacgttgatcccaaatcaagtgacaacaaatgacaagttcccaacagaactgtgaagtgatagggaaggctactatcagaattgcagatttagcacccgtggattcctgagtttgaagaacttgctggtagcagcatcccacattaaggctttaagtttcagcttgaaatcacaagacgctgatgcggctgttttaagatagcaacgacatcacccttcgagaaactttaactatatggaatagcgcacgaggaccactagtctgtatttgctgtaagctacacctggttgcagttttgatgatgttgttacagtttgccaaggaactgactacactctgcagtccaagggacactggtagttatgtaattgttctatcacgggatataatatcgaatggatttgttatgtc

SEQ ID NO: 12464 - DNA, 1051 bp, Triticum aestivum
  Clone ID: PAT_TA_12464
tgcgtccgcctctggtaccgcgcgcccgcgccacaggccgggcacggtccgcagctgctccctccgccgcggtcgccccgccggtcggcccccgccctgcccgcgcgcccctgccccgccgcccccggcgtcgctccgccgctcgcccccatctcccagccgactcgcgcgcgccggccgaaaaggctatcccatcatggatgcagcaaaggatccaaacccgtcatgtaaactccacacaagactgagactctgggagtttgcagaccgttatatattcgaaccaattgatggtcttgctgacttatatttgacagttagccgggccagtggatcaatgaattcagttgaagagttgccaccacgtagcccctccagatttccgtgtgttcggactgctcatgctggcagtggggtcctctttcttgctggtcgctcgccgtgtttggggggcaccgtccgtggggctggcggttcttacaggggccgggctatttgtcctgcgccgcgacgactcgcccttcgctgctttcgcgcacttaacacttcgactctgaaatttccgaactcctggatgctgcagagaagaccatgggcctctacttctcctacgatatcaacttaacacttaattctcagcggctctctgatgtcgctgacgaggtctgatgtcgatgacgtgggcgactcacgtcctctttggagacaggcagagccgagatttctgtggaacagcgtccggttggaacctctaattgagaacaaactggaccagtatttattgccagtcattcaaggcagttttgagaatatccaggcagaagttgggtcagagaaggtaaatgtgaccctgatagcacgtaggtgcacagggaggataggtactcgtatgtggagacgaggagctgattcagagggttattgctgcaaactttgttgaatcttagcagataatgcaatcaaaagggtatacagcttcctatgtacaaggacgaggttctttgtcatttttgtgggagcatattggtgatttgcatactaacctagcttt

SEQ ID NO: 12465 - DNA, 901 bp, Triticum aestivum
  unsure (1)..(901): unsure at all n locations
  Clone ID: PAT_TA_12465
gcgcctgggcgcggccgcgctgtaggaggtgctggctccggagcgccccggcatcgacgcctccgctgcgctcagtcgcgcgcaccgcttccggctaggggcgccagttccgtccgtctacgcagccccatgccgtccgttcctacccgccccgctagcgctcactcatccctctctcttcagccggaacaccgtattgtggatgaaccttccaaaagatattctggatccggagttctacggcatagacacgtccctctgcacacagatgcattcacggaatgcatccagcaaaaaaagttgcgttcgtctacgcagccacagggaggaggttcctaggatgccctctctcgggagatgatatgtgccactggttcttgtggattgatgaaccatggggtccagtacttagccgttcaataaaaaacctatgggatcaaacttctcgggtcgctgacagagcagcaatgttggagacaaagaagaaggaaatggagcacgcttacttagatctttggactgaaagaagcaatatggagatagaacacgagcaggttgtcaacggtttgaagaacagattagttgacaatgagattaagatgtccaggaggttggattttcacattaagttgtgtgtggcatctatttcttcagctgttactctagcttcagtgctggcttatgttctatctacattgacatagcaatgtagtttattagaaagtacgtgtttgcttcacatcgaaagcatttgtctgcttcatatcaatgtttgggcagaatgtatgacaattatgtgagcagaattaccctttgttttgaatgaactcatttgttatgaatctactgctcttgtttcactttctaagtctcaattnaggtttttattttcagagcaaga

SEQ ID NO: 12466 - DNA, 677 bp, Triticum aestivum
  Clone ID: PAT_TA_12466
gcctgctcaatggcctcctcatgaccgtggccgctttcacgtcaacttcctggctactcccaaaagcccctgtggtggaaaaccaacattgttttttgctgaaattcaaagcgatggcacatatgattccttctgttgccctgtggctctgcctctgccatgtgctgcacaaattcggtgtgtttactgcgaagccatggggactagaattgtgcatccagttgcgataaacttccgtggccgtgattcggcgtttgagatgctggcccgcgaaaaagacccctgtcagcgcgaggaagcaaccttgagaatcatcagccatagacgtctcatggcggagaatgttcattgcaaggagaaagaagatatcctctacgatggggtggatgggcacaggaataagtttgataatgtgagttccttgaaggtggaagaagctatgttattggcaccactttgtcgctatctgtaaggtgttgtggcattggaaaatactgtgccaatgcaagacaagttaaagtttgtgttgtcctaggagttgggatggtgctcatgaaatttaacaagtggttaagtcgtactgttagaatatatccaatgatgtgtgttggtaacggcatttgaatgtgccagctgattgtgtaattgcagtttatacgctctaaactattagaact

SEQ ID NO: 12467 - DNA, 2603 bp, Triticum aestivum
  Clone ID: PAT_TA_12467
cgccgccatccttcagtcttgtacgccgaccaccgatgacatcgcctctgtgcctagcacccgagcccccctagacgtaacctttgctccggttcatccactcctaacgcccgtcatggatcaggcccgcccgacctcaattccgcctccgcccgcgttttacctgccccgaccgccgctgccgccgcccagcccaccagatcgacaaccggtccccgagcacgccgggatggtgtaggaatctgccaacgccggcaaggccccggccgcggggctccacgtggacatccagaagctgtccctgggaggggacgaaggatgcccgcccgccgcgcgcggagcgccagctgaagccctcggggcttgcactaacgggtacgaccaaccccccgggcgaattcacagaccatagaagcccgcgtgctggacagggtacataaacgcccctcgatccacgcgccgatgaaccccaacttgaactaccagcgaaatggagatccttcgccagcatcctatgaatctcgagtttatcttgtctccaccagtaagtccatcacccgctttgttggtctcgaaggattggaagggcccgacaattgtgagggagacatgtactattgatatggttatgatcccaatggcccgtatcctttaggttctcatgtcccaaccgttgggcatgacggcctgtcgtatggcacacagcagtatcagtaccctggtcagtattatcaacagccggctccaaccaatgcgatgcatggtgttaacagtgccaatcctcaatctgagctgccttccgctgcggctcaccaggcacgtgctacggtagtttcagcaaaagtaactaccgggactgctagtgggattgcaaatgctgccagttcactaccgcgcaagcaaactcaccaccatgtatcagtgaccaacagtggttcatatggacgagggccctcgcaaggtggaccttccgctagcaattttggtcacactggtcaccgttctccagctcagtggtatgatgggccggtctattctaatgggcatcacggatcaattgctagttctacatcttatggttctaattcatcttcagcaaaaaatcagagtcaccgtccaccaactaagctcatgggtatgcatacacatgtgccttcatcttaggtggggctgactggttctcgtgggcctagtagtatgttatatacttgctgacaccgggctgattattggcccctcgggaacacactgaaagctggacttggtttttggttctaatgtctataactcgagaaataatggacagtggggagtcgtggataccgtcaaatacaagcctagaaaccgggcaacttttgggtttggcagtgagaatcaagatggcttcactgagcttaacagaggaccaagatctggtggattcagacaccaaaaaccatttggacctactgtcactattgctgtgaaggggcaggtcctcccttcagctgggaaacaagataatagcgttcttccagataagagtcaatttaaccaggaaggcttttctgcaacatacaaggatgcaaagttcttcgttatcaaatcttacagcgaggatgatgtgcacaagagtatcaagtacaatgtgtgggcaagcactcctaatggaaataagaagctggatgctggataccgagaagctcaggagaaatccagtgaatgcccggtgttcttatttttctctgtgaacacaagtggtcaatttgttggtgttgccgaaatggttggtcctgttgactttgacaagacggtagattattggcaacaagacaagtggaatggctgcttttcaatcaagtggcacatcgtgaaggatatccccaacaacattctgaagcatattacgttggacaacaatgacaataagcctgtgacaaacagccgtgacacacaagaggttaagcttgagcaaggtcttcaaatgctcaagattttcaaggaacatgtcagcaagacctcaattttggatgactttgcattttacgagaaccgacagaagttgatgcaagaaaagagagcaaagcaacaaccgcttcaggggcagggtgttgatgagaaggagaagagcgcagttaacgggaattccgctgcacagaagcagacaccgagcaaggagagcaccacccctgccgccggtgaagagccgaacgcttccaaacccaccacagctgaaagcggcggcgcgagtgccaactagcgtgatatatttcttacgctcgttgctgtaacatgcggtagtccattgcgcaaaactcggtcaggcttcggaatatgcgcggatcatacatgggaaactaaatttaggtcgtgtgacttggttctcatcgtttaggtctcttatatacttggtgacatcaggttcttatatggcccctttcctattcctatttttgtttcggagtcttgttggtttagtaatttcagctatttgttattgtttagactaaaggagccgattttcgatacttctagacaacatttaaggtactaagtttttatgagtgttgtagtgctggagaaagtaataagaacaaagaactcctggtttttctagtccaaaa

SEQ ID NO: 12468 - DNA, 1120 bp, Triticum aestivum
  unsure (1)..(1120): unsure at all n locations
  Clone ID: PAT_TA_12468
ggcacgaggcnccaatacgttcgggcctgcggcggctgcgtcttgccccggcgactccgggatggaagatgcgggcttgagttcttgctggatgccatcgaccggtttccactccgggaggatttcaccgacaacctttaacattcagatccgctccccctggcattattacctccaggtcaagccaaccctggcatgccgatagattcaaaatgctagttctggatgcgggcagcaagttggtggcggtggcccggagaaggcacagggtggcatgcgccggcgacgggaggcatctcccactaggtctgtgcactcaactgacagggtcaacccagaggcgcccggatggacaaagagacgcgcgatctactgggattattccattgaagaggggcacaacagaggatggtgcagaatggggtggatgtggatcaattgacgaggatcaaagtgcgcgcacacttggtgcggcggccctggatttagttgaccaagacataaatcatccgggacttttcgaagggggtttcgatcaagcaaggagtctgctctcgaggctgcgtgaaggagatgtcggatgtaaaacatagagatccatggcggtctgaatatacttgtgttgattgcattttgacccatcttcagttcattttgttgacccatctgattacgatgtcctccggttctacatcaacatgctgggctgtgacaaaaacgtcatacgaaagaaatggttctggcactttcatccaatacttgcagtggcatctggtcaggacctgaaggatgagttaactcttggtggtgagttaatgttaaatgtctggagatgcatgcagcacgtgctaagtgcaaaagagaagaggatgtactgcggggtggcttgtgagatggagacggattttgatccccgttttgtgagctatgcaggggagacgatgaagtgggctgggatagcatgatgatgaactctgatttgatgggctacataattgattggctaaagaagataaaggtattgtgggtgaaaaactatggacctgtattgaatttgtaattcaagacctaagcagactaagtgaaagtactccctctctacagtgggagtatgtacgtg

SEQ ID NO: 12469 - DNA, 829 bp, Triticum aestivum
  Clone ID: PAT_TA_12469
ggtcgacccacgcgtccgcaagcacccctgcatcaaagattcaacgcacaccaatggttacccctggtggcagctccagagcccaggaggagaagatccttgtcactgtgagggtgcgaccattgagcaagagggagttggccatgaaggaccagaaggtggcatgggaatgcgctgacagtcagacaatcttatacacgggtccgtcacaggaccgggcagcacccacctcctacacttttgataaggtgtttgggccagcatgccagacagacttggtttatgaagatggagctaaggatgttgctatgtctgcattgacaggcatcaatgccacaatctttgcttatggtcagacaagcagtggcaaaacattcaccatgagaggtgtgacagagagcgctgtccgtgacatttacaaacacatcgacaacaatcctgaaagggaatttattatcaagatatctgctatggaaatatacaatgagaatgtgaaggatcttctacgacctgactctggtccccttcgcttgttagatgatcctgagaaaggaaccatcgtggagaagttggatgaagaaatcgccaaggatagccaacatctaaggcatctaataggcatttgtgaagaacaaagacaggttggggaaactgcactaaacgacgcaagttcacgttcgcaccaaatcattaggctgactgtggagagtaggctccgtgaagcatcaggctgtgttaaatcttttgttgctaacttgaattttgttgaccttgctggaagcgagcgtgctgcacaaacacatgcaattggtgcaagattgaaagaagg

SEQ ID NO: 12470 - DNA, 2493 bp, Triticum aestivum
  Clone ID: PAT_TA_12470
gcgaagggcacaggaacgcgctacgagtcgggagcgcgaccgcgcacttcgggttctgggttcccctcccccgcgggccgcagggctggattcaggcagcagcatgtggaggggctggatctgagggtgaaccccgttctgtacatcgtgtcgtgcttcccgggtgtacctgagcagaacctcaggtcactctcggggtccctcgctgtccccgaaactgatgccctcccctcgatgtccacctcatccttcggccacaagggtacgctcgcgttcgcggcgctcagcttcaagcagccggacattagcctttgggattgccctgacattgaccaccctctggtagccgtgggggccctcaccccgggtgtgccctgaaacacggggacgtgagcggaacgtgtggcttcgtgggcagttaatcgcgtcgactcgccctcgcctccgatgtgcgacgaagcgcagggtcagcccaataggggaaaagttgagagggtaagagacgagaagcaccacatgaaccttgttgaagagcaggctatccgggttgatctgcacgcagtggaggcgaacctccatggggttgctgatactccagggaggggtaccgatatggaggtctcgactagtatcttatcagggggtgagtggattaactatggccggtgaccgacggcaagttggccccgttcccgggcacgttcaaggagtacaagaagatgctcacgacataaacctggaaaaatgacgggacatacagactatatgtatgatatgtacgccctggcatgggaagcttatgtaatcttatgcttgtcacctacctgaggtttgaaagtttgagcagaactatgctactacatacagtttattcatgatgaaacccagctgggtcaattactgaaagatctagagtatgatgcagagtccaaacagagggtagacaagagcaagggtgatgttgacaaagattctatcagcaagaggcttgaggagatatacaagagacttgaattcattgatgcagatgcagcagaagctcgtgcggcatcaattctggcgggtctcagtttcactccagaaatgcaatgcaaaaatacaaaatcattttcgggaggatggcggatgagaatagcactagcacgtgctctattcattgagccagatttactgctacttgatgagccaacaaatcatcttgatctgcatgctgtgttatggttagaaacatatctcctgaagtggccaaagacattcattgttgtgtcccacgctagagagtttctgaatacggttgtcaccgacgttcttcacctacatggtaagaagctacatgcttacaaaggtgactatgacacatttgagaggacaagggaggagcacctcaagaatcagatgaaagccttcgaaacaaatgagaaggccagaggacacatgcaggcattcattgacaagttcagatacaatgcaaagagagcatcacttgttcaatcaagaatcaaggcattggagcgaatggaacatgttgacgctgttgttagtgacccagactacaaattcgaatttccaactccagatgaccgtcctggaccaccaatcattagcttcagtgacgcgtcatttggttatcctggagggcctattttgtttaaaaacttgaattttggtatcgacctcgacagccgcatagcaatggttggttcaaacggtatcgggaagtccactatactgaaattaatatctggagacctgcagccaacttcgggaacagtgtttcgctcccccaaggtccgcatggctgtattcagtcagcatcatgttgatggacttgatttgacggtgaacccccttttgtacatgatgagatgcttcccgggtgtacctgaacagaaactgaggtcacatttgggttccttcggtgttacaggaaatcttgccctccaatctatgtacactttatcaggtggtcagaagagtagggtcgcgttcgcgaagatcaccttcaagaagccgcacattatccttcttgatgagccttctaaccatcttgatctcgacgcagtggaggcgctcatccagggtctgctcatattccagggaggagtgctgatggggagtcacgacgacgacagatcgacggggagtgtggatgagctctgggcggtgaccgatggcaaggtcgccccgttcccgggcacgttcaaggagtacaagaagatgctcacgacataaaccttgaaaaaggacgggacataggggaagatgctcacacagacatacagagactatatgtatgatatgtactccctggcatgggaaactgatgtaatattatgcttgtcacctacctgaggtttgaaagtttgagtagaactatgctactacatagtagtacaattttgtttgttccagcctgcctgacaatctgcatcgagcttgcgattttcttggacaagctttgaaggtggtgatagttttcctttttttccgaat

SEQ ID NO: 12471 - DNA, 844 bp, Triticum aestivum
  Clone ID: PAT_TA_12471
cgcgcccttcccccttcccgccagggatgcgccgtggccttccggtcttcgacggagcccagcatttgcttcggacggatcccgaggatcacctggagggattcttcatagcgctctttgtgaggaaagcagccgccgctcatgctttggagcctagcgaagacggtagcgcgttgggaaggaaaaggaaacgagcttgcacaacgcgaagcggaggtctcagggcgttcagctccccgcctttctccgggatgctctctcacatgctctatcatttccctctgtagtagagcattggtctacagcacctgttcaatacaccaggcagagaatgaggatgtcgtcagctctgtgctacctttagcctcatcactcggtttcgagctcgctaccccattccctcaatggaggcgccgtggccttccggtcttccacggagccgagcatttgcttcggacggaccccgaggatgatctggagggattcttcatagcgctttttgtgaggaaagcagccgccgcagatgctttggagcctagcgaagacggttgcgctttgggaaggaaaaggaaacgagcttgcacaacgcgaagcggaggtctcagggcgttcagctccttgagattgtccaggatggacgtgctctgctccatctggggtatatagagatgtttgatgttgccctaggatctttgagcgatttcttttggtagcggcagctgaacgaagcccggcgttggacttgtaactgaattttgcattttctcgatatgtaggcagaattgtgaactaaggccacattgtgcacgttcagttttgaagcaattaacatcgaaaaaaaaaa

SEQ ID NO: 12472 - DNA, 969 bp, Triticum aestivum
  Clone ID: PAT_TA_12472
tggcgtgctgctctcggctcctccctccgctgacactgtgcttaccctccttgtcctcgttcgctctgcctctggcagtcttccgtgtcatctcccggtctggcgcactgaccgcccgtgtttctggggctgcgtggggctcgtgtgtggcgctgctgtcacctgctcctgttgctgtctcggtgcttcccttctttgtctgagttcgctaggtttgagccatctttttgaattttttttcaaagaactgcatttagaagtggattagatggtgactccatttttctgcaatgtacagccatagtaggtgttgttgcatataacaatcataagcttaaaccccaagtgaaccagcagcagggcgctgacagcaaagtcagcccaggaagccctcgacatgtcgagataccattgaactctacaaaagaatcttcataacatcgaaggtagtgggatcttggacagaattttttgggggaaggtaatataagttcgaaaactttcaattcatgcacctgtcatgcacggcaacatactgacggttggtgcatttactgttgatgcaggagaattgagctcttgattttgctacggagttgtccagctctccatgggatacattcttcctacaaatcaacaggaaggccggaaattttgtacaatgatatgtaggatacggtagcatactgatttgtattattgttgcccggagcagggcgggcacatcataaaggtcaattaggttgtgtagatgtgtttgttgtctttaaggtgctgtagaaatccatcaggtgctcccaaagatgcaacctggttctgttggtatacttcgttactttggagggtcctgccaacaagatggacctggctgttggcgcatggctcttcgcacattgtacaataccattacttcaaatataaaagaataccatatctgaacttttttttaaaaaaaaaaaaaaaaaaact

SEQ ID NO: 12473 - DNA, 823 bp, Triticum aestivum
  unsure (1)..(823): unsure at all n locations
  Clone ID: PAT_TA_12473
cccgcctcctctcgcgggcgcgcgcatgcatggnacaccgtctccggcggccgcgcgtgaaccaggnagacatgaacaggggtcacatcagcagctcggagctcatcgacgccaagctcgaggaacaccggntctccaccgccaggcactgccccaactgccgccacaagctcgactgcaaaccgaaggattggttggggctaccggctggcgtcaagttcgatccgacagaccaggagctgatcgagcacctcgaggccaaggtgagggaagaaggctcgagatctcaccctcttatcgatgagtttatacccaccatagacggcgaggacggcatatgctacacacatcctgagaaacttccaggtgtgacaatggacggcctaagcaagcatttcttccatcgcccttccaaggcgtacacgacgggcacgaggaagcggcgcaagatacagacggagtgcgatgtgcataagggggagacgaggtggcacaagaccggcaagacacgaccggtgatggccaacggccggcagaagggctgcaagaagatcctggtgctctacaccaacttcggcaagcaccgcaagcctgagaaaactaactgggtgatgcatcagtatcacctcggtgacctcgaggaggagaaggagggggagctcgtcgtttgcaagatcttctaccagacacagcccaggcagtgcagctggtccgcctcctcagaccgtggtggtgccggtggcgccgtagccattgccgccgccgcggcagtgacggtgcaggagcagcgtatgagggacagcggcagcggcagctcctcgtc

SEQ ID NO: 12474 - DNA, 624 bp, Triticum aestivum
  unsure (1)..(624): unsure at all n locations
  Clone ID: PAT_TA_12474
ccctcggccaccataccccaangnatggnaggtggctgtcgctgttcaagttgaagatctggtggatggccccgaagacgggcgcggacgcggcgggcgtgccggcggagacgcagatgctgcttctggagaagacggggaatggggccgaggacacggtgtacgctctgatgctgccagccctcgatggcgatttccgggccagcctccaagggtgtcccgagaatgagctccaattctgcttcgagagtggtgatcctgatgtgcagacgaaggacgctgttgatgcggtattcgtcaactcaggggacaatcctttcaagcttatgaaggaatcaatcaagatactgtccaagatcaaaggaactttcagtcatattgagagcaaggagacccctgcaaacttagactggtttggatggtgcacttgggatgcattttataaagctgtcaacccagtagggattgaagagggccttcaaagtttgcgtgaaggaggcgcaccaccaaggtttctgattatagatgatggttggcaagaaatagttaacgaattcaaggaagtggatggagctcttcttgaagagactgtgtttgcagagaggctggttgatctgaaggaga

SEQ ID NO: 12475 - DNA, 854 bp, Triticum aestivum
  unsure (1)..(854): unsure at all n locations
  Clone ID: PAT_TA_12475
attcggcacgagggatttggactccaggaacttgtccgtcaatccttgcgctgcagaaatggaagaaacccaatgtgtgaagtcaaattctgctgctgtgcacatgtcacataaatgggttcctattggaaagaaagatataacccatttggatgttccggaggcttctgttgttgaagcatcagttccagctaatgatgtttctgtttctgctaatatacaagtgcagagaaatgtttcagatgctcctgcatcaactaaatgtgaaggcagcgaagttgctactgagttgactgctacaccgaagttatctggacagcttgattcaaaatgccaaggacatactggcaatggaactgttttcagcaagataagagaggcggtgagtgatgctcatagggcccaacagagtgcggaagatattcaacttcacattggcaggcctcttgccgattttgaacaatttatttactctgcttctccagttctgcactgtagcccttgccctactggctgcagctcttcttcacaggaatgggttagnagatggcttgtgctgtcatcagnactgcggatatctctctagctagcatttggcagtggtatgaagaacctggctgctatggcttggaagtgaaggcacaggatctccgtagatcgaaaggcttctggaatagtcgttatcagtttaatgcctactttgtgccatatctatctgcggttcaattgtttaggcaacctaagagaactgttgataaggatgaagccaatatgggtgcaagatctaaaacatctccatgtataagctctctcccaatattagcgaagcttctacctcagnagtccaataaaag

SEQ ID NO: 12476 - DNA, 653 bp, Triticum aestivum
  unsure (1)..(653): unsure at all n locations
  Clone ID: PAT_TA_12476
cgacaactatagacccatagaatctgagcaccagcaaacaatatttcctctggtttcatttgattcttaattttgttttctgtttatttcccctgactttcttttcgtttggacttgagaccaaacgtttatctgtatctgttgacttgaggtgtggtaaattctctattcgtattgctggtggttgcgatttgcagtgattataaaatgttcagatacaaactgtgactgatgggagccgctagtcatcagttcagatacaaactgtgactgatgggagccgctagtcatcagttcagatacagactttggagtggagcactaaagtccagccatgggagccgctagtcatcagttcagatacagactttggagtggagcactaaagtccagccatgtcttgctagttcgtgggccaccgtattacaagaccttggacagtagtcagtgaactatgcagctccttttcagttagagcagttgcaatgcatcgggttctattaagcagtcgagtcaagcactgtcttcatgaaatgtaatttttccgggtgtaacgggcggtttcggccgcgctctccttttttctgccttacctctagcctttcagcgccgaatagatcttgcgatcgcttggcgtccgagattcgctnaan

SEQ ID NO: 12477 - DNA, 1042 bp, Triticum aestivum
  Clone ID: PAT_TA_12477
aggcttcacatcttttgttcgaacaatgctattatttgcaactgttctgtttctttgcttagtgttccgtttagtcgttcctgcatgattttcttccctttcatacttttatattgtataaattgtgctacgctgctgctcttcttcgttcatgcatttgctgcactatggcacctcaagcgtcagcaaaaagatattacatttggtctttgatgtcatcatatgtttatttagttctgagtctgcccatttatttttggtataaatcatgtgcaacctaatctgcagggcgcgtggctgtccaaaatcaagctccccaacaactggacaatggagcacatccggcagcttgtcacgctttgggctcggctgagggccatccccctcgcggtggacgccgaaggacaccatcacctggaaacatactgccagcggaatctactctgccacatccgcgtacagtgcgcaactccttgggctggtcagctcgcccatgggcttcgccgtttggaaagcatgggctccccctaagatgaaattctttgcttggctggcaatccaaaaccgagtctggacggcggatagattggagaggagagggtggccgaactgcgggcctatgtccactctgcaagcagacgttggaaacggcgagccacatcttcttcaagtgtcggtactccattagactgtggggcctgatcaaaggctggctcaagctagactacctcgacatctcctcctggatcacgatgcgctccatcaaggactgctggctcaacatgtccaactccagcatgcccaaccggaaggcgatggcttctcttgctatgctgacctgctggaccatttggtgcgagagaaatgcacgggtgtttcgtcacaaatccacgcttccgtctgtattgttctccaacattaagaccgacgccaacctttgggtaattgcgggtgctaagcacttgggtcaaatcatgccgggagagtagtggctttgtaatattttctttcgcttttcttgtaaaagcaactctaaactcct

SEQ ID NO: 12478 - DNA, 1632 bp, Triticum aestivum
  unsure (1)..(1632): unsure at all n locations
  Clone ID: PAT_TA_12478
tggtaaaagttaagggcgctacctgttctgaggacagagatctaagcctcctgatcagccgctgcaatatccatcaatcgccatccaaatcgcttgtgggcaccagatgctacacaaggtaagctcagcacaagagagtctgatggagacggcgaaatcggggagaaagcgggcggggaaaaagaaggcgtcgaatgcggtgtcgttttttatgcaattgacggttgattcagcgaagatggtcgaagagggaaggctgaagcgagcggtggcgaggcggaacgaggagaaccccggcgtggcgccgatcgtgccggaggcgctcacggagcaggagcgggcggcgcttgtgcagtgcgagattgcgagggagaagatattgtcgcgcgaacgctccctgctcatgcacgcggagagactatgggaaaaagaagagaggccccggtcgccgccgggtccgaaccaagaagacgagtctgaacaggattacaacaggtaccggctgatctgggacgtgaagcggtccaaacagcacgggtctttcgaggacaccacgtcgatccccgccatgtgtttcacggacattcctatgcctcatttcgctgccaaccagaccaccttgcgcttcgtcccagtcaaggtcacggaaataactggcggtttacagtggcccctcgatgtatttggcatgatcgccatgcgcgacgacctggatcataatcgcaatattatctttaaccggtcaagggacaactgccaaaccctcacccaacagggtcaacatttggttcttacaggtcctgctcgtgctgttgtgcacgaggggcatccgtctgtgtactttgaggccattctaaaagttaagggcgctacctgttcagaggacagagatctaagcctcctgatcagccgctgcaatatccgtcaatcgccatccaaatcgcttgtgggcaccagatgctacagaagtaagctcagcacactggagctggcatatggtatcatcgtcgcttgcgccgaggccaccatcgcagtcgaggtggtcgaggggtcatggccgcaagggttccacggccagttaactgcatgtactgccaatgtgccccacatgaaagtcttgctgctcgattcaggcgagaaagaggccgtcgctggcgacagcggcaagatggaactctcgcgccgtgttgtctctgttgaaaggtctgggcggctcatggtttgtgctctgttgtctcgtggtggtgagaaggtcgtggaggctgagacgtcctttgcaccattggaggctggcagaagccatggcatgcttgatgttgggtcgtgtaagctgcgggtcacggtggcctggtcgccaattctgaaaggctatccacttcgtggtttttcccctaccttccagcgaggctgttgctagctagtgtggagttcatgttcatcccatggatcttaatagtgcttatttttttgggcgatctaacagtgctatgttaaatatattcttccggaacaaaggatagcaccccttgcgctagtgcaaccctcgcaagctgctgcattttcccgcccccccttcaagggtaanaaagccnnttcctcaattccccaggangacccntnggatacgggtgt

SEQ ID NO: 12479 - DNA, 290 bp, Triticum aestivum
  Clone ID: PAT_TA_12479
gcgagaccatacgttcggtttctctgtgcctgctctgctgccatccacacccgcactatcccagctcgtgtgccggctcgaggttggagatcttctcctctcccctcctccttcacacaccttatcttggggctgccatcgtggtgctttgtatccgcacataatctgtaggtgttctcatcggataaacgtaccagattttcaatccacgacatgatatgtgatggaattttcagctagagatggttgttacctattggtcagagaagctattgataacaaaaaaaaaa

SEQ ID NO: 12480 - DNA, 1438 bp, Triticum aestivum
  Clone ID: PAT_TA_12480
gaggagagggcaaggagatcaacctcgaggagcggtgcccgcggtcgaagcttctcagccagtgcatcaagtatcttggtccggtaggtgtttgcaaacattttacatgggataaatgtgtagctggagtggaatgcatgtccatgagagttcaggagtactaatgattcaaactgaatttttgttgtgcctgcagaaagagagagaggaatatgaggttgtgattgaggatggcaagtttatgtacaagaacagcaggcaaatcctcgacacgtccggcggtccgagggacgcaaagtggatctttgtgctgagcacatccaggaatctgtatgtcgggcaggtaacgttcaggcttcatactagagtgctatcaacacacaacattgcattagacctattacctatgtgtactagatcatcatctaactttgtccaaaactctactttctgcagaagaaaaagggcacatttcagcattctagctttctcgccggaggcgccgcgtctgctgcggggcgactagttgtcgaagatggcgttctgaaggctatctggcctcacagtgggcactaccgccccacggaagagaacttccaggaattccaggacttcctcagagagaacaaggttgatctcagcgatgttaagatgagcccaactgaagaggatgaggagttttggagcaggctgagaagcatcccttctgagcggtgcaccgatgccgacaaacccgaagaagaaatggttcctgctgcagaaaccatcccttgcctggcacctcaggtcactgaaaccacacctgaaaatgtcatccaactccaagaaacaagcaaagatcatagccaaccggagatattcacaaggctggattcatcgaaaggcgccgtaaacatcgaaaaatcaacaacttccatgcctgaagatcatcaggaagacagcgacgatgatcattcggcggtgccaagggagaaggtcattgggagggtcaactcatatcagctggggaagcaagggtccttcaagtggaccaccggcgccggaccccggatcatttgcgtcagggactacccgccggagctccagcaccgggcgctggaggaggtgcacctccccccgaggaggagcggcaggccgacgtcgaggttctcgtcgccgcagaggggcggcagcccgatgtcgagagggtgtgaacccctggcgccgagagaggcgttccatgccacgcatctgcagcaaggattactgatcagtttatgatgaacgagctattcttgttcataagttgtgcatatggatagaggaataaagtcacctatatagggagtaaaaagaggtactccccccgtgtagatcttgtaagtgatgtatgtatacgtgatgttcaaattggacacaaagtgcaaagatcaatacaaattccttcaaaaaaaaaaaa

SEQ ID NO: 12481 - DNA, 774 bp, Triticum aestivum
  Clone ID: PAT_TA_12481
accattccccgttctccctatctcatttgttcctcgcattgccggctcgatgccgcccctcgccgtggctcctccgtctcctctcagcccgcagtaggactcgagtggtcctcgtctgcctgcgcagcacgcccggcgaggtacgtggttctctcgaggtagagggtggcttagagagggagaagtcggcggacagggtgatgagctcggaagaataggagggaggaagcgaggccgccagaggcagaggagaagaggcaatcgagtgctccttgcctgaaagcgaggccgccaaagccagaggagaagaggaagcggcagggtagggcgtggtgattacgggatctccgacatgctcaccattggggagcggcggcggtcagagctagctagacgctgcaagtatccatgggaggttcacggttcagatttcggaccattcacaagtcgtgcagcccgcggttcgacatgggacgttttgtgcttcctcaagaacttctgcaccgtgagcctgacaaagacggcagccatgctctttcctcctctgtcaaggtaagctacgtcagcagaaacacacaaattgtatacgcctgcttacattgtataagcctaattacattacattatatcatataataaacgcaatcaatcctagtgttcactgttgatatgtgatagaacagcagcaaagaggtgtgaatttgttcttctttgcagtacctgttttgttgggttcacatgtaacaatacagggcaactaaatatatatttttg

SEQ ID NO: 12482 - DNA, 830 bp, Triticum aestivum
  Clone ID: PAT_TA_12482
gattcggcacgaggcacgtgcaccttggcgttccagacggacccgcgcgcgtgcccggcgctgctgctggagctggccgcgcccacgggggccctggtgcgcgagatggcgtccggcctggtgcgcatcgccctcgagtgcgagcgcgccaaggccgccaccgggggcggcgacgggggcgggaggaagctggtggaggagacggtgtggcgcgcgtacgtgaacgggaagagctgcgggtacgcggtgcggcgcgagtgcggggccgcggactggcgcgtgctccgcgcgctggagccggtgtcgatgggcgccggggtgatccccgcggccagctgcggcggcggcgagggcgacgtgatgtacatgcgcgcccggttcgagcgggtggtggggtcccgcgactcggaggccttctacatgatgaaccccgacagcagcagctccggctccggcatcaatggcgggcccgagctcagcgtctacctcctcagagtctgatcggccggcggcccggcacggtggatggtcgttggtcaactagcgtttctttcggttttgtgcattcggttggtggaaacgggttagccttcagggggcgtttacgctcgttggaagcgtaaagtggttgtgaaccaaatactacgttttgttgcttagcaccatttgctagtgttggatgtaatgattctgtagattgagatgaatagtttggatggactccggacaatgaactggagtggtagtagctctaccagtagtaccatgcatgttgtcattgtatcgtcaataaatttgtttcatcaggcgggcttcatgtaaaaaaaaaa

SEQ ID NO: 12483 - DNA, 455 bp, Triticum aestivum
  unsure (1)..(455): unsure at all n locations
  Clone ID: PAT_TA_12483
gcgatgnatgagttgctcggtttccttccaagtccctcttgcaatcggtaaaggagnaaggagaagagaactttggnaggagaaggaaactggctttgcggaccacgttcagcggcagaagctcatatcatgcctgccaagcacctttgacattatcttccttatctatcagtcgaggcagcgaactgtactgacaaagcaggagctcatccacaagatcatcgaaagtaacccgaagatcgtggacaagggtgaagtcgaagagcaagtgagactgctgctagagtttgtcccaagagtggatctctgagaagactgcaagaaatggagatgttctctgctggtgtcaataccgcactgagccagntctgaggttcgacaaagggttgtcccgggtcgtctagggtggggcacgggaggctctctcctcggttttctccntttttttaacaaat

SEQ ID NO: 12484 - DNA, 536 bp, Triticum aestivum
  unsure (1)..(536): unsure at all n locations
  Clone ID: PAT_TA_12484
ggcggctcgcagcttgaaccacgatagtggccgcgaagagaaaagctcgctcgacagcgtcttccattggccgtggctcttcttctcgccggccatgggcccacagcgacaactacaatggccaggtggccgtaacgcccgccgcgtcgctagttgatgagcatcatgcccaagaatactggcgcccagttcatcccgatcgatggtggagtcttgtccgagccttccaaccgtaagcagctggttttgaagcctaccaaggcaccaatcaaatccacatttgcatacataaattcctgatggcagcaacttaatcctgttgagcggcaatgattctaccggctactccttcgtctaactcgtttttcatgtaaacatggcagaaaccaccctagatctggtacgacatgttcgcgcgtgtgcagtattttctgcatttatttcttctgataatggagtgagtcattgtattaggataccaagttatcatnctcatgttttgcgaagatgatctaaatccatcataccgtgagtgc

SEQ ID NO: 12485 - DNA, 632 bp, Triticum aestivum
  Clone ID: PAT_TA_12485
catggacgcatatgccaacttgcatcaccaaatggcaaacacatagtactggcctctgcctttcaatttatatattgctttattattgcaacttttttttatcaaggattactcacttgataaaattaacgtcactagatttgtatttcaatgtacttcatcggtctcgttaagaaaactggttatgattcatgtatggtcataaaattaagctcactaagttatgattcaaggtaggtgcatgatggttaattattagttacttatatcgatcgataggccggccgggcggctgaatttcaggactagttttctttggtcactttcaccatatcgttgaaacttccaagagccaatacactgtcgatgtagtgcccatttcaccatctctagggtagctcaacaaccatatacagacaaacatcatgtgcatgcctggtcagtcgcacgtggagcgatttgttcggtcccggctaacaaacctcaccaaatcaaatcaagactttcttccttcaaatctttgatgttgtttatgtgaagcctttttgtttatgcggtagattctttaatggaattcggtggaggggcgtcggaccctttatattaattaaacaagaattattttcggacat

SEQ ID NO: 12486 - DNA, 1079 bp, Triticum aestivum
  unsure (1)..(1079): unsure at all n locations
  Clone ID: PAT_TA_12486
acatctggtttggatgactatcctcgtgcgtctcaccctaatgatgatgaacgccatgttgatcttcgatgttggatgcttcttgctacaaaatgtatgcggttaattgcagaattgcttaaaatggacacctatcttgagaaggattactataatctgtcaattcaactttcggattttgggacccttaacaagatgcacttggatgttaaaagtggtggctattttgattatggtaaacatacagaaaaggttcggttgagatggtatgaattagaaggtaagtatgccatgagacgggtacttttaagagagacattacagcctcatctgcaattagtaccccatgttggttatgtcagccttttccccttcatgatgggggccattccaccagaatcatgggttcttgagaagcagctggacatcatatctgataggtctatcttgtggacggattatggcattcggtcactttctagaacaagttcaatgtacatgaagcgtaatatgccacatgctgctccgtcttggagaggtccaatttggataaacatgaactacatgattctttcggcacttcatcactactcacacgcggacggcccgtacatgggcagggcaggtgagctgtatgatgaactaagatcgaacctgattcggaatattgtgcataattaccatgagacaggcttcttctgggagaagtatgaccagaagaacagaggcaaggggaagggcgcgaggtcatatacaggatggagttcacttatagttttgataatgtcagagtcataccttagcattgccgacttatccaattagccacgtagaaggcagcccagccagggggcctagggagccctggcacagtacctgaccgcgcggtgattggacgttacagcccataccggtgtcagtttgccacgagtatttgagacatgtgaagccatctgagtccggactgtgaaatacaaaccgtgacacgtctgcatgtcccaattttatttttttttgcaaaatgtctgcatgtcccattgctgtaaatatttatgcctttcatggganngntgggtcct

SEQ ID NO: 12487 - DNA, 1143 bp, Triticum aestivum
  unsure (1)..(1143): unsure at all n locations
  Clone ID: PAT_TA_12487
gcgaagatttgacagaggcacaagtaaaatagnatcatctcttgtgactctcaagnatatgtatccagnagggcaagtcaggtctcgaaatgctgactgaatattccatggcctttgtttttcttgctaggtggattactacttccttggatattttcagaaaataaatgaaatgtgcagaccgacaacatggacggcaggtcttgcggctcccagcgccctcaaccccccactgaccctctctcaattttgatctctcctctactcttctgggtggcggtgagagcgggtgtgaaacagtagaggcgggagaggcggccataggaagtatatgataggaaaagaattgctctatggcagtgctttgactcggtgaccagagactgactgagtgtgcttgcagtttgaggttgattttttctggtatacatataattggaggtaggcgccatggacgccgctcttgtgctcatcaaggtctgctgctccttgttccagtcccatgacaagcagcagcagtagcatcatggttgggttggagctacagtggccagccaccgggacgacactgatagccaaagaaagctccttccccaccgctgacagccaaaaccactcttgtgctcatcaaggcaacaggatggcagtcacaggagccattgcattttctttgtcgcaatggcattagcaaagggtctcgccaccgcgcgcagtccacctctccccgcaggcatgccggccacctccccacctgacgcacatctttcccatggggccatggaacacggctgtgtcacttgtattgagcacaccaatctgcctcggtagacggctgctgaagttgacccacaggttggagacaaagatagtgtgacaattgactgaccttgacatgtttgagaattaggcaattgattgtgccatttctctgcgcattggtacttacttttaaaaccggtagattttaagaaatatttccgatgcattatagaatgccaccaaaacagaataactctcctgcctatttccatttattcttaacattgcttgtttttccttatgatgctacactagactgcagtttttgttgtcactgcaatgatgtatttttnattccatctgctgtcgacgcaagcacagagg

SEQ ID NO: 12488 - DNA, 266 bp, Triticum aestivum
  Clone ID: PAT_TA_12488
ggccaggtccattccctgtccatgtcctcgtagcagcattaggagtcaaccaaaccaatccaagcaagcaatgtgttcatgtagatgtattagcggttaatcggcgtcaatggcgggcaccggcgaagaagacgcggggcgttcctctagatccagtgcctaccaaagtcggcatacaactccagtcattagtcagtactagcagtagcatttgttgtgattctgaacatattgttgctccattattgcattctgcaaaaaaaaaa

SEQ ID NO: 12489 - DNA, 824 bp, Triticum aestivum
  unsure (1)..(824): unsure at all n locations
  Clone ID: PAT_TA_12489
cctccagttggtggcccagctcgccggcgttctgagtacggcctcggctacaaactctgatggataactgtaccatacccattccagtggggagcactgacttttcatgctgctgaatcctttgccatgatggcagctgcttttgttgctcttgtggagcgctacggctatgaagatgacgtgttgaagaagcaccatcggcttcagtgtcaccatcctcctcggcatgcagaagacactcccaagtcgtctctgtactgcatccaggatggcgaggttgagcgtttgaaagtagaaagtccagatccacagcggcatcagnagcttcgtcgtcgacctcatctgcgatcgtcctcgaggtcgcccatggcggtctggtccggcccggcagcagccatggacggagacgcctgaaaccctagccctccaaggnatgcgcgccggctgcaggccatcttcggcgagctcatccacagatcttcgtctatggtgcgtgtgcatgatccctagaccccttgtcttgttgctgagatggggagaagaggcaagggcgtatggtggtgggtaggggggctcaggcgtcacagagataaagaaggccataatgtttttctgctgacttctctcttgctacaaattatttgatacttatagatagtgataacaaaggtgaaaactggaccgggtgtatgatctccaaattaatgttgggatatctttatttggggtttcactgagaagttgttctttaaagattgaaatattgaatggcatggtgattcctctctggtgtagatatatattattagcatataaaaaaaaaa

SEQ ID NO: 12490 - DNA, 833 bp, Triticum aestivum
  unsure (1)..(833): unsure at all n locations
  Clone ID: PAT_TA_12490
ggtttcgttgnatgtttctgggnanaaatggnaaatgccactgtaaaagagtttggagngcttactcagctatgtaagcttaaagtgggtggtctgagctatagaaacatcagtgagttatggtctgccattgctggtcataatcaacttcaatctttatcagttgaaatgggttacccatacgaagagaggaatgtgttagatggctgtttgggtgaaggtttgctgccaccaagcagcctcgagagcctcactctgcatggtaagctagtcaatgtaacaggatggacccatacgcttcagaatctctccaagttggtgctaaagtggagcagattgaagcaagatgatgatgccatacaagcccttgggttacttccaaatcttgcagttctacgtctgggggtggattcgttgtatgggacacaactccatttcgagagctcatctttcccgagtctcatggtgctggagttgtatgggttaggcaacctcaggtcggcgctgtttgaaaaagacgcagtgcctaagctcgagctgctacaagttggtcggtgcgcagagctggaagcattctgtgggctgccagccctcacaagcctcaaggagattcagttggatagtcattgtctcagtgaaacattgaaagaattggtgcagagtcaggtagccgagcatatgaagcatgtcagagtgaattttgttgacttgtaaattctctttatatgtgtatatataatatagactccatcatcagagcacaaagattggtgcgtgtactcgctcttgtaattgtaccctttggtactatgctggcagtataattagtcatt

SEQ ID NO: 12491 - DNA, 875 bp, Triticum aestivum
  unsure (1)..(875): unsure at all n locations
  Clone ID: PAT_TA_12491
cccacgcgtccggccgcaactgtggcaaatcaggccacattgcaaaagactgcactgctccgccaatgctgcctggagaagtgaagctctgcaacaactgctacaaaccagggcacattgccgtggagtgcaccaacgagaaggcctgcaacaactgtaggaagagtggccatcttgcccgtaactgcaccaatgagcctgtttgcaacctctgccatgttgcagggcatttggcccgtcaatgccccaaatctgacgagatcaacgagaggggtgggcctcctcccttccgtggcggcgatgctctgttccgtggcggtgatgctctgttccgcggtggtgatgctcccttccgtggtggcgatgctcccttccgcggtggcggtggtgctctcttccgtggtggctacagtgacgtggtctgccgggcctgcaaccaggttggccatatgagccgtgactgcatgggtggcgccttcatgatctgcaacaactgcggtggccgtggtcacatggcttacgaatgtccatctgggaggctcctggaccggttccctccacgccgatactgaacgactaccaagagctctttcagatgactgttccttttgatccatcgtgttgtgagtcatcatcttgacgtgcgtcatgtttttgattgtcaagggattgggtattccagttgtttctgcaacttgttagtctcgtggttattgaatggcttctagggtcttttcaagatcagaactccccttgctcccctgtgttttgaataataattattttcagtggattaagtgaatcacccaagtgtttactcctgtaaaaaaancaaaaaaacanacaaacagggcgggccgactatnagagggntn

SEQ ID NO: 12492 - DNA, 1734 bp, Triticum aestivum
  unsure (1)..(1734): unsure at all n locations
  Clone ID: PAT_TA_12492
gaggcggccgacccaccgggtgcgttcggtgtccggaccaacccaatcccaatccaacatcgcgagtcggggtcgctgcccctcaccgtcgccgccgcggcttccacccgctgacctccgccggagctcgccggactcgtagggtttcttcagtcgtcctcttccctgctggagatccgcaccctaggaaggaaggaagggaggaaggaagcagggtgagttgtggtgattttgtggtttggacgtgtggtgttcacagtttggtgggaagcttggaggcaggagatttagaaggaagggttgacgatgagcagccgaagcccgccgccgagggaccggaggatgcgtactgaacgcacctcgtaccgtgacgcgccataccggagagacagggacggccgccgtggtccaagcaggtctgctagtgatttgtgcaacaactgtaagcgtccagggcattttgctagagattgtccaaatgtgtctgtctgccatgcctgtggccttccagggcacattgcagctgagtgttcttccaaagatctctgctggaactgcaaagagcctgggcacatggctaatgcctgcccgaatgaagggatatgccgcaactgtggcaaatcaggtcacattgcaaaagactgcactgctccgccaatgctgcctggagaagtgaagctctgcaacaactgctacaaaccagggcacattgccgtggagtgcaccaatgagaaggcctgcaacaactgtaggaagagtggccatcttgcccgtaactgcaccaatgagcctgtttgcaatctctgccatgttgcagggcatttggcccgtcaatgccccaaatccgacgagatcaacgagaggggtgggcctcctcccttccgtggcagcgatgctctgttccgtggcggcgatgctctgttccgtggtggcgatgctcccttccgcggtggtgatgctcccttccgtgatgtcggctgtgctctcttccatcagggctaccatgacgtggtctgccgggcctgtggccagtttatgattatgagccgctgctgcatccgtggtcacatggcttacgaatgtccatctgggaggctcctgaaccgcttccctccacgccgatactgaacgactaccaagagctctttcagatgactgttccttttgatccatcgtgttgtgagtcatcatcttgacgtgcgtcatgtttttgattgtcaagggattgggtattccagttgtttctgcaacttgttagtctcgtggttattgaatggcttctagggtcttttcagatcagattccctgtctccctgtgttttgaataataattattttcagggatgagtgaataccaggtgtttatctgtaaattgtgatttcagctattttattaactgggtcggtccgtggaggctggagctttaggaggggggcgcgtcgtggtgctgccgacgcccgccgccgagggaccggaggatgcgtactgaacgcaccttgtaccgtgacgcgccataccggagagacagggacggccgccgtggtccaaacaggtctgctagtgatttgtgcaacaactgtaagcgtccaaggcattttgctagagattgtccaaatgtgtctgtctgncaatgcctgtggccttcaaggganatnnaactgantggtcctccaaagatcnctgctggaacgcaaanagctganacatggtaatgcngcccaaacaaaggatat

SEQ ID NO: 12493 - DNA, 530 bp, Triticum aestivum
  unsure (1)..(530): unsure at all n locations
  Clone ID: PAT_TA_12493
taatcaatcctttcttttcatcttttatcaagtcttcctcttcctgattgagtcaatcagggnatagaaattcggatcaactatgaggagtagggctgctgggcaagtgaatgaactctgtcctaggcatttccaataagttcagtgaagtgagggcgaagccttttttgagagggaaaatacactccaaatgatattccataatggaaggaatgagtggaagatttactggaagaaaaaaatacgatacttttctagtcgtaggtagggctacctatctagtttcgtgcttcgggcgtaccagattcaataggctaggttatagctgacagatttctttaagaactagccgcctataagcctcgctagtagtattcctgcccagtgccggagtagtgactcacaaggtaagttctcctcgatgcatttccaacactctatttttactacgtacacttttgattcctcagtaggtagggacaacgttcgagnatctcatccgaccgtctatttctcactgattgggagat

SEQ ID NO: 12494 - DNA, 785 bp, Triticum aestivum
  Clone ID: PAT_TA_12494
cgtccgcgcaagtaccccctggagaagggcaccccgcccccatggtggcctgcagggaatgaagagtggtgggctgccttgggccttccaaggggacagattgctccttacaaaaaacctcatgatcttaagaaggtttggaaggtcggtgtgcttacatgtgttattaagcacatgtcccctaactttgataagatcagaaaccatgttcgcaaatccaaaatcttgcaggataaaatgactgcaaaggagagcctgatttggttgggagtcctacagagagaggaaaggcatgtgcatggcattgacaatggcgtctcagagattactcaccgcagtgctccagaagacagaaatggaactaggaacgcacacagcagcagtaatgagtatgatgttgatggttttgaggaggctcctctttcaatatcatctaaagatgatgagcaaggtctttctccagctgcacaatccagcgaggagcatgtctccagaagagacagagaaagggcgaacactaaacatctttatcaggctgttgttcttaaggaaggaacaaaaaaacaaccaccaaagagaaaaagagcacgtcacagttccgttgctgttgagcaggaggtacaaaggactgatgatgcaccagaaaatccaggaaatctgattcccgatatgaaccgactggaccaagtagagattccaggcatggctaaccaccagattacaagcttcaatcagatggccgttacaagtgaagctttacaacacagaggaaatgctcaagggca

SEQ ID NO: 12495 - DNA, 1145 bp, Triticum aestivum
  Clone ID: PAT_TA_12495
aggcggtgacccaggttactggcttgacctgcagtgttccgctgataactcgtactcaggcttctcatggcggctgttctcgtgcttttgcacgagtatggcatggttctggaagaaagtgcctcgcgtccggtcatcagtggacagcggtggattgggccgggatggcagaatgttgacaaaagcaggggacaatggaggcaaggctgaggagagcagagtggacaaggcgaaaaggaaggctgaggagaagaggttggcgaggttggagagggaaatgctggaggaggaggaaaggaagcagcgagaagagatggcaaagctagtggaggagcgggcgtttccgtcctcctcctcaccagaggctgaggagcgatccaaaggcgctacccccgttggggagaaggattctaggaaggaagcagaacggaggcggcaggagaggaggaggaaggaagacaagggatcaagcaagagcaattcagactgcgaggatgtcgagagaagagtaagcagagaaggtgagaggaagcgcgactttgatagaaggaatgagacagacaggcgggatgcggcaagagttgggacagatggacataagcccaataactttgaagctaacagtcagggtagtaagatagcacagagcaagacgaagtactttggtcgtatgactggaggtttattatcttcttccagaggttttggtggtggctccttttttggtagaagtgctcaggcccctgttcatcaagctaacaaggtgactaaaccgctcgttactgcaactgacgagagtattaaaagagatacccaacctgcagccacaccagcaatggtcaaatctgccacagccggagaaactagaaattcattgactaatcttatgtcgacctgttagtccaaatatgcaggcacatcctacaggccttaaaaagtcatggcatcaggtgttttagtcgctcagttgcagtttcctcttgccccgatgttactgcttcagctcgtgagaagaacatgctgcctgccccatatggtgcacagataagctgcgctcaaaattttcttgctcagtatactcctttggacagcacgccgaagtcaagccaatccattcattctggaggatttccaacaagagtatg

SEQ ID NO: 12496 - DNA, 788 bp, Triticum aestivum
  Clone ID: PAT_TA_12496
cggaagcccccaccagcccccctctcccccatcccccccccccccccccccccccctcctactctcgccacgacccgctcctccccacccccacccggcctcctcccgccccatcctggcccgacctcgccaatccacaaacggatcggggcctaaccctcccgcagcttgcgcccgcggcccacccggacggcggcgagaaccaccaacccatcttgagacctcaacgacggcgggtaccaagaatcgatgctgcaccaaccgcgcgcgtcacaaggagggcgggctgtggttgctgccggagcagtgaactctgcgctttggtcgctggaccagcgggggctgggttggccgtgacgcttgattgggtcgtttccaactgccccggcgtcggcggcgacgagacggtgctgcctccactgtcgtcatcgcttttgatttcagcatcggccggggcccgcgtccatgtcataattgtttctctgtgggtgccatcgtggctcggacttgatgcttggatattctgcaatccagaagaactggctactcagaagtggatgacagtgaacaggagaagctatggtttcctgatttgttgttatgtgtacgtgttgtcatgaagcatagtggttctggctttgtgtaaaatcattataagtatagtacctctttagaggagtttaacgctgaactatgtatgtgattcatgtacctgaagtatccactatgatgcctattgcttaaaacagtataaatatttactgttaaaaaaaaaaaaaaaaaaaaaa

SEQ ID NO: 12497 - DNA, 1083 bp, Triticum aestivum
  Clone ID: PAT_TA_12497
gcctggctcctgtgagaatagaagtcgaggcagatgaaacaacgttatcatgctttgcttcaggtgctaagcatgaggcagggtatgatgcattcatgactggatgtgtttttgcgcagttgtgtgcccatattggcgtcaaatttgaagacttcacacctaaggagagcctagagatgaataagaagctgacgaaatatatcaatcttctgccccctagctttaacagcggaacagtacttgatttgcgtactggaatggagagaccagatgcatgttataagcttagatatcctgctgctgtgcatgataacactgttctcatctggggattccaatctgggctgagcgcaaaggctataaagggctgcatctgcaaagtgtttggctcagcttcagtaacgacagtcttctcgatcgattccactgctgttctcgttcagttcagcacacaagagtctgtaaatgatttcatggatctgaaggctacgttggagaagcaagatagtgctatttcagtcttgcaccctctgtcaactatattagaaggaggccaaacacatgccgcaaactacgatacatacacagacatctgcagctcatctgtaacgaagtatctctttgctgatcaagctaatgcggtgtgctcaacttcaattagtgagctcggaggtgagaacgtagttgacggtgatgcactgggaacaaatagcgttctttgttgaaactgcggatacctcggtaaagcaggcagaaggaacccagcatagttcccaagaagcaagatgctactgatatttcgtgcccaagacatcttggatgcgcttcaagatggcaaaactttgttcggcaaacaaaccaggcggacatgactaacagggattgctctctgagtgtggtatactttgctgtggcctgactgctctgaataactcttgtttcaaagagcatttgttttgtcgatgtattttttgatgctttttagcatccaccactgtaaccgtgccttacagaataaccttgtgctgacgcagcaaagaccttttttttccaaaaaaaaaaaaaaaaaaaaaaaaaaactcg

SEQ ID NO: 12498 - DNA, 328 bp, Triticum aestivum
  Clone ID: PAT_TA_12498
gtgcagattacacagaggcccaaaattacatacaaccgtgtaccatctgtcaaagaagatcagcttgtgatatcccgttttcatgtgattttggcttatataccaagtaggtcgattttgattggagtgacactgtgatggaatacagcgtactaattagccctaggtaaatttacactttctcctgtactaaagagcatactttcttcttctcttgtaccctggtgtggcctagaggtccgaagcatatctgccaatacagaaggccttcttttttttgggaaaagaactgagatctattataaagatgtgctgatgtcgttgttcc

SEQ ID NO: 12499 - DNA, 1177 bp, Triticum aestivum
  Clone ID: PAT_TA_12499
gcttgactgctccgcaccgccccgccccgaccccgctttctcccctacgaaagcccagggcgcgaccgcgcgaaggaagcaacgaaagcccaaagctggcgcatccttagcacccaaggcaagaagaaagaggcgagagagcgaggcgtcccggaggcagagccaagaggatccatggatcggccccaggtggtcagcgagaactatgccaatcctataacatgcctcttccatgtgctcttcaaggcgtcggcgctggcgttctacatcctcttctcgctcttcgtgaagagcttcgtcatcatctttgtcatcaccgtgctcctcgctgcgctcgacttctgggtggtgaagaatgtcagcggaaggatactcgtcgggctgcggtggtggaatgagattgacgatgatggcaacagtgtgtggaagttcgagtgcctcgacggcgagtctctcgctcggatgaacaaaaaggactcgtggctgttctggtggactctttacttgaacgctgctgcatggatcattcttgggatattttcactcattagacttgaagctgattaccttcttgttgttggagtttgcttgactctaagccttgcaaacatcgtggggttcaccaaatgcaacaaagatgccaagaagaacatccgagcttttgctgaaaatgccgctcaaaacgccatcacatcccgcatcacatcatccctgcagtcagcattcggtatctgaagtccagattacagaggcccaaaattacatacaactgtgtaccatctgtcaaagaagatcagcttgtgatatcccgttttcatgtgattttggcttatataccaagtaggtcgattttgattggagtgacactatgatggaatacagcgtactaattagccctaggtaaatttacactttctcctgtactaaagagcatactttcttcttctcttgtaccctggtgtggcctagaggttcgaagcatgtcttccaatgcagaaggccttttttgtttgtgaaaaggacacggttctgttatgattcctcacatgctggacctgcccgagttcttgcatgtgcccttaaggactaagcgccttggaggcgtagttgtcgttgttgaaccttgaatcaaattcacaccaaatttcaccatctgtgagaaccctaaaaaaaaaaa

SEQ ID NO: 12500 - DNA, 704 bp, Triticum aestivum
  unsure (1)..(704): unsure at all n locations
  Clone ID: PAT_TA_12500
nnngcgggaattcgattagcgtgnncgcggccgaggtaccgaggnataaaaaatcaaatggagataaggttagtgaacaggaaggtgtgaatggagatgatgtgaataaagaggggggaaatggaacgaatgataagccaaaggatggtaaagagaaaaagattagggacctgaagaaggatccaaagcaaaagtcacttaacgacgccaaagagaagaagaaatctgatgaacctcctaaacatccaggattcattctgcagacaaagaagagtaaagagtctaaactccgtccaatatccctttcattggatggcctactagactatacaaccaatgacacagaggaatctgtttttgagctttcgctgtttgctgagtcgttcagtgaaatgcttcaattcagaatgggctgcattatcctgtcttttcttgagaaactacacaagcactatgttacaaagaagaacccgacgtaagcgcacaagagaggatgatctaacgaaggaaggcacaaaatcatcagaaaagagatcaaagacaactgaaggtgctcacattgaaagtacccccccgggcggccgcgctccaaaaaacgataaaataacggaagatgataagaaaaagatgagcatagatcagatacctttaccagctactcgtgatgaacctgtagcagcagagaagatggaggatgaagatcc

SEQ ID NO: 12501 - DNA, 587 bp, Triticum aestivum
  Clone ID: PAT_TA_12501
gccttccccttaacaaaaatgatcggcggcggttggcggcgggggggagaagaaagggcgaccgacggtgagtcggcgaccgcagggcattcaaagagaagtagtggcaagtccgtgttaagcgaggagctctatcagggtgtctacatggctgcaaactccattcaggagagtatcctctggatccaggcccaggagaagaagatggttgcgattggatgtcgcggggactccgcggatcacaagaatctgttggagttgaaatccggtctgtctgagttgttggagaagctcttacgtcttgccgaatccgagacccagaggaagatccgcgcgcagcagaacgcctgttggatcggcaataaagggaaagctgagaagaggatccgatcgatgaaatcgatggatagccagagcaagattgccgaggacgctgagatggaatttgtagggaagtcatccaagaggaccagcagccaaagcagatccgtgaataagcagagcaagatttgcgacggtggcaaatcgatcttcaatcggttcagggagcaggagctgcaggccatgaaggagctgttcgaggagct

SEQ ID NO: 12502 - DNA, 532 bp, Triticum aestivum
  Clone ID: PAT_TA_12502
cctctctctccctctcttccattattcccgtggcgctggccacctctcgtctgctcatggcaccgccacacccaacctccgctccaacgatgcgcctgtgaccgaggcgacggctggagcgcttctcctcttccactacggcagccaaaccacccggatcccgcgtcatcttccactccggcggccagatcagttcgagtttgggcaacacgagatctgccgaggacgcggtcctcgtccacggatctggccgtcagaaatcattttcttcattgttttcgttcgtgaggctggatcacgacctgtacttgcttttctcctagttgttcatctgttccagatttgcatgtttttggttatttttttattttgttccttttattcctttggtactgctgatctggctggtttcgccggggtgcatgtatgcatcaaagcgtcccgcggctgttccttgtggtggtgccggcgtgctctcctactctatcttctgctcgggcgtgcctcgtgctaatttttctcaaaaaaaaaa

SEQ ID NO: 12503 - DNA, 1081 bp, Triticum aestivum
  unsure (1)..(1081): unsure at all n locations
  Clone ID: PAT_TA_12503
cgctcatcggttagcccgacgccctcgtacccttcttcctcgtgcgctccgccagactgcgacgcgcccgccgtgctcctcgctcttgcttgagcttccaaagccccaaagccgcctcttccccacccgccgctacaaataacccccttcctcctcgcacgccacgctgccccctctggcttaccgcctctcctccgcctccgcctccgcctccctacgccacctcatggccgccgccaccgcagccgccgtctcctccccggcggtcaccgcccccttgcctcgcgccgcctcgtccgcggcgcgccggggcttcgtctccttcagcggggccgccgcccgtccgtccgcgctccgatccgaccgcctccgggcagccgccgccggcttctcctccggtgtgcgcacccacgttgctgctgttgaacaagcagttgtgcaagatgctacagaggtggaagctccagttgttgttgttacgggtgcttccagagggattggaaaagccgttgcattggctcttggaaaagctggctgcaaggtcctagtgaattatgcacgatcctcgaaagaggctgaagcagtctccgaagagattgaagcatctggtggtcaggctattacctttggaggagatgtttctaaagaagctgatgtggaatctatgatgaaagcagctattgataaatggggaacaattgacatcctggtaaataatgcagggattacgagggatacattgttgatgaggatgaagaaatctcagtggcaagatgtaattgatctaaatcttactggtgttttcctctgtacacaggctgccacaaaagtaatgatgaagaagaaaaagggaagagtcatcaacatagcattagttgttggtcttactggcaatgctggccaagctaattacagtgctgccaaggtggatcattggttcactaaaaattgcgaggatgaacatcagaatancantnaatcanccactgatcaacanagantaccccgaattggaagacttnaaaaaactgccacaccttggagntgcaccangattcggttgttantcggcctaancagg

SEQ ID NO: 12504 - DNA, 716 bp, Triticum aestivum
  Clone ID: PAT_TA_12504
gccgcggtgtgtaccgccaggaggtggtgcagctcctggccgtgctggatgtgggagatgtgctggtggtgttcttcctcggaccgtgagggtggtggttgctgaaaggtgtggcctcgccatgctgggtatctggtgttctgtgacgctatgaccacgatggcgaggtgctgcggcggcggcggtgtgatccaacacagacaggccttattccttcgcgaggggtggcaggtgggcgatgttaaggatgaaaatcctgccgtcttcgatcggtgtcgtgacgacggcgcccgtgggcgtcgttcccctccttggaggcgtcgcttaggtgtatcggcatcttcccttcttgcttgggttgctgtctccaggtgaaagcctaggtcttggaccggtgatggcggcgtcttggcgtcgtttctctgttgagagcatcgtgtgtggagacttggctaggatgttctgtgttgcagttctccggtgcgtgtcgttggtccgagtagagtctcttgggcgctaggtacgccaacgccggtgagtacaagaaggtggctatctcgggactatctgagtcccgccacccactcgccatctccacttgccatcttcttttcggtaatcatgggtggttggtgcgtcgacaagggaagttcggtgaaagttgctgctctaaaaaaaaaaaaaaaaaaaaaaataaaaaaaaaaaaaaaaaaaaa

SEQ ID NO: 12505 - DNA, 789 bp, Triticum aestivum
  Clone ID: PAT_TA_12505
gcctctcctcccttccgctcccctccccctgcctaatctctcctccggccaccgcgacaccgttggttcgctcgctagctccctcgccgcgccaagagacaagcctgcggagaccatggcggaccagctcaccgacgaccagatcgccgagttcaaggaggccttcagcctcttcgacaaggacggcgatggttgcatcacaaccaaggagcttggaactgtcatgcgttcactgggtcaaaacccaaccgaggctgagcttcaggacatgatcaatgaggtcgatgccgatggcaatggcaccattgactttcctgagttcctcaacctcatggcccgcaagatgaaggacaccgactccgaggaggagctcaaggaggcgttcagggtgttcgacaaggaccagaacggcttcatctctgcagcggagctccgccatgtgatgaccaaccttggcgagaagctgaccgacgaggaggtcgatgagatgatccgcgaggctgacgtcgatggcgatggccagatcaactacgaggagttcgtgaaggtgatgatggccaagtgagtgcgtccgcggtaatggtatactaccctactggaaggaggaaaccgttcattgcatattagtaaggcaatgcagctcttgtttccttcgtcttcccatgaagaaaccgtactagctgtagctgctaaaacatttgagtccctctgctgccacccttatcttccattgtgtcattgaacctccttgctccccctgtgtgaatctgtacggctttgcgtgttctg

SEQ ID NO: 12506 - DNA, 428 bp, Triticum aestivum
  Clone ID: PAT_TA_12506
gaaacgttcagtgcggtccgagtgatgtactccctccatttcaaaatatagtgcgctcacgctttccgaggtccaactttgaccataaatttaaccaacgagaccaactgtggcgggtaaaaaaattatataattgaatacttctttcgaatacgaattcactgatataatttttgctcccgccgcaatcggtcttggtagttaaatttacggtcaaagttaaagcacgtggatagaagaagcactacattgtgaaattgagggagtagtaaataacccatgatatcctggttgagcctgttcaacccgaccactgtaataaaagtactagctggcagagactcaattgtttcttaaaaaaaaaaaaaaaaaaaaaaaaaaaaaaaaaaaaaaaaaaaaaaaaaaaaaaaaaaaaaacaaaaaaaaaa

SEQ ID NO: 12507 - DNA, 672 bp, Triticum aestivum
  Clone ID: PAT_TA_12507
tcagatcccttctcctccgtctcgcccgcgtgttggggtaggagccatggcggaccagctcaccgacgaccagatcgccgagttcaaggaggccttcagcctcttcgacaaggacggagacggctgcatcaccaccaaggagcttggaactgtgatgcgctcgctggggcagaaccccactgaggcagagcttcaggatatgatcaatgaagtggatgctgatggcaatggaacgattgactttcctgagttcctcaacctgatggcacgtaagatgaaggacactgattccgaggaggagcttaaggaggctttccgtgtgtttgacaaggaccagaatggtttcatctcggcagctgaactccgccatgtcatgaccaaccttggtgagaagctgacagacgaggaggtggatgagatgatccgtgaggctgacgtggatggtgacggccagatcaattacgaagagtttgtgaaggtgatgatggccaaatgagctgccatactaagctagttctctctttttagatgaactaagctagttctctcttgaagttagcagctagtttagccctgaaaactgacagcacctcgtactacttgtaagttcagtgaatgaacatattgggcgtgctttctttttagggattgtgaaaattttcgtttggattt

SEQ ID NO: 12508 - DNA, 437 bp, Triticum aestivum
  Clone ID: PAT_TA_12508
tgtgtttgacaaggaccagaatggtttcatctcggcagctgaactccgccatgtcatgaccaaccttggtgagaagctgacagacgaggaggtggatgagatgatccgtgaggctgatgtcgatggtgatggccagatcaattacgaagagtttgtgaaggtgatgatggccaagtgagctgccatactaagctagttctatctcgatgttagcagctagtttagccttgaaaactgacagcacttggtactactgttaagtccagtgaatgaacatattgctcgctcttcctttcttctcagggatgttgagaatttcgtttggattttcctgcagttgtattacctttgtacaatgtagctttctttccaaattgagatcatgaatttgctgtaaaaaaaaaataaaaaaaataaaaaaaaaatatatattaaaa

SEQ ID NO: 12509 - DNA, 841 bp, Triticum aestivum
  unsure (1)..(841): unsure at all n locations
  Clone ID: PAT_TA_12509
gccggccggttcgggagtcgcgcactgaaaccccccacgccatcatcgccccatcaacgcgcagctcgcgtaacatttgcaggccctcatcgtcccctcgaggtctccgtttgccatggcggaccagctcagcgaggagcagattggcgagttcaaggaggccttcagcctcttcgacaaggacggcgatggcagcatcaccaccaaggagcttggaaccgtgatgcgctcccttggccagaacccgaccgaggcagagctgcaggacgtgatcaacgaggtggatgcggacggcaacggcaccatcgacttcccagagttcctgaacctgatggcccgcaagatgaaggacaccgactcagaggaggagctcaaggaggcgttccgtgtgttcgacaaggccagaacggtttcatctctgcagcggagctccgccaggtgatgaccaacctcggggagaagctttccgaggaggaggtggaggagatggtccgcgaggccgacgtggatggcgacggccagatcaactacgacgagttcgtcaaggtcatgatggccaagagaagggagaagaggatagaggagaggagagcgccgtcggccaagaagagcgctgcaggggcgtctggtgcaaagggcaataaatgcataatcctctagctgaaaccatcgagcgtgcatagtgtgtgtggtgcgctcggagcgctggtccccgaccgacgcatctgagctgttgtatgtatcaatgtatgttcatgtgtatcccggtgtatgatggccatcggcctacgactgtaaccattctcaggggtaacgaataaagntgctctgtgtcttgcag

SEQ ID NO: 12510 - DNA, 477 bp, Triticum aestivum
  Clone ID: PAT_TA_12510
aaaacagagagaccccccagccatcagggttcatttcagtacggggggttacgtacaagggacacgctgggattacgacaggagtacgtatattttacgggacaaaaagggggtaattcgaaaacaatattacttgggcaaaccatgcatcgagcaattcattcgagcacaaaacaatgggggtatcgatcgggcgatgcccatgcatgcatgaaactggaggaaataatatgatatcagctcgacccttttgcaaagagagataggtatggcagtttatgcggggagccccccctccttgggggtctcgaggacaatgccggacttggggtaggcggggcaggggaacacccaccctgcctccatttgggcgtcgtcgaggaagctctgggcggactgggcgatctcgccggaaaccaacttgccggcgcaggaggagcaggacccggcgcggaaagagtagggcagggggacccc

SEQ ID NO: 12511 - DNA, 828 bp, Triticum aestivum
  unsure (1)..(828): unsure at all n locations
  Clone ID: PAT_TA_12511
gtttgctctcgcgtccgccgcgcccatcctcgtccgcgcctgcgccccgaccgtgctcgccgcctcccgcccgatccaccggtccaccaccgcgccggcggcatggcggatcagctcaccgacgaccagatcgccgagttcaaggaggccttcagcctcttcgacaaggacggagatggttgcatcaccaccaaggagctgggaacagtcatgcgttcgctggggcagaacccaacggaggctgagctccaggacatgatcaatgaagtcgacgctgatggcaatggcaccattgacttcccagagttcctcaacctgatggcccgcaagatgaaggacaccgactcagaggaggagctcaaggaggccttcagggtgttcgacaaggaccaaaacggcttcatctctgctgctgagctccgccacgtcatgacgaacctcggcgagaagctcaccgacgaggaggtggacgagatgatccgtgaagccgacgtcgacggtgatggccagatcaactatgaggagtttgtcaaggtcatgatggccaaatgagcaccccaccgtgctcccaagacaggaggagaatgtgcatngcatatagtttaagaattcaactcttattgatcgatttccaggtaagcatcctaccctagctggagctggtaaaaacgatcggacgaccgcatnccgggtatgttcttcatgtgtttccagacctcttgtgtttatgtggaacctnggtcctccctgtggattctgaatgctgtgcggcccgttgaagataattttcatcaacttctgcttgattttctagaataatgggaaggc

SEQ ID NO: 12512 - DNA, 1125 bp, Triticum aestivum
  Clone ID: PAT_TA_12512
cttgatctgtttgctttgtcagtattggttaacgagcgaccaggaactatctgttggatcgttctcggttttgagggatcgcggatcccgattcctggtctgcacgccttccttttgaatccccatctattgtgatttcttgagatccgtttggagtctacggacctgccggcaatgcttgactgcttgtcacttttggatcttagagagtggcgtagcttgattgggggttgcattaccaccaaggagctgggaactgtcatgcgttccctggggcagaatcccactgaggcagagcttcaagacatgatcaatgaggtggatgctgacggcaatggaacaattgatttccctgaattcctcaaccttatggcccgcaagatgaaggacactgattctgaggaagaactcaaggaggcattccgtgtgtttgacaaggatcaaaatggttttatctctgctgctgaactgcgccatgtcatgaccaaccttggtgagaagttgactgatgaggaggttgacgagatggtccgtgaggctgatgttgatggtgatggccagatcaactatgatgaatttgttaaagtcatgatggccaagtaagttgcattaccacctgagggaagcttcagtaatcaggccaaaatattacctatccaggtgccattttgtgagatggctatcgtattaaaccgaaaacaatataacactgtgctgtgtcatactccctccgttccaaaatatagtgcgcccgcgcttccggaggtccaactttgaccataaatttaaccaatgagaccaactgcggcgggagaaaaaattatataattgaaaacttctttcgaatacgaattcactgatataatttttgcttccgccgcaatcggtcttggtagttaaatttacggtcaaagttgaagcacgtggatagaggaagcactacattatggaatggagggagtatgttgtaggcaatgattgtttgccttgaagattttatagatcctgctctggtctttctgattgtgtctgttccttttttttatgtttggttcgtttcaacttttcaagagtgtagccacaatgtgttaatgaataactatatgtcagtgttccatgattgca

SEQ ID NO: 12513 - DNA, 762 bp, Triticum aestivum
  Clone ID: PAT_TA_12513
ttttttttttttttttttttagctagtagaaattgctctgaattatgaacagtgataaataagctatacaattctttacatggaaagaacggtaatatataacacatttaactttaggtcacttgacacagctctataaccaaattacgatactgctggtatatatcgctccttcagtacggtagatatgaatttacatcagacataacctttcaaattgcgcccgattattcggcatgtccctcctgtcaaaccttgagccatccgcctggatacacctcggttgtctttccgttgtctacattcttcgcccttgagtcgctctgaattgatttttcagaaagtgaaggcaaaattgttgtaaagcttatccccttgctcctcctgagatgagctacgaagaacaccgcgccgatgagcgtgatccctccagcaactgacttcagcactcctttccctgatttgggagcattgttcccggtcccctgagcatttctgttgttttcagttttatccagttcgtcggatttgcaagcatccatgtgatccttagtccttgcgctatcgtctttttctggatgatcagtgaatattttcccatttccctgaacagaatcatgtgaaggttcgacgtgtccatcatgaatcctttcagacacttcgacaggaggaccgcccacatcattcttgctactgtcgcacgctaaataactgtttatggagtctgactcttctgaacttagtgaacatttatttcttcta

SEQ ID NO: 12514 - DNA, 537 bp, Triticum aestivum
  Clone ID: PAT_TA_12514
agatcactaacggagggagtacatcacatttctgtaggtaagttgcaggatcattttcttcctgaatgcaaatggctcccaagttactaagcttttgtgactgtttacaacacaaaactgtgcattggtgaaccatggtgatgcagtcaatagggcacagtggcagtgaccgttctgtgcctggggtctgtcagcacggagcacacattgacgaagcctgcttggctcagcgcctcctccagatccagcatgtagtactcgtcctggaacggttcggtgctcttcatcagagtgaacagaacgggtgataattcctggagtacttttgatttgggcttcggcgagcacacatacaaaaggaaacgaagttagatgtctgaacctttttcaaaacagttgtgttaccaggtacagtaactgattaatattgggagactgaattttcttactgagttgtcggttaaggcgatggttcctcctggacgaagtaatctgaatgcttccttggctaatccgattattgctcctgctggacac

SEQ ID NO: 12515 - DNA, 522 bp, Triticum aestivum
  unsure (1)..(522): unsure at all n locations
  Clone ID: PAT_TA_12515
ggttgagggcggggtacagaccaagctgaactgctgaagatcgagcgggtgtgatggataacatgagcgataacgggcgcgagggcgggtgggggcggctccttgctatccgggtgccggcgcgcgacggcgagcagaggcagcacctgccccgtgccggcgcggggccggncgaagggagctggggcggcgcgcggaggatagcaacggcggcaacggcaagacggccaaggtgatgcacctgctgctctggggccccaagtgagatgagaccggccaggttccccgccggccggtttcccgtgtacccgtgggccgttgctgcatgctccttcagtttgccgcgttctttcttcaccgcttgtgttttaatggccagtttgctgatgtgtatgtgaagtttgtactgtacatagcgaaatatatatatggatgcgatcgttgtgtctaaaaaaaaaaaaaaaaaaaaaaaaaaaaaaaaaaaaaaaaaaaaaaaaaaaaaaaaaaaaaaaaaaaaaaaaa

SEQ ID NO: 12516 - DNA, 634 bp, Triticum aestivum
  unsure (1)..(634): unsure at all n locations
  Clone ID: PAT_TA_12516
aatagtccgaagaaccaatagacagagcagcatcacaacaaactgtcttggtgatatcgacaagagaagccctttcatcaatatatataatcacacaattaacaggctatcaggtgaaactaccatatcgtcgtggtctctcattattttagttgtttgttatatgtacaactactactacaatctataagggtttaaagaaaaaaaaaacatgttcacatttttataggaagggatgagacggtccaaccaggttcagccactgctgcttcagatgggagggatgttggcaaaagagaagccctggtaccctttgtaagcataatacgctactcttgtgtagtagaatccagggatgaacatcactacgcccagcactgtgaagaaaatcccgtgggagcggtcgccgccgacgcggtggccggccatgacgaggccggcgacgacgccgagcgcgccgaacgcgagcagcgcggcggcgaaggcgatctccttgaccggcgcgccgcgcggncggncccccgccgcgccgnccaccaggtngtnctcgtcggtgatggagaaagcgtggtccacgtacgccatcccgctgcaggccggtcgagcggccgccgcccgcgccggcgncaccacc

SEQ ID NO: 12517 - DNA, 843 bp, Triticum aestivum
  Clone ID: PAT_TA_12517
tttttttttttttttttttcatttcagtacgttgaattacgtacacgctagtattacgacagtagtatatcttacggtacaaaaaggtaattcggagacattattacttgaccaaatcacgcatcgagcaattcattcgagcacaaacaaatcggagtatctggccatgtcaatgcatgcatgataaggagataatatgatatcagctcgatctcgttgcaaagagagataggtatagcagcttatgcggtgagctcctcctccttgtgggtctcgatgacgatgtcggacttggggtaggcgtggcaggtgagcacccattttttttttttttattagaaagttgctctgaattatgaacagtgataaatcacctatacaattctttacacggaaagaacggtaatatatatcacatttaactttaggtcacttgacgcagctctataaccaaattaggataccgctggtatataacgctccataagtacagtagatatgaatttacatcatagacataacctttcaaattgcgcccgtttattcgggcatgtccctcctgtcaaaccttgagccagccgcctggatacacctcggttgtctttccgttgtccacattgttcgccctcgagtcgctctgaattgatttctcagaaagtgaaggcaaaatagttgtaaagcttatccccttgctcctcctgagatgagctacttaagaacacggcgccgatgagcgtgatccctccagcaactgacttcagcacccctttccctgatttgggagcattgttcccggtcccctgagcattgctgttgctttcagttgttcccggttcgtcagat

SEQ ID NO: 12518 - DNA, 674 bp, Triticum aestivum
  Clone ID: PAT_TA_12518
attaagaagttaccgaaatggcgaccaattatgatccggtcataacaagacgagtaaaatatagcatgaatccctcgctagtttgcagcaaggtacaacaattattcaaccaagaccattgcattgcccacaccaagtgcagctcacacgagattagatatagaaagatgaaaatatgtaacacttttgcggtagcgaagcgaggagaaatggcgcctcctcctactaggctactacagcttgtacttgtagcgcgtgaccccggactcgttggggaagaaccccatgaggcgtccggcggagttctggtaggcgtacatgaaccctcccaagacgccgatgaggccccccgtcaccatcgacggcccgcggatccccggcttgatcccggagaggtagccgacggtgacggagacggcggagatggtggagaggcggaggtagtcgagcgtggagaagttggcgacgactttggtgaaggcggggttccggtccaccaccgggtactccggcttcaccgacgcggtgatgtcggtgttcatcgcgcgctgcggggctctcttccttccttccggcggcggcggcgcggtggcggatttggtcgctggggctgagaggtgtgtccggtgtggttctcgggttctcagtctcacagtaatacgactcagtatagg

SEQ ID NO: 12519 - DNA, 556 bp, Triticum aestivum
  unsure (1)..(556): unsure at all n locations
  Clone ID: PAT_TA_12519
gagaccccccgcccccctctctcctccacctccatctccagcgctcgccgcgagaagccgagaaggaagagcctgagaaggtagcatggcggaccaactcaccgacgaccagatcgccgagttcaaggaagccttcagcctattcgacaaggacggcgacggttgcatcacaaccaaggagctgggaacagttatgcgctcgctggggcagaacccaaccggaggcagagctccaggacatgatcaacgaggtcgatgcccgatgggcaacggcaccatcgacttccccggattcctcaacctgatggctccgcaagatgaaggacaccgactccggaggaagactcaaggaggccttccggtgttcgacaaggaccagaacggttcatctcggccgcggactccggccacgtcatgacaactccggcgagaactaacggtgacaagtcgacagatgtccgcgagntgactcgacgggacgcagtaactacaagatcgtcagtgatgatggcaatgataacgatgtatgtcgtggaatatantttcgggaggagaa

SEQ ID NO: 12520 - DNA, 941 bp, Triticum aestivum
  Clone ID: PAT_TA_12520
accataagagcagggtgtttcatactccctccattctaaaatatagtgcgtccgcgcttctcgaggtccaactttgaccataaatttaaccaacgagaccaactccgacaggaaaaaaattatataattgaaaacttctttcaaatacgaattcattgatataatttttgctcccgccgcaatcggtcttggtagttaaatttacggtcaaagttgaagcacgtggataaaggaagcactacattgtggaatggagggagtacaaaaacataattgctcaaatctaatcacgccgtagcatctgcccatatcaaagtgaaaacatagtagcagtaacattttaatcaccatctacaaatttctggcaaccgtcacactaactacggtccaacagcaaaagaagtaacaaaatcattaatgttgcggagaaagataggtggtttgcatcaactttattggactccatattcagatgcggcaggcaggagacctattctggtcctagctactgctgtttgctcgttgcatggtgagcatcttaacatcaataaagcgttttgcgcagttggacaggcaagaggtttcgctgttgctgaagctgctcccgatgcttccggtgatgcatctgtcccagcaagtgtcagtcagcttcgctatcatctcattcatcatggcctttttcttctcctcctctaagagcgcctgaaacctcgggtcgttgagagctgaagcgtccatgggctcgtgactcgcgcccctcctgcaatctcctctcttcccttggcggcagacgggcagagggaggtcggcttttgttttcctttcccctggagcaagaaagagaagggggaagaagacgatggagatccaagcacgacggggtgtcgccgacaaagccgggaaggagaacgacggcatctggccaacatgtgagaagtagt

SEQ ID NO: 12521 - DNA, 874 bp, Triticum aestivum
  unsure (1)..(874): unsure at all n locations
  Clone ID: PAT_TA_12521
cgctcccggcctctctctgtttgctctcgcgtccgccgcgcccgtccggtccgtgcccgcgctcgtgctcgctcgctcgccgcctccgatccaccggcccaccaccgcgccggcggcatggcggatcagctcaccgacgaccagatcgccgagttcaaggaggccttcagcctcttcgacaaggacggagatggttgcatcaccaccaaggagctgggaacagtcatgcgttcactggggcagaacccaacggaggctgagctccaggacatgatcaatgaagtcgacgctgatggcaacggcaccattgacttcccagagttcctcaacctgatggcccgcaagatgaaggacactgactcagaggaggagctcaaggaggccttcagggtgttcgacaaggaccaaaacggtttcatctctgctgctgagctccgccatgtcatgacgaacctcggcgagaagctcaccgacgaggaggtggacgagatgatccgtgaagccgacgtcgacggtgatggccagatcaactacgaggagttcgtcaaggtcatgatggccaaatgagctccgacccaaatgctccgaagacaggaggagaattgtgcattgcatattagtttaagatgcaactcttatttgatcgatttccagttaagcatcctacctagctgtagctgctaaaacggatcggacgacgcaattcctgctatgttctccaagtgtgtttccagacctcttgtgttttatgtgaacttgtgtcctccctgggtgtatcctgattgctgttgggccntttggtagtaatttttcaacaactccncttgaccctccaacaacnatgggaacccggtgtttccttaaaaaaaaaaaa

SEQ ID NO: 12522 - DNA, 990 bp, Triticum aestivum
  unsure (1)..(990): unsure at all n locations
  Clone ID: PAT_TA_12522
tcctccttttttttaggtccaactcatcagctttgtatttctcacattttcatagtgttcatacaaccagaccagtacagaatacaatgtaactagctatgaagaacaaccagaacacaaggcatattgatagataacaaccacgctacatcatcttcctcttccaaattccaagagacaaattacctcatggaggagtggggattggcgaaggagagggcgtcatcggggcggccggaggcggcgaggcggcgcttgatggacgaaaagtttcaacatacactcagctcagcggcgaggcagaggggatttctttagaagagaaagagaaatgtagatctctgtgtatgagttgacgtaggggatgaaatccaagtagtacatcccgccggagagggggccgatggagcgggtgaccctgccatcgaagtcggcggcgagcacgagctgctcgagaggatcccacatgaccacctcggcggcgccctgggagcggagcagggtcatcctgccgtggcccgtggtagcccatcttgttggcgtggaactggcccgcccaggcccaggtgacctggtcggcgccgtcgccgggcaccatgtagagcacggccacctccttggcgggctggtcgacgcaggcgacgcagaagttgccctccatctcgccgatctcccagtccttgcggtcctcgacctcctggggcgcggggatgaggtcgacgcagcccgtctccggggtgtagcagaggatgtggccgatggtggtgcggaagaaggcgcgtccccgcgcgccgaccccggactgcgcgacgaccgtctcgggcgcgcagatgtcgtccccgacgcgccagtcccaggtgcgggtggagaaagactcgacggcccagacgccgtcgtggacctggtaggtgacgacgacgtggtagtggcggaagccggcgccgaggccgacttggccggcggcgtncctcgtcgtcccctcgtgccgaa

SEQ ID NO: 12523 - DNA, 1185 bp, Triticum aestivum
  Clone ID: PAT_TA_12523
ttttagattaaattgcaatgtttgtaaccgcagttgtatggttctatctagctccgagcttcatctatgatgcgccaagaaaaacaaacagagaaaagattacataaaaacagagaaaacatggagctacccagcatccacgactagagctagtagtaggaacacatggtacagtagtagagccgcaggacaattagtggtcttgtctgtcagccggcaaggcatgcgttgtgctacctactcatggttcagagagccatctcgctgaacctgaatggtcttgacaatccctgactgaacctaaactatcatatgcgcatgattgggactagtggcaagtacaccaggatgttgagcggtaggcccctgtcggcgaagttgttgttgttggtactcctcccgtgtcacccgctgcatcctctcgtgctcctgcatgtacgtgtccacctgcacttattgggaagttgaggagcccgaagtgtgagccccagcacttgagtgtcgcctgagccccagcacttgagcgccacgagatcatgggtgcgagctacttcctcctctgtcttgtaagatcacaaataaacaggtggtgaagaacttggcggactacgcgaccgcgaaggtgaggagccccgcgacgatcgggtagttcaccacggcggcgaccatctccagctccagatcgaagtggacaaggctgcggccgtcgcgggtatgggagcaccgcctcgcactgcccgacctaggaccagggtgaggggagggcgtggtggtgtgcgaagggtgaccgccgtcgtggccttagcgtctgcgccgtgattcggacgggatcccgatgggatctacacgaggccgccgccgcccctcccctgttgcggggccgggtgcgggtcacctcccatgaaaggagacggagatggagccggcgcggacacggatgggactcggacgcgcagcgaaggtggttgccgaggcgggcgcagagacggggtgggtcgctgggattcgtggcgctgtggagacacccgtgaggaggggaggaggagagggcgagcgaaggagggcgccaccgccggcgatgggaagctagggttagagaggggtggcgacgtcgatctggactgaggagagagagagggaggcggcgggaggaaggaagggaggagagggcgcctcgtgccgaat

SEQ ID NO: 12524 - DNA, 832 bp, Triticum aestivum
  unsure (1)..(832): unsure at all n locations
  Clone ID: PAT_TA_12524
ctcgtgccgaattcggcacgagccccgtttattcccctccggcgcagccgcccccgtgtcctgtgcgcaccttctcgaagcctcctccctccctcatggcggaccagctgaccgacgagcagatcgccgagttcaaggaggccttcagcctcttcgacaaggatggcgacggttgcatcaccaccaaggagctcggaaccgtgatgcggtccctccgggcaagaaccccacgggaggcggagctgcaggacatgatcaacgaggtttacgccggacggcaacggcaccatcgacttcccggattcctgaaccttgatggcgaggaagatgaaggacatactccngaggaggactcaaggaggcttccgcgtgttttgacaaggaccaaaacggttcatctccgcggcggagctccgncaggtgatgaccaacctcggggagaagctgtctgaggaggaggtggaggagatggtccgcgaggccgatgtggacggcgatgccagatcaactacgacgagttcgtcaaggtcatgatggccaagagaagggagaagaggatagaggagaggagagcgccgtcggccaagaagagcgtggcaggggcatccggtgcaaagagtggcagcaaatgcacaatcctctagctgaaaccatcggacgtgcatagtgtgcgtgtggtgcgctcggagcgctggtccccgaccgacgcatctgagctgttgtatgtatgtatcaatgtgtgttcatgtgtatcccggtgtgtgatggcgatcggcctacgactgtaaccgttctcaaggtaaacgaataaaagtgctctctgtcttgcgga

SEQ ID NO: 12525 - DNA, 670 bp, Triticum aestivum
  Clone ID: PAT_TA_12525
tttttttttttttttttttcatacaaaaacataattgctcaaatctaatcatgccgtagcatctgcccatatcaaggcgaaaacatagtagcagtaacattttaatcaccatctgcaaatttatggcaaactagggtccaacagcaaaagaagtaacaaaatcattaatgttgcggagaaagataggtggtttgcatcaactctattggattccatattcagatgcggcaggagacctattctggtcctagctactgctgtttgctcgttgcatggtgagcatcttaacatcaataaagcgttttgcgcagttggacaggcaagaggtttcgctgttgctgaagctgctcccgatgcttccggtgatgcatttgtcccagcaagtgtcagtcagcttcgctatcatctcattcatcatggcctttttcttctcctcctctaagagcgcctgaaacctcgggtcgttgagagctgaagcgtccatggctcgtgactcgcgtccctcctgcaatctcctattttcccttggcggcagacgggcagagccagagggaggtcggcttttgttttcctttcccctggagcaagaaagagaagggggaagaagacgatggaggaagggaggatgctctttcttttttttcttttgtgaggagggttgaaggccgat

SEQ ID NO: 12526 - DNA, 919 bp, Triticum aestivum
  unsure (1)..(919): unsure at all n locations
  Clone ID: PAT_TA_12526
ttttttttttttttttttaagtccaactcatcaacttttatttctcacattttcacagtacaaagaaacagaactatttcatgacaaatatttcaaatgaaacaaaactatatacttgaaatgaccagaccagtacaaccagaccagtacaaaatacaaccagaccaataagtgtagcctattacaatctttacatactgttcatacaaccagaccagtacaaaatacaatgaaactagctatgaagtacaaccagaacacaaggcatattgatagataaccaccacgcttcatcgtcttcctcttccaaattccaagaaacaaatcaccagctatgctatgctggagtagaaaaagagttactagagtgggaggcctgcgagtggaagaagaatcatcgcatggtggcgtgtctctgtcttgcagctgagcagagagccgatggcagcggccaagcgtgaacgaagcgggaagtgatgtcttcgcgcggtggctcaaccaactcatagaccttgcaacccacgaccttgcgggcacacacgtcgacgctgatccggtgctcatcctttatgtccagacatggcgaggacgcaacacacaacagccctttcttgcgttctgcaggttgcagcttcccttgaggagtgaatatatatggtatatcttccctcatgaccctatgaggtcttgacgaagaactgcatcttcctgctgctcgtgcgtgcgggagggagtcaagatggtcgcgtgacaacgacggagcaggagcggaagcacgaaaacgacgggtgggtgcctgcggctcggatccgaagccagacctccatcgaggttgcggctcaccagggtgacgacgtcggcaaggccgccgggttgtgggtcggagcgaaggacctcaggcgtnccatggcggcctccc

SEQ ID NO: 12527 - DNA, 754 bp, Triticum aestivum
  Clone ID: PAT_TA_12527
gtaggggacatcatatgatgatcaggcgaagctccagggatttctcctgacatctggctgttggtgactgaagggacgtatcccctagggatctctccactgtcatacttggagaggccgatctcgccactgtcatacttggggtggccaacattgccactgcccccggtgttcatgcgccagctgcgcatcctgtcagcaatcttctgcttctggtcctcagtgccagatgcagggtagttgaagtcactaccatcatcggcatcagtgtcgtcgccttcctccccgcggatcgctgggctccctctgtggcgcttgtacttggtcttgcactggaggcaggcctgggtgccctccttgcgctcgtgctcgtagcaggggcggcagaccgggaagcggcagacgtcgcaggcggtgaagacgtcgccgtccaacgtggtgcccaggccgtcggcgcagatctggcacacgtccccggccccgtgcctcccggacttcaggggcgtccgcgtcgccgtccatggcgcggcagagcgatccaacccgcaccgacgacagagctggagcagctcctcccacccaatgtgcggagcgcggaggggggttcgggggggcagtggggatggcagcgggagtgccgctgctactagtagtagtggtggtggcgcggggcgcttaactaccggacggaggggaggggaggggagggggggtgaaaaggacgggccaccagaccagcggtgcctcgtgccga

SEQ ID NO: 12528 - DNA, 1197 bp, Triticum aestivum
  Clone ID: PAT_TA_12528
tttttttttttttttattcttgttctgccgcttcaataatatatatactaataataatataatgagtagatagcagagctaatttaatacttcctccgtcccaaaataagtgtcttaactttgtactaactttagtacaaagttgaactaagcttgagacacttattttgggacggagggagtactgcatattaacactaagtaccgagtttctacaaccaaggtcatctgataaactagtgtcacccgctaatatcatacaacagaatgggtgacaattctgttccggttatcttgcacgctcctagcagttgatgccacacatttggatatctggcccagtgactcttgtggtgaacgggtcaatgcgaacccacagcaaggagaaaatggatgcaagaaggatggcccagacgacaacgatggtcggcgtgcggttctgccgtcccatgagccccttgaggaatgggtacaagtggataatcacccagaaggcaaagaagagcttcccgaaaagtgggccccatgactgatagccgctgttgatcgcgtaggaggtaccagccacaactccgacaaggttgatgatcaagatagttgttggtgggatcagaagagtcgtccacttgaacatgtagagctcggcaaaatcattatcttcatcggatgcttttgaagtgacagtgaagctggtgtcgataccagcaaggtaccttcagaagaccttggaagacagcaaatagatgtgcagaaatgcctccgatgacccagaactgttcattcctccaccactcgtcgatgccaacaccactccacctcatctcaaggataccagtggcgaagattgaaataaagagagagataaaccatatactggcaatgttgctaatctgtgggatgataaactttcccgtgagaagacaaacagctggtaatatgcagtatatgaggagtggtattgatgtgagtggagtagatagtggtgttgatgtaagcaaatctctccaggaatttaagccgtccgccatagccataccatatgggacaatgcctactgaaaagaatttccaccgaaccaagcgcccaccgaagcacttggtttcagacgatccgaaagattgaggggggcagacccctgaaagcggtcgcttggcatgccagtagattgaccgccagccgcgtgcatgcatcttgaac

SEQ ID NO: 12529 - DNA, 549 bp, Triticum aestivum
  Clone ID: PAT_TA_12529
taggggccttttttttttttttttttgaaaacaccgtccatctttattatttctgaaccaaacaacagacatccagttttattcggactagtaaacatttaagcacacgagacgatattactatgggttcaatataaggtcgtggcaatagcttgtattgctaactagatggaggcatgcatccaggcggtgcaatcgtcaacaccttccattgttcgggagaggtgtttctgcgggtatcagggctgaacacttggtgagcacctgtacaagctgctgcaccgacgaccggtgtaggggtcaccaggcggcactgtaaccgtcggacgattaggatcgagagctccaccaccgatccctgggcgggctccatggcagacggggccgctcatgagcacggcggagatgacgaacaggacgatctggaggagcaccaggaagcgcgcagctctggcgaaggaccccatccgatggagctcgtgtgggctggtttgctagctcgtgtgagtttgctagctcatgagctcgtggagtcgaagcccggccggc

SEQ ID NO: 12530 - DNA, 593 bp, Triticum aestivum
  unsure (1)..(593): unsure at all n locations
  Clone ID: PAT_TA_12530
ctcattcgcatcgccaccttcctccctcccctcctcgccatctccgacccgacttgcggccaatggcggaccagctcaccgacgaccagatcgccgagttcaaggaggctttcagcctcttcgacaaggatggggacggttgcattaccaccaaggagctgggaactgtcatgcgttccctggggcagaatcccactgaggcagagcttcaagacatgatcaatgaggtggatgctgacggcaatggaacaattgatttccccgaattcctcaaccttatggcccgcaagatgaaggacactgattctgaggaagagctcaaggaggcattccgtgtgtttgacaaaggatcaaaatggttttatctctgctgctgaactgcgccatgtcatgaccaaccttggtgagaattgactgatgaggaagttgacgagatggcccgttaggctgatgttgatggtgatggcagtcaactatgacaattgttaaatcatgatggcaagtagttcattacactgagggaactagnatcagacaaatatactatcagtgcatttgggatgcaatgtntaaccaaacataaacgcgttaat

SEQ ID NO: 12531 - DNA, 649 bp, Triticum aestivum
  Clone ID: PAT_TA_12531
gggctgtgcaggaggaggctaagctgtgcccacacctcagagtgcgcgtgctgagagcggggtacagagtacagaccagctgaggatcgagcgggcgggatggacaacgtgagcgacaacgggcgcgagggcgggtgggcgcggctcccggctatctgggcgccggcgcgcgacggcgagcagaggcagcacctgccccgtgccggcgcggcggcggggagggagctggggcggcgcgcggaggacggcgtcggccacggcaacggcaagacggccaaggtgatgcacctgctgctctgggggcccaagtgagacgagatcgaccaggtttcccgccggccagtttaccgcgtgcccgtggcggtggcggagcggccggactgtacactagttgctgcatgctccttcagtttgccgcgttctttcttcacccgcttgttttttaattggccactttgctaatgtgtatgtgaagtttgtactgtacatagcgaaatatatatggatgcgatctgtgtcgttagaccatgtaatgtaagtttggagcagcagatccttgtaacaactttcttcacctgtggttttgtgtgcgatgtggttcattccggttcggaagaaagatgatgcttcctcttttacttggtgaaaa

SEQ ID NO: 12532 - DNA, 1188 bp, Triticum aestivum
  Clone ID: PAT_TA_12532
tttttttttttttttttttttttttttttttttttttttaacccaaattcaataccaatatattctgtttttgaccactttcaatccaagaatacatttcaaaaatacatacaataatattccaaggatttgtacatatattctagcatttaaataataagttcaacaagaaaatatacaccaaattctcagcaagaccaacagtacatccaaattcccagaaaatacggcattacaacaaacatataaagcaagtcgttgtcttggacttccagcttcttcaaaaaaatcagcacataactctcctttgttgctcccagttcagtaaagaaatagtcgagcagtgagcgcttcgcctcatggacttggcagtgcacaatagatttcggaatggagcataaatagaataccatgatttcaaaagcatgggttatgtaatcttttatgccatcctcccaaaatttggctggatgattttgcaactgtagttgtacccagatgtagatctctgtgtatgagttgatgtaggggatgaaatccgagtagtacatcccgccagagagggggccgatggagcgggtgaccctgccatcgaagtcgacagcgagcacgagctattcgagaggatcccacatgaccacctcggggggcgccctgaattcatgaagcgtggtcttcgtctcttgtagtaaattagaagaaatcctacgcagctccagctatccaataacccaaattcaagcaatgccacaacgagcaaaatctacgtgaaaggaactgcctggactgaactccacgtctccacggtctactctcggacggtcggtccctgaccacgattgcgagctgctgctctccgcaactctgtgttcctgcttcgtcgacacgtgcggcgacccggggcggccgggggcagagcaggcagaagcactttgtgctgcggtcgagctggcagaagcgctagaggcaggcctgggtgccctccttgcgctcgtgcacgtagaccgggaagcggcagacgtcgaaggcggtgaggacctcgccgtccatcgttgtgcccagcccgtcggggcagatctggcacacgtccccggccccatgcctcccggacttctgcacacagcaacgagacgggtcaaaaccaaggttccgctgcggggaggaaggggacgggatggagaggagcat

SEQ ID NO: 12533 - DNA, 1942 bp, Triticum aestivum
  Clone ID: PAT_TA_12533
gaattcggcacgagcaccacagtctagtcccggccccctcccctccccactccccccaccgttcttccttcgccggccactccgcgaaatcgaatccagcgagcgcgaatcctgccaaagccggtgttgaggagcagttcgtgtgccctttggtgagtggggcaatggcggcggcagggagactgcggggacggcggcggacaaaggaggtggagcgcgagcccgagccgttcaccatcgaggaggaggtgtcccacctcacccgggtccggtcggagccgtgccccggcacccgcgccgccatccatggcgccaagcggaagagggacgtctcggctttcgagatgctgtcgtcgagggagtccggcctctcgggaggcggcgggttctgttcggccgaccgcgcctacgccgccgggaagcacctcccgtcggaaggaccctggtgcgtggaagacatggatagcgaggcctatgtctcgcagttctccagcgatggctcgatgctcgttgccgggtttcggggaagccgcatcagagtttacgatgtcgatagagggtggaaggttcataagaacataagctgcagaagtatgaggtggacggtttcagatattgcgctctcccctgaccagcgatatcttgcctattccagtttgtcgcctattgttcacattgttaatgtgcagaatgctggaagggaatcggatgctaatgttactgaaattcacgatggtttggaattctgtgatgacgatgaatactctttcgggatattctctgtgaaattttcgaaagatggtagagaagtagttgttgggaacaatgattgttcaatatatgtctatgatcttggagcaaataaagtgtcagaccgtatccgtgctcatacgtctgatgtcaacacggtcacctttgctgatgaaagtggcaatttattgtactctggaagtgatgataatctctgtaaggtctgggataggcgttgccttgtaagagagaaaccagcaggtgttttgacaggtcacttagatgggattacatgtattgatagccgtggtgatgggcgttatctaatctccaactgcaaggatcagactatcaaactttgggacatcagaaagatgtccgccaccgtaaaaggacgacaaccaagattgtatgactgggactacagatggatgtcgttcccgtcacacgctagatattataagcatccaaatgatctatctctggcaacatacaggggtcattcagttctgcggacacttatccgctgctacttctctccaatgcacagcacgggccagaggtacatatacactggatcaagtgacgattcagtgcatatttacgatgtggtaacaggggcgaccgtcaagaagctctcgtggcacggttcgatcatcagagactgcacctggcatccttaccgtccaacgctcgtaagctcttcctgggacggctatctggcccggtgggaggcatcaggcaacaatgaggacccctcggtgctcacgtgcgacgagcagaggactagcccttacgaccagacatacgggctctcttttgccctgtagtaagttgcagaggacctggcgcagtaagcagagccggagcgagctcgtgatgcacccggtgttgggttgtggcagtttatgattgatgtgcttatatggcaatataagcacaagcagtcatgcattgtatatctgaggcaacttgtgctcctcttgctgtcactgatagaaaatagtgatgtaaacaaagatgtagccgttgcttttgtaaatttgtttgcagttgatcaggtggtgtcagtgacaaagtcatatgtaactatacaagtttttttgttgttgttgagagaattgtaactatgtaagttaataatgcatgtgcattctgttgccatacagaagtaaataacgctggtgatact

SEQ ID NO: 12534 - DNA, 829 bp, Triticum aestivum
  Clone ID: PAT_TA_12534
ccacgcgtccgatgctcgcctcaatcatacacagagcttcgttaaagcacccgatattttttcctcgctgctgctgcccatgcgctgctgcttataagagcgaggctgcacaggaggaggccaagctctgcccagacctcagaatgcgcgtgttgagagcggggtacagagtgcagaccagctgaggatcgagcgggtgggatggacaacgtgagcgacaacgggcgcgagggcgggtgggggcggctgccgtctctgtgggcgccggcgcgcgacggcgagcagaggcagcacctgccccgtgccggcgcggcggcggggagggagctggggcggcgcgcggaggacggcgtcggccacggcaacggcaagacggccaaggtgatgcacctgctgctctgggggcccaagtgagatgagatcggccaggtttcccgccggccggcttcccgcgtgcccgtgggcggtggcggaccggccggactgtacactagttgctgcatgctccttcagtttgccgcgttctttcttcaccgcttttgtttgtaatggccagtttgctgctgtgtatgcgaagtttgtactgtacatagcgaaatatatatggatgcgatctgtgtcgttagaccatgtaatgtaagtttggagcagcagatccttgtaacaacagttcattccggttcagaagaaagatgatgctacctcttttacttggttttgtgaacaactttctttaccctgtattattctgtttctccaaatcattaaaggcagttcgtagttttcagcgccagattgtaacttgcaattccttttgaaagacttgttg

SEQ ID NO: 12535 - DNA, 803 bp, Triticum aestivum
  Clone ID: PAT_TA_12535
gcagatcccttctcctccgtctcgcccgcgtgttggggtaggagccatggcggaccagctcaccgacgaccagatcgccgagttcaaggaggccttcagcctcttcgacaaggacggagacggctgcatcaccaccaaggagcttggaactgtgatgcgctcgctggggcagaaccccactgaggcagagcttcaggatatgatcaatgaagtggatgctgatggcaatggaacgattgactttcctgagttcctcaacctgatggcacgtaagatgaaggacactgattccgaggaggagcttaaggaggctttccgtgtgtttgacaaggaccagaatggtttcatctcggcagctgaactccgccatgtcatgaccaaccttggtgagaagctgacagacgaggaggtggatgagatgatccgtgaggctgacgtggatggtgacggccagatcaattacgaagagtttgtgaaggtgatgatggccaagtgagctgccatactaagctagttctctctttttagatgaactaagctagttctctcttgatgttagcagctagtttagccttgaaaactgacagcactcggtactactgttaagtccagtgaatgaacatattgcgcgtgcttccttctcagggatgttgagaatttcgtttggattttcttgcagttgtattacctttgtacaatgtagctttccttccaaattgagatcatgaatttgctctagcttattctttcattgtatcaagttgcatggatgtctgatatttttgtgtgcgtgtgtgttatca

SEQ ID NO: 12536 - DNA, 1063 bp, Triticum aestivum
  unsure (1)..(1063): unsure at all n locations
  Clone ID: PAT_TA_12536
tagcgtggtcgcggccgaggtactaacacaacagtctaaactgatcgaatttggattctccaaatctatatagattcctaggaatttgtcatagaggctgtcaatcaagcaagatgacttaagttttgctcttgaacttcctctgcgccttgaggtctaccacaataaccgtgatgttgtccactgtactttgcaactcctcaatatcctgatacagttcgaatgtcgtgcatggtacaaccagaacacaaggcatattgatagataacaaccacgcttcatcatcttcctcttccaaattgcaagaaacaaatcacctcatggaggagtggaggttggcgaaggcgagggcgtcgtcggggcggccggaggcggcgaggcgacgcttgatggacgaaaagtttcaacatacactcagctccgtgttgaattggaccggccaatccagctcttaaacaggcttgcagatcgacgaacacttggccaatatgtagatctctgtgtatgagttgacgtaggggatgaaatctgactagtacatcccgccggagagggagccgatggagcgggtgaccctgccatcgaagtcgacagcgagcacgggctgttcgagaggatcccacatgaccacctgggcggcgccctgaattcatgaagcttggtcttggtctcctggagtaaattagaagaaatcctacgcagctccagctatccaataatccaatttcaagcaatgccacaaccagcaaaatctacgtgactgcaatgtctccacgtctccacggtctactctcggacggtcggtccctgaccacgattgcgagccgctactttccacaactcggtgttcctgccagggcatngggtgtgttcctgcttcgtcggcacgcgctagtacaaatacacattcagtcagtcatctggtggtggcacactaagtgcatcataagtgcacccagccattgtaatctttctaagtcgatcagagcaatacaaagaaagctaggagtgacacgcccctgtggcatccacaaaatctccatcgtttttcagttcctgagtt

SEQ ID NO: 12537 - DNA, 871 bp, Triticum aestivum
  Clone ID: PAT_TA_12537
ccctccttcctcctctcccccacccgtacggtcaaacaagagaccccccgcccccctctctcctccacctccatctccagcgctcgccgcgagaagccgagaaggaagagcctgagaaggtagcatggcggaccaactcaccgacgaccagatcgccgagttcaaggaagccttcagcctattcgacaaggacggcgacggttgcatcacaaccaaggagctgggaacagttatgcgctcgctggggcagaacccaaccgaggcagagctccaggacatgatcaacgaggtcgatgccgatggcaacggcaccatcgacttcccggagttcctcaacctgatggctcgcaagatgaaggacaccgactcggaggaagagctcaaggaggccttccgggtgttcgacaaggaccagaacggtttcatctcggccgcggagctccgccacgtcatgaccaacctcggcgagaagctaacggatgacgaggtcgacgagatgatccgcgaggctgacgtcgacggggacggccagatcaactacgaggagttcgtcaaggtgatgatggccaagtgatccagccgatgttcatgtccggtggtattattatttttaccggggaggaggaaattgtgctatgcatattagtagtaaggaatgcggctctcgtttccttgtctttgcccccgaaccagaagaagcgtactagtagacgtagttgctcaagagcattcatggaatcctcctcccctgctgctaccctgtctctctcccgtgtgtcatttgaaacatcttctttccgtggtgaatctgcaagacttggcccttcgcgatgaaccctgattgcagttgaatccgtttaaaaaaaaaaaa

SEQ ID NO: 12538 - DNA, 634 bp, Triticum aestivum
  Clone ID: PAT_TA_12538
aaaatgtcattgatctggcagttttcccccccgtgcttgaggtgatgctcctcaattgcattcatccagtttccccgaacaatctggttcgcttcttcgatcgaagtagcctcgggtatggccctctttgcaatcgacaaggttgcagcctcagcctcagctgcagccagccatgataggttcccttcgtcataggcgtggaatgggctcagataatagtcagggtagacgatattggggtctcgtatcctctcgaacacctcgtacacgtcagactccagcaccttcctcgtcatctccctccacgggatgttggacttctccgccgtcctgatgatgacctcgcgggaggcgagcttcatgagggagtagagcggcttaaaggcgatgagcgcggcgacgagccgcgacaccggcgtctccccggaccacgccggccgctccagcgacccctcctgcggcgcggcgccggtcacggcagcgacgacgaccgcatctcgccgacggccgccgcggctggtttcttgatgatgccgcccgaagccgccgctggcggtggtgccggcgcgcccgaggatggctgccattttaggccgctctgctggaaatgctgtggtgattttctccgccgtcg

SEQ ID NO: 12539 - DNA, 455 bp, Triticum aestivum
  Clone ID: PAT_TA_12539
gaattcactagtgattagcgtggtcgcggccgaggtttttttttttagaaacaccgtctatctttatttctgaaccgaacaacagacatccacttttattcggagtagtaaacatctaagtacacgagacgatattactctgggttcaacataaggtcgtggcagtaacttgtactgctataactagatgaaagcatccaggcggtgcaatccttccattgttcgggagaggtgtttgtgcgggtatcagggctgaacacctggtgggcacctattcaagctgccgcaccgacggggtgtagggggcaccaggcgggactgtaactgttggccggttagggtcgagagctccaccactgatccctgggcggggctccatggcaaacgggggccgctcatgaacaccgggggggatgaccaacaaaacgattctggaggagcacaaaggaaaacgc

SEQ ID NO: 12540 - DNA, 733 bp, Triticum aestivum
  Clone ID: PAT_TA_12540
ttctctcgacacctctttggacaaacttaagcccagctagccagcgtgaagcaaaagaaaatcacactacttaatctaagatacaaaaatctattttaacacaacagttctccatttccagaagtttaccgaaatggcgaccaaattataacaaaacgagtaaaatcatagcatgaattcctcactactgtgcagcaaggcaccccatttattacaccaagaccacacattgctcacacgagattagagaaagataaaagcaaagaagtaacacttgcggtagagaaacggggagaaatgatgatgccttctaccactacagcttgtacttgtagcgcgcgacctcggattcgttggggaagaaccccatgaggcgtccggcggagttctggtaggcgtacatgaaccctccgaggaccccgatgaggccccccgtcaccatcgacggcccgcggatccccggcttgatcccggagaggtagccgacggtgacggagacggcggagatggtggagaggcgcatgtagtcgagcgcggagaagttgccgacgaccttggtgaaggcggggttccgatccaccaccgggtactccggcttcactgacgcggtgatgtcggtgttcatcgcgcagccgcggggctcgattcgctccttccggcgggcggcgcggcggcagatttggtcgctgggaggaggaggaggtcgagattcaacctcggccgcgaccacgct

SEQ ID NO: 12541 - DNA, 641 bp, Triticum aestivum
  unsure (1)..(641): unsure at all n locations
  Clone ID: PAT_TA_12541
ttttttttttttaatacaaaagttccccattccataagtttaccaaaatggcgaccaaattatgaccaggtcataacaaaacgagtaaaaccatagcatgaattcctcactactgtgcagcaaggcaccccatttattacaccaagaccacacattgctcacacgagattagagaaagataaaagcaaagatgtaacatttgcggtagagagacgaggagaaatggcgcctcctaccactacagcttgtacttgtagcgcgcgacctcggattcgttggggaagaaccccatgaggcgtccggcggagttctggtaggcgtacatgaaccctcccaggaccccgatgaggccccccgtcaccatcgacggccccgcggatccccgggcttgatcccggagaggtagccgacggtgacggagacggcggagatggtggagaggcgcatgtagtcgagcgcggagaagttgccgacgaccttggtgaaggcagggttccgatccaccaccgggtactccggcttcactgacgcggtgatgtcggtgttcatcgcgggctcgattcgttccttccggcgggcggcgcggcggcagatttggtcgctgggaggaggaggtcgagacctcgtgccgaattncctgc

SEQ ID NO: 12542 - DNA, 668 bp, Triticum aestivum
  Clone ID: PAT_TA_12542
ttttttttttttaacacaacagtttccaattccggaattcaccgaaatggcgaacaaattttgactctgtcataacaaaacgagtaaaatcattatcatgaattcctcactactgtgcagcaaggcaccccatttattacaccaagaccacacattgcccacaccaagtgcagctcacgccaagtgagattagaaaggtaaaagcaaagatgtaacacttgcggttgagaaacggggagaaatgatgatgccgtctaccactacagcttgtacttgtagcgcgcgacctcggattcgttggggaagaaccccatgaggcgtccggcggagttctggtaggcgtacatgaaccctccgaggaccccgatgaggccccccgtcaccatcgacggcccgcggatccccggcttgatcccggagaggtagccgacggtgacggagacggcggagatggtggagaggcgcatgtagtcgagcgcggagaagttgccgacgaccttggtgaaggcggggttccgatccaccaccgggtactccggcttcactgacgcggtgatgtcggtgttcatcgcgcaaccgcggggctcgattcgttccttccggcgggcggcgcggcggcagatttggtcgctgggaggaggaggtcgagattcaggcctcgtccgaat

SEQ ID NO: 12543 - DNA, 782 bp, Triticum aestivum
  unsure (1)..(782): unsure at all n locations
  Clone ID: PAT_TA_12543
ctcgtgccgaattcggcacgaggctccgggcctctctctgtttgctctcgcgtccgccgcgcccgtcccgtcccgcctgcgcccgcgcgtgtgctcgctcgccgcctccgatccaccggcccaccaccgcgccggcggcatggcggatcagctcaccgacgaccagatcgccgagttcaaggaggccttcagcctcttcgacaaggacggagatggttgcatcaccaccaaggagctgggaacagtcatgcgttcgctggggcagaacccaacggaggctgagctccaaggacatgatcaatgaagtcgacgcctgatggggaacggcaccattgacttcccaagagttcctcaacctgatgggccgcaagatgaaggacactgactcaaaggagggagctcaaaggaggcctttcagggtgtttgacaaaggaccaaaaacgggttcatctctgctgctgagctccgccacgtcatgacgaacctcggcgaagaagctcaccgacgaggaggtggacgagatgatccgtgaagccgacgtcgacggtgatggccagatcaactacgaggattcgtcaaggcatgatggccaaatgacaccgtgctccgtgctcccaagcaggaggagaatggtgcattgcatattaatttaagatgcaacccttattgattcatttccaatttaacatcctacctactgtagctgctaaagggttnngacnaccattnctggctagttccccagtgtgtttccaaactccctgggttttaaaaaaaaaaaa

SEQ ID NO: 12544 - DNA, 841 bp, Triticum aestivum
  Clone ID: PAT_TA_12544
cttcctcctctcctctgcccgtacggtcaaacaagagacccccatccccctctctcctccacctccagcgctcgccgcgagaagccgagaaggaagagcctgagaaggtagcatggcggaccaactcaccgacgaccagatcgccgagttcaaggaagccttcagcctattcgataaggacggcgacggttgcatcacaaccaaggagctgggaacagtgatgcgttcgctgggacagaacccaacggaggcagagctccaggacatgatcaacgaggtggacgcggacggcaacggcaccatcgacttcccggagttcctcaacctgatggctcgcaagatgaaggacacggactcggaggaagagctcaaggaggccttccgggtgttcgacaaggaccagaacggcttcatctcggccgcggagctccgccacgtcatgaccaaccttggcgagaagctaacagacgaggaggtcgacgagatgatccgcgaggccgatgtcgatggcgacggccagatcaactacgaggagttcgttaaggtcatgatggccaagtgatcccgccgatgtcccggtggacggtggtattattattttaccggggaggaggaaattgtgctatgcatattagtagtaaggaatgcggctctcgtttccttgtctttgccccaaaccagaagaagcgtactagtagacgtagttgctgaagagcattcatggaatcctcctcccctgctgctaccttgtctctctcccgtgtgtcattgaaacatctttctttctgtgtgaatctgcaagacttggccccttcgttatgaaaaaaaaaaaaaaaaaaaa

SEQ ID NO: 12545 - DNA, 826 bp, Triticum aestivum
  Clone ID: PAT_TA_12545
tttttttttttggagcacaatctcatctcttttcattacttgattgacttgagaaaatgaacactaggcattaataagcaaaagcaatcaaaatccgaccacagcagcaagtactaattatactttgtaattcctcaatatcctggtacagttggtacgtcgtgcatggtacacgcgcacggtggaaacgggtcgaactaaacaaaatcagtgaattcaagcggtgagctcctcctccttgtgggtctcgatgacgaggtccgaggtggggtacgcggcgcaggtgagcacccaccccgcctcgatctggtcgtcgtcgaggaagctctggtcggactggtccagctggccggagaccaccttcccggcgcaggaggagcaggagccggcgcggcaggagtagggcaggtcgatcccttcctcctcggcgtggtcgaggatgtagacgtcgtcggggacctcgaggtccacctcgccctccggcgtgatcagcttcaccttgtacgtcgcctgcgcgcggagcctcatgcccctggcggccgtcgacgacagcgggagcgcgacgcgggatgccgccatgggcgccgcaggggcggcggggcagatggagaagggcaagcggaggctgctcagtacggtggccatcgcggcggagcggcgagctagcttgggaggtactactccgtagacagatagctcgacgagacacgagaggatcgaggcggggtgggtgctcacctgcgccgcgtaccccacctcggacctcgtcatcgagacccacaaggaggaggagcccacagcagcaagtactaattatactttgtaa

SEQ ID NO: 12546 - DNA, 1693 bp, Triticum aestivum
  Clone ID: PAT_TA_12546
gcggccgcccgggcaggtacacgcgcacggtggaaacgggtcgaactaaacaaatcagtgaattcaagcggtgagctcctcctccttgtgggtctcgatgacgaggtccgaggtggggtacatcgcatttctgtagttaagttgcaggatcattttcttcctgaatgcaaatggctcccaagttactaacttttgtgactgttcacaacacaaaattgtgcattggtgaaccatggtgatgcagtcagtagggcacagtggcagtgaccgttctatgcctggggtctgtcagcacggagcacacattgacgaagcctgcttggcccagcgcctcctccagatccagcatgtagtactcgtccaggaacggttcggtgctcttcataagagtgaacagaacgggtgataattcctggagtacttttgattttggtgagttgtcggttaaggcgatggttcctcctggacgaagcagtctgaatgcttccttcgccaatccgattattgctcgtgctggacactcgtggcacacataagcaagggagacgacgtcaaatgaattcggtggcaacccagtcgcttcaccatttgcatgaacccaacgaatagggttttgccgagacagttgttcttccttctgtgctgccacggccaggaagtagggcgatagatctagtccaacagccttagccgaaggaaacctttcagccaggtatctggtgctcactccaacagagcagccaatgtccaaaatgtcattgatctggcagttttcccccgagtacttgaggtgatgctcctcaattgcattcatccagtttccccgaacaatcttgttcgcttcttcgatcgaagtagcctcgggtatggccctctttgcaatggacaaggttgcagcctcagcctcagctgcagccagccacgataggttcccttcgtcataggcgtggaatgggctcagataatagtcggggtagacgatgttggggtctcttatcctctcgaacacctcgtacgtttggtgcagatatgcttatagagttcttggagaaaaatgatcttgatcttatctgccgagcccatcaggtggtagaagatggttatgagttcttcgcacagcggagattagtcaccatcttctcagctccaaattactgcggggaattcgataatgtaggtgctctgttgagcatagatgaaaatctaatgtgctcatttcaaatcttgaagccaaatgaaacaggcacatcgcgggtaaaaagacaaattccaaataagccagcaaccgggggaagtgcctgatctgatcaacatccattccttcaatattagcatcgtcggctcgaagggggtgatctgatctattgtttggatccaccagggcatggcaatattcatccaccagccaattgtcttgcttaaccacccttagttgccgagcatttgtaaatgtccattggctctgcactcgttttctctgtacagaattaggccggatttaacagcaccacctattctggttgttcttcctggttgcgcggcatctgtttttgtaagttacttttgtggtacatttttgcctgtggatgttgatagcttctgtttgtgagcatctattatttgccttatgtttgtgacgtgacgtcttgccaacttgttctacacttgtacttatctactactaaaaaaaaaa

SEQ ID NO: 12547 - DNA, 970 bp, Triticum aestivum
  Clone ID: PAT_TA_12547
cggcacgagggcgcgcataaagcccggcaaaattccccgacgcgaggccacaaatcgctcccggccccctccttcctcctctcccccgcccgtacggtcaaacaagagaccccccgcccccctctctcctccacctccaccttcagcgctcgccgcgagaagccgagaggagcctgagaaggtagcatcatggcggaccaactcaccgacgaccagatcgccgagttcaaggaagccttcagcctattcgacaaggacggcgacggttgcatcacaaccaaggagctgggaacagttatgcgttcgctggggcagaacccaaccgaggcagagctccaggacatgatcaacgaggtcgatgccgatggcaacggcaccatcgacttcccagagttcctcaacctgatggcccgcaaggatgaaggacaccgactcggaggaagagctcaaggaggccttccgggtgttcgacaaggaccagaacggcttcatctcggctgcagagctccgccacgtcatgaccaacctcggggagaagctaacggacgatgaggtcgacgagatgatccgcgaggccgacgtcgacggggacggccagatcaactacgaggagttcgtcaaggtgatgatggccaagtgatccagccgatgttcatgtccggtggtattattatttttaccggggaggaggaaattgtgcattgcatattagtagtaaggaatgcggctctcgtttccttgtctttgccccgaaccagaagaagcgtactagtagacgtagttgctgaagagcactcatggaatcctcctcccctgctgctaccctgtctctctcccgtgtgtcattgaaacatctttctttctgtgtgaatctgcaagacttggccccttaaaaaaaaaaaaaaaaaaaaaaaaaaaaattaactaaaaaaaaaaaaacaacaaaaaaaaaaagcaaaaagtaataaaa

SEQ ID NO: 12548 - DNA, 824 bp, Triticum aestivum
  Clone ID: PAT_TA_12548
cctgccccccgcgacacagatgcacccagtcgcgcactgagaccccccccacgtcatcatcgccccatcaacgcgcagctcgcgtaacatttgcaggtcctcgtcgccccttcgaggtttcggtttgccatggcggaccagctgagcgaggagcagattggcgagttcaaggaggccttcagcctcttcgacaaggacggcgatggcagcatcaccaccaaggagcttggaaccgtgatgcgctccctcggccagaaccctaccgaggcggagctgcaggacatgatcaacgaggtggatgcggacggcaacggcaccatcgacttcccagagttcctgaacctgatggcccgcaagatgaaggacacggactccgaggaggagctcaaggaggcgttccgcgtgtttgacaaggaccagaacggtttcatctccgcggcggagctccgccaggtgatgaccaacctcggggagaagctgtctgaggaggaggtggaggagatggtccgcgaggccgatgtggacggcgatggccagatcaactacgacgagttcgtcaaggtcatgatggccaagtgaggaacaacccccctctgaaataacccttttctattttcgccgaataatgaaccacctggcttcgtaacaacaatttttaccctattattacgtgcacgctgctggtactgacacttgttggctaggtgtagtcactgaggggagaagggccagatactattttttttgttctcttggccacggacttctcctgtactactttgctggatttggtgttttttcttggttgggttgcttcttggttc

SEQ ID NO: 12549 - DNA, 868 bp, Triticum aestivum
  Clone ID: PAT_TA_12549
aaaaaaaaaaaaaaaaaaaaaaaaaaaaaaaaaaaaaaaaaaaaaaaaaaaaaaaaaaaaaaaaaaaaaaaaaaaaaaaaaaattcgcatcgccaccttcctccctcccctcctcgccatctccgacccgacttgcggccaatggcggaccagctcaccgacgaccagatcgccgagttcaaggaggctttcagcctcttcgacaaggatggggacggttgcattaccaccaaggagctgggaactgtcatgcgttccctggggcagaatcccactgaggcagagcttcaagacatgatcaatgaggtggatgctgacggcaatggaacaattgatttccccgaattcctcaaccttatggcccgcaagatgaaggacactgattctgaggaagagctcaaggaggcattccgtgtgtttgacaaggatcaaaatggttttatctctgctgctgaactgcgccatgtcatgaccaaccttggtgagaagttgactgatgaggaggttgacgagatggtccgtgaggctgatgttgatggtgatggccagatcaactatgacgaatttgttaaagtcatgatggccaagtaagttgcattaccatctgagggaagcttcagtaatcagaccaaaatattacctatccaggtgccattttgtgggatggctattgtattaaaccgaaaacgataacactgctgtgtcatatgttgtaggcaatgattgtttgccttgaagattttatagatcctgctctggtctttctgattttgtctgttccgtttttttatgtttggttcgtttcaacttttcaagcgtgtagccacaacgtgttaatgaataactatatgtcagtgttccatgattt

SEQ ID NO: 12550 - DNA, 893 bp, Triticum aestivum
  unsure (1)..(893): unsure at all n locations
  Clone ID: PAT_TA_12550
ttagtggcaatgttgaagggatggtcgccttttgtatacccattggaaaggggattttcaagcattaagtgggacgccaggtttccaagtagagttgtaaagcggcccaggtattgtaatcgactccatagggggaatgggtccggcccccccttcagtttttttttttttttgacatgaggccattttcatctccttttatacttgattgacttgagaaaattaacactaggcattaataagcaaaagcaatcaaaatccgaccacaacagcaagtactaattacgtactgtactttgcaactcctcaatatcctgatacagttcgaatgtcgtgcatggtacacgcgcacggtggaaacgggtcgaactaaacaaatcagtgaattcaagcggtgagctcctcctccttgtgggtctcgatgacgaggtccgaggtggggtacgcggcgcaggtgagcacccaccccgcctcgatctggtcgtcgtcgaggaagctctggtcggactggtccagctggccggagaccaccttcccggcgcaggaggagcaggagccggcgcggcaggagtagggcaggtcgatcccttcctcctcggcgtggtcgaggatgtagacgtcgtcggggacctcgaggtccacctcgccctccggcgtgatcagtttcaccttgtacgtcgcctgcgcgcggagcctcatgcccctggcggccgtcgacgacggcgggagcgcgacgcgggatgccgccatgggcgccgaaggggcggcggggcagacggagaagggcaagcggaggctgctcaatacggtggccattgcggcggagttccgagctagcttgggaagtactactccgtaggcggatactcggtggaggagcccacgcgnccaga

SEQ ID NO: 12551 - DNA, 1158 bp, Triticum aestivum
  unsure (1)..(1158): unsure at all n locations
  Clone ID: PAT_TA_12551
gaattcactagtgattagcgtggtcgcggccgaggtttttttttttttttttttttttcaccatgaggttggacctcatgtatagaaactcctccaaaatgtgaaggacaggaataatttatataaataataaatacaagaattcataggtccattcctacgatacaaagtgcctcataggaaaattcctataggtttacaatccaatgagattcctttgttccaaaaaaagatcttaacctcatgaaaacggtagatggtctattacatctatttacaaatgtgttttctcaattttgacaactttctcaaacatagtaattcgcaaccccagcataaatattctctggctccacaggtggtcgctcgatcactgttatattttctgtctctacaaactcccactttcctagcagttgatgccacaggtttggatatttgggccagcgagacgggtagtgaatggatcaacacgaacccacagcaaggagaagatagaagcgaggaggacagcccagacgatgacaatcgtcggtgtgcggttttgcctgcccataagacccttgaggaatgggtataagtgaacaatcacccagaaggcaaagaagagcttcccaaagagcggcccccatgattggtaaccactgttgatggcgtaggaggtaccagcaacgacaccgaccatgttaatgatcaaaatggtcgtcggagggatgagaagcgtcgtccacttgaacatgtagagctcagcaaagtcgccttcttcgtcattagcctttgaggtgacagtgaagttggtgtcgataccggcaagcaccttcaggagaccctgaaagacggcaaatagatgtgcagaaatgcctccgatgacccagaactgttcattcctccaccactcgtcgatgccaacaccactccacctcatctcaaggataccagtggcgaagatcgaaataaagagagagataaaccaaatactggcaatgttgctaatctgtgggatgatgaactttcccgtgagaagacaaacagctggtaatatgcagtatatgaggagcggtattgatgtgagtgggtagatagtggtgttgatgtaagcaaatctctccaggaatttaagccgtccgccnnngccaacctgcccgggcggccgctcga

SEQ ID NO: 12552 - DNA, 1145 bp, Triticum aestivum
  Clone ID: PAT_TA_12552
gaattcactaagtgattagcgtggtcgcggccgaggtctcattcgcatcgccaccttcctccctcctcccctcgccatctccgacccgacttgcggccaatggcggaccagctcaccgacgaccagatcgccgaattcaaggaggctttcagcctcttcgacaaggatggggacggttgcattaccaccaaggagctgggaactgtcatgcgttccctggggcagaatcccactgaggcagagcttcaagacatgatcaatgaggtggatgctgacggcaatggaacaattgatttccctgaattcctcaaccttatggcccgcaagatgaaggacactgattctgaggaagaactcaaggaggcattccgtgtgtttgacaaggatcaaaatggttttatctctgctgctgaactgcgccatgtcatgaccaaccttggtgagaagttgactgatgaggaggttgacgagatggtccgtgaggctgatgttgatggtgatggccagatcaactatgatgaatttgttaaagtcatgatggccaagtaagttgcattaccacttgagggaagcttcagtaatcaggccaaaatattacctatccaggtgccattttgtgagatggctatcgtattaaaccgaaaacaatataacactgtgctgtgtcatactccctccgttccaaaatatagtgcgcccgcgcttccggaggtccaactttgaccataaatttaaccaatgagaccaactgcggcgggagaaaaaattatataattgaaaacttctttcgaatacgaattcactgatataatttttgcttccgccgcaatcggtcttggtagttaaatttacggtcaaagttgaagcacgtggatagaggaagcactacattatggaatggagggagtatgttgtaggcaatgattgtttgccttgaagattttatagatcctgctctggtctttctgattgtgtctgttccttttttttatgtttggttcgtttcaacttttcaagagtgtagccacaatgtgttaatgaataactatatgtcagtgttccatgattgcattgctagctcaaaaaaaaaaaaaaaaaaaaaaaaaaacctgcccgggcggccgctcgaaatcactagtgaattc

SEQ ID NO: 12553 - DNA, 1608 bp, Triticum aestivum
  Clone ID: PAT_TA_12553
aggtaggaaggtttgccacctgaattccatagtatcagagaaggcagtacaaaatagtttataccactagttcctgttgtaccctacaggctcaaatatacatttccagatacatgatggcccagcttaagaaaaagaataaggggcagcaaaggaagaagaacagaaaacaggatcacccacgccatcaggaaacataaaccctgatgcggaatttcgtaatctgtactgtatacaggaatacagcccttggcagcccaaatgttgaaaaggaagaaaagaacgaactgggctaagtaatgtactaacacaacagtctaaactgatcgaatttggattctccaaatctatatagattcctaggaatttgtcatagaggctgtccatcaagcaagatgacttaagttttgctcttgaacttcctctgcgccttgaggtctaccacaataaccgtgatgttgtccttgctccccttctggagagcaagcttcgacaagcattcagcagctgcttgagccgctggatctggggagtcaccgctacgttgggccgatgataagtttaccccgttctttttatgccataagagtattcgcttgcgggcaacatcgcatacctcttcattcgacagtacatcccagaggccatcactggcaagaataaggcactcatcatccttcgcccgaggaacaattgtgacctctgggacaggaattatccatggtttcagaatatctgtcaccaattgatcgcgacatggcaaggacaccgaaaactcggtagccattccactgtatgaccttgccaccctctgcctcaatccttgcgtactcatcctccctattaggtttatgatccaccgacagaggcacaggctgcttgcctcggcagagcactgcccgtgaatctccacagttggaggacaatgatatgtgaggagcagatgacagcgacgaccgccgtcgaacccaccgtctcaggtgctacaggatctgcaatggccattgcagtgacactgcttgtgcccacgtttccccctcctcccctggtcgccttaccagctatctcatcatccacccttgagaagcaatccacaaacgccttttcccactgcttcttaaactccacagctcccaggttagcaccagacacggacccttctatcctgctcagctcctccaccagcgctgcgtggagcagataaaagacagtaatctgctacctgtgcaccgccgtggccatcgtatacaccaaaaaagtgtgcggggaggcggaaggagatgggatcgagtccatcgaccatattgttgcccgtgagcatccagaggggcaggccgaagaatcgcggcacagcgacgaccgcatcctccatctccgggcggcggccgcaaattgatgtaaacccccagagcggaacgcattcgacagcgaagacgctcctccccccggccgcgaccctcgcctccgcctcgacggtggccgcagaagccgccgagtcctcgaacaccaccgcgcccccctcgacccccgcaccgaagaagcccagacccaccccctcgaaatccgcgcttgccacgctgctgcagtcgctggtgaccgagcacgggc

SEQ ID NO: 12554 - DNA, 877 bp, Triticum aestivum
  Clone ID: PAT_TA_12554
gccggccggttcggagtcgcgcactgagacccccacgccatcatcgcccatcaacgcgcagctcgcgtaacatttgcaggccctcgtcgccccttggaggtttcggtttgccatggcggaccagctcagcgaggagcagattggcgagttcaaggaggccttcagcctcttcgacaaggacggcgatggtagcatcaccaccaaggagcttggaaccgtgatgcgctccctcggccagaaccctaccgaggcggagctgcaggacatgatcaacgaggtggatgcggacggcaatggcaccatcgacttcccagagttcctgaacctgatggcccgcaagatgaaggacaccgactctgaggaggagctcaaggaggcgttccgcgtgtttgacaaggaccagaacggtttcatctctgcagcggagctccgccaggtgatgaccaacctcggggagaagctgtcggaggaggaggtggaggagatggtccgcgaggcccgatgtggacggcgatggccagatcaactacgacgagttcgtcaaggtcatgatggccaagtgaggaaccaccccctctgaaataaccctttctatttccgccgaataacgaaccgtctggcaccactacttcataacaatttttaccttattattacgtgcacgctgctggtactgacacttgttggctaggtgtagtcactgaggggagaagaggccagatgttattttttttcttctcttggtcacggacttctcctgtactcgctggatttggtgtttttcttggttgggttgcttcttgcttcatgcttgtcgttcggtttgttgatgaaagttatacactaattttgcgccacacgtgcgttccatctcgct

SEQ ID NO: 12555 - DNA, 922 bp, Triticum aestivum
  Clone ID: PAT_TA_12555
gggctgcaggaattcggcacgagccgcgccccgtttattattccccttcccgcagccgccccccgtgtcccgcgcgcaccttctcgaagcctcctccctccctcccccatggcggaccagctcaccgacgagcagatcgccgagttcaaggaggccttcagcctcttcgacaaggatggcgacggttgcatcaccaccaaggagctcggaaccgtgatgcggtcccttgggcagaaccccacggaggcggagctgcaggacatgatcaacgaggttgacgcggacggcaacggcaccatcgacttccccgagttcctgaacctgatggcgaggaagatgaaggacacggactcggaggaggagctcaaggaggcgttccgcgtgtttgacaaggaccagaacggcttcatctcggcggcggagctgcgccacgtgatgaccaacctcggggagaagctgacggacgaggaggtggacgagatgatccgggaggcggacgtggacggcgacggccagatcaactacgaggagttcgtcaaggtcatgatggccaagtgaggtggcgaggacaggggtccctcccacgaaataagcttgaaatttgctctcaagtggattggaatggaatgccagacagactcgcaaagttgtattttgtgctatgcgcctgtttttttaagtactgttgcctgttgggtagttggtcgggttatcttgtagcggtgtagtcgtggggagcagcatcggaattacctggtttcttttggttgtggcacttatcttgcctgttaggcttcgtcttatcatggaatttaggggctttgtgcaaatcttggtttccgccctgcattttaaatgtctgcttggtttgtgttagccggaagtacattgtatggatttcatttggcatgcttggtttctg

SEQ ID NO: 12556 - DNA, 823 bp, Triticum aestivum
  Clone ID: PAT_TA_12556
ccggctcgacgggggtatccggtcacctaaatattttcctccctgtcgccctccctccttcctttcctccactcgcgcttcgctctcagatcccttctcctccgtctcgcccgcgtgttggggtaggagccatggcggaccagctcaccgacgaccagatcgccgagttcaaggaggccttcagcctcttcgacaaggacggagacggctgcatcaccaccaaggagcttggaactgtgatgcgctcgctggggcagaaccccactgaggcagagcttcaggatatgatcaatgaagtggatgctgatggcaatggaacgattgactttcctgagttcctcaacctgatggcgcgtaagatgaaggacactgattccgaggaggagcttaaggaggctttccgcgtgtttgacaaggaccagaatggtttcatctcggcagctgaactccgccatgtcatgaccaaccttggtgagaagctgacagacgaggaggtggatgagatgatccgtgaggctgatgtcgatggtgacggccagatcaattacgaagagtttgtgaaggtgatgatggccaagtgagctgtcatactaagctagttctatctcgatgttagcagctagtctagccttgaaaactgacagcagttggtactactgttaagtccagtgaatgaacatattgtgcgctcagggatgttgagaatttcgtttggattttcttgcagttgtgtttcctttgtacaatgtagctttctttccaaattgagatcatgaatttgctgtagtttatgcctttctggtatcaagttgcagttgcatgg

SEQ ID NO: 12557 - DNA, 852 bp, Triticum aestivum
  Clone ID: PAT_TA_12557
caaaggttgcccctatccgtatccggtcgcctaaatattttcctccctgtcgccctccctttcctccactcgcgcttcgctctcagatcccttctcctccgtctcgcccgcgtgttgggataggagccatggcggaccagctcaccgacgaccagatcgccgagttcaaggaggccttcagcctcttcgacaaggatggagacggctgcatcaccaccaaggaacttggaactgtgatgcgctcgctggggcagaaccccactgaggcagagcttcaggatatgatcaatgaagtggatgctgatggcaatggaacgattgactttcctgagttccttaacctgatggcacgtaagatgaaagacaccgactccgaggaggagcttaaggaggctttccgtgtgtttgacaaggaccagaatggtttcatctcggcagctgaactccgccatgtcatgaccaaccttggtgagaagctgacagacgaggaggtggatgagatgatccgtgaggctgatgtcgatggtgatggccagatcaattacgaagagtttgtgaaggtgatgatggccaagtgagctgccatactaagctagttctatctcgatgttagcagctagtttagccttgaaaactgacagcacttggtactactgttaagtccagtgaatgaacatattgctcgctcttcctttcttctcagggatgttgagaatttcgtttggattttcctgcagttgtattacctttgtacaatgtagctttctttccaaattgagatcatgaatttgctgtagcttatgccttcatggtatcaagttgcatggatgtctgaaaaaaaaaaaaaaaaaa

SEQ ID NO: 12558 - DNA, 953 bp, Triticum aestivum
  Clone ID: PAT_TA_12558
gcccaagttgacgaccgaacaggggaagtcttctcctacccacaagaacactcattcgcatcgccaccttcctccctccccccctcgccatctccgacccgacttgcggccaatggcggaccagctcaccgacgaccagatcgccgagttcaaggaggctttcagcctcttcgacaaggatggggacggttgcattaccaccaaggagctgggaactgtcatgcgttccctggggcagaatcccactgaggcagagcttcaagacatgatcaatgaggtggatgctgacggcaatggaacaattgatttccctgaattcctcaaccttatggcccgcaagatgaaggacactgattctgaggaagagctcaaggaggcattccgtgtgtttgacaaggatcaaaatggttttatctctgctgctgaactgcgccatgtcatgaccaaccttggtgagaagttgactgatgaggaggttgacgagatggtccgtgaggctgatgttgatggtgatggccagatcaactatgacgaatttgttaaagtcatgatggccaagtaagttgcattaccatctgagggaagcttgagtaatcagaccacaatattacctatccaggtgccattttgtgggatggctattgtattaaaccgaaaacaatataacactgtgctgtgtcatatgttgtaggcaatgattgtttgccttgaagattttatagatcctgctctggtctttctgattttgtctgttccgtttttttatgtttggttcgtcaacttttcaagagtgtagccacaatctgttaatgaataactatatgtcagtgttccatgattacccctcagtcattgaagtgttatactgtatgtgtgtctgatacagacatagcttgcatatttttttggtaactatataaatgaatatttctggtaatggaagtgcggtatca

SEQ ID NO: 12559 - DNA, 883 bp, Triticum aestivum
  Clone ID: PAT_TA_12559
gcccccgcgacacagatgcacccagtcgcgcactgaaaccccccacgccatcatcgccccatcaacgcgcagctcgcgtaacatttgcaggccctcatcgtcccctcgaggtctccgtttgccatggcggaccagctcagcgaggagcagattggcgagttcaaggaggccttcagcctcttcgacaaggacggcgatggcagcatcaccaccaaggagcttggaaccgtgatgcgctcccttggccagaacccgaccgaggcagagctgcaggacatgatcaacgaggtggatgcggacggcaacggcaccatcgacttcccagagttcctgaacctgatggcccgcaagatgaaggacaccgactcagaggaggagctcaaggaggcgttccgtgtgttcgacaaggaccagaacggtttcatctctgcagcggagctccgccaggtgatgaccaacctcggggagaagctttccgaggaggaggtggaggagatggtccgcgaggccgacgtggatggcgacggccagatcaactacgacgagttcgtcaaggtcatgatggccaagtgaggaacaaccaccctctgaaataaccctttctattttcgtcgaataacgaaccgtctggcactactacttcataacaatttttaccttattattattacgtgcacgctgctggtactgacacttgttggctaggtgtagtcactgaggggagaagggccagatactattttttttgttctcttggtcacggacttctcctgtactttgctggatttggtgtttttcttggctgggttgcatcttggttcatgcttgttcggtttgttgaaagttatacactaattttgcgccaaaaaaaaaaaaaaaaaaa

SEQ ID NO: 12560 - DNA, 869 bp, Triticum aestivum
  Clone ID: PAT_TA_12560
aggaacccaaccaccgcgccccgtttattcccctccggcgcagccgcccccgtgtcctgtgcgcaccttctcgaagcctcctccctccctcatggcggaccagctgaccgacgagcagatcgccgagttcaaggaggccttcagcctcttcgacaaggatggcgacggttgcatcaccaccaaggagctcggaaccgtgatgcggtccctcgggcagaaccccacggaggcggagctgcaggacatgatcaacgaggttgacgcggacggcaacggcaccatcgacttcccggagttcctgaacctgatggcgaggaagatgaaggacactgactcggaggaggagctcaaggaggcgttccgcgtgtttgacaaggaccagaacggcttcatctcggcggcggagctgcgccacgtgatgaccaacctcggggagaagctgacggacgaggaggtggacgagatgatccgggaggcggacgtggacggcgacggccagatcaactacgaggagttcgtcaaggtcatgatggccaagtgaggtggcgggacagggggtgtcctcccacgaaataagcttaaaatttgctctcaagtggattggaatggaatgccagacagactcgcaaggttgtattttgtgctatgtttttttaagtactgttgcctgttgggtagctggtcgggttatcttgtagcggtgtagtcgtggggagcagcatcggatttacctggtttctagtcttatcatggaatttaggggctttgtgcaaatctcggttttgccctgcggtttgcttgtatgcttgggttgtgttcagctccaaaatgctggccggaagtacattttgtggattccattaaaaaaa

SEQ ID NO: 12561 - DNA, 849 bp, Triticum aestivum
  Clone ID: PAT_TA_12561
cggcacgagaccgcgccccgtttattattccccttcgcgcagccgcccccgtgtctcccgtgcgcaccttctcgaagcctcccccatggcggaccagctcaccgacgagcagatcgccgagttcaaggaggccttcagcctcttcgacaaggatggcgacggttgcatcaccaccaaggagcttggaaccgtgatgcggtccctcgggcagaaccccacggaggcggagctgcaggacatgatcaacgaggttgacgcggacggcaacggcaccatcgacttccccgagttcctgaacctgatggcgaggaagatgaaggacacggactcggaggaggagctcaaggaggcgttccgcgtgttcgacaaggaccagaacggcttcatctcggcggcggagctgcgccacgtgatgaccaacctcggggagaagctgacggacgaggaggtggacgagatgatccgggaggcggacgtggacggcgacggccagatcaactacgaggagttcgtcaaggtcatgatggccaagtgaggtggcggcgggacaggggtcttccctcccacgaaataagcttaaaattcaagtggattggaatgccagacagactcgcgtggttgtattttgtgctatgttttttaaggatactgttgcctgttgggtagttggtcgggttatctatcttgtagcggtgtagtcttgggggagcagcatcggaattactacctggtttcttttggttgtggcacttatcttgttcgtcttatcatggaatttaggggcgttgtgcaaatctcggtttttgcgctgcagtttgcgtgtctgcttggtttgtgttcagctccaaa

SEQ ID NO: 12562 - DNA, 1579 bp, Triticum aestivum
  Clone ID: PAT_TA_12562
cccacgcgtccgcccacgcgtccggacctcagaatgcgcgtgttgagagcggggtacagagtgcagaccagctgaggatcgagcgggtgggatggacaacgtgagcgacaacgggcgcgagggcgggtgggggcggctgccgtctctgtgggcgccggcgcgcgacggcgagcagaggcagcacctccgatccaccggcccaccaccgcgccggcggcatggcggatcagctcaccgacgaccagatcgccgagttcaaggaggccttcagcctcttcgacaaggacggagatggttgcatcaccaccaaggagctgggaacagtcatgcgttcgctggggcagaacccaacggaggctgagctccaggacatgatcaatgaagtcgacgctgatggcaacggcaccattgacttcccagagttcctcaacctgatggcccgcaagatgaaggacactgactcagaggaggagctcaaggaggccttcagggtgtttgacaaggaccaaaacggcttcatctctgctgctgagctccgccacgtcatgacgaacctcggcgagaagctcaccgacgaggaggtggacgagatgatccgtgaagccgacgtcgacggtgatggccagatcaactacgaggagttcgtcaaggtcatgatggccaaatgagcaccgtgctccgtgctcccaagcaggaggagaattgtgcattgcatattagtttaagatgcaactcttatttgatcgatttccagttaagcatcctacctagctgtagctgctaaagcggatcggacgacgcaattcctgctatgttctccagtgtgtttccagacctcttgtgttttatgtgaacttgtgtcctccctggtgtatcctgattgctgttgggccccgtttgtagtatattttttcatcaacttctgcttcactcttctagtatcaatggaaagccggtatcaccattatcaatttcatcttgcagaccgctatatagctctgttctaagcgtcccttgatgcatcctgtaccaattcagcctccattgctcaatgcatgttgctgcatctacgatgaactgaaggaacaattttccacttgtttgcaagactactgactagttcagtcgctgctgtatgcgatatgcataatactccatcatggtaacatactttctctttccttcgacaccttttgttttttctaatttaatttctggtctgaatccatcttctccgtatgggaataacaacgggtattgcatagacataaagcttggatgcagttccgaaattcgctggagttgtttgtctttgttttctactattatatcacgttcaacattttctcctatttgttccccaacaatgagtgcggctatttcagatgtagttggtaggttgtattgtcttccatcattggatcttgtaccaattaatcgcaacctaacattttcgagatccgactctcggtatctatcccttgccatacggaatgatttcactaactcattgtgatcatcaagcatctgcaacaatccagacacaatgccttcatcaagttgtgttttcctttccttt

SEQ ID NO: 12563 - DNA, 580 bp, Triticum aestivum
  Clone ID: PAT_TA_12563
gaattcactagtgattagcgtggtcgcggccgaggttttttttttttttcgttagaaacaccgtctatctttatttctgaaccgaacaacagacatccacttttattcggagtagtaaacatctaagtacacgagacgatattactctgggttcaacataaggtcgtggcagtaacttgtactgctataactagatgaaagcatccaggcggtgcaatccttccattgttcgggagaggtgtttgtgcgggtatcagggctgaacacctggtgggcacctattcaagctgccgcaccgacgggtgtagggggcaccaggcgggactgtaactgttggccggttagggtcgagagctccaccactgatccctgggcgggctccatggcaaacggggccgctcatgagcacggcggagatgacgaacagaacgatctggaggagcacaaggaaacgcgcagctctggcgaaggaccccatccgatggtcgatggagctcgtgtgggctggcttactagcttgtgtgagctcgtgtgagtttgacctgcccgggcgggccgctcgaaatcacttagtgaattc

SEQ ID NO: 12564 - DNA, 913 bp, Triticum aestivum
  unsure (1)..(913): unsure at all n locations
  Clone ID: PAT_TA_12564
ttttttttttttcagcagtctcttaattaaagagaagatattattaatcagagagacgcctcagccatcaggattcatttcagtacgtcgagttacgtacaaggtacacgctagtattacggcagtagtatatcttacggtacaaaaaggtagtaattcgaagacattattacttgagcaaaccatgcatcgagcaattcattcgagcacaaacaattcggtgtatctggcaatgtccgtgcatgcatgaaatcagctctcagggtttacacaggtctcagggtccgtgatattatcttgcaaagagagataggtaaagcagcttatgcggtgagctcctcctccttgtgggtctcgatgacgatgtcggacttggggtaggcgtggcaggtgagcacccaccctgcctccatctggtcgtcgtcgaggaagctctggtcggactggtcgatctcgccggacaccaacttgccggcgcaggaggagcaggagccggcgcggcaggagtagggcaggtcgatcccctcctcctcggcctggtcgaggatgtagacgtcatcggggacctccagctccacctcgccctcgggcgtcaccagcttcaccttgtacgtcgcctgggcgcggagcctggctccccgcacctgcttggcggcggcgaggctgagggccgcgggcgcgagggccacgcggggcgccggtggcgccacggcgcgcagggagaagggcgcgcggaggctcagtgcggcggccattgctagctacctagccggagctaagatgctctaggtgtggctgaggaggtggagaggataggcctcgtgccgaattctttggatccactagtgtcgacctgcaggcgcgcgagctccagcttttgttccctttagtagggttaatttcgagntggcga

SEQ ID NO: 12565 - DNA, 836 bp, Triticum aestivum
  Clone ID: PAT_TA_12565
ttatttccttggaaatcaacattcaacagtctcttaattaaaaagaagatattattaatcagagagactcctcagccatcaggattcatttcagtacgttgaattacgtacacgctagtattacgacagtagtatatcttacggtacaaaaaggtaattcggagacattattacttgaccaaatcacgcatcgagcaattcattcgagcacaaacaaatcggagtatctggccatgtcaatgcatgcatgataaggagataatatgatatcagctcgatctcgttgcaaagagagataggtatagcagcttatgcggtgagctcctcctccttgtgggtctcgatgacgatgtcggacttggggtaggcgtggcaggtgagcacccacccggcctccatctggtcgtcgtcgaggaagctctggtcggactggtcgatctcgccggacaccaacttgccggcgcaggaggagcaggagccggcgcggcaggagtagggcaggtcgatcccctcctcctcggcctggtcgaggatgtagacgtcgtcggggacctccagctccacctcgccctcgggcgtcaccagcttcaccttgtacgtcgcctgcgcgcggagcctggctccccgcacctgcttggcggcggcgaggctgagggccgcgggcgccagggccacgcggggcgccggtggcgccacggcgcgcacggagaagggcgcgcggaggctcagtgcggcggccattggtggctagctagctggagcttggacgctctttctctgtgtggctgagaaggtggagaggataggcgggcgagctaggggatggaggagtgagg

SEQ ID NO: 12566 - DNA, 1105 bp, Triticum aestivum
  Clone ID: PAT_TA_12566
tggcgcgcgccacccagaggctcaccggcgccgcccgccgcgccttcccggccttcccgccggcgcccatctcgtccacgcgagaagaaaccccccaccccgaggccgagcgggtcaggcggtgccgcgccgcctccctcctgcccgccgtctgaatggcaggaagattccggaaggttttttccgcgatcaaagccctctctctcctaactgcgcttcctagtcctcgcctccttgtcaaaacctgtgctcgcgcggcgtgaggggtggcgtgttcgtactgccggcgggagcaccggcggcgaggttttaatcagagagacgcctcagccatcaggattcatttcagtacgtcgagttacgtacaaggtacacgctagtattacgacagtagtacgtatatcttacggtacaaaaaggtagtaattcgaagacaatattacttgagcaaaccatgcatcgagcaattcattcgagcacaaaacaatcggtgtatcgatctggcgatgtccatgcatgcatgatactgtaggagataatatgatatcagctcgatcctcttgcaaagagagataggtatggcagcttatgcggtgagctcctcctccttgtgggtctcgatgacgatgtcggacttggggtaggcgtggcaggtgagcacccaccctgcctccatctggtcgtcgtcgaggaagctctggtcggactggtcgatctcgccggacaccaacttgccggcgcaggaggagcaggagccggcgcggcaagagtagggcaggtcgatcccctcctcctcggcctggtcgaggatgtagacgtcgtcggggacctccagctccacctcgccctcgggcgtcaccagcttcaccttgtacgtcgcctgcgcgcggagcctggctccccgcacctgcttggcggcggcgaggctgagggccgcgggcgcgagggccacgcggggcgccggtggcgcgacggcgcgcagggagaagggcgcgcggaggctcagtgcggcggccattgcaagctagctggagcttagacgctctttctctgtgtggctggggagctggagaggataggcgagcgagctcccggaccggccggc

SEQ ID NO: 12567 - DNA, 3967 bp, Triticum aestivum
  Clone ID: PAT_TA_12567
aaaaactcctccaaaatgtgaaggacaggaataatttatataaataataaatacaagaattcataggtccattcctacaatccaaagtgcctcataggaaaattcctataggtttaccaatgagattcctttgttccaaaaaagaagagcttaacctcatgaaaacggtagatagtctattacatctatttacaaatgtgttttctcaattttgacaactttctcaaacgtagtaattcacaaccccaacataaatattctctggctccacaggtggtcgctcgatcactgttatattttctgtctctacaaactcccactttcctagcagttgatgccacaggtttggatatttgggccagcgagacgggtagtgaatggatcaacacgaacccacagcaaggagaagatagaagcgaggaggacagcccagacgatgacaatcgtcggtgtgcggttttgcctgcccataagacccttgaggaatgggtataagtgaacaatcacccagaaggcaaagaagagcttcccaaagagcggcccccatgattggtaaccactgttgatggcgtaggaggtaccagcaacgacaccgaccatgttaatgatcaaaatggtcgtcggagggataagaagcgtcgtccacttgaacatgtagagctcagcaaagtcgccttcttcatcattagcctttgaggtgacagtgaagttggtgtcgatacctgcaagcaccttcagaagaccctgaaagacggcaaacagatgggcagagatacctccaatgacccagaactgttcattcctccaccactcgtcaatgccaacaccactccacctcatctcaaggataccagtggcgaaaattgaaaggaagagcgcaatgaaccagatactggccaagttgctaatctctggcatgatgaactttccagtgagcagacagatagcaggcaatatacaatagactagaagcgggagagaggttagtgggtaaatggtggtgttgatgtaagcgaatctctccaggaacttgaggcgccctccgtagccataccataaggggcaatgccggctgaaaagaatttcaacagaaccgagagcccaccgcagcacttggttcagacgatctgaaagattgatgggggcagaccccttgaaagctgggcgcttgggcatgcaatagactgaacgccagccgcgtgcatgcatcttaaacccggtaagaatatcttctgtaacagaaccatagatccaaccaatctcagttccccattcagacttgtcctcataaccacagctgatgacatggattgcttctttcagaagagattctggagttgcagactgaggaacaccaccgtactccatcagagtggaggctacgaaaacactggactgaccaaatctcttctctaagctcatttgagacataagaagtgatttctcgtcatcaaacccagcaccttcaacaccctcctctatatcttcaagattgaacactggcacagaaccgtctgcatgcttatctgacttcttacttcctgtgctccttttcgattttgaggttctacccccacaaagcttagagaataaacctgactccttgctcttcatcgggggttcataaccatataaagctgttctgttgaaaacacaaccagtccccacataaactggtccttggatgccatcaagacccctcaagttaatatcaaaaaatacagtattcctgtttgcatatcgatcattcctatcaataccatcaaacctttgtgggaactgcacataacagacttgcggacctaggtttggatccattaggaagcacatagcttctcggacagccttgctgttgttgatgtagtgatcacaatcaagattcaacatgtactgcccattagtaaggacagctgatacacgaacaagggcattcattgcaccagctttcttgtggtgctggaatccagcacgtttctcacgagacacataaactaaacgggggagctcattaccctcagtatcaaggccaccactgtgaccaaggaaaacctgaatcattccaggatgatccctggtattgtttcctggccatggtgtgccatcttgcatgatccaaccttcctcggggactttcaatgccttagaaactagggcatttatcctaattttaaattcttcatattctctcttcatggcccggcggtctttaacaaatgaaggctggactttgtctttcaggtaatcaattttctggcaaaagtaaaactcaggagctctgggttcaatgtcatacttcttcacaaatggtacccatttcctagcaaactctgaagtctcagccaatgcatcaaaagtcagcattgaagctccgtcatcagatacatagcaagagaccttgtccacgggataatcaacagcaagaatggatagcacagtgttggcagtgacgataggtggctccttcaaggggtcgactgtactgacaaatatgtcaacagcagccaactgagacggttcaccttctcggtcataccttaaagccagtctatcaaggtaggtctcccggttgattggaaaccacttcgggaactgatccagtatccaggataaagcaaaccaaatctcacatataacagataaaagccacagtgggtatgcattacgcacaggatttgtgagacggtagtgcaggaagatgcttagaacaaccaaccgcagaacaatgaccattctgtagggatttattttggatgaagcaatggggacttttctagatagaggctggcgagtttcatcattcagtaaagcgtcttccatgttgtattcagtagatgcatcgatgtcagtagctgcccgaccttcagagggagcaatacttgtcccattagtcatgggaattgcacccttgtcctgcttcattttccagccatcgactctctctttccaggcaacattcccaatactgccagagaggcctctctctgtttgctctcgcgtccgccgcgcccatcctcgtccgcgcctgcgccccgaccgtgctcgctcgctcgccgcctccctcgcctcgatccaccgcgccggcggcatggcggatcagctcaccgacgaccagatcgccgagttcaaggaggccttcagcctcttcgacaaggacggagatggttgcatcaccaccaaggagctgggaacagtcatgcgttcgctggggcagaacccaacggaggctgagctccaggacatgatcaatgaagtcgatgctgatggcaacggcaccattgacttcccagagttcctcaacctgatggcccgcaagatgaaggacaccgactcagaggaggagctcaaggaggccttcagggtgttcgacaaggaccaaaacggcttcatctctgctgctgagctccgccacgtcatgacgaacctcggcgagaagctcaccgacgaggaggtggacgagatgatccgtgaagccgacgtcgacggtgatggccagatcaactatgaggagtttgtcaaggtcatgatggccaaatgagcacccaacccaaatgctcccaagacaggaggagaattgtgcattgcatattagtttaagattcaactcttatttgatcgatttccagttaagcatcctacctagctgtagctgctaaaacggatcggacgacgcaattcctgctatgttctccagtgtgtttccagacctcttgtgttttatgtgaacttgtgtcctccctggtgtatcctgattgctgttgcgcccgtttgtagtatattttttcatcaacttctgcttgactcttctagtatcaatggaaagctggtgtttcgtaaaaaaaaaaaaaaaaaaaaaaaaaaaaaaaaaaaaaaaaaaaaaaaaaaaagaaaaaaaaaaaaaaaaaaagacccctaaaaaaaaaaaaaaaaaaaaaaaaaaagggaaaacaaaaaaaaaaaaaggccccta

SEQ ID NO: 12568 - DNA, 783 bp, Triticum aestivum
  Clone ID: PAT_TA_12568
gccgacctcgtgtggtcatggtcaatagatgactgccttgacggattcgttgttctcgacaactggagcactcagcagatcgccgtctacaacccgctcgcgcggaccctggatgtcttccccctgcctccccaccaggagcactgcaagaactgcgagcgccagtattctgattactacatcctcgccgaaaaagaagaagactccttgccgtaccgtgtcttgtgcgtccggcacagcgaacacggggcgcgcaccatggtcttatcatcggacaccagcaagtggcagattttcccatgggtagacatcgacgggctctggcctcgcactgctaagctggtgaatggctgcatctattggaccattgggatgatggacgcccgcgtgcttaacactgctacaatgcaattctctcggatggataagccgccgcgcaggagagggagtgacgtcttgacggctggtgagaccaaggatggaaggctctgtgtggtctccgcacctttggggccactgacattcgaatccgtgcttgctgtttggattcggagagccgatgacgatggcgtcgagaggtggatgttggataagtcactcccgttgcaggagatagctggaatcgttcggtgcgaattcaaggaagacaatgttaaatatcaagtgactgttaggacgattatcgatggatttgtgtacttctctgcttattgtggggtgtggcagcatcatcattcgacactctggctcctatccttctgcttggaaacagcggcgctgaac

SEQ ID NO: 12569 - DNA, 913 bp, Triticum aestivum
  Clone ID: PAT_TA_12569
cacatcacagaggccgcggcggcgccggcgccggcgctcccaatgacgtcgaccacggcgacagaaggcacgttttgctacttggctggctgtggtcggacacaaggagctcgggacggcacatatgttgtgcggtgcaagcaacttcttctctattggattggattggattggatttccgctgagaacacggcaaagaccgccatccacaccacaccacaggacgtgtccggcggtccactgggccaaaggccagatctcggcccaggctaccccgtacgcatgatgtgcgcaggcccaacccgccgcctgtgatccaccgggctcgttattgggtggacgggcctggctatggatggatctggcccaacaggtgccatcacctcccgacccagcgccgtctctctctttcgggggaggaaagggcgagaggtcgaggggcggcggcgacgacagcgtcgaccggtggcggaggcggccgcgaccacctcaaccccccgtgaccagagccggccatcaatccgccatagcttttcgggggaacgtggtgaggtcgatctgaccggcggtgatctgttttggaggcggccgtccccagcccaagctcgtctgcctaaggtcgacgggaagacggggctgaggctgcatctgcgggttatatctgttgaggacgctgcctttcttccaacgaaagctttctcggatggcccccaaggagcaaagacttcacgctgatctgttcaaggtgacccaccagaaggtggttgatgccatcagggcaaacatacctaatcagacctcatatgatgtaagatgtaattgtattatcttgattggttaggatgttgatttctttttcagttttgctaaagcacatttagatgtgcccaagtatttgcacatctaagtcata

SEQ ID NO: 12570 - DNA, 1215 bp, Triticum aestivum
  Clone ID: PAT_TA_12570
aataccggtaatacggtcgttgaaatcctgtcctctctttgactctctctcgcgactcacccgcgacggcggccgcctcccccggcccggccccggcgtccggcggccgaccccgcgacccggcgccggcaaggcgagaaagagaggctcgcggcgtggagaggtccctctgcttccgcaccacgcgcggacgccgctcggcctcgagatctcaagatgcggctggtcggcctgacgggcgggatcgcctcggggaagagcaccgtctccggcctcttcaagtccgccggcgtcccggtggtcgacgccgacgtcgtggctcggaatgtagtgcagaaaggtactggaggttggaagaagattgtgaaagcttttgggaatggcattctgttggaaaatggagaaattgacagagctcaattgggtcaggttgttttcactgacccagaaaaacgcaagcttctaaaccgtcttctggccccacacatttcatgcggtatattctgggagatactaaaactctgggtgaagggatgcctggttattgtcgtcgacatcccgctcctgtttgagacaaagatggaccgatggacggaccccgtggttgtcgtatgggtggatcccaaaacacagatcgagaggctcatgtcaagagacagttgcggccaggaacaggctcaggcaaggatcgacgcgcagcgggggttgccctggacgaagtcggaagccgacatagtgatcgacaactccggctcgctggacgacaccaaagagcactgaagcagggttctggtcccttgacatggaaggagggcatgatgtgcacggatggcgttctctcattgctctctcgctcgcggcgtgtgcatggccgcgggggttatacttgctcggaagaatctgctgctatcttttcaagcttaaacaaggaaggaaactagaatgagacgttgattgtttcgttgtgtcggtcgagggctctgggcgggccccttggcgggcccgttttctctcctgtcatgtcaccacttgtgctacctctcgtgctaaatttcgagtgtaactgcttgcttgtcctgtctctgcagttttcataggattcatattttatttcttatcgaaggaattatttgtacagttttgacgaaattcctttgaaattcgaatcattcagtcccaaataccccatgtaaaaataaaaaaaaaaaaaaaaaa

SEQ ID NO: 12571 - DNA, 1002 bp, Triticum aestivum
  Clone ID: PAT_TA_12571
ggcgacctccgcggcctccgttccccgccggcgagcggtgacatcctggagacctgaatcgtttgatccataggggcatcgagctcgaggtggctccgccgctagagcacctgcagtagatttgccggctggactcgggcgggagtccccatggcgtggatctgggtggtcgcggtggccggagccatcctccttctgtgggcggtctccctcggccggatactctcctccccggcgccctactgcctccctccgagccctcgcttcctgctccctctccacggcgacaggaggtgccggaacgtgctcctggtgctcgcccaccccgacgacgagtccatgttttttactccaacgattcttttcctcgaatcaaaaggtcacaaggttcatgttttgtgcatgtctcttggtaacgctgatggttttggagatactcgtaaagaagaattgtacaatgcatgcgctactctgaagattccagctgagcaagttgcagtcttggaccatcaacagttgcaggatgggtttcatgaggaatgggatcatggactactagcagaacttaccatggagcagatccaactgtgggatatcgacacaattgtgacctttgattcctatggagtatcaggtcatccgaatcatcgtgatgttcatcatggcatatgcaagcttcttcatgagaatcagcaagaaaatattgaagcgtgggaacttgtaagcctgaacatgtttcggaaatacagtggtgcagttgaaatttggttatctccgttgatctcctcaagttcaaagcaactgatatgttgtctagttaactgtaacccttccagaacctttaaggcaatggctgcacacagaagccagtgggtttggtaagtagggttggcatcatctcattttctaatgtaaaaaattgcacttcaacagaatggtagaggtcagtctcatagtcggaactttgccaaaagtttattttcaactttagtaagacatggg

SEQ ID NO: 12572 - DNA, 622 bp, Triticum aestivum
  Clone ID: PAT_TA_12572
tgcccggctcggcgccggtccccacccccgccccccgatcacctccgcctcccggatccgagccgcgccccgatctccaccgcctcctgtctctgagctccgatttgatccaccgcgtgtacgagaggcggctcggaatgtgggccggagggcgaggcggcgcctcttgaagcagtggcgagcgaccgacctggcgcgggcctcaccggccgatgcggagagttcatccgtcgtgtttttaaggcgaggagtcgagcagttttccggtttcgtttaggaattaatggcagccgagggagcaccgtggcggcggatggtagaggttgtggtcttgagctgtcgggtcgctttggggccggtccggctattaggcgggagcaccatttcaatccgctagctatgttttcttttcgtgggtagggtctttttgccattagtccatcagacccccaggccgcgcggcacaagccgtttccccacgttcctcccggcggccgggcgcggtcaatctgcctgcccttgatgccactcccgtgctttccagatatatcctcggtatcaaaattctgtcccggcggttcgcactgccctgtatcgtattttctgctaatctaattcattt

SEQ ID NO: 12573 - DNA, 823 bp, Triticum aestivum
  Clone ID: PAT_TA_12573
gaggaattcggcacgaggtcccgccaggctatgtttcctggttcatccgaagctttgcgaaggctgggtaacatcattccagatagctatttccccttcaattctattcctcctatatctgggaaggggctttgtgaccctgttgaaaatcctttaccttctattgcttcatttcaagggaagatgggtcttccgaactttggtctggaagacaatattccactcagtcatatgaagtcagtaccagatctatttcccaacttcccactgggcactaataaggagtatgctcgtaattctatcccagaattgccaaacagttcatttttaccgaacttcatggcagatattgctggaagttcaaaaaaggtgaggtcaaaattcatggcagatatgtctgcccttcttcctgggttaggtattagcccagttcaaccaatccattcagccatgcctgaaaatcacaagaaggtattggacaatataatgatgcgtgctcagtatgccacaaataaattaatgaaaaagaggtcaaaacctgattattggtcggaagatgaacttgacgctttgtggattggagttcgtaggcatggaagaggtaactgggatgccatgcttagagatccaaagttgaattttttgaaccaccgcactagtgaagagctagcattgagatggattttggaggagcagaacattatggaggaaccaatgcctacagccaccagaagttccaactccacatttcctggtttatctgatgccatgatgtctcgggcactaagtggaagcaacttctctaaacttaagatggagccac

SEQ ID NO: 12574 - DNA, 1540 bp, Triticum aestivum
  unsure (1)..(1540): unsure at all n locations
  Clone ID: PAT_TA_12574
tcgcagcggccgtcgcgcgggccgcccccgcaatcacagccttcgggaacgtcgacgtcgtcggccgccccgccgcgggcaccccctgggctcctccggcctcgccgccacgctccgcgccgccgccgccctgctccggctcgacgccgagtgggactggttcgtcacgctcagcgccgccgattaccccctcctcacccaggacgacctggttcatgtcttctcgtctgtgccaaggcacctcaacttcatcgatcacactagtgatattggatggaaagagtctcagagagtgcaaccagtcatagtagatgctgggatatacctggctggcaggaatcagttcttccaatccacagagaaacgggccgcccccgatggtttcaaattcttcacaggttctccttgggtcattctgaaccggcggtttatagnagtactgcattttcggatgggagaacctccctcggacccttctcatgtacttcaccaacgtgatgctgcctctggaaggttgtttccactcggtcgcgtgcaactcggacttccgtaacttcacggtgaacaatgacttgcggtacgtggcctgtgacgacccgcctcagatggaaccccggtttctaaacatcacacattatgaggagatagtggagagcggagtgccctttgctaggaagttccgagagaaagagtatctgttggacaggattgatgagaaaatactccagcggtggcgtcacagacctgttcccggagcgtggtgcacaggcaggaagaggtggttcagtgatccatgctcccagtggagcaacgtcaacatcgtaagacccgggccccaagccgagaagttccgcagatacatggaccggatcctggaagaatccaagtcaagcaacagctcatgcgcgcaatagcagcactgaaccgcgaggctgcatgcactttccggcagtcgagcgcgtctcattttgcacagatcgagtggctctccacgtgttcagaactccggcatttccgcctcccgtgggagcatttttgctgcagctgggttgtgcgcacagggccaaggtgaggggcgtgcctattctttcaagattttttggtgactctgatggcttcaagtgctcactgctccccccagcattgttggaggccagggagctttcggtgggggattttacctgagcttgtagggagtgtaattagtagcgatcagtcgaacgaccttgtgaggatgtttatagaacctttggtggaattcttggtgctcccatacggaattgaatcgagaggcaggcaaaaaaacatgaagggtggggaattttgttggccttgtggttgtggattggtagctgttgtggtttacagaatgctcacagactctttttactcctctcgaactgcanaggaagttccaaatttcccatgcatgatctatcaaccacatttgacatttggtttctcttttccaatctaatactgtatgtgtanacatctaacaagtacttcctctgtccctccaaaaaaaaaacaagtactt

SEQ ID NO: 12575 - DNA, 1118 bp, Triticum aestivum
  Clone ID: PAT_TA_12575
cgtccgcccacgcgtccgcccacgcgtccgggagtaccctcgctgccgggctccatgccgctgccgccgccaccaccggcggaaccagcagcgccgccgactcgcccacggcgtgcgcggctgccgccgaggcaggacggtccgccggaacctgagccgccggagctgcctcgccataggcggacgccgaaggatccgacgccgccacggacggtggtgccaccgcaggaaccggggtgggccgcggtgccgctgccgatggcaccaatgccggctcctgggatgccgatcaactacagcaccaccggctggacgaccatgctggtgttcggggactcgacggtggaccccgggaacaacaaccggctgcagacggtgatgagggccaacttcctgccgtacggcgcgggcttccttggcggcaggcccaccggccggttcagcaacggcaggctcatcactgacatactcgcggaaagactaggtgtagcgaggagccttccaggtttccgcgagccaaggttgaggccaaggcagctcagaaggggtgtgagttttgcatcagcaggctccggatacgatgatgcgaccgccaggatatcgaatacactatcattttccaatcaaggcgaggacctatggcgttccagaggaaacctccaaagattagtgggaccaagaagagctggtcaacttctcaggagggctacattcgttataagtgctggaacaaccgatctgtttaaccactatcttgccacaaaccgttcaggaacagagagttggccgccgtatgagaacctactgataacacgtgtcgctaactatacccaggcaatgagagcacttggaggaaggagatttgtatttgttggagtgcccccagttgggtgttcgccacttgttagaaccttgctaggcacgggtgcagaaacatgccatgaaaacatgaactccatggcaacttatttcaacagaaggctaggcgaagtggtgcgctttttgaggaaccaacgagatatcagagctacttttattgacggttatccaatcgtaagcatggtgacaatagaccccaaaaacttttggctgacagaaacatcaagaggctgctgtgg

SEQ ID NO: 12576 - DNA, 622 bp, Triticum aestivum
  Clone ID: PAT_TA_12576
ggaggagtgcggtcaatttgacggatataggagctcttgttgtagatgctcttatatgcagtttacttcttttataacaactagatgatacctgggtcaaaaaaaaactagatgatacctcacacgttgttacgggaatatttgcattatatttcgatgatatttgatttgtatggaacatgaatagtaatactatgaaaactaaaattgcaaatccatatgctttattgtgtttgattaatgtattgtaaaatatttattaaatatctcatttatatttacatgttgaggtggacattttcctgtgtatgaatgtatgttgtgatgggtcttttgtcatgcatgttgcttgatgatgtggcatgcttatatattaagaaaaatatgttagtggaggttagctatttagatataaaagattaatgggtatcaatcaaagagaataaatcaaagtggttgtgacaaggtcgcatatatacaccaggcatcaatgggacgaagatttgtagcacgcgagtgaggggcactcatgcccctggtgtcggcttttcttttggttttttatttcaatgtcctaaatcttttaaataaaaaatttcaaattgagttatgttttccatat

SEQ ID NO: 12577 - DNA, 1785 bp, Triticum aestivum
  unsure (1)..(1785): unsure at all n locations
  Clone ID: PAT_TA_12577
cgtccgcggacgcgtgggctctctctcttttctcctctctctgcgcgcggaggaagattccactctcgatacctcggagttatcgcgcaccgagcagcagattatcccctccctgcaggcatcgcgctgcttctccaataagattgcctgcttgaattaatcaaaatctgaacattttttgcacaaggattaccaaaatcagaaagcttactgtttcatgctatcaacaactgatcatcaatagtgtcattggtcaaacataaaacaggcaaaatgagctctgaaggcggtggcaccgccatcacaggcaagaagcggaacagggcccaaattcagacactagtcagggaaggctctctctataacctcaccctcagtgaggttgaaagccacctcggtgcgccacttcttagtatgaaccttgatgactttgtgaggagtgtgcttccagatgagaagaaccttccattaccaaatggcgctgggaattcaggcagtcacagcacgtcagcttttggtttggaacgtcagggcagcagcattactgtacccctgccattgagcaagaagacagtggatgaaatttggagagacatccagcaggaagaggagagtagtgatgatgagaaaaggagttcaggttgtgaggcacagatgtcgtttggggagataacacttgaggagttcttgcaaagggctggcattgttaccgggcagtatcagaaggatgctgaggagttaattgatcttgtaggaactggagaaagtgctcatttgatgaccagagtgcaggatttcccacagggaacaagtgcaattgatgcgtatattgtacgtcagtcaattgcgcaaccgctgagtgttgcaatcccttcgacaatggattccatctacccagatcgtcaaatgagtatttcgtcatctctagaactttctgatcttcaaagtcctagtcataagagaatgtcttcccaggatgtggtatacaaggttgctgatcggaggcagaagaggatgatcaagaaccgagaatcggctgcacgttcaagagctaggaaacaggcctacacaaacgagctcgaatgcaaattgtcttgtctggaagaggagaacaagaggctgaagagagagaaggagttggacatgttattgaagtccgcgccccctccagaaccgaaaaaacatcatcggagaacgagatcgacctcattctaattgtgtgtagagtacaggcctctggtagattttgatcacccttttgctttctcctcgcatgtaactatggagcgtgtgcagtttgctttgcttgtaatttgtaaaggcctagggcacccaacaatcttgtgaaatatcctcccggccgttaggtttcagatttgtaaatctggttctttcaaatattcttgcggcatggatcccggtgtacggaccgtgctgcgaagttgcttgctaatacttgctgtaagtttgggctgttgtaacctgtagccccctccagaagttcctttcaaatgaaccttgtattantgatataaacgctctttatttttttacgggagnactgcttcccaagcgggcgccgggaccaattgcccnatagnatcgaataccgcgccaatgccgtcgtttanangtcngaatggaaaacctggggtaccaactaatcccttgaganacnccttcccagngggtaaancganaggccgcacgatgccttcaaaatgccacctaagggatgacccccgtacgggatacccgcgggttgggtcccactacgnacttcag

SEQ ID NO: 12578 - DNA, 1385 bp, Triticum aestivum
  Clone ID: PAT_TA_12578
cccgcgtccgaaaaacgataatgccaaaccctaagcgccccgccgtcaccgccgacgaccccgaccctaagcgccgcgccctccacgaccccgtccctgagcgccgcgccggcgaggaccccgactctgagcgccgcgccggcgacgaccccgaccctgagcgccgccgcggcgacgaccccgaccccgaccctaagcgccgccgcggcgacgcccccgacggcgcaagccctaatcgcctccccgacggcgcaagccctaatcgcctccccgacggcggcgacccttctggccaaagaacagctatggcgtatggcggcggggcagaaggctggagcacggaagataaggtcgagaaagtgtatgcccagaaggaggtggccatggacatcacggagcgtaaggagcagattgagacaatctgtctgcagatgcaggtgacggcatcgttcttgacgaagatcaacgcatctcagaccgcactcctgatggagagggaagataccgcaaaccagatctcagttctctgtgataacttgtccaagatcagaacattacttgttgagatcagattcgacatggagccgaaggagcagatcgagacaatctgtctgcagatgcaggagacggcatcgttcttgacgaagatcaacgcatctcagcccgcactcctgatggagagggaagatatcccaaaccagatttcagctctgtgtgataacttgtccaagttcagaacagtacttgttgagatcggattcgatgccgcgggcagcaaatcatctatgaagaagaaggaccttgtgggtatttatgccgccaaccgcatgcgcgagatgcaagaggaaatctccaagaaagagaagatccggatccgcgaccagctgcagctcatccctctccaagagcccgaggagtacatgcatgagtattacaggcttcatcctcatcaggaggaggagacgaagctgacgagatctcttaagaagcagattgcagaggaggagagcctctatgctacctaccgtagaggcaggaagggtttattggctggctctaccttcgaagctgaaagcatgataagtcctatgcattttactttctgcccgcctggagtagcctctgaagatgacgttgcagttaccaccgggaccagcttggagatcttctccatcaagattgcccagatcaaaggcgacttaaattggcctctttacgtgtatggtgtggtcgctgccagagacagagtggatttcaaccgcaacattctcttcaatcgaatgaggaataatgcccagaaagtcacagaagctgatccttttttgtgcttgactggtccagctcgggcaattttgcctgaggtcgagtttgaagtcgaactcatg

SEQ ID NO: 12579 - DNA, 697 bp, Triticum aestivum
  Clone ID: PAT_TA_12579
gcaccgatcagcactcagcagccggcagtgtgagcgactgacactggacgaatcgccaatgaagtgaggggggaagccagccagccaccgcccagaaaccccagccaggccaatccccaagctttctcctgcaaaccctagcaatggcgatgccgctgtgaatcggatctggtcctagcggatccaagatgggctcttcccgaggtaaccgcaacgtgagggcacggcgggccgtgaaggccatgaagctcctcggcatctccagggagcagaccgcccccgtcctcaggcgcctggtcgagctctacgacgacaactggcagctcatcgaggccgagtcctaccgcgccctcgccgacgccatcttcgacgaagcaggccaacggcgggccagccaatggcggggatcaggtgcaggggcaggaggagctcgatctggagctggaggagacgggcaccatgccggaaatgttcacgccggaggatgacgaccagcgcccttccacctccctcgccgtcgtccgcaaggacccggataaccgcatcaccgcaccacgctcgaggactggttccagagcaaacccccttggccctgacccaactcaagccgcttcgcctacacagaccagagcgctgagcaagcggaggcagatgcagatgcagatgatggatggagattttcagcagcctgtcttcc

SEQ ID NO: 12580 - DNA, 724 bp, Triticum aestivum
  Clone ID: PAT_TA_12580
ggcacgagtcacacacacacacacacgcgcacacacctttcttcttttaccagcctccaagaatcactcactcactgcacgccatggagattgccatggtatgcacaagagttaacctcctcatcctcatcctctccctctgctcgccatacaagttcatccagagccccatggactttggccccttgaacctgctccccaccaccatcgctgcgtccagtgatttcggtaggatcctcttccactccccgtccgcggtgttgaagccccagtccccgagggacatctctctgcttcttagcttcctctctgcctcgtctctaggcaaggtgacagtggcggccaggggtgcgggtcactccattcatggacaggcccaggccctcgatggcattgtggtggagatgcgctccttgcctgccgagatagagctgcacaaaggaggagaaggagatgcttcctatgctgatgtgagcggcggagccatgtggatagagctcctggagcagagcttgaaggctgggctggctccaaggtcctggactgattacctctacatcaccattggtgggactctgtccaatgccggcatcagcgggcagacattcaagcacgggcctcagattagcaatgttctacagctggaggtagtcacaggcaggggagagaccgtgacatgctcgcccaccaagaacgcagagctgttcagcgctgttctgggagg

SEQ ID NO: 12581 - DNA, 456 bp, Triticum aestivum
  Clone ID: PAT_TA_12581
ctgcaggcaattcggcacgaggcgccgacccagagtccacctcgcgcgtgatgttcagtgctcttgtcatcgggctagagccgtagtggcctgaagcactcgatgcatgcacctgcagtgcggccaacgatggcttgcagtacggccgacgacagcgtgctgttcggcgatcctcccacgagccatcgtttcgacaaattgggggtccggccgtgcatgcagtgcagagggcacgacgcgctcgtatggcagggagggatagcgcaatttcatccattgtttatgttacagattttgccgtgcagtgtccgtggaattgcagatcacaaagctcttctttgcgttatttgaggttttgagtatgtgcggtttcattacagcacagttgcgggtcgctgcagcactgtaggcatttcagtcccgggcagcatgcagtttccatgtgcaaaaaaaaaa

SEQ ID NO: 12582 - DNA, 2453 bp, Triticum aestivum
  Clone ID: PAT_TA_12582
gttttttgttaagggagtcctctcctaccattctctcgtcgcattagaccttgaagatctcaccaacctcctaccagccggcgtatctgcctctctcagtgccagagcttcacgacgcggctctcttatctgttcggggtgaaccatacgtcccccggatcctccgcaaagacggtgcctttctggttgttcccggcactatccatggatgatactttaccgctaccataatgaggaaacgcagtgacatcgttcaactatggagaagaaaagggtacaaggtctattagcctaatacatacaacatttttaagttgccgcaaacaatataatggaaggctacaggcaaatttgttaaacccatttcaggcagaaagctatccactctgtttatcaggctaaccccatttcaggcagaaggttatccagtccggtcatcaggacgatgaactcctaccgacccattcccatacattcatgtaggtgatgatggtacacaatgctccccagcagaagatccaccatggttctccctgggaggactcctgacccttaacgggaggtgttaggaaggtaaatgcgatggaaattgttcatcttcaggtgcttccggcaggtaggacatttcttctggaactggatggcttgctttatgcagtttgtgcagaagatgtggccgcacattgttgtggcgggctcatccaacttgttccaacacaccgggcaggtgaagatgggttcctttggagccacattcagaggctctttgctagttttccccgcattttttgactgtaagctggacccttctcctgtttctggagagatgtttattacaggggaaactcttgggcgtttgttccttgtgttatgagaaagcactgttgcattatcatcatgagacactccttgccgggtagcatgtacatcgagatcaactacagtcacaggctgcctcctaggtctccggttcctcctctgaggaggcacttgtgaagctgatacgacctgcacttcatcctcgagggcttccacgtcaatgggtgaggtgcgcgcgccagcgttagaagtggatactccacgacggctgcccgccgctgggggggttgagaccaagttcacgacgaccttatcagcatcttgtgattgccttcttgaggcacggcgtgtgccgttggcagtactcttcctccctgcggccccctggttgaatgctgcttcttctcttgtcagggggctgtccgagatggaaacaaaggggcccccgccgcgccgcgccgcacaagagccggaaataaagttccataatccgaagtttgtttctctgctaaaccatttacggttctacatccctcaaatactccccaatctggagaaggtggtttttcttgatgatgatgttgtggtgcaaaaggacttgacacagcttttttccatagaattgcatggcaatgttataggagcagtggagacttgtttagagtcatttcatcggtatcacaaatatcttaatttctcgcaaccaataatcagctcaaagattgatccacatacttgtgggtgggcttttggaatgaacatatttgacctaattgcttggaggaaagcaaatgcaacatcgctctatcattattggcaggagcaaaatgctgatcaactgctttggagaacgggcacacttccagcaggccttttgacattttatggcctaatggagcccctagaccgaagatggcacgtattgggtcttgggtatgatgtagacatagatgaccgcttgattgagagtgctgctgttgtgcattataatgggaacatgaaaccctggctgaagttggccattcaccggtacaagtctatatgggagcggcatgtcaatttctcgcacccacatgttagagagtgtatgtttcactagggagtgtgcaatcactgtttaccatcaatggtcttccacggcactgaagctagaaacatcagtttctttaatagggttgcttttgagcaccctagtttcgaaatcttccagagctagattatatactcaacaggcatcatcaaagaattcaactgttaagtttactttttgggtgggggaagatttattttgagaagaaaataattcagttgcagatttttacatacaattcggtctggaagttttagcagtctaatgagattacctggatagatattgtaaaggagatacagttgttggattgatgcgtcattttttgagatgttagaaaatgccaattgccaaatcagctgtgcagagcttactggcgttcattcttttcaggttattgtattttatactgtactgttgaggaatgtcttccttttcctttttgtataaacagttgagtattcttcacagtacgaactcggctcaactggagaatataggaaagttaagtaattttgatgttcagaagttgaaaaaaaaaaaa

SEQ ID NO: 12583 - DNA, 1228 bp, Triticum aestivum
  unsure (1)..(1228): unsure at all n locations
  Clone ID: PAT_TA_12583
gcccgctccccgcacccccgcgccccccgcagtgaaggatcacccagagaccgacttgcactgatcgatggcgtccgtccggcgcccgtgcgcggtggtgcggctcccctgcgccgccccattcctcgtcacgggccgcgcccagccgatggacaaccccatccttcccgaccccaacgcggtctgccagaactgacgtggtcccgcgagctgattttgcctcattaccctcggaggtgtccccgtacacgtctacgtgctcgctgctgctacactagtggctccggattcggtttcagtataaatcaccggggggtgatgtcgtgtctttgtgtgttagtcaatcgatcgttgtgtagggcaacgttggaaatccaggcctggctcggtgtgtgcacgccagcatgggcccggccgggctgggtccgaagaccgtacccggtatcggtccagccaatcgcggcgtgttgcgctccgccggccagttccgcatcgtcgccaacgcggtgccggtgaccgaggaggactcgagggtccacgactacggcctcaccgccgacgacagcctcgcgcacctcaacgtcgcgtttcaaagttcaaactccatcaagcgcccgacgtgcacggcgtgctcggccagacctaccgcccgggactacgtcagcgccggggttgacatgggcgccaagatcccggtgatgggggggtgccgcaaagtaccaggtgtcggacatcttcgggacggactgcgaggtggcgcgcttcgccggagaggacgtcgtccgcgtcggggcggtcgacatgatcgacgagccggccgacaccatgtgcggcagcggcaagggcagcgccgggctggtctgcaagaagtgaagtggtatcgcgagctgattttgcttcattaccctcgtaagtgtgcccatacacgtctacgtgctcgctgctgctacgctacgttattggtaagtggctccgcatttgctttccgaataaatcacctgctgggcatgatgtcgtgtcttgtgtgttagccaatcgatcgtcgtgtagggcaacgttggaaatcccaggcgttgctccgtgtgccaggctacttttttcccctccaaattttttcaaatctaatgattgaacaatcaaggtcaacactcccttctgccttgccccctcaaagnatttttcaaatataatgatggagcaaccaagttggtttcnaagttaaaaaaaa

SEQ ID NO: 12584 - DNA, 732 bp, Triticum aestivum
  unsure (1)..(732): unsure at all n locations
  Clone ID: PAT_TA_12584
gcgaatttggatcggatgttcaccagcatgggccgtggatgggatgagcttggtggtggtcgtcgtggaggagcagaattgagggagaagtttcttggggatgcaggtggcagaaagaggaaagttggcgctgacgatgaggacgatggtgccgatagtggggaggactcgggagttgaatcactctacatcgactgaggaacagaatcatacaacggcactgaatgtcatatagtgtagcctgagttctgaatctggcatgggaaccatattggaagattgatttatcatgctagcatctacaccatggtgtagtgatcttgattgataagagagtgttgtagtctgaggtgaaattttgagtgagaggtctcgtcctaaacttgcggacactatggattggggaagttatcaccctcaatgctgccatgcatctgcactaggatggttgatggaattttcatttgctcagcattatgtgaagggacaaagacacaagcaagagaactcctttctgcccccaagctaatttgatcagtgtcttttgacttgtgagtaactctggatctatttcactcattgctcccatggaaaactgtttgtgttatggatggaatatcaccatagcaacattctgtcagtcagttctatgttttgcaacatattgtaaccaaacaatgatactgtaatcggttaganatcgcaaataaaatcagaaatgcgacggggcgc

SEQ ID NO: 12585 - DNA, 2116 bp, Triticum aestivum
  Clone ID: PAT_TA_12585
tcgccacgtccggtaactcccccttgcccccccccctcccgcccgatccgatcccgcgattcggttcgttgcccccccccggttgctttcccccccgtttcttgcccgccccgtcccccctgacgccccctcccgtcccgcgttgagtgacatagctgctgcgatgtggcagagggcgacgcttgttgccccccctgccgcgggtgaatcggccggtcggtgcgcgtagattcataagtctaggggtttttttgtgagggggtggcttcagtcgcccccttaggttaggaaagacctccgggtggttgcgttcatccgtccgtccaggattgtttagccatggataagggcctcttcgccaacgaaggcttcttcatggcagagatgcgagcagttgcctcgggcggatgcagtagagggaccatgcataggcgcctcttcgccatcgacggctcctccatgggcagacccagccagatgcagcaggaaatgctggacaaggagaagcccgcagcccccgccaccaccgctggtgctgtctcctctgcgccggccaagcctgtcaaccctaagacgccccttgtcattgtggcaaacaagaggccgctcgaggtgaagaagtcaggctcggttttgtcgggcgggaagctggcctttagcctcaagaagaacaagatccccattgtgcctgtcaagtttggagccgaggaggaggacgacgaggacgttgccggtgtggagaggggggatcatgcgaagcggcacaaatccattgatgctcactcagctgctgccccagctagggttgttgcctcagcaccaccaaatgatatgacagtgaggcaggttgctgacaaattagcaagctttgttgccaaaaatgggagacagtttgaggatattacacgccagaagaatcctggagattcaccattcaagtttctgtttgataagaactgttcagactacaaatattatgagactcggcttgctgaagaggaaaaggtgcatgctcagacaaaggatgctcaggcttcaaaaattgttaattcaagcactgcaagctccatagcacatactggtgcacacagaagctcatttgaacaaagatctaactatcaaacgcctgcttccgctttatatggggcatatgaaggtagttcttcccagggaagctcatctggtcatggtgggctacgtgtggcggctcccccggtccctgtccctttcttgggcttccgcgcgacgaaagctgcacaggaagaacggaagagaccaccaaggcagtcaaaagacgaaatgccaccacctccatgccttattcagggtcctcctaagaagggacaccacatgggggacttcattcctcaagaagaactcgagaagttcatggcacgctgtaatgatgctgcagcacaaaaggctaccaaagaagctgcagagaaggctaagattcaggccgataatattgggcacaagcttctgtctaagatgggctggagggaaggtgagggtcttggcagcgagagaagtggccgtgcagatcccattatggctggagatgtgaagcaggaccaccttggtgttggtgctatccaacctggtgaggtgtcatctgaagatgacatctacgagcaatacaagaagcgaatgatgctaggctaccgccataggccaaacccactgaacaacccaaggaaacaatactactgatacaaggggaggtcagccggggggagacgtaagaaaccaattttgctgcaatgttttgctcacagaactaactgctgctttgggaaatgactaacagtattgaaagctttgttcatcagcaagagaagcccagaagttgatttattcagcaagtaacttgggatgccacagctttggggcttcctggggttctgcagtagctttgctgttttagtgtttgtttaagtactactactatgaatgtgtcctacggtggtgttttatgccaaagttgatgtttcaaatggtgatgtatttctacctctgttggtggacaatgtaactttgtgattatggattttctgctgggacttccttcagttgattatactgcttcttattttggccagtgcaaagcgtgtgt

SEQ ID NO: 12586 - DNA, 986 bp, Triticum aestivum
  Clone ID: PAT_TA_12586
ttccttgctcgctcatttggttgctcagagtactgctgatgttcggcacgaggatttgattcgacgcacattatcttgcataatcatgatcaaaaggggcatgaactggctatgcatgtgttgtatcagctgcagtgtgtcaatgttgctgatgctccagaaagttctatatctacttctgaacattacgagaagttctttatatcacttgcaaagttgttgattgacgtgctacctgcttcagataaatctttcagtaaacttctatgtgatgccccatgtttgcctgagtctctgtttagattccttgagggtctttgcatgtcacaaggcaacaaccaacaaacaaaggacagtgagggtgaccgtgtcactcaaggcctgggaacagtatggagtcttattttagggcggcctccattgcggcaagcttgcttggatattgttctgaagtgtgctattcactctcaagatgaagtcagaggaaaggcggttagattggttgcgaaaaagctctatgatctaacatatgcatcagaaaaagttgagcagtttgccacggacagtcttctggcgattgctaataagcatggtgtgtcgacagatgttaacttcacaacctcaaaagaatctacatctgaggttgaagtaagcaaccaggaagcttcagttagtggttcccagatttcggatgctggaccttctgcgaccgctccgacttcgccctctctgtctgcaatatcggtatccgaggccaaacgccacacttcattattttttgcactttgcacaaagagacctactcttcttcgacagctgttcaatgtttatggagggtctccaaaagttgttaagcagtgtatccattggcatatacctactcttgtaagaaatctgggatcctcatgtcctgagatgctggacattatccatggtccacctgaaggcagtgaggaacttgttactatgatactgcaaacactgac

SEQ ID NO: 12587 - DNA, 623 bp, Triticum aestivum
  unsure (1)..(623): unsure at all n locations
  Clone ID: PAT_TA_12587
caggatccagcagagactttgaacaaggacttaatatctcactttgtgctccgtcttgtatactgcagaacggaggaattgcgtaagtggtttctctccatggaaaatacactgtttcggtatcgctttcgtctcgagagtcctgaatcacagaggcttcttatgagtgagtttcagcttccatacaaagcattgccacactcagaattcgaggctgtgaaagataagttaagccaagttgcacggtccatcggtcaatcggcaagcgttgaatctgtgttcttcaaggtaccttttgaagaagttccagatcttgttgccagccgccgagtattcctttcaaagggctatgcttatgttgcgatgagtcaggtggtttcacttgtggtaacccagttccgctgcaatatctcaaaggcacttgttttaacaaataggaaatggactgcgaccattaaggagcaagaaaaggacaggttgactcctattgttgaagcgttaagcaatgcgtattttggacctgattactctcagccaaatgatgctactgagatttcgtcgaaagatattgatcaactggctagaacttctttccctctttgtatacgccatatgctnnnnnn

SEQ ID NO: 12588 - DNA, 485 bp, Triticum aestivum
  unsure (1)..(485): unsure at all n locations
  Clone ID: PAT_TA_12588
gcaaacacagtgagcaagcaagcaagnctctcgnatccaaggcttggctaagaagacgccacccaccgctgatccatggcctccgccgcgagatcctgcgccgtcgcccacttcgccccggacgaggtggccccgccggagaccatccaagtcatgcacctgcagcggctgcgcctccgccgggcggcggaagggtgcctggagcccatcgccgaggaggaggactccgatgccgacgacgcccaagtccccgccggctcgcccagcgcccgcagcagcagcagcagcagcactagagcggccgttcttggcccgatccttcgacaggcccggtcttgatgctggattgattagatgcaccgagttcggactagcaagtccatctcagttagagctaggcgcgctttcgggtactcccgtccaattcatgtattcctctgtaattagtccatgcattaattcatgcgagttagctaaaaaaaaaa

SEQ ID NO: 12589 - DNA, 823 bp, Triticum aestivum
  Clone ID: PAT_TA_12589
ctcacctccgcgcgccccttcccgctcgcgggcgcggcgacggcgaacgacatctcagacaaccataccgtccctcctccccctcgcgctcccatggcgtcccctacgagggcatctcctccaatgtaggcgcgggagggcggcgccaccgccaccaccaacggcagacagggtggagccaggcatgcattcatcactatccctagtttcctaccactggcgacgagaggtgcagagaaggttagggtctcgggagcatacttatccgcgtatacgttcgacggcgtatcgcacggatctacggcattcttggcgccggccgctcggtgtgttcttgatgaattttgcgatgttattttcctagagtgcaatttgttgtgcggaggatctttgcgaattctccaatgtttggaaccttttaacttcttttttctctcaagtttttggtgatttcagtcagagactagaaaacaacagtaggggactgaaaggtgggtgtattttgagtttgcttgaatggtacctgtggttgaattcttggaatgctcttctgcacaggagtcaaggtttggtaccctgaaattgttcattcgtgtgctgtctgctgtcgcttaaggccatgataagttactgaatatgtttggttggtctgttgataagatgatgtggaccggatctggcattgtgcgaaacggggccagatttgcaccctaagttttacagctaccagactagaggctacctgttgatcctttggtgtcagcagatatgctacaacagcagagagtacacatcaaatcgtcgtgttggtataagtatatgt

SEQ ID NO: 12590 - DNA, 626 bp, Triticum aestivum
  unsure (1)..(626): unsure at all n locations
  Clone ID: PAT_TA_12590
ttcggcacgaggggactacggggcaccgactatcacgcttcacgcgatccaganagatccagagagctgcatcaatcacgagaccttgcatcaatcattcaatggcgtcgccgttgtctgagattcccgaggacgtgctacacctcatcatcgacggcctcgtttcctccactgatcggcgtggcctcgtctccacggcgtggtctggactacgccggctcctccacttctccgatggcttcgaggcggcgcgccgtgcccggcactcggtctcggccgatcgcgctcgcttccgggccgtctgtcgttcgtggcacttggctatgcgccagcacgttctccgtccaagaaagatcccctggattgtcatgtccgatggctcgttcctcacaccttcggacgttgccggcacctcgcccgcgcgcataccctccttgcccaggaacgcgagatgcgtagcctcggctgatagttggctccttctcgaccgcacggatgtcaggaagaagatgcatagctacttcttgcatgatcccttcaccaacacgactgtgccgctcccagagcttgacgctgtgatcggccatgcttctgagcttttcggggtccacaaactgcgtatgcgg

SEQ ID NO: 12591 - DNA, 221 bp, Triticum aestivum
  unsure (1)..(221): unsure at all n locations
  Clone ID: PAT_TA_12591
gggatcacctgctcgtctaatctggcgtctttctcgctgtttctttgcgggtttgcgccctgttgggtttggtgcgcggttgttggaagagtactagtcttggtggatggaatgaaggacagcctaatggcttgtccatttttgtacagtacagatcatcgatgctccaatgaaagaggcttgcgnctcgactcgatcgcgttgtttgtttaaaaaaaaaa

SEQ ID NO: 12592 - DNA, 1078 bp, Triticum aestivum
  unsure (1)..(1078): unsure at all n locations
  Clone ID: PAT_TA_12592
cgtccgtaaacattctttatcgattcccatcgctgcaacgcactgcttcctcgaaaggaggtgggagtagggaatatgttggtacaagatggtctacaatgtcgagtggcattgaaaagtttatggaagagaaaccatgggaattcagtaaagcaaatgcattagagagggcaatggttgctggtttgggaggactcaatctttttggcgtcataattctgggaaacttactgaagcaaatgacaatgacacctggtgggcttatctcatttgctgcgcagttatttcccttgcttcagatatatgctggctccttttttgcaataccattatttagatggttgctgctacgcaagaccaacaatgacattgcaaggaggaacaaggctagagaagagagagcccaggaacttttgtcgccagaaccttctctcagaagaaagttgctcagtgcacgcgacatggctcagcggaaggtgattacaccaggggagattgtctacacaaccgaaaaggatctattggatcaggaatatgaagttagggagtgggaaaggcgatttaagaaacttgagtcagactgatggtaatgatggataatacttgagattcattttattgaaaaataatacttgattcatattatatatggatggtcctttggtcgtctggcatcattcttggatggaggatagatctgaccgaaccattcaaccaagtgggcagaatgcctagatgagagactggatggttcttaggcccactgatgtgctgtgaagtttttgccgaagcagtctttaatactaccattcatcaaagtaattgctgctgctgtacatatctgtaacatttagtctacacacatgtatatatagttgtagatcaatgcacagaagcagggaattgtaattcagagctagggaattgaaattcagaactgaacaccggaaccgtaggacatgtaaaggataatgccgttaaactgttgtctcagattgggtattctggatctagattgatgacactggtgttaaaaaaaaagggggggcccggtacccattcgccctacnagtggcct

SEQ ID NO: 12593 - DNA, 918 bp, Triticum aestivum
  unsure (1)..(918): unsure at all n locations
  Clone ID: PAT_TA_12593
gggtccggagtcgagagcaaatacgctaacatcactgtctctactcctgcattcactagaacggataagtagtgttagatcgacagagacagaggagaggctgagatgcaggcgccggcgtgtaccaatgctccggcgtgcccgttccccttcgccatgatgcagtctcatggtgccaggatcgtcaggttgcacacctacgactgggttgcgctgctcctcctgatcgccatggaaggtgtcctcaacgccatagagccgttccaccgcttcgtcggcgaaggcatgatcgcggacctcagataccccatgaagagcaacaccgtcccggtctggaccgtgccgatcgttgctgtcattgcacctatgctcattttcatcgccatctacatctggaggaggaatgcgtatgatttgcaccatgctacaattggtattctgttctctgtgctgatcaccggcgtcctgacggatgcgatcaagaacgccgtgggccgtccgcgccccaacttcttctgggcgctgcttccctggatgggaatcgctgtaatgacactccgctcggattcctctgaatttcaccgccaccctagcgtgagtctgggccccttgttgcccaangtgttcgancaacatcaacacagcatcatatgccacggcgacccagcgtgatncaaagaagccacaagacttcccaaagtgggcatcctcccggtctttcgccggcctgggttcctgtcctggtactcncccggaaantaacgtcttcgacgacnaggaactcnccaacttgcgtctcatctgctccctgtcncgcntatcgcatctncgggtaatatacggacantgnagantctcctggggatcctgaagtgattctcgtttcacncnttcttcaanctcgatanaagntttgcc

SEQ ID NO: 12594 - DNA, 579 bp, Triticum aestivum
  Clone ID: PAT_TA_12594
tctggcgactgggttattggtggaaaaaccgacgagatggtggaaagaagtccgcagagaatggaaatgcaaagaagagagatagggacaaggaagacagagtccgggagagggattcaagtgcccggcagaagagatctgcccatctgtgggctgatagggaggttcgagagaaagagagaaattctcgggatagtcgagaagaaaagagtagccgtgatgttggtaacaaagtgcgctggttacagagcaatattatgggttagagtggttaatgagaggttcagcagaaggttgtacctgcagaaggcaaaaattgttgatgtggttggaccaacgacatgtgacataatgatggatgatgggtcagagcttgtgcagggggtggagcaggatatgcttgaaacggtcctgccacggacaaacgggcaagtgcttgtgctctgtgggaagcacaagggggtgtatgggcatctggtagagaagaattcagaggcagagactgcagtagtggaggatgcggatacaaaagacatggtgcgtgtgaaatatgatcagattgcagagtacgttggggac

SEQ ID NO: 12595 - DNA, 1116 bp, Triticum aestivum
  Clone ID: PAT_TA_12595
gcttcccctccccctcccctctcctccccaatcccccctcttccatcccccgacagaccaatttcttcccaaatcgccacggccacggccacggccaccgccatgatgtcctcaccagcagataccgcgccgtcatcctcctccgcggccgcggccgcgccgaatcagcatccgcagcctccggcgcagcaggctggtccgaaggagcggcggatggagtcgctcgggtggctgacggagtccacggtgatgccgaagaagcacaaggccatcgagggcgtcggcgcggcatccatactcgacctcaaggcccagctctaccgcactcaggaggaagcccgcaattccaccgccgctgacgctgcctccagcgagttccgccgcgccaagaaacgctccggccccgccgaccccctcggcgccaagaactcaggcgtagacgctcgcgcccacaaagataagctggagctgaaagctgtgaaagatggtactgcatgttattctgccctagaaaagaaggctgagctgtatgagaaattatccaggggtgagctacctgatgaagaagaccaggagaaatattgcgttgatttcttccagaaaagttttcatcaagtcagcgagcgccggcagccagagactgctactgcctctgagcatgtagaacaagaaaatgagagtgtcgattctatgccaaatcccaagccaatgggccttggacgaactggtacaacagttgaccaagatgagcacaaacgctttgtcagggaggttcacgacgaagtaagtcaagcaaggcagaaggcttcaacgatgaaacaccggcgacaagagcaggagtcggctcgtagagagaaactcaggcaagctttcctcaagaagcgccttgataagttgatggctgaaaagcaggcatcttcggccagtgatgaccaaccagttagctagtcgaggttttgtatgtcttgcacttgtgcccaggtggcagttgttgtagttcatgcgatcacggttcatgcaactgcaaatgagaagatttgtcttgtttgtgattcccttgatgctggcgaaatcaaattcagaaaatggtactttgcatgtacagtcacgcaatgt

SEQ ID NO: 12596 - DNA, 433 bp, Triticum aestivum
  Clone ID: PAT_TA_12596
cgtccggcggtacttctggccaagatggccaccagatcctgcccagacattggattacttggaggaacacgttggagggcttcctgcaatccccaggtgtaaataagggtggagggattcagtgctgcatacaagatgcgctcagatacaattgctgtcgatcagtgcaaaaaggcaacctaaataaaggccaaggagcgtcagaagagcatcctgctggagtagcaggtgctaaagagattagctcctctattgcattaaaagatgcgattgcagcatcattggatgccaacacagcaatgtgcaataatgctctccttgacatttttgtctcagagaagtttgccatgttgtgtgatttgctagttggaactttccatgtgagtaaggttcatgaggtcattgatttggggaaaattgacgccaacatgag

SEQ ID NO: 12597 - DNA, 715 bp, Triticum aestivum
  Clone ID: PAT_TA_12597
ccgccgcggaagcgacccaagagaagaaacccccaaatggcggccgcatccatgctcaccaccgtcttctcccctctcgccctcctccgcccgtcggcctccttcgcgcgcctgcgccgcgcggctcccgccgccgccgtcgccgtgcgcgccgcggccaagtctaccacggccgcggcggcccccaagaagaagagggcggcgccgaccggcatcaccatgccccggcccgtgtccccggcgctgcagggcggtgtcatgggcgccgccgacgtcccccggcaccgaggcccatgaaagcgcatcctgggcctacatcaaggcagaacaacctccaggaccctcaggacaagaaggtcatcgtttgcgatgagaagctgaaagccctgtgtgcaggcagagaccgtgttgggttcctggagattgccaagcttctgaccccgcactttgtcaagactccgtgaagcctcttccatggagtagtcgagttagcgttggtggtctcgacgctccggtggtctggcgggtgcgcccgtgtggcctcgtcgcccgaggtgcctcggccttctgcggtccttgtgcgctccgcagacaatgttagtttacccctggcagtaagcaatctggaacatcttaacagctttaagctcgcatgcttgcagactggtttgtgtttgaatagcaagttgtgtggtctggaaaaaaaaaggggggg

SEQ ID NO: 12598 - DNA, 661 bp, Triticum aestivum
  unsure (1)..(661): unsure at all n locations
  Clone ID: PAT_TA_12598
gtcgacccacgcgtccggccaaccaccccccaagaaaccggnaaagcgaacggcatggcgaccccccgcagcgcagcacgccacgctccctcctctccctcccgcaggccatgacgcgccaccgtccttggcctccttcccaccctcctcctcctcctcaccctcatcctcttcgggcagcagcagcagcagcgaccggcaccggcgccgggaagaagatggcgaggctctccccgggggcggcggcgccgcaggtggacacgggcaagtacgtccgctacacgccggagcaggtggaggcgctggagcgcgtctacaacgagtgccccaagcccagctccctccgccgccagcagatcatccgggactgccccatcctctgcaacatcgagcccaagcagatcaaggtctggttccagaaccgaaggtgccgggagaagcagcgcaaggagtcctcccgcatgcagacggtgaaccggaagctcaccgcgatgaacaagctgctgatggaggagaatgaccggctgcagaagcaggtgtcgcgtctcgtctacgagaacgcgtcggtcaagagtctcaagactaagatccacaaggcttctgcggccaccacggacacgagctgcgagtctgtggtgacgagtggtcagcagcaagccct

SEQ ID NO: 12599 - DNA, 925 bp, Triticum aestivum
  Clone ID: PAT_TA_12599
ggtttcttggagtacaatgatttctggttgtgtgcagaataaccaatcgtcagatgcactcgctgtcttcgataacatgcgagcccagggagtcaggccggatgaggttactattgttagtgttatatctgcatgcactaatctgtctgctctggagaaaggaaagtcggtgcatgattatgtaaggcaaaacaaatgttacatcactcttgtacttgggactagcctcattgacatgtacatgaagtgtggatacttggaagctgcaatggatgtcttcaacataatggaagaaaaaggagcaccttgctggaatgctgtcattgtggggttggccatgaacggccttgtgacgaaagcccttgagatgttctcagagatggaagcatccggcactgccatcccgaatgagataactttcatcggagttttaagtgcttgcagacatgctggcctagttgaggagggccgccacttcttcaagttgatgcaacacaaagtaccgaattgtgccgaacatcagacactatggatgcatggttgatcttcttggacgtgctggatatgttaaggaggctgaggatctgattgagagcatgcccatgttacctgatgttccagcatggggtgcattgcttggtgcctgctggaagcatggtgaaaatgaggttggagaaagggtgggcaggaagcttgtcaatctggatcctcgccatgacggatttcacactatgttatctaacatatatgctaaagaggggatgtggcaatcagtaaatgacctaagggactccatgaagcaacgacatgtcccaaaagtttcaggatatagtgccgttgaaatgtctcattcttgagatactagcagttgatccacctcaaatgaaaatctttagataggtccaagttaagccttacaaggtca

SEQ ID NO: 12600 - DNA, 565 bp, Triticum aestivum
  unsure (1)..(565): unsure at all n locations
  Clone ID: PAT_TA_12600
gcaggnaattcggcacgaggggttcatctcaattattatttctattcgttgttgcttgctgcctgcgtactttctgtgttggttgttgttgtctcattgtttcatatggccggcatctgtggcataatatcttttgtcaggccgattctagaaacagtggctgcacactgtggtttgcctcctcctagccacctatgtgaggttgatgggatgggcatctccttgctgcattagaaattgaaattcctggggatggcgtcttgctaatgccgcagaggaaaaaaaattgggcctctggtggtcagggttctacgtcagggcttttgacactcatggaactatgtcaagccactgtcgatactatccctttatttagctttcttaatgaatcaactgttatgtgttgtaaatatcacaattggaccaccgttggcccttcctgccttccctagctacttatgacaatttctactcgttgtaaataccactggattatgctccttaatctagctcttgccatcgtcaccgtattgtctatgtcttattatgttttttgtaagttgtt

SEQ ID NO: 12601 - DNA, 718 bp, Triticum aestivum
  Clone ID: PAT_TA_12601
cgtccgcccacgcgtccgcccacgcgtccgcccacgcgtccgttcaatagcaaataaagagagagaaaacggggaaaaggccatcagttagattagggtttctggtcggctagttcatacggcgaggagcacgggaagggaggcggaactcgggagaggagatgggtgcgccgaagcagaagtggacgtcggaggaggaggaggcgctgcggcgcggcgtgctcaagcacggcgctggcaagtggcgcaccatccagaaggatcccgagttcagccccgtcctctcctcccgctccaacatcgacctcaaggacaaatggaggaatttgagttttagtgcaagtggactgggttcaagggataaactaagggttccgaggccgaaagcaccttcgtcctccccatcacctagcccgcagcttctgcttctctcagccccgaataatgttgccgaggcttctccaccagaagattgtgaaaaaagcccacaggatgacaagactccgagtccaaagttgtacagttccatgatcctggaagctctcgacgaactgaaagagccaaatggttcagaagttgctacaatttgcaatttcatagagattgataagtcctataagctgacggattcatatgcaaaaagggctctggctccaatgaaagatccatctctaaagaagaaggattcagccaagtcatccaaggcagcaaagggtct

SEQ ID NO: 12602 - DNA, 1075 bp, Triticum aestivum
  Clone ID: PAT_TA_12602
gtcggctggtacatacggaggagcgggaggcggaactgggagaggaagagatgggtgcgacgcagcaggagaggacgtcggaggaggaggaggcgctgcggggcgggcgtgcgcaagcacctagctagcaggtggcggaccatcaagaaggatcccgagttcaggtcctttctgccctcacgcacaaccacatgtctcacgaacagaaggagttgagtttgagttcgcgcaagctgggttcatgcaagtaataaacaatgctgaaggatcctgaaagcaccccccgcccctcaaccgcctagtagttcagcatttgctacaatttgcaatttcttagagattgataagtcctataagctgacggattcatatgcaaaaagggctctggctccaatgaaagatccatctctaaagaagaaggattcagccaagtcatccaaggcagcaaagagtctagggcagttgattcatgcactggtcgcagctgaagctggcagcggatgaaagttagccgtacgcggaggccaaatgcgcacctacgcaaaccgaagcacatgatggaggttggaaaggatcggcaagatggctgaggagaccgagtctctcctcgagctcgcctcagagctctacgagcgatgttcaagaggagaggcgctcacaatactgcaagtggcgcacagggagttttgatggtgttgtcgaccccgtcagctgcgcgccgacatctgctctcttgtacatggatggatggaagcgtaggcccagcctgttgtcttcttgcccgcgtgttgtctctgtgttgtagcataactcgaatcaattcgttggttgtacctgagagggcattcctttcattgcctaggaatgattttaagttggtgcattttggatactgtcctgtgttgaaatcagggaataatgtgtatctcgtcctgctgccttttcctgtatgtactctaatgaaagtttggtcatatgcaccctcctcgtgtccccccgcccgcgggttgtcgctgttgtatcatactcgaatcaattcgtggtgtacctagagggcagcctttcatgcctagga

SEQ ID NO: 12603 - DNA, 211 bp, Triticum aestivum
  Clone ID: PAT_TA_12603
gcacgaggattagaagctcgccgcctgtatgtgtaaatgtactgacgagatgagcaactagacaacgatagatagacccgtccgtcgtcttgagccccgcccctaccgcaagcgcgacgagcccccgagtcatgcatcgagcgtccccggctgtgtctttttttttctgtaaaaaagctttaccgagtgcaccattcggacaaaaaaaaaa

SEQ ID NO: 12604 - DNA, 479 bp, Triticum aestivum
  unsure (1)..(479): unsure at all n locations
  Clone ID: PAT_TA_12604
gcccactttcaccgagtcgggtcactacaccctccttgtccatgctattttcgtcatcacttcacttagggaaccaggaagcaaagttgaagtataagcagcttatgcaaacagcatacatgcaatgctatggaaatatcaacgtctcaaactttatcctcctctactaaagaggcttcctaggagaccaagaaagaatataatccaggtttgaatgaaataggtgctaggttgggcctacaaagaggaaatgcaaatgctgtggacagcttggccagatacagaagaattgtaaagagtaagttgaccaagaattttcagaagatgaacagactggtccctcgattagtgcaagcaatgtatggcactcttcctcccaaatgcctttttctttagattttgtaaaagtattgttnctcatgtaaaactaatgcatttatttagcttcagtaaaattagttaattctataaaaaaaaaa

SEQ ID NO: 12605 - DNA, 523 bp, Triticum aestivum
  Clone ID: PAT_TA_12605
ggtcgactggacggcaacggaagatatgcgtagctagctagctatatgtgaccaccgatctagagattaatcatcagatgcatactcgtgtggctcccgccccatatgcacgtaacgtacgaagcggaggaggaggagagaaccggagctaggagatgagaaagcaaaagaggcatgcagctggggaattaaagaataagacgagaccaccgttgatctaggaacaaagtgcaaaaggggccagggagggagagacatgggtgcgtgcaagtgtgcgtgcgtggtagagagatggatagtgagatagataggctttatcaaaggcagtcaggagcatgcaacaagctggttagcttgcctgcctgcctaaaggcttgcttctggtgcacaacacacacacgatgtagcttgaagagtgtgtgtatgtgtgcgtgcacttcatggcatgctgcctgatgagacagagctgctaggttaagaaaggtctcatctttttgttatgccacaagaaaggtgtaaagct

SEQ ID NO: 12606 - DNA, 811 bp, Triticum aestivum
  Clone ID: PAT_TA_12606
ccgcgcggcgccccgcccctccgccccgccccccgcccccccccccccgcctccccgcctccacgccggcccgacggcccgggtgccggcggctccgcggccccggtggccccggcggcccgcccgcccccccgccgcgtgcttctgctactcacgttggccagggatctgcagcaggggcctccctcctccgtttcccagagcccgcagctcattcgccatccggagattcggagcagcaagcgccggacgaggaccgtaacctgctggaggcccgagcgcctgctggaggcccgagcgcgacctcgtcaacggcgacgacgccccgcacaagatcagtaggagctctctgcctctccaattccatggacggcgacgaccgggaccccacgctcaaacccgacgagcttgaacggcgaggtcatccgtgccgaccatcatgattccccacagaacaataaggtctatctcatggacacccagattttgtatgcaattttctcaacacccagattggagcctaaggttggacattttgatgggactgcggatcttcggatgttggtgctgagattgatgtggccctagctacatgtatgattgcgtaccgggctacttggtgctgcccatcacaatttgcactgacatgataacttccatcaagagggccggctgcaagaacttgaatagcaacttcaatagtttaaatgttctgtttgtgtgaactggattgtactgttttttaactttcccaagtgatatatgttgtaaactatcatttcatggaggattttgtaagctgctatgttgt

SEQ ID NO: 12607 - DNA, 1665 bp, Triticum aestivum
  Clone ID: PAT_TA_12607
gcacatgccgccgtccgcggacgcgtggagttaaaacacatttgccagctccgacaaacatccctgcgaatttgagagggaggaaggattcattcagcggccggtaatcaatggcttccgctactgcttccatctcgtcgcactccatcgccctgcgcgatctcaaagccgcgaggattggagccgtgaggcagcaggtggccgtggttccagcgggcctgccggcaacggcgcccaagggccagcgcgcgagggcggtgcgcccgctgtgcgcggcggagccagcgaggaagccagtgtcggcctccgcggcctcgtcgccggtggcgccggtggaggaggaggcatctagaactactcgcgaggtgcaagaccttgtgaggagcaagggcctcttctctttctacgaggacggacaccaggagtgctgcagggtgaggaggttcggccttgaggagggccctcaagggcctcaaggcctgcatcacggggcagaggaaggaccagtcccctggcaccagggccagcatccctgttgttcaggttgatccgtcttttgaagggctgcacggtggagccggtagcttgatcaagtggaaccctgtggctaatgtcgatggcaaggatatctggaccttcctcaggaccatggatgtccctgtgaacaccctgcatgctcaaggctacgtctccattgggtgcgagccgtgcaccaggcccgtgttgccggggcagcacgagagggaagggaggtggtggtgggaggacgccacggccaaggagtgcggcctccacaagggtaacatcgacaagggtaacatcgacaaggaaggtcaggcacccaaggtcggcgtcaacggcaacggctcggccgaggccagcgccccagacatcttccagagccaggccatcgtcaacctcacccgtcccgggatcgagaacctcctgcggctcgagaaccgcgccgagccgtggctcaccgtcctctacgctccctggtgcccatactgccaggcaatggaggcgtcctacgttgagctggccgagaagctgagcggctcaggcatcaaggtggccaagttccgcgcagacggcgagcagaagccattcgcgcaggcggagctgcagctacagagcttcccgacgatcctcctcttccccggccgcaccgtgaagcccatcaagtacccgtccgagaagagggacgtccagtccctcctcgccttcgtgaacagcctcagatgagtggtcagagaaccggagaaccatcgttctctgcattggtaccggcggtgtctaggcactattatgtagtggtagcaagagaggatggttcagaacatcaacggaaatgttggagacaaaggagtgtggggaggcagggacagcggctcaaagcccctccattataatggggtggggatttgtgtgtagttgtagctagatgattgtaaggaagttcaaataagagtactagttttgaaattttgatccaaggcttcatcgatagtttggacaatatactcgtggttcactcggtcacaggcagctacccgccaaagaaaaaaaatagcagtcacaggtcagttatcacattctggtgcccattgatgctcaatcagattctggttgatgctgaatttgttgatgcatttgaataaattg

SEQ ID NO: 12608 - DNA, 951 bp, Triticum aestivum
  Clone ID: PAT_TA_12608
gctgctctcgttttctcccctcacagccgctcctctctccctcaggctcttagccactcctctccatggcgcctccccttccctcgacgtcgtccggcccctcctcttcccgccacggcgttgaccgacccctcctctccccacctcgagcgagcccacgcgcccgccggtatagcatcctgtgtagccagatccggccggtcggtgcagaagggttcgccgctctccgttcgtgccggatacccagctggcccgtccggatgtgggcgggacgacatcgggcacagctttgcggcgcggcgaggaagagaaacgccgccctcgtcgttggctccggtcttctacccagctgagcaccggagcatagtcgcgctgccgcgcggtcgatctgcatgacgaggccattccaggccgattccggtgcgaaggtgtgcataccgttgcgcggagggcgaccacaccagcgacacgaccttctgctcaccgtatcgctgcacagcatgcctatggtagaatcaaagttgatgaccggtgtggtatggagctagatgagactgacttggctgtctggcttaagttggaggctgcaacggaagagttcattcagaaaaaaatacaggctttaaagatgtttgtgagtttctagttccaagatatcaagaggaagacaagtcttctagaattgtcaaatccctgtcattttcaagattgagttcatcaaattcaggtatgcgacgatgggcattctgagctaatcccctgcttggataggaatttgattatcagacaaggttgaagatggatttaaaactgatggagcatcatgagcatcattgccctacttatgagagacgctttaattgcctgattccaccgccacaaggctatagggtcagcagactgtcctttctttcatttttttcgccatctcctcaccttaattgattatgt

SEQ ID NO: 12609 - DNA, 725 bp, Triticum aestivum
  Clone ID: PAT_TA_12609
gcggctttgctcaacatattcatctatgattttctccccgattttgaaattatttggcccctatagtccccttgagaaaaatcagagtatttatggactatgctctatgggttgacaaatttgattgcaggggctggcaaagtaagtgcagtgtcaccgttgcacatatattcagggctacatcaaacttcagtcagaagaacatgacgaggcagggtgcttcatgcagtattgggagtgaaagtttggtgtataatcagtgtcgcctccactctgccccgcccctgtgctttttcctcgatggaaatgcgggccaccatgccgctcacttcgcgtgcaaccacttcatctccaacctgtcgttggagagcattgcagaccgagcggacaaacgatgaggtgtagcagcacaaccttgcctcttccccttactctccttcacaagcgagccaaagacaccccaagttgtggcacccatctgaggccagccttgcttggcatacatggctgcatacatgtgatggaaaacatgcatggaagctttggcctggatatgcaattatgccttcctaagttttactgatgcaatttctttttgaaagatccctaaaatcatttacccttttgctcctgagaattgtttactattgtgaattgtatcaatggtcgaaatggtcaattaacgacatagaccgagataccatcaaacccctttagtagatcga

SEQ ID NO: 12610 - DNA, 1413 bp, Triticum aestivum
  Clone ID: PAT_TA_12610
tcggcacgagcagaagctaggaaaatatttgattctatgatcggtttgggccaaaaaccggttgttactacctacagtattctactgcatgggtatgctatggaaaaatcttttcatgatatgcattgtctcattgatttgatggttcaaaatggtattgcaccaaatcatcctgtctacaacatactcatatctgcatgtgctcaagaagaaatggttagtgaggtaatgcatatatttacaaaaatgcggcagcaaggattgaaccctaatgtagcgaactatggagtggttgtaaacttgctttccaggattggccgaatggatgatgctatgtccctattcaatcaaatgataactgaaggattagctcctgatatcatagttttcaccccccccggctcgtggtttctgttcttgtggcaaatgggagaaggttggtgaactattttctgagatgttggatcgcggcatctgtcccgacacagtgttcttcaacacaattatggaccgcctttgcaaaaatgaaagggttatggaagcccaagatctcttcgacctgatggtacacatgggtgtgaagcctgatgtatgtacttataacacactgataggtggatacttgtttgttggtaagatggatgaagtgagcaagttacttgacaatatggtctcaattggcatggaaccagatgttatcacctataacatactgattgatggttactctaagaatggaaagatagatgatgcattggttgtttttagggggatattggaaaggaaggataagccttctgttatcacttttaatattatgattggtgcgttgcttaaatgtcgcaggaaggaagaagcaaaagatttgtttgacggtatctgggccaaaggattagttcctgatgttgttacatatagcttaatgatacaaaaacttatagaagaaggttctctacaggagtctgatgatctattcctttctatggagaagaatggttatcctgccaattcctgcatgctaaatgctatagttagaaggttacttcagaaaggggagatgcccagggctgggacttatttgtctaaaattgatgagaggaatttcacccttgaagcttccacaactagcttgttgactgcacttgcttcagtggggaaatgtcaggaatataaggggttactgcctgaaaaatatcattgttttctggaacagggcactgattgaaaccttttctagagatttttcctagatgttctggagtgctaatcgagggttgaacttctctttgtaggttacttcttccaaccttttctttttttagtacgtctgaaatgtaataatcgttggagaaactgtagtaacttctcgactgtcaaccctttctagagatttttagacttcttccaacaagc

SEQ ID NO: 12611 - DNA, 796 bp, Triticum aestivum
  Clone ID: PAT_TA_12611
gcacgaggctctttcccctcttcctctctctcgcgcatccccaccctgctccgacctgcccaagctccaatccagctcggtgcggctctttgctagactccaaccacactgcgccatagatccgccggcgcctttaccgttcccgttctacctcatcgcgcacctgctgtcctcaccccgtccgcgatctaggacattgattttggagctcctcatagccggcagatggacgagatatcgaccagtgaaatcgttggcgtccatgacccgcgtgcaatagatttttacgatctacgcggtgttgatgaagccacaaaggaaaagaaaaaagaacagcagaggatgagagcggaacgcatcaaaacgtccggcttaagcataaaaaaaaaacgcttgaggaagcaacgtaaaagagaggaagctaaagcaattgtggacagggccctccagttaagagaagagatgtatcaaaaaaggctcgaatttgaggcatcggaaaagggcaaggaggagcaggaaaagtaccgcagcaccctccctggagctggaggccggcagttcccattactgaagtcactaaccaaccaccagctttcgaatgggttccatcttttgacgttgataagtttgggagaatatctgtactgaagtgtacaagttggagagtcgaggaatacacattggaacttgctgagtgtgtggttggacttcagacatttacagaagacaagcatcttttctcttgctctggaacaataggtagagtttcaaaaagggagttggtttgtgggaaaca

SEQ ID NO: 12612 - DNA, 1376 bp, Triticum aestivum
  unsure (1)..(1376): unsure at all n locations
  Clone ID: PAT_TA_12612
gtctcccccccccagcctcccctaataatccccacgtccgaccaaaccctaggcaaaatccaccccctccgcttccttcgctgctaagtatatcccctgagctccgaatctcctaccgggttgggtctcgtagtcgttggatgagagcttgggacagtggaggagcatgacggtgatggagctcaaggcgctaccgctcggtttccggttccaccccaccgacgaggagctcgtcaggcactacctcaaggggaagatcacggggcagatcaagaacgaggtcgaggtgatcccggagatcgacgtctgcaagtgcgagccgtgggacctcccagataaagctttgatccgctcggaggatccagagtggttcttctttgcacccaaggaccgcaagtaccccaatggaagcaggtcaaacagggcgacggaggctgggtactggaaggcgaccgggaaggacagggtcatcaagtccaagggcgagaagaagaagcagcatatgattggcatgaagaagacccttgtgttccaccgaggacgtgccccgaaaggggagcgcactggttggattatgcacgagtaccgcaccaccgagccagagtttgagtctggcgagcagggtggttatgttctctaccgcctatttcaaaagcaattggagaaaactgagcgctccattccagaggaaatggatagaagtggctactctcccactccatctcgttcaactcctgacaacatggaagcaaacgaggaagctatcacactcataaataaggaatctcctgaatctggtctgcatggatgtccaattgagttgccaggtaccattgatactccgggcacaccagttacaaggtggcttgcagaccgaaatggcaattcggggatagatgaagcaaatgttttaggcatgccttttcatggtaatgtcgatgaaagtccgaaggctgatatgccggttggctctttggctcacctaattgattcacagacgaaaaatctcgggtctcatgaatttgcaaccgtttccgcccccatgttatcgcttgatgatgtggataagcttctacttcagttacctcataattcagtggaagatttcttgaatgaaacaattgctgatccagatgagcattcatcaactgcatgtaaaggtcagtatgattcagacactgtttttatgcaggctcanggntgaggtgctatatgaatggtccaaaactgggtttcggtaaattnttctgtcaagattgacaacaaaatcccggcaaacaaaagtgggaattattaatgaagaaatggcaaacatttggctttccctttaatgggcacctaaatcccccggattgtaaccttttccccatgggaac

SEQ ID NO: 12613 - DNA, 591 bp, Triticum aestivum
  Clone ID: PAT_TA_12613
cgtctgaagccgcgtgggctggccatcaccagatcttagctcatgctgctgctgttgatgtctacagaagaaaattcaaggctaagcaaggtggccaagtagggtttgttattgattgtgaatgggcggagccaatgtcggacaaaatggaagaccaggctgctgcagcacggcgcattgactttcaacttggatggttcctggacccaatatactttggtgattacccagaaagcatgcgccagagagtgggcgaatatcttccaaaattctcggagaaagaccgtgaattgatgaggaacaaaattgattttattggattaaatcactatacaacaagaatcattggcaatcggcctaacccacaaccacaagagatccatttttatcaggttgaacaaatagagagatcagaaaaatggagtagcggtgaagcaattggtgaaagagctgcgtctgagtggcttttaatagttccttggggtattcggaaaacaatcaattatatagtaaagaaatacgaaaatccaataatatatgtaacagagaatggcttggatgacgaagacgatccatcagcaccagttgatc

SEQ ID NO: 12614 - DNA, 903 bp, Triticum aestivum
  Clone ID: PAT_TA_12614
attcggcacgaggtttggtacttgcaggtgctctgggccctcgccgcagcgccggccctgtgccctggccctcccagggttttggcgcttatagattttccgtatcttggtcacggatatttcctgatggcttagggacagagatcaatgagcaaggagttgcgttctatagcaaccttatagatttcatgattgagaaaggtattcagccttatgcaactctgtatcactgggatcttccgcataatcttcagaagactatggggggttggctttctgacaagattgtagagtacttcgcattatatgcagaagcttgctttgcaaattttggagatagagttaagcattggataacaatcaatgaacctattcaaacatgcattaatgcttatggggttggaatatttgctcctggattatgtaaaggtgtagctgctgaacctttcttggctggccatcaccagatcttagctcatgctgctgctgttgatgtctacagaagaaaattcaaggctaagcaaggtggccaagtagggtttgttattgattgtgaatgggcggagccaatgtcggacaaaatggaagaccaggctgctgcagcacggcgcattgactttcaacttggatggttcctggacccaatatactttggtgattacccagaaagcatgcgccagagagtgggcgaatatcttccaaaattctcggagaaagaccgtgaattgatgaggaacaaaattgattttattggattaaatcactatacatcaagaatcattggcaatcagccgaacccacaaccacaagagatccatttttatcaggttcaacaaatagagagaacagacaaatggagtagcggtgaagcaattggtgaaagagctgcgtctgagtggcttt

SEQ ID NO: 12615 - DNA, 1366 bp, Triticum aestivum
  Clone ID: PAT_TA_12615
ggagttgctttctataacaaccttatagatttcatgattgagaaaggtattcagccttatgcaactctgtatcactgggatcttccgcataatcttcagaagactatggggggttggctttcggacaagattgtggagtacttcgcattatatgcagaagcttgctttgcaaattttggagatagagttaagcattggataacaatcaatgaacctattcaaacatgcattaatgcttatgcggttggaatatttgctcctggattatgtaaaggtgtagctgctgaacctttcttggctggccatcaccagatcttagctcatgctgctgctgttgatgtctacagaagaaaattcaaggctaagcaaggtggccaagtagggtttgttattgattgtgaatgggcggagccaatgtcggacaaaatggaagaccatgcagcagcagcaaaaacaatcaattataaatagtaaaaaaatgatgaaaactccaataatatatataacagagaatggcatggatgacgaagacgatccatcagcaccagttgatcagttcttaaatgacacaaagagggtcaatttcttcaaaggatatgttggtgcagtcgcacaagcaataaaggatggtgccgatgttcgtggatactttgcatggtcattcgtggataactttgagtgggcgatgggattcaccaagaggtttgggattgtctatgttgattacaagaacgggctctcccggcgccctaaagcatcagccatgtggttctcgcgcttcttgaacggcgaggccgctgacagcaaacctgacacaaactaaacccgcttgcctcattcaccaagggatggcactgacgttcgcggatagtctggatggccattcccggacaactttgagtgggccacatacagtatacaccaagagaggtttggtgcaaggatgtgcattggggacattccgaagcatcagtcctgtacgtggctctcacacccgtcgaagacccaagacggcgcgagctgagccatctcacagcaagtaaatgaaccattatacaatagttgtttcccctgttgttgttgtatcgtactgcgactgccatctactcaaaataataatcgtagcccatctcagatacacttctgtacgggccgcgattagtccattggattgttgaaatggatgtttaaggggccacagttccctgctaataaattatatgagttcatgtcagccaaccctgaaagacaacgctgcctatgtatgtttgctactctgctgctgctgtattagtcctgtaatgtttggccttcatagccccttctaggaagcaattgccagccgccagaaagtgtgtttctcttc

SEQ ID NO: 12616 - DNA, 1265 bp, Triticum aestivum
  Clone ID: PAT_TA_12616
ggttctcttgtgctctgtttattctggtcgcggataataagtagaggttggccccgctgctgagccagcgcgagccacaaatttgccatggtgggtccaccacttccggccacacaattagtttctctaaggtcagaagaactacatcttcagctcaagcaatatgtgcattcaggttagatacaaggtcagagacaattttattgctcgtggcatgggtctgtgttgcggtgtggctcgcgctgggcatcgccgtgggctccgcgcctggcagctctgtcgtctggttgtgtctggaagcccttacccttgttgccgaactttgtcgataatccgcaccctccttggctttgtgacgtatgtggcgctcaatgtgtacattttccctttttctaaaaaacgtatgatttaacaaaaaaaagcgttagggagcaaactggtatggagaaacttcccttttgaaaatgcttctagaaaagacgatatatgaatgaaagataaatacttccatgtattgtcctttttagaagtgttttcataattcagtttaattcttttttcactttgaattgacctaagttttttgtttgaaaaaggaacaatatatagttggttttagtcacttaagcttatccacttagcctatcattctcaagtgcagcaatattttgctgcacattttcaaggatataagagcatgttcattgtgcctcatccagatgtcgttcgccgtcaacctaagaatcgagtgtgtcgtcggattcaacctggcaatgtgtccaggcctaaatagaattcagatagttcaggttcttagtctgtcctttctcaacgctggaacactgaagtagattgagcatagggacattgtgattttgttttcttatcgcttaacttcctacattttaatctgctaatataggtactgacctgccagattccttccattgtaatctatgtgaagaaaaacagtgaatgtttcttgatgaacaaaggtgccaatgcaacgattgcatcagtcatcaaaaggaccatgatgtaaaagttgaaaacgaaacaaggtctcaggcagtgcttagtttcatggcacaatgtttctgttgtttttagacgtttagcgctgttccatagacatagacatgaaatggttacttgtatggaagcaggctcgacaatgtgatgtttatataattggtaaaccaacaagaagtaactggacgtgctctcttgcgtgcaggcaaataatgtgctgcaaaaatagaagg

SEQ ID NO: 12617 - DNA, 906 bp, Triticum aestivum
  unsure (1)..(906): unsure at all n locations
  Clone ID: PAT_TA_12617
acgacctaagcggaagtactatttgcaaggnatcaaagctcaaaaaaacactattcaagtatcttgcacaagaataacttgtcgattgatgccaattcagttacttgcaacactgatagggataagtacaagcttatagaggatttcttcaatttggaagttgctaatgttgaagagtccgaaatatgtgaacaaggagctcgttgtggatacatatttcaagatggaagcgatttaattcaaagagaagtagccttgttgagaagttctcagaataaattgtatgttctgctagttgatatggagcaagatgaacaagaaattatgccaagagttttggggtgctataggcttgaagatctggaaaaagttttgactgggctgggtctacaagcactaagggtacacatggcagatcatacagctcatctattcttgacacgtacttccaaggaagcgcaagatgtactttggctcttgaatctgttcagctttccacagttaaccagcggggtatctttgcaaagttgggagaagatccaagttaaattgctcgagaaatgtatatgtgcaagtttgaagatggggatatttctctactccatgttgatgttttggaagaatgatgctgaagaggaatccctgggttattccgatcccttgttgttactgaaggatcaatatgtgtgtgcattgagaacctacatcagtttgggttgctttcctgatgattcacaccctccatatntctctctcgatgaaatgctgttctatcaacagtattaaggaagtggttgtgggatnaacacgacaaggaatgcttgacattaatccttgcacaaacacataaacgaaggaagatttaacagcagcactggnaatcngcaagaacaagcaagcaagntg

SEQ ID NO: 12618 - DNA, 788 bp, Triticum aestivum
  Clone ID: PAT_TA_12618
gcttgtctctctctgtcccgtcttctctaccgctagcttcaatggtgccggagctggttcttggtgcacctccgacgccgccgctgagcgggactagtggcgaacatgccggcggccaagcacaggcagatgcggtgtcgtccatcggccaggctcgggtcatacacatgcacaacttgctgcagcacggcaatggcggaggcgcttccatggcggacctgtgcttgctggttcagaggaccctccactcaacagcgcggaccgagattgctacgctggagatccgtcgtcagatcgccgaccttagcgaggtcgtcaaggatcttgcgttgcgtcttcgcggccctagcgtgcacgacctcatccgcgtcttgaatgcccgaccagaagcccgccgggccatcaagttgccgatcacctgctgggctgagttcgtggaggcaacagaggctgtcttggcggcggaggagaggcttcggtcgggctcgccttcgccaccggcgccgccggtggcggatcctgctccgtcttcctctccgaagcgcaaggcccctgagcagccggcagctccttttactctggacgactagctgaagtgaagatcgccctggcgcttcgtgatccaggcatccatttccacggtgggatgccttgcgcgtcggcttgtttgttgtggcaacgttggacctgcgtttcattttgggtttgctctgtactaccaagtagtagtcgcttgaactcgtgtttgtttctgcttcggcagcgtgcggtggtgaacgtttcttaat

SEQ ID NO: 12619 - DNA, 1618 bp, Triticum aestivum
  Clone ID: PAT_TA_12619
ccacgcgtccgctctatataacgagtgaaattgggattttataagtgaatgcttcgctgttaggtaaaagcaacggtggatgcttcgccgttaggtagcagcacggcaagatttacagtactattttgtcgagtcagtgctttggatcgaaggatccttcccgcagctgagttccttccccagctgtctagtcagtgctttggatcgaagtcccctccccgcttcttcttaaagcttcgagtcagaatcaatcccctcccccaacgcaaggcagacttcttcttccctcattcgtcgtcctcccaatcaccggatccccgacgcaaccctcgtccgtcacgtcagcgagcaatctgaggcggcggctccatcacgcagatgttgatggaaggaggaatgaacatgttgacatatcccatgtagattccctggatgaacctctactagggaagtctagttatgacggtggcggatcggaagtatatgaccccagaaggcaagacttgtgggatgatgatgacaggaaaaaggaacaattacactggtcatttcttttctcaaatttgattgcgcagtgggcacagtggttagcaaatattattgtaagctccgggtcaatttttggcaggttgtttcccttttcttcggataacgaaaccagcaatccagtatatcttagtcctttgcaggaagaaagattggacaatttaagacgcagattgaaaatcccttttgatggttcccgtattgagcaccaagacgccttgaaacaactgtggaagttagcttacccaagtcgcgagattcctcctctaaaatcagaatcgtggaaggagatgggttggcaaggcactgatccatcaacagatttcaggggtggtggatacatatcattggagaacctcatctttttcgctaggaactacccagcatcctttcaaatgcttctgaacaaagtgcaaggtcaaagagcagattgggagtacccttttgcagttgctggtatcaacatttcattcatgctgatccagatgttggatctgcaatcaactgttccatcttcaaagtcaggatcccgcctcctcgcccgactcggacgtgcggtgtacccgtttgatcacctctattgtgtagcctttcggatgctcgatgcccagtggctcgtgaaacgtgcttcatatatggagttcaatgaggtgatgaaatccccgagaactcagttggagcgtgaactggttttagaggatgtattggcggtcaaggacctaccgtcttacacaatgctggacaaataatagagcttctgcatttgatttgccgtgagatataactgactctgctatgggggaaaggggctcagacagaagggttacttatgatgtgtcagtgtttggtgataaattgtgtatggccccctgttgtggctatatattgttgcatgcagtacattattgaacttgatcatggctaggaagacagtacattacccagacatccaaaatttttaggcgttgtacatgtctgtacctaataataaagggagtattgcttttggcgggacatcatggaaattaccttttaaaggtggacaaattacccattatgcccctgaaaaaac

SEQ ID NO: 12620 - DNA, 816 bp, Triticum aestivum
  Clone ID: PAT_TA_12620
ttccaagccagtttctcagcatggcagataactctctagacatgatcatgtctctagcagttaagttttgaactagaactgttgatcacattgtaattgttcctgctactccaggttcgacctgaattttgtattatgtacagatggtgttggtgtgcctctccataggtttccacctcccagaattcatcttcctattgccacataattacatcttttgtttttgcgacatcaatgtatagatcccctcctccgcactccgatccctgtcccagtccctgcggcaggttgcgctggctccatcccggtgcgcttccgccgacctgagaatatgatgtactttttctctaaagtagtaatgaggattgatacaatgacatgcacaagtatttgagtagcatgtgactaatcttatagccccctcccctgatccatggggcctgcgtgggttgtggtgtcaagagatttagaataggctctttgctctatattctgaaataatagtcatgtgtcatgtatcatccttcggtgatgtttaggtctagatgtgggtcttttcgtccataaaaaaccgtgaagttgtatgtgcatttccttctatgcatctctgcagatatttgattgatgcaaatttcctccttgagttctgacggcaagagatttagaataggctctttgctctatattctgaaataatagtcatgtgtcatgtatcatccttcggtgatgtttaggtctagatgtggtcttttcgtccataaaaaaccgtgaagttgtatgtgcatttccttctatgcaaaaaaaaaaaaaaaaaaa

SEQ ID NO: 12621 - DNA, 587 bp, Triticum aestivum
  Clone ID: PAT_TA_12621
cacgaggatgacactggcaccatgaacttgatgatctttgcggaggaggcggagggactgatcggtatcgcggcagaacttctcaaagagattgccggtgatgacaggtgcaccatgccagatgcaatctcaaatattcttggcacgacccacacctttgaagttgccatggacaaccggagcttgagcttcgtggtgaaatgggccctggacaacgatgagttgacactgctgcagcacagtgggtcagttcagttgacagtaggaggcgacaacaatcatttgctgaaggaagaggactattcgttggtgtctggttgcagctcacaacttatggaggagaagatggtaatcatcaaacaagaaaccgagctgaaggccgtagatgaggcagatgcagaatgactcctttccctgactctcagccgcagctcttcgtctcacaagaacaatatgtgctacatgggcggtaatcagaccaagtacctgttcttttgcttagcttaattctaaacctatgtaaaaaagccatgtaagaaatctaatgtaaatattatgtggaagccacctttgctcaaaaaaaaaaa

SEQ ID NO: 12622 - DNA, 180 bp, Triticum aestivum
  unsure (1)..(180): unsure at all n locations
  Clone ID: PAT_TA_12622
ggacaacttgacaaggnattaccaaacgtttggaagaagagggaccagcaagcctttggtggttgcaaatttacagtgtcagcaaccaacaaaggcttgctggcactgtaaatttgcaaccacccaaggcttgctggtccctcttcttccaaacgtttggtaatccttgtcaagttgtcc

SEQ ID NO: 12623 - DNA, 1106 bp, Triticum aestivum
  Clone ID: PAT_TA_12623
gcgctgggcgagttgggctgggagaatctttcagttgagatctatccccgcgcaataattttgggctctccacctctatctaccaagtgttcttaattcagagaggccaagaacagcacaagaacagcatggtgtagtggtgcctctagtgcattatgaggagtgaggaggtgggatgggcgatggcctgtggtgcaggtgcagatggagatgaaggagagacagcggtggcggcctgaggaagacgccatcctccgctcctacgtccggcagtatggcccccgcgagtggaacctggtggcgcagcgcatgaacgtgcccctcgaccgcgacgccaagtcctgcctcgagcgctggaagaactacctccgccccggcatcaagaagggctccctcaccgacgacgagcagcgcctcgtcatccgcctccaggccaagcacggcaacaagtggaagaagatcgccgccgaggtgcctggccggacggcgaagcggctcggcaagtggtgggaggtgttcaaggagaagcagcagcgggagatcagggacagccggaggccgccacctgagcccagccccgacgagaggggaaggtacgagtggctgctcgagaacttcgccgagaagctcgtcaaggagaggcagcaggtgggagtgggcgcgacgccgctgcaccaccacctcatggcggctcccatgctcccgccctggatgtcgtccaccgctaccaacggcgcgcccgtctctccggcgccaccgtcgccgtccgtgacgctcagccttgcctccgccgtcgtcccgcccccgaccgccgcgccgtggatgcagcagcagcagcagatggcggaggacggcgccgcgttcgggttcgccaggccgccaccggcgccgggcatggtgccggatgctcctcaggcagcgctggcggagctggccgagtgctgcagggagctggacgaggggcaccgcgcgtgggccgcgcaccggaaagaggcatcgtggaggctgaagcgcgtggagctgcagctggagtcggagcgcgcgtgccggcggcgcgaggccgcggaggagttcgaggccaagatgcgagcgctgtgggaggagca

SEQ ID NO: 12624 - DNA, 529 bp, Triticum aestivum
  Clone ID: PAT_TA_12624
cagctacttcaacgccacgtccttcgtcggcaacccaggcttgtgtggaccatacctcgggccatgccgccccggcggtgctggcacagacccgtccgcacacactcatggtggactgtccagtagccttaagctgatcattgtcctcgtcttgcttgccttctccattgcatttgctgccatggcaatcttgaaagcccggtcactgaagaaagccagcgaagcgcgtgcatggaggctcaccgcgttccagcgccttgaattcacctgcgacgacgtgctggatagcctcaaggaggagaacatgattggcaaaggtggagccgggaccgtctacaaggggacgatgccagatggtgaccatgttgcggtgaaaaggctttccacgatgagccgtggctcctcccatgaccaaggtttctctggcgagatacaaactcttgggaggattccgcaccggtacattgtgcgggtgcttgggttctgctccaacaatgaaactaatctcctggtgtatgagtatatgcct

SEQ ID NO: 12625 - DNA, 683 bp, Triticum aestivum
  Clone ID: PAT_TA_12625
ggaggaagtggaagaagaggaagatgatggcaatggggatttgcttggcagtagaggagaggcttctgctcagtgtgctgcttctggcaatgagggtgatcgggaaatgggtggcggagaagaggaagatgatggcaatggggatttgcttggaagtagaggagatgtaggagatggggcgaaggtggaggaatgtgctgttagaagcagccttgagaccatgacattgcaggagtggttcgaccggatggaaaagtacctcccaaggatgatcaacgaggctgctgatcagatgatcgcggagttggaggagaaacaaaagcgagtccatgagtacatttcaacgctcagtaagagctccgacccttcctgaaaattatgtcttagatgctggagattgactagaaaataaactagagtcgctcccgtggtgataatcttcacttactgtagaagaattggtgtggcgtttgtccttttgggtaatatgagtagtttactatctggtattagtttgatatgttgacgtttgctcgttggcttgtaattagcttagcattttggtatgcactgatgtttctgtgggtttcaggaaggtgtgttataatgttgaatactccctccgttttggaacacacagtttcagtaatgaaactgagagcttgtccccttgggaaaaaaaa

SEQ ID NO: 12626 - DNA, 848 bp, Triticum aestivum
  unsure (1)..(848): unsure at all n locations
  Clone ID: PAT_TA_12626
gctgatgcggtggtgctgctcgttggcggccgagcagcgacatcgagtgcgagggtggttcctgtgtggcaatgacgcgattgttgtgcaggagtgtacgggtcagcggaggtgatagttgactttggttggctgcgtgggagtgaaggctctgcttctccaggagaaagctttggctggtttctggccggccggcggcggcgccgcccgtgggcgtcgctatctctcttgggagccccgttgaggagttttatgcaacctctcctctcgggtcaaaatcttcgggcgaaagtcaggatccttctggtggatcggacggcgacgtcgtctctacgttgctttcccttttggggcgccgtctttgagatcttggccccttttgcacttccggcaggctggacgtgcacaacatcgtggtcggtagatgttcgaccggcggtgtgggaggttggcgttgtgacttgtgtggcaacgacaatgatggcgtgcggtgctgggtggtctggtgtgccaatgggtgtgcttttgctggtttagaagtcggagctgtgggcggcggggtcatttggcagcaacgatgactccatgagggcggttttcagcgaacggtgctctccgggtgttgtgctggactaaggtcggtgcgaggccaacaaaatcggagttgtcttgtcctcgacgctgtggtcgactctttggcgttgctttgttgttcggtgctacctttcgatggtgtgtcgtttggttgtgaggtgaacttgtttgtggccaggtcgtccgcgtgtgcctcatgtggggtttgtaatnctaggttttcgtnccgngtttttctctaattaatcgggcaa

SEQ ID NO: 12627 - DNA, 729 bp, Triticum aestivum
  unsure (1)..(729): unsure at all n locations
  Clone ID: PAT_TA_12627
actaggcgaaacagtggtctgagttccagccagtggcagttggagaagatagtctcactgggttcttctcaatggcagtgggcgggttcaccaaggccgaacttgttcctgcgtcactgcggaagcccatcgcttgatggtggccttttctcactggatatcaagacattacagcttgagagggtgcttggatcagagtctagcatgctttacccgtggccatgtaccaactttccaccatttctgtcgacaccaacagtatcaagtgatactcaggaaggtgatgagaaggagatgccggaacaaggtgctgagatgctgcaagatgacgagcccacaggtagccttcacgacgagcgcactgctgatgacgtgaatgctggaggccaggtcggtgtatcaaggacttgaaatggcgctgattgaggttgttgctgcgactgggcagttgaccacaggttgatcatcaatacggtactggtaacttgtggctctgtctgtctttaatatggttatctaacatcaacatggagtttatcttgtgtgccttgatctggcaatgatcggttcgtccgtcaaatgaggtagcaagagtattagcttcatttgtattttactagtttaattatgactatgtggttgtgatcgtgctgtatgcctgccccatgtggcatgaatggaaccagtcaggtactagactataaattaaggagggtaanatcactccat

SEQ ID NO: 12628 - DNA, 617 bp, Triticum aestivum
  unsure (1)..(617): unsure at all n locations
  Clone ID: PAT_TA_12628
gatcgatggcaaaggtgccggcggcggaagccntggacgtccgggctccgccccggccgcccagcgccaccaccgcgccaaagccacgctccccccacgacctcctcgccgagacccgcgcctccgtcgaggaggtcgccgcccgcatactcgccatcaagaaggacggcgcccccaagtccgagctccgcgagctcgtcgcgcagatgtccctcctcctcatcacgctccgccaggtgaacagggagatactgatggaggaggataaggtgaagggggagacggaggcggcgaaggcgcccgtggactccacgacgctgaggctgcacaacctgctgtacgagaagaaccactacgtcaaggccatcaggtcgtgcctcgacttccagacgaagcacccggggatagagctcgtgcccgaggaggagttccaccgcgccgcgccggctgacatccgcgacaagacgctcgccgctgacaccgcccacgacctcatgctcaagcgcctcaacttcgagctcgtccagcgtaaagagctatgtgagcgacatgagaaattggaacaacagaagaacagtttgctggggacaattgcaaatcagaagaagttcctctca

SEQ ID NO: 12629 - DNA, 986 bp, Triticum aestivum
  unsure (1)..(986): unsure at all n locations
  Clone ID: PAT_TA_12629
gcctccgtccgccgcccccctcctcctctgctgcctccgtccgccgacctaggcgacccccatcgctgtcgatggcgcccggtgcggcgaggtcgacgccgcctccctctcccgcaccagaccccacggcagggaagggagcctccttcatcgtgctgcgagcgtggcaacgacaagcactagtagggagccgtgctttttgcctcctctgccgtctcagggtcgtcgtgccaccaccaggctgtggcgctcctactctccgccgccctctacgctgacgagcaagggcgggatccccatcacggcatcctccactccgatggcaggagcggtgctcctcactgtgctggtacaccatgctgctcagatccgtcacggtggactcgatacagccttcctccagatgtttttggtgtcttacgattttgttggctgctcagatgggacgaggctgttagactttttgggcaagaaggaagtagaatgaggcgcactcttaggaatcctctgtcctaagaaagaacatggaaagcgcactcttgggaaaaagaaggaaactacaatctagcaaatgaataaagaaacagaagcttgctcacaaaatttcgcataagtggttggcatcatcactagaagatcttcatagtaacaacacaatcaagtgaggggaggtttctgatcttcagagcattgcaagtttggtgactcttctgctggagacatgtggccctcttcgagtaatgcagattcacaggatagtgctgagtctggtattcaaaagacatcccatgaantatggtaatgtactaatgtcatccaacaaacagctgagcagaaaatgtgataatgccattgtccttattggacatggttgtagccatgagtcaagctcaaacagttggtgtaacttagttgtaaattatgtttattgatgtggttggatgctactgaacaaatgtatgtatgttaaatgtnaaattttagta

SEQ ID NO: 12630 - DNA, 692 bp, Triticum aestivum
  unsure (1)..(692): unsure at all n locations
  Clone ID: PAT_TA_12630
cacacatnccttttccgtacgaaccccaaaaaatactgcattctctttctcgttcacaccttcacacactcgcatgttgcgctcgccggatcccctttctctcttccttgttctctccgttcactccaaaattactgccgcccgatagctccccgtcagcttgcttccttgattcgttgccatgagcttcctcatcctctcctgcagccacccccgcagctcgattcgctggtccggccataggatgaccttcaacgacggctggtttgtctccatgtacgccttctcggtctcctaggctggcaaacggcgatggaggggtagcagggcccaaggtcgagctgcgaagggagtaggcgagatcatccatctgcgcggtgttgttgctatcggcgtccgtgcaggtgatgtgggcatggatttcgtctcgcgcagccagctttgatccatctttagtgtgaggatggtggaaacgttttccgcccctagagcgccagccaaacgcatcctccacatcggcgacattatttgaagttcgaaantagaaaggcaatcttttgacgtaannatctctgaagtgaaattcaaattgaactattttccaacaattagaagcgtggcttggtcatcacctttatttatgtatttaaaaaggtttctcaatccatgctatgtggctcaccatttccttt

SEQ ID NO: 12631 - DNA, 1227 bp, Triticum aestivum
  Clone ID: PAT_TA_12631
cagacgcgcacgcgcacccccgctatttcaagcccgcacatttccgctgcgattccaccactcgccgccccgccagcagccaccggacacagagccgtagccgatcgcatcaccgcgtagtggtggccgcggagcaaccggcgagcaatggaggcgggcgtggggttggcgctgcagtcgagggccgcggggttcggctccggccgccgccggagcgcgacgtacggcggcgagagcggggctcggacggtgagcttgcgtgccagtgatcaggtggggtcgccggccgccgtgcgggcgcgcgtggccaagcccgtcgtcccgctccgcgccaagaaatcgtccgggggaggtcatgagaatttgcataactccgttgacgatgccctcttgttgaagagaaaatcagaagaggttcttttccagttgaatggtcggtgcatctaccttgttgggaatgatgggttcggggaaaagcacggtcggcaagaacttggttgaagtgcttggtttttcattctttgtcagtgataaattggtcgacctagctgttggcatgccttcagttgagcaaatttgagagattcgcagtgaagcgctgctatgggttagttgcagtagtgtcttggggcagttatcctgaccgcgtcaactggataaagatgatgaagggcctgccgttttgcgaccaggtgactttagaaatacgtggaaagcgcattgctatattgtggaatgtgccccttgcacttccatactcgacctaccggtgaactggggactgcctcgcgtcctcttctagatcaaccatccggcgacccatacacaatggctttctcgaaactcagcacgctcgcggagcaaaggggcgacgcttatgcaaatgctgatgtcagagtttctctcgaagagatcgcatcgaagctgggccatgacgacgtctctaagctgacgccgattgatattgctctggagtcgctccacaagatcgagagctttgtcgtagaagacaccgccgtcgccgacccacaaacggaatcgcaagctcaaaggatacataccttgtaggatatgaatcctttttgtaccatgtagggcgcggcgcggcccagcgcagctgagttattcgttcgttgtgtcgacaaggagaaagctggagtatcccttttctttgtaagctgtaaaatggcggaataatggagctaatacaaagatccttgttggttg

SEQ ID NO: 12632 - DNA, 577 bp, Triticum aestivum
  unsure (1)..(577): unsure at all n locations
  Clone ID: PAT_TA_12632
ggtggctacttnctaccctccgcccaccggcgggtacggnaggaggnaggcggcggcgggtcccaaggaaggcacaaggtggaggaggaggcggaggcggtgcctacccgacgccaccgccgcccaacccgttcctgccctacttccccttctactactacagcccgccaccccagctcaagagcccggcgccggccgtctcgtcgtccgccgcggcgccgctgctgctgctcgcgctctccgggctcctgctgtggtgaggaggacgacggtgagaatgcgaggtagatctgccgagctgacgcgctcagtggatccgttcaactggctggctggctggctggctgcatctgcgctgcagtaattttcgattttatttatttattcgccgctgtaattttctctatttttttgctcctccctcctctctgcttctgtgatttattatgtgccggtatagaactataatataggagaccgtaccaagtgtaaaccaagggcgactaataataaagcaccagtgctgttttatatagatggatctggtgattaagatgttcatgccaaaaaaaaaaaa

SEQ ID NO: 12633 - DNA, 896 bp, Triticum aestivum
  unsure (1)..(896): unsure at all n locations
  Clone ID: PAT_TA_12633
attcggcacgaggcaggcgtccgtgactcccaccatgctgttcagcgaaaaaacatatgcatggatggacttaccgacgaggagagggctatccgatatgctctttactggtatcatgatggcacacggaagcactccatagaagcttttgtttcctgtacgaccgatctccctacagaggaattggttaaggctgtactcgacaaatacaatgaggacaatggtctcgtcggggatctcgcatgtgaactagaagatattgtgagccacaattcatgttttgacgggaaagattgctatagatcttacgatcatttcaatctcaccatgaagactaaaggagctgccaacaacgatctgtactttgctgaagtcacatgtatggacggcgattatgaagcgtatgtgctcacctgtatctgcgtggtcaaacctgatgataatggtgaatgccatgtctgtggagctgacatgaagcaccctgctcatgatggatacaaccgtggccgcccccagaagtcatatggacatggtagacgtcgtgcacgtggagttcctttatttgagaagttatttgacgtgcgtgatgaagtttggctgaaagaagaggaggatagggtgagacgtatgatcaagggaggaaaggaggaaaggcgcaagtttcataccggctagacgatggaggacaatgagttgaaaatgtgtaaaacaccacaactggatgagagcgagatgaaacttttttgaatagcctccatcttcagaacaaccaccacttggtggccggtgttgtattgctggtaaccttggaacctataaggatttaattaaaaaaaaaaaaaaaaattccttgaaggggggggncccggtnccccaatttgnccctttnatggagt

SEQ ID NO: 12634 - DNA, 728 bp, Triticum aestivum
  unsure (1)..(728): unsure at all n locations
  Clone ID: PAT_TA_12634
aaatgctcaccatnaaacaattgttatggggcgaaaagccgacgacaccagcaatagagaataaagtctgaaagaaaggggatgctcagagctgaagataaaacgcacaaacaaggtcccaaacatcctccactaagcccaggcaccatcagcttgcggtagcatcgtccgccgctgcacagatccacatcaaagtaggtgttctccctgagcatcctcgcttcgcgctccatggcactacaatcatcattcttcagcaaggttatacctcaaatctaacatgcggtgtgttggttcattttgtccaaaaacatacatagcaaggttatcacaacaacagccaacttcataattcccagtaccacagctctggatactttaaactattaaggtatataagctgcacaactaatctgaactgtgaatttccttttcgaggggaaagcaccaaaaggcaacagacgtacctgtcttttgcaagctctttcgtctgcactgcaagaagatcctgcctttttatgatcaaacttcaaagcttccaattctctatccctttcactcaacttcctttccagctcaacaatgtacttctctcgttcaccaagtggcgcctgttcaatctggatgccagttttgtttacaacaggaggaaagaccgtctgtgatacttctcatttaaggttaccgcattggcttttggtgaccgttcatcaagtggcgcctgttca

SEQ ID NO: 12635 - DNA, 850 bp, Triticum aestivum
  Clone ID: PAT_TA_12635
cgtccggaaaaaaaaaaggtcggttgcaaaaattatttcgcgagatcagggcggctccgcccccttgccgcagattcgcggcgagaggggaaggcggaggtttccgagccggcggagcccattctccggtagacgcaaggcacgatcttgcggctgtcccccgtcgaattcttgccgggctatatctgaggattgaaggtcgcgcgaggctaggcatttccaccgcgtttcttgtgcagatttcgtcgatttcttggcgctgctgccgagaatccggtgttgaacaggttgcggtggacgaaaggcaaagaggcgatggactactacaacatcctcaaggtgaaccggaatgcctcattggaggacctcaagaagtcgtaccggcggctcgctaggacctggcaccctgacaagaacccgactggtggcgcctgaggctgaggccaggttcaagcagataactgaggcctacgaggtactaagtgatccagaaaagcgtgcaatttatgaccaatacggtgaagaaggtttaaagggtatgcctccacctggttcgcaaagccggaccgccacagcttctggctcaagtggtccaagtaatttccgttacaatcctagtgatccagatgatatctttaatgagttcatggcgagcaacaagccatacacctttgatcaagaccgaaggcgctttcaaccagcacaccggacctcagcagtgaatggtcgaagtgaagcttcttccagttctcagaaggagcctggtaccagtacaagccatctggaaaagccaccgcctgtggagaagacattactttgcactcttgaagagctgtataatggaacaaaa

SEQ ID NO: 12636 - DNA, 613 bp, Triticum aestivum
  Clone ID: PAT_TA_12636
cgtccgctaacttttagcttactcctctgacaactgaaaggccattattcatcagagcggctgaaactaatggtgatcggattacccctttggcacaacgagcgtccgaatttactcagcattatgttctgaatgctgataacgtggctagcctgccaagtaaagatgaggctgaaacctcagaagatgaattaattagaaggatcccaccaagtcaaaagtgtaccttgcaagttcaacgctcaaagcctgaaccaggttgcaggttcatgtatgacaggatggaagaccgatttaattacctggaagatcggattggaaggtcagcaagattgttttctgcaactgggctctgtggacaacctgcagatgctacccttgcttcagaggagaacatgtttgcagttggcatggtaatttgcgatggggaaggtcgtttgaatgaaaaatctatcttgttgcagggcagtgttgagcactccaggggacagcgtgtacgccttgatttgaaggatataaaccagttctcgttgtttcctggccaggttgtgggtattgaaggccacaatcctagtggacactgttttgtcgcatcaaagttgactgattccat

SEQ ID NO: 12637 - DNA, 718 bp, Triticum aestivum
  unsure (1)..(718): unsure at all n locations
  Clone ID: PAT_TA_12637
ttaaacccaatncgcacatgacgcatagtccaacactgcggacacatctaccgactgtaaaatgaaactgggcacctttggaagcctttttctccagctgaagctccctgtgctgctctgcaaagaactcctccgtgtaaacatgggactgaatgtgaaatgtcatcaaccccgccgcccccccggccggtacaaagaatgtgacaaagtcaacttcagacttggagccctcataacattccaatgctattgtctttatagggatatcaaaacttctgatgaaatcgcggtgcttacggcgccacacattgttttccccttctgaccgtggctgtttgtacatcctctcccaccatggattgcgtctcccccactcatgttctccgccccctccaggtggtcccagctgctctgctcaaggcccgcctgtgcacgctgccgttccctccgttgcggcacctcgcccccgaccacccgtggagccaaacacgaacatgggaagacgatcctgatctgagttacgaaacccaccagaagtgccgcttaagctctccgcaaatgtaggcagggtgacatcagaaaggcagcctagggtctgcaacttcggcgcggagactattgatacatggataccaatggaaaaatcaagatggagcaacctctcaagacaaggcgtattctcgatgatgagttcccgaaatgggatggcacaatagca

SEQ ID NO: 12638 - DNA, 814 bp, Triticum aestivum
  Clone ID: PAT_TA_12638
aagcaaccaaatgactgttgtgcaatacttttggggccgatacaagtatagattgaggttcacttcttggccttgtctgcagtctggaaatgattctcgccctatatatttgccaatggaggtatgcacaattattgaagggcagaggttcaccaggaagcttaacgagaaacaagtgactggcatactgagagctacgtgcgaacgcccccgtgatagggagaacagcatacttaagatggtggagcacaacaactattcagctgataagctggcgcaggagtttggaatcgatgttacggataaaatggtcaatgtgcaggctcgcgtgctacctccccccatgctcaaatatcatgaatctggaaaggacaaagcttgtgcaccaagtgttggccagtggaacatgattggcaagaaaatgataaatggagggaatgttcagagatggacttgcttgttcgtttcacgtttgcacattgatggagtcaaaaggttttgtggcgacttagtcaaaatgtgcacgccatcggcatggttttcaatcctatgccagtggtagaaattctctcagcgtctgccaataacatagaaggtgctttgaagcatgcttaccagagggcccataacctccagttgcttatcgtgattctcccggatgttactggccattacgggaaagttaagaaggtgtgcgagactgaccttggtatagtttttcaatgtctcaagccagacaaggtcgaaagagcacacaagcagtattttggaaaagttgcacttaatgtcaatgacaagagtcggtgggagaaat

SEQ ID NO: 12639 - DNA, 792 bp, Triticum aestivum
  Clone ID: PAT_TA_12639
ttttttttttttttttttttttacccagctcgccaaacatcattatgctgatgaaaattacacatgaagatggtattgaccgcttattacacgactagtactgtgcactccgcaaatagcatgtcaagttaacctgcttctagatctcccctacctccctagctgtgtaactatcactacaaagaatacagaacaaaatgcaaaactctcatcagaaaggaagaagaaagaaaatgatatatacaaggaccttcagataagaatggacaggaaaaatactagccatctccctctgaattgcctcgcgtcgctgcagcaccgcagccactctgcaaaatctcatcacatgtagaccgtgttcatgttctcgcgccgataccctttcggatatatcgcaactgaatcaacgcacaaaccacctttcgtatgggtgcagtcaatctgcatcattgaatacttcaggctggtcagctcatccgagttcgagatgacaaaatcacccacgtggtagagaatccagcttcccggtccatctagataatactccgatgtagcctgctgttcgtccgatgttgagagctggaaccgcgtgggtctggcatcccacccatgaatgagctcagttccacaaacccggcgacccatgcgtctgtgcgctcgacccaggtgaagacggaaaaacaggctgtatgaacctgcagggaagcagaaatcaagctccccacccacttcaagccaccaaatttgctgaagataggcaacactatggaatcttgattcctctgtgacaag

SEQ ID NO: 12640 - DNA, 2006 bp, Triticum aestivum
  Clone ID: PAT_TA_12640
ggtcgatgggacagctcaagtcttgatagagatagagatagggttagtccagcggcgccgccctcgcgcgtggggagcttcgaatcgaaatttaggaattgagagcgggagcgggacgggtgagatccagatttccctcctccttcttcctcccttttcccccttctctttatctttatagattattacagaagagagagagagagagagagagagagagagagagagagagagagagaggtggagatcctgattcctcgcttctcctcccggcgggatccgaagtaagatcgatctccaaagttggcccaaataaatagctaccgtactagtccaaagctagcgttggaggaggcagagcacaaagggttggtgatttctcgactcacgtcccaagctaaatcaggccatgtccgagcagcgggatcgccgccggcgccaaacccgttacccccctggggtaaaagaataaaggcctcgccctgccaacaagattgtgttccagatggatcaacttatgcaaatggccaggcaaagacagaggcctcaccctgccaacaaggtggtgccagtcaaacagaggagtgttcagagctaaatcttccagaggacatctggcatcatatacattccttaatgccactgaaagatgctgcgagagctgcctgtgtgtctcagtccttcctgtcttcctggagatgccattccaacctcattctgagtagagaatcatttggcttggaaggcgaaaaggaaacagctagagattttagaagaaaaattgatcatattctgagaaaccactcaggaactggcgtgagaaaactcagccttcggttggttccaaattacaatgctaaggaccgtgattatatcaacaaatggcttgagaaggcagttacaccagggattgaagaactcacccttagtctgcctataaacaacaaatgcaaatacgagtttctgtgcacggttttatcaaatgggaggggagactcgcttcggtgtctttaccctaccaattgttcttttcatcctatggctttgcttggttgtttgagaagcttgacaaaattagagctgtttatggtgcgtattccaggggatgagttatgctgccttctttctagatcttcagctttagagtggctttcacttacgtattgcaataaggtaaactgcttgaagataccatgtcaccttcagcgtctaagttctgtgagaggggaagattgcagcaagctgcgagtgatagagaaacaaagctccaaatctctccagctttcagtttaaaggtggcctcaaggtacaagtcaaacttggaaaagcattgcaagtgaagagcttatacatgagcagcaccgtatttggttgtaacactcgagcagagctggcgtccagcattccaagcagggagatggtcaattcaccaatggtgtctagcaaactcaccgacctgaaatctatgatcatctgtcttggagaaatgtccttttgcctgagctttgattgtcagtctatcgtttctatccttggtgcttctcttacattggagactttcatctcacatgtatctgatgaactcatgcagcatgccttagtttttggagatccctcaagatcgtggatgttggacacgagtggcggcgtcgtgtccccattgaataagagtctgattaagctagcatgtcatgtcctcagggggtggttgacttaaacatgtccccgttttgggagtgcaacgactgtcacaggggcatggtaatgccaaatgccatgcataaagccctttgcagctgaaaaataaactaagtgcaagtttgcctcctgagttttttaagctttgtgcggttggtcatggtgttgaacattgatcttgtttataaagtttgtagctggatcttgtttacttaaaccaccggaactgctcattgttaaattgatgtggttagtctgtaaaattcccccaaaaggaagtggtgttaaaaaaagggaccccgcttgtt

SEQ ID NO: 12641 - DNA, 691 bp, Triticum aestivum
  unsure (1)..(691): unsure at all n locations
  Clone ID: PAT_TA_12641
cntgggggcnggggttantacngactccatttttaggggnggaatttggggtaccncggcccccccccctttttttttgccaaaaaggggaaaaaaaaaaccnccaaattgcagtttgtccattaggaatctttgtttcaaaaagggggcgnggtttcttaaatnggaantagggatatggcgcgggctcttttgcgttttgtcccgccgtgtcttctgcgtatccctccccaaaccgcactgtcccaactcctgtaccccttcgaaccccgttctcctctctagtctcggtcgtctacactaatggaacataagggaaaagccgtccaaaacaaggggtaacctggcaaggcctacgccaagccgcaaaaccacatgtatatgtagccgctatttgtggctaaaccttccgacctgtcatccagtatccaacaagaacagataacaggaagacgaggagcacaaacgtacgtgagaaacccccaagagactgccttctctcgctaagctgttccagctcttgttgaagcttcttgttttcagctacatatttaacaacttctgacttaaccgtagacgcgtccttgtcatgtgaagcttgtggtccagatgcatattcttgcctagatgcagcatcgatcatggattgcctaaacacttcatggtcganctncatatctgcaatctcttc

SEQ ID NO: 12642 - DNA, 1753 bp, Triticum aestivum
  unsure (1)..(1753): unsure at all n locations
  Clone ID: PAT_TA_12642
ccccgccgcaccccgcccccccggccccctcccccccctcaacttggcgcacgtccgcctcctcctttcccactcccgctgccacccgcagccccatcgcctcctcccgctcttccgcttctccacctccaactccggcgaccccccaccgccgaccatcaagcccgtctcctacgccccgaagccgcaggccccacccgaggaggcctcctcgccggatgcccggagcgctagccccgggtggcaggattcgcctcccaggagatttgagcagcagccgccgaatccgccgcggcagtttacgcggcaagaggtgcggttcgtcaaggacgcggggcccgcgatcgcgccggtgtcgtacccgagcagggttgcgccgctcccggaagaccgtccagcggaagatggggctggggaaggggtgaatgagcaggatctgcgcggcgaggcggagcggattgagatgaatgctgaagcggtcgaggaggtccatcttccggcagtgccggtggaggaggtggcggtgccgtacctcccgctgacccccgctccgtagcttccgcacggggtcacaaatgatctcgttggttctccccgccaaatcaagacaaccgcctctgaggctcagcagtctgtcgtgtgtaatcgcaatgtaatattgagttcattaccagagaagaatatattattttcgcttgcggggcgtgacttgacttggccgcttggcgctcgcgcatctgagtgatcagtgtccactaggaagtaaccggtttttgctgggcttatgttagtatagttagcgtatttattgcagctggtgtgatgcagttctaggtcgtcatctcatccagctcgtgctcccggcaagtgcatagcgtccccgttgtccatgcctcggctttcaaaggtcgctagaatattgggtccgcgtggtttgatgccaaatcctaagttagggtctgtgacaaatgatgtttctggtgctgtcaaagcggcaaaatcaggtcgtgttgattttaagatagataaaactgctatagtgcatgttggccttggaaagatcaatttttctgaggagagtttacgtgaaaatattggtgctttcgtaaatgcacttttacttgctaagccggtgggcctaaagaaaacttcgaaatatgttggatacgtgaagaagttcacgctgagtagcacaatgggacctggatttcctgttactataccgtcgctatcggcagctgctgatgactatagcaaggcgcatgtgagctaagtatgaaacaaatctgaacgaaccattttattttgggggtacttgcaaccggttcctttcaaatggctggcctatcgcagcggagcatggcgtgtgataaccaggctgagcagttggatgggttgctgttctgacacgcccggatgatacttttgtggtcaaaaactttgagcaaaccgtatctcgttaaattccgcacggtcacacaattatatggtttgttttgctggcccactcatgtcatactccttggtgctcaccagtttgttatgtgcaatcacaatgtaaccttgagttcattactagagaacttttttttttttgtcttgggcataactagagaagattgtagtagttggcatctgagtgatcagtgaccactaggaagtaaccagtttttgctgggcttatgttagtatagtttagcatgtanattgcagcgggtgtgatgcagttcgaggtcgtcatcccatccagctt

SEQ ID NO: 12643 - DNA, 682 bp, Triticum aestivum
  Clone ID: PAT_TA_12643
gcggcatggcaaggtagtgggcactcgtgaagtgcaacatccttgctcaacatcaatcttggaactacttggcactaaggcatgcggaagttccggaaaaacacgccctcgtcatgccgagctccggggcagacgctcctcgcggacgggaccacggtcgcgccgtcgtctgcggtgccccccgcgcggcccccgagcttcttcacggcggtccccaagcaccgccgctccttccctccccccaccgccgcgccccgcaccccgccacccccccccccctccactcgagttcgacatagagatggacgatgacggcttcccaggcaagctgggcccgaggcaactgcgtgccccacgctgcgaatgaacaggcgattctctcggtcgtcctgctcccgacggcaggcgaggcaggaggcggcggatctggccgctcctcgagcgtggatccggcggtggcggacggaatcgaggcggaggagaacgaagccgacgaagaggtggtcggaggcggcgagctccaaggcggggtggcaactggctggcctgctggaggcggctcggggcagaggagcgctcctctcccagcgccgtcggaggtggcagcgaggcagcacgggccggctgctcccaacgaggtgaagagaaaaggggattttgctttgagtatagagaaaggggc

SEQ ID NO: 12644 - DNA, 1470 bp, Triticum aestivum
  Clone ID: PAT_TA_12644
cggacgcgtccgcacacgcatccggcagcgctcaactgcggcagctaaaactcgattttatccccggaaaatagatcgcctctagtcagcggcggcgccgccgcttcgcttctcggcttgctcggctgggtttgctgtaaaaatggtcaatgcacagatggtgagtgggtacttggacaattcgttcaatgcactcatggtttctggtggcggtgagagtggacagacacagaatggtggcacggacaccaccttgtcaggttggaaggacctccccatggagcttctgctgaggatcatatcagtagctggagatgacaggatggccattgtagcctccggtgtttgtaccgggtggcgtgatgcactaggatggggagccacgagtctctccttctcgtggtgccaggaccacatgaatgagttggtgatatcactggcccacaaatttacaaagcttcaagtcctttctctaaggcaaatcaagcctcagcttgaagacagtgcagtggaggctgtagcaaattcttgtcatgatttgcgcgagttggatctgagcagaagcttcaggcttagcgatcggtccttgtatgctctggcacatgggtgccctcaccttacaaggctgaacatcagtggatgttccaatttcagtgatgctgctttgatctacctcactagtcagtgcaagaacttgaaatgcttgaatctgtgcgggtgtgtgcgggcagcatccgacagagcattgcaggccatagcccgcaactgtagtcagctgcaatctttgaaccttggttggtgcgatactgtcactgacgggggagtcactagcttggcatcaggatgtcctgaacttagggccgtcgacttgtgtggctgtgttcttataacagatgagagcgtggttgctcttgcaaacggctgcccacacctgcgttccctggggctgtactactgccagaacatcaccgaccgggccatgtactcgctggccgagaacagccgcatcaggagcaagggcatgagctgggacacggccaagagcagccggctccgcgccgccgcggccgccctcgccagcccggccttgccacactgcacagcgctgacgcccccggcctgtgcaccgcggtagtccacgccggcctggcgatccactcccgccgcgcgacgcacttccccctgagcggcggctgcctgtgcctcaccgccgcctgcactgcgcgtgcgcccaccaccggcaccgcgcccgggccggcagagccatcctgtcaaaccatgcctactgaggtccctccctgtgtggatcatggcagggttcttgagatcccggcatggccgagtttgtatcgtgttgtatcagcgaacgtgaagtggaaccgaaggtgcggtggaagtcggtgtggctgtactctgtcattaactacatgacatataaggcctagggacacgggaaaaaaaaaaaaaaaa

SEQ ID NO: 12645 - DNA, 641 bp, Triticum aestivum
  Clone ID: PAT_TA_12645
ttttttttttttttttttgacatacgagacttatgccgatatacaggggctcttatcagttaggtttattcagttgctgattcatgagatgaagaacacggtggagatggtcagaaacagcagcgagcaacagttggcgagcagcctatgtaagttcgacggcccgcccgaggaggtcggcgccttgcctgcgacggcaggaggcgtcacggtgggagaggtctgctgctcgctcgacggcagcggatcccccgggctgtggtgctgcgacggacccaggggtaccgtcgtgctgttgtcaagatcatggcattcagaccggtaccagcccagcttcatgttctccttgtcaaaaacaatgtggtatccagtcaggaagttctgcccaataattccaatagcctctggtgacttctgaacagctaagcaaaagccagcaatcgatccctctccgtccttgcgtacaatcgtaggattaacgacctgaaagctcttgtttgcagcgaaattaagagttacagttggcacgtcaggcatctccagaggactagcactgtagcagtattcaaaagaatcatcttcctgggttattcttgaggcattaacttgtctgtcaaactcgacagtgacagccttgtaaa

SEQ ID NO: 12646 - DNA, 1070 bp, Triticum aestivum
  Clone ID: PAT_TA_12646
cgtccgcggacgcgtgggggcgtatggaccttggtggcaaggccctcacaaactatctcaaggagcttgtttcgtaccgatcccttaatgtcatggatgagaccctcctcattgatgatgcaaaggaaaagctatgctttgtatcccttgatgtccctcgtgatcttcgccttgccagtttatcattcaaggacaacccatttagatgttcttacattctccctgatggcataacatacaagaaagggtttgtcaaagatttggatgaagcacgtcgatactgttctctgcctgttgaaggagaattagataaaaaggatggtgacagtgacacagtcaaggatcgaaaaaagcctgaactaagtcaaaatgaatttgccttgaccaacgagaggttccttgtcccggagatgctttttcatccaattgatctgggcatgaatcaagcgggccttgctgagtgtattgttcgtgctgcacaagcctgccatccatatattcaacctgtgctttatcagagcatcatcttgacaggcggaagcacgctgttccctcggttcgctgaaagattgcagagagaacttcgacctcttgtgcccgaggagtaccaggcgaagataatctctcaagagaacccgatccttggtgtctggagaggagggatctgtcctggcgtccagccccgatttcgagtcgatgtgcgttacgaaatcagagtacgaggagatgggggtcggcacggtgccgccgaagattcttccactggaagagttgctcagtagataggacaatgtagcctgttttagatggcgtgtttagcaagtggcatgcgatttaggggtttctcttctgcaaaaggtttatcaagttcagtatttgcactagacaaatttaactactgcttggttggccatggcccatgaggttgtcttccccatgcaccccatgacgcacggaatgcagcatatctatttgttatgaatggattcagttgtgggtgggtggatttagcatctgggaatttcagattttcctgaggattttctagtcaaaaaaaaaaaaaaaaaaag

SEQ ID NO: 12647 - DNA, 799 bp, Triticum aestivum
  unsure (1)..(799): unsure at all n locations
  Clone ID: PAT_TA_12647
aggtgtacatcattgcaatacaggaatattatctcacaaacagaacgataaaagtttttcttcttcagggaggattgccaagggcaccaagaactgccaggattttagtccactaaatctagacatatatgcctatgtcatgccaacaaaatagatgcatctgctcaaaatttcagagtcacaacgttgcatatatacctcaagtatcacgcactgcaaacaccctgacgcagtgatcagatccacaagaagccagctcgattgctgctttctcatcagccgagtcgggtttctgccaccgcaaacggtgcacagttgacacatgacacaacagaggatccaaccggagcatgcatgcgacgctgagggggggcggatctgagctactgtctgaagcagctctccccncctgaaacactccagagctcgatcagtccattgtccatgccaacagcaataatgccggcattacgagcacggtcacggcccgtccaggccaatgcggtgacactctcacggaactgaggcaatgtggcgagcagcttgacggaagatgcatcttgaacacaccatatcttgacagtcttgtccctcgaaccagttgcaaattcatacccaaaagggttccacgagcatgcccatatgattcttttgtgcgcttcatgctttgtaaccaggtgatgctgtgctccttcctcagttttcttaattgaaaagacagacaagtgacaatgcttttcttctgagcgtatcaagggatcgtcacttgtctgtcttttcaatttgtgcggacgcgtgg

SEQ ID NO: 12648 - DNA, 799 bp, Triticum aestivum
  unsure (1)..(799): unsure at all n locations
  Clone ID: PAT_TA_12648
cgtccgcccacgcgtccgctgaacgacgacggatccggcgggatcctcctccacatccgtcccccgtgcctgcccgccggttggatcctcctacacctcccattcctgtgctagccggtcacggatccggcaagatcctccacccctctcctcccatgccttcctggagacggatacggcaggatccccctgcagctccttcctctacggcggcgtcgagctctctgccctcccctagaagccgccctcccctctcgccattccttcttcctcctctccccgcaaactacctccggcgaggtctagtgcatgtccatccccggcagctcgcgtacagtttggccaacgatggcgtgcagtacgatgtacgatggcatgcagttccgcgactttccctggcatgcaatgccactagcgtgcagtgcagcttgctctggcgtgcagtgcagctcgccctggcatgcagtgtagctcgtccatgcatgcgggcaccctcacctgtagtttctctccttttgtagcctactcttagttgtgccatattatttccaaaaaccgaatctctgcaactctacgcttacagattcccttgtggcagctgctgggattatcgcccaagaantgctggtgatgttcgcatgattgatactgcatctgacaaggtagatcttgccttggactgttttgctgggagggtgaactggataaaggcctacatgggtccaacttgtcctggcaaaaaaagattgntgtaanatgcaacaacgtaatgntggnanaacaaaacgtnnggatttcc

SEQ ID NO: 12649 - DNA, 623 bp, Triticum aestivum
  Clone ID: PAT_TA_12649
tttttgcaacggcaaggcgttcccggagcacgtgctgcagtggatcgcgctcaacttcctgctcgcgggccgcgacacgtcgtccgtcgcgctcagctggttcttctggacggtcatgcagaggcccgacgtggagcgcaaggtgctcctcgagatcgcgtccgcgtccggggagacgcgcggcgacgacacgggtaggtgggcggaggagccgctggacttcgacgagctggaccgcctcgtgtacctcaaggcggcattgtcggagacgctgcgcctgtacccgtcggtgccgcaggactccaagtacgtggtggccgacgacgtgctccccgacggcaccgtggtgccggccggctcggcgatcacctactccatctactcggtcgggaggatggagagcatatggggcaaggactgcgtggagttccggccggagcggtggctgtcggcggacggcagccgcttcgagcccgtcaaggacgcgtaccgcttcgtggcgttcaacggcgggccgaggacgtgcctcggcaaggacctcgcctacctgcagatgaagttcatcgcgtcggcggtgctgttgcgccactcggtggagctggtgccgggccaccaggtggagc

SEQ ID NO: 12650 - DNA, 964 bp, Triticum aestivum
  Clone ID: PAT_TA_12650
cttcttccccaggtccgtaccctcttcttttgggggattgtccacctttccttgtggccattgtccgacatacccacgtggccatgggccgttattcctccgtgtacttgggcggttgcggcccggtaatcctccccccgtccgggcagtcttgtccccctccggccggtatctcgtctccttgtagtgattgttcctggacttgtttttccggtcggtcgaggacatgtctttccggacggccccggccgcccccgacggcgtttcccccgccgcccgcgacctccatatttccctctccgtcctcctccccgatcaccacccctcccttgtcccccgtcataccccttcgcaaggcttccgtaatactacatcgcaatgcatgaacttcatagaggctgaagttaagtatcccctcgagcctgtcattacttttggaagcataggatgggaacagacggtactgactctacttgtgtgcccttcaagtgttttaatacaactatttgtctgcaaatcccaaatctttggcagtcttatcatcagatcctgtaattaaaaattgcttatcgccacgagaaaagtaatcccaaacatctcactttggatgtatggccagcccaacgtgaggttagaacggggagaatcaagactccaaatcttaatagtcttgtcctgggaaacactagcaaaaatagttgcatctttggtattaaatgctatttggtacacagaacctttgtgtcccttaaatgtctgagcagatttccggccctttttccagtcccacagctcaatatcgtagtcatgggatgctgacaatacgtaagtcttagttgggtgaacagccaaagaagtgattgatgcattatgagccttcagattcttgacttcctcccatgtatcataattgtacacatagatccaacctttacgatctccggcggttccagccacaatccac

SEQ ID NO: 12651 - DNA, 953 bp, Triticum aestivum
  Clone ID: PAT_TA_12651
acccctctcgccagtctccagcagctccaacctcaatccatcgcctccaccagcctccagtaccgcgctcccgtcgcaagaggcttcctcgacctctccttcaagcagtgcagaccgaagcctacgcggggcttcgcgccaggagctggctaaccatcagcagtccctcgcggcggcgccggcgccggacgcggagctggccggggagacggaggagcagcgcggcaagttcctcgtgctgcgcctctacgaggcgctcaacgctcgcgacgcgcgccgggcgcaggagctgctcgccccggacctcgagtggtggttccatggcccgcccgcgcaccagcacatgatgcgcctcctcaccggcgccggcaccaacgccgagttcaggttctgcccgcgctccgtcgacgccttcggctccaccgtcatcgccgaggggagcgccggccagctcctctactgggtgcacgcctggaccgtcgggcccgatggggtgatcacccagctcagggagtacttcaacaccgacctcaccgtcacccgcctctccgccgcggcggccaccaacaacgccagcgcgggctcccctagccactcctcctcttcctctgcctcttcctccccctcctcgtccacgtcctcgggcctctcctcgccggcgcacacgcccaagtggcccaagtgcctgtggcagagccgccgcaccgaccgcgcgcgcaagtcgctgccgggcctcgtcctcgccatctaacaacagagcctacgcctacgaatgagtaaactagaaatcaaaggagttgctttgcgtgcttgaattagcagcgtgatttatttggtctagatcatggattatggtgtgtactcctgctactggggcttgctcttgcagctgaataaaagtatatcgtattggagcctcaggcaaaaaaaaaaaaaaaaaggccccaggggaa

SEQ ID NO: 12652 - DNA, 1043 bp, Triticum aestivum
  Clone ID: PAT_TA_12652
gctcaacccagcgcctccacccgcctcatctcgttgcccctcgccgacacgaacgtcgcttccaccagctggttgcgatcaagccgtcgtcgtcgccgcacccttctcctccacctactagtggtcgagccccaggcgctggctcgcctggctccccctgctgggcgtccggccggaggggggggcgaaaagcccggggggcactgcctcacctggactccctgcagggcggcttcgcctccgcgcgcgggcacgagaccgaggagcatgcgcaacaagttcctggctgctccgcctctacgaggcgctcaacggccgcgaccacgccgccgtgcactccctcctcgcccccgacctcgacgtggtggtcccatggcccgcccgcgcaccaagcacatgatgcgcctcctcaccggctccacgctcctcctccttccgcttccaggccgcgcctccgtggaccgccttcggctccaccgtcatcgccgagcgggcgtcctccggccggccggccgagggacaccaaggggcggcctactgggtgcacgcctgggacccgtcgggctcccgatggggtgatcacccagctgcgcgagtacttcaacacccgacctcaccgtcacccgcctcgccgccgccgccgcgtccaagtgcgtctggcagagccgccgccccgaccgcgcccgcaactccctccccggcctcgtcctcgccctctagccgcctgagccaagccaaagccaagctggacgacgcccacaaccacttgggcgtacgcatgggctgacgttgcttcaattcttcttcatcctctgctttccctggcctgttgtttcttgtttgcgtgtctggttgaacgtacgtagtatagctgaatagccgatcgaaccggccggtgatggcgacgcggcgccttcacggcggctgcgtcttcactgctgctgcttgtatgtcttcgtggttgctgtcatggtgtgataataataataaaggaagttggcttgtactggacgtaatttaaaaaaatcttcaccgcaattcgc

SEQ ID NO: 12653 - DNA, 808 bp, Triticum aestivum
  Clone ID: PAT_TA_12653
cgtccgcggacgcgtggggtagggagcgcaagtcactccaatttgaggatccaccaatcagccaaaattttcaagaatcatcctctcctaagatggcaaaatcaccttctcttcaaagaacacatggcatgcttcagttttggcgatcagacaccaccagaaattcccatgattcaccaaaggatcgaagcccacctccagaacaaactacagataatggaatacctttagttgcaactgaaagagcaccgtccatcaagagacatgacagttttgaaatggaattgcccaaccttccgaaggttgacatccatcccatacaacggcaatcttcaaagaatgcaggacctgactcgcctatatctcctcttttgacttctgatccaaaaaatgagcgttcacattcacaaacttttagtagaccacagagtgaacgtgatgatacaagttccgaacagagtgaacctgatgaattgcaacatcacaagccaccatcattttggagactggcagcacttagcattgctgaatggccttatgctctcttaggcacaattggtgctgctatatttggctcattcaatccactgcttgcttacacaatagcacttacagtgtcggcatattatcaaatagaagttagtgacatgcaccatgaagtgaacaggtggtgtttattcatagtaggaatgggtgttattacagtgctggtcaactggttgcaacatttctattttggaaatatgggggagaagatgactgaacgtataagaagatgatgttctccgcaatgctgcgcaatgaggct

SEQ ID NO: 12654 - DNA, 889 bp, Triticum aestivum
  Clone ID: PAT_TA_12654
cccgcgggtgctgtgatcgtcgccgctcaggtcgggggcgcgtggcggtggacgtcggccgcgagggcgagatctccccgcgcggcctcggagtaggccagccggtcagcgcgcgcgcgcgtatggaggggagcggcaggcaggggaagggcggggcgccggcgtgggcgcccagcgagggcacggtgttccggcccttcgtcgcggccgcaggggcggcgtccgcgtcgccgtcggggtcgggcagtggcgttgccgcacgcataagcaagcttcatggggtcaagaggaaaccgtgcgttgcgaggctaacggcggacatcattaacacttttgaaagatgccaccctgagtttaagtactcagagacactaaacccaaagcgctttctcacccatccttcgaccccagcccacaatgatggagttgacaatgcaaattgggacctcatattgtatgtcaacctggagttggttaacaagacatcaaatcggaggttcattgtcaaggaaatgcttggccaaggcacgtttggccaagttgtgaaatgctgggacacagaaaccaacaagtatgttgctgtgaaggttataaaaaaccagcccgcgttttatcagcaggccatcatggaggtttcactgttgagaacgctaaatcagaaatttgatcctgatgataagcacaacattgtccgaatgctagattatctctcattccaaaatcacctgtgtattgcctttgaaatgcttggtcaaaatctgtatgagcttttaaaaaggaatcatttaagaggattgaaagtgcaatttgtacaggccttctcaaaacagatattagatgccatgatagtgatgagagatggtggcatcattcactgcgatctgaaacc

SEQ ID NO: 12655 - DNA, 1626 bp, Triticum aestivum
  Clone ID: PAT_TA_12655
ctggataatgaacttttggagtacggaggctccgatttggttgcttttcttcagagtgctggtcgtaagcatcaagaagagcgtccgggggctcctaggttggatgatttaggtgcacctatttctactagccaaacgaagtatcttgagctcctagcaaggtactatgttctcaagggggagcatgttgctgctgccaggatgttattgatattggcagaaaggcagtgctccaatgccgaagaagctcctgctcttgatcagaggtatcaatatctgagcaatgctgtgctacaggccaaaagtgcaggcattgctgctgattcgtcgagaaatcctattgacagtagtacagtggatctacttgaaggcaaacttgcagtgcttcggtttcaaatgcaaattaaacaagaactggagtctatggcttcacggcttgaaactatcccaggcagttctgaatcacccagcgacccctttcctcgtgataatgttctagctgatgcagaatctgccaaggaggccaaggacaaggcgaaagagctttcactgaatcttaagagcattactcaactatacaacgactatgctgttccatttaatctttgggaggtttgcctggaaatgctcaactttgcaaattactctggagatgctgatagcaaaattgtccgggaaatttgggccagactccttgaccaaacactgacaagaggtggtttagcagaagcatgttctgtggtgaaaagagttggctcaaaactagatcctgcagatggagcttgtttacctttggatataatatgccttcatcttgagaaggctgcgttggataggttaagttcaggacaagaattagttggtgatgaggatgttgcaagagcccttctcggagcctgtaaaggtctagccgagcctgtgcttgctgtgtatgatcaactgttatcgaatggcgcaatcgtgccctcacttaatctgaagctgcggcttctgagatcagttctcgcaatccttcgcgaatggggaatgtcggtcattgcccataagctaggcaccacaactgctggggcttcgttctttttggatggaacattttcgctgaatcaaacagggtctttgcagaaaggtgttcgagataaaataattagtttggcaaacaggtatatgactgaggtgaggcgattaaatctcccacagaaccaaacagataatgtgtaccgaggtttccgtgacctagaggagaaattgttatcaccttactagccattctttatttgtcctcaacattgtaaagtgtgggatgcgcatttgttgttgtaccaagtatgggaataaagccaagacaatcttgattcaactggacattgatctctcatacgctgtttatccatgtagtggaattttgtgcaagaacccaggagggggctcatcacggatcaaattgtttgtacatccttttatatgtcaactgttgcctgaattttggaaacagagcagtctaccttgtttctttgcgcgtctcgaagatattggattgttactgcattgtttccgtagtgatgaggttgtacagttctgtagttaaatgttcttcaagctagttgtttcaaaaaaaaaaaaaaaaaa

SEQ ID NO: 12656 - DNA, 647 bp, Triticum aestivum
  unsure (1)..(647): unsure at all n locations
  Clone ID: PAT_TA_12656
tncctgttgatttatttgacgcactttatnctgtgctaacttatcccttgcctggcacgctgtccctcgttcgcttgcctgcacaagctgccgattcaggagctgtccgctcctctcccgctctcgcccgtccctgctgcctcgctcacggtccaccaggctgcctcgcctgcttcaccatgctttccggatgatattcacctacatgtacacacaagtcgtatgcttcgcccaaaaagtcgaaagtagtaccaaggaccggcgtgatcacgttttcagttgggttctctctgcaacacctgacagccttctcgatcgtgcgctgattcaacttgggtgcggtgttctgctcggtgcggcagcaccaatcctaagcctcttgttacaacccagcgcttggggattcatcttccccgttgatagctccgacgtcggaggcgagctctccattctttcggccgccgcctccttcgccgggcgcgtgggtgcttcgccgctgtccaccctccgattctgcgtcacctcgccctccgcgaacaacaaacaaacatccaaaaaaaataggaagaaaaaaacaaaagaatacctcaaatagttgacaatcaataagggcaaaagagaaatgtttttggaaatttttgggcttt

SEQ ID NO: 12657 - DNA, 1253 bp, Triticum aestivum
  Clone ID: PAT_TA_12657
cgtccggtgatgtacaatgtaatttgatagctgatttatagtgtaattgccatggatttgcactatatcctctagtggaattactgtgtaattcacttgaatttttatagtggaattgcgttgtggatttacagtgtaattgatagctgattttacagtgtaaattcagtgtaattacactgttattggtagcggaggaattgtgactgttcttgtgatgcatcgctggtttgtaagttcttgtgatgcatctgattccagtgtattttcttagaggatttagactgtaattatattcagatttacactactattttcatcggaattccagtgtttttttctttgtctgtgttaacattgcacttagagtgttgttcgctattggttagcccagtcattcgcttgcctcttgtacactgtacttacccctactttacgtagcgtcctctcatggactctatctgtcactcccccaaatccctcccgtcattcgttggtctttatgttctatccgagccgctgtctcctcccacccttttcgagctttcccttgggtaggtacgtgtttaggttatagattaaagtatggggagactcgtgaaggcttttggtaagggcacttctgctgcttgtgttgaagattctgatgattcagatggagatccttttgtccccaatgattttgcggaggatgatccttttcaagcttcggaggaaggtctaatggatgatcctgatttcgacaaagctttgtatgaagttctacgtgtctcataaagagaattgcttaaaacgggaagattaccaaatgttggagctcgcaatgtgaagcgcaagaggtcttctgattttcctatagcaaatacattcactagatactctggcaagctgttctccactgttattggtggcttgtctcctaggcaagttcgtgttcttcagaattacagggcagattgccttctgaaatttgtagtaaatcttagcggttttacatagcaaatgctaattggttttacatagtaaattttagcggttttacatagcaaatgctaattggttttacatagtaaattttagcggttttacatagtaatttacacagttgtttacactgtaattttagtacctccgccccggcctttactgtttttgtaagcgggtttttcagtgtatttttttttgtcattttaatgatttctgtagtgtcaatcttagtgaactttgcagtgtaaatttactggattttaatc

SEQ ID NO: 12658 - DNA, 422 bp, Triticum aestivum
  Clone ID: PAT_TA_12658
tcactccaaaacatgaagttcttaattttaagcaaagggagggagaaaatttaaaagatgcttggcatagaatttgtaatgctcaaaatagatctactaggaagctttctacttccgttcttctccgcagtttttatgtaggcatcactccttggaatagatgtgttcttgatactgttgccggaggtgatttcttgagtagccatgcgtttgatgcttataatgctatgttagatttgtttggcccaccacctcttttggttaatggaacggttttaactttagaacatgtgatgcaacggcttgatattattgaaaataaaatggccactattgagttgattgacaatttggataaaaagattcataatcacattacccaatatggatctagggttggagttactttgaaaaatcttaaa

SEQ ID NO: 12659 - DNA, 1062 bp, Triticum aestivum
  unsure (1)..(1062): unsure at all n locations
  Clone ID: PAT_TA_12659
acaatgagtctgcacttacaccttgacatacaccttcaagcaatcaaaccttagcccaatgcaacagaagcttgcctccgcgcccggttaaacctgtgaatctagagccccaggggaaaagtggaagtggaaataaagtaggtgcctcctctccgggcgccgctgcctcttcccagtgccgccgcctcttcccagtgccgctgccgccatagccccttccccttagatcccaatggggtcggggttgagcaccgtcgatgaatcacctcggcctccccctgtgtcgtctgncggcacagcagaggtggtcgagccatcgaggtgagcagtggtgggcagctgtacggtatgtcctcttctttttctctttcgtcgacgacgcctccgcgccttccagcgtcacctcgccaaccaccaccaacaacaacatagggatcttgtgtggggtggacgacgtcgtcgtcaaggtctaggtcaatgtcctcctcgtccatggagggagggcacctattaaaaccgaaagaattcagagtgagggcctagagaggggcactgaagatggcattctgttgatgaatgctgaacagggacgatcatcactggagattacacttgctgatcaaaaggcagtgatggaatcccttcccctggcatgggtttcataccagtgatggcacttcttcttgcttgttgaggactaatcccagaaatagattatttttcctgaagctcggtgaagcacaacatgggcacggacacatcagtggatctctacacgattgatgtaggttgcatccccttggtgacaatgaggaccccaacaatgcttctcctccttgccggataaatcattggactggatcatggtctccagtagaagcatcctctcacaaagcatctatagtatctctcttttagatgcatgtggtcgtggtcgctgcagcaggcgtcgaggatgcctcaacctcctcttctgtctctacagccgacaccctgtcaagcatccgactgacaggaatgaactggtcaacgggcacatcttcagctgggatgcccacccgc

SEQ ID NO: 12660 - DNA, 953 bp, Triticum aestivum
  unsure (1)..(953): unsure at all n locations
  Clone ID: PAT_TA_12660
gctctcctcactcctcactcgcaagcctcgctcctctccctccgctcgctctcctcgctcggccgcagcgacaagaagcatgggcctctcggtgatcgctccgccggccggcgactcggcgtccccggcgcaccgccgcgcgcgccgcgccttcctcgtgtccaactacatgatcctcggcgcggcgtccgggtgcggcttcctcacgctctcgctccgcctggtgccccccgtcgacggcttcctcctcatcctgctccacgcgctcaccgtggcggccgccgtggccgggtgcgccgtcatcgcggcgcccgacccgccgcggggccgcgtctacaccgcccacatgtccgccaccgtcgtcgtctccatcctgcagggcgccgccgccgtgctcgccttctcccgcaccgccgagttcctcgccgacgggctcaggtcctacgtccgcgaggaggacggcgccgtcatcctgcgcatgatcgggggcctcggcatcgccatcttctgcctcgagtgggtcgccctcgcgctcgccttcgtcctcaggtactacgcctacgtcgacagggagtgcggcggcaaccccatgcgccgcagcgccaaggtcggcggcgaggatggcgccggcaactggccgtggccattccaggtctgatccgcctcaaggatgatgatgcagcaagcaatttatgatgtgtgggaggggtgtctgaaggcgaggaggactgagaaccgatagttcttgggagaaagactagtgtttggtgatattattatttgttgattgggttgtattgtgtggtgtggtatatgattatgttgtactgccgctgttgcacctctataaaattattggaaattcctgttcaaaaaaaaaacctgaaaaacccnttncactgggtaaacaaaagcccacgttgcttcaaaatnccactaagnaatgaaccccn

SEQ ID NO: 12661 - DNA, 1075 bp, Triticum aestivum
  unsure (1)..(1075): unsure at all n locations
  Clone ID: PAT_TA_12661
gcctcctctgccttccgcgacagcgctcccccacccccctccgccgaagctcgccaccccagacaaatttctccccatcagccccgccgtcggcttcttctcccccgtcgcactggactggcgtggagtcgattcggtaggtttgctggcgacgaaccctaaccggctcgcgttctgttcgcggtaatccgagtgttcatttttctccaaggcgttcagttcagtttcttgcgggctcgcgtggcggctgaccttccaagaggttcggcggcgttcggctgggcattgaggaaccatgctcaacgtcaagtccgaacctgcaactgcaatggatgcagtgggtgaaccggaaattgaggagcatgaacagaaggtaaacagataccaagctgaacttgcagcccgcattaaggccaaatacttctctaataaggcttcagacggaggaaaaatctttgaagaagaaactattgttgaaggcgaaaccatccattcaagcaggtggccatgcacaagttcgtatgcgaacccggtaaattttctccgagagaagaacaaccatgagaggagggattctccatcttcagcagcagattcctctgccaagaacgattctccatctgtggtagctgaagcctcgccaaagaataatgcaggtgttccggcaacagaaaacaatctaacacctgccaagagacaggcatccaaggagacctgatgggataacagtaggctggtgggtcgttgtacgttctccagtctgaagtcggaagacgtgcaacaacccgaagcatgcaagtatcatcatgaaataaaaatccgtccagcagatgtatgtaggcgatgcttgattcatttcgtcgaaccggtttcagcgtctgttgggaacagtttttttgtcttatgtctcaaggtatatgctacctgaagcttgtttttttaatataaacaactgccctgcttgtttgtaggcgnatgctacattcatttcattgaatctgtttcagcattacctgttgcgaagaattgttgtattttggatatgttattggtgcttagtatttgnataaaacat

SEQ ID NO: 12662 - DNA, 1158 bp, Triticum aestivum
  Clone ID: PAT_TA_12662
cgtggatagagaggtaacgtgaaatcacagttatctaggtactgataaattcgtatggctccagggctctgcactcttataagaataacgggcagaagaaggcggaggtagctgtgagagagatgctcggggtagtggcatctagagttgaaaaggagacaggggtcttgtgtcattgaagatgaagactacatggatgatggctctgtgctccatttgaagctcacccttgattctcggtcgtggtgaggctacctttgactttaagggcaccagtcctgaggtgtatggtaactggaaatgctcctgaagcaataacagcagctgctgtcatatactccctgcgatgcttggctggatagtagatatacccttaaatcaaggttgcctagctcctgtgaagatcatcatccccaaaggctctttcctttcaccaagcgacaaggctgcagtggttggcggcaatgtgttaacctctcagagggtgacagacgttgtccgaatggcgttcgaagcctgcgcctgctctcagggctgcaggaacaacctgacctttggagatgacacttttggttactatgagactatcggaggtggttgtggtgccctggccgtgctcggaatggtacaagtggtgttcagtgtcacagtgaccgaacacaaggctgactgatccagaacatctttgagcagccggtacccggttcttttggcacaaatttaacatcagagagagccgcgtagggtatggtttccacagaggaggtgatggccttgtaagggagattgaattccgccgccctgttgttgtgagcattctttctgagaggcgggtgcatgctcccaggggactgaagggaggggaaaatggagcccgtggcgcaaactatctagtcaggaaagatggccgcagagttttccttggagggaagaatactgtcacagttaatgccggtgagattcttcagattctcactcctggtggtggtggtttcggctctccttgatggtgtccttgtggacgctcatctgccttgttttctatttacatagaataaagcttgcacatacattatactggtacagatcccagactgttatcgatgcttctgaggcactagagctgaataaatcatgatcattgcttgcttttatccg

SEQ ID NO: 12663 - DNA, 811 bp, Triticum aestivum
  unsure (1)..(811): unsure at all n locations
  Clone ID: PAT_TA_12663
nncntttttttttccgaagatgctgatattcatcggagcagtagcgtntgaagatacgttagcagcagtagcctgccttgttttcancgataaaaacatgaagagtatacagntgttaagcaaaggaaacattgcagaatgnggcccaattccgtcacgggcaatgctgcaggcatcaaggagcagccagcaagcggtgactcagaggaagcctctaaacaacgtgacgaacaatcgtcttgtcttctaataaccgtgtgcctaccataggccggcctcaaattggaggccctgctgcacaaagaatggattaaccaagcaatcaatcagccctaccctcctctcctttctaaacccagtcagtcagcatctgtgctaaccaaaatgcaagcgccntcgtgtagttaacaatgcatctaaacaagaattgagtcctatctgtcgaggttgttagcacctgagcgtcggctaccctaaaccgtatgccaaaacccaggcggcttgtcatccactgcaaatctctggcctgaactgccctgctgctgctgctgctgctgctcgaccagcctgttggcgctacgaggcaaccggatcttcacccgctttggccggacctctgaggaggctgcgtctttagttgcctccgcgaactgctgctgggaacagctgctggcagatggatacaccttcgactgctgctgggaacagctgctggtagatggatacaccttggactgctgcgcggcataactggcgtcgccttgttgagcttccagctgccgcagcttcatcctncangcaatgggaacca

SEQ ID NO: 12664 - DNA, 739 bp, Triticum aestivum
  Clone ID: PAT_TA_12664
taactgttgataaaactacaatgaagtttaaccaaattgtattatatcaatttcaacccattttttactccaaaaggaaactaatacaaattatccataataaatgcaaaaaatcgacggaaccatctgaatcaaggcatttttttacaacatctgaatcaaggcataatgttagtgcctccctaattgatttctgaccttgatgtctcttcgtatattttagtagcccagaaaaagtagtctagacgatctatactcacggccgcccccatgttacatacacacgctacgatgaagacagggcaccagaatagacccatattcgactgcattgacaaagataaggcaacaataaaatagcatctccttcggctctgtgttgttatacaacgggctccattacgtttatacttaatccttaatcctcagctctacctgcagctccacattcaagaaacatcaaaacacaccaaggcttgtgaacaacttttagctattgataacaaaatagcctaagattacacatggtcattgataagattgaataacgaatcttgtgtgttttcttccttaaagatcatgaacagtgggttcagttttctatgttcattgttgattgaatttgcaacttgtctgccgacttgttgaccagagcctaaatgcgctatatggcagcttcgttaggaacttgaacatgaaagaggaccaaaggaaaagtattttttactacatgtatatt

SEQ ID NO: 12665 - DNA, 533 bp, Triticum aestivum
  Clone ID: PAT_TA_12665
ctggattcattcattcattcattctacctccgctccctccccgctttccttcctaatcctaatcgtagctagggttcctccccgcatccgtcgcctcctctcctcaccccgccgccgccggccaacgagatccagccagcgagatccgaccgacgccgtctccgtctccgtctccgcctcgccgccgccgcctgcttcggcatgtcgcattccaaccaagtaaggtacaccgcgcgctccatcacgccccccgccgacagggacagcggctccaagtcgcccccaccacggaggcgcgccgcttccaagtcgcctcccctgcctccccctccacctttccctcccaagggggtgcgcaccatctcgaggtcgcttctccacctagtagtacaagacgcagcgtctcgaggtcccctccgccaaagaggcgcggcaggtccaggtccaggtccaggtccaggtccagcaaccaggagccgctccaggagcctcgacccccgcccacgcgcgggaattctgccaacctccctcct

SEQ ID NO: 12666 - DNA, 1462 bp, Triticum aestivum
  Clone ID: PAT_TA_12666
gaggtggatcaacaatggcgtcgcttctttcgccgaacaccgtcgctagcagacacacagggagggcgttcgtcaggaggagccgcctcacttctagtgtcatcaccatggcaagacgtccctccgccctgcctcatcctcccgccccgccctcctaatcctcccatccatccccatccccatccccatccaaagctagctagggttccgccctcccctccccatccccatgcccgcagccgtcgcctcctcttctcttctctccccgccgccggccaacgagatccagccagcgagcgagatccgaccgaccgaccgacgcctgcaggcagaggcagatcgagatcgacccctccgccgcctggttccgccacgaggccgcaacatgtcgcagtccaaccaactaaggtacaccgcgcgttccatcacgccccccgccgacagggacagcggttccaagtcacccccaccccggaggcgcgcagcttccaagtcgcctcccctgccccctccccccccttttcctcccaagggggtgcgcaccatctcgaggtcgccaccacctactagtacaagacgcagcgtctcgaggtcccctccgccaaagaggcgtggcaggtccaggtcaaggtccaggtccaggaacaggagccggtccaggagcagagataaagacgatgtgaggaatcctggcaacaacctctatgtcactggactgtccacacggacgcaagaacctggcctcgagaagttcttcagtaaagagggcaaggtttaaagactgccgtgtcgttatagatcctcgtacgaaagaatcacgtggctttgcgttcgtcaccatggagaatgttgaggatgcaaggcgctgcatcaagtacctgcaccgtactgtccttgaaggccgcctcatcagtgtggcaaaggcaaagagaactcgtgagaggacccctacccctggagaatactgtggtccgagaggcgggcgctcccgagtggaaccgcggaggagccgttctccacgccgttccagcaggtcgtcaagggaccgctcgaggtcgccctccacaaggagggatagagacagggacaggaagcgcgactgaatgaaacaagaagaaaatgatgatgctaaagtatgaattgtgtcttggattgtagtatggttgctgaatgaatgaatgtttgatgaaggactgtagtatttctgctggaggctttagataaagctcatctgtctgtctgtctgttttatcaatcagaggatttccctaacatttctttttagcttctgtgtcatctatatgcggtgaaggcgtatttatttcgtgtttttatggattctcgctatcgaaacgtctatttggttgtatgagctacttgtattggctggatgctaacaatattattattatgtctgcccacaaaattgaatttgtgtcgaccgttgcttaaaaaaaaaaaa

SEQ ID NO: 12667 - DNA, 971 bp, Triticum aestivum
  Clone ID: PAT_TA_12667
catgcgccacccctgtttctgctgtctgcctcggttgtcaacttctgactgttctctctcgccatgctggggtgactattcccgtgctccacccgccgattccgccggatgccgcgttagggacttgcggcctacgttcaccggcttccctcctgcctcttgcccctgctcatgcgacgcagctccgccacagcggccgctgtggcccggcgtcccccctttccctgtgtcccgtctgttcgggtgggcccccggggccaccccccggagacgccgccgtccagccgccctcctccccctgcccatggggccacgccgcggtgctcctgcccctctggcccgtcctcgcctcctgcccggcgcgcccgctggggggctcgccccgcgcggcctgcctcgggagccgcggccgtcgggccccccagcccgcgccttccgcggagatagtccgctccttgtcggtcccagatgccagaaccccgccattgtcttcccccacttctcctccatcgcggatcctcatcgacttgtacttgtacgccaccagcgtgttgattacttccgcggtagcgcctttgttcatatccagatcctcgtggaagcctaccatggagattatgcagggcaggcaacagcatatcatcgtgcacaggatgaatggcagtgcatagccgatgaagccgaatgcaaggaacactatacacagcctgtacaagttaggagcgtcatggacggaagagcggccaccgaatatccacacattccccacaacaaaccacacggcaaagaaacaatccaaggccaacttcaagcacgcaaccaatgcgtagacccttggacttgcaatcgggaaattgtttcttgggactccagtattgttatcttcgtttacagcttctgatgcatgtgcagatgaaattgatgcaaaagaatcagactcggatatgttcctttgagatgaacctgggctg

SEQ ID NO: 12668 - DNA, 1424 bp, Triticum aestivum
  Clone ID: PAT_TA_12668
cctttttccagacgcttttaggacattttagcaactatccaatgcttgtccatttttcctggaacaggcccttcactgtctttccctcatttcgcagcatatcctggttttccgatgaggatgctcgagcccgggagggcaaacctgtatataccagcacaggaatgacatgctctcccttggcatcatcatcagggcacagcttccttctagcagccgatcttcttgctgccatggggcatagcgaaagggcaacactgtgcaggctggggcatcgtcctctatgctgagccagtggcagtcctggaatgcgcagctcccggaggctcgcagcgtctcgccgacgtcccggggctcgcaggaagtgcggcgtccacgacggcgtgccgtcctcgaacgagttgtgcgtgagccgctggagccccgagccgtcgatgttgatggtgaagatctgcgccgtagggcttggtagtggtgcgggttcgaaatgggctcggcggacacggcggcgaggtccgaggtgaacaccatgcgcttcgagtccgggctgaaccaggggtggttcgtcctgccgccgtccgcgctgtgcaccaccctccgcagcccggtgccgttcgggtgcaccatgtggatggcgaagctgccgccccccgggttgtgccggtcggaggcgaaggcgatccactcgccgtccggcgaccagttgcacatggtgtcggtccatggcccgtccgtcaggcgccggatgccgccggcctcgccgtcctccgcgtccatgatgtacaggttcttgtgcccggacctccccgaccggaacaccacccacttgccgtccggcgacggcgacgggaacgcgttgttctcgcctccgattgtgagcttcttgatggaaatctgagatacgctgctgccgtcgtcgtcctcgtcgccgagggacacggccaccacgtccacctccgtgctctcgctcgcgctcgcccccccgtcgccgcgggagatcacccctttcctcttccagtcccacgacgtggggaacgcgttcccggagaagatcttccggcggccgccggagccgtcggagttcaccacgtacagccccggcagccccacgaaggcgatcttcttgccgtccggcgagaaggaagggtacgacccgtcgatcctgaacagcgactccgacgccgggctcttgaggctctccagcagcagcggcgagtccccgttcccgctgccccggcaccggtggtacccgacccgcgcgccgtccggcgagacgaacgggttgaagtggtgcgcgcgcggcgccacgggcctggtcacctcgaagtaggcggcgttgtcggcgccggagctcaggtcgatcacctcgatgtgccggtagtccgagccgggccgcctggtggccaccgcgaccctcgtgccga

SEQ ID NO: 12669 - DNA, 635 bp, Triticum aestivum
  Clone ID: PAT_TA_12669
cagtttcaggccgtccggcagcgcagtggcgaccacgatgctgaaggctcttcccgcgcgcttcctcgtctcaccggagcccggggggcggcgccggaggcctcgcccacgatctctacggccgatttcggcggcgctgatgaccaaccccgcgtacttcgaggtcggcagattgttgggtaactatggcttcatgaacatcacaagctattcatcttctcagtctggagggcttccaaacgatgctgttaatcaagaccttagtcttggatattcaccggaagagattgagcgattaagagtccaagatgttggagagggacaagtgaaaattagtctattgcagactttacgagggaagagtggtgcaaggtccattgaagggcacacaaactgtatttaaggtataccctggagctattgctggtgcttctgaagctaatttgatggcactgaatgagctgaggactcatgctttttttcagagtgatgcaagggatatctgtgagaacattcagtttctgttaggagcatttgagacagctactggagagcagtggcttgctttccgtgatgatgggagatacagtgctgcagactatgcaaaaataaccagtgaaaggcagttgaaggaa

SEQ ID NO: 12670 - DNA, 1221 bp, Triticum aestivum
  Clone ID: PAT_TA_12670
cagtgtggaatatgtcatgaattggcagaagatgtggtggttagtaggttgcccctagaaagtcatttaagctcatgcattgttttccactggttatcttcaacatatgaactttcctttcaagttgacttaacaacggaaaattcgagaagaaaggtccctgcaaatttgaagggtggcaaacgctcaggaatactaggcagactacaaagcctagcagatttcaagacaagtacgaaaattgatgcattgcgagaagagataagaaacatgattgagcatgatggttctgcaaaagggattgttttcagccagttcacatcgttcttggatttgattgaattctccctgcagaggtctggcatcaagtgtgtgcaacttaatgggaaaatgaacatggtggagaaggggagagctatagatgccttcataaatgacccagattgcaggattttcctgatgagcctgaaagcgggaggagtagctcttaatcttactgtagcatctcatgttttcttgatggatccttggtggaatccagcagtggagagccaagcacaggatcgaatccaccgaatcggacaattcaagcctattagaagcacgaggtttgtgatcaaggacacagttgaagagcgcatcctgcaactgcaagagaagaagcagcttgtgttcgatggcaccgtgggtgactcgccagaggccatgtcaaagcttacagaggctgacctgaagttcctgttccagaactagctcgtcttgtttccccgatgatgttccggagccgcataggaaggaggaatacatacatccgtcaggcagcgcccgaggccagcagcaggacgcttgcctcgcatattgactacagccagccctagggatcatgagttttggatggcgtactctgtagttttggacttgggaacaacatcgagttctatccagtttacttgtttgggaacaacatgggttctatccagtttacttgtttgggaacggcaaaagcaaaacacgggcgcttgtatattgggaccatgggtctgtggattggacggccctgcttagctaagctaccgacgaacaaaacgcacaggatcagcggtcagcgcgtaccttgcttgcgacagcagcccatagagtggccatattgggcagttgcactcctgctcatgaatatagcattacattagggaaaagacttaatgaattctaagtctttga

SEQ ID NO: 12671 - DNA, 859 bp, Triticum aestivum
  unsure (1)..(859): unsure at all n locations
  Clone ID: PAT_TA_12671
aggatgtgttctgtttgttgctccaaattaaccctactaaagggaacaaaagctggagctccaccgcggtggcggccgctctagaactagtggatcccccgggctgcaggaattcggcaccaggcggcaggctgccgccgggcgacgtcggctcgccgctcgcccgcggcttgtgccccctccgccgcgcctccttcgccggccgccccgacgccttcatcggcgccggcgcccgtggggtcggccgcgcgggccggggctcggcggccgcgggccgcggccccgcgggccgccgcgccgcgcccggcgcgcgcgtgctgctgctcggcgtcgccggcccccgcgccgcccgccggcccgccgccgcccgcccgcgcgtcgccccccggccccgcctcgtgcgccggcctccgcgccctccgcccccggcgcccgctctccgccgccccctccttcgcccgaggcgcgctcacctcctacctggccttcatcgaccacaccgtggtcaccacgctccggggctggtccgacccgggcgacgacttcgagcattcttcacggaggctggcgcccggatgacgctcccggaggatcctgcgggtcctgccgggccggtgcccgacgccgcgcacggcggccgaaagggcgagcaccgccaccgacaccagcggccgcacccgccccaaggccaccgaccccccggggtccccctcacacaaggccatcggcgcgccgcgccggcccttacttgcggcccctttcggcccggcggcggttcgcccgccgccttcccccgggggggcgggnccaatttnccggngggccggccgggccccggnaaaaagggcntttcggtngg

SEQ ID NO: 12672 - DNA, 660 bp, Triticum aestivum
  Clone ID: PAT_TA_12672
ccgcccctcccctccgcgccccgctcgtacggaaaaccccaactccacccacgaccagccagccagccagccgccgcaaaagccgcactgagtccctagccccaaaccccggggatccgtttggtggaggcgaagcatcgggtcagggcggcatgtccggcggcggaagaggaggaggggaggaggaggaggtggtgcacatggaggacgcggtgaacatgctcgtggagcacctcgtgaagcccgtgctgccgcggggcgcgatctttggcgccgcccagggggagcgccacatggagccggacaaacagcgcgccgtcgcgcagcagattcacacggccatcatcttgtacaactactaccacaggaagatgtcgccgcagcttgcatttgcagatcccaaacggttttttgtgtgtgcttctctttctgctggagaggatctgcttgcgtacttgagtatggttcatgagcgtgagagcaatcctggcaagcatgtgaggctatctgttactgacagagcagcgatacaggcatgtgagatcgctgaagaactcgacgcgagcaaagattctccagacatggcaatgtggccaatatcaaaagttgctgtgcttcttcttgatttgacaagaaaaaaatgtttgattgagtatagtg

SEQ ID NO: 12673 - DNA, 923 bp, Triticum aestivum
  unsure (1)..(923): unsure at all n locations
  Clone ID: PAT_TA_12673
ggnctgcaggnaattcggcacgaggggcgaacgtgtgcgcccccggcctctcctttcaaaccgctcgccgcgttcccagctccccgcgtccccgcgccatgagcttgggcatggtgagctcgtggatagcacacgaggaggcacgccgctctactccatgcaggtgcagccggcgcgcatggccatgacgtccaaggccggtgtgctcgcccgcctcatcaaggagctgaaggagcgcgattcccgcctgctccgctcccccgacgagctcaccgtgtttgatgtggagctccgtggagggagatggtgcgactcggggtggaggggagacgggcgcagctcgcgggggcagaggaggggaggccatgtccaatgagacgcgcgacacagctaggggggccggctggtgaccgtggcatggtgctccggccggtgcacggcgtactcctcccgatgccatcagcgcgcaaaccgttcgacgaaatgccacaaagaagaatggtattacagaggagtattaactctgatggtgggcctcacaactgatttaacggtcaacacgaatgtggttgactcttactgccacgtggacctcaccaatgggccctgcatgtcagaaatcgtattaaacggtccaaatcaatcattagtgtttattgagaattttagtaagaaaaacggtgaatttttgggccgagcaagaaatgtggtgtcaattccggaagataacttaaaatgtggcggtctgttgcaattcactcaagtcatgaggggccggttgcaggcgtacgttttgcgtatcactagtaccggactctggcaccgtcgccggtgacacgagctgtaggcagcttccatgtgagggtcaaatttgccaaagttcagtttcgacagttnattcagttccgctcagcatcagctct

SEQ ID NO: 12674 - DNA, 638 bp, Triticum aestivum
  unsure (1)..(638): unsure at all n locations
  Clone ID: PAT_TA_12674
aattcttaaatagcacttcctnctcggtttggtactgaccggaaattggttacagaaaaactatgaattgaaacaagccatacacgcccaatctcctgatacagatccttattatgtgaatatggcgcatctggcatctctatgaattgctccgtgaacgcgataatgaacaaaagcaggagaaagtagctagcactacatccataacccgcagtgagcccatcgagaacaagatcatcctacattcaccaactaacgtgatcttctttggcccccctggcactggcaagaccttcaggttgcagcaaaaaatgaaagagtacacttctcatgctgttcccgctgatcgtgatgcctggctggattctcgccttgaatcgttgaactggatgcaggttataacgctggtgctgctcgatcttgggaaacgagcgaaagttcgccaaattattgaacatatgtggtttcaacgtaaggcattattaaacggtcgtaatggcaatctatcgaatactgcctgggcagctttgcaatcctatacagttcccgagtcgttaaccgttgattataagaatcggcgtgagcctgccgtatttaacaaaacagataacagcgaatggtttctagttgattcacag

SEQ ID NO: 12675 - DNA, 933 bp, Triticum aestivum
  unsure (1)..(933): unsure at all n locations
  Clone ID: PAT_TA_12675
cttcaaatcactagatctgctgggataattacagagacagcatgggctggtgctgccttcaatctaataatttacatgcttgctagccattngcccgggcgccgccgtggtacttgctttctattcaacgcaaagatgcctgctggaaacaggaatgtggtcttaatcctggctgtaaccctgcatatctatactgtgggaatgggtgatacaaatgcaaatgctggaaatgctttcttacagagtgtttgcattccaagtacgcccccaagacaatcttccagacccaccctttgggatctatctgccagctataaataatgtttcccaatcaaacaaatttcttccgcaaaattattttactgtgtcctggtggggtctgcaaaatctcagttcgcttggccaaaacctcaaaacaagcacttatgcttgggagaatttgtttgcagtttttgtctcaatatcaggcttagttctgttttcacttctgatcggtaatatgcagacttatttgcagtcagccactctgagaatagaagaaacgagagtgaaaagccgtgacacagatcaatggatgtcatatcggcttcttcctgataacctcaaggagcgaatacgacgttatgaacaatacagatggcaagagacaagcggggttngatgaagagcacctcctgatgaacctccccaaggatcttagaagggctataaaacgacatctttgtttatcacttctcaagagggttccaatgtttgaaaaaatggatgatcagctcttgaatgccttgtgcgactgcctaaagcctgttttgtactccttcttgacctcctccacctcgttgatcacctgtgtggcgtcggtgcacccgaacataggcagcttccacattgtccagtagcggccgtcgtagtacctcggccgcgaccacgcta

SEQ ID NO: 12676 - DNA, 692 bp, Triticum aestivum
  Clone ID: PAT_TA_12676
attgttttacttactcagtagctcaacctttaaggatccacaaatagatatacaagagaggcatgttacaaaaaaatggccaaagttcctaagagaccaattgcatgatcactggattgctacagaataatacggaagaccaactcttcaatcgccaagccgaatcaacttccatatgaacaaaatgtgtcaacccagttctcaacaaaacagtcacgagaacatcttcagtcaacttgtggacttgctactgtctaccatttgtccctcacagtcaagaggcgctgatccacaaccttgtttggggagttgaggtcagggtcgtcgtcttgggcttggggtcttagttgtcctcctcatccatggagtcgggtgcctacacattgtttgttgttgttgttattattgttgtagttgatcaaaagggcgacttggtgggtttgtggtccttatccaattccaaccgaccatgcccggtgctgacccggaggggttccaactctaccttcagaccatatagcaccaagttttgcttctcatatgcttaatttactattgcccagactgatcacacctaggcggcacaatggtccacccatcagcatcagggataggcttcgaggacctcggttcatcctgcttcatcctcgagcatcagtggctagtcaccatcatcatcatccaaactataa

SEQ ID NO: 12677 - DNA, 897 bp, Triticum aestivum
  unsure (1)..(897): unsure at all n locations
  Clone ID: PAT_TA_12677
cgtccgcccacgcgtacgcacggctattgcttgcttgcgctgcaataaagtcccgcggaagttctttgattgaaaggaagggatattgcgaagaggcgctagggttctttagtgacttgattaatttggatcccttctcataaaagatattatgaagatgagcggagcttagtactaatggatcagctaacatgtgacatggagactttcatgaagtactgttcagtccaagttaaatcaaattcagctccattgaaccatgtgcaactttgtagattgtctttaacacgcattggatttactgaacgcgtgttgtggattcaaatgctggacctaagccataatagcctcagatcagttgaaggtttggaggctctgcagcagcttgtgtgcctgaacatcagcaacaaccagatcagcagtttcacgtcactcgaacccctgacgaagatagtttctttgaaagcgttggatttgtctttcaacaagattggagctcacttgatcgacacgacacgttacatgtgctcatctccatttttgcacaaagtcgaacggtgtgaagccttcgaggagtgccgaaagaaaaacgtcaatgtggaggagttctgggacgccatactcttcttcaaatccatggacctggtgcagcttgacttcaagggaaatgcggtcgcggacaaggatagctttgcagctgtcgtgtcgaccctcagcccttctctgaagtggctcaacggcacatgtatccattagctgttcatcggagagtggaacttgtgatagaatggggaaactggacactgtacactgctattttacctagctgctaatgtcctgattcatgtattaattagttataagcagctatagagacnaatacaattatactacaag

SEQ ID NO: 12678 - DNA, 2030 bp, Triticum aestivum
  unsure (1)..(2030): unsure at all n locations
  Clone ID: PAT_TA_12678
cccacgcgtccgcgctgacatgccatcagagcgcctcctcgcgcacttcgcttcctatggagagattgaagaggggccgcttgggttcgacaagctgacgggcaagttcaggggctttgcgctctttgtgtacaagacacctgagggggcgcaggcctcactagtggactcaactaaggtaatcgatgggcaacagctcttgtgcaagctagccatcgaggggaagaaggggaagcagcaaccacaacaatctgggcctgccgggcaacagcaaccatagatgctccagggtggcccgccggacatgacgggttctgggcttgggctaggtggagcgcagatgggtgggcagtatggtggccctgggaatggtatgccatcgttcggcgcatttggtggtcccaacccatatgcgaacatgccatcgtccatgggcggcggtggtggagctggtttgggctcaatgggaaatccgatgcattccgggatgggttctgctggggctggtggatttaccgcgggtgggctgggtggtggttcatttgggggctcgtctcaatttggtgcaactccgactcgctccgcgcgtggttctccgcctagggcgacctcgaggaggccgtggttgcaacagacaagaccaccggccgctccaagggctacggattcgtcaccttccgctacgcagactccgccctcctcgctctaggaccctcaaccgatgtcaccagggccaggtggcagggctcctcctatgtaccccaatgtgccaccttatttctaaggttgttgacaactcttgggagcatgtgctttgaatggttgtgctgaattcagcgttcttgtctgcatacatggatgtcttgcatattctggctacctctgatctggaaatcagttttgctctgagttttcgttgttaagagataaatcaagctagattagtgttttatgtgaactctttcactagacatgtacttcttatgactgctttgcagtctgtctatttaaatacctgaattatcattgttacattcttgtgtattgtcttgtgataccaagttacttatggtcatgtatggtgaaaagtagcttcttgatcgtggtcgcgtgatgcgttcgagcgttctcgacgtccctgcttggctgggctggaactcctgagaagcagagccgatgtcgcccttgcccttgccggccttcttggtgggcaatatggtggccctgggaatggtatgccatcgtttggtgcatttggtggtcccaacccatatgctaacatgccatcgtccatgggtggcggcggtggagctggtttgggctcaatgggaaatcagatgcattccgggatgggttctgctggggctggtgcatttggcaccggcgggctgggtggtggttcatttgggggctcatctcagtttggtgctgctggtatggggccttatggtggtctaggcatgggtgggccttcctcactataccgtatgcaacagggctcaggtgggctgccctcaggctatggcgagggtggaaactaccctcttccagggtctggtttccggggtcaggaccctcaagggatgtcaccaggaccaggtggcaggggtcctccgatgtaccccaatgtgccaccttatttctaaggttgttgacaactcttgggagcatatgctttgaatggttgtgctgaattcagaagtgttgtctgcatacatggatgtctttgcatattctggctacctctgatctggaaatcagttttgctctgagttttcgttgttaagagataaatcaagctagattagtgttttatgtgtactccttcactagacatgtacttcttatgactgctttgcagtctgtctatttaaatacctgaattatcattgttcctcccgtgtatgtccntgatacaattactatggcatccgggtacaacatagaatctttaacaggtgaaaaatcacatttaaagctcctcaaaccaagncacaaaaanacctcccgatacagatntaacattcgan

SEQ ID NO: 12679 - DNA, 633 bp, Triticum aestivum
  Clone ID: PAT_TA_12679
atcgagttgaccatgatgcgcagaccgcagaacggacactgcactacagacttacaatcttgcacgaaccacacacacacacacacacatgcagctagctgtagcaagagagatctccatacatttatctctctctctctccccctgcatgcatgtccccctcacttcacttcacactacagcaaatcattttacttgactcgatcctacatggaaggaaattaaactagtgataaactcgactagaacttaacccaagctaatcaaagccaactaggtcgaaacacgagcaatgcagcagtgttcgacgacgacaactgacagtactagctgatacacacacgcacaaatgagaagtgcaaagccataaccatgcgtgcgcatgcatgcatacgcgagcgcacataaaatatatctggcataccggccaaataggagatcgttcgatcgaccaccggctgggggcgggtcgtcgtcgtcgcctcgatcagctcagcaaccggcggcgggaggcgggccgggagggggctggtgctggttgccatggaagctgccgctgctgctgtcgccggccagctgctgcggcttcttgcgcttcttcttctcgtagctgacgccgcgggcgcgggcctg

SEQ ID NO: 12680 - DNA, 558 bp, Triticum aestivum
  unsure (1)..(558): unsure at all n locations
  Clone ID: PAT_TA_12680
taagatcctattggaagaggcgccactgattnactggaaattagaactaacatatgtatccacatgagcttttcctaattagtagctgcaagtaactcagcacatttcttttgttggtgcactgcagaaacttggcaatctacccttggcacatacaatctggggcaggataagtgtagatagactgcttcggcttcctcagccggatctgcccgtatctacctttgtggcctgcctgtacagcctgctgaaactctgaccactccatgctcttgttcacaaatatgtggccaagcaatgtcatgtttggccttatcgtcttcaaattcctgtaggcccggtgggccagcagtgcattatgcatattgccaggagaagcagagatgaaaacatcgctgtgcatgctgatatggtagtcaagagctgctagcacagaagccttcccttcaacattagcaagttcatctgccaatgcaaggctcctcttgtcttccatcagcgggaaaagtttgcgcaggctagagatcctagcttcccctccatataccttgtgagagg

SEQ ID NO: 12681 - DNA, 1623 bp, Triticum aestivum
  unsure (1)..(1623): unsure at all n locations
  Clone ID: PAT_TA_12681
gaaacccctgcccgggatgaggcccagccgttcgatccgccctacgccagccacgcgcaccagctgtgcgggatgaaggacgccggcgtccagggcggggtggggcccttcgccctctgtgtcctgccctcttccaacctggccgagtaaaccgctgtgttctccagagtctcccgggatagtcagccctgacctggcatcctggagtgccccgaattcttccccgtgcgcgagccccccaagacgaacggagtcgacacctccccgttcggccctcgctaaaagcgcgtgctcaagaaactgtttcgacaacacccgctacgactactacaccgtgggcacctacaacaacgggagggaacggtacgtgcccgacaagcccaccggcgacgtctgccatcggggccagtacggcttcggcaacttcttcgcgtccgagaacttctacgacccggctaagaacacgccgggtgctggaggtctgggacaacgagtccgacagcgtcgcgcacgacaacgccaagggatgggccggcatccacgcgatcccgaggaagagatagctggaccccagcggcaagcagctgctgcagtggcccgtggaggagctggaccagctgaggggcaaggctgtcagcgtgggtgacaagctcgtcaagcccggccagcactttgaggtcactggcctgcagtcctaccagtctgacgtggaggtgagcttcgaggtgtcgagcctggacaaggcggagccgttcgatccggcctacgccaacgacgcgcagaagctctgcgggatgaagaacgccgacgtcaagggcggggtggggcccttcggcctctgggtcctggcctctgacaacctggccgagaagaccgccgtgttcttcagagtcttcaaggatgggcatggcaagcctctcgtcctcatgtgcagtgaccccaccaagtcatctctcaccccgggtctatacaagccgacttttgccgggtttgtcgacaccgacatttcgtccgggaagatctctctgagaagcttgatcgaccgatcggtggttgagagcttcggcgccggagggaagacctgcatcctatcgagagtgtacccatccatggcgatcgggaaagacgcacacctttatgtgttcaacaacggggtgaccgatatcaaggtgtccaaactaacggcgtgggagatgaaaaaaccaatgatgaatggtgcctaagtagtatataccgtatatgttttctcatgagtttaagtttttgttgaatgccattcgacatcgatgcacaccacgcaactgattgctcgtcttaatgaagacctctttgagtagaagtggttagagaaatttgttgtacaattgataatttctgtcacgtgttgtacgaataaacatgatgatcccacgctgaagacaataaagaccttaatgaatttcttctttccaaaaaaaaaaaaaaaatcagccaagaccacgctaaccagtagtgaattcccactaggggatgcgcggggggggggnccgnncccaaaatnccccncaacccgaaggcctcnggccgcgnnggttnccaccgccccggntttggnaaaanccggggggggggggngaannaaaa

SEQ ID NO: 12682 - DNA, 447 bp, Triticum aestivum
  Clone ID: PAT_TA_12682
gacgcgtccgcggacgcgtgggcggacacgtgggcggacgcgtgggcggacgcgtgggcgcctcgattcccggcacacgagccggcgagccgcgcagccttcgactccgaggggaaccgctcaccggagcaccaccgacccgcggacatggccgaggaggggaagcacctggagacgggccgggccgaccgctccgtctggctcatgaagtgcccgaccatcgtctcgcgcgcctggcaggaggccgccgccgatgccggaggccccaaccctaaccctaaccccgtcgtcgccaaggtcatcctctccttcgacccgctcagcacggacgaggacccgaaccagttcaagatggagatggctcaaactggcaatggcaacacaccgaagaattactctttaaatatgttcaaggattttgtgccaatgtgtgttttctctgagtct

SEQ ID NO: 12683 - DNA, 300 bp, Triticum aestivum
  Clone ID: PAT_TA_12683
ttttctttcccctccggggaataaggaattaaaaatgaaataaaaggtgtttcaatgtgtactttctggagaattaggtatccggcttaaatttaagctaccctccaccaacacaccttcacaatcctgagcgccacttgcaacaacatccaactccgaaacaaagttagatgcattcacttcaccatccccagggctgtcatcagtaacctcgtccatatctttttcaactgctgcatgcatggagacagcctctccactgttaggagtagccacagaaggagcggacgcgtgggtcga

SEQ ID NO: 12684 - DNA, 1474 bp, Triticum aestivum
  unsure (1)..(1474): unsure at all n locations
  Clone ID: PAT_TA_12684
atatatgatactatgctagtatcatatgcatgatactagtatatgactccctattacaaccagcctaaaggagaaaatcgcactctcgctttccaacacaactccctcggcagtatcgcctagtgtagcagcggctccgttccggccagctttgctcgccgagccggccatgatgttgctgctcgcgcgcagcctccgctcccgcgtccggccccccctcgcctccgccgttagcgccgcgcccttctcatcggtatcggcggccgcggcggaggcggagcgggcggtgcgggacgggcccaggaacgactggacccgccccgagatccaggccatctacgactccccgctcctcgacctcctcttccacggggctcaggtccatatttaggtccataaacccacccaaccgcagcaatgcacacttctttcaataaaaactggtgggtgcagtgaagattgttcatactgcccacagtcttcaagatacagcactggattgaaggccgaaaaattaatgaagaaagatgccgtcctagaagcagcaaaaaaggcaaaggaggctgggagcacccgattttgcatgggagccgcatggagagagacaattggcaggaaaacaaatttcaaccagattcttgaatatgtcaaggacataagaggtatgggcatggaggtctgttgcaccctgggcatgctagagaaacaacaagctgaagaactcaagaaggctggacttacagcttataatcataacctagatacatccaagagaatattacccccaacattattcctacaagattccgttaccgatggtttagatttaccagctcctttcnagcatgtcccnttnnaggctgcgcaggtggccgtcctggtcccggagaggcggaggatgaccctctagggctgttgcatacactggccactttgccaacacacccggtgagcgttcctatcactgcattgattgctgtcaaagccacgcctcttcagcatcagaagcctgtagaggtatggccaatcctccgcatgattgccagcgcacggattgtgatcccaaaggcaatggtgagactttcggccagggggagtacggttttccatgccagaacaagctctctgctttctcgctggggccaactcgatcttcgccggtgaaaagctcctgacaactgcgaacaatgactttgatgcggaccaggcaatgttcaagatccttggcctgattcccaaggctccaaactttggcgatgaagaggtcatggtagcagcacccacggagagatgtgagcaagccgctttgatgtaaaatgtcggtatagattctcgagaccacatccggtgcaaaactggcaccattatctccacctagagctttgtactgtagagatcatgatattttttagtaacttcagattcatcgaaataaaaatagggggttctcttcatcgcaaaaaaaaaaaaaaaa

SEQ ID NO: 12685 - DNA, 791 bp, Triticum aestivum
  Clone ID: PAT_TA_12685
ggtatttctatggtacagaatcacagcaaagcatataataaaggtgaacgcacatagttctcgaatactttctctggaatctacacggcctacttatgtggcttgcaagaagcatcttattgtcaagttccatcacttatttcggtgaactgcgatggctgacagcaaagatttttccaggtcttccagtgggatgcatgtcaatggaagaaccattatgtttcacataacctcgctactatgaaattggcactcttgtcttgtgtgtttcctagctccagctgaacccatttagatcgaatttcttgctattctgagttccattatttgtgtcattcatgtttaaatccaatttcgttgcctggtatgtcatactcaagctgtctctcctctcgtgtccttcttggtggtttggaggccttctgcttagcttgttgagaaacaaatcctcgtggtcctctttctttcatttgcagatcgaatgccatgcctccaatctcctttcctttttgagcagaaaggctcattgacaggatatcttgatccttttgtgagccctcgcatgcagttaagcagctgtcaactgatccatcaccaagctgcatggtctgccttcgtagcatctgtgatccttcaatctcctcaaagcttgtgaaagcattatggaagcattctgttgatacttttgagaccaattctgatagttgtatctttgcagtttctagaccacccgagcctgtattctgctttgcaagtgtctcgtgtgccttttccaacactgatcgtaggta

SEQ ID NO: 12686 - DNA, 745 bp, Triticum aestivum
  Clone ID: PAT_TA_12686
atctggtcgatgtaagggttgatgcgcggtgtgttccttttggcgttttgttttttttttttttgaaacgaaggcaaaagctttgcctcatctattaattaagcacaaaaaattgcttagttaattagtggaaaactgggcgaaaaccgatacaacaagggccaagcctactcccacacaatcacgcacacatgactaagcccacttttgccgacaacatgtcgaacacacaacttccaccgctgtcggagagaagaatccatgaccactatgagaggagcagccacgagaccctcccgtagaaatgaagagcatgcactccacatgacccgcttccctgatatgacaacgagcaacatcgaaggcaacctcgtcgcccagacgacacgaagctgaagttctcaatgctgcaaagtctcggagccgccgccccgacatccaccgctccgttgcaccctgtgcggtccaccgacaccaccttccggggccgctgccccgacataccaccgctccccctcctgctacaacgttgcacgatgcagccacccgcaacccacgctgcacagggtgactgcccgcagaccacggccgtcgcaccacttccggggccgctgccccgacataccaccgctcacccttgagctacaacgccgcacgacgcagccacccgcaacccacgctgcacagggtgactgcccgcagaccacagccgtcgcaccacttccggggccgctgccccgacata

SEQ ID NO: 12687 - DNA, 844 bp, Triticum aestivum
  unsure (1)..(844): unsure at all n locations
  Clone ID: PAT_TA_12687
tttgttncagggtatattgatntggatatggtttcgctctcctagtctcctttacataaaaagggtatctttgctgactacaatcatcacatttgcaatcatccagcctagagtttggaggaacggggaaaatggatatacaatgcgagcatgccggtccaggtgtattttgatcattacccaatgcttcaacagcttcattagccatttagcctgaactcccagtaatgacggcatctatcgctgttactcgctgttcaactgctctatgacggagtcgatcggtaatgaccccagtggcgccgatggctccagacgctcgagcatgtcgtattcaaagtgatcatcatcgccggcatcaagtgatttctcaaactgattttcttggggtctaatgattccatcaccaggctcatttagagcttcagggccctccttaccattgcccacgagcaaagctgggaatgaatgctccacagcctgcgatgtgatactgaactcctcaaccctcataagaagcgtgtcaggtgcaagtgcattggcttcatcgtcatctagcgacaatgctatggatgactctattgcacgcttccacagtttaaacattctgggtctcaatacttctcttattgtcacattgttgctggcaccagcggattcacctgagctatccacaacagatgacactgcccgattattcttttcaacttttggaacgggggtgagaggcttcaaatatctgggatttccatccttgccctctgtagattaatatctgctccttgtcaaatgacaaaaggacgcaaggaacaagatccctcagttttgccccaatctttttgct

SEQ ID NO: 12688 - DNA, 903 bp, Triticum aestivum
  Clone ID: PAT_TA_12688
tttttctttttttttttttttttttttttttacttcgaaagatttaacagtttatacgacgaaagatgaacagtttaccgctgtcctgacgactaccatttacatccttacttgaggtaaacaagtgaaaaaactaggatagacagttcacataattatttacctagagcagcataataaaatgatgaaacaagagcaaagtttgctgcattttctgaagattaaagctaggtaagaaaaaaaaaacttggcgcctttctagcactgggctggataaaccaactggggacgtcagtcagtcgtcgatggccttggccctcatgcagctgcaccccccgccctcgcgccgccggctgccccccgcgccgccgccgcgccgcttcccgtagaggtactccaccagctgcaccctggaccggcgctgcaccgtcttggcggcgcgccggctggcgcgctcctcctcgtgcttgagcaggacctgctggaacttttgcatctccatctccagccggcccaccttctcggacatcttcctcacccgctccaggatcttgcgctggctccggctccggaggtccacgctcccgccgtcgagcccgtccgcccagctgcgcccccccgccctcctccgcgccctcccccggcgccccctcgcccgcccgctgccccccgcggacgcgctcgtcggcccccgcccgctccccggcccgcgcccccccctcgcccccccgctccccccccgcgccgggcggctccgtggggggcccctcggcccccgcccggccctgctcggccgccccctcgccctcctcctcctcgcgcggggcggctcggccctggtccttctcggacgccgcctcgctctgtggcggccacagatcgtcgtgcctgccgctgccgctg

SEQ ID NO: 12689 - DNA, 1813 bp, Triticum aestivum
  Clone ID: PAT_TA_12689
ccacgcgtccgccccacgtcctctgacctcgttccccacccgaatccgccgccgccgccgccgccgccagaactctcgcgtggcgatgatatcatcggagaaactctgtcttggagcagacgggaaccgcctttcccatcccgacgccgggtacctcgacagcgtctgcgcggacctgtccgacttggggttgccgtcggacatgggccatgatctgcgggagggggagacggagtcccttgtcaagatcggcgattcacatccgtgtccaattgggcgtgacgacgtctgtctagacgacatgttcgatgatatcttcggggactggccgctcacgggcgatccaattctgtgggatgacatccgctcagagaacagcgacgattacgtcgtcccagattccgatgaaggtgataggttcgcagacgtgaaaacaaattgcccagggagaaacattcccaggcagctagcaaagaaaatggacagcgcatggctaaggagcatcgcggaacagaacgagaaatacgacgcgcggtgccaggagatcctgagccagaacgaggatgccgatctccctcctgttccactagatgtgttccctgaggcaacaggtttatgcgtggaaaggggttgctgctaccacattgaatacatgacccatgacacttccaccactaattcagatctcggatatagcggaccagaactgatgctacagatattttctctgcgtttatcaagcttttctgcatcctattcttaccccatcaatgtctatggagtattcgctgttcgggatgtactggagcctctgcggaaccatgtcttcaaccgttccagagatgaccctgtcactgttgaccaggatccttttaccttggcactctgtagcccttgtcgaggaatgtacataccatatgaccaagtattgctagaagttgatctctggataaaaaaggaaggggatgggtcagccgaccaaaaattactttccaaataccttgagctcgatgtccgaacacggggcgacgggtttatatatggttgtatccctggggacagtgtcagcttggaaatagactgtgcgtacctcacagagagtgttgaggcagtgatcgaggtctatgcagaggttagccacccttgccatgtgagattcgtcgctttcagcagtggctatgacgatgagattgtgctcttcgacggaaaattctctggggaaaagcttttcaagcatgttgttgctgtgaaggcagagagagaactgaaggttcagttagaggtggagaaatcagttttccagtggatttttcagggtggaaatgccggacctcttagcttccccgatgactcgatgttgaagtatggccagtttgatgtgggtgtgtgtttttatccatcgacgggctaagtcaaacgtaccgtgatcggctgaaaacaagtgatgtgctctaatgtttgtgttttaggagttgaatttaagtagcaattggatttccttttgtgccctcgtgacaaagcggtttgaagtttgggttttagcttttgtttatgatccagatatgttgaaactgtagcagaagtccgagatatgcatgactctggcgtgatcctgaactccagatatgttaagctgagggagatgtttaaggtctgactcgtatgttaaactgccaggagcctgaaaatgttttatatcctcctagtacaaatgcccgtgcgttgcaccgggcaataaaaggggcacagcctgcttcatgtgctattttgcatcatttttatattcaattttaataaatgtcgataataaccc

SEQ ID NO: 12690 - DNA, 541 bp, Triticum aestivum
  unsure (1)..(541): unsure at all n locations
  Clone ID: PAT_TA_12690
ctggatnggcaaggatgtcttcatcgtgtcgccatangactagtntccatttgtggccctctccgatgattatactctatctcaagcgtagcgttgttctgcctcagatcagtgcaccggttagtgctagcgttgtaacccatgtttgggtccatgccaacactactactgccggtgtagaattcatcatcacgtcctgtgcagtcctcctcgagatcaaggcactcctgtatctgcatcacaacttcagccatggagggccgctgtaggggcacttgctcggtgcacttgagcgcaatctctgtagctttccaaacagcattgatgtcatgatcaccttgcatacgcgtgtccaccacgccctcaatgtcaccccgcgcaagccgntgtcgtgcccaattgatgatgctgatggcctcggtgtcgggcaggatggctggcttccccgtgactagctctagcagcacaacaccaaaactgtacacatcattcttggttgacgcctgacatgttctatgatactctggatctacatatccgc

SEQ ID NO: 12691 - DNA, 817 bp, Triticum aestivum
  Clone ID: PAT_TA_12691
cgtccgcccacgcgtccgcgctcccccgcctccccctccctcccccctcgatcccgccgccgctccggccccactcctcctgccgcctcctctcccgccgccgcgccctcctcctcctccccctctcctccctgcgcccatccggctcggccgtctcctcctccgccgcgatggccgcgccgccggtggccaggaaggtgccgcggaagctggcggagcacggggacgtgcgcgtggacgactactactggctccgcgacgacgcccgcaaggacccggccgtcctcgcccacctccgcgccgagaacgactacaccgccgccctcatgtccgataccaaacaacttgaggacgaaatattcgctgagatccgagggaggatcaaggaagatgatatagatgcgcgtccgcgcaaggggcagtattactactacaaaagaacattgaccggcaaggagtatgcgcaacgctgtaggcgtcttgtgccgaccgatggccctgttacagtccacgatgagatgcccacaggccctgatgcgcctgctgagcatattattctggacgagaatttaaaggctgtgggccatgactactacagcattggggcattcaaggtgagtcccagcagcaagcgtatttggctactcttagtacaccatggttgaggattaatacaacgacatgggatttgagtgttcaagcgagcattcttgtcttaaaacatttaccgtctgatgtaacaacgttgaatggaggggcttaattgagaaagctgcttaagccagggatggatgtgtgtaagatgttgacaagaatg

SEQ ID NO: 12692 - DNA, 775 bp, Triticum aestivum
  unsure (1)..(775): unsure at all n locations
  Clone ID: PAT_TA_12692
aaatccgaccaacttttatntacatgttaatataaaatccgaccaactttatcatacaatgctacaactacagcgacgacattccaaatgatgatgcacaacgagttcaatacttctgaaaagatactggaaatttaaaaagcagcaattatgatagatggtgtacatccccatagattgctatgctgtcttagccatcaattggagtcaagtccacgagtggaaagggacctgaggggatactcaaatcatcaacccacgtctagcaggtacaatgtacttcacgcttccctggttatcctctctcttggccaaaccagcgccctctcctctcttggccaaaccagcacactctcttctcttggccaaaccagcagtcatctttgcaccacccaattttgcaccctctccactcttggacaaaccagcaccctctcctctcttggccaaaccagcacactctcttctcttggccaaacgagcagtcatctttgcaccatccaattttgcaccccctccactcttggccaaaccagcaccctctcctctcttggccaaaccagcaggcattttttcaccatctgattttgcctgaataggagaatcaccagggcacttgtatatatatcttatcctagcctcctcctcctccaacatagcctcctcctccgccgccaacatagccttctccgcctccgaacaatccttctcattctggatgtatccaggtctatccaggaccatggaaggaatacaatctacaccacaacattgg

SEQ ID NO: 12693 - DNA, 858 bp, Triticum aestivum
  unsure (1)..(858): unsure at all n locations
  Clone ID: PAT_TA_12693
cgtccgcgtccacgatttcgcacgcttgctctcagtctctccgtgctaaaatcgaaaccgcgcaaatcctaggctaggccaccggcgcccgagatggcggcggccttggcggcgggcgtcggcgtgctgctgccgttcccgttctactgggcgctgtggacgcgcccgcagcggtgggtggacctgtgcggccggggcgccgacccgtgccgccgcatggcgcaggtctcccacgtcctcaaggcgctccagctcctcgccctcgcctccgtcgcctccttctcctggccccctcctctctgcgccctccccctcctcgccttcggccagtacctcaacttcaaggtgtaccagctgctgggcgagtcgggtacctactatggcgtccggttcgggaagaagatcccgtgggtgacggagttcccctttggctacatcaaggacccgcagtatgtggggagcatcctgagcctcgtggcgctgctgtgctgggttcccttccagtatattgtgttgtggtgcctcggttatgttttcatgattttggtggaagacaaggaagatccagccacccgtgccaagttgctctcctgactgttgtatatgttgtgcggttgatagatgactcgagatctctcactgtccattagttgtgttgttcctggacgtgtcccagtcatgcctgtttttttttgcgggggtgtcccaaacatgagggctgttcattttttttaataaggaggataccgagggggggtttcttgtgtctctggcgtnnaaaactcggggggggccccggnccccaatttgccctttttggggccgttttacaaattaattgcgccgggggttaaaaac

SEQ ID NO: 12694 - DNA, 684 bp, Triticum aestivum
  Clone ID: PAT_TA_12694
ttttttttttttgaaataaatcagcagattgctgatttcagccattaagataggatcaaagaccttaggaattattacagggtaacacaagtcacgagtcaggagacgcccagttaaagctaaagctaaagctatacgtattacatactcccttcatcccaaaataaatgtcttgagcttagtacaaatttgtacccgaactagtacaaagttgagacacttattttgagatggagggagtattatataacgaacagagtaaaaagaagaacagcagagaactatccaacccctctccattggacacctttgaatccagcagccctccgtgtggcaacttcattgccacctccaggaaactgcaagctttgttgttgaatatgcgattgtttcgctctttgcaaatttcccagcaaactaccatgatcagataggataggtctttccttctgcacgggggagcaaaccatcctccatcctcaagtgacaaagctggcagattgggttatggggccagccacgcttggcaagcttgtcagcagccaaacactttcctggcgcaaatagcaaactgaaaattttcatcttcagaggggcctttaatctgccagatgatgcttgcgagcagagagtctattctgccccataactgacatggataagccgatttcacagtacatttcc

SEQ ID NO: 12695 - DNA, 664 bp, Triticum aestivum
  Clone ID: PAT_TA_12695
agtttcctatgttaattcgttgcaatcttagttgcaactgtcatgttaaacatcaccaccttgctaaaacgcacaaaagtaacattgggtgaacgtctaggttcgaagtgctatgcacaaccgaattcacagctaattaccatcaactctgctttgagctcgcctctggagatcgaccgtgagctcgtcaccagctccagtccatcgatcaatagtagagcagatgggcgtagggggacaggcaatgctggtcctgccacgggctgcggagctgcgtcaggaacgggtcctggagccagtcgaagactccatggttggtcgccgccgggagctgcaggctgggtaggtccaccacaccctggctcgccgccggtagctgcagactgcacatgttcgacatcccatggttcgccgccgggagctcgaagccacagggtgggttcacggccgggagctgcagactgaagggcgcgttcgccgcgtgcggaagccacgacgtcgactccacggccaccgtggccaggtctgcttccttcttggctaccatgggcgccgtcgtggctgctgctgttgccagacagcgccaccgacgaggaggaggaggagggcatcaggaagttgtcccgggcgtcgtcggatgacgacaggtagaaatcgccggctg

SEQ ID NO: 12696 - DNA, 687 bp, Triticum aestivum
  Clone ID: PAT_TA_12696
ggttgtctttaagtacaataattcaattcttatctgatttttgctaatacaaggaacagtctgaatgttgtttataaaatcaacgatcctgactaattaagctagaagaaaatgtgcccaaaggaaatacttgcagccactagaaacaacaatgcttgcatcatcaaaatatcgaaattcactaagcatagcaggaaggtccgattattaaggagaagcgaagagaagctcaaaagaaaccctcactgctagcgtcgttaacacacaagttccccatagcttttccactgctctccccagaattcccgtgcaatcgaaatcaatcaccaatcaccatgccataaatcaacagagttaagtcttggagcatacagaggtgtccacacaaaatcgtgtcccacctcccatccatcgatcttcaaaatcatcgagatgctttgtagcatcaatggagatgtttgccactgttgtatttgaagctttcctcaaccacttaagtattcgactcttaggcgtgcatgcgaccaagagcacgcacaaacagatcgatgaagaacccaaggctcacaagacgcctctacttctcctgcagcatgtgtccatttcaacatcgatcttcttcacactgtcgaagacgaggaggagagagagccagcctcagcacccttcaccaatccggctcgacct

SEQ ID NO: 12697 - DNA, 794 bp, Triticum aestivum
  Clone ID: PAT_TA_12697
ttttttttttttttttttaaagaatctcaactttcccatatgatacgcgcatgtttcaacgttacaatgcagctaaattcatgcttcagttcaccatgcccctaagccagtgtctcagaaaatattacagaaagagagtcagtagcgccacgcgcccccccacaggatgttaatttcgcccttcaggtcagagctctatgcctccacagcaaatcagtcatgctcgcttgacgatgctaagattaaacactggttcgacgcttaaacgacagtgataagttactgctagtaccagtactacctacctatagtaagcactgaccgggaatttaatccaggataagcagggtacagggtgatggggaaggagttcagtcatcatcatcgtcagggatgtctatcacggcaggccaacttcttggatttggaggtgttggaccaggcgggtcagccgaacgaggtggaactggaaccacctgaccagcggcgatggagcacggagctggtggctgtgactgatctgcaggggcctgagccatcacctggtcagcaggagcgacagcagcagcaatgtccacgcttgtagaggcctccggtcgccccccctgctccgcccgtgggtggacctcgtgcctgggtggagctggtggctgggactgacctccagctccagggtcttcagccagcacctgatcagcgggaggagcaagaacatccattgatggagcttcagccatcacctcgtcatcgatagcaatgacctccaagtgtagaggcggtggctcggtttgtcc

SEQ ID NO: 12698 - DNA, 743 bp, Triticum aestivum
  Clone ID: PAT_TA_12698
cgtccgagatcctcaagagattcgatggggtagaggacgtcattgccgactccaaggcacacaaggtggttgtgaagggaaagaaggcggctgccgacccgatgaaggtggtggagcgcgttcagaagaagacgggccgcaaggtggagctcctctcgccgttaccgccgccgccggaggagaagaaggaagaggaaaagaaggaggaaccagagccgccgaaacctgaagagaaaaaggagccaacggtgatctccgtggtgctgaaggtgcacatgcactgcgaggcctgcgcccaggcgataaagaagaggatcgaaaagatgaaaggagtgcaatctgcagacccagacctgaaggcgtctgaagtgacggtgaagggcgtgtttgaggaggtcaagctgactgagtacgtgcacaagcgcaccggcaggcatgcggccattatcaagtccgagccggttgccccggccgagaaggccggcgaaggcgacgccaaggatgagaagaaggcagccgaaggcggcgaagagaagaaggacgacaaggaggagaagaaggacgacaaggatggcgctgcagacgagaagaaagaggagaaagacaaggaggatggcggcgccggcggcgaggagaaggagaaggagaaagaccccggcgccatcgccgcagccaacctctacatgcactacccgcagttcgcgttcccgggagggtactacccgccgaggccggggtacgcc

SEQ ID NO: 12699 - DNA, 1400 bp, Triticum aestivum
  Clone ID: PAT_TA_12699
gccgccgagagccccaccgccccacgagcgacccacccacagggaaccgcacagagcctccaccaccaccccacgccaccagggaaggggcagaggacaagagggacgcgcgcgaggggtggggaggggaagaagcccaaggaggacgcgcaggccacgccgcagcagaggccccaccgggagcagggcgcaacgcccccagacaagcacggccgtgggagcgggagagagggcgagggacgagcgacgtgagcgggggggggaggggcccccagggccggcacaagcgcaaccaggaggagtccgagagggaggagaacccccacgggggggaggaggacaggcccgagaacgacaagcccaaggggggggagggcgaaggggagatgcccaatgaggaggaggcggcgcccccggccggcagccgacgccgccggaggaggtcgtgatgcgcgtctgacatgcacgtgcgagggctgcgccaggaaggtcaagaagatcctcaagagattcgatggggtagaggacgtcattgccgactccaaggcacacaaggtggttgtgaagggaaagaaggcggctgccgacccgatgaaggtggtggagcgcgttcagaagaagacgggccgcaaggtggagctcctctcgccgttaccgccggccaggcatgagacgatggacaagtacgagccggtggccccagacgagaaggccggcgaaggggacgccaagggatgagaagaaggcagccgaaggcggcgaagagaagaaggacgacaaggaggagaagaaggacgacaaggatggcgccccagacgaaaagaaagaggagaaagacaaggaggatggcggcgccggcggcgaggagaaggagaaggagaaagaccccggcgccatcgccgcagccaacctctacatgcactacccgcagttcgccttcccgggagggtactacccgccgaggccggggtacgccgcctaccctccgccgccggcctacccgccgtacccgccgcagatcttcagcgacgagaacccgaacgcctgctccgtcatgtaaaaaaggttagaaccttggtggtctagagtggaaaacaaataagaaggggagaagggactgcatgagttgaggggtgccatggcagcaaaaatgccgtcgagcaaagcaaatggcagcagcttgaagaaagtaccaggcttttttgcggtcaggttttccttttttttgaaccttttatgtttttaccgtctggtataaagtaagtctggacttccttgtcagttgatggatgttttcatcttatgtagatttttctttttgccttgtactgaacttatgtaaaaactgttattatagtatagtaattctctccatctcaaaaaaaaaaaaaaaactcgag

SEQ ID NO: 12700 - DNA, 415 bp, Triticum aestivum
  Clone ID: PAT_TA_12700
cgggtcgacccactcgtccgctaaagcatggggttctggcttgcttcaatggcttgaattcaccaaactaagggggttatcaattcaaggcaggggcaccataaatggtagggggcaacagtggtggacctactcagacccaaatgacgatgaggatgacgacacatacaatcaggagcttgaaaggatgccacgggttaaacctacggcattgaggttctatggttcttcaaatgtcgagtggctggcatcacaattgtcaacagctcacagtgccatctcaagtttgacaactggctaggggtgctggtccacgacctgacaatatccttccctgagaacaagtctaacaccgacggaaaacacctgcagtaatttcaagatgtcagcatttatcattaccaacttggcttgc

SEQ ID NO: 12701 - DNA, 725 bp, Triticum aestivum
  Clone ID: PAT_TA_12701
atgaaaagatatgcaagctttgcgtattcgcgaaaaaaaagaactgcacagccaaaaccaagaaacacttttggtcttaactgaagcagatcaagaaacactagtggtcgctaaattaatctaggtacatctctagatgaccacgacgagtgtcgactaaaaaatgcagccaaatcttctcatggtctgcaggtatacagttaagctagataatgggatgaagaaagaaaccatggtttcacaacctgcgagccgcccccccggcaggtaccggagatcaatgagctaccggtttctcctggttagataatcacatgtcgaatcaacacgcattctcgtccaccctgtttggctctctcttctgcattttccacgccgaattctcgtccaacctcccaacgggcaccctgttgggctctctcttctgcaattttgatgctgactttccgtccagcctgccaaggggcaccctatctgggtctctgttcttcatagcattcgatgtctccttgagcatcactcttaagcctccttatgctaagtgtatccaatgacatcttccctccctgcccgcgccccacgccgctgggcctccggctgccctatgctcccctcgccggcccccccctgcgccggccggcatgcgctagcagtactatctccctcgcctccctcgccggcggatgccggaatgaactaacagtacctcggccgcgaccacgcta

SEQ ID NO: 12702 - DNA, 1191 bp, Triticum aestivum
  Clone ID: PAT_TA_12702
tcggggcgccggggccgccgttctgatgtcactccaacggcggaggtgtacccacaggaggcaaatccgcgagcttcacgcacagtcccttttgtaacaaaagcaatcgaccaccctgtggcgagatatggccctctgatgagttctggagtgacgttgtccgagcttgggtttatgacaaaagtgattcctaagcatgttaccatgaacggaggcgtgactttcatctgagaaattagaggggttccacatttgtggttctgggcatagactatgcattggctagtgcatgtgcattggccaaaagttgccgctggagatataataccctcaagttgccccttgttcgatatactgtcttaattgatatgaactagaatccctcaaccatgcagggaatttctttatctgggtgcttacgatagtgcaccctttactggcatccaaacatagtgcaagcttgcggagcatccaagtttggttgactgctgtggttacaagtcggaacttccaaattgccgagtggtattctcaacgtgtgaggcatgggtacgggtgtctagctatctataaagctcgacctcaagatcctttgactcgatagatggacctccaggccggcagcctggttctgtacctcctggcgcgcaaaatccccatcatcacaactgtagggtggtgcatgggcccccatagacgccagcaaaagaattaaaaacaggtcatttgagagtcttgcattgcaagactatttccaggcctgctgaatgcaccacagaagctgcccgccgcacaggttgacccttaggctcatataccctcatcctgctcgcccttttcccatcctattacttgatcttaaatcctgcgccatgccggcgcctggttgcatgttgttacgctcgccgaccgcacgccctgcgcgcaggctggcgtcggcacgttggtttcctgtgtgttcggagcgctggaagttggtattggggattgggaatttttgtcgtgttaccatgggagcgtcgggtaggcatctacctattgaagaacgccgccggttgcaatttgtggtttcatccccctcctataccatagactgtaattgccgcggcggaagtttgtgctacctctctatattgtaattgtactgtccccgccccccgctcgggtaccgggtttctcccaaaaaaaaaa

SEQ ID NO: 12703 - DNA, 553 bp, Triticum aestivum
  Clone ID: PAT_TA_12703
cgtccgcggacgcgtgggcggacgcgtgggcggacgcgtgggcgccggcgtgggtctggcgggcgtggcggccggtggggttctggcgggcttggcggccgacggcgatctggcgggcgtggctggagctagaagggcagcagtagcctgtggggtggccaccggaccgacagcaacttcaatggaggggaacggtccggcaggcgcatgcaggcgggagaaactgggggcgctcgtcggttgggaagatggcgaccacttgagcttctcgatctggacagggccactacagcacaagcaaggggtgggcgcgagcaacaatatggagccacacacgtctacagcccatacatagatgacaggcctgctcttggtgaaatatcaatagatggaagtcagcctaggcatatgtgtactaatttaggatatttcgaatttggggttagttcatagtagagcttgctttgcactatgtatctacccgccttcaacactatggtctgtctgctgggatgttttgacaagcacactatacttccctgggaagtttttt

SEQ ID NO: 12704 - DNA, 891 bp, Triticum aestivum
  unsure (1)..(891): unsure at all n locations
  Clone ID: PAT_TA_12704
ttanctngacttnccctttatcncgtacacanaatgtgcggtnccaccncaacnccngacactttngtaagganttnttaaatagcttnataacattgccccctttcttgttaaatttgaacttctatacaaattgaattatggatctctctatccatccccatttagtacatgatggaacctgtcgggtactaacacaaacacatactgtgcacacgccatgggcatccagtgataatttatgcatcaaatacaacatcaaaaaagaagaaaatgcatcagggtcataaaattgaagctccaggagacatcacgaccaactgcacaacattatagatctccacaggggcgcaactttcttctggattgcaagtcatttaatgctagttatcaagcaccggtggccatgggcatccagtgataattatgcagtgccgatggtaggagtcaactcggctggctggatcgcaaggcgttctccttctctgtattaagactgcgacttctttgattgttgcatatttccttcttcaaatttcatcttgaacttctgctttttgtttttccgctgcaacctgcaggggaaccggctgtgggtggtggagctcgagctccctcggcatggccctgcctctatgcccacatccagtgggcggctggacgtggttgcacgcatcggcaacagacaatggtggggggtggttgctgcagcgtcggccgtatgtggtggacctcggcggcagcgacagacgcgacaagctgcagtcgatacctccaggtgaagtgtttgtgcaaatcactgcaggtcgagtcttgttagctagcacaacagtgcaagaatacgaacatatattttctctgtagagctaacgtaaactatgtaacccagat

SEQ ID NO: 12705 - DNA, 761 bp, Triticum aestivum
  Clone ID: PAT_TA_12705
aataattacagccagactgtattcgcgccaccaccaaccgcagacaggcgacgaagacttggtagcctctcagtctcaggtccacgcccatcctcgccgccggcgacacccacccagagatccagatccagaggaggctgctctgtactcagccggcgggatggagatcgcggtgggcgcgctgtcgggcatggtggaggcgctgccgggcaagctgggcgagctgctgcagcaggagtacgacctgctctccggcgcccgcggggacgtcgccttcttccagtccgagctgagaaccatgaacgccgccgtcctgcgctgcgaggccctcgaggagcccgacgtccagaccaccggctggatcgcccaggtccgcgacctcgccttcgacatcgaggactgggtcgacctcttcgcccaccgcgtcgacgccggcggcacccacgacgccacctcccaccgcttctcccgctggatccgccggctcaccaccatccccgaccgccacgtcatcgcgaccgagctcaaggagctccgggcgcgcgtcgtcgaggtgagcgagctgcggaagcgctacagcctcggcccgcagatgccgtctcgtcacgcgcccgccgtcgacccccgcatcttcgcgctctacgccgacagcgccggcctcgtcggcatggacgggccgcgggacgaggtggcggggatggtgaccggacagggctcggacggcctcaagggtcgtttccatcgtcgggatggctggctcc

SEQ ID NO: 12706 - DNA, 714 bp, Triticum aestivum
  Clone ID: PAT_TA_12706
gcctctttttccgtggatgaaatacagatacaacaaactcctctatcactaacttctcacaagatgctaaaaaaaactactgtatattactactaataaagatccagaggcatccgtgcgaacactccgaactattaggtgatcatccagcaacacaacttttcgcataattcaatccatccccagagcagcatgttaaacgccacatgaaaaagatgctctaaaagaacacatagctaaaaagggtgtgccatgaaaattgatagcatcttctgccctgagcttgtgttgctcgatctggtttccccagaatctgatatctgcagttgatgtgatcctattacgtgggtctcattgatacagactcgcttgatttaaacaccttctcaagaggttgtctaagcatgtcgtagtatttatgttcataatgccttgtgtccctccaaaaaatgctcaagatttcccttccacgcctcgtttgcataaatcaaccattttaacagcgtcatgacatgtgtcatcatcctttcttggtaagaatttttgaagatccattattgctcggattgcataacatccatcaaagcaatgcccagtcaaagcattaaatggatccaataatttcttaaacgattctttttcccaatcaatagaagaatcatcagtactgaaaaagccttcttcatccagcaaatccatcaagcttgcaagttg

SEQ ID NO: 12707 - DNA, 1574 bp, Triticum aestivum
  Clone ID: PAT_TA_12707
tcgacccacgcgtccgtgcaaattaagcgatcttctcttctgtttcttggtgaggtgtccagcgcatgcagaaagagctagaaactaatccgggtctataccctttcgatgagataatctattgcaaccttagcaatccacattacctcggacaacagccaattaagtttttccgtgaggttcttgccttgtgtgattacccgcatcttctgaactgcagtgtaactagttccatattcagttctgatgcaataacaagggcaagggagattctagacctcattcctgggagagcaatgggaggatacagccactgtcagggtactgaagggttgcgaaatgcaattgctgctggaatagccactcgtgatgctttcccatgcaatgcagaggacattttcctgacagatggagcagccgcgccggttcatatggtaatgcacctgttgatacgagatgaaaaagatggcatcctttgcccgattccatcacacttcctttatacaagctcaatggctctgtgtggcgcaactcttgtaccatattaccttgacgaatcaggaggttgggccgtgagtatttcgaacctgaagaagcagctggatggtgcccgatctgaaggcatcactgttaggggacttgtggttgtaaatccaggcaatcctactgggcaggttcttgtgaaggaaaaccagtgtgaaatagtggaattctgcaggaatgaaaaccttgttcttctagcagatgaggtttaccaagaaaatgtttacacagatgaaaagaaatttatctctttcaagaagatagcacggtccatgggttttggtgaagaagatatttctttaatatcattccattcagtttctaatggatactatggagaatgtgggagaagagggggttacatggaggtcactggcttcaattctgaagttcggaaacaagtatacaaagtggcatccctaagctcatgctccaacttagccggccaggttctcgtgagcctagtcatgaacccaccaaaggttggagatgagtcatacacctcttaccgggaagaaagagatcgcattatgttatcgttatcccgatgtgcagaggccatggtgcaggcattcaacagcctggaaggcctgacttgcagcaaggctgaaggggcaatgtttgtatttccatctgttcggctgcctaaaagggcgattgcggctgctgaggcaatgaacgccaagccagatgtgttctacgctctccgccttcttgaaaacactggcatcgtcgtcttgcctggttctgtgtttggacaagtacctggcgcatggcatttcagatgcacaatcctgcaacaggaggagaaagtacaactgataatctatcgctttaaggcgttccacaaagctttcatggaagaatttcgcgattaaaagtcgccagcttattttatctgtagcacaactttagaagtccggacagaaaaaacatgagctttgtaaactgtcagttacatgatttatgtctggaacaattgagtttttcctttgtatcattctgaagttaatctaaaacttatcctttgc

SEQ ID NO: 12708 - DNA, 517 bp, Triticum aestivum
  Clone ID: PAT_TA_12708
accaaccagtcatattactccctgacttcataggtctcttcctgccagcgaactcagtacggctggcgatgtcggttgtgttatccagtgttacatcatgaagacatatcagatgaccgtcctctgatgcaagtatatcagtctcaatgaagtctgcaccttcgtcgatagccctcaaatatgccgcagctgtctcttcgggtatttcgccattggaacccctgtgggcaatgttgtaaggcctgaatgtctgtagtggctgcttcttgtggtttacatccagctgactgtggcgacgggcggctgggttggcatcggatcctccaatgaataggagcaccaggacaatgacggaggcgtgccagagggaatccatggtgcttctgctgcctccctccttgcttccttctcctccttataagcgtagcctcctcctccgcctatcgagtcagagtcagagaagcttttaagaagcggtggcctggcacggaatattccttagagagcgatacacccc

SEQ ID NO: 12709 - DNA, 1834 bp, Triticum aestivum
  unsure (1)..(1834): unsure at all n locations
  Clone ID: PAT_TA_12709
cctgtcggtggtctgcgcggcgcctccgagctccctgaggctctgcacatgctaattcccacggtctcgatgcttttattatctatgatgctctttatcagtcccttctcgtgatctatgcgacgccattacctcgacgggtttgaagcagcccattatctccgtactgacatcagtgaaatagttcctttaaagggaggaggtatccagacttggcaacctaggctttagtgtgcatcaaccttcagcttcttggcgatctcgggctggaggtcctctgcacttcttttctttttcttggtggggagcggcccactcccggtacctctgcaaattgcccgtgaagtcgttgaacagggcgttgggtccgagttctctgaacccgtactcatattcggccataagggtcttgatggaagttgaagtgcaggaatgagttctcatttctggaatgtgtacggcatgcacctgaagattcagtagcgtgcgcccgttccctaaagtcccacagtgaatgccctggttctatactctcacacatgagaatggcaacaacaatgtagcgatgcatgacccttccctaaacaagtggcaccacccatctgttccccttgctcctgcagacatagtaatgccagtcgcatctgcaggtggccttgtgtgcttattggatcatagccacaggaacttctacatatgcaaccctcttacacaatcactaaaggaaattcctcccaggtcagtccaggcatggtcaagagtgtcagtggggatggtgctgaatggaagaacttctaatgagggttacaaagtgatgtggttgcgaaatgatggaaatcatgaagtttacgactcagtgcagaatatgtggtctcagccaggcgagtttcctccaagcatcaagctcccacttgctctaaatttcaggtcacagccagtcgcggttggcagcacgctgtacttcatgtgctcagaacccgagggtgttttgtcatatgatgtaagcactgggatttggattcatttcatcatcccgctgccgctgcatctgactgaccacacacttgccgagttccaggggaagatcatgcttgtgggtctgctgtgcaagaacgcagcaacctgcgtctgcatctgggagttgcagaagatgactctcctctggaaggaggtggacagaatgccaaatatctggtgcttagaattctacggtaagcacatgaggatgacctgcctgggcaacagcggcttgctcatgctctccttgaaggcgaagcggatgaaccgcctcgtgatgtacaaccttgtgagcaaggagtggcagaaggttcctgactgcatgctcccttgcagccgcaagaagcagtggatagcatgtggcacggcattcggcccgtgcccctctgcctcgccctgacggttctcagcaaaggttgacattgtcgctttcattttgttacacattcctgtgtcgtcgcgacttggcgagaaggttatctgttatgttattgtacaaattcatgtcaaagtggttgttttcgttacttgctgaagcaatcggaccattttgttactgtcggttttatcatccgcgagaatttgtgtcggtgcaatggcaactgatcagttgaactgaatctgttaaggttactgcgatcaaaaggctgaagagcagacatctgttactgtattagaacttttatttgttccgttgttgtgtcatgttcagtatgtaatatttgtactaaatctcgggtcatctcctcagcaaaactgagcctactctataataataacaactggagttgtattaaaaaaaaaanaaaaaaaaaaa

SEQ ID NO: 12710 - DNA, 1119 bp, Triticum aestivum
  Clone ID: PAT_TA_12710
ccacgcgtcccgcctgcgccccccccaccacaaaaaaagcgagacgacgggacgagacggcgcgagcgagacagacaggccggggcccgggcccgggcgcgccccaccccaccacgccctaggcgacgagacgcgacggcgacgacggcggcggcgaaggcgtatcccgcgtccgcgcgcccgggtgcgcggctcatccggccggcccgctcggcccggccatgtccactcagtgggttctttgcaagttcttcatgcattgtgcttgcttgaaaggagagtattgtgagttctcccacgactggggtgaccaagcaaataatgtttgcacgttttaccagagaggctcatgctcttatggtaaccgttgcagatatgaccatgtcaaggtttctcgtaacaacccagtgcctccactaccatcatcaagtatcgcaacacgtaattccccacttcgcccgccaccatcatcaagtactgcgacacatgttgcatctacatctccacaacttttaagttctggacgtcctcttcacttgggacaccaaacaaattcaagcaaccaacgacaacagatatctatggataagctggcagtttctgaaagtaagcctgcatggaggaatgaggtccaacttgacagtgtatcagaggatgggattggctggtcatccattcaaactgcgcaaaaccaaacttccatgaaacttgctgatatgccaatttgttcttttgctgctggtggtaactgcccgtatggcgaagagtgccctcacatgcatggggatttgtgtgcgttctgtgggaaaatgtgcttcctcccgttgcgtcccggtgagaggcaggagcatatcaagctatgtgaaaaaaaccacaagcgtcttgaggctttgaaacgtagccaagaaatagaatgcagtgtctgcttggaccgtgtgctctcaaagcctactgctgctgaaaggaaattcggactattatctgaatgtgatcatcccttctgtatttcatgcataagaaattggcgtggcaactctcctacatctggtatggatgtgaactcagcactgagagcttgcccaatatgccgcaacctttcgtacctgcccgggcgctcga

SEQ ID NO: 12711 - DNA, 765 bp, Triticum aestivum
  unsure (1)..(765): unsure at all n locations
  Clone ID: PAT_TA_12711
ggttttttttttttttttttttttggtggaataaaagttcaacatatatactagaatggcaaaatccaacacattgaaacaacaaacatatgaacacaccaccttcactaagacgataccgttacacgaacaaggccatagtcctgaaagagggtgacgtgatgacatgattgaagcggaaacaatgtgcgtgccatgattctaacgctaggttgatgcttacggagcagcatcatgcggccaagtgctctccaccaccaccttcttccccctccnggcggcggcccccgaaggacactcatctcctccaactagctcgtttctccccccccactcctccgccccgccccctggccaactcctccctgcatccccccccgccctcctccctcccctgccgcccctgcggctgcctccggcagcctccaggcgggcagcccctgttggttttctcccttggatcgggaaaacaaaatgactgggaaatggagctgcaaaatctacaactgctagctagtccatgtccatgtacacaaacaactgttttctgccaatcggaaattagatgctctcttgctttcattgtgtttgcgttaagtacgcagatcatacctgtctcttgggaatatgagtttctgtcttgctcagaatatccagaacttctgctatattaggtcgattgtttctgtcaggttcaacaaaacgcattgctgtgtcaatgcatatctgcacttgatgtgattcctctaatgggtactccgaagt

SEQ ID NO: 12712 - DNA, 737 bp, Triticum aestivum
  Clone ID: PAT_TA_12712
aaggttggacagtaataatcacaccatgtacaacatgacagccctattcctacaagaaaaatgggttttcaaaatgtacctaaccaaatggcctgttatacttggagccagacaatagacaaaacccagagttatattacaccacaacacagggcatttctagtacagggagcaaaagaccatcccagaggcaggcgtcacatcctaatcggtttgaatcaggatcgcacttaaacctgaacatttgtttccatgggtggctcgtgctagaacagatttcatccatcaaaacttcatggtgcttgctttaggtgccaagacagatgattaaggcactcaatatggtgcaaacatgatgatccagcagcagcaaccgtgtcatgacgatattggctcgtaaggaaaagaaagccacgggtgtttcaatgcttccaaggcgcttgggcgcttcttcggattcacctcgagaaggtatgaaacaaactcgatgaaaccctgatcggccatgggcaagcggtgccgcaatgatgtcttctttggaatcaagtattctagcctgctactctcctgatttctttcatacaacatgtgattctttgtgaagtgtttataagtatcacgcccctgtgcaagcatggcttgttctatggaaccaatgatgcccatcacacgtgcaagtaatgtcgcaggagaatcgttttgaaaaagaacattcccagtgcaaagttctgctagaa

SEQ ID NO: 12713 - DNA, 818 bp, Triticum aestivum
  Clone ID: PAT_TA_12713
gggcccgcctggccccccgccgccgccggcggcgccatcaacggctggaccccgcgccgcgccgacaccttcgagaagatcgacaagatcgggcaggggacgtacagcaatgtgtacaaggcgcgggactcgctgagcggcaagatcgtggcgctcaagaaggtgcgcttcgacaacctggagcccgagagcgtgcggttcatggcccgggagatcctcatcctccgccgcctcgaccaccccaacgtcatgaagctctacggcctcgtcacctcccgcatgtcctgcagcctctacctcgtcttcgactacatggtccacgacctcgccggcctcgccgccagccccgacatcaagttcacactgccacaggtcaagtgctatgtgcatcagctgctgtcagggttggagcactgccacaaccagggagtgctgcaccgtgacagctggggctcgatgctgccccccgccggcgtcgctgtgcggcgcgtccgagtctggggtcggccggcgcccttcgaccccggcctgtagcctccccgggccggtcgcggggtggccctctgggcccggccgcccgggcggcggtcggctgctccagattttggagcgggcgggctcccccgcagtgcccgatgggtccaagtcgaagttgcctcatgcaacgatatttaagcctcagcagccatacaaaagacgaataatggatacattcaaagattttccacaatccgcactgcggttgattgaaacactacttgcaattgatccagctgatcgtttgacagcgtcctctgcattaagaagtgatttcttta

SEQ ID NO: 12714 - DNA, 1099 bp, Triticum aestivum
  Clone ID: PAT_TA_12714
cgcagcctcgtcccttcgtcctcccacccgacccgatctcctcctaggtttcgctccccaccaccgcggaacgaaccggaaatggcggcgcggcacctcagatccggcctcccgctcctccaagcccgcctcgcggctaacgaatccgcggccgtcgctcaggtgtcgagggggcttgcaacggaggcggataagcctaaggagaacaagatcaaggttccaaaagctctgtatggtggcacgggcaactacgctagtgcgttgttccttgcagcagccaactcaaattcgttggaaaaagttgaatctgagattctcgatgttgtaggggcagccaagaagagccctatgttttctcaattcatgaaggacacatcagtgcctaaagaaaccagggtgaaggctataactgaaatattctctgaagccgggtttactgacatcacaaagaaattcttgtctgcactggcatccaatggaagactgaaatatgttgaacgcattgctgagagatttgttgatttgaccatggcacataggggggaggtgaaagttgttgtcaggactgttgttccacttcctgagaaggaggagaaagaacttaaggagaccttgcgtgatatccttgggaaagacaaaaccatcttggttgaacaaaagattgaccagagtatcatgggaggactggtgattgaatttgggcagaaggtgtttgacatgtcgatcaggactagggcgaagcaaatggaggcgttcttgaggcaaccctttgacatctaactgcctttcggatccagtgcagtggctgtgctgctgaaggttccctcgtgaaataaaagctttcctttacaagagaacggcactctgttttattttgtcttgtgggttaggaagaagcccactgaacaatctttaatttcctttctaccgaaaaaaacatggataaaaacatgaagagaggtcatggaaagtttttaattcaagtgtttgtaattttcggttgaagtgctctgttttcctcgtattcagtggtgtatgaatcgtgaaataatacgatgacagcacatttcgctgcttttcccaaacccccccccccccc

SEQ ID NO: 12715 - DNA, 1385 bp, Triticum aestivum
  Clone ID: PAT_TA_12715
atcaaccataaccatatagtaccaacgagtcgtgcacgaaaaccatcgcccaggccccccccccgggggaccttaagtgtagatgtgctctgaggcaactcaggggcaaccttagcgggcgcccgtggctcgcgctccacgcgcgcagcctcgtctcttcctcctctcacccgacccgatctcctcctaggtttcgctccccaccaccgcgggaaccaactggtaatcggcggcccgaccccaccgatcctacctttcgctcccccccgccgccgtagcgaaccggaaatggcggcgcggcacctcaggtccggcctcccgctcctccaagcgcgcctcgcggcggaacgaatccgcggccgtcgctcaggtttcgagggggcatggcaacgtacgcggataagcctaaggcagaacaagatcaaggttccaaaagctctgtatggtggcaccggcaactatgctacgtgcgttgttccttgcagcagaccaaacgcaaattcgtgggaacaaattgaatccgaaagtctccatgatggtgaggggcatccaacgaagagtcatgtgttttactgcaattctttgaaggacacatctattgcctacagaaaccaaggagttcaaggcctataatctgaatccattcgctgaactgccaagatttactgaaagcacaaactaaattcgagtcgtttgctggcatcccattggaagactgaaatatgttggagcgcattgctgagagatttgttgatttgaccatggcacataaggggggatgaaggaaagttgttgtcaatgactgttgttgccacttccattgataaggaggaagaaagaactatgattgagaaccttgcgtgatatccgattggggaaaggacaaaggccatcttggtttaacaaaagattgtccagagtatcatgggaggactgagtcattgaatttgggcagaaggtgatttacaatgtcgttcaggactagggcgaagcaaatggaggcattcttggagactaccctttgaacatctaactcccctttcggatctaaatcaacaccttgattttcagtggtctgagccgctgaaggttccctcgtgtctgcttcttcgatgttggtttgaaataaaagcttacctttacaagagaacgacactctgttttattttgtcttgtgggttaggaagaagcccgctgaacaatctttaatttcctttctgccaaaaaacatggataaaaacatgaggagaggtcatggaaagtttttaattcaagtgtttgtaattttcctttgaagtgctcctttttcctggtattcagtgctgtatggaataatacgatgacagtacatttcagtgcaaaataaaaaaaaattcggatgagcc

SEQ ID NO: 12716 - DNA, 732 bp, Triticum aestivum
  unsure (1)..(732): unsure at all n locations
  Clone ID: PAT_TA_12716
tttttttttttttttttttctaagggtgcatcattgaagaaggccatcacataagcaatttgtgcgcttaaccacaaatacagaaggtactaccttgacaggtggggaatattgtaaaagatgatatgaatagaacatccaagctacaaagtttattgtccgaaaagtacatccagactacaaagtaaactgaggagctgtcaaattatatgttggtccaactacactaccagaatttaagtggaaaggaaaagcacttcggatgttagttaaaggtgactgactgccagtttccgtcctccaggtccatatggcaggaaaatcaattatactttcaccttcttgctgttggctttcgcgcccgtcgcgcgtcccgccttctccggtccggtggaatccaaaagggacgatgactgttctttgttggatgaagattttgcaaaggggttaagtggccgctgaggctctcctcggttgctgtcttcactgcccttatttttagcaccagcctgatcaatgcctcctttcaaaatctgttcagctgctccatccctctccctttttgctttcccttctgagttatcatttttcttgggtatcttagctaaaggggtaaccacaggtgaaacctttggagtgttatccttcacatcttttggttgttctaattctgccttcttaggtccagctgcactgcttcgtcgggcaaaagggttcggtgtggatgcctnc

SEQ ID NO: 12717 - DNA, 665 bp, Triticum aestivum
  Clone ID: PAT_TA_12717
attcggcacgaggtttttacaaatttttgttagctaacgaaattttgctttgttatatcttcataatactcaaacgacaccattgcagccaattgaaagttaacctgagggtcgggtccctacttgcagtgccaaatgaattggatggtctaacaaccacaatgacaccttccaactacaaaatctcaacacctgtacaaactaaaagcactaggcccctatagaaatgctatttgttacctcccctgagaaacatttatctatcactgcccctattacaccattccatgagcaaaattgtgttccatctcgggaggtgatgctaaaccatgaacaaataattcaagtcgtccactgtcagtcgagtctgaccgccaccagatttatcttccccaaaagctgaggcaaccatctcccgctttttctcctggagtgccagaatacgatcttcaacagtatctttgacagttaacctagatactgtgactggtcgtgtttggccaatacggtgtgctctatcaacagcttggtcctcagtggtaggattccaccaaagatcgagcataagcacatggcaggcagccaccatatttagaccaagactcgcagctttgagagacatgatcataacagaaacctctggaactgttttgaagtcgttcacg

SEQ ID NO: 12718 - DNA, 2357 bp, Triticum aestivum
  Clone ID: PAT_TA_12718
ttaattcggcacgagagaagctcggtcttacctcacgcaccaccagcgcgccggcgttctcccctccaccgtgccgaccgaccccgagcggcgccgcggctgacccagcgtgatgtggcgccatgcggcggccaggcggtcggcgcagatccggcggctcctgtccacgtccgccccctcgtcgggcgccggctccgccgtgcgcggcccctgcatcgtgcacaagcgcggcaccgacatcctccacgacccctggtacaacaaggacacggcgttccccctcacggagcgggaccgcctcggcctccggggcctgctcccgccgcgggtcatgtcgttcgagcagcagtacgagcgcttcataaactcgtaccattcgctggagcacaacacgcagggggagcccgattccgtggtctcgctggccaagtggaggatcctcaacaggctgcacgaccggaacgagacgttgtactacagggtgctaattgacaatatcaaggatttcgcaccaataatatacacccctactgtcggcttggtctgcgaaaactacagcgggctgttcaggcgtccccgcgggatgtacttcagtgcaaaggataaaggggagatgatgtcgatgatttacaactggccagcagagaaggttgacatgatagttgtgactgacgggagtcggattctaggtttaggtgatcttggagttcagggcataggtatacctattggtaaacttgatgtttatgttgcagctgctggtatcaacccacagaaggttcttccaataatgcttgacgtgggaacaaataatgaagaactccttgaagacaagctatatttaggattgaggcaacctaggttggaaggagaggaatacttagctgttgtagatgagttcatggaagctgttcatgcacgctggccgaaagcaattgtgcagtttgaagacttccaaatgaaatgggcatttgaaactcttcagaggtatcggagccgattttgcatgttcaatgatgacgtgcaggggacagcaggagttgctctagctggtctacttggagctgttagagcacaaggtcgaccgctcgcagattttactaagcagaagatagttgtggtgggagctggaagtgctgggataggtgtgcttaacatggctaaacatgcaatgttaaggatgccagggacccataaaattggagaactgggtgaaggacacaatcaattctgggttctggacaaagatggccttattaccaaaagtagaaaagatctggatccagctgttgctcgttttgctagaggttatggtcctgaagaggtcgaagatctccatgagggggctagtcttgttgaagtggtcaagaaagtgaagcctcatgtccttttaggactatctggagttggcgggatatttaatgaggaggttctcaaggctatgaaagaatctgactccccctgccctgcaatttttgcaatgtccaacccaacaactaaagctgaatgtacgcctgaagatgtattcaagcatgttggagaaaatgcagtatttgccagtggaagccctttcagtaatgttactttaagcaatggtagaaaaggctatgctaatcaagcaaacaacatgtatctgtttcctgggattggtttaggagcccttctgtcaggtgctcggcatatttcggatggcatgctccatgctgcagctgagtgccttgcttcatacatcacagatgatgcgattcgaaaaggaatcctctttccttcaatttcaagtatcaggcacatcactgcacgtgtcggcgctgcagtcgcccgtgctgctgttgatgaagatctggccgagggatgccctgacttggatcctcgggacctcaggagcatgtcagagtcggatacggtggactacgtggctcggaagatgtggtaccctgtttacagcccactcgtcaacgacaaatagtgttcgacgaagcacacccgaagagacgtatcaggcacatacatttgttctgatcagtgaatacttcgctatttcggtttacctgctctacttgggagtatttcagcagatactgctgccacgtctactggctatattgttgcctcatttgtttacgttgacaggttcatcaaacattgctcaattttgagacccgttgagctacagttatgtccatgtggtaggacttgaataaatgtcagatgttggcagtctgtctcctgcatcttcattgttggcgtatgtctcttgcatcgccatcgttaaactagtcaaacaccgcaaatactcatgtggtgctgtactctcagaagctcactagttcataccactcgcctggcttctctttctt

SEQ ID NO: 12719 - DNA, 989 bp, Triticum aestivum
  Clone ID: PAT_TA_12719
ttccctccgccgaactgcaatgattctagcacctcatgccgatcctacatacatacactggccggcgccagcttgattaatttacagggttttcaaaggagaaaagggggagaagaaggaaaaagttgatgattggagcttgctgatgcctccaaacaaagggggcgacattgactggctggttgagttgtatagtcagtgatgtgagctggccgattcttccgatgaacaaagccgatcgccaccgcgggcaaattgttagttgcaaaattgcccagctatcctctatgttagcttctgcagctatatgttccccacgcatctctcctaggctttacatctcggcagttactaaaatgttaaaaacagatggaaaaatattgcacattcacatctggtcatccaacagatcttgcaaccaagttattcatcggtgaggaccgatcagcttgtagcatggaatcgcctgaattagtagaactttatgtttccatggctgtgagcatacggcaacagttcttccacctcaactctagaactgaaatagcccatgtttcttctcctctggtggagaatttcaacctccgccataaaaatactgtacactggtctgtggtcggagaagcgtgattctcctcggacatatgataactgaatgaggccggtaccatgccacaaaatacgatcacaccttgctggcgttcgcctctaacttcctcagtaagttccttacaactagagttaagtagaagggtgttctggttgactaaagtactaaagacgtcaccaagctggcgttcgcctcttttccttgggacgcacaccataaccagaataccggtctgagttgaaagagtatttatatgttggaggaaaataaatccttccttctttccatcctaggaaaacatgtccgcatctccgctctatacgaagctgatctctctccaacagttgcctccagttatgtgtttcaaccggacgcgtgg

SEQ ID NO: 12720 - DNA, 1396 bp, Triticum aestivum
  Clone ID: PAT_TA_12720
gcctgtgtcgactgattctcggtggcaggtggagcccatggcggaggcacagcccaggcgccgcgcgcgcatctcttcgcgagcgtaggacgactgcacggctgcgcacgcgccgctatatcttcagctgcaggcggccgccgtctcaaccgccacgaagagagcggcggggtgatcagatattttgaaggggatcgcgcatggcagaggcgcttcccggcggctgcatccgcgtctactcgcggtggtcgggctcctagcctgcgccgccgttccgcgccgcgcgtcccctgcgccccacgtcgggcttcctaccctcgacgccgaagctgagggcgtgagcaaacagcaggcgtgcggacggactggcgagtccgcccgctgcacggcggcgccctgcctccggtacggccaggaccgcggcagcctctaaagcgggtgccccggcgagcggccgtgcgaccccctcgacgcctgctgcatgcaccacgacaactgcgtcctcgtcaagaatgactacctgagcacggagtgcaacgagggcctgctggagtgcctggcggagctgcgggctggcacgggcacgttcgaggggaacaagtgcatgatcgacgaggtcatcgacgtgatcaccgtcgtcatcgaggccgccgtcgtcgccggccgggtcctgcacaagccctagctacatagtaccacggcggcgcgcgccggagccggcgagctggaggacaagcagcaaacaacttgctcggtaggtgggtggtgcatgccttttctgcttggtgtcactcgtcagtcacggtgtgtgtccgtgtcctgtcacgcatgcaccggcgcctcacgtacagtctcgcgggcacgggcgtgacatggttggtgcttcagctaagatcgacgatggcgccggattttgcgacatgtatatgggcatggttaccataacctgctttgcaggatttaatttacttgattgatgagttggttcgtctttgccagtttgcctacacatcatgtgcagctcgtacgtgttcatgtcatgcataattggcactactacactattgttacaactgtccaagtttcggtgaattttgctgtttaaagctgctctggattttgggggtaatctatagatcagtactgtaatttgtgtcgtctgaattatgtatagagcctttctgtgtagggctgccggttcgatctgcatataacgtgattagttttgtaaacactacatgtgcttagcttaggtggacagtggtgtcccagaaaggcgacgccatctgattgtatggttaggtgaatagtggtatccccagctcatcatggttcaagttctgatgctcacattaatcttaaatttacggtattgataaaaaaaaaaaacccacgc

SEQ ID NO: 12721 - DNA, 741 bp, Triticum aestivum
  unsure (1)..(741): unsure at all n locations
  Clone ID: PAT_TA_12721
gtaggctcaaagggaaaattctaagcaagagagatcccacatatgattgctacggcgaggggcgacgttaagtcacagattggatgtcatccgtcaaagggggaaaatggagaggaaaaattcttttctggtgagaaataacaccgtacaccagtaccgacggctgccccgtgcaggcagattctaaccctcttatctttcggtaagataaccaaggcaggtagctcagtgtcatagttgcataatacacagcgaaccagctaaacaaactgatgcaccataacagtgaccagctcagtgcttgccattgcttatgattcctttctatggcaccattagagcaaagcccatatgcttttggcccaaggggggtttatggcgctgacgctgatggtccataagcgatgagcccagtgagaacagctgcgtcatcatcatattgaacttgagtgtttccagccacgctattgagagggtttccaatcatactgaagattattgaagctatttcctgctctaagtccacccaacagctgatttcctatgtcatgctgctgctgctgctgctgctgctgctgctgctgctgctgctggcccaactgtgataggtcatgtgcgctgtgatgcattcccatcctcccgttcattgccattgcattgttcgtcactgccattctcaacccattagctgnnnnnnttgaaccanncccacccatnnnnncccaaccccattcctccgac

SEQ ID NO: 12722 - DNA, 1399 bp, Triticum aestivum
  Clone ID: PAT_TA_12722
tacctgtccggggtccgcgcggcggccccctcgtcccgtttttgctagagccccctctgcaccatagcctcccgatcagcgtgccgatcccctagctagcaatctacggtcacctctttatggcgctgctatgcaagggcattgtgaattgttagcatccgatttcaacgctgccggactggagtattgatggaatcatttctcatgtgaaacactttggtttgaagtcgatggataaacaaaaatgcgcaaagataagaactgaactgaaacagaaagcttcaggggcttttaaggaaggggaatattatatggcttcagagatgtatactggtgcaatggcatttgaccctagtccagatgattgtgcaatcatattggcaaacaggagtctcagtacgttgcgcggtgggaatggaagagctgctctctctgatgctagcatgtgcaggatggcgcgacctctttggccaaaagcctgctatcgagaaggggcagctcttatgttattgaagaagtacgagagagcatgcgaggcttttgcggatggcttgaagcttgagccttcaaatggtgatcttgcaaatgctttaagggaagcccaagaagcagcaaagaatgctcgtagccgtgaaaagtgactcacgtgtcaagtcgaatccgaagctatgctttgttgccgagcaccttttgtctagcctgaaaacttctaacaataatatcctgtggtttttaagacttccgtcgcacgcatggttggtgaactcgctagctgtagtagtcctcgattccagttcaagtgttaacaaacttgaccattctggtaaattaagaccgttgacggatgggtggaatcacctaattcagtattgtgcagaagggtgcgacctttttggccaaaagcctgctatcgagaagggtcagcttttatgttattgaaggactatgagaaagcatgcaaggcttttgcggatggcttgaagcttgaccctacaaatggtgatcttgcaaatgctttaagggaagcccaagaagctgcgaaggatgctcgtcgccctgaaaattgactgatgtgtcaaaccttacatgcagaatctgaggctctgttttgttgctaagcaccttttgtccatcctgaaaacttctgccaagaatatcccgtggtcgtttaagacttccgttgcacccatcgtttgtaaatataactggggatgaactcgctgaccatagtatcttcattccagtgcatgtgttgacaaactttatcgtcacagaacgtacggcatagtccggtcaccgagaagcgctggaggcggagcagtatgtaattggctcattaattcttccttccccttacctcgcgggaagtggtaaatgatgaaatttggacttgaacaac

SEQ ID NO: 12723 - DNA, 796 bp, Triticum aestivum
  Clone ID: PAT_TA_12723
atgcgacacacaataatctgaaaaacccagctataggaagatgagatgatgcatgcttcctcttcagcacacagacaaatttagtgtgttctcaaactttctacatctaattaaccaaagtttatcaggaagaaactacgtactgcaaaccatgccaaacaaaaagaggagatgacgatgatgataaattaggagataattactagtactattaagcatccctgggatccagctcgggcagcttggccagcctcaccatgctctgctccatgacgccgttgcaccgcttgcaggacagcacgcccagcccacgcccgagcacgctccaccgcctctcgcccttgggctcccgcgcggcgccgccggtcttcttcttcccgccgtcgccgctgctcttggtgcaggcgaggtacgccgccaggaaagggtcgtcctccggccggacggccctcgagtagcccctcgccgccggcctgcccggcggcggcggcaccgacagccgcctcgccagcgccggcactttcctctggccctcccgcatgccaccaccacgggcttccgtcgagaccggcttcttcacggccggcttgtgctcccacgacaggaccaccggcgccttcctcgggctctccggcatgccctcctcctgctcccacgacaaggccacggtcagggcgtcctcttcttgccccatgtacgtacacaagggcaaagagccaccggcagctagctagctaactaatcaccaccggccggcctgtcgtgttggtatggaccaacggtttcttgccgtgct

SEQ ID NO: 12724 - DNA, 1008 bp, Triticum aestivum
  Clone ID: PAT_TA_12724
gtccttgagtcgagagatcgaatcggcggccgtgttcacacggattactcctttggatgccccattgacatgggagcctcatggttgcacggtgtcagtaatgagaattctttagcaccactgataagccatcttgggctgagattataccacactagtggtgacaactctgttttgtatgaccatgatttggaaagctgttcgctctttgataagaacggccttgcagtcccaatggagacggctgctaaagttggcgtgatatttgagaaaattctcaaggagacggtgaaactccgtgatgagcaggagcacgacatgccccttgaacaggccatctggatggtgcttgagaggcaccctgatctcaagctggaagggctagatgatcgaatcctgcaatggtgcgtctgccggctggaggcatggtttgctgcagatgcagatgaaatatctctgaagaactgggatcaggaacatgttctcactggtggccatggcctgatggttgatggatactttcctgtaattcaggctctcgctcaaggtctcgacatccgtctgaatcagagagtgaagaaaattgcacgccagcagaagggagtgaccgtcaccatcgaagacggcacgcaatactcggccgatgcctgcataatcactgtgccgctcggtgtgctgaaggcaaacataatcaagttcgagcctgagctgccatcctggaagagctccgccatcgccgaccttggtgtcggcatagaaaacaaggtcgccatgcacttcgacaaggccttctggcctaatgtccaggtgctgggcatggtcggcccgacgcccaagacgtgcggctacttcctgaacctccacaaggccaccggccacccggtgctcgtcttcatggccgcccggtcggttcgcccaggatgtggagaagctctcggacaaggaggcggtggaactcgtcatgtgtcacctgagggaagatgatacccgacgccccttgacccactc

SEQ ID NO: 12725 - DNA, 3384 bp, Triticum aestivum
  Clone ID: PAT_TA_12725
ttttcccacgcgtccgacgaagcgctcttcggtgatccggtttctgaatttgctggtcaaaacgttggcgttgtgattgctgaaacacagaagtacgcctatatggcggcgaagcaagccgtcatcgagtatagcaccgagaatctcgagccgcccattctgacaatagaggatgccatccaacatgacagctacttccatcctcccccatttttggctcctaagccagttggggatttcgagcaagggatgtctgaagctgatcacaagattttatcaggagaggtgaaacttgaatcacagtactacttctacatggagactcagaccgccttggccgtccccgacgaagataactgcatcaccgtctatgcctcaactcagatacccgaggtcacgcagaatgtcgtcgcggactgcctcagcattccgtaccacaatgttcgcatcgtcacaagaagagttggcggcggcttcggcgggaaggcaatgaaaggatgccatgtggcatgcgcgtgtgcagttgcagcgttcaagctgcggcgcccagtccggatgtacctcgaccgcaagacggacatgatcatggcaggagggcggcacccgatgaaggtgaagtacaacgtggggttcaagtcggacggcacgctcacggcgctgcacctcgacctcggcatcaacgccgggatatcgccggatgtgagcccggcgctcccgtcggccatcgtcggtgctctgaagaagtacaactggggcgccctggccttggacgtcaaggtgtgcaagaccaacgtctcgtccaagtcagccatgcgcggccccggggacgtgcagggctgcttcatcgcggaggccatcatcgagcacgtcgcgtccgcccacgcgtccgattctgccccccctctggcgcattcgcacgagtcccgccgtcccttctccatccaccgcccgccggaagaaagaaagcatctttgcttctcgccgccgccggggagggagggaggaaggaaggaggcaggggatcccattgggtgttgccggtttggagccagggtaatgagctgcctcacgttccgccgctccgccgccgacgccagccgcctccaggacggcctcctcgtcttcatgttcttcatctcgattcccatacgtagtctcaataatagtcgtactagtagtaattctagtattattagtagtaatctcttgtaaacgcacgccgctcgcgcacgcggttgcgttcgcgccgaccgaggggcctccctctgctgctggtgcgtctgtatcttcgtcttcttcttctcgtcgggcgacggtcgcgacggcggctatggatgcccaacagctacaaaactgcaggccttctgcttacatgcttcgagaggcggcgcgcttcgcctccgtctgtgatcgtgatcgccggcgcaatctcagggattgccgcggctcgtgtcctctccaattcctcttttgaggtgactgtccttgagtcgcgagatcgaatcggcggtccgtgtccacacggattactccgttgaaagccccattgacattggaggctccaggttgctcggagtcagtaatgtgaattctttagccccactgatttgcctggctgggctgagattgcaccgcaggatgagagcgtaccagactattggtgacaagtattttgagtgcggccctcttgtggaaagctgctcgcccactgatatgatcgggattgcagagacagaagacaggacggctaaggtgagcgtgaagggtgagcaaaatctcgacgaggcggtggagctcggctaccggcaggaacgggcgatccccgtcgcacggctccagacaatgtgcatcgaaggggatgatgctctgtacgatacaggtttattttagccatgcccgcattggtgtgtatgactgccagaagccgggtcagctgccagtagagtcagtccgtggttgaagcaacgcaatgtggaaaacattttaactttcacctatgccctgattggtgctgcctacagtctagtaacctcgtagatagttccaagctgctagccacgtcggacgcacaatttatagagttagccattgttatgcacgtcatcaaccagtaaatataatgcaggaactggataatcaccggccggccgatcactcacgagggcgcgctccggccggctcccgcgtaggtgtccatcctggacgacggctccatccccgtcgagctcggccgcctgcggatcgggcggcggctttatacccaggtggccatctggcggcatacgggctggctgagctctgtcccgccgccgccgagctcctgcgcaaggtgcctgacctcccgccagacccccggccccccggtgctcgtcgtcatgccggccggtgggttcgcccaggatgtgcagaagctctcagacaaggaggccgtggaactcgtcatgtgtcacctgaggaagatgatacccgacgccactgaacccagtcagtacctggtatcgcggtggggctcggacccgaactcgctggggtcctactcgtgcgacctggtggggaagccgtcggacgtgtgcgagaggttctcggcgccgctggagagcgtgcgctacttcgctggagaggcggccagcgcggagcactcgggagctgtgcacggcgcatactcgtcaggcatggacgccgctgaggagtcccggacgaggctgcggatgacggagggcggtcgggacctcgcccgggtgggcgtcgcctcctccgaagagatggcggacgtcgtcgcccctctccagatttgccgcacctagagcagattcttcgatacagctgcgttcggccatgcccgattggactgatgattgacagaagccgatcaatgtgcagtcgatcagtccgagtcggcagaacgcaagattgaattcagatttccttttttttcacatcttctattttctcgtgttgctttggatcaaggcacatttgatcgatgcctgtgctgctgtgcactgtgcacacttggtttatagcgttgccaatttgttatatccggtcaatcattaaatttgtgccaagagtccataagttttagagaggcacctccagagcctctcctctgcggccgccggtcccaacgccggcgtcaaggcgtgatggtacttgtgtaagttatgtagaaacgtgacacgtgtactgtaatgacacgaccgaaggtttgggacgctgcttgtctgcggtgtgcatagacaaagggagcatacagctagctacgtgatcgatttgaagcgtcgaagcctcacgaagttctacggcgacgccgccggcgaggcctcgacgtacagcctcgttgaaatattcgacaagctggcttcgtcgccggagtatcggagc

SEQ ID NO: 12726 - DNA, 623 bp, Triticum aestivum
  Clone ID: PAT_TA_12726
cgtccgctgacacgagggttccccagatctcgccgccggcacaaggcttgcgagggctgccccagaattcttcaacatctacccctactccttcgaccctgccgccctacacaattctgacgccagcacccccagcccggactgggtcctcctcgacacgaaggcgtacatcgccgaccgcaggaacggcaccactgccacagccttggcgagcaacggcgaagccgtcgaggtgaccttctggattgccgacccgccggctctttcccacttctctgttcactgcaaggagctttttgatatggcggaggagccccgtgttatctgttccgataagaaggtcgccatcctatgcctccactggatctattctaaattcggcaggtgcaaagttctccgtgactacttcgtctacacagccagatcgctgaacaaggccccctcgctcatgcggctcccgaacccatccccgcgtgtgttcaatccacgggagatgggtctcttgcccacagtcgacggggaaggtttcgttatcgctgttgttcgtccgcagttgataattccaggccgatatgatctccacctcttcatctccaagaactggagatggagcacaaagtctg

SEQ ID NO: 12727 - DNA, 1102 bp, Triticum aestivum
  Clone ID: PAT_TA_12727
cctactacgaacatagctaggccatatgaccaatcagacaaaattggggtggaaaacatggtatcagttagctcctgcctcctataagccaaaaaaacagataaggaaatcaaagatgaagctccactcccctttggcctctacgagttaaaactggatgttcagtgggtcagttcagtgtgcagccatggcttctccagaggttacagacataccaaagttccgatgcttgccatctgccttgttggtgagcttaaaacctttcgtgggtagctgatttatgagaagagtctccagttggcaggcaacactcttgccaggaacaatgatgtataatattgtggcatcctgcataccttccttcgatctatgagcaccaagacggcccacgagatcatccgtctgtccgacgtagagcttgttgtcacgtctgatgatgatatagatgctggacctcccaacagttgaaggtggcggttgctccctagcacctacagtaacgcagaccacctcaaccagttctgagatgcttctcttgttgtagagatccaacagtttatctttgcatattgcggtaacaatgctctcgacatccttccgcagcagtccagtagcacctgacggaggttcgaacatatttcccagaccatcaggcatatcaaccaagccatttacattggagtagccaacggaaggcccattgttggctgtcgatgatgtctgtttgttgcttctgctcatggtcaaatatagctcctctgctcttttaattatcaagtcaggcataccttccttcctggctgtttgaaaagcaaggctttctctacagataccatccataagtctccatgttggctgaatgcacccgttgaccacttctgttcccatagccttgaaatcagtattgttgagtgaaagaggcaggtcaaaaatgccatgcaaatgggttgatacgatgcctaggcagccaacatcatccagcctttcgatgatgctaccagcgatacaggttccttttgcagtttctgtgcctctacaaatctcatcaatgagaacaagactcctgccagtagctcgactaactaaagatcgtatctctgct

SEQ ID NO: 12728 - DNA, 832 bp, Triticum aestivum
  unsure (1)..(832): unsure at all n locations
  Clone ID: PAT_TA_12728
tttttttacggttcagcttactcaggaattcatcataggcaaaaatcaaatggtgaaagaagcaccagtagtacagtacacaaggcacccttcatgtgttacgagaccaatgcttcaaccatcatgcctttgtggcttctggttccaacagttaaaaactcccgtcgagctgtttcactagtcacaaccttcaacttaaattcatcacttggctgtttttcatatccagcacctttagaggcactggacacaaagactacaaaaactgcaaaagcctctgtaaaactgcataccttcactagggcggctcaatcagccagagccaacgatgacgagcgcatcaaaattccatactgctaccttggattgtcgatgtcagcatcatttgacgctttgctcctcggcagcagcagagagcttatactgaaggtaggctttgatgaagggatccagctcgccatccatcacaccgctgatgtccgacgtctcgcatgccgtccggacgtccttgacgagcttataggggtggaagacataattgcgtatctgttgcccccactccgccttcaccgcatcaccacggatctgcttgatctccgacgcacgctgctcctcggcgaccaccagaagctttgcctccagccgtcttagggccttcttcttggctgctggccctcccccctcctctgccctacgcacggcgatgccagtgggcagatcgccctggcgaaccgccccctcccccttgtccgcattctgccctccttggcctccagctcgcgctcgacttgggtccagaccctcttctggtcangggcggacatcctagggg

SEQ ID NO: 12729 - DNA, 770 bp, Triticum aestivum
  Clone ID: PAT_TA_12729
catactcggcagtcagtcatgtaaatgcagagatatgtacctacatagaatacagtactgttttctagtagccacattgttgaagcaactcgcggtcttcttgtaaaaactcagggtaacctctactactataatttattcatgactgttacatcatccggaaggttgcccacgggagaaactttgccaggagcttgatttcctcgtaaattgcatcagcggcatcatcatcaaacccaaagctgcgttcagactatacagccacacgccgcccagtaatatgttcaaggagctgcagccatgcttaacaatggcgacacttgagaccataaataaagacttgacatacatatatcctggaaccataacggtgcaagccaggcagaagaacagcaagtgcacggaaaacctttagcgtacgggaagtctggaacataaaggcctctcatcctcaccatcagtatcagactacgccccttctttgaactgcaggagtctaagccgttcctcgaataaagggtctgaaagctataggtaaatcatcctcatcacttggtgtcaaaatagtgcctttcttgaactgcaggagctggacgcattcctcggagacgggcgcttctgaaagctataggaaaatcatcctcatcatcggtatcagatcctcgtgccgcacgagccgggagccgttcctcgaacacggggtctgctgacacttacaggtctagcatccttcctcgtcctcctccccctgcccatcatcatgataagca

SEQ ID NO: 12730 - DNA, 780 bp, Triticum aestivum
  unsure (1)..(780): unsure at all n locations
  Clone ID: PAT_TA_12730
ttattaacangattagctttcacatccttttgatgagtagagtacgatgatatttacagttaattgccatggcaaaagaatgagtttaacagatgatgtgccctgtatattgcaaatgtagattataaaaacataaaaaaatgtaagaaagaaatatcgctgttgcttgtgttcatgaacctgtaataattagatcactgcacttcagcttcagaactgatgcaagacttcccagaagactagtggatggaaatccacgcattttgttcatatctgtgataagattgtcatgggctgcagtgactctgatgcggaaatgttgaatctctttccttttggatccttctcctatattcatatattctatacatcaacaaagaagataaacgtgtgttccaatcatgtggtctttgctttagccctttgccatccgttcagcaaaccatgttttccagtctgtaacgttttcatcgccatttgccacctcgaatatgagtgttgtctggggaatggcatccagggcctccacacaaattgtagcggcatcctctctgcttattttccccttggctgctataccctctgtaaaactgaaccccttctcaccacccggagtggtctccagagaagcactcctgattatcgtagatgggatgccagatgcaagaaccacctcttcatcccgctcggctagcttccttagcttgctgttcataatagcttgaagcccaccgctatttctgtagacagatagctgggatagcaggacnaatgtgttcg

SEQ ID NO: 12731 - DNA, 983 bp, Triticum aestivum
  Clone ID: PAT_TA_12731
cgtccgctcgtgtctttccttctcttctcaagagatcgacggcgccgcctcaagttctcggctttctagaaccttctagaagaaccgccgatgccttatagaatgggtcgtccggagaggagttttcgatggattaattgattattgattaattggttccggaacgccggccggtttcggtttcttccctgggccttggccttcttcttcatcttctttttcttgcggaagaggcgcgatggaggatgggaagatggggaacgtggcgacggtccgggcggtgctcgccatcctccaatggtggggcttcaacgtcaccgtcatcatcatcaacaagtggatcttccagaaactggagttcaaattccctctgaccgtgtcgtgtgtccacttcatatgctcttctattggagcatatatcgcaatccacgtgctcaaagtaaaaccgctgatccacgtcgaccccgaggaccgctggaagaggatcttccccatgtccttcgtgttctgcatgaacatcgtgctcgggaacgtcagcctgcgctacatcccggtctccttcatgcagaccatcaaatcgttcacccctgcaaccacggttattctgcagtggttggtttggagcaagcatttcgagtggcgcatatgggcttcgctggtcccgatagtcggggggatcctcttgacctcaatgacagagctcagcttcaacgtttttggattctgtgctgccatgataggctgcctcgccacgtctaccaagaccatcttggcggagtccctgctccacggatacaaatttgacagcattaacacagtgtactacatggcaccctttgccaccatgatactggctcttccagcaatgttgcttgaaggaggcggcgtaatcgactggttctacacgcacgactctgtcttttcttcgctgattatcatcctaggctcaggggtgcttgcgttttgcctcaacttctccatct

SEQ ID NO: 12732 - DNA, 1758 bp, Triticum aestivum
  unsure (1)..(1758): unsure at all n locations
  Clone ID: PAT_TA_12732
nnnnnnnnnnnnnnnnnnnnnnnnnnnnnnnnnnnnnnnnnnnnnnnnnnnnnnnnacccacgcgtccgcagatttgagagcggcagcttcctcccttccccttcctactctctcctactccttccccttcctactccactgacggacgggactcggccttcttcttgccttcctctcccccctcccccctcccgccgccgccttcctccgccggggctggttcagctactaactgcggccgggggaaggagaaaggccgcgtcttttccggccacctttcggctcgcccccagcccacgcgggagccggattgggatggagtcggccgccggcggcgggctgggcagcatgcgcgcggtgctcgccatcctccagtggtggggcttcaacgtcaccgtcatcatcatcaacaagtggatcttccagaagctggatttcaagttccccctgacggtgtcctgcgtccacttcatatgctcttcgatcggggcttacgtcgcgatccacgtgctcaaggcgaagccgctgattcaggtcgagcccgaggaccgctggaagaggatcttccccatgtccttcgtgttctgcatgaacatcgtgctcgggaacgtcagcctgcgctacatcccggtctccttcatgcagactatcaaatcgttcacccctgcaaccacagttattctgcagtggttggtttggagcaaggacattcgagtggcgcatatgggcttggctggttccgataggcggatatatccttctatccttccaatcagaggttggcttccacatttttggtgtcactgctccaatgatcggcgggtttggtttttgctcgtccacggttttggcggagtgcctcttccacaaataccatccttacagcaataccttctccgtctatatggcgccgtcagcaactaccctagaggctacgtggccacggttgcccctaggagcctctggaaacaagaggtcgtacacgcacgaaactgccttatcaacgagctgtacaattctgcggttaccggtccttcactttttgttatactttcgctgattatcatcctaccgttcaggggctgcttgcgttttgcctcaatttctccatcttctatggtgatccatgtcaaccagcccgcacgtgaccttcaatggttgcctggcaaccccttaaagttcgctggttgccgtattggtctcatggctgatcttccggaacccgatctcccccatgaatgcaatcggatgcgcaatcacgctcgtcggcttgtactttctatgggtatgtgaggcatctcatctcccaacagcaggctgctgcccccctggggagccaaggaacgaactcgccaagaagtcgggtggagatgctcccccttgtaggcgacaaggaagataaggtctagcaaggcaatactcccatattcaagagccgttcatttcagcggttgatggtacattacagtttggcgacacagatgctgagttgagggaggccagtaaattggtaggggggcaacactttcttgtgaagctgcatatgttgtactcatggcaaactgtgagggtttgttcagtcactagttgtcatagggttgctagttatctacttagtcaaatccccccaggacaattcatgcgattaggatggtgcttctgttttcttgttttgctgccatatgtttagaccttgaactgctggtatgaaacttaatggcgttacgatacgagtcatctttgcatcgaaattcaaa

SEQ ID NO: 12733 - DNA, 698 bp, Triticum aestivum
  Clone ID: PAT_TA_12733
tttttttttttttttttaaattttaaacttcgtttgataaacatacataccgaatacttatgtttagatacatatacatatgaatcaaccatataaggatgttgtgccacaaaataacttatgtttctaaatgtgccacaaccaaaatgatcatacagtggcttatgtgccaaaacaatcacctaaatgagtacagtaatacttgccaccatctccaggttcaacaaacaagtcataatacattataacaacagcaacttaattgtaggtcttccaaacctccagctccaacttgtagatcttccaaacctcgatcaacttgtgtatctttgggaaatctgcaacaagtcggaaactcaagctacataggcattaataatttccacgagataatgaacatttcgaggccttatcatctcattatatcttctaacactctattcttcttccatcacccacactgccgttgcatcttttaatctattgtccatgtcactttctcctgccttttgtcattcttttttccgaagatatgcaccctcacacaaaagcctgattaagaaaattgcacaagaataccactcatacttatcttaacaaagataaacagaactatggaaagcacacaaaaatatgagacgatggctgcaggtcagatataattcagacttgctgttgtcatcactccaagaaatatt

SEQ ID NO: 12734 - DNA, 1215 bp, Triticum aestivum
  Clone ID: PAT_TA_12734
ttttttttttttgttcacgactatttttcttgatttaacagcacatctcaattggaccaacagtacatcttttcatgcccaccgagttcatggaaatccattgttgaggggcaccgcatcactggactcgcagcagaatgatttattattattcaagtacatcaagactccgatcttggaactaccaagatcagagcatcatgaatgtaaattagaacttctgggacatattataaaacaacaatttgttctggaacacggataaaaatgcaccttgatctgatcaccagttgtgtaataacgcagagaagctctaatgggaagttggtacagacgcaggaccatctccggccaccctttgggcaaactgaacatcctgcttacactcgagcggagcatcataaatccataatgtggctatcaataggcctagtgcgaaaccagagtgatagatcatgacactgacttttgcttgtgcaagactcaaactatgcgacactaaagcacactaacttggtgactcttcagatggatgctcatctcagtgccatcaaatcgtgactcatccctgattcttaagagtgccatcatgactaatccccttggattagtcaaccttacagagtgctggactccattccagcatccaccatatatccatgacttgtcagatacagaatcaataataatgctgtatctaaacatcgacgatcacaatcccccaccaggacaggatttgaaccaagccagactgataagagcagccgtcgctcttgagataccgccccatccatcgggacagttcatgatctccaggtacatatgtcgaccatgataaggacaaccttatgaatacaaggatgattttttccaggtaagaacaagtgctgcaaatacagcagcactgttcttttagtcctgctgcaaactaaagttacctcaaggtataaatggttgggtgcatagttcagcttgctctttagtctgaaccactagcttgtgtaaactgaggtgagtgggctggtacaaccaagtgtggatgggagggaactggtgctgctactaaaaagggagccttgaatggtgggacgatttgttggggatgaattaattaagtttgacccagtgagatgcacaaattgatttcctggcatactgtaaccatgcatcatcggatagccgttgcccccaccagaaatggatgggctcaatgct

SEQ ID NO: 12735 - DNA, 841 bp, Triticum aestivum
  unsure (1)..(841): unsure at all n locations
  Clone ID: PAT_TA_12735
cgtccgcccacgcgtccggtcctcatggccattcctatcccccacccaatctcttccccttcacgatccttcttctcccccgctctacaaatatctctcttccatggtatgagcggctatgcttgagcgaagcgacggagtagcgaagattgcgaggtttggttggggacagatgggtgctccctgtgcagtgacctttccctccctctctctgcaccagattcatttctctgatcttcaagtcattttttcctacaatctcccatatccccgtgtgtttagtcgagatgactgccgtggagacatggtccttacctttcgtctctgactctattctggccaagggagctccgacgccgttggggagattggttctggtcggttccaccggaatcagaccagccactggtgcggcgtcgggcaggggcgcagggctgcagatctgcgacgagaggatgacctcaagaatctggaccgtgctgctatccagcaactagccgcggccaacatgggctacctccacatcggctgcacagccgccggtgcatgctgatccggccacctgcgccacagcagaacaatgagcgactccttatccttcccactactactgtatgtcatgtctatccgaaacattcaagtttggagctttcggatcgtacttcagaaagaacatttagttaccgccaaattcttctcatgcatgtacagaagatcgacaaatgtaagatactcattttgttgttatgtaattcaaaaaatctgtaatatgtgtgatatgtaaatacggccaagattgtaanacttttgnaacatcttatggtttaganatnnnnnnnna

SEQ ID NO: 12736 - DNA, 1515 bp, Triticum aestivum
  unsure (1)..(1515): unsure at all n locations
  Clone ID: PAT_TA_12736
ccacgcgtccggccggtgatgctcaagccaccgccgtcgatggcgctgccgcccgcctcccaggcgggctccacgtgggatatcctgctgtctttcgcgccagaggggcaagggcaaccacaggcgatcagatctgtccccgactttggagacccggatgccgaggacgacgaggatgcggcggaagtgttgacgttggaagatctcaggctgggggcgtccgcccacgcgtccgcaggcacatcctcgatatcgaccacaaacgacgatgagacaaccgagtctatgttctacatctcgcccaacgggaggtttaagaagaagatccggtcgtggagtcgaggtgtgctcttggggagtggctcctttgggaccgtctatgaggggatcagcgacgagggtgtctttttttgctgtcaaagaagtgtccttacatgatcaaggaagcaacgcacagcagtgtattttccaacttgagcaggaaattgcactcttgagtcagtttgaacatgagaatatagtacactacttcggaactgacaaagaggactcgaaactttacatcttccttgaactagtgacccaaggatctcttgtatctttgtatcagaagtaccgcctacgagatactcatgtttcggcatacacaagacaaatacttaatggattgaattacctccatgagaggaatattgttcatagagatattaaatgtgccaacatactggtgcatgcgaatggatccgtgaagcttgcggactttgggcttgctaagcagacctccaaactcaatgtgctaaaatcatgcaaaggaactgtatattggatggcacctgaggtcgtcaatcccaagaagacatatggacctgcagctgatatatggagtttgggttgcacggtcttagagatgttgacacgtcaacttccctatcctgatctggagtggacacaagccctttacaggattggcaagggggagccaccagcaattcctagtggcctttcgaaggaagctcgtgatttcattagccagtgtgtaaaaccgaatccagaagacagaccatccgcagccaaacttttggaccatccttttgtgaatagatctatgcgatctatacggtcgatgaggacatatacacgcccaaattcttctacacgtggcacgagcggatagagctgtggacaactccagcatatcggcagaattatattagtcctcgctaatcatgtggagctggctggaaaaaaggacgatccttgtaaacagagttgtcaaccagcatctcttgtgttttgttagttgattcttttctttaccgaattctggtgatccggctaatattatcctgcccggggagtagagtaaatgtgcatctgagcctagtgtaaagtaggagaggacacgatgtaaatacgcatggtgacttactgccttgatgtcaatgtcatggtgctggagagagatttcactggttgaaaaaaaaaaaaaaaaaaaaaaaaaanccaaaaaaaaaa

SEQ ID NO: 12737 - DNA, 1030 bp, Triticum aestivum
  Clone ID: PAT_TA_12737
actgaccctcgggagctttgaatttgtagctcaaatactatacagagacaacatgaatggtcaggaaacgagtcaacatactcgatgcagcattgcacttgtgctgcctcagctaccctcccatgttccttgaggaaactaattccttattccttgttgtgcattagctttaatcgacagagtagagaaaaaagaatggccggccaagaatcgactgtcatgaaccggatcactgcatcgtcttagagtaacacccacgggactgtcatgaaccagatccctgcatcgacttgagcaacttcttcagcgtatccacaatgcttgaaaacgaagggcgctgccttgggtcatcagaccaacaggattcaacaagagcagctagctctgggatggtgtctttagggattggcagccttctgttctggaatgcaactgcccctactacttgtgctgggcctaggccgccccatggttgctgcatcgtcaggagctcccttaagatcacgccaaagctgtacacgtcacatttctcgttggatggctcgccacggggaaactctggcgccatccattctggtgtcccagcgactgatttggatgatatgaaggtggtcgccttaaatctggacaagcccaaagtcacctacctttacggacccagttcttatccaccagcatgtttggtgtcttcagatcccaatgtactataggagggttcaggcagtggagatagttgatgccttttgcaacatctaatgccatgcgcaaacgccgccgtaaatcaagtatttccccactagaagctttgctgatgagacggaagaggctccctctgggcaagtactcagttactatcgacaaatgcgggcatttggtcactgcacccatgaatagtaccacgtttggatggcgaactcgtttcatgatagagatctctctaaggaattctttgagctgagcttcgccaacaccctggtctgtaagcacttttactgcaacatcagaaccgtgccagtcagctcgataaaca

SEQ ID NO: 12738 - DNA, 704 bp, Triticum aestivum
  unsure (1)..(704): unsure at all n locations
  Clone ID: PAT_TA_12738
taaatgaaatccgcacaactacaataaagtgatccagtgcatctggntttttacagtggaacgccgatccagtgccatcctacaacagcattcagttacctgctttactagaaacagaaatactcatctcaaacatacatagtacatttgagggtagaactatctgttctgtactatccctgcctcatctacaacctgccatgacaggacaacactgcgtagctgctggtcagtgcagacgcgctgttggaaattttgcatttgccacagaacaccaaccagacggacagaggggcgttaccatcgtctgaactcgtggagcacttggcttcagaactcgtgaatgatcttctgcagagaagagtaagtcccacttgcggcaaccaaggagccgagaacgatgatcatgacgatcagcgcgacctcagccctgctacacctcgccgtgccgaagattttcaggtagcagatgcacgggagcagcatggaggccatgacgctgagcagcgagccgacgagcgccatgaggtggccgaagaaggggacggtgagggccacgatgaccgtgctgatgacgatgaaggtcctgatgagcatgttgagggacctcttgttgccggcaagcagcttctcttcgaccgctgtcgcgacgggggtcaccatcagagcgtactttgagaacgggttgataagcggccgtgtag

SEQ ID NO: 12739 - DNA, 680 bp, Triticum aestivum
  Clone ID: PAT_TA_12739
cgtccgtgaagctgctgcagcagttatggccaggcttgctgttcacagagcagagacataccatgttagagatgtaatacgatggcttgacaagatgcttattcgcttcactgctaagttcggaaactatgtccctgaagatccatctacatttcgcttgtccactaatttctccctgtatccgcagttcatgtactacctgcgaaggtcacagttcattgatgttggcaacagctctcctgatgaaactgctttcttccggttgatgttgaatagggagggagttgtgggatccctgatcatgatccagccaactttattccaatactcatttgatggaccacctatccctgtgctgctagatgtcagctccatctctcctgatgtcattttgctatttgattcgtacttctatatagtgattcattatggctcgaagattgctcagtggaggaaacttggctatcatagagacccaaatcatgaaaacttacggaagctgcttgaagcaccagaagttgatgcagaggcactattggcagaccgttttccagtgccaaaactcataaaatgtgatcagcatgggagccaagccaggtttttactagcccgattgaatccatctgtgacacagaaatcacagctttctgaaggatctgaggtcatattcaccgacgatg

SEQ ID NO: 12740 - DNA, 455 bp, Triticum aestivum
  unsure (1)..(455): unsure at all n locations
  Clone ID: PAT_TA_12740
cgtccgcggacgcgtgggtttttgagccatatttttcttaccagtaaaggagatggacctaaaattgcgaaacggttggtggatgtctacattgcngttttcaaggtactcatgtcttaccctcgtgatagtaaaggagaaaaacaaagttaacatggcaagaaaaaggttgaatatgggaaaacaaatgggcgagaggacaaggtcaacgactccaattcacatggaaaccatgaaatggatccaccagcaggaacagatttagagatggattcccgccttctctctgcccttttatctggcgtaaatagagcgttaccatatgttgcaagctctgaagttgatgatattgtggaagttcagacaccaattctttttagactggttcactctgagaacttcaatgttggtgttcaggcgttaatgcttttatatcagatctccacaaaaaaatc

SEQ ID NO: 12741 - DNA, 783 bp, Triticum aestivum
  Clone ID: PAT_TA_12741
tcttctgaaggtgttgtcacggaggtcgttgagccatccgaagtcaggactgagaatgagaatgacccatggagagattagttagttctgtaggcatccattttattttttaaataccctggaggtggatgagcaaaaaatagaagtatcactggagccagagtgatgatgacatcgagcgatggactgtctttgtaagaacactgagctccagaatcttgtttgttatcgcccaaggctaaattttgtaggtgacttttttgacggccaaaaaaaaaaaaaaaaaaaaaaaaaaaaaagcggccgccgctggccgaggccttgctgccgtcgagaagtttgcggacctggagcataaaccaatgcctaagccagagcccaagcgtaaaccaatgcctaagccagaacccaagcctgaacctatgcctaagccggaaccgaagcctaaacccgaaccaaaaccaaagccaccaccaaagcacaagccgccaacagcttacaattgatgggattctatatatgcaaactgaaggatcgaggagatcatggccagagccacaatcgcgacatttatagaataagtggtgtagtaacaatgtcattctatccggctagctccatagtgatgcatcattctgtattctatgtatttcgttacatttacagagtttctgtttcatgtacccatgatgagcatcacagctttgtaattgttagctgcttgttggtgtatgttcaattttgtacgtgactcataaaaaagaaaaaaaaaggggcgtgccg

SEQ ID NO: 12742 - DNA, 3410 bp, Triticum aestivum
  unsure (1)..(3410): unsure at all n locations
  Clone ID: PAT_TA_12742
ggacagaccaagatcggacttccatagatgcagccgtccaagctagaagcagcggcacaacaaatccatccctagctgcggcaacaaggcgcgggccgcaatggcgagggacaagcccattgctgtcacgatgctcctagtcgaggtagggtctgcatcaaatttcctgaagacgggcgacgcagggcggccccttgccgacttctaaaagtttacggagaggggggtccacgccaaaacgggaaaccagggaagaaagtcgaaacgacggccgaggctacgagccagcaccgatcccaaatcctcagactcaaccgaggcgaaggcggtggccggccaagatcctcaagactatcaccatgcggattgccgggcgatggctttgatccggcacacacgactgtagccccaaagaagacttcctcccggagcaagtggtggaatgcgagttatgcgtaaggtaaggtgtaagttcttagaataaccaaaccacctgtgcaggttagttgtgtttgcatgtaaagattttttacaaaaagcaatggatccggaagtttgaggagcaggtgataggcgtattcgcatggtccaaaagataagatggaaggaattaatttggctgctattggaacaattccaaccttcaacactttcatgtcactgaggtaggttaaggaggctggcgcaagtattggactcagtggtcaaattggtgttggaatttattgggcttttcttgttgcaatgtcggttgtggtgcacgctgaggctcccacgtcagataagcagcaactataggaagctgaggcaaacaggggctcatgcgttatcagggaagagacggaccctgggggcttgctcacacgtggacgacagctttctctattttgatgtcaggaggctgggtgtgactttggaaagcctaagagggttcaaggatgacctatgaagaggttggagttttttgcgggccccatttttatatggtaaatgaactgtagaacagttggcgttaaataagaggagtccaaagaatagggagatgcagccgacggagagaaggagaagtaggagagaactatcagttcgaagttctggattttgcaggtggcaagtgaaacgaagtcgatgtggttgcggaaggcaaaggaagttgagtaaaccgactacaatgaattttacaagaaggcattcaatgagtttttggatcctctagctcatgcacacttcacaacagagggtgaggtggaatttaggagtgttctctacatcccaggaatggcaccacttagcaatgaggagataatgaaccctaagaccaaaaatatcaggttgtatgtcaagagggttttcatttctgatgactttgatggcgagctgttccccaggtacttgagctttgtcaaaggtgttgttgactcgaatgatctccctctgaatgtttctcgtgagattcttcaagaaagtcgtattgtcaggatcatgcgcaagagacttgttaggaagacttttgatatgattcaggatattgctgacaaggataacaaggaggactacaagaaattttgggagagctttggcaaatttatgaaacttggttgcattgaggactcaggaaatcagaagcgccttgctcctttgctgcggttttattcctctaaaaatgaaacggatttgataagtctggatcagtatgtggagaatatgcccgagacccaaaaggctatctattatattgctacagatagtcttcagagtgcaaagaccgctcctttcttggaaaagctgcttcagaaagatattgaagttctataccttatcgaaccgattgatgaggtagctattcagaatctgcagacgtacaaagagaaaaagtttgttgatatcagcaaggaagacctagaattgggcgatgaggatgaggacaaggaagaaaccaagcaggaatacactcttctttgtgactggataaagcagcagctgggtgacaaagttgccaaggtccaaatttcaaagcgactcagctcttcaccatgtgttcttgtatctggcaagtttggttggtcggctaacatggaaaggcttatgaaagcacaaacgcttggtgacacatcaagcttggagttcatgagaggaagaagaatttttgaaatcaaccccgaccaccctattgtcaaggacttgagtgctgcttgcaagaacgagcctgagagcaccgaagccaagagggcagttgagttgctgtacgagactgccctgatctccagtggatacactcctgagagtccagcggagttggggggcaagatctacgagatgatgaccatcgcccttggcgggagatggggtagatccggcaccgaggaggctgagaccaatgccgacgtcgactcttctgaaggtgttgtaacggaggtcgttgagccatccgaagtcaggactgagaacgagaatgacccatggagagattagttagttctgtaggcatccattttttttaaataccctggaggtggatgagcaaaaaatagaagtatcactggagccagagtgatgatgacatcgagcgatggactgtctttgtaagaacactgagctccaaaatcttgtttgttatcgcccaaggctaaattttgtaggtgacttttttgacggccgtgaaaataatttatctttattactgtaaaaacctgcccgggcggccgctcgaaatcacttagtgaattcannggggccnttaccggcaagggcgcctttnaaaccgtgagcccaagccatatctatccatgggcatgctgatgctgtacatcccacctgcaccaaccatagaaccactagaatatgggggtggtgccgccatatgcattggcccataggggctccccatcgggactcgcccgccatagccatacggatatccagagcccggagggagctgaggaatgccatagcgtggcatgggatgcccattatagaggttggagccatacgggggaggagccccggtgaggtacatggacggaggcgtccccggcggcatgtaccgccccggcaccgagtagtggggtggagtctgcatagccgtgtgatctgcgggcctggactggtcgcagttgcgcatgttgcaggtggtgcggaatgcgaagttgacgttgttacagctggggcaaatccagtcgtcctcacgccggctaccgtctgtgcgcgcgcgctttccagcggactggatgcggttattcatctgagaagacattgctggtggtgggcgaaccgagaacagcagccggcgagcgcgaagacgtccgcgagacgcacgggcggaggggaatccggcggcgagagaggggaacgcgtcgccggtctagggttttgacgtcttgtcgatactggtttgtcccagcccggccggc

SEQ ID NO: 12743 - DNA, 722 bp, Triticum aestivum
  Clone ID: PAT_TA_12743
tggaactgcttctctgccgtgctgtttctgtttcctcttccttggcaacaacaatacctattcttgttactgctgaaccaacatttagcaatatgcccatattgatctcaactaatttagaaagatcaggccaccacagcttggccaaagggcattcaaagaacaattgagaaatatcaccaacaaggtcgtgcctatcacactgcctattggggctaagaaaccctataaacacatggaacccgatgggaatttcagtttgcaacagagcaggagttgtacaccataatcccagaagagtttttctctggtctttttcttctttccaccggcaaacgatatagaagatgttatatgcagcaatccatgccacaaaaccatgagcctccaaaaccgtcaactgggcagtacaaattctcccggcagtcgattttgggtgcactcaactcggacaaaggaactcaagtttttcgccagcacaaatagaacaaaagcacgtccaccctgaccgaactgttcagcacaaccagcaacaaattagactgaagttcacttcaaattcaagatgtggaccgtgctgtgttagggtggggaatcatggatagatgaaccatgctccagaacagatctacaagcaagttgagactgctcttagatcaaccatggtccttggcctctcctccaattgacaggctgctgcagctacaccatcgccgatggct

SEQ ID NO: 12744 - DNA, 1235 bp, Triticum aestivum
  Clone ID: PAT_TA_12744
gcacccgtcagtatttacaatggctaggacattgctatctggaaacaatattgtctataatggtgatccattgacagacctgtcgcttcctgccttccttgacaaattcatggagaagaaaccaaaaggaaaccgcattgctgaagggaaatggcatggtggatcacaaattgcaccagctaaaaagcttgacctgaatcatcatctcattggacaagatctgctagaattggcagaaaatgaagttcctccagaagactgttgttttccaccgcttctacatgaacaagacaggccctattaagcccaaggcaaagaagaaagcttcaggtcggggcggcggcgctggcgcgcgcttgccgggggccgttggggccgtcaggggtgagggtgatgacgagatgcaggaggtggatgaaagtgatgacgagatgcaggtgctggaagatgagtccgcggaggatggagaatatgactacgacaatctggacgccaaggcatttgaggaggaaggggatttgcttagagatgacagtgatgctgatgtgttggatgacatttcagatgacgacgaggatgatgatgaagatgatggtcttaacatgtcatatgtggacgagagtgctgacgattcagatgatgatgttaccgatgtaaaggctgcagctgcagcccgtgggcaaaagcgaaagagccgctcaactccatttgcaagtctagaagagtacgaacatctcatggagggggaggctgagaagtctactttgaagaagcagcggaagcacaaggaagctggggacagtgtgggccgtaaggagagaggacagaaacagtcgggatcacgaaagagaaagtccaagagatctgaatgagaatgagcttataccatgttggaaaatgtttgtggcgatgttgctcgctaaagttttgtagttttggaagacgcaagcggctggcaacatgttggtcttaccttctggcactcgccgccaccagttcctctccgcccgtccttttgccggtgtggacgcgctagctcttgcaggaagaaagaccggcgtgtgatcaggctcggagaattaaccaatcagtcatcatctcgtctaggcgtgtaacagcttggattctctaattttgacattttttgtatgttgcatacatttttttcctacattatgtaaaccgggtgcatgaagaagctatatccacctaaatttgttattttttcataaaat

SEQ ID NO: 12745 - DNA, 712 bp, Triticum aestivum
  Clone ID: PAT_TA_12745
gccggccgggttccggaattcaagtttccccaaatcaaggcccatccatggcataaggtgttccacaagcgaatgccacctgaagcagtggacctggtttccaggcttcttcagtactcaccgcaccttcggtcctcagctctggatgctctgatccatccattcttcgatgagctccatgacccaaacacccgcctccccaacggccggttccttcctcccctcttcaacttcaagccccacgagctgaaggggcttccgatggagatcgcggcgaagctggtcccggagcacgcgaggagccaatgcccgttcctagggctgtaggatctggcctgctggctacatgtgcgaaaaggtgctgtctgccatgctagcgaatagcgctcctacctagagggaggactaggcgtcggaacaagtgaacatgatccatgtgggtggtgtctgtactgttgctttggacggtttgcgtgtggtcttgaactgccgggacaaagagtcggagaaaacgactaagtgaggattgcagtagcagaagtggctgtgtacgctttgattgatgaattccgttgtagatggtggtggtgccatcgactcttgtccgagttaggatgggcgtcaaagacttatgagatagcatgaaaaattttctacaaaccgacaagtaattgcatttgtcatatcgtcaaatgtgatcggcatgcctggg

SEQ ID NO: 12746 - DNA, 2002 bp, Triticum aestivum
  Clone ID: PAT_TA_12746
ggctagccggcagcccccaacttttggcagggctgagaagggcacgaaccaaacagcccctccatttccttttccccgtgccttctccccaacccaccccaccccaccccacccccccggcccactgccgtcagcacagcgacgcgacccccgcacccgcacccgctgctgcgactggactggactggagtggagcgcactccagtggaggcgaccctgagcagctgcggaccaggccctccgatccgcccgcgcccgcgcccgccgcagccctatggtccggccgcccaccggagcgcctcgccgccgcagcaacccggtaataacatgttcagtgctctgaaggtttcagagtcataattccgaatcagctcaatgacctcatttggtgtcgcaccggcatctgggctgagagatgctggtggtagtagtgaagtggataaattgccggatgaaattagtaatatgagaataagtgacgaaaaggaagtagaggcaacaatcatcaatgggaatggaacagaagctggtcatattatagtcacaactatcggaggcagagatggccaaaggaagcagacaataagttacatggctgaacgtgtcattggtcaaggatcatttggtgttgtgttccaggcaaaatgtttggagacaagtgagacagtagctatcaagaaggttcttcaggataagagatacaagaaccgtgagttgcaaatgatgcgtctacttgaccatccaaatgtcgtctctctcaaacactgcttcttctcaaccactgaaaaggatgaactctttctgaatcttgtgcttgagtatgttcctgagacagtccaccgtgtcatcagacactacaacaagatgaaccaacgcatgccactgatatatgtgaagctatatacttatcagatttgtagggcactggcttatatccatcgcaccgttggtgtttgccacagggacataaaaccacagaatcttctggttaacccacacactcatcagctgaagatctgtgatttcggaagtgcaaaagttctggtgaaaggcgaacccaatatatcatacatctgctctaggtactatagggcaccggagcttatttttggtgctactgagtacacgacagcaatcgacatctggtctgctggatgtgttcttgctgaacttctgacaggacagcctctgtttcccggtgaaagtggagttgatcaacttgttgaaattatcaagattctgggcacacctacaagggaagaaatcaaatgtatgaacccgaactacacagagttcaagtttccccaaatcaaggcccatccatggcataaggtgttccacaagcgaatgccacctgaagcagtggacctggtttccaggcttcttcagtactcaccgcaccttcggtcctcagctctggacgctctgatccatccgttcttcgacgagctccgggacccaaacacccgcctccccaacggccggttcctacctcccctcgtcaacttcaagcctcacgagctgaaggggcttccgatggagatcgcggcgaagctggtcccggagcacgcgaggagccaatgccccttcctagggctgtaggatctgatccggcctgctggctacatgtgcgaaaaggtgctgtctgccatgctagcgaatagcgctcctgcctagagggaggactaggcgtcggaacaagtgaacatgatccatgtgggtggtgtctgtactgttgctttggacggtttgcgtgtggtcttgaactgccgggacgaacgactgagcaagtgaggattgcagtgacagaagtggctgtgtacgctttgattgatgaattccgttgtagatggtggtgccatccactcttgttgagttagggtgggcgtccaaagacttatgagataacatgaaaatattctgcaaaaccgtgaagtgactgcgtctatcatatcgtcaaatttaatcggcgtgctaaaggaaaaaaattacagcagatgag

SEQ ID NO: 12747 - DNA, 1250 bp, Triticum aestivum
  Clone ID: PAT_TA_12747
cgtccgcggacgcgtgggcggacgcgtgggcggacgcgtgggcggacgcgtgggttgacttccaattgttcaaacatgcaatgcatagcgtcagcaagcaggttgacagcatgtcaaagaatgttcttgccaattcctcttcatcaagaaaaaacgtgatgaggatacctcgcgaaaccctcatgaatcatggtgagaaagagaagaatgtcttcagtagtgaatttagcaaaggctgtgagatccttcaaaagtcaaaagcagcaattgtacttgttacaaatggctcagactctgatattgtggatgctgagtttcagagattgcttaactcttttagtgagttaatgaaggtagaagaaaatcatatatctcccccttttgttattgtttctcctggcgatcatgtggattcagttcggaactacttgatagagaacgactattttggttttgacactcagaaggtatgggtccttgaagagatgaaactaccagttgtcagtctgtcctctgagctagggagcaaaaaaattctgctgaagtccccatgggagatacttcaaaggccagctggatctggggcgattttcagctcactatcatcaaataaaattttggaatcgttcaatgcaatgggcatagagtacgtacagatatgcagcccctctgacgaactagtcctcgggcatcctctgctcttcggtgctgcaagttcgcgcagtgtggatgtcggtgtcaagctccgcaagaccagcgacaagacggaagatggtttcgatttgatcctttccatcgaccacttgaacaagatgtgccgagacgtcgccaaggccaggttctctgcccaccccgagcagcacgaacacgtcgagcttgtcgacggccagtgggtcaccgtccagccagaggggccgaactctcaccggttgagtaccaatgttacaagtgttttggattcttgctctcctgacaagctgtgcgtcatggagattgttgagtagcggctagtgaatctttttgctaatgtactgtaggactgtacatagccagccacaaccaagtacttttttttaaaatacttgtcatcaaaattgataaaaaggatgtatctagaactaaaatacgtctagatacatttagttttaaccattttgatgacaggtatttccggacggagggagtaccttttttttttgaaacagaggcaaaaggtttgcctcatccattattaattaagaagagagtgt

SEQ ID NO: 12748 - DNA, 717 bp, Triticum aestivum
  unsure (1)..(717): unsure at all n locations
  Clone ID: PAT_TA_12748
tacaaaagcgctgaaatgtcttcccacgaattcactaatttggaaaattggacaaatagaccacatgaaacatcgagtctgatgaaggcatattccaagcaagtaaagatatgtattgaaataggtttaagttgtgtgcaggaggatcgacacaaaaggccaactgtaaagaatattgttgatagactgaatgagacagaaactgagtgtacctatgcgtataagaaatttgacgtgcaggagaacccaggggggctcacccctaattatttcatgaacaatggccgccctgtcagtgaagtgcctctgaacaatgatgcaggcccttccaaacaagctagaatggcatggcaatatcctacagacatgactgcacaacaagaacttggtgaacgacaagcagctttgcttcctaatggaatttatgagcctcctaggcagatatcggcaggttttcctgaatctagaggcaccactagagtcaagctgcgctttgttgatgttgaaggaccaaaagaccccctttacactggttgtccagtacaatggctgaatggagaaaatgctaaagtagtgatatttgaaaacgataagcaaatcacacagggcgacctttctaaattgcaaattgagattttagcagtccatgctgatttctttactgagcgaggacccagcgacttcaccaaagnaggaattcacaagcagatcctatgt

SEQ ID NO: 12749 - DNA, 669 bp, Triticum aestivum
  Clone ID: PAT_TA_12749
atcgcttgatttcttagaaataaccaacagtttcaagcgttcgggaaatggtccatacaaatccacaaattttacagcctatgctccaggaattgagcaagcagaatcctcaacttctgaggttgattcaggagaacaatgatgagttccttcagttactaaatgagacatttgatggcggcgatggggactttttagatcaggctgaccaggatgagatgcctcatgctatcagtgtaacaccagaagagcaagaggcaattgggaggctggaagccatggggtttgagagagcacgtgtcatcgaagcattcttcgcctgtgacaggaatgagcaactcgctgcaaactatcttcttgagcatgctggtgacgaagaatagagaaaatttagttcacattgggccagagttcttcctcgatgtcttggctctggaggaacgcgtggtggcgtgcactaacgatgtgtttcttttgtggggccatgacagagcttgttatgaacatctgacccaaattgatggtgaaaagttgtgatggagctaatactcggttgaacaggttatctgtatgcacaaccccttaggttacttgcattgcgaatttgagaaaaacttgtagaatgagcaaaaaattactgggtgctatctgaatgacagcgtggtcttg

SEQ ID NO: 12750 - DNA, 1750 bp, Triticum aestivum
  Clone ID: PAT_TA_12750
gcacgcgggacccgcggggccaacgcacgcggcgaaggcgaaccaggcggcggcgtatcgagcgactgcggcgcatcagccggcggcgcatcgagcgactgcggcggcgcggagccggtgacggagagcgagggggaccgcgaggtcgatccgcgaactcgacgtgccgttatccgcggaggggtgcgtcaacagcacatgacctgctgaaaaccctagcgcgagcagcggaaaggaaggggaggaaggaactccgatctcccggccgagaccaccgcggcgccgccatgaagctgacggtgaagactctcaagggcacccacttcgagatccgggtccagcacaatgacaccattatggctgtcaagaagaacattgaagagattcaaggaaaggatagttatccatggggtcaacaactgctgattcacaatggcaaggttttgaaggatgaaagcacattggatgaaaatcaagttagcgaagatggatttctagttgtcatgcttagcaagagtaaagcttctgcttccagtggagcttcatctgcccagccttcaagcactcctgttaccagtcaagcacctccagttgctcaaccacaagctcctcagccccaggtcccatcaactacgacttctcagcctgaaagaccacccacagagaccccttcgagtacagttgatcttgcagcatcggatttactgtcaggaagcaatctggacacaatgattaaccagataatggagatggggggtggcagctgggacagagataaggtccaaagagctctccgtgctgcttataacaatccagaacgtgccattgactatctgtactctggtattccagtgacagccgaagttgctgttccggtggttggtcaaggggcaaacaccactgatgcagctcctggagaaaccggcctctctggaatcccaaacacagcaccattagatcttttcccacagggggcttcccatgctggaggtgctgctgggggtggatcacttgattttcttagaaataaccaacagtttcaagcacttcgggaaatggtccatacaaatccacaaattttacagcctatgctccaggaattgagcaagcagaatcctcaacttctgaggttgattcaggagaacaatgatgagttccttcagttactaaatgagacatttgaaggcggcgatggggactttttggaccaggctgaccaggatgagatgcctcatgctatcagtgtgacaccagaagagcaagaggcaattgggaggttggaagccatggggtttgagagagaacgtgtcattgaagcattcttcgcctgcgacaggaatgagcaactcgctgcaaactatcttcttgagcatgctggcgacgaagaatagaaaaaaaagaaatagttcacattggttgatggtgactgttttactttgtgggaccatgacagtgcttgttatggacatctgacccagattgatggtgactgttcggagtggctacacaagttgagatggagctaatgctcggttgaacagattatctgtatgcacaacacctttaggttacttgcattccgaatttgaaaaaacttgtagaatgagcaaaatttattgggagctatcggaggagtgtgatcattggaacatcagttctgatgatacggtcatcactagcttggattatacaagaaaatcccaaaacgatcctggcccaaaccgggtactggttacattgaaaaaaaaaa

SEQ ID NO: 12751 - DNA, 691 bp, Triticum aestivum
  unsure (1)..(691): unsure at all n locations
  Clone ID: PAT_TA_12751
tcgtgattgggtttggtgttcttgccgcttctcttttttgtgatgcaacatcaacgaaacacatgacattgattacatcagtcatcactccngatagcagcaacagcttcaggtaggctctaaatagaatatgctacatataaatttagcaaataaagctacccatgctagtagaagtagaaccctgtccaacagaactctgccctgccttcacagagcacattccaacaaccaaaaccattgcccagaatggatactgcaggcagaacacttgcgcttcttgtaaaaacttgggcgccgaagtatgcaggcatgtttgagttcagaggcaggaaaaaggatcatcagaagacaaatctgatcccgcttcgatgctccaagaacttccgataggattgctgctgacctcgaatcgcactttgcagtttgtgttggcccaattagcacaactaagatcccccagtttggcaaccaccacttgcctctcagtgtaagttaggtctagtttaatttggatgatcaacctctccagcttcggtgcattctccacgacgaacatgatgaaatcaaactcactatcattcccttgtagctcacagaaagacagagtcttgagatgcgactggacacactcaataggacttgtctcctgccagaacttgagacgacggttgctggtgttttcttcaag

SEQ ID NO: 12752 - DNA, 1044 bp, Triticum aestivum
  unsure (1)..(1044): unsure at all n locations
  Clone ID: PAT_TA_12752
tctctctctctctcagcaaaaaacaataacttcccatactgtactatagtatagtttctaaatataagccttttcagagatttcaatatgaactacataccgacgtatataggcatactccctattttagaggggcagagcggccacattttnccttatnatccatnaaaaaatttaaaatctttaaacggtcttatatttaggaacggagggatgaatcaacacccacaagttgggcgatgctcccgattcagagggagcacatcacaatggtcattcgtccgaacccccccgcgttgagcaggagttggggggtttcccaactttattaagttcacgggcggagaaactctcagcattctgatatgcctcttcgaaggggaaaacagaagagtgagagggtgattttgggtcgctagggcggacacgagaacagcagtgacgcgttggttccaccaaacccgaaggaattcgagatggcggcccgtatcggcatcttcttggcggcggttagaggcatgaacgcgccctcgaacagcaggtcgggctgctccaggttgagcgtgggcggcgccactccatggtggattgctagcacggtgaagattgcttccactgatccagccgcccctagcagatgaccgattgctcccttagttgaggataacgcaagaccaccggatgtcgcgtggtggccaaagacagattttattgcagttgcctccacagcatccccgagaggagttgatgttgcatgcgcattcaaataatcaatttgatctgcctgaagcccctgactgttccaantgccctctccatggcataagatagncacctctaccatcattttgtgnngctgagttatgtggtgtgcactccccaccaccacgcccatagccctcgaacttctgggcataaattttatgcgccctcgttcccattgcagtggtcaaagtgcctccaacaccatggnactccacagccccttcaccaatcacaannntnccatntnctgccacaatcaaaaatggccctcgaagatgc

SEQ ID NO: 12753 - DNA, 848 bp, Triticum aestivum
  Clone ID: PAT_TA_12753
attctacccatttatataccaattacaccgaaacccaggagaagaaagaaaaggaagaactacagcactgacagcctcccacattgccaaaaatctaaaatctaaaattgcaggcctttgctgaattctcagcttctcgtggccgcgcccgcggtacttaccacaacagcccttgagtgcttattgagctgaccaaattcacaccaatttgcatttacatccggccaccgactccggcggtgcttatgctgctgcattgctgctcgatccaagcttcctgtcgatgggcagggcgatgcatccatccactcccatgtcttcaaatgacaccgcaaattcggccaattgctgagtttatgtgcgcgctggccgtcggccggctccggcgcgcgtccctcccccggcccccggtccagattacgcgaggctgaccaatgggaactgcatcatcgactcaactcacaaccagaaggactatgtcccggtctcttctcactgaattgtcttggtgagcttgcatttcgcgaggaagacggtggacgtgcaatgcacggtgcaaagcttgagcagctccgaggcttgctgcttcagctccggcccgcacccgctttggatcaccagcagcagcttggcggccagtccgacctccagggcggcgggtgcggactcgtcgggcaccatcctgcacaccacccacagcatcgacagggcgcgctgcgtgcaggcctcggacaccctcatcagcagtcggacggcgttgggtatcgtcctcgggcaatccttgagagccgtcatgccttcagggactgaggcgagcgcgtcaaggatgtccaaggctggctccacgc

SEQ ID NO: 12754 - DNA, 1412 bp, Triticum aestivum
  Clone ID: PAT_TA_12754
cgtccgcttgaggaagtggagtctgttcttgaaaatgtgaatcatggagaaggcttggttgatctatcaagtgaagacaacatgaaacatttaacttttaatgaagatctcgaggcacgcccttggtggacaccaacaaccagtgtaaattttctttcagaaccaattgatgaaagttcgacacctgcgtgctttagggccgaagtgtgcaagcacaaatctactgagaaggatggccctaagatgagagatgctgagagaaaatgtcttgtcccccagcttgtttacctttccatgcatggttgtgtatcttccctcagggagactgagcccaacgggtctgtttctgatatcactgttggggaaatgaaaaccttacttgagaaatatgctaggactattggctattccatggatgatgctctaagcatgattcttggtatatcttcaggcaagaagtctatgaaggattttgctcctgatattgtgagctggatgagttttgctgtatttattaatgcaatgaacttgtggtcaaatgaatcagtgatccccagaactgatccgagcagcccaagttcttgggagattgtggacagcttagtgaaaatttgcatagaggagcacctgactgatgccaatagaatcctgacttgtcctggaaataaaattccactgttagtgcaaatggttacagaacccatttcttggcatctcatcataatccagtcctgcatgagagtggtggccccgcaaggaaagaagaaaaagaaaagtggccccatcgcttgcgaccaaacatgcctcagttgcaaggaattcaacgtcctgttcagtgcttgattgaaacactccgaagtgtccaaaaatggttatctgatcagatgagtctagaggagcaaggtttggatatcttaatgtcatatttgcaaggaactggcgatgaaggtccaggacagacattcagagtcttggaagagaaaccagcagcacatgcctctgagcttggtgatcgaattgctcagtctctggaagcatggagttctactggtgtggtaagaagaattgttggagcagaacatgaggtcctagccgagttcaagaaaatggttgactctaaactcaagctgctcatgtcagaatccgcttgtctatcttcggtgttacactagagttgatgaaattttgcacatgaattttgttctattcttgttgtggcgttccattatacatatgttgtaacagtataacagaatgtctgtgcgcttttgttgtttgactttcttctattcgattgaggacatcttttttccctttgcttttgtgtctctgctcctgatttggtattgtggtatagttattgtattactccaatttgttttggtgcaatataaaacgacgcattccattct

SEQ ID NO: 12755 - DNA, 766 bp, Triticum aestivum
  Clone ID: PAT_TA_12755
caggtccaggagcacaaatacaaaggttcaggtgcacaaatagtagcagaaatacaaggttcagcagcagcacaaatacacaaaaaacaaggttcaggttgagtacttatgggccaacaagctagcagcagcaagtagtagtgtaacagctaatggaggtagcagagtagtgtagcagctggtagcatcaggcttcagttaggatggattgagcatcaacctcctcaaggttaggtcttgcatacaacatggaccgaccaagcaacggtgatctccaccttggagtccccaatgtcacatacagctttacttatgttgcaaagcttgggggtgaacttgacatgaccttttgcagaaacaacaccagactctgaataggcttctacctgaacttttaaggtctcttctaacttttctggataataaaaatgatctaccggtaactccacgggaacaacacgcctcattagttcaaggtaaccatcagtgctcattggcatttctccatcatcgcaataacgagaatcaagcaacacaacttgtgtgcctgggggatcaataaagggcagcccggtccatgtagctcccgctcctgggggatcttccatcaaaaagcctttactatcacagacaatagcttcattagatttcaacgagcaagcaacgcggcccccatatttgaatgtgcatgtgccagcattaacgatctggacagctatgattgtagcctgaactgaattcacaagctgctgcaggcttaacttga

SEQ ID NO: 12756 - DNA, 2241 bp, Triticum aestivum
  unsure (1)..(2241): unsure at all n locations
  Clone ID: PAT_TA_12756
gcgacccccggatgccgaccatcctgtccgacgcggatcggtcccagtcgcgccggactggcgggatcccggccccgccggacggtttcgacactcccgcggccctacggttccttgtccccgacctcgccctaggatcctcccttgctggtctcacgggcagccacctggtacttcgcggcgcgcacggacgacgggccgtcgcactgaggcggcgagggggcgccggttgccgctccgggggatgacgccgtggactgctacgcccctggctgcgtcgcttccctcacgtccacgcgggagcagatcggagtcgtcgaattcttcgcccactggtgtccagctgacagaatctacaagcctcattatgagaaggttgcgaaacttttaaatggtatagttgcggcgcatcctgactgtatattgatggctaacgttgatcttgcatcaaaggttactgtagatctttgcagtagattttctggtggccattaacctttcctactttgcggcccctcaccaaaatatgctaacactaagtgggaacggaagcatgagaaaagcgaaatagaattgattgatgatggaagaacagcagagcgcttacttagctggttcactttggatgtcgaaaaatattagaatgaaaatgtgagacaatataagaatgaaaacattcttccagacaatgcatcagatcctgaacatgttgaacaaacagctcacgcgttacagatagctatggcgcatgcgataatcaaaacagtcaatcgtgactctctcataagagattttccaaattttcgtagctcatctttcatcctagaggtgtcgaagaagactctgctgagctgcttattaactttgatgatcactggccttcaaacctctctttaagttcacaagacagttctaaattgttggaaagtgttgcagcagataaccacaagattgttgcagcagataaccctcggatctactggaaggactgtcgtggaagtaactgtatcacatgccgtggtagctgtggtctatcgggtgggctgcgctctcgtcctggccttttgcggcgtcggcgtacgcccctcatccgggacggcgaaagccaatcaacctttacatcaatatgtgatttcatacacaatttcttcatctgtgaggaatgccgcaaacacttctatgatatgtgctcaagtgtgtcagttcccttcaagtcagcccgtgatctcagcctctggctatggagcacgcataacaaagttaatgagaggttgatgaaagaagaaaaggatatgggaactggcgatccatcatttcctaaggctatctggcctccaaaggcactctgcccatcttgctatcgttcttcaagcaggacgagtgatggagccttgcaggttgactggaatgaggatgaagtatttccattcttggttaactactatgggaagacgcttgtatcatcctataaagaaacctacatggagtctcttcaagggaggacgcaagtaggggcggcacttgctgacgatgcctcctcctcacatgctgcaagagtcccaattggagctgccctaggtgttgcagctgccagctgtacctttggggcactagcttgcttctggagaacccagcagaagaacagaaagcaaagaaagaactggaactgaaaaacagcccaccggttgctcaccgtgcacttcatcagaggtggcctccgtgaatgtatatttcttggatgggttaaagagcttggtaagtagctcacagagagtgcacaaaatccaatgttggagctgtcatttacagacgtccgagcatgatgacctaacctgcaccttgttataggctcaaatgtagttctgtttttaccatatagttgtgatctgattgccggacatggatgagctgttgctgcccatttgatccgtaaaattttgaactcaatgttaatcctgaagtattgcgactttttatcgggtgtactctgtctgtggtatcaaaatttgtgctgtcgacgacagcatggtagtgcacctatggctgatataccctacacaagcagcatttggaattggcgaattgtcgagcaacaataacaacaacaatgaaggcgacagagtgattcctgcattctctgcgcattgaatgtacattgcacaagtctaaaattnctacatcttgtactcctgactctcgtcttgtacagcaggaacactttatcttcattgcttcaaaaaa

SEQ ID NO: 12757 - DNA, 809 bp, Triticum aestivum
  Clone ID: PAT_TA_12757
gttttggttccgggccccccatttttgttggggcccgttttggcacacataatagattggattagttgtatctcttcacctatgttccccaaaataccgaacgttcagattgatgatggcgctagaccatgttgtatcccactctgtttcaaaccctgctgctcttaacaaatacagcagggcagcacatcccgaatggtaggatttgggagcatcagctgacagacatgactttacacaagcccaagaactgggcgacattaatctatcagcaacaaaaaaggttaactaagccagactaccagtgaggatatacaagatccgcaggcgtgcccgcctactcctatacgtctccgtgcccctgctgctcttcgttccccgtccctgccctcaggcgccgccgcttggccgttcttctccctggggccccgtcgcacgccctttcctctgccggggcccccttgcttctcccacatcgcggcggtcgctacctcccctccctctcagagcaccacatacttctcaagtcccatggaattcagtaacccagtaaccgtcgacggttcttctttcagctcaggggatgtaggccggcgcccagattgtgtgattccattagtttctggtcctctatcgatcccaatcctagagctgtcttcgtaaggttgatgggttcttaacgtgtcagcagcatctcttgtgatatgactagaaggtcttgtggtaccgacagatcgaagggatggaatggaccctgtatgatcatatgttcttgggggagacatgcctcttcgaacacttcttggagg

SEQ ID NO: 12758 - DNA, 716 bp, Triticum aestivum
  Clone ID: PAT_TA_12758
gtaagtgtgggtcatgggctattacaagaagctcttgcctcggtctgcttatgcgatgtgagatctacatgtaaattcatcaagaagttgatacaacaccagaataaatacatgaccccatacaagccgcacaacaaaaactaaaacgctatatttttattttctgttatatgtcccagtgcttccactttgtgaaccaaacaactggtgagctcagtatactatacgttccacaacaagtagtgctcctgatgcaaaccgttaattgttcacgttgtggcattgttgaatctagccagtcatgtcttaataagcacatatgtgcggaacagcggaaagtcctcaaatgcaccttcttccttgcattcattttggatccatacaagtgtttctccaccttccaacaatctttctctgcgtacgttgcattgcactgtgtgatatttacagcatctgatgggcaggatttacgattccgttcaacaaccttgccaaacgaagctagttaaacgtgaaagacctattgaaggctgtctgattacatctcttcatggtctattcatggcctatcgattatggtggctcttggaagtacggatggttcaatgcttcatcaacgcttagacggtcctcatgatgccacactagtctctctctctctctctctctctctctctctctctctctctctctctctctctctctctctctctctc

SEQ ID NO: 12759 - DNA, 778 bp, Triticum aestivum
  Clone ID: PAT_TA_12759
cagggaaatctgatatgcagcatttaataatggtgagtacagatggatatacatttgatacaacattgagcacaccagtttagccaaaaggcgcatgagaaaaactatcgtatatcatcagtgaatttgtgtagaataagtagcgtgtaccaccccctcatttgtcgcccccagaaaagtgggggtcaaaaaagaaagaaagaataggatggcctcttacatataaatatttcttttcccttttacagtttacaagagcattgggtttaacctaccatgctacaaatatttgtggttccgcggcaaaaagaattttcttcctaatacctacctcgcatagcgaatggggctggcagcaatcgcagtccctgcaggctgatgtgccttacagcaaccgcaggacctacgtttccggatatccaccaaccctaaacttccgactggtccgttgcccagcaacctagctcatgcgctgctaccctggtgcatttagctacgccgcccggtgatgccttgtcgagagttctgtgtcgccggatcccccccaaacgccgcgtgctgccagcccatgcacagtgtggggcccctgcggatccgttcttcttcaaaattgtgtctgcatatttaaagaagaatgaagagagaattccttgcgcagcattgttacaaatgaggaaaaaagtggcccttgaatgccctcgaaggatatcaaaactctctggcccttgaaatatgacggttcctaggataccaaggagattgaaaattgcaccataac

SEQ ID NO: 12760 - DNA, 700 bp, Triticum aestivum
  Clone ID: PAT_TA_12760
aagtgagaaccattgccaccatgccttagggcaacatacagatcgaacagaatcactatctctatccctagtagctgtgcttcctcagcctgtacagagttccaaaattcccagcggtattcacaaccactgagttctcccaggatccacccccaccataataatccaacccatgcctcaaaatgccgaggaaacagcccgaaaagagctacgaaagagaaagaacaggatcccaccttagtcacctaactatatcacttattttaccaccgatgaatggccgcgacaattcatgctgtcagcttgcataaaccccagtgctgcccttggggaatataccttggcctggcccgaggatggacagcgggtcaaaccggtttttgcgctccgcgaaccgctcccaacgcgggccaaagtgttggtgccagccagccggagttggatggtgagccaagtactgttttgcgccgatgcgcactccggcggtgtcagcctatgtggcgatgacggcggagaagctcttgcaggcagtggtgggagcatccttcatcagggtttgcagaacggagaatgccaaccacgtacatcacctgctccgtggacccggaatccggtagcacgaccgatgtgttagtgccccacttgtctctgaggagtggatagatgaggatgagcccctcaaagttatccggtgagatgt

SEQ ID NO: 12761 - DNA, 613 bp, Triticum aestivum
  unsure (1)..(613): unsure at all n locations
  Clone ID: PAT_TA_12761
cgtccgcnnccacctaccggtgcgccgcccccataaatcaacancatcattgcccgccttcaccggcggggccctcccgcccctattccacgcgacacgctgcagctcggccacgcctaccgtctcatcgccgtctacgaggtcaccagggccgtgcaggccagtaaggaggagaagaccaggagggcgcagcggcagcggctgcaggccggcgggggggcggcctcccccggcgatgaccagtcgctcatggacgacggtctcgatcagttggagcagcaggacagggacggccacccgagcagctccgacgaaaggctcgaggcatcgccagtggcgcccgtctctgcacagcatcgccgaagtcagcagctgatgcggccgacgcatggcctgtattttagagttcaagttcatctcatcagatggttgctagattcaagctcaacaccggaagatgagcgtctgaaaattaccggtttatactcatctttttagtgagattaaggttggtgcctccgcatctcagtgttgggacaaagagaaagattggactagcagtgtggtgttcggtgtagtagtagtagtatattattcagttatgatgcaaagt

SEQ ID NO: 12762 - DNA, 860 bp, Triticum aestivum
  Clone ID: PAT_TA_12762
ggagacatggatcccttccttcggacaaatagcaacatcaaaacaattttaagcagaatgaccaagacgcctggcatcatgggtcagatgcctcctctgcaagaacttgcacatgaagacaagcttaattcacttcttcaagttgacagaatggtccaatcttacagcgcagcacacacctcacatatgaaggaagagcctcgaagctaatgcgtggcatgcaccgaaagaagaagggacagatagacggcttcagctactttccctcggttccccaccggtgctgctaggaatccctacaggctgttatactgatggagcgccatgaatagttgccgtacatccttgagatcattccctacccttccagctgaagctcgggaaagcgtgtttggaaggagcggattctgcagttctgcagggtatgcgagcgggggttactgcccttcctcccatcaaccacaccaccaccaaccagatacttgattcgggactacagcgaagtgactgtaaatattggatggccggaggcatttccgtgttttgttttccccaattggtcgtgaatacatttttcgaaagggctaccgtgcgtttgcatttttacttgttccagattgtaccctgtacagtaatgagccttgccctgatacacgctgtgccgtgttggtgaaagcaaagcagcgaggggcgttccttttcaaggggtatcctagttttgcataaatgccctcctctagtttaggcttctagctatttgggtcattgctcaacagctaaagagagaaggatgagaacagaaaatgtaggagtgacgtgactgaattatcaaactattgacaagagttgcactaaaaaaa

SEQ ID NO: 12763 - DNA, 465 bp, Triticum aestivum
  Clone ID: PAT_TA_12763
tctatgccgtacacagtatgcactacgtaccctcgcccgccctcgtcgtcttctccgtcgtctgtcgcttcgtgtcgtagttgaggccaaaccccccgctcttgcgggtgagataaatacatccgtggtcactgtatttgaggcattagcacaatacggtcactgaacttcagaatacgctcgttacggtcattgtatacgtgttgaggtgattatacggtcactggcttcgttgtatagctctgtattctgctgtgttgactggtcaacctatcatgcaccgcaccaccctcccccacgcccccgcgacggcagctgcatcaggatccgtcgccggcgagggcccgcggaagcagccgcagcagctccttcccaagtcgctctcgtacttccacggctcgccctcctccaagctggcgggcctcatcgactatccgcgccggatcctctcctgggccgcgtctc

SEQ ID NO: 12764 - DNA, 870 bp, Triticum aestivum
  Clone ID: PAT_TA_12764
gagacaaggtgataaaggtaatttacatacaagagcacaaaaagaactggctggaactttctttgaacaattaccaagcctcgaatacaggagaaagagaaaccaaaaacctttagagcaatgctgctaccgcagcttcagacagctaggaacatgaagaacaaagcagacacattcttacataactaaaccccttgcagaattaatcaggactagcaactcttttcatagctgcagaggcaacatccactatcatgagaaggtttccggcagaggcctgccttgtaggaatgccctgatgagcacaagagagcgctcaggctgcgagaatggcgcctcatgtgaggctcctctgatggtggcgaaggagagctcttcaccgtatacctgagtccacccaccaacctgcttcccttcgaaccaaactcgatacggaatgctcgtcttgaggcctagatcgcgcgctagattctgcaccagtgtcctgcttcccgttagagggatcaccgagtcttgatcgccactgtaaactagtactctgatgccggagttgaccagtgatcccactatgttgattgttggaatctgcaagttgaggagctcatactcaagaacactgctgcaaactgcccatttttttacgccgatgagcttcgcatggagcgcttcctggacatccttcctgttcaagtagtttaccgtctcgtcctccacacagacgtcgatgcggtgcccaacacgcttatggggggagaggatcattgactgagagagcactgaagacaagcagacgtcgagggtaacatcgtacttgtcaacgaaccggctagtctctcgggttacttggttcatcaccctcgcgcaaagcgg

SEQ ID NO: 12765 - DNA, 298 bp, Triticum aestivum
  Clone ID: PAT_TA_12765
gttaaaagaatagaagccacactctttatattgatctgatcataccataggcggtcaagaatttggcaagtcaataatacacatacgaataacaatatgccatttcataacagataaggtccttgcacccatgtaaatctcatgccgcaacagccgccaagattccgacgtgttgagctcctgcgcgttcacgatggccgagacgatgccggggaaggctttggtacccaccagtcgtcctggtccgacgaggcataaattatgtaacaagcctgcagctttgatgctcatcatatgt

SEQ ID NO: 12766 - DNA, 660 bp, Triticum aestivum
  Clone ID: PAT_TA_12766
gtagggttaagagcctgtcctcttttctgctcttcttgtttttgccctggccattagtctcgtacgagtctctttatgccattgcagccccgctatggtccttgctcccatcttactctcgggccccaacagctgagtatgttaaaagaatagaagccacactatttatattgatctgatcatactataggaggtcaagaatttggcaagccaataatacacacgaataacaatatgccatttcataacaaataagatccttgcacccatgtaaatctcatgccgcaacagccgccaatattccgacgtgttgagcttctgcgtgctcacgatggccgagacgatgccggggaaggctttggtaccccaccagtcgtcctgctccgacaacgtataaatctgcccaaggagaaaaaccatcactgtgttcagtttcagactaacttcggagttcaagtacagtactatgcaacaagcctgcagctctgatgctcatcatatgattggaccacggtctccccataggcgactcttggttgtagaaggctcgctccgccatcgcaaaacggtcatttagctctttgagtttcagcatgcgttacctcatgttatctccccacttttgtgcttgcaacatctattgtcatgaggacagcagat

SEQ ID NO: 12767 - DNA, 714 bp, Triticum aestivum
  unsure (1)..(714): unsure at all n locations
  Clone ID: PAT_TA_12767
gnaacttgtcgcggcggtcaataagattagtggcagttcagtttcagtcagaatgctaaaatgaagaagatacaaagacaacagcagtgctatgtgaatagctacggccatgaggaaatatattgaccttcaatatccctaaaatgtgtcaaggttggaggtcaggaggtattttccctgcacgagccgcggcatacacatctgcaagctcaggaacactctccttgtaagactcgataaaccttgacctgaagtacctctcgctcgcagcaaccactgagcaatagtcagaactcagaagtcccttgccctgcagtatcttcatgacaatgtaccgaggctcatgcctcgccttcaggctgtaagtgatcagcgcgggcctgcgcacgatgtactctggctcaagaccaaccttgttgatcaggaactctaccgtgctgcgcaggttgtcctcagatgatcttaggaggcttgggtgcttgacgaccgcaatcttcagcatgtcatcagagcagccgagggtcttcttcagtaactccattctttgcaagcaaagcttctcctgggtcacgcaggagacggtggtgnagccgcatacatgaattggcctgggccccggggtaccccgagctcatcttgcgcgtgcgaccagtacctggagcttttctgggcttgaccactgtgtcaatgtcacgccttangagggcaccacct

SEQ ID NO: 12768 - DNA, 585 bp, Triticum aestivum
  unsure (1)..(585): unsure at all n locations
  Clone ID: PAT_TA_12768
cccaaaaaaaatatnnaacccataagattgcagcaagcactgcttggctcttgttgttttgttctataatatagtagtcgtatgataactgactgacaatctgacattcgagtcatggccaacatatatcctcactgctacaacaagtgatccaaaactaaaagcatagttaacctttttttcagaaattaaatgagatgcagaataaataaaatccatctgcagttttcagcaacagcattgccacactggaacgagcctagatcttcagcagagcacagcctgcgatactccctcggcaacgcgtcatcggtgatccttgtcgccaggttggcctctcgcttgcgacattcaagatatcaacatcagacaatggcttaatgcactgatttcttggcccagggccgattactcnaccaaacaacatatgcngcccctaancaatcatgcaaaagccgatccggctttggnatcctgatgncaaagggaccatcttaccagggaaatccancatgctgctccanncagtatgccaganataagcctcanaacattccatggctncacaaagtanccnaaagccat

SEQ ID NO: 12769 - DNA, 548 bp, Triticum aestivum
  Clone ID: PAT_TA_12769
cgtccgcggacgcgtgggttcatttcactctgcagaagaggagaagacgggaggtactcttgccgcttcaagattaatacttcttttattggctgtaatctcccggcatatcttccacctccgccgtttaaccttccggttttaataacggatgcgtcgccgaggagtctcaggagggaaggtttcaaatttgttttatgcccaaggatatttgaagttgtgcttgttaagaactaggctcttgcagcctatatccaattctactactgagttccttggcccaaacatttttgtgtccaagactggtagagacggtctcattctttttacgggagaatatatgactttaaaatctatgaagaacacctttttatgtcagaaggagaaatcaaagtcatcagtaaattttttggattatcctcaagctcgagttcgccagttgtggatggtgtttgttttgttcctacttcacaagatgatcaccatttgtataaacgaaggaggatggacaagaaatgtcattttgttccgacaaatacaaatggaaa

SEQ ID NO: 12770 - DNA, 1411 bp, Triticum aestivum
  unsure (1)..(1411): unsure at all n locations
  Clone ID: PAT_TA_12770
ggtcggcacgaggaccagcgcggggcacgcgccgctccccccggtcgccctggcgccgccacccaacgatcccccagaccacgcgaccacccgcctgcggctggccggcgcagggttgggcgacgagccctccctccagctctagacgtcctcgtcccaatctgatcaagcccccccccccccggtcgccctggcgtcccccccgaacatgttcccggattttgtacccctctgtgttttctgcgagacgcatgccggcgcagggatgggcgacgaggccaagtacctggagacggcgcgggcggaccgctccgtgtggctcatgaagtgccccccggtcgtctcccaggcctggcagggcgcctcctcctcctccggcgatgctaaccctaacccggtcgtcgccaaggtcgtgctgtccctcgaccccctcagctccgccgagccctccctccagttcaagatggagatgtctcaaactagtgtagccagcacttgcaatctaccaaagagttactccttgaatatgttcaaggattttgtacccatgtgtgttttctctgagactaatcaaggaaaactctcatgcgaaggaaaagtcgagcataaattcgacatggaacctcacaaggataacttattaaactacgcgaagttatgccgtgaaagaacacaaaagtcgatggttaaaactagaaaagtgcaggtacttgataatgaccacggaatgagcatgaggcccatgcctggcatggttggtctgatatcttctagttccaaggagaagaggaagccaacgccaaccaaaccatccgatgtcaaaaggacacgtagggatcgccgggaactggaaaacattatcttcaagcttttcgaaaagcagcctaactgggcactgaaggctctagtgcaagagactgaccagccagagcaattcctcaaggagatattgaacgacctctgtatgtacaacaaacgagggccaaaccagggcacgcacgagctcaagcccgagtacaagaagtcgtctgaggacgctgccggtgccccgtgaagatgatctatctgttttggcggctgttgtgtaactgtgataccaggaacctgttggcttgatgcgcggaactatgagttgtctatgtgaagcctccagtcatgcttgggctgcatttgcttgctttttattaagaggcattgttgtaattgtatgggtataagatgatacatatacaacacatgtcacagagaggaaatggatctactgataaaccacacgaaagattgtttgattttctgggtagatgtaagaatcatgtcgaggattcgacgtgtgcgatccttgttccttttgagaactcccgtacttcaatacaatccagatgtttggctaaaatatangaatcacctgatt

SEQ ID NO: 12771 - DNA, 677 bp, Triticum aestivum
  Clone ID: PAT_TA_12771
cgaattcgcggccgcgtcggctgcgcggcgtccgatcgtgtcctcgtcgtcttcctctctccaaaccggaagacctctcgcgccacgccacacccctactactttaccctctcccgccgctctactccagatctcgaggtccaccgcgcgggtccgcttgccgtccgagaggtttcactttatgccactttgtgtgactgtggacaatggagtgattgctgccctctttctgtgagtcaccatgggaagcagtgaagcagagacacctgctaaggcaaacaaggcatccgcacctcaggagcagcagccacctgctacttcgagtactgcaacaccgacagtttacccagattggaccagctttcagggatatcctccaattccaccacatgggttctttccctctcctgtggtgtcaaacccacagggtcatccatacatgtggggacctcagcctatgatgccaccatatgggactccaccatatgtcatataccctcctggaggaatttatgctcacccatcaatgcgaccgggtgcacacccatttgctccctataccatgacttctccaaacggcaatcctgatgctgctggaactaccaccactgctgctactgctggtggtgaaacaaatggcaaatcctctgaaggaaaagaaaaaagtcccattaaaa

SEQ ID NO: 12772 - DNA, 794 bp, Triticum aestivum
  Clone ID: PAT_TA_12772
cgccccaccccccgcccgacggtccttcgtccccatctccctccttctgctagctagcctcgccgccgctgcagcagcagctgcggatccagaggaacgtccgcacgagaccgcacagcgcaagatcagtctgccagagaaggaagatggcccgcgcccggctgtccttcgtccccatctccctccttctgctagccagcctcgccgccgccgcagcagcagctgcggatccagaggaaggggacctcaggatcagcgtgcagtacgcaaccgaggaggagtctcggtggcttgaccgctgggcggagaagtacaaggctcaagggtccggcgaaggcttcaaggtccagccggccaccgacgaggagtcggcgcgtatgaacaacatgttcaccggcgtcggctacgacggccacatcgagtttgacgacgaccacccctttggcagaatggtggtggatgccttccactctcgacctcgtccgtccaagccgaacgaaaacgatgatctgcagaagaagaacctggaggagcctcactctcgcgccgagcatgacgtcaaggatctttaggagcatcgtcggtacctaatcggcgaggtcattgaacggaataaataagggaggacggcagcgaggagttcgtgtcgtctatcattagtctgtcttatttagtagctcggctcaagagagattagtcatgttctagcagtaattctggcttatgctcctgtgtggtggtctccatttgcaatagtatctctgtttcttgcccacctaatataagtgatatgc

SEQ ID NO: 12773 - DNA, 693 bp, Triticum aestivum
  unsure (1)..(693): unsure at all n locations
  Clone ID: PAT_TA_12773
tttttttttttttttttataaaagagatttttataactcggaggctcagtatttctgaaaagacatcttcacatacatatggagattaatatcacgatgtatgattgatgcctcaataccctgaatgatagcatcaccttatacattcaatatacaaaaaagatacatatcaaggaggcttgttccagtggcaccgagattcgagccttttcagttttcgttttgtgcctgaatttcctactgatggatatgctaactagctcctccttgacattctcattctttatacaacccacttgcaccattctcattcccaactgcgaactatacagttcttcagttaagcatccaacaaccttcagcttaatcttcatggttgttttcgccttcagaatcggatcggacatcctcaccaacatgacctctggattgaatttgtttgacgagcatccggtaaatcagtacccaccaatatatgtgaaagaccagaagtgaaaacaagagagtgttgaagagatagtagtacgaggttctgtagattcttctgttctcgttgtccacgatcatagctatttcataactggtgcttcttaggatccagaaaggaaacactattagccgaagaaggatccacgaagccacaaaaagtagaaatgctacaacagctagccactcacagntactgtacttggc

SEQ ID NO: 12774 - DNA, 704 bp, Triticum aestivum
  Clone ID: PAT_TA_12774
aaagctggccgtggaggcaacaggcgtggagttaaatgcgatgaagatcgcagacaatactgaaataaccaaggctggactggagctccaaacggaggctgctgaggagattaagccctgctggaccaaaccaagcccaaaggatgatcagtctaacggttttgttaccttgtcattgactattggccccgaataccatgcatcacagatcgctgatgctgtagtgattgcaaggtatctgggagctacacttgtacttccagaaatcagaggaaatgaattaggaaagagtcgaaaattccaagacatgtacgatgtggaaaaatttaagatgaacttggatggtgttgtcaaagtagtagataaacttcctgctgaattgaccactaagaagccagccgttattagagtaccaaacagggtgacagaagacttcatcctggacaccatccagcccgccttccaaaagaacagtttcctacgacttgcaattattttctcttcagtaagtttgaaaccgaaagggacgaataacaaggacttggattcaactgcttgccatgcaatgttcactgggctcaaactgaacgctgaatattcagaagtggctgaacagatgctgggcaggcttaaagagctcagcaagaaatcggatggcaaggtgctggcggtcgatatgcggaccgacttgctagagaagaaga

SEQ ID NO: 12775 - DNA, 1812 bp, Triticum aestivum
  Clone ID: PAT_TA_12775
gcccccatcgcgcggctgttagcactgcacacgcgcagcccggcgctacccgcgtgctgctgtcgcctcgcctgtcggtgctcctccgcttcctcccgcgccgctcgccgccggccggccggcgcaatggtgggcccgcggcaggtgctggcggggttcctcaccctctccatgttcgtcatgctcggcaacatgatcaagcacgaccacttcacctccgtctccgagctggccgtggaggcaacaggcgtggagctcaatgcgatgaagatcgcagacaatactgaaattaccaaggctggagcggagctcgaggctactgaggagataaagccctgctggcccaaaccaggcccaagggataacaggctctaacggttttgttaccatgtcattgactattggccccgaccaaccattcatcacagctcgcggctgctgtagtgattgaaaggtgtcggacagatacactcgtacaggaagaacagactagcaattatttaagatatggcattaactattgacccatgaaaccttgcatgacaagataacatgatgttgtattgatttggaaggaattttgggagctacacttgtacttccagaaaacggcggaaatgaattaggacagagcggagaaaagaaagacacatcccatgagaacatccttcccgccttccaaaagaacatgttaactacggcttgcaattgttttctcgtcaggatctttgaaaagcaaacagtcaacggactaggacttggagtcaaccgcgtcccaagccacgtccactgcgctcccgccgtacgcagaatctgctgaagaggccgtgcagatgcttgcccggctgaaagagcgaagccgaaagggacgaataacaaggacttggattcaactgctggccgtgcagtgttcactgggctcaagctgaacgctgaatagtcaaaggtggctgaactgttacaatcctcaggaggttctgaatttcctgaagaaggtcggcttctctgctaatacaaccatctacttgacagagacatggtggcacaaaggcctgaataatctgaagaaggcattcccaaacacttataccaaggaggacataatgccggctgagaagaaaggtgagttcctgaattctggcgattcagacctagcaagggccctggacctcgagatctgctcgcagaccgacgtgttcgtccctgccatccccggcatgttctacggaaacgtggccggtaagaggatcgcgtcaggcctgacccagatccttgtcccggctccggtggtgggcggttcggcgcaggcctcagacttcgtctccacatacatcaccaagaagagccacttcgcctactcatgctactgctagtgccgcttagagtgtttgttgtcattattaataagatgaactggcagtgagctgcttggccatgctttgggtagatatgcaagtgctgtttgttgtattactaatttagggttttttggtgaagaagcacaatattagaatggtctcctaggaacaaacaccacaagacagaggattagcagtgtgctacagagtggccctgtgtagaggtcctctaggcatggcatgcgaaaagactttccctcatgtgccaagtttttgtgcttaatcatcccgtatctgctctccgattctagagcgaaagcacatccataattacagtgcgctacagagtggaccgtgaggtctgtctcgaggcatggcatgcgaaaagagtgtgcctcatgtaccagggtgtcttgctcatcatctccccttatcagctcaccagttttggcag

SEQ ID NO: 12776 - DNA, 1013 bp, Triticum aestivum
  Clone ID: PAT_TA_12776
ttttttttttttttttttaccggaaacatatctgattatcagaacaagacatgtgtgttctttgtggtcctcgtaatatttactgtttgtaaatagtacaatgtatacggctctcaacatttcatatatcacagctttacaggttacatttctacccctttctcaaacagaattctgctagcatgcaaaacttgcaagctcgaattaaaccaaaacgcattcacttttgtaaaaaaatgttaccaaatttacattacgcaagtcaatagcaagatgtggtccggcacttcaggattcgcaggagcagattcctccagctatatttcctgctgttgcaaactttatgcagatgctgcaactgacccgaaccattgcttgaacatatgcatgaacgggatggttgcaatgagataattttcacaaacattctcagtatcctcattccacacagggaagatggtgccacatcataaagaacaaaggacttccacctggacttttcttatagccaattgcttgtgatcgattgttatgtgttagggtttgccatttgggctctaaaacaactggaagaagagacttgtagaaccatcaccaaatgaccgaatgtcagcaggctttaccaatgctctacacaaagggcaagttcgttctcgctcaaaccattcagagacacagtcctcgcagaaaatatgtttacagcgaaggagaacaggaacgtgcatcttttcctggcagatggcacacatatcaccggcagcaattgcctgttctgctgtcgcataagacccatagtgcacatctttacgtgacaatgctttcactgcagataagaatgattgaaccttctcaactaccgaagtcaacttgaaagtcaggtatagcccagtagttaaagatgagaacagactcccatattccttgttcagaaagaaacggtaccaaacaggagtcggcaataaagcacgatatagaagcagaaggtactccacaagtgttagcatttgtccctg

SEQ ID NO: 12777 - DNA, 854 bp, Triticum aestivum
  unsure (1)..(854): unsure at all n locations
  Clone ID: PAT_TA_12777
cgtccgcggacgcgtggggaggaggccgcgagtggagtggcggtgccaactccgtccgtggagggagcgacgngcgtgtgcggtctctttccggggaggggaggagcgacgccggcgcagcgagtgaagcggctggcgagngagcaacgtcagngatctctgtgctcccgccggcgcaatcccaggttcctcatgtcgatgttcaccnggtgtgtccatcgtcgatggcgacaagcagagctcctgcgacacgtcgtgccatctacgctggtgatgcnggacagctgtgggtaccacctgctcatggtcctggggctacttgcgcaccaaagagngagttacccacgggtgagagtgccctgcacctggtcttttcacaatgggagtgacatgatttggtacgtcgagtactaccccaatggcataaacaagngactgcgctgacttcatctctcttgatgttacccttctctttgatgacgacgacgatcctttcgacatggttgtggaggccaaggtcagtttcagtctcatcgaccaggttgagaagcagaatctgatgtacattntgtcaagttagaaagaccagcaccttctcaagcagtgctatttgctggggttgtgacaagtttgtgagaagggacngccctcgaacgatcatctgatctaaagggtgatttgtttcaccatccggtgcganatcatgggtcgtccgaaggattccaaaagtcagangcctgntgacatgancnnnnatttaanctccttaaaacaaggnggntgcgacgtgaatcgagtcaagngtnaaagttgtgcgacncccgctntngtcagcgnacgtanncagganatga

SEQ ID NO: 12778 - DNA, 586 bp, Triticum aestivum
  Clone ID: PAT_TA_12778
ttttttttttttttttttaaaccgtaacagtaagaacatcacctggtatattgaaacactgccaaaaccgttgaataaacgggacaatatggcttgtttatgcagacacaacaatcaccttcctagacataatgctcaatgtgcgtctaatgtacaggctacataattccggagccaggttatctttccttcagctggggaacaaacaaaccttggtagaatactgccttcatctaacatcccagcagctacttaagagatacctatgtctcagggtcaatcggctgcattcgctccggctgtcgcaggcctgtcactgtccgagtcactagaagaggaatctgaatcactgctggagctgcttgagctgctagatctactggcactcggtatattattattattttggtctggcacagaagttgctaattgctcgcccaccatcaaatttagctttggagatttttcaccaatgttaggttgttgacttgtttgttgtgcagcatgcagagcacgcaactctacatcttgccttgcaagcattgcacgctcagccttcctcttttgcttgctcaggttcttcttg

SEQ ID NO: 12779 - DNA, 545 bp, Triticum aestivum
  Clone ID: PAT_TA_12779
gacccacgcgtccgcagccctcatattgtggggggaagggatagccgtgatgagagtgatctgcaaattacaccgtccgcccacgcgtacggaagcaatcaagttgggaccacattttctgaatcctctcaggattctagagaaagactgacaagagtagaagaaaccgggagattagtgcaccatgacacagttttgaattcgcagcatacaggcactggcagaatctctgatgacaaagatattactagtttggggatcgagagcaccgaagaggcatctatcatcaatgtagatatggagcaaagaggaacaatactgggaacgtctgaaactaccgcaagagaaaatatacaaggtggttcatctaccagaaagtctgtcaacgaaagcttgttagaatcagctgctcgattagagaaatcatctacatttcatgtaggccaattcgttagtgagctccaaagaggattctcagatgcagatactacttcaacaaagaaaaccgagaagtccataatggaaggtacaacgagatcttcatc

SEQ ID NO: 12780 - DNA, 502 bp, Triticum aestivum
  Clone ID: PAT_TA_12780
acatattacctaagccaaatgtttgtcttctcttagtttcgtaagaaaagaaatccactattcagaacatagaattcatgacatgatatttaacaagtacgaactgatcaaactagttggttgcaaacacttatcaaaatctgagacttacaagtcctacacaactcctattacaggaaattcagagtacagtagcaagaaaagggagagattcaaagattaattcctagtcaatcttcaggcttgcagctgtagatggtgtaggtgatggagaggatcagcagggggcgagttggagaaggagaggtacagcagcagagggcagagcagcagcaaggtagggagaagaaagagcagcaggctggggttcagagaagattaggagcagcaactagaggcaagggaagaagagagcagcgacaggagaagaaggaaacagcagcgtgatgaggagaggagcagcagcgtgagatatcagcaagggggcgcagtagaagaagag

SEQ ID NO: 12781 - DNA, 2152 bp, Triticum aestivum
  Clone ID: PAT_TA_12781
attcggcacgaggcctcactccgcacgggcccagcccaaataccctcccgaccctccacccctctcgccgcaaaccctaaccctagccccccgccccctcgccgccgccccaatccgcgccgcgccggcggccgctcccctccgaggtacagcgcggccttggtccggagataggcgcgttccgcgatggatgggctcgggaactctgcgctgaacgcctcagaagcggtgatgaagaggcccaggagcgtggcgtccaggaggccgaggcccaaggagcagctcgcttccgagtacaaggacatatcgtgcgcgccttcgcggagcatttcccccgaagacgaggccgctgccgaggccagcggtcaacggcggaaggagctgtacctcaacgggcctgaaggtaggggctccacccaccataggaatgccctgtccaagaagataaagaaagaggagggatctgcaggggataatgatattggccacaatcggagcagcaagcccaacgatgccaagcatattactcatggtgttcttgcactggcctcctcaagaaactctggatcgactgatgcctcgcagttgtcctcaagggacacccctgtgccagtggaaaatagggtgagaaaagttaagctcaaggttagcggacttaaccgaatcataccgaaacaagagcctgttgacgttggcatgcctggcacatcggatgtctctttccatcgccaaaagcagaaggattctggtgagcagaaacatcacagcacaagaaaggatagtcatggtaatcacgttgatggaaaacgtggagataagcatgacatttcaccatcttctgacctggttcgcaaaagcaaaagggtccctaagaagcgaactcttgattctgatgatgaagatgatgaattacgttatcttgagaaacttaaagcggctaaagcggcaccagaacagcccatggctactgaccagcctctagcttatggttatggtgaggatggtctcaggaaaaagaagctctccaaggtttctaaaaataagagcactccttatgaagtggacaacgacttcactatgtcacaatttagcagagatgttaggaagaaggtgaaactggaggataccagtgattttattgtagaggaggaatttgggttggacgagtctgatagattaattgaagctgattcaccatcgggtgtaaagattgaagctcctggcctaacaacaaggcagcgagccctccaaggcaggggtggccatggtgaaagcatgattgaatttcccgacgggttaccagctgctccatcatctagaaggcaaaaggataagctttcagacgtggagatacaggccaaaaaagcagaagtggctcagaggcgtaagatgcaagtagagaaggcagagagagagcaacaggctgaagcaatgaggaaaatattggggattgacaccgagaagaagaaggaagagaggaagcagaaagaacgtgaagacaaggaaaagcaagcaaaattcgaggaatataaaagaagctgcatccagtgcgtaatgcgaccagaaggaacagttattacattccctgataccatgggccttcctagcatatttaactccaaacctatcagctaccctcctccaagggagaagtgcgcaggcccctcgtgcccaaacccttacaagtaccgtgactccaagacaaagctcccgctctgcagcctggagtgctacaaggccgtccagggaggcgctgggacgatggcgtgctgattctacagagtcgatggcgcaagtaacgcgcaaccgcgggcggacatggaggagctggagaactgcatctcacccaatgccctgcctgttttgccgtttttgcgttgcctttgctagtctgaggattgaaaactgagcgatgacagatgatgttgaggtgcctgctgctggtttcctttgttggtcctcgtggatgtatgtatgtagtagctgggccgtgcaaaagagtctggtttatgtgtgtggcaagtggaggattagttgtgaattgtgtacagtgatggtcgggcttgacgctaaggcgttggccatgatggtatgagttgagttaactcgttatcctttagtctcaatcttttcgaaaaaaaaaaaaaaaaaa

SEQ ID NO: 12782 - DNA, 668 bp, Triticum aestivum
  Clone ID: PAT_TA_12782
cacgaaccctagccacgtcctcgcctcctcctccatccgcgccgcctcctcctccgtccgcgcgccgcgtcctcgtctcctccatccgcgcgcctcggcggcgaccccatggagggcggccgggtcggagcggtcccccgtgtccctcctttcccgcttggcgctctctactcccagcgcagctgccgcctccctccgctcttcccatctcgccagagccgccgcacccggaggcgaccggcgttgctccatctcgagctgcccgttcccttctctccccgcagcaggcggagaagatggagaggagctcgtccgcccaccttccaccatggtttgcagcggccggagaagatggagaggccgagctgcggctgcctcgtgtgcgctctcctgcatctcgcgcgggagcgagtggtggtgactagcatagaaggcggaggaggtcattggggccggcttcccttccgttttggctgccaagctccgcgcgttgatatagattgcagtcaagacacatgctcctcgtcatcgacagaaggaagggagcagcaaccgcaataggcgacgatgctgggcgaacgcgtcagacatgagccggttcggcttctttcagcggcccagccatgacgccctcaagccgccgacggcagcggccgtctaccaagcta

SEQ ID NO: 12783 - DNA, 991 bp, Triticum aestivum
  Clone ID: PAT_TA_12783
cgttgcggtcgcgggtccgctttctatgggatacatatcgtacgtaatcaaaatcgtttggtgatataatttaatatgctaggtttaaaggttcagtctaaatatgtgaatagcttctgaacatacaattcaaaatgtatccttgtcagccaagcttatggaattcttggctcaaaatatttacaatctcgacacctgaactttcttgtgaacaaaggccgcctttctatatatcttagcagtgcaatcgcttagtctgcaacgtccgacggcgtccttgtttatactgattggagaatttctccatcaccaccaacggcctgctttttgctcctttatccttactgtcttcttgcatggagcaaatccatcctcttgcttttaccataacagctagcgcctcttgttgctccagtcggacaccaaatactgactcttacctagagcgctgcatcactgttatcagcaactgtatcaagtcaacacaacaacccaggattgcgcgttgagtacctgctggagcggtggcgcgagccggatgcagacctctcacaatgcaccccacgcgccggggcatggcgcgaggcagctggagcggcagtcaccggctcctcgacaacatggccttcgcagcaagtatgtgatgcagccctctctccaatagaacctgcagcttcaccttcattttccttctcttgctctgctttgggttcttctggtaggaacctgatccttggtgttggtgacaatcacttgctgtccaaacctcctagtacattgcgaatcattatctgatctacaaaacacacttaggaaaagcaatactacatccaaggatatgcacatattgaccgatgcagcaaaaccaaacacaaataaatcattggatggtcaagactcctacattgcatattatcgccctagtatgtagatctgcaggtagccgatcacatgagaaccgtgatcaaatgcagtatacctatcaaccctc

SEQ ID NO: 12784 - DNA, 858 bp, Triticum aestivum
  Clone ID: PAT_TA_12784
tttttttttttttttttttttttttttgaggaaaaaaagaagggaacatcaagcaaccaagtagaattaaaagggactgcaacaaccaaaggccagcattagccgaagactcggattgattgcctatacaagtatacctgaaaccaatgatgtacaaaacccttgggccaccccaacatctcaaataccttcactatttatgctacatttgctatgacgctaacctgtaatcctccgctaactcttgatacagctaacactaccaccctactagttcccaactctggggtaccctattcccacctctgccttgaagggataaaatagcaagacatgcacattcccctgataacaagtcactgaagtcggtccatttctactcgaaaccaggcagcacactcgcccttccgtacagggtcagtccatttctaagaccttaatgttcccactggagttagcagaaagaagtgtcgaagactgccccctccaacacacgcacgaaatgaactgtgattgatcgtcgatctcctggcctgatattgggtctgtgacattgaacttatacgccaagactggcattggaaatgctttgtggtagacaaaaacctcatttgtttctgacccagtagcaatgtatccatcagaaatggaaaggccaacaaaattctttgtatttgtatgccctgtaaaagtttgaactggattgtcaataactcttgcttgattcgtagacaagtcccaaagcttcaatgagttgtcagtggaaccagatactatggttgatgcatctacatacttgacatagcttacagtctttgtgtggccaactagtgtacaataaggagcccgtatgttgcg

SEQ ID NO: 12785 - DNA, 989 bp, Triticum aestivum
  Clone ID: PAT_TA_12785
tgcgtccaaagaagcgttcgttcctctccacctccctgacgcgagcgaccaaagtccggcggccgacgcggcaacggcggcggaggaattatcagccacactgaaatattcttttatacagaaggtgcctgttagatcgactttctacattgccttttgagaaaacatagagggatctttctgccctctgctcttacctgaagctagaatcacggagggggtgctctgataggtctatgcaccctgtgtcgatctcctttcaacccttcactgcaacttcagcgggcaatttttcctcaaggaccactaatgtgaggtctcgctgtgattttatcaagttgctgacagttggaagaagtagtggataccgtgccatgaattccggaccaacttctgcttccaggtctgaaacgaccggggaacaggattatgctgtgggagagaatgatggtgtgatcatagtcgaccacgggtcacggcgacaggaatctaatctcatgctaaacgattttgttgcaatgttcagggcaaggactggctacaggattgttgagcctgctcacatggagctcgctgagcctactattaaagaagcatttggaaaatgtgtcaagcaaggagcaacccgcattattgtcagcccatatttccttccacctgtacatcactggaaacccgtccttccttctttatcagcagaagcctcttgttaatacactttcgcatcatgcattgtccctgcgcatcttgcaaggcatgccgttattgtggatattttgaaggacaccggaaagtactgccacccggactctgcatacatgaaattcccaaattctattcaggcaccctcgtttggctatggaaccaactcatgctgggcaagatccgctggttcctcccctgtcctctcacgtcatcctgtctttggctcattggcagcacagattgatggctgaggccaataattccatcttgttaacccatgctcc

SEQ ID NO: 12786 - DNA, 2215 bp, Triticum aestivum
  unsure (1)..(2215): unsure at all n locations
  Clone ID: PAT_TA_12786
tgggcttaatttgcgccgacgtcggcgaccggaggcgaacttagaggcgctggatccgacctcccacgctgaaattacggccggttgggccgaagcggcgatatttaagtccctggccacccgaaggaacggagatgctcctacctctttgactcttcacaccgtccgctggaggcgccctcgcgtcaatagcccctctccgcactcgatggcctcagttccagccgccgacgtcgaccagggaccgacgatggacgggacagaagtggacgataacctcatgggggctgggaactcagacatggctataaagattgtcactgaaccttctaaactaccaaatagcctcctcaaaccttcacgtaccgatgcaatagtaattggatttgactgtcagggtattgatggcatcagtatcttgctgcttgcgttgcccgatgctgtctacttagttgatgctattaagggtggacaagagttagttcaagcttgcaagattgcacttgaatcgattgccatcaccaaagtaattcatgactgcagggcgtcacagcaagacactttttgatcaatatggcatcagacttcgtaatgtgatggacacccaggttttatattctgtattgcaagagaggaaatgggaaaagccagaacatgaccgcatatctctctttgctattcgtcgctaccatgaaatgacatgtgctgcagaacaaaggctcaaaatgctgccttgtcaggaatgggcgagaaggcccttatctaaagtcatgatcgaaatggctagggattacgtgtccttccttcctgctttacatgctataataataaagaacttaagcaagtcatctttatggcaagtggcagttcaaagtgatgaactttcaagacattattattcgccaatttctgtcatgtttgggcctggatcatgtcttaatgatgaaccggtagaggcatatacaaatcggtgtgctactacattgtgttacaccatcgatactgagcttgaaattcttgttgccacagatgacggaagattcctattggccggattttttaaatacctaattagtatgctgcttaaaagaaagagctggaaagcctgttttcagttgcaaaaccttgtcattcgaaataaggaattcataatctcgattccgcctactcacgaagccagtttgaagaatgcattccttgatctgcagagaatgctgagccttctccttccttatttcttaagaaataacagatatgcaaattacatctctagcctcattacggtcattgataaatattcaattgaaattgatgattctgatttggtgaaatttctttcggaattacttggtcacatgtcatttaattcaccagttgacaattcaagcctactttttcatctgatcaccatatataataatatgctgccggaagccgataagattatttttgagcatgctgtgaacagagcccagttttttgatgaatctggtcaacaaattgattggagagaaatggcatggcgaaaggctttattgattagtgataatgtttccaccactccagtgagaaaggttcatactttctttgcagactcgatgttatgtcctgtttttaacaggcactttaaagagcatgtggctgaatcagcatctgcaattcaaacacctgaagaattggacatctttggacacttctatggaaattttacggctcaagctgtgatggcaatctttatggcattcaatcctggcgacaacaaggagattgataatcttcgtgataatcttcgcagatgtagaatctagaatgtgaaaaatcctggccaaggcagtatgttttgggaagttcaaggtcaagaaatcctcttaatagggatcatgaccctttttcgatggaagagcgagttggtgatgctgatggtttttcttccctagattcaatggaggatgattttggttaaagatatttggctgaggaagctgttagttttcagacagtgaaatagtattgctatttgtggataagctcgccagctatagcaattattgttgcactgatttgctatttttggtgctaaatttgacagtcttatttgcccatcttcgattgaagtatgtgctgtgatctgatgcagctatttttgaaactccttanattcngtaccgtttttcatgacctggcaaatttaaaatttagtgtgatccgatgcagt

SEQ ID NO: 12787 - DNA, 689 bp, Triticum aestivum
  unsure (1)..(689): unsure at all n locations
  Clone ID: PAT_TA_12787
ttacatagcacactgaataaataccagtaatnaagtcgacagccactgccaacattattacaaaacaggtttaggcactcaaataatccgttctactaagaaaccacagcaagcaaagtagcagaaataacgaaatctaacgcaaaagcagcggagcttttgaaccaattgtcttatggtgccacgcttaattgatgcaagaccatcagacatcgtcgtagactgccttcttgagccagccattaaatgtttttctagggatgtgctcaatcttttgccagtttggatgtcccactgttttgacaggactttatcaactcatgattgcaggacctaagatgaaactcctcaatagactggggcagtgttggaagccactggacattgctgtaacgacgacagaaataaataaaaagttctttgagcgatatgaggtgctccaagttgcctggtaaggtgtcccagctgaagctggtaagccatagcacacgaagatgaatgaaagccacgagctccggaccaggtcccggttgtttccatccagataattcaagtctttgcaggttattggggccaccggtctccttacgcaccatccaatatgggtacctcgaaccattgtaaccaccaattttagtgtttcaagcccagtgggaggacacaggcccttcaagtacttctgcttggac

SEQ ID NO: 12788 - DNA, 601 bp, Triticum aestivum
  Clone ID: PAT_TA_12788
catcgatttggtagttgagattgaacatacagtttgggaacttataatttacacaatcgcaagaacgaaacccctctgcctgtctggcttggaagatttctgcatgaacaaccaagtctgaccagtaccccccccccccctttcaaggcccccaacccaggcgtgcaatctggtttggtgcttgatgctgcatggaccaagtctgctggagttgcaaagttccatgtaaaatcaaccccgagagttttggccttcttgcaattgcatttcaaacatcataatgccctaaggggtagaaaactatcggcgggaaacagcgaagcttctctctccacccaacgggggcaagcttgccagcttctactgctggcagaccatgttagttccagtaccgaaagaaggtttctctgtgccatggacaaaatggcagtttcagcatccccgttttcctccaaatgacaaacgatttgatttgcgccccaactcaactggcgatcaaccaagatcacaaataactagagcaaacgtcacctcgccaatagatggtctgtctccggtctctccccctgactgatctagtgagcatggttccactgactgg

SEQ ID NO: 12789 - DNA, 283 bp, Triticum aestivum
  Clone ID: PAT_TA_12789
ttttcttcttctaagggaatgcaggctgtctggttatttcagcctaaaaaccatggacttcatcagattaaagaaacagaacactgattgcacattacaaaataatacgtagcttattgctatgcctactggtcgaccattcatcatcgtactactccagcccatcgtcgtcctccctacagcttccttgggttggcagacttccgtttcttgtagctctgatctgttatcaccgtcttgactgcgacgttgtcggaggagccggacgacggacgagaaggcg

SEQ ID NO: 12790 - DNA, 980 bp, Triticum aestivum
  Clone ID: PAT_TA_12790
cgctgcccgaccacgttccccgtcatcagaaggcgagcgagaggggttgcctgcctcctccagctccgctcatctggcgccgcctccccgccgcgctgctccttcctcgccgtcaagagagtgtcagagagatcctatcgaaaaaatggaagaggtggaaaataccagcaagcgcaaagcacccgagctggattccgaggacagttcctctgccgctgttatgaatggacagcagtcgctgcctggctcggctgccaagcgtcagaacctcgcccggtcgtgcatccatgaggttgctgcccccaatggctacgatttgtctaaggacgaggccgtacatgggaccctttcaaaccctgtgtttaatggggacatggccaagacatacccgtttcagctcgaccccttccagactgtctcggtcgcctgcttggagaggaacgaatctgtcttggtctcagctcacacctctgcggggaagacggccattgctgagtacgccattgcaatgtcgtttagagacaagcagagggttatatatacctctccactgaaggctctgagcaatcagaagtaccgtgagcttagtcaggagttctctgatgttggattgatgactggtgatgtcacgcttcagccaaatgctacttgcctggtcatgacgacggaaatcctgagggcaatgctctataggggttctgaggtgatcaaggaagttggttgggttatatttgatgagatccactacatgaaggaccgggagagaggcgttgtgtgggaagagagtatagttttccttccacctgccatcaagatggtctttctttctgccaccatgtcgaatgcaactgagtttgctgagtggatatgcaatctgcacaagcagccttgtcatgtggtgtacacagacttcaggccgacaccgttacagcactacgtgttcccaataggtgggtctagtctctacctcgtagtagatg

SEQ ID NO: 12791 - DNA, 633 bp, Triticum aestivum
  Clone ID: PAT_TA_12791
tggaaaaaatcaaaaaaggatatatagggaatagataaattccacccgcccaagtagagaactgttacaaataaagaagaaactaataaatttaggtaagaaacaagataaaataaaccatatttgataccggaatattcagtttggtaacctgctactaattcttcctccgcttcgggtaaatcaaagggtaatctttcacattctgccaaagaagaaattaaaaaaaccagaaaacctataggctgacgccaaatattccatccaaaaaaaccgtattttgactgtgcttcagctatatcaactgtacttgaacttgttagataatcatagtcgatgataacatcacagttcccaccgctatttcaaaaccgtacatgaaaccttagcttcatacggcttctctatgatcagaaaaaggaaaggactgttttgttcctagcccctggggcgtagatagaattagataaaataaaatagatttgaaagtcctaaattagaccaaaggaattccgtctgctagaataagaaaaagcgcttccgaattgatctcatcctttataatataaagaaaatttttctttgttcagtaataacttaatcttggaataaaacacttgttacttgttatag

SEQ ID NO: 12792 - DNA, 888 bp, Triticum aestivum
  unsure (1)..(888): unsure at all n locations
  Clone ID: PAT_TA_12792
cggacgagttccctttcaagcccgacgacttcggccgcttcgacgagtcatcagatactgtgttctattcggctccccgttttgtcacgcacattgacgacccagcaatcagagcgctcacaaaatactactcccaagttcttcctccaagcaacactccaggcgtggccatcctggacatgtgcagtagctgggtgagccattatccggctgggtaccagcaagagaagatcgtagggatgggtatgaatgaagacgagctgaaaaagaacccggttttgacagagtatgttgtgcaagacctcaatttgaatccgaagcttcctttcgacgataacacctttgatgttataaccaacgtggttagtgtagactacttgacaaaaccaatggatgtttttaaggagatgagacgaatacttaaaccatctgggttagctatcatgagcttttcaaatcgctgcttttggacaaaagctatatccatttggacatcaactggtgatgctgaccatgcttggatagttggtgcatacttccattatgctggagggttcgagccccctgaggctgttgatatatctcccaatccaggacaaacagatccgatgtacctgcccggcccgcggcagaaaactgcttaattaaatatattttgtatcggagttttgcttaaaagaccaaatactagctgacgcacatatatttctaccaagaagaaaagactaacgacccccgcggggggcatgtcatgattcatagtggcaccactcgtatatctgnatgttgagtatttttcataggaaagnagcgtctgcatcaatactgnnacncaacagtggtaanggcaanagtttgtacaaaaatcgattaccnaaaaaaaaaaaa

SEQ ID NO: 12793 - DNA, 1143 bp, Triticum aestivum
  Clone ID: PAT_TA_12793
cacaaaccctagacttcgcagcgagcagccgtcgcccgagccccacagaaacaccaaagcccgagccatgtcgtcggcgtccctcgccgccaggctcctccgccgcgccgcctcttcgccgcggctctccaccctatcccgacgctgcgcccactcctccgcgacgtcccgcgcgcccgtttcgcttgcccgtttccgccccgccgccgccgccgccgcccctccccttcagggaccactgcccgccgcttcctgtcgtcgcagtccccggcgtcttcctccaagatctccccggacgagaacctgaggcgggtcatcgactccgagatcgagtgcgtcgtcgaatcggaggagggctccgcgcagcaaattgatccaccagaagacttcccctttgagataattgataaccctggtgatcagtccatcgttctcaaaagagagcttgcaggagagactattaaagctactgtatacacaaattttgatactgaggaagatttgaacaatgaggattctgatgctgagaatgatgatgactcatttaagccagcacttcagatggttgtcactgttgagaaaccaggaaacgcagtcctggaatttgagtgcaactttaatgatgatgaactggcaattgaaaatatgaggttgctgaatcgcgatgccaactttactgagaatgcatatgaggggccacaattctctgatctggacgacgagcttgcagaagtcctttcacaggtatcttgaggtgagggggatcaagcactcgctgcatgactggctgcacgagtacatgatgacgcaaggatgagaaggtgtacgtggttgggttgaagaacatgagagagttcatcgagaaatgagtgccactgcccgtcattctcttttaatagaaagaacatgcctggtgctctatgtcaaacctgtctgatcataattgtgccttgctttctggcacaccaagtctcggtggacgctgagctggatttatattttgctggacctgtttagctgtagaaaagtttcggcatcttatctttcgatgtttaacctgtgatccgttcagatatgatcagttcatgtattttcagccgaaaaaaaaaaaaaaaaaggcccctagaaccatgaaaaaaaaaa

SEQ ID NO: 12794 - DNA, 924 bp, Triticum aestivum
  unsure (1)..(924): unsure at all n locations
  Clone ID: PAT_TA_12794
gcattgcattccttcagttcagtagcggcccacgcgtccgcctttgcggcgttccaatttggtcccgagctttcgcttcacactccggtcgagtgcgtagcaatggcgagcgtgaaggtgttcgggtcgccgatgtcggcggaggtggcgcgcgtgctcatgtgcctgttcgagaaggacgtggagttccagctgatccgcgtcgacgcctaccgcggccccaagcgcatgccccagtacctcaagctccagcccctcggcgaggcgctcaccttcgaggacggcagcctcaccctcgcagagtcgcggggcatcctgcggcacatctcgcacaaggtacgccatgcagggcaacccggaacctgatcggcacgggggcgctggagcgcgcgtccatcgagcagtggcctgcagaccgaggcgcacagcttagacgagcccaaaagcccaaatgggctaccagcctcgccttcctcgcgcccggcgatgcccccgaaggctcaaccaaacgcacgacggcggtggccacgtcagggccagcgggggccggtgcccacgcccccgcgcaggcgcgggaccagctccggaggctgggcgagcggaggaagggggtcgcgggaactgctgcccatctacgcccaccgcctgccgggggcactcccccggccggcgacacttaacatcgccgactgtcgcactgcctagcggacactnngctccgaccgngctccgcgcatttcgatcccgcaagactcagnagtggggnacaactctccgcgcanactgaanactcagaccngaagccgcgtcaagtcacgacgcaangcaagacgcaactggcanaacaacactgctngcacgacgcaagctnagncaacgtgtcanacacggantcacgtgcgtcttcgcgnatatactgcccgn

SEQ ID NO: 12795 - DNA, 408 bp, Triticum aestivum
  Clone ID: PAT_TA_12795
tttttttttttttttttttacagctgccaactctctagagacgagtaaaattatttcgacagtacccaaaagaattgacaccagtagtacaaggaaatgaaaaacaaatcgtgagctatatctgcagtgccattttgtaggcatataaccttttttccaaattgaagtaaaagtaatagcatgtcgaaaacagctagcaggttggatgaggatgatcggtgacgagggtgatcggtgtccctaggtggtggtgcagttgttgccggcgccggcgtcggcgccgcagccgcatgtgcggggggagaaggcgcagacgccgaagggcttgccggggacgttgcagtcgatggcgtagcagcaccgcgtgtccacgcatgagctgctcgcgctggcgttgcctcgtgccga

SEQ ID NO: 12796 - DNA, 667 bp, Triticum aestivum
  unsure (1)..(667): unsure at all n locations
  Clone ID: PAT_TA_12796
ttttttttttttttttttgtacttaaaacaacaacataacactatatattgacaagcatggtacatatatgatattacacagaacacaattttcgacaacaatatcataatatagcaagttcatttcccatgtgaatatacaaacatacacccacaatacttcacatcggcaatcgggatcttcgtaggcgttttctctttctgtgtacatgacgcccaaaggtaaagaaaaacacttgattcggtattggcntaactctgagctgatttgatctgaacaaatgtatgctgccttctttgggataatttgtgcatttggcttcagtgtggcatcctgccttggagcagcagcagcagcacgcttgacncaatgtatgaggtagattgtagaggttgcagcaacaaaatcttgaggacgggggccgctgccgccgctgtcagcttgccggctgcccgcctcctccgccgccccgctgccacccctccgcatatcgccctgctcaccgcgccagctcgtgtgtcaggagaaattaggaaaagtccccttcgtttgaacagtatagagaaacaaaatgaatcaaaagacaaccatgagtccatctctgcatctctctcgggtgggcaatctccatgactgcaaagtgtaacagcggctgcactagtttga

SEQ ID NO: 12797 - DNA, 579 bp, Triticum aestivum
  unsure (1)..(579): unsure at all n locations
  Clone ID: PAT_TA_12797
ttttttttttttttttttttttttttttttttttgcccctngagcccattatctggtgcatcttggttgagctggaggtgcagcatatgcacttctacagcacacattgtattaaattattgtgtaactacaactgctttgccttctgttctccccgtttcgcatgtgctggcccttgcgcatgagcattggtttgttgctgctgtatatctacaaatgatgtgatagtacatccagacatgctatgcctacaggtttgggttgcggatgcactgcgccccttgccacgtagctcccggcggcagcaccacgggctccagcatggcaggcccgatgcacacgtaggcgaacttgccgtaccactcgtacttggaccccgggctgaacacgtacagctcctcgaaccctcgcctgctcaggcaaaccgagttcctccggcccctgtcgatgacggtgaactccctgggcgcgtgccggtacacccggcacagctccgccgtcaggtgcttgtagttgtcgtcctcctcgccgtccggctccggcgccgcccgcggcgcgctctgcccgcccccgccgccg

SEQ ID NO: 12798 - DNA, 1022 bp, Triticum aestivum
  Clone ID: PAT_TA_12798
tttttttttttttttttttttttttttttttttttaccggtttatgagctcctacccagtttgttttttaaatatagcaaaatagttcccttatccagtcaacatctattgacaaccaagaccaagcagtgcaggtacatgaaaatactacaagcagtaccaaagtagagaacagaaaacaagtgatcggccaaactacttaactaccaacataggattgcctgttgtatcctcctgatgcggcgccattcgcatacgtctggtgctggtggccagcagcctgtgccggacagtctctcgcgaagtgcccaggctgattacatttgaagcacagaccagagttggcgttgccgccaaccgaagaactgtaggaggcagcctgccctggacagtctcttgaaaagtgcccaggctggttacatttgaagcacaagcctgagctggcattggcagctgaaggaccataggaattaaccgcgaagccgctacctgctgctggtgtcgctgatggtgcagtcggcatcccgcgagatgcgctgaattgctgcccaaactgatttgggccaccccatattcacagcataggaattgttggaagctggcacactctgtccagcttctgagttggcgaagccagcattaacagcaggaccaccattcagcccaggagaagagcctgaagcgtcctccgccaaaaggctatcaatggcccccagaaaaaaacgactctctttcactgggtcgtatctttcagccttaacaatgttgcacttcacacgcggctcatcattatagcctgctgcccggactttcagcttgaataggtattgctgaaatcggacctgctgtatgatttctgcaaaccgtacatcatcttgctcttcatgctttatcctgaaaagatcttgtgctgagaggccgataatctcctggccagcctcttggaatgaagttgcatgggtggacccagtatgatcctggatatggcatgacagcaggtatctatactcacaagtttcaga

SEQ ID NO: 12799 - DNA, 1460 bp, Triticum aestivum
  unsure (1)..(1460): unsure at all n locations
  Clone ID: PAT_TA_12799
ttcggcacgagggtaaagtnaaaggtgctgttcctcatgacctaggaacacatgatccatggcacgaaatgaatgcctacaacatacatgatacaagcaaatggaaagatctaaatcccacgcgtccgctccaggtgtacagagactttgctgccacaggtgatatgacatttggtagagatgtatggcctgcagtctgtgcagcaatggactacatggatcagtttgatcgcgattgtgatggtctcattgagaatgatggatttcctgatcaaacctatgatgcttggactgttcacgggatcagtgcctactgtggtggcctctggcttgctgcacttcaagctgctgctacaatggctcatcgccttggggatcgtccatacgctgaaaagtacaagctgaagtttatgaaagctaaagcagtgtacgaggcgaagttatggaatgggtcttatttcaattatgacagtggtacaagcagcaatagccggtccattcaggctgatcagcttgcaggacagtggtacgccgtatcgtcaggcttgcccccaatttttgatgagcacaaaataagaagtgctctgcagaaaatatttgaattcaatgttatgaaggtaaaaggaggacggatgggagctgtaaatggtatgactcccaagggaaaggtggatgagacatgcatgcagtctcgggaaatctggactggtgttacatacggtgtcgcagcaaacatgctactccatgggatggagcatcaaggttttatcaccgccgaaggaatatttcttgccggctggtcagaagatggatacgggtattggttccaagcaccggaaggatggaccacagatgggcattacaggtcgctggtatacatgcggcctcttgctatttgggcaatgcagtgggcattgtcacccccaaaggcgattctcgaggcacccaaggtaaacctgatggacagaatacatatatcccctcaagcagtccgagcagtcggtgagataggtgttcgaaagatcgcccccgataacagatgtattccgagctccacgttccagtgcgaatgctaaccacgggaagaaggtaacgtgtaacgactgatgagtaaatcatggtttttttccggcttttgcttgttcccctccgagatccagtggggttcaggtcttttttttccctttacagtcagagggaacacctatgggacagttaaactcacagctccaaagagctcttgttgtataatttgtacagtgaactattacgtaacatattcaagaagtttgcaaaaaatggcttcgccttgttggtacctgcaggcggcaaaaactctgcacgaagcagaagtctcacaccttggagcaggagccgaattgtattccctccatacacaggagcttctgatgcttcacacccctgtacgaatattcaacgtgaaaaatatcaaaaaatct

SEQ ID NO: 12800 - DNA, 786 bp, Triticum aestivum
  Clone ID: PAT_TA_12800
agttttttttttttttttttttttttttttggcaaagaaacgaatttttgggaaagcatcgagaagataatcaaactacaaatagcggtatgcagccatcagagcataactactgtcatgcagttaccagctctggatcgacagattcgtaattctaaaccagccgttacaaaagaatagctgagccaagccaattttcatgcatgttcttctatgcacaaaatggaaagtgagcatgtccaagataccattgctaactctcaatcatgaaaatgaacacacagaacgaatctacacggctggggaaacaaatcaatgcacacttgtgtgcaataaaactgtttgcagatctactggagatcgacaatatccttgttacactcgaacaggtttccttctaatgacgcacttaacagagaacgtgttctgaagtgatatgtccatctagcaataattgaatctcactgcacacttgcttctcttatttcaattcaggagcatatagagcagggcaaggtgatacggtatgatcaggcaagccacttatgatctcctgcgcagcctgtggacagcctgcctgcttcttctgctctttccgggcggggcgggtggcatcttcttgctttggggccatactccccccggccggctgcgcctcggcctcgtccgaggtagtcgcacaaccagcccacctttgggcgcgtggtcaacgagttggtatcattcttatttattttttacaaatcagtaccggctctgaggcagagtaatgctcgtgccgaattc

SEQ ID NO: 12801 - DNA, 649 bp, Triticum aestivum
  Clone ID: PAT_TA_12801
agtttttttttttttttttgatcaacatacttgtatttaaggtatgagctggtagtctgtaacatagctacaccctgcatcagggaatttattgggccaggtaaataattctttagtttagatcaaactctccagatctcggaaatcatcatcaaaaaattgggaaagttacgaacactaacaaatccatgttgcaaaaatgaaggccatgtatcctatccaatctggcactcctctaacccaccgcttcagctccaaatggtcccccggccgcccggcgtcataccgctacgacgccgtcgtctgccgccagaccgtacacggccgaaccgcgaggccaatgcagcagtttctcacgcccccgaatcaatccgatgttagtccttgggctcatggcgtggtggcctcctccataatggggtcagcattcagagggaggaatcaaagacaatgaaaaaagagagttgggggatggaaggaacgggaaccttacgagccgagggaggggaagtcacgggagtcgcgccagccatggaggatctgaggtgaccgccactgccacaatagcgccgcctccgcaaactatgcttccgatcatccaccacagcgaccgaggccagccgccgctcaccacgccatcccggctgcc

SEQ ID NO: 12802 - DNA, 703 bp, Triticum aestivum
  Clone ID: PAT_TA_12802
tttttttttttttttttttgactcttgacaaacattatttgcaagtaagaactgaacatccaagtacacatacacgcatccttgtaacctatacacatcacgtcagtaaatgctgcagtttagatgccctgacacatattagacctcaacagtaaaattcagtggctacccaagtatccaaatagacatgtttctctccttttttttttcggtttgaggtaactgaaatggccggctcagtcaactccttattcagttcaagcaaactgctagctacagataacccccaaataatttccaactacaaaggctgggtcggaggagtagaagaaacccaaaaagctagccgctggagatccacaccatgaactgctcgaggacaagatccatctaaggcatgaaaagaaagttaactgaaggaggcaaagagttttagcgctattgaagttaactgaaaagcgggaagtcaccactagaacaagcttatgcgcctccactagaacgacggcatggggaaggtgtcaccggagctggagccggggtgggcagggctatgccgccggagagggagtaggccacccaccacgggcctaaagaagggtgcgctccatccacctccccacggcagcggcgcctgccttcgatggggccgggaaggcacagtggcgtgagtcaacgcccgaaaccatggctgcagggtgag

SEQ ID NO: 12803 - DNA, 677 bp, Triticum aestivum
  Clone ID: PAT_TA_12803
ttttttttttttgactcaaggtaggggatccctacattaattttaccaggggaaatgatgatgagcagaagcgatccaacttgcgttgaaatgaaagattggcaatgccttacatactcaaattacaacactctacttgtcacctcctagtctttaagccattgaaactagtaatccatagtacaaccacgaaaggggaagataggcatatggagactacttgagatacgaagggcatttacaacttaatctcccgaagcaaaacttgggcttgctaatcacattggtacaaacataacctcacatatctgggtttcggcgtcagcacttctgatcggctgagcaagagcagtttccttggtcctgtttcagtttctcgatttggtcctgcagcactttgatgtagtcaacagcaatatccagcatgtcagaagtatttgtttgcttgtccatgttgggcacgaggtcttgcagcctcctaagcctcttgctgatcctcgttcttctttccctctcggcgatgctccccgggtgtggggcgcccccgcgcccggcccggaccccgcgggccacggagccctgctgccgctgccgggagtcgtccatcccaggcatcccctgcgaccggccaaactgggagtcgatgttgctgtagctggtgaccatgccgtcgtcgc

SEQ ID NO: 12804 - DNA, 833 bp, Triticum aestivum
  Clone ID: PAT_TA_12804
tttttttttttttttttttttttttttttttggacaacaactacatttgtttcatagtgggaatgacagatgaaacaatgccacttaataaaaatatcacaacttcatggctaaagagacttggagaagagcaacgaagtgaaaacaaaaacaatctacatgtatttaagtaacatatctacatcaaggtagccctcaattcatacattaatagctataaatatgcatttcctattgaagctatcatatttaattaacgaatgtttccatgtgagaattctcaaaagttcttttgtctttataccacaactgttacttgcaaagttgtttaagtggtgaattattttttttctaagcatttttcttttgtacccgttgcaacgcacgggcatttatgctagtctttacctaataataaagcaaattaggtttctgtcgtccatcacgtttttttgcaaaaaaaacccgcggtttgctgaaatcaacccacagtactacaggaatcaagtaaaaaataaaatcactcgctggtacaattcctcgctccagtcccaggccgctaccgcccgcctgcccattcttcgccgggcggcgcgcgcgcccgccgccctaccaggctgtgcctgccgccgtgccaggtcgcgcccgccatcccgcgccctcgcccgcccagctccgctcgcgccaccgccggccgcgccctcgaccgcctccatgcccggcctcgcccgcctccatgccccgccatgccaggtcgcgcccgccatcccacgccctcgcccgcccagctccgctcgcgccaccgccggccgcgccctcgaccgcctccatgc

SEQ ID NO: 12805 - DNA, 737 bp, Triticum aestivum
  Clone ID: PAT_TA_12805
ttttttttttttttttttatagtagcactagaatctttttattacttactgaacgtgacagcccaagtaagcagtacctggactcctggaggcaccattccctacctggatgctttgtcgttcaagtgaaccaaaatacggagtagattagttatatcttcagtctcgacttcaagaataagatgccattctgctgcacagcatcccagcaactaacactagcgcatggattactgcaaaaaagagttcgtgtaatgtgcaaaacaagatttatgtcaggttggttgggccaatcagtgaacagatgtgacgaataatatcagccgaagcatttggtcgagcagcatttagtgccttctgagacatttctgccatcaatttctcatcaccaacaatttcatcaattatgcatgttagactactagaatcaagttcatcttcggttatgacccttgctcccatgacatctgccatgatatacgcgtttttcgtttgatggtcatccacaattgtcggtaagggtatcagaattgccggtttcccagtgaccaatatctcagtgcaagccacagaaccagctcgagaaacgacaacatcagtagcagcatatgtcatgtccatttcatgcaagaatggtgtcagaaacagccggcgatgcgccctgacgaggctctccatctcgcagaaatcctctggtcccgtctgccatataatgtacctatttttccttctcgaca

SEQ ID NO: 12806 - DNA, 590 bp, Triticum aestivum
  Clone ID: PAT_TA_12806
cccccctcgagtttttttttttttttttttttacgaaaagagtactcaaatctttataaagcacacatgaaaaatgcgaagatgattcgaaggtacggacatggcaaaaggagggtaggttttgcgtctataacacaacatcttcacataaatgctttttgaaaagaagatcgtagcagtgctaaggtagaatctccatgggggcagtgataagggggaatctccctgcggcgcagattaggggcgtgtttaagcaggccatgagctggtgtctaagctgagatgttcgatctgaagcaagaatcggtaggtgctagtaccgtccagagtgcctcgtgcgccagcgtggaggtgttcccctgtaaactttttcaggtgggatcttgagctttatgccgtcctaatgcctcgcaatgtgcaatgtgcaagatgcaagccccggtatcctcctatgtagatggtagaccaatctccatcctgtgttgccatccagcgtagtactcattgaggcagtgcaagacagcgtggtgaagcttccaggcgataagttcgcgcttatccttggtttgcatgtacttgacccactgtca

SEQ ID NO: 12807 - DNA, 984 bp, Triticum aestivum
  Clone ID: PAT_TA_12807
gagtttttttttttttttttttttaacaactaaaatgaggcattttattggaagataaaacctgtacattttggggactgctggcaaattagtggaataaatatatacagagttttcgtttatcggtgtgccacagcacaggctatacatgacagcaaaagcaaattttcagttgcttatgtcgaagtacttgggatctgctgggttgtcgtgttcccccctcagctgcggcagttttggggtcggcagatcctgtcctcgttgggggccggtcgccaaattagtggaataattttgtacagagttttcgttttctcagtgccgcagcacaggctatacatgacagcgaaagcaatttttcagttgcttatgtcgaagtacttgggatcagcagggaaatcatgttccaccttcagctcgccttcatctgcatccgagtgcctctgaggaaatacaactctaagatcgttgtagagatagaatctcctatcctcagtcaccgtattgccgctgtgcggtacagatgatggatcggatttgcaacgtagcatagattttgaggatttcttggaggcggagcagagaaaccgcaggtgcagagcatagcggagcacgcctccacctgaactgtccttgatcctgggaagacgcacaacatgatttcttcgcacctgagtgcacgttgtccatctgacagcaacaatcatcagaatcagtattgttttgcttattcccaatagaattgggtttatctgattccttcatgtcagtgcccgatgagtaacattttgtgtttgcgtgtctcttttctgattcatcagttgagttgcacgtccgcccctgcccgcagtattccaagcatagagttcctccttgtgcaagttcacttccacatgagacacactgagctttcgggccaacatttgtgtcactggtcttgctttcttctttcactatattagagggagaaacagtgggagacag

SEQ ID NO: 12808 - DNA, 492 bp, Triticum aestivum
  Clone ID: PAT_TA_12808
tttttttttttttttttttggacaggcagatctcatctcactgatagatgaatatagtcggcaccactacaaatcaagatcatctcatcttatcggaccctacactagtactagtacagaggtgactgacggacggacacctgacctccattatctaatgtaatcaaccacccaaggttgttgcaacagcggccgccggccccatggcgccgcctaatcagatccagtccgctgatgatccgccgtcccgtcactgcgcgtggggccccattctactcgagcttcggtctcacggagtggagtggagcggagtgaggccgacgccgaggcggccgccggccccatggcgccgcctaatcagatccagtccgctgatgatccgccgtcccgtcactgcgcgtggggccccattctactcgagcttcggtctaacggagtggagtggagcggagtgaggccgacgccgaggcggccgccggccccatggcgccg

SEQ ID NO: 12809 - DNA, 533 bp, Triticum aestivum
  Clone ID: PAT_TA_12809
ggaaatactcttaaaaatttaaatacaaactacatacggatgtttataaacatattttatagtgtaaattcactcattttgctttgttgtcctttttggaatctctaaaaggtcttatatttaggaacgcagtactttgttacaaacagggaataagcggtagacataaacttcaattaacagtatgtggggcgagcctactggcgagcccatcctatcatgggcatcggaccaaacctattcatctcgagaagaccgtgataccaatatggcttgggcactggccatctgcatttgttgttcacatctggtttgtccaatctgagcacagagcggtcggtagttaagcgccatgtgctatgtaagacttcacgaatttgcttacaaggcaggtagggagttctatcaggccttccatcacaaaagttcatgccaacaagacgcccattaaagaagtttatcagggggcctccaataccaaccttcgtgattttacaattggacagcttaagttgctggcaaccaaatgtgct

SEQ ID NO: 12810 - DNA, 1190 bp, Triticum aestivum
  unsure (1)..(1190): unsure at all n locations
  Clone ID: PAT_TA_12810
ttttttttgtgaagcgtacgcgcatggatagtgctcacagttaattatacaatcacaaaaatatagaatcgtgctgtagcaagcagttgggcatctgcagttgataccggcgctacgtacgtgcatgcatcagccagtaatcctcaagtacaaaccgaaaagctagcatggcacgtacgtgcatcaagcgctagtgggcctgggcgtgggcgcgcttgctggaggtcgaggacggcggcggggcgagcaggtggtcccagagggcggcgaactcggccatgacgtcggcgaccatgccggccttgcccttgccgacgagcagccgcaccagggcgcccacccgcgcgtcgggctcctccaggcgctgcccgcggggaggctccttcaggcgccggagcagggcgcgcgcgtggcgggcggccccgggcagcgtgcccgcgcggagcgacgcgtcggccagcgcggccgcgtaccccgtggcggcgcggctgctggtggtgctggtgctggcacgcgccgggtgcgccggcggagcgccggaggccgacgaggagcagcggggcgccccggacggcgccgcggtcacggtcaggcgcgcggagatggaggaggcctgacgcgggtgcctgaggtggagcgcgcggtggtggtggtggggctggagggaggcggcggcggcggggagcgccccgtggtggtgcagggacacggccgcgtccatggcgcccggtgtggaacggagcgactgaacgagtggcggcggtggcttatgcttacgctgcctcgtccgcaccgcgcgtgcgcgccttctccggattaggttgggtttggcgtttggttgggggttgggtggggcgacgttggacacgcgcngcgcacggcggacggacagggaacccgggcgcaccccggcgacgttggcacggccacgccagcagcaagtggccggcgtgggccaagagcgggaaaaacccggtgatttttttattttttggagaatctctctactttattaacttcggtatcttcatccggtgcataactgggtcatanggtaaatccaaccaaatcatggtcctaaatccaaaagtacaagcatcccantactaanccggggnggaccgcgctangtcngccgtcgcccaaaccgttcgattggtacagtcaacgtcaaaaaacatatcgcccgt

SEQ ID NO: 12811 - DNA, 575 bp, Triticum aestivum
  Clone ID: PAT_TA_12811
ttttttttttttttttttgacggtccaagaaaacatactttatatgattcccaatatgttaagtacatgcttgtattcatctccaaggtacagttttatgtgagatacatcagaggggagaggggagatacacacgcatgctttacacaaactccggtgccagatcctatctttaggttagctgatgctagacacgtgtggcatgtttgcatgcatggctgcttgaccagaatggcccgtgagacttgctcatatgagaaacgaccatacggattagcttgagatggcaagaacaaagttttgaattttcctagggtcaccaattgcataatcgaaaaagcattcactacctcccaaccatacggagtactatccatgcagtgacgcaggttgtacgttggcttctgggtaaattcaaggaaaacggtgatgggctgggttagcttgaacagatgatgacgacggcgccgacaacacgatcaacacttcagcttcttggcttgaacgactgatcggaactcgatgtcggcaagactgctgccttggctacgactatcggaggaagtgaagttggg

SEQ ID NO: 12812 - DNA, 215 bp, Triticum aestivum
  Clone ID: PAT_TA_12812
gaaaaaatagcgcgctacagaaaaatagcatcaacctcaaaatatactattagcgtgctatatcacgctatagcgtgctattagccagacattgtacaccgttttatttaacgagacaattctcaataggctatagcgccctatttttttttcagtggatcgaacttattgcttctccgaccggccggccgacttactcgacgccgtgcatctct

SEQ ID NO: 12813 - DNA, 912 bp, Triticum aestivum
  Clone ID: PAT_TA_12813
aagggtggtgtgtttcttttcttgtttctgtttcatatctatgctagattccttgtctcttgctcggctgtattttcagttttcatgctgctattatttggccctatgctcttggtacgttctatcatcgtcgtagcatcttgcgcccggtacccgcatctgtgtccgccccatcaccccggccttatcaatgtgagacacaattggcacaggcagcccaggcttcccccttttttctcagtttatgcactcatttcctgtcatatcttcaccttccgtgcaacaatgaatgagttgaacacctcatcgcctgcagggtggtgcacggccagcacttggaacccgccacgcccgatatcgtccagctccactacaggatacaggaacgctcgcgccccgtgggcgcttcgcgcgacgagcaccgccccatctgccatgtgcttccccaagtgcgcgatggcgtcggccttctcctcggacgtcattcccacgagcgccgccaggaagaccacatcatacgcgccgagctcagccgtgaggtccgcgacttcggccgtgtggaacgccatgcgcgcgcgcacgccctcgtccgccgcgccgaccagcttcctcgcccggccattggccacgctgcaccggtcgtagttgtcgaaccgggtgtccggcaggtggtacgtcgcgaggaagagggagctgaacggcagcggtcccgacccgatgaacgccacgtgggccggggctgccacgtgaccggacagaagatcgtgctcgagcttgctcaggttgatgtagttgtcaaagtaagggaagcggccgaggtggtcgagcgggttgtccaaggcggtgagcatgtcggagtagtgcgcctcgagcagccctcggcggccgagcagaggcggatgaggtcctgcc

SEQ ID NO: 12814 - DNA, 1157 bp, Triticum aestivum
  unsure (1)..(1157): unsure at all n locations
  Clone ID: PAT_TA_12814
tgcaggnaattcggcacgaggagaaaatctgctgacagagtatttgaggaagcctctgcttcacaatgctctagccctaagccacagatcaatagagaatccccgtcctcgtccgcgggagatgatgctgaagttcccgcatatccaacagttgattgcctggagcaaccggcggatgttctgatgaatgataagacactgagtgaattgccgcaggaccatgacaaccagtttggttgtaacgaaagaaataatggtgacctggaagatgagggcactgattcagctatcgaagataacaagaaggatgctcttcgaggaactcgaagcttcgagggagatgccctagatgaaaatattgcttgcagaaatgattccactaacagtttgatcaagagttcaaatgttgtggttaatgagggcagcgacatgccatcaactgttgataccaaggagtctggggaagagttagcaccttcctctcatgtccctggtacgacgaatgctagcttatctgggaatgatatcagtacaagcaatgcaagcgaacaccctggtagtgccgacaccaaaccagaatcatccgtaggtgaaagctcagaatcataactgagaggaacttgttgtagaccacatacagcacgggggagaattgtaatatgctgatcggaggataggaaatgaaaaacaaggttggcctagctgcaagcacttaatcctcattgcctgaccttgatgatacaatccgcgtgctcaagcctgcagtctaaaagaagtgtctgcgccgaggtgtggtgagatcagaagcatcgctccacgatagaagactcttgttcatagctacgggtagcttgggcttgcaagtttggccgagttatgacggattgtattgtatgtttgttctcacatgtttgctgtcggttgtggttgcatgctgtagagtttgtatatcgaaattttaatacttgacagttcagacatcagacgctggggttgtacacatgtatctactgtgcaattgctggcctcatctttgtgttgggaataggaggccagctgataccatgtttgtatgggaacctgatctacatcatgacattttgttgacgtcatggatattcattacgtttatatgannnnnnnnnnnnnnnnnnnnn

SEQ ID NO: 12815 - DNA, 420 bp, Triticum aestivum
  Clone ID: PAT_TA_12815
cgtccgggaggactcccctccaccgacatggccgactaggatcatgtaaccctaggggccctggtaacttatgtaagccgggaccgagctggtcgatagacaacatacaatccctggataataccttgtactttgtacaccccaatcgcagtatacaacagtagggttgtacctcgtaaggagggcctgaacttgggtaaatctagtctcctgtttctcctccaatatactcaccttgccgggataccctaatggagggatctaccactcagcctttccgcaatggatgggagttgttgaacttttcagcatactggtatgcaggccaggcgtctcgccaaacacctaaataaggtgccatttgattgggtaatcgtcttgacgtgcccggaggaaaatcacggcattattagcatatag

SEQ ID NO: 12816 - DNA, 632 bp, Triticum aestivum
  Clone ID: PAT_TA_12816
cgtccgcccacgcgtccgctctcccctaccccgccgccacccaccctatcctccaccccgccccgtcccgtcccggtcccggtccatctccgccccgtactgtccctctccggcaaggtcgcaaggaccctcccacgtcttggttacctgtccctctcgccaccgcaggacgcctcactccagccacccgatctgggcagcccacggtaggtcaactccacccccggaggactaaggagcaagaggcaccggggctcttggtctgggagcaagcagggaaatattgggtgaagtgtgatgctgaacggacagaggaagatccttgagcaatgaaaatctttgttgggtggtgctaataatgcaaagattcagttaggtgtagtgtgagggtgaacggaacagaacggaagaaatgaagatcccttgggcaatgaaaatctttcttggctggtgctaataatgcaaagattcagtttttatgtaaccttggctagactctgatcatttgatgttgttgtgaacctttgtcgtattgcaaagattaactttttacaaagtctcatgtttaagttatatgtattggcatggttcagtttaatgcaaaacattgccatgtgtgaacaaaaaaaaaa

SEQ ID NO: 12817 - DNA, 811 bp, Triticum aestivum
  Clone ID: PAT_TA_12817
ttttttttttggggggttgtgtttggggctggctatttgatatttgactgttttacaatttgagaacattcaaaaatcctgacaagtgagcatatgacccctgtacagtcacaaaaacagctgacagacataaaggacgtcaaaacgggtcagagaaagtagctgacccggtaaccctggacaacaaaccgctccagaaaaatcggcgacctacccctctcttgatcttcagggtcacacaggacacagcatgtgcccagcttgcaaccaaaaccctcccgcaaaccactggacagatctcgcctgacgagcagcaagaaagaaggacatcagagggaaatcggcatcatgatccacaggtcagcaaaaacagtcccaactgctcgccaacttctctcttcacctctcacatgaacaaatcaggggaggaaatttcttcataacattccttctaccaacagatgataatttcctcttgagctgcttgactttattagtcacatagaaattgtaaagtgctttatcaaactcttcatcatcagcagagaaatccaaagacataacattctcatcagcgaaatcattaggcacagaaggatcttttgaagaatcctgactctcaactgaagaaacttgcggaacatccttggccgagactttccgtagtctgcccattgatctactagcagagcagcccgcggaccaagagaagaagagggagaaatcgccttccccctctttccgccagagcagcctgcggtggatgagctcgaaatcgccatgaacgcaagcaatcgcctcccttcttcca

SEQ ID NO: 12818 - DNA, 457 bp, Triticum aestivum
  Clone ID: PAT_TA_12818
gtgactaccccatgatctccggctgctgtgtgggccccaagaagagagtggtgaccctccgccagtccctgttgaagcagacctcgcggttggcccttgaggagatcaagctcaagttcatcgacacctcatccaagttcgggcatggccggttccagaccactgacgagaagcagaagttctacggcaggctcaaggcttaggctgcgacagatcttatcccatagtgttaccagctttttttcttgctttgtggcagattgtttgggaaccggtttatgcattgcaattgcaactctgagctgctgcgaatgtttgaactgatgaggtttatgcattttgaactttatagtaatgctatttgcatgccttcaaatttggaagcaaatgtttcagctgtgccaaagaactcacaaaacaaaaatacaatcaaaaaaataaaaacctgactaatatt

SEQ ID NO: 12819 - DNA, 739 bp, Triticum aestivum
  Clone ID: PAT_TA_12819
gacccacaagaggtcttcgcaaggttgcctgtattggtgcctggcatcctgctagggtgtcctacactgttgctcgtgctgcccacgcgtccgcccacgcgtccgcagagatgaacaaaaagatttacaagattggcaaggctggacaggagtctcatgatgcctctactgagttcgacaggactgagaaggacatcaccccgatgggtggcttccctcactatggtgtggtgaaggctgactacctgatgatcaagggatgctgtgtcggccccaagaagcgcgtggtgaccctccgccagtccctgctgaagcagacctctcgtctggccctggaggagatcaagctcaagttcgtcgacacctcttccaagttcgggcacggtcgcttccagaccacggacgagaagcagaggttctacggcaagctcaaggcttgagctgctgccgcgcatcatcagttatatcattttgtcaaaacgaacatgtgatacttggttacttcccctgcctaagttttgtactagctgatgttttcagaatctggctcatctatgaattcttcgtgtcatgtgctactgttattgtgatttagctgttgaaacctatttagagtcgtacctggttgcaaattttctgaaatgagtttgcttgcctaaaaggttgtttatctaaaaaaaaaaaaaaaaactgttttctgcgagctttgaaggaatgtgtacaagccattttcattgtt

SEQ ID NO: 12820 - DNA, 771 bp, Triticum aestivum
  Clone ID: PAT_TA_12820
ccccacgcgtccggcgccgccgctgccgccgtccgctctaccccaggcaaggaagggaggagcggcgatgtcgcaccgcaagttcgagcacccgaggcacggttccctcggcttcctccccaggaagcgctgctctcgccaccgcggaaaggtgaagtccttccccaaggatgaccaacagaagccttgccacctcactgcctttctgggctacaaggctggaatgacccacattgttcgtgaggtcgagaagcccggatccaagctccacaagaaggaaacctgtgaggctgttaccatcattgagacccctcctctggtcattgttggtcttgtggcctatgtgaagaccccacgtggccttcgcactctcaactctgtctgggctcagcaccttagcgaagatgtgaggagaaggttctataagaactggtgcaagagcaagaagaaggcgttcacaaagtatgccctcaagtatgacagtgatgcaggcaagaaggaaatccagttgcagcttgagaaaatgaagaagtacgccactatagtccgtgttattgcccatactcagattaggaagatgaagggcttgaaacagaagaaggctcacctcatggagatccagattaatggtggcaccatcgcagacaaggttgactatggctacaagttctttgagaaggaagtcccagttgaagcggtcttccagaaagatgaaatggttgacatcattggtgtcaccaagggtaaggggtatgaaggtggtgtcactcg

SEQ ID NO: 12821 - DNA, 2120 bp, Triticum aestivum
  Clone ID: PAT_TA_12821
actcccacgccacccccccagccgccgccgcccccaccgccgccggcgtccgctcgcaccccgacagggcaaaggtaggccaaaggtaggcacgggaggccggggtccccgagccagggagcgctccgttgcctccccacgaagcgctgccggccccccccccgacagctgccgcccccgcccctacaggggcaagctaagggaagggatgtccgcaccgtaagttcgagcaccggaggcacggctcccctcggtttcctcaccgaggaagcggtgctcgcacgtccgcgaagacgggaaggtcggtccccagcagatgaccaatgcaagcactgccatctctttgccttccttcgccacaactttgggttgactcacattgtgcgtgaggtcgagaagcctggattcccagctgcacaagaaggagacatgtgaggctggtcaccatagttgagacaaccccagaattgttaatgttggacttgttgcctatgtgaagagttcctcggtgggccttcgtaaatctcaatgtcaggtaagaacaaaagcatcttcaagcgaagatgtcgaggaaggaaggttcttacaagatctggctgcaagagcaagaagaaggccttcaccaagttatgctctgaagtatgacagtgatgctggcaaaaaagaaatccatatgcagcttcgagaagatgaagaagtatgctactgtatgtccggtgttatcgcccatacccagattaggaagatgaagggattagcattggaagaaggctcacctcatggagatgacaagttcaatggtggcaccatcgccgacgcaagggtcacgggtatgttctcgcaatgtggggaaggtcccccttgatgctgtcttccaaaaggatgagatgtgtgacgtatcctggtagttatccagggtaagggttaagaaggtgttgtgacacggtggggtccgtcacccggcttggccccgcaaggaacccacaggatgtcttcgcaaggttggcctataggtccggcctggcatcctgctagggtgtcctacactgttgctcggatgctggtcaagaagtggtttccccaccatgctgagactgagcatgaacaagaaggtctaaagagggcttgggcaagcttggacaagggcaaactcgacgatgcccctgcactggaagttcgaccaggactgggaaaaagacatcattccccgatgggttggccactcttcccccatatggtgtcggtcgaagggccggactaccatggatcgatggcagggtatgctgtgtcgggcccccaatagtaagcggcagggtgaaccctccggctctagctccctagctaaaatgcagacctctcgtttttgggccctcggggattgatatcaaggtgcaatgttcatcgctcacctcttccaagtttggggcatggtcgtcgtttctagaccacggacgagaagcagaggttctacggcaagctcaaggcttgagctgctgccccgcatcatcagttgtatcattttgtcaaaacgaacatgtgatacttggttacttcccctgcctaagttttgtactaggtgatgttttcagaatctggctcatctatgaattcttcgtgtcatgtgctactgttattgtgatttagctgttgaaacctatttagagtcgtacctggttgcaaattatctgaaatgagtttgcttgcctaaaaggttgttatctaaaaaatcaaatttggaagctacaaccttttttcctggctttgtggcaaattgtttgggaaccggtttatgcattgcaattgcaaccctgagctgctgcaaatgtttgaactgatgaggtttatgcattttgaacttaatagtaatgctatttgcatgccttcaaatttggaagcaaatgtttcagctgtgccaaaaaaaaaaaaagaaacaacaaaaaaaaaaaactgaaacataaacaaaaaaaaaaaaaacaaaccatacaaataaaaacccaaagacaaaaaaaagagcacatccaaccaaaacaaaagcgacacgggaaaaacaagataaaaacttgcttcaaaaggcccccaaaaatttccccataactccaaaaaaaaaaaaacggcccccc

SEQ ID NO: 12822 - DNA, 919 bp, Triticum aestivum
  Clone ID: PAT_TA_12822
cgtccgcggacgcgtgggcggacgcgtgggcggacgcgtgggcggacgcgtgggggcgccacgggcacgaccgccaccaaccgtccgccgacggccgacgccatgctctccctcgcccgccgcccgctctccgccgccgtccccgccggaaacctcctcggcatccacctcttccagtgccccgacgcggtgggcatcgtggccaagctgtccgagtgcatcgcctcccgcggcggcaacatccacagcgtcgacgtcttcgttcccgacgacgcccccgtcttctacgcccgcagtgagttcacctacaacccgaggctctggccgcgcgacgtgcttcgcaccgacttcctccgtctgtcagactgcttcggtgcacaaaaatctactgtgcgagtacctgacattgaccccaagtacaagattgcagtcctcgcgtccaagcaggaccattgttgtttgacttgctgcatagatggcaagaaggcagactcccagttgacattcattgtgtgataagcaaccatgatcgacctgtagataaccatgtgatgcgttttcttcaagaggcacgaaatcccctatcattacttacctacgacttcctgggaataaaaagggaacaggagatactagaattggattgaaggtacagattttgttgtgctggccagagatatgcaggtaatgtctgaaggcttcctttaaagcatatggggaaaagatattattatttctcaaccctccgccctctgtccttcggtcgatccgcgggaaggccctttgctgggtgggccgttcggtgcactgccggtggtaccctgacttggcgcccaccagccaccttgggttacggccccaaacgtagttggctcgggcccaatctgttgcgcggaacggccgcaaccgggtttcttac

SEQ ID NO: 12823 - DNA, 828 bp, Triticum aestivum
  Clone ID: PAT_TA_12823
tttttttttttttttttttttttatttttttttttttttttttttagccaagtcaagatgaatttcttccatacaatagctagtcaattcaagatctgatttttttccccatacataaggtacctaacaggcgttgctaggaataatgcagcctggggtctttatggaaccagcgccaagacattaccaacacaactacacatctgctatcttaacaaacgcaactacgcagttgctatcttgtccttgggaattaatcctatcagttctgcaatcttgagcttcttcctggcgtaccgctcatacgttcctgacgactcacgcgtccagcgaatttcctgtttaatcagctcacgggctctatcttctggaacaccgtcactaaggcccgtcgtgcacttaacaaatactaggtccattttggaatcgccgtactccagctcatacttcatactgcggtcgtgtgctggaaacaagttagcctcataaacttgcttgagagcatctctgaaacgcagctgatgatccgcattgagccgcctccaaatattatacaagataccatcaagatctttcacaaacatgagatgtatgcgcgcattccatatatactcatgtaaaccaacagctgcaagtttcagggtcatgcagggaaacttagaagcgatcctaattgcttggaacgtagcctttgaatgtttatgcgcccactcgatagaagactcgtttgtcagcagatactgctcaagccatttaagttccttcgcaattgtttcccagtagctgagataatctctatcagcttcaggggtgctataaaatgtttgg

SEQ ID NO: 12824 - DNA, 864 bp, Triticum aestivum
  Clone ID: PAT_TA_12824
tttttttttttttttttttttaaagcaatccaagcatggccatagtatattacaaacatgacaaacaaagaattaagagcatcacaccattcagcatgaatgatgagctacctcaaaaacaaagaattaagagcatcacacagtataaaccaacaccctgcagtagttaattacacgcacggacgccatgcatgtacacgtctgtctcacgaaattgcaacgtcgcacggcacgccccggaaggatttcgccgacgacggcgacaagccgatgaccaccgggggagcagatcgcccgcatgttgtagtgcctgaacttgacgccgccgaccaggaaatggacgatcgcggtgacgcgcacctccacgcccacctcgccgtcggagcggtcgtgctcgagctcccgcgcggtccagtcgggcaccggcgccgaccgcgccacggcgcgcacctcgagccgcgtctcgttccggctgggctggtggaagtccggcacgtcggcgaccgccagctgaggcgccacctcgcccgcgccgtagtgcacgtagacggcgaccgacttgtagcgcatggacacgcgccggttcgggttatcggccgcgagggtgaggtagaaggaggcgttgagcgtggcgccgccgcccccgccgggcggcgcggtgacgtggaagcgccgcacggcggcgcgcgcgacgctgtactcgatgggcttggggcggacgacgagccagaagacgaggacgacgaggccggcgaggagcacggtgacgaccagcgcggccacgatgcagcggagcacggccacccgcctggcgctccccgtcgtcgccggcatcgcggtgcccaccgtagctgcgcgcggcgt

SEQ ID NO: 12825 - DNA, 918 bp, Triticum aestivum
  Clone ID: PAT_TA_12825
cttctttgccctgtgatatacatgttgtcaacttgaaggtccctcagcctctaaggtttgctcatacggaagcagttgagccaagatttgccattctgttgcagagaaggggctgggatgcatcatactgcaaaaggggtgggttacagtgtacaaatatcggggaagaggctgtaaatctatttgacatgttcaaagatctatcggttttaaatgtgaaggcaacctctctgaacctcttgaatgatgaccctgaaatgctagggtatctcgagcaaattggcgatgtagctcaggagggtaatgttctcatctcaccaatggaaattcaggcatacaagttagacctacagccaccatcatcaccagaagaatagtatgtcgaagcagtacatttacgctgctttgccactaactggagaaggatctacttggagtagttggcagttgcatcttgattatgctggaacacctgctcttccacatgcatatgtgttcatctggttgacatacagtgagggattgaagttgatcgtcgagacattcctctgagcagcctgagaattgtggttcagttatttgactgctgcctttcatttaacctgcaagggtgcatatacttcattttctccttggtgattattgcttaacaaattggaagtttgaggcaattcggagcaggctattggagtagcttcgatgtctacgtgctgccacctccacttttatcccagctttttgcgctcacagctgtggcatgttatatcggccaatgctatcatgataggaacctatatgaacacaagtttttgtatataccctttttgcatccgagttttgtagcgacatcacagaaccttgtggacaagatctgagacagtttaggtacatgattcttgctatatgactgctttatgc

SEQ ID NO: 12826 - DNA, 771 bp, Triticum aestivum
  Clone ID: PAT_TA_12826
ttttttttttttttttttttttttttttttaaacaaaacaacaagtccatcagttacttcgacgtatgatccaaaatttgtagtgttaaaaattgtgtaccacaaaactagccttatttagtaataatagcagaaatgtcccaaaagtaaaagatgagtcccattaatgcccacgggcgaaaagctgagtgaaaacccccgatcctacggtatcccattgatcacccgaaaatccttgaaaggggcggaagtacccaaacacttaattttggttcccttcccagtccaaacaatcggaacaacaggatggatagtgccggacttgaggacgatggccacgggcgactcggcggtgatgcggccgacgggtacagagggtatccggtgatggagagattacagaagggtgtagagcgcgacggagatgaattaggtgttctccgagacgattggagcttgctcctgtgacgatagtgacccgctggagcagcaatggcggcgagggcttctggtcgaggtccttgcactcttatggatgcgcctcttctgtggcgacgaaatcgaccgacgagaccttctgcaacggctgaacttcggcgagatcgaaatgaggcaaaacgggcatgggagatctcaagttggtgaaaaatcggacgaataggagcaagcgagcatttatatggggtcatggatgtactaggggtaagagattggtcgattggatgaggatttggatcgagaaagtgaagaactcgtgcgcgtgcaggagtt

SEQ ID NO: 12827 - DNA, 764 bp, Triticum aestivum
  unsure (1)..(764): unsure at all n locations
  Clone ID: PAT_TA_12827
gtacgttntcccaccgcttacnaaacgcttacaagtttgccatgnctgtantttgatgtgcaacactttctcttttgtgttttcttgtgttttgaacaccgcgacgacctacgcgttgctacattctagtaaagaaatgccacggagaggtggagtagaagtgcaaactaattactagcaaacttagcctggcagctttaggttctgcgtcagtttggtgtatgaaattggtttgtacctgtgcctgaaatttgtgccaccagggtcttttgatggcagtacatgtattggaaattccctttttcaaacgacagggtggattcaaaagtctgaatctcatacactgttcgtgtttgccatttgttttctatggaaacaaaattcaaaacgatttccagtgcggggaaaccgcggagcaatagcattgatcgagcttactgcgcttaatcgcatccgagcttctggtaggaaacatacgggtacgcgcagtaaccgctccggttggcggagtcttgatgcggtcgttggacgtcgaagcggggaaagaagggcggtggcggtggcgaaggcgcggcggcgccggggctggagcgcttgaggtanaggcggtacttctggaggtggctggcgacgttctcccgcgtgaggccgtcgacgttcatgaggcgcacgatggccttgggcacggcgcccttctcgccgaggtgctccacggcctcgacgaaccggtggtgcagctccggcgtccaaccatcctcgccttc

SEQ ID NO: 12828 - DNA, 1511 bp, Triticum aestivum
  Clone ID: PAT_TA_12828
gaattcggcacgagccatggcgtcgccgccgaccgccgcccccgccgccgcgctccggtgcgcgggcgtccacgtaggccgcgtccccctcccgcgccacgccggcggcccctacctccgctccgccctctcgttcaggttaggcgtgctgtcgtcgaggacatgccgcgcgggcgctggcgccgtcgtgtcggccacgaggagccccggtttgggcaatgcagggaacctgcgcgagggttcgaacttgtctaagaactgggatttgagcagacagattggcgatgagcacggtgttcttatagaatgcagggatgtgcacaagtcctttggggacaagcatgtactgcaaggcgtcagcttcaagattagacatggtgaagctgttggaataatcggtccttcgggaactggcaaatcaactattttgaaggttatggcgggccttctagcccctgataagggcgaggtgttcatctgcggaaagaaaagacagggcttagttagtgatgaggatatatcaggtctccggattggcttggtatttcaaagtgcggcattgtttgattctctcaatgttcgtgaaaacgttggatttcttttatatgaaaactccaagttgtctgaggagcgaataggtgaactagtgacggaaacattggctgcagtaggcttaaaaggtgtcgaggagcgaatgccatctgaattatccggaggcatgaaaaagcgtgtagcccttgctcgttcaataataaatgacgacacaaaagaaacaatagagccagaggctcttttatacgatgaacctacagctgggcttgaccctatagcatccactgtcgttgaagaccttatacgttccatgcacgtgacaggaaaagatgctatgggtaagccgggaaagatagcatcgtatgcggttgtcactcatcagcatagcacaataagaagagctgtcgataggttgttgtttctccatgagggaaagatagtttgggaagggatgacggaggaattcacgacatcaacaaatcccattgtacagcagtttgcctctggcagcctggatggtccaattcgatacttctgaggatttatcgaactgctctgtcgaatattcgacgcattcctacgccagcgtccataatgcctcgtcttagagaggcatctacaatacttcagccaagaaatatgagcagtgactttgggcccatctggtgatagatggtgttattcagcaactaatagatgcgttcgacacgcaatgatgtaactctatttattggaccttaggtgaataaacagcaaaaccagcttatcaatttagatgctctgttttggcgagtttggggtcgatgtaaatgtcattctcacccggagcagctcccttgaatccttcatttctttgtaatctttcatggacaatgatttgtgatgtgatattgatttgtaatgtgctcaaatattgtcaaaaccattgagcaatgtcaaaaaaaaaaaaaaaaaaaaaa

SEQ ID NO: 12829 - DNA, 610 bp, Triticum aestivum
  Clone ID: PAT_TA_12829
ttttttttttttaccatccatccatatattccatccaaatatttataagaagaaataaacaaatgaccaataatgtgcagtacaccaagaaagaattcgcagtacatgcgacgtcccgagagaacgtcctcgggacaacacgctcgtgtaacgtaaccctaaacaagatcgccaaagtaagccagccctgctctgctcaattaaaacaagaccacgagcccggcagccgccatggccacgagcgcggcgacgccggcgcgcgcgcgccctcctctggccacgggccgcgaacgcggggcccgccgaggcgagcggggacagcgatggggccatgatgggcgacagctcgggcgccacggtgggcgccggctccggtgccatcgtgggcgacggagtcggggcgaagatcggtgccggtgcaggtgacatgggcgccggagccggtgacacgggcgccgcgccggggcccgtggtggggccggcggtgcgcccccccgcgccggccgcggcccggcgtcgcggggccgctgcgccggccgcgctgcccgctcggcgggccggggggccggccccgggggccggaagcgggcgcggcgacggtgggtggcat

SEQ ID NO: 12830 - DNA, 510 bp, Triticum aestivum
  Clone ID: PAT_TA_12830
tttttttttttttttttttttggcaatttgcaaaataaaatgaactggaaaaactgaaacgaatgagttgattaggatgttactgcagggaagtgatccaacgctggggccttgtgcactgtatcgatgtagctgcggctgcgcgttgccatagtgagattcagcatggcgcggaccgcgcgtgagaggtggtgaggccacaccgcgcccgcttgagaggtggtgaggcccctgtagctccgtgctcgcgtcggacggagagctgagttgttcgctctacggcttgctgtcgctgtccggcgcggcggaggcgaggcagaacgcgatggcggagtggtatggcatcgtggaagctctctgtctccatcatccgcatctgcagctcagcaccctgaactccttcgtccccgcaccacctgcaggacgttcctcctccggctgcggctgcggcaccggctagccgtcgctgtagtcgggctggcccgaccaccccacaacggcgcccaccac

SEQ ID NO: 12831 - DNA, 823 bp, Triticum aestivum
  Clone ID: PAT_TA_12831
catatgaaaatgcgctttagttaaggaatattaaatactggcaatggtattgcttcctaaccatgaacacaaattgtatccaagagaatggtccaggaacttgcggaaagacgctgtcgattcggaccgccatttattatccgcataccataaacacttgcaaagatagtcaaactatggtgcttgcaacggtgtgttagcgagttgggccctgatgatacatcaaatgagatttaccgggcaactacacaggaagaaagaagaataaaacatgaaacaaaaacacagctagatcatctacaacggcaccgcgtctatgaagccattctgatcctatgacaagaggcacccggtgggatgtacacaatgtctaacaaagttggaaaaatctacagccctttcacaaaatatatcacagaaggatcgcaaagactactgcttcgagctcggtcgcttgggcattcctctctgaacatcacagcctttttgcaagtacaagcggaacatcaacctttttgcaaagcacaagcggttcgtccattcagccttccaggggcgtcactggggagggaaccagccaccattgtagaacccatttgatggccttggggccgagtgctggctgccttggttgacatgttgtctatggtttctagtatcgtcaacggagggagcggagtaatctggtggtgcgactttattcaagtcttgctgcagaggaaagtagtccgcgacagttggatccagaacagggatgtcacctgtgagggtcttgaacgcgaactcgatacatgggtctgaccaggaatttccaaatgatggc

SEQ ID NO: 12832 - DNA, 478 bp, Triticum aestivum
  Clone ID: PAT_TA_12832
tgaatgtgcatttcatatcgttcatatcatggataatggttacgtcagataagatatcctcctaaaaatagcaaagcttttctttttgttgcttgtaagaaaatcaatcaattcactaattgctggaaacatttctactattccgatgcagtgtcatgcttcgtcgatttcatcaacgaatcagtaacatgttgcttccatatgagtactagtgtatatgtatgtatgtaaatcaagaattgactttcctgcaatcgagcctgatctccccgctggagccggtgagcgggctgacgttcccgaggttgatcatggaagcggcgaagtcggccgagaaggcggcgggggttggcgctgtagaggcgcaccagggagtccacggccccgttgttgaagagctcctggtcggagcgcagcagcccggcgccggacatgaggttgcggtagtagccgttgtcgaactcgttggggggtgagc

SEQ ID NO: 12833 - DNA, 732 bp, Triticum aestivum
  unsure (1)..(732): unsure at all n locations
  Clone ID: PAT_TA_12833
ttttttttttttttttttttttttttttttttttttttttttttaaccaaaaacaagatcacatttgcttccaatttgtttggggtatcagttttggctcaacacacaaggttgctgtgatctacccctttttccagagaacgggcggggttatcttctgtcaaaacagcaataatctgttcaaaggaaaccaaaaatgaaaaggcgagtcccatttccattatcagatcatccctttggaggaccatatgtaccgaatttttttcacatgggatcaagagagtgagtacgcctatcctaagcctatcgccacggccgcaacatccgcggagcacttcaggaagcctttgagcagatgctcggcaaaccggtttccttttctaggaggagaccttgccgccatgggtcattgtataacttgtaatgcaatacctgtatgaaagttgcaaagacgtcatcaccatcttcctagttccgaaacctcgactgaccaggccgcctcctcttcggcgaacacctttttcggcccctctgcctctagcaacagggtgtcgcgataaaagaccccccgcctgagcgggcgttcccttcctaaccccattgcgttctgcgtcccggtggtncaataggttgggatgcaactcctttagcggnanaaacgttgaattaanaatccgtaggaaaatancaccntttagaaagaatgancttaaaaggnntcaagcccancac

SEQ ID NO: 12834 - DNA, 699 bp, Triticum aestivum
  Clone ID: PAT_TA_12834
ttttttttcggacgcaggagacaatattttgcgacgagttaattctgcatttgttctcttccttttatttccgcgactcttaaaagataaaagaatctccaggggagaaagcctaaacatcaacaaagaagtcgatcctgtagacatcgttgttcgccgtgctcgcctcgggaatgtaaaccatggggctgtaaccccgcgccatccgaaacgcgccggtcccgccgacgactgtgcgctcgacggaggcccgcaagtcctgtatcgtgcccagcatggccagcgtgctcccttggtacttcccgcccgtgaacacgacgtccaccgctgacagaaggcccggcgtgttcgccagcccagtcatggcaaacaagccctggaaccggcccagcggcgacgagctaccccggtgcagtccgtcccgcagctcgttgtccagcacgccgatctgcccgaacgttgcgctgccgcccagcggggactgcactgacgtcagcagtgtcgcgttcggccccgacatggtttcgtgcatgtacacgcggatgcgcttgaggtcgcccttgggatcggcactggcgcacgccacggccaccgacgaggtcagcaggaggagtacaagcgtgagtaagggagcagtcatggccggccggctaggagaagtcagcagctgcggcagtagtatatgctggtgatgcaacg

SEQ ID NO: 12835 - DNA, 1122 bp, Triticum aestivum
  unsure (1)..(1122): unsure at all n locations
  Clone ID: PAT_TA_12835
ctccggacctccagagcagcggagcacccgagcaacccaccgaccagcgtagcactccacctaccagccggcctcttcccaccgcccccaaattctaccgagcagctcagccggccaacccatggcccactgcctcgccgccgttgcctccttctcgccgtccgccgtccgccggcggctgtccagccagtgtggctaatgtaattttcgagccggaagctcagtttccttccgtagccaaaagatgagctttgtatccatcatgttcaagaccgagttcgcttcggtttaagatatgttgttcaggccaagggtgaggcacaggccaagaaagagacagtcgacaagggtttgtaatgatagtcgaaggaagcagcttgggcagtccctgatgggacccctgtcacagcggagtcggaaattttgctgaacttggttgctgactcactggatacggttgagattgtgatgggccttcgaggaagaagttcaacatcagccgtcgatgaaacaagcgcgcaggacattgcaacccgtgcaggatgcagcggaccttatcgagaagcttgtgacagagaagacagcgtaagtacctcggttcattggacagctttagaaggcaaaggtgtcgtctggaaccgtggacttctgatttttcggtcgcatttggggcgagagaaaataatttatggacagctttgcattcagtctatgttgtgtgttcattaccatttgttatttcttcatcctctcgagattttgtgttgttgcttagggttaattacccaaaggcttcataaacaagctaggaccatgtcctaagttcgaattcatatgtgttgtactattgttatagaaaagctaatggacctatgaagattgaagaatctggagggcaggtaccaccacaacctggacctcttcacgatgtccaaggacgtcgccgccacaaagatgccgtgcgcgtgacaccgcccattttctgttttcttgcatgtctaaggagtctgcagctgtggctgtacccatatgagcttatgttggtggttgtgactgttagaggatctcatgctnggctatatataggaatccggtttgtcgaaactcgaataataaaagtna

SEQ ID NO: 12836 - DNA, 549 bp, Triticum aestivum
  unsure (1)..(549): unsure at all n locations
  Clone ID: PAT_TA_12836
cgggttgacccacgcgtccgcggacgcgtgggcgccgatcgaaaactcagacgctcacacactcactcagcaagaacgcagcgccggcgacgtaccggcctaccggaaagcggagtctccacgacggaccccgtgcgcgcgcagggcggctcgggaggcggaggcgccgagatgggccggatcccgtgctgcgagaaggacaacgtgaagcgcgggcagtggacgcccgaggcgtacaacaacgcgtccgcctacgcgtccgagcacggcacgcgcaactggcgcctcatccccaagaacgccgggctgcagcggtgcgggaagagctgccggctgcggtggaccaactacctgcggcccgacctcaagcacggcgagttcaccgacgccgaggagcagaccatcatcaagctgcactccgtcgtcggcaacaggtggtcggtgatcgcggcccancttgccgggcggacggacaacgacgtcaagaaccactggaacaccaagctcaagaagaagctgtccgggatgggcatcgaccccgtcacgcac

SEQ ID NO: 12837 - DNA, 548 bp, Triticum aestivum
  unsure (1)..(548): unsure at all n locations
  Clone ID: PAT_TA_12837
gcggtgcattactaacatcattgttgtaagaatctctgtagaaaactaaaaataactccacaggtaaaagagtccagcagcagctcacattaaaaagcaggttcccatcagtaacaacgagatggtccatggtctgtacgcccacgcggtccagggatcaacttcgcctttttttttgggtggctttacaccattacactctctgtcaatatattctcttgtaggcttgtgacgaccgttgacctccaacctttggcaaatactacctacaaaataaccatagtagcatacaagatcaaagcatgatcttactgtcctccaagaaaaactaactaatactgccactcctcctaaaaacgagtaggctgctctaatgtttgagccaggcggaagatagaatcaacatgagaacattcacaaaactacaaagtgactgagagcagagcaacccggctataagttganaattattacaacctgactatggaaaattaaactccagatctgctccagcctccagcccggccgcccaaaccgaagatgcgttg

SEQ ID NO: 12838 - DNA, 264 bp, Triticum aestivum
  Clone ID: PAT_TA_12838
agtccggaatggtctcgcttttttattgaagataagactaacatattatccattgtacactattaaaaaaaattgagcgatgacctcatgggcacctgaaacttctgctttgggctcgtccctagatcttctgcttcgcgcttgatactccggccagcccgaagctcgaaacggacctcaaatgaattaaaacgtgctaccgcggcgggctggcccgctcccgcgacggccgcctcctctcgcccacaacccaacgggccgcct

SEQ ID NO: 12839 - DNA, 420 bp, Triticum aestivum
  Clone ID: PAT_TA_12839
agcaaaaccaaatgctggttccaacaaaaatcaaaatcaattgtaggaaaaacaccaccgtcccagcaaaaaaatctacactaggctccagcaaaaaatgatgccggtagaagcaaaaaccaccaatggttccagcatcccgctgcccggttcaagcaccgtcaccatcctgtgggcgccatcgtcgccgccgtgcactggttgtagcaccgcgacacgtcgatcccagcgctgctatgtgctggttgcagcacggacgtgtttggttgtagcacctcgccacgccggttccagctccacacgccgtggtagcggcatctcttagcaccgaccaccgttggtttgtagcaccaggttcatcgatgtagcagtgcgcggtactgtgtgccggttttgtggcagcccacggcagatggagct

SEQ ID NO: 12840 - DNA, 1167 bp, Triticum aestivum
  Clone ID: PAT_TA_12840
ttttttttttttttttttttaaatatggtggagtaaggtattatacggtagtgggtacaatgcaaaacgggaagcacgctgaggccggatcacacaattatccatgagccttacgtccggcgggccatcaactcctccatgagctgcccgacatcctcgtacgacgacccgcccttctccaccgctttacacgccatcacgccaagctcctcagccttcttccacaccgtgtcaccgtcaccatcctttttcatcgctttcttgatggattcggcgatcatctcgccggcgacaacctggtgggtctccacacatgatgcgtaatcctcagcaccgacgctgacgcccaccccaagcacctccacgacgagcttctcgttgtggaactggtcggcgtaccgcggccaagtcaccatgggcacgccggcgctaacagcctccagcgtggagttccacccgcagtgtgtcatgaaaccgcccacagcggggtggttcaggatcagcacctgcggcgcccagccccggatgatgtacccgcggtcgcggtgcgccatcgacaacccatctggcatacacagatccgttgatgcagcagcagcactgccattggtgatgacccacaggaagctcgtgcccgagaggccaaggccgtgggcgagctcccgcgtctgctctggcgagaagctggtcatcgtgccaaaggagacgtacaccaccgagctggccggcttcttgtcgagccaccgcaggcacccgatggcctccggcgagagcgcgccagcaatggcgcctcttgacgccacgtccttcccgctgccgcttgcgagcgcaaccgggccgacaagccaggctcggcggtggagtgtggcgcggtagtgctcggcgtaggccggctccagctcgtggaagctgttgaagagctcgccgtagctccgccgatccgcggcgtggatgagctggaacaatgcccactcatgtggccgcttcgcaggatccatcatctgcccccgcagctcaaccaccgggtgcggcagccctggcagggagacgacggcggctgggtcgtcggagcatgcctcgaacgggttgctgcagagcatggcttcagtgcaggaacgtgcgaacatgctggtgccgaggaacgtgatgcgcgggatgccatgcccc

SEQ ID NO: 12841 - DNA, 918 bp, Triticum aestivum
  Clone ID: PAT_TA_12841
tttttttatttttttgttttttttttttttttttggacaaaagcaaataccaagggtatgcatcactttttccaaccaacaaatacactatccctttgtataggcgaagatcataagccagcccaaaaaattattccccctacttgacaaattgctttgctttggacacgacactcacaactctccttttctgccttctgctgtgcgttgcaacataacaaataaccaaaggctagcttttacaaaatgcaaataacctcagcacttgtatgacggctcaatgccacaaaaattttgacccctacaagatcaaatatgtcaaggattgtggaatttgaccagaaaggctcttgttaagaaggttgttaccccaagtagacattcactctggaccgaggaatagatggtgaggtccagaaattcatgctttgggcgatgtgatcttggtgagcatccgcaatcacaacaatgaccatatgatcgttccttcctgcacctcttgtcgacgaggcccatcttgctgggcagctacgccacatgcatcaccctgccctgcaccagaccaagtggcacgtgcattttgaaataatcaattcggccagctcatagggacaaaaatccagcaagctcacatgattgtggtggccagaagaaaaccaccggagatctgaacactgaaccaagaagaggtgacgacaactgcaacggttgcgcaagccgaggttatggaagattagacaaccacaaagaataagctaaatgttctttttctgctgcatgatcttggggaacctggagagcaatcagcggcgcctccagcatgtggaggccggcctgattggcaaggctggacacaggagcagccttcagggggcaacacatgattgaacctgagtgctgtcatagtgctttcaggga

SEQ ID NO: 12842 - DNA, 180 bp, Triticum aestivum
  Clone ID: PAT_TA_12842
ttttttttttttttttttgactaaaacacaactattcacataaataacttatccaaacacatggtcgtttacgttgatctctttgatctcttacctaaaacactatggaaaacaggacagatgaagaaaaaaaatatgaggtggcatttgaaaagtgatcacctctcgaacctctcaact

SEQ ID NO: 12843 - DNA, 648 bp, Triticum aestivum
  Clone ID: PAT_TA_12843
gcttttttgaactaaagttgattggggttcctgctgcttgtcggtttgtttttgatggcaacgccaatcacaaaacattgggtcaaacatgcattgtcatggttacatttgttccaacatcgttttgtcagccagatgtaacaaatttcaatacaatgttagccaactcaagccgatgagatgaatatctatgatcagctccttcagtaatatgcacttcgtggttgcctatatatttatgaaattccagagcatcctccgatggcacaacatcatcgtcagaaccatgaactgtcaggaccctgcagttagggccaatagacatgcatgcactttgcatatctatcctaagacggtccatcagactttctttggttacacggtacatgaactgtcctgttttctgtgccacgtcaatgaaaccatgttgatttatcctttccatatagtcactgccaagacgatctgcaattccacgtttcagatcaaatctgcccgatatgttgataacacgagatacatcttgatacatggacgcatagatgatgaccacatctcctcccttactgtggccagcaatagcacgagtatcacgcttgtgttccttaaaatgctggattacagcatgcaagtcatccacctctttat

SEQ ID NO: 12844 - DNA, 653 bp, Triticum aestivum
  Clone ID: PAT_TA_12844
ttttaatcaggtgacccgcgcacgatcgcaacaaaatcaactccatgatgatgatgtaattacatactctgtctgtctcagaaccagcagtgcctctcctatcgccagcatccctcaacacacgcagctaatccaaagcgtccctcgcgtccgagaagaatctagaaattcatgaaacttcaaaaaaagaaagtagaaagcacacggtggtaaataagtaatgccctaaagacacacgcaagaagacaagattctcttctcttcagaatcttcttccgtaaattaccgaacggtcgccatgctgggtgacacgaaccgaggcgatcgagcctcagctctctcggatcgacccggccggcttgagcggccggtcgtcggcctcgtcgaccgagatgctccggccaggccgtgccatcgacgacgccgaccccggggcggcgagctcctcgatgcgcacgacgatctccggcatcgccggccgctggtcgggcaccggcacggtgcagtccatggccagccgcagcatctccaccatctcctcctccgcgcccggcggcctcagcagctccgtgtcgaacacctcggacgtccactcctcgcgcaccacggaccgcgcccaccgcgggaggtccacgccctcgtcgtgcagcgcg

SEQ ID NO: 12845 - DNA, 1170 bp, Triticum aestivum
  unsure (1)..(1170): unsure at all n locations
  Clone ID: PAT_TA_12845
cgtccgcgtgaaccccctgaacaaaatctgccagtcaaggaagttgtgtacaggtccagtctgccccatcttgaagataacatttcatcccatatgatgaattcgcgatttaattcattcacgggatatcctccccttactgaaagagaagagagtttccagccaaaggaaactacagcggttcattgtggcttctacagtgaaaatggagggttcagagtttctgatgtagataaagattacatgagatcttgcagagttgttgtggccacttgtgcgtttggtggaggggatgaccttcaccagcctatagggatgacagaagtatctgtcaaaaaggtatgctatgttgcattctgggatgaagtcactctctcagctcaacatgaggaaggtaagaagattggtgaagatctcaggattggcctttggaggatcattcttgtgagagaccttcctttcacagatcaacggctgaatggcaaaattcccaagctgataagccatcgcctttttcctatggcaagatactcgatttgggtggattcgaaatcccagttccggagagatccactaggagtcattgaggcccttctgtggcgctcaaactcttccttggcattatcggaacatggagctcggagcagcttgtatgacgagggtaacgcgattgttaggaaacacaaagcaaccccagaagaagttaaaatacagttggttcagtaccgacaagatggcattcccagatgacaaacgattcaacaggaagaaagccctggcagaagcttccgccattgtgagggatcacgccccctcgacgaactcttcatgtgcctccggttcaacgaggtggtgaggttaacgtcccgggattaactgacttcccccacctgctgcggcctcaagtccccggcgtcaactttcccggtgtgcgcccgcaagtgtctgggcaacacttcggcatcggcgcaagcgaacctcccccaacgaggaagatgacttctgatccaatccctgtaatttgctggggtaaaacacacgtagcaagccatcctacacgttttagaagggttactccctttgtagatggacgtggcccttgtaggataaacgtgggacctttaccnacganaanctcaaccngatttaagnaaccagnttgtgaatttn

SEQ ID NO: 12846 - DNA, 985 bp, Triticum aestivum
  Clone ID: PAT_TA_12846
ttttttttttttttttttttaatgagtattgctgctaaggacatttcaatcaacgagtcgcacatataatgttataaactgttcagatgagcattcatgtactagtcttaatttatactaatgaatatggtgatcgatttttgatgcaatgctttgtttattcaatacactcgtgcttaacaaaaagtccgaaaatccatatgactattatgtaggtagttcctatgttccagtttttattaatcttccagcactgcagggaacaagaggagcttctcctttcggtgtactgttaccccaaatgattcagtcatactgatgccagcttccattgattctgatggtagcttccagtcgaaagtggtacatgagatttgctagcatgatttcaatcgtcacaatagcaaagttgatacctgggcatatcctccgcccagtcccaaagggcaagtaagggaaatttgtttcccttgtagtccatagttgcagcgctaccaccttccataaaccgctcaggcatgaactcttctgcgctctcccaactactggggatcccttgcaagagcccagctgtttacgatggcgcgcgtcccggttggtatggtgtagccattgattttgcagtcggccatggagaggtgaggcacaaggagcggtgcgggcatatggagccgaagtgtctctttgatgactgcctttaggtaggccaaactgctcagatcgtcttcagcaatcatttctttccccttggatatagtgctcctgacctcggttttcagcttattcatgaggtggggtttttgcatgagccgaaccatggcatattccaacactatgaacgatgtatcggtgccagcttcaaacatgatctccaactgagccttaatatggtctctcgtaagattgtactcttgttgaatggaaagcaacacatcgatgaagtcgctgtcctcgccgccttgttctgacgcgggcctgcttgcat

SEQ ID NO: 12847 - DNA, 690 bp, Triticum aestivum
  Clone ID: PAT_TA_12847
ttttttttttttttttttttgaaaacgccttcaaacatctccaccatatttgggtaggagtacgtatttaaacagcttctgttacaggattggtcattcacgaacacccctgcctcaagtactcaccatcaagcacaggcgatacatagctgggagatcacgctggagatcacacatggtcaccatggaggtcacatgagttcatcaacatgtcaacctcgctttcatcacctggaggtgagttcaccttttgacaaagccatctatttctccgatgtggtgccatctttcttgtgaatcttcatagtccgtgatgcagtacgagcaaaagtcaaaacacctctggtttcctgccaggtactctgccagaaatcacaaacttgttgatgccagtgagtatccaatcatacacaagcgcacagaaatcaaaaccacttgtgcgctttggattaacaagcaaggtcaaaaactcaatgtgaatctgatcgctggaagatggaaaaaggaagcacgacattgcgatcaccatgaagcatatgaaagtgccttcctcgctgtgaaaatcagaagatatgagcatgtctccaaagaaagtaatgtttggcatttctctcaagctgaaccgagacaaaatgaagttcctcccactatccttgtcttgtgtcgctaaatcacactgtctctcgtgcc

SEQ ID NO: 12848 - DNA, 389 bp, Triticum aestivum
  Clone ID: PAT_TA_12848
ttttttttttttttttttttttcatacagaacacatggaactacatgctacagactacatacactatatgcagaattgctgcgtttttaatgcagaatttcctaatgatctctcttccaaaaaaatgttctgctacacttgcatctgttcgaacttgccccctgcagttgcatctgtgaactcaaatgctaatgagggacaaaaaggagccgcgtaagggcaaacatctgtgaattgaattgcctactcctaggggaacactggctgcatctacgttcagaaaacttgcctgaacaaactttgcatgagcggggtgaaggatttgcacacagggctccgcacgtgacgagcggggatggaggtgcgggagggaagcagcgttgtcgccg

SEQ ID NO: 12849 - DNA, 1018 bp, Triticum aestivum
  Clone ID: PAT_TA_12849
ttttttttttttttttttatacagaagaactgtttatattatttcactcctctggattgaaggaatatgtacacagcgacagaccaaaaagacatcatttggccatactatagtagtatgtatgtacgtatatgcgattgatttggagggcatcatcgaacagatcggcttgctctcatgcccacacccacagatcgatcgatccatcgatcgacacggtctcaattccaaccccaaactgagcgcaaggggcaaaaaaaagctataagcttggctatactgagacgtactccgatgaacaaacaaattataattaactatataatctatgtggaccagctcctgaggagcgacggcctcgcgaacatctgctccagcgccaccaccactgccatggcgagcggcacgcccacgccgggctgcaccgccaggcggaacacgtccgtgccgaccacctccttgggcctgatctccgccaccgcgcgccgctcgccgtcgtacaccacgcagctccgccgcgcgtacgacccctccacctcgtaagacggcccagcgccggtgcccgcgcacgccgtcacgtgcgccaacgtcttgccgcggccgctccgcctgacggtgtacacgggcctccgcgtctcctcgccggagaagacgagccactgctcgccctgcagggtcaaccgcttgcggcggacggtgaaggcggggcggccggccgcgtccatgaggacgacctcgtcgccgctctcggaggcgtagctgtcgacgcggtaggcaaggttgccctcggcgtcgaacaccgtgaaccccttgcagtcgaacagcagggacttgcgccacaccgtcagcgtcgtcggcccgtccaccgcggagctggccggcgcctcgtcgatggcgcccggcgcggccaccatgttggggtgaaccctcgccatgtagggtatggagcaattgagagcggacaggcggtagctgagtagtctgagctaattgagcttggtcgccccctcgtgccgaa

SEQ ID NO: 12850 - DNA, 521 bp, Triticum aestivum
  Clone ID: PAT_TA_12850
aagaacatacgccaaaaatgacaaaagaaacaggagatttgagcctgagaaaaaagcactagatggtctacaagccatagaatggtaacggtgtactcctcattaatatagcgacacgggcgaatcatctccgacctgcgcagtgccgtacttgttggaggaggaggagcccggcggcttggacaagtcaccggaccgcctccggagcatctggcgcatgccgtcggcgacccggacggcggggttggacttgaacttcttgcagaaggccatgtgcgcccgcacggcctcctcgacgcccgggtgagcctgcttcttcctgccggcctcgtccctgacggcctcgcagcacagcccgcacagccactggccgtagaagccggctctcacgctcgcaatgtagtccggggtgcagtcctccctcaggccacagcactcacacttgaccgactctatctccattgctgctggctatggctattgctattgctctgtgctgtgctgtgctggccttggttggc

SEQ ID NO: 12851 - DNA, 713 bp, Triticum aestivum
  Clone ID: PAT_TA_12851
gaaatgcttccagagttatcccaatgtatatgtagcatatggcaatcaagtctggaactttgcattgtgcatatattctgacattaactgttattttaggggctgggtttgccatggctttgaagcaacatttgattaaagctcaagcaaaccctaatggtaaaagagtagtaatatatatatccctaattatacatggcatattggcatcaccaaggagagttagctagccatatagtggtatatatggagaattggaactaattaaccatcacacaaaactaattaaccttgaaagcaaattaacacgctgtatagtagtagtagtagtaccattaccatggcatgcatgagatccatcgccatatgcaatcatattcgaccagatactatgagctatggccgccggccggctagctgattcattaagcagccgcttgcatgttcatggcggcgacgcgtctctcttgggccggtcgccggcggcagccccctgcctctccacgagggccctcagggcctccttgaggaagtcggcgccgccgtcctcggaggatggggagtagtcgtcgtcggcgtgtcctccggcgtcgcgcgcgaggaccagcacgttgcggacgcggccgccgagggtggccatctcgcgcggagcgtgcggaggcggagcgcgcgcaacgtgtcgatgaggcccgggaggaggtcggagcggtcgt

SEQ ID NO: 12852 - DNA, 1317 bp, Triticum aestivum
  Clone ID: PAT_TA_12852
ggagcaaacaatccgagtactcgaggaagccaaggaagccaggttctccaagcttcaagccttggggttaaagcttcgagacctgtggaagttccacaatactgctccagaaaatatcttggagtttgccgaaacttttgcttgcatagatgctgaatccgcaaatgaattgaccaaggagaagtcactttccatggaacttatcagtaaagcaactgaagagattaacaccttggaggcttctatggttgccaaacagaagaagatgtacttgggtaaaaaacagaaattgctgaaattgcttgaagaaacgcacatggtacctgctgacatgaaatttgatcccaagaaaaaagtagaatctgatttccccaaggcaatatcagatttgacgtccgtgattaaacaagttaaagtacaaattcttgaaagaaaagatattgtcatgcgaattgaactactccagcatgcagtgaataattcactctctgtgaaaacatctgaaaggctacttcgatctttgaagaatatggtcgtccttgaaggaacatttctatttgatggcaaggatgtcaaggttgttataaatgaaatcgaatatgaaatgaaaccagcttcaacaaagcctgcgcttccagtaaagaagaggatgagtgctcggctgactgagttgagggacaaggagcagtccagtcctgacctgcctccccctccctatccttcacgagttcgcgatgggaatagggaacgcaggaagggggtatggggcaaggaatccaagaggtgaaaaggcttcatggacgccccgcgcaaggcccttgtcaacaagtcaagttactcgaagtaccgtcccgactcctccctcccaggatcactcgtctgtccacgaagactgagcacttgtaaagttgtgtgcttcaacacgaactgtcttctcatttgaaggcaagacgcccgtgaccgacagcaaaatgataatgtggcgagtagtttttgttgtgcggacgtactttggtttgttgcttctgaggatagatagatgcatagatctcagcagaccattccatgcgtactgtcgctttacctgggaaaacagtggcctcggcaggaaccttgtagccatgaatcgtgtcaagttcccgactgttggctgttagtacaaatgtagatggatctaggatgcctgtgttttgctaatgagttgctggaacgtgcatattagaactgtgttgcgagtatccgtggccagatgatttgtttgtcgtgggagtagagtatcgcccggctgcatttcgccctgtcaccgtgttcaaagaa

SEQ ID NO: 12853 - DNA, 627 bp, Triticum aestivum
  Clone ID: PAT_TA_12853
ggaattataggaattaaaagatgggtgatcttgatctgaatcatttgcgattgcttgcaaaaataaaatgtcaaaagaagatgcagccgttactgcttcccttctttgttcaaagtgggaggaggagattaaagatccagaatggcacccttttaaagttatcatggatgaaggcaaagagaaggaaattctccgcgaggatgatgagaagctgcgagaactgaaagaagagtatggcgaagaagtgtatggcttggtaacaaaggctctgcttgaagttaacgagtataaccctagtggccgctattctgtacccgagctgtggaacttcaaagagaagaggaaagcaactctcaaagaagctgtccagtacgtcctgagacagtggcgcacacagaagaggaagcgctgagccaagatatctagattcctgaagtagtgaacaagaagtgcgtttctgttatttactcatgaatgtatattggggtttcgttggattatccagacttgtgtagcattgacatgaatgctggtacttggagattgtgaaccgcccttttaggataatctatttcgtgccaagctatgtgctatgaatgaaacggctactagtttgttgatttaaaa

SEQ ID NO: 12854 - DNA, 1096 bp, Triticum aestivum
  Clone ID: PAT_TA_12854
gtgaaagcaaaatatcttaagatggcaacatcggagcaacagagggcggatgaaaatgtgctgaagcttgtggcaaaacacaagagggagaaaaaggctgctctagatgagattatcaagttagagcagaaactggatgccaaacagaagcttgagctagaaataaaacagttgcagggaaaattggaagtgatgaagcatatgccaggtgaagaagactctgaatcaaagaggaaaatagatgaacttagtgccgagctccaggacaagtatgatgaaatggatgcagtggaagcgctccaccacactctgcttatgaaggaaaggataagcaacgatgagttgcaagatgctcggaagaagctaatagatggtttgcgggatcttacaactggccgaggaattataggaattaaaagaatgggtgatcttgatctgaaatcatttgcgattgcttgcaaaaataaaatgtcaaaagaagatgcaggcgttactgcttccattctttgttcaaagtgggaggaggagattaaagatccagaatggcacccttttaaagttatcgtggatgaaggcaaagagaaggaaattctccgcgaggatgatgagaagctgcgagaactgaaagaagagtatggcgaagaagtgtatggcttggtaacaaaggctctgcttgaagttaacgagtataaccctagtggccgctatcctgtacccgagctgtggaacttcaaagagaagaggaaagcaactctcaaagaagctgtccagtacgtcctgagacagtggcgcacacagaagaggaagcgctgagcccagatatctagattcctgtagtgaactagaagtgtgtttctgttattttcctcatgaatgttggtaaacgtttagttgtctaggtttccttggattattcagcttggtgtagcattgacatgaatgctagtacttggagattgtgaaccgcccttttaggataatctatttcgtgccaagctacgtgcttgtatgaatgaacggctactagtttgttgatttcaatgcagcctggtgactgcttggtgctcgacaaaaaaaaaaaaaaaaaaggccccta

SEQ ID NO: 12855 - DNA, 405 bp, Triticum aestivum
  Clone ID: PAT_TA_12855
tcacgaagagaaataagtgggggattttcaccggaggcagattcagcagccccacatctagggcgacccgccagtccccgcgcatgctggccgaccgccagatctggcgcgcaaccgagccactgcacactggccccgcaagcccccgttgcccccagccacccaccgggagaggggctccgccacgcacagggactccgccccggccccgtgagccgatgagcaggccgtcaccgccccagccgccgtagtagcaaacacagcgacgccacgctgccagccgggaagtggctcgccagccagcgcggacgacaagaggagagcagcgcttgggtggtgagatggatggagaagtggaggaggagcagctttgggtgggtgaggtagcaggaggaggaagatgga

SEQ ID NO: 12856 - DNA, 572 bp, Triticum aestivum
  Clone ID: PAT_TA_12856
agtagtacatgatagtaaaaggaaggtacgaaggacccgggcgggcagcgtgccgggtggccacgtcgcagcgggcgccgcaagcgcggatcacgagcgcgcagaaagccgcggccatggccgtccgtcgcggatgggtcgtcggagaaggatgtgacatgcacgtaccggtaggcgtggccgtagcgggcgaacaagtcttcactgcacctctgtccacccggtcgacgcgccacgggacagggagacgaggaacagtcccgcatcgccgtgatcccctcctgctcacccggactatccagttgttcagcttcatcttacggaactccatcgctcgggttacctgtccatctcttgaacccgtgtataccatcatcttttacgtgtttgctatctgcaaattgcccggaaatgcaacttggcgcagtccattcaacgggtagagaaagaaggcgagacgcggcccgaggcaggggactaacactgttggccgcagcgtccgcggcgacgccgccaagaggccaggcccggagccagcgacgccgtggctgctcgtgccgaatgctgcagcc

SEQ ID NO: 12857 - DNA, 426 bp, Triticum aestivum
  Clone ID: PAT_TA_12857
ggttttcctgggagtacaatggcttctggccctcttccttccgttggctgtcttggtcttggtgttctcgaaaggaaggatttccgctccctcgttccacccgccgggacatatggtttgtttgttttcttgttggtacgcggccaatggggaagaaggcggccaagtgcgtcttccgcagggcgggttcggggcggcgaaaggccgctggcaggggcgcgtcccgctgggtcttcgttcgggcgttgctgccctcctctcctgggcttccctctcgctggcccgcccccggcccccccgccggccttccctgccgctgcgctgctcctcccgcccgcttggcccacggtttcctcgctcgcgtcggcttcttggcctaggtcccgtaatgccttactgaatactccagcagctgttggctggggc

SEQ ID NO: 12858 - DNA, 538 bp, Triticum aestivum
  Clone ID: PAT_TA_12858
tttttttttttttttttttttaataagagtccgtaggattacaattcatagaagccatgcacgcagatcatcggccccaattgaagcaagctaacacaaaacttatgtactcagtggataaccatctagtagctgtagccatccatccacacgcttccaagaagacaagccgatgaagcaacacctatgcagcagctaactaccttaagccataccggcagctcgggggcgacgcacgcatgctataccgggctctccaggtccggctcccgtccggcggtctccgccctcttggagccgtccttcgctgccggaaccgggagagcagggcgcgcgcggcagacggggcaggtggcctgcgcgcacagccagacgtcgacgcacccgacatggaacgcgtgcctgcacccgggcaaggcgcgcaccgcgtcgccgtcctgcatggcgctcaggcacaccgcgcactcctcccttacctcgctgccgtcgccacgcgcctccgccttgaatcggaccgccggcatggctgctcgtgccg

SEQ ID NO: 12859 - DNA, 600 bp, Triticum aestivum
  unsure (1)..(600): unsure at all n locations
  Clone ID: PAT_TA_12859
ctagttcgagttttttttttttttttttaaacgaatgtcctttgactttaaaaaattgaggcgaaaatatgttcagttcatgtaactgacatttcgattatgtacatatagtattcgctggtcttatcttcgtcatgtcacagtccttccacgatgaacttccacctctaaaatacctccgaacaattacttgcccctgtgggctctctcaggcagcgcgatattgccatcacagcgccttcaattgacgcatcctctcccttttctttccaatagaacatgtttccatacttccctgcaacacgactccagaagctctgaggaatgtctagatcaatcaatgaaccaatgttgaaatttataatgttaccgaaggtgggatctgcaacaaagacaatagttctgtcatcaacttgccaaaaatccttgatagccagtcctggtgtaccgggataantttgtgcgagaaccctcaacttataccagtgtccttctcnaggtctcaatctcttggngcaaacaattcctggcctgaagaaanaaaacggngactcaatgacgggngngaacncctgggancaaccagtttgttnacccacc

SEQ ID NO: 12860 - DNA, 514 bp, Triticum aestivum
  Clone ID: PAT_TA_12860
ttttttttttttttttttttttttctcttcagatccgaagcttccaattcaattatctaaaacgcaattgatcgctataggtatcacacaggaattaagttcaaattatacccttcgcatcacgcagatcttcttaagcatcggggtgatgagtggccgttttggtcccgatgaacgccctgatctcctccacgagcctgcctgagtcggggagctcggggaagcagtagaaggcgtggatggcgtccgggaactcgagcaccttgaccgccttccccttccgccgcagcatggcgccgtaccgctgctgccagtcctgcagcgggtccagcccgccgacggccaccatcgccggcggggaacgcctccgccagctcgggctccgggcccgcctcgcccgtcacgtgcgccgccgggtggttccggtccgccccctccggcaggaacgccctccacgcccagtcggagcgccgcatgttcaccaccggcgccacgccctccagcctcagctccg

SEQ ID NO: 12861 - DNA, 513 bp, Triticum aestivum
  unsure (1)..(513): unsure at all n locations
  Clone ID: PAT_TA_12861
cgtccgctttttttttttttattttttttttttttttttttttttttttggggcacacgagagaatgataaaactttattctaagatcgtctaagcaagccatctcataacaccagatcaccacgaaccgtctgaacaaaatatttcaagcctcactcattattaccaaccaaccgaccgacttaccatctacaagtttcttggcctgtgtccaagtaaatgaggctagggcgatgcacagcgcaagcaaagcatgccccgacctacttaccctctactatacccaaatcacttgtcctcagtgctaacattagcggcaatggcatcgccctcagctatcaatctctccttggcttcctgaatccagaagatgccggcttatctgatttcctgcgcaccgggtagcctttttggcaacaaaacagacattccaatccccaccaaagcacgtttgttccaatgcaaaccgaaagtggcgattnacagcaccttttaaactggggggtttggggg

SEQ ID NO: 12862 - DNA, 842 bp, Triticum aestivum
  Clone ID: PAT_TA_12862
tttttttttttttttttttttttttttttttttgaattaacaaaggagcactttatcctcctttcttttactgccaactcctaaccaattacagtcgacaattttacagttgtctggaataaataccaagacctcaacgctgatgaacttactgatttctcacagaggtcgtaaaaattccagatttatgtcactactaattattgtgcttggataaatggacacagaattgtaactcctgcgtagcctctcctctctgtcctctatcagatgaaatgctacatgccttaccatctgcagtcctgaactgacgtcacgagttgacgtgcttgtccagaaatgcatttgccagattgctgaagctgctgttgacggctccagctgcagaatagtctcttatgatcctaagtacatccggtttcaatatctcgttctttgtcgacgggttgcataagtagtacaaggctccaagtgcgtaattcactgtattcttaactgggctagataagcattgtacaaccaacgggattccaccacattgagtaataacagaagcatttgctggatcaacacgatgaattccatattccaccaccgccgcactctaccaggcttgcttgtcgctccgtattgctgtcctgcatcctccccagtattttcagctggcccttgaaggcgtggctttagggggctcacccgcacttggactactttgccccccttctcccctcgcaccctgcctccctggtggccccgtactgcggcccaagatcctctcgggactggtctcccggggggccgccgccgcccgcgcgctcgacctgtcgctgcgcgttcgtgaa

SEQ ID NO: 12863 - DNA, 513 bp, Triticum aestivum
  unsure (1)..(513): unsure at all n locations
  Clone ID: PAT_TA_12863
ttttttttttttttttttctccnaagtgatgctgatcttattcttagcaggaattctcttgctaaaccggcggttgctggatacaaaaaacaggcttcagcaacaaatccagcacgtattgtacattgccgaatcggagggcaggggcacggagcacagaggaagaaaaagttgggagaaaataagttcacccactctctaacggctaacccaagaaacagacgactctccggtcaccatatcctggcgtggacggcaacatcctgtccggcgtcgccgccgtcggcctcgtccccggcgatctggtcgagcacgaggacgatccccatggcgaaggccgcgtcgaagccggcgcccacccgcagcacgaacacgtccctgcccatcaccacccgcgccgcctcgtccaccttcctccggatctccgccaccaccgtctcctccccgtcctcgcccttggccaccacgcggcagcagcgccgtccgaaggagccctcgacgcggagctcggcg

SEQ ID NO: 12864 - DNA, 586 bp, Triticum aestivum
  Clone ID: PAT_TA_12864
ctgctcagcctgccgtccttcctcaagccttcctccgcgagcaagacaccggcggcgccggcgaggagcaccagctcgtccagcctcttcccgtcgtcctcctccaccgcctccttctccaccagctacgcctcctccaactgctccaacgtccgctcctcctaccatggcttcggcgccgcccccaagctacatcagcagcaagagcaccttccctccgccaaggaggcgccggcctcgccggtcaggaggcagccggcgagcatgaagaagaagcagaagaagaggtattacgcggagaacaaagcagctatggcggaagcggggccggaggaggacgtggggctggcagtggagaaggactcgtcggacccgcgcgccgacttccgggagagcatggtgcagatggtggtggagacggggctgtgcagctgggacgacctccgcagcatgctccgccgcctgctcgccctcaactcgccgcgccaccacgccgccatcctcaccgccttcgccgagctctgcgcccagctagcctcgccgcccccgccggcgacatcgtcgtaccactaccagctctagctag

SEQ ID NO: 12865 - DNA, 938 bp, Triticum aestivum
  Clone ID: PAT_TA_12865
ttttttttttttttttttttttttttttttttaggggatcagccaaactgcatattcggtaatgcagaggaaaataattatttaaattaaaattcagataattcatacagatcccgttcgtcgctacaattctaatcagcgagttgctactaggttccccatgagcccgccaccaagttcatagtgcttggcggaggaaaaaccgcttctttggctaacttctccaactcctctcctgtaagatactgtgcaatcggccgccgcccgggctggtactcttcagtaagtccatagctactagccagaggaaccacgacattattgatcgcccaactctgtaacgatgccgtgaaaaatgacgaactcttgttgaaatctagaacagatgctcgtgatcctggttttaggactctaaggatctctcgcattgctttgggtttgtccaccacattgcgcaatccataaccaaccgtaacagcatcaaagtaacggtccgtgaaaggtaaatcaagtgcatcgccctcgatccatttgatgttcttgtagcaagccttccagcgttggtcctgacggctagcagcagtttgcagttgctgccctgagaaatccacacccatcacctctccgtctaggccgaccttctgagacagaaggaacgccaaatccccgctcccgcagcagagatcaagaacccgatcccctctcttcgccattgaccaagagacgcagatgcgcttccacgtccagtgctgccccaggctgagcacgtcgttgagatggtcgtagacgggggcgatgcggctgaagagggcctgccgctcgtcggccgcggacgagcagcgcacggcgacggagccgcgggggcggtgtcgtcttccgccggcgtgcctggacggcgccgtcgccccggcggtcacgggaatcgccgcgcccatcgc

SEQ ID NO: 12866 - DNA, 492 bp, Triticum aestivum
  Clone ID: PAT_TA_12866
ttttttttttttttttttttttttttttttttttaaaccaagacaacgaatcacactgctatcatcaaacgaatgtgacatgcaagatcgacagagacacgcaccaaagaccaaaccaagcacacgatacagattgttacaccgggcagagatcaaagtatcatggagaagaacgaaaggagattgcacgagctacttgaacgaccgccggccgacgccggccggcatggacacggtggagtcgacgctgagcccgctgacggaccgccggtgcttgtgccggccccctccgcccgctcgtggacgccgccggcgtgcccactcgcgacggcgcggcggactggtccccgccgccggcgccccgccagaacgggctcttggcccagctcccgatgctctgcccgagcccgaacgagaacctgggcttctgctccgccgcgcgccgctccttgtccagctgctgctgcagcaggtgcgcgcgcgcccgggctt

SEQ ID NO: 12867 - DNA, 530 bp, Triticum aestivum
  unsure (1)..(530): unsure at all n locations
  Clone ID: PAT_TA_12867
ttttttttttttttttttttttttttttttttttccgttgaagacctcaactaagaaggaaaattatagagattggctaatcattacctaattgatcttgtatccttgtgatctaacaatggatttgttttctcatgtacgtgcactcacagattcacacaaagaagcaatcaatcgtgtactacaagtaggaaccgaaaagctgcaacagaagagaagaagaagaacagagatgcctgtcgacgatcgacggtgccctcgagagtcgagagagactgaacccggaccccatggagaacacgaatcgcccaagaagcctaacccgtcgtcgccggactgtactgaagccaatcatcccggctcacccgcagccatcggcgcaattaacaaggtgcttgcccagcgtcggctccctccagcccagcgcggnacgaaggaagccaacggccggcgcgacggctacccacgcgcatggaccacgagcagcgaattaggcgctccggcgcggcgcccgccagccgagggcgacg

SEQ ID NO: 12868 - DNA, 739 bp, Triticum aestivum
  Clone ID: PAT_TA_12868
ttttttttttttttttttaaagttgacggcgacgaagtgagaataaatttagctaagattcaggcgacagctacatatgcaggcagatcagatcagacagagtgtcaaagattgaatgaaactagtgctgcttcgacatgctagtagaggtcggactccttgtgcgtctggatgacgaggtcggaggtggggtaagcgacgcaggtgagcgcgtagccggcgccgacctgcgcgtcgtccaggaaggactggtccgactggtccacgccgccctccaggaccttgccggcgcaggtggagcacgcgccggcgcggcacgagtagggcagctccacgccggcctcctccgccgcgtccaggatgtagctgtcctccgccacctcgatcacgctctccttcccctccggcccgatcagcttcaccttgtacaccgccgccgcgcggaagtcgctccgtgctcttgagcctgtcagcgtgggcgccattctcgccgagctcaggtgcaagtgccgtggctgttgtctggtgctgtggttcaggcgtgggttcgctctcaagttgcagagaattggtgccgtgaatgtagttgccatctcgggtgcttggggtctgctggtactggtaggaaggaaggaagtgtgccgccgcgctgcaatccggagcaaggctgagccgaccgaaggcgaatggggagaagaggaggagcgtggaaatggaacggtcacggggcgctgggata

SEQ ID NO: 12869 - DNA, 837 bp, Triticum aestivum
  Clone ID: PAT_TA_12869
agggtttgccccagccttcgaaaggtaggttcttctgccacgcccccttccacaaatcccgatcgatcgaaaggtaggttcttctccacgccccctccacaaatccccactttgcgccggcgaatcttcttggcgatggctggtaagcagggccgcaagaaggcgaggagcccccccggatgccctcagctgcgtccgatcggcagcaccgtctccggatcgaagaagcctgcggcggcgacggttccttcgtgcaagtaccacctgtcggaggcgtctgtccaggcggtcctaaaccacaagagggtgcctttcgtcattgggggctacttcgacgacctgacccccgaggagcagcaactcatgctcgaggtggccgcccagcacgaggaggtcgaggacaggtacgccaagtaccaggaaagagtccgcaaggagctggatgagaagggattcgtcgcgctccccgatgacgttgacaagaggagggccgcgctgaacgcgcgctgaacgccgcaagcatcgaggctttcagaggagtcgccgaggtcaagtaggttttcaggaacttacaatggaagaagaggatgcatcatagcgccgtctgcctctcttgttttatctatctatatatatctttctgtgtgatatcaatgcactggtctagatttcctaaatctgttcgctggcactcttgtcatttatcaagctggaactagtcattgtgatctaagttgatctatgtttcaccttgcaataaacttgtctgtaaattattaatgggcgatgaaaaaaaaaaaaaaaaaaaaaagagcggcccgaccggccgctccccgg

SEQ ID NO: 12870 - DNA, 449 bp, Triticum aestivum
  Clone ID: PAT_TA_12870
tttttttttttttggataaaggaatactctttacgtactctggccttcgttctcgtttcttttaatcttcgcgatgtccaaacataagcactacaattctcacataagttatgttcagatccaaataatactcgttgaaccattaaaggtgaactgataccaaacactacttataaacaagtaaaccatgaatctagtggggggcattcacccgatctgccaaagccttcataacttttgcttctacacatccattcccggagcccattcggcctgcttcgtgcatacatgtatgtgtgtgtgtgtgtgtgcgcgagatgcatgcagggatgcatgttgaatgttgggggttttgcaatttactcctgagagaaacccagccaagaaacaaatgccatgacaggtcaagcacggcggccaagcgggcttcaacggagaaatggattcag

SEQ ID NO: 12871 - DNA, 891 bp, Triticum aestivum
  Clone ID: PAT_TA_12871
ttgggccgcgtgtgccgcctcggccacttctgccgccgcagcacggccactcctccccctccctctccccgcccccctcctcgcagcaacagcggcagagccgtgcgcgccggagccagagccacctcgtcgtcggcgccgcaggcgatggaagccaagcgggaggaggagccgagggtggtgacgctccggccggtggaggccacgccggagtccttcgcgcccttcgggcaggtcatcgccgcctcccccgacggcgaccagttcggcccccacgacgcccagctcgacctcagccgcggcatccctaggttctacatcatgagattggagagtaggccgctcaagttctcgtccatcacccaccacgccagcgtcacgcagtgcctgggctccatcggcggccaggactggtacctcggcgtggccaagccttccatccttgacggggcgacggagcagagtggtggcgggactgccgtgcagtcgcgcgctgggcatttctatctgcctcccgatccgtccgaggtctgcgtcttccgggtctctggtcccaagtttctcaagctgcacgccgggacctggcacgccgggccgctgttcaaggcagacgccgtggatttctataacctggagctgagcaacaccaatgttgttgatcacaccacgcactacttcaagaagcaggacggcgtaacctttgtgatcgaggactgagacgctgcatgtcactgaccacgacctatgcacaaaagctcagcgcaccgtgtgcctcacggacgctgttcgggccctgtccctctgtatgatgcacgtccagtatgtatatgcaataatgtactgcaagtcacgtgtacttcgtacgctgctccttttggtccttgagcgttt

SEQ ID NO: 12872 - DNA, 807 bp, Triticum aestivum
  unsure (1)..(807): unsure at all n locations
  Clone ID: PAT_TA_12872
gtttggatggaggcgctgggcctcctgggccgcgcgtgccgcctcggccggtggaggccacgccggagtccttcgcgcccttcgggcaggtcatcgccgcctcccccgacggcgaccagttcggcccccacgacgcccagctcgacctcagccgcggcatccccaggttctacatcatgagattggagagcaggccgctcaagttctcgtccatcacccaccacgccagcgtcacgcagtgcctgggctccatcggcggccaggactggtacctcggcgtggccaagccttccatcgttgacggggcgacggagcagagtggtggcgggagtgccgtgcagtcgcgcgctgggcatttctatctgcccccggacccgtccgaggtctgcgtcttccgtgtctccggtccgaaatttctcaagctgcacgccgggacctggcacgccgggccgctgttcaaggcagacgccgtggatttctataatctagagctgagcaacaccaatatcgtggatcacaccacgcactacttcaagaagcacgacggtgtagcctttgtgatcgaggactgagaggctgcgtcctaggcacaaaagctcggcgcagcgtgtgcctcgcggacgctgttcgtgccatgtctgtctctccgtgtgattgaacatccagtatgtatgtgtatgcaataatgtactatgcgtactgcatgtcatttgtacgtgcctacgtacgcatctttggccgcctccctgggcgttaaaaaaaaaaaaaaaannaaaaaannnngggggggccgttataaaggancag

SEQ ID NO: 12873 - DNA, 924 bp, Triticum aestivum
  Clone ID: PAT_TA_12873
tccgccgccgcacggccactgctccttccccttcccctccccctcctctcaccaaccgcaagcgcggcagagccgtgcgcgccggagccagagccgcctcgtcgtcggcgcggccggcggaagccaaacgggaggaggcgagggtggtgacgctgcggccggtggaggccacgccggagtccttcgcgcccttcgggcaggtcatcgccgcctcccccgacggcgaccagttcggcccccacgacgcccagctcgacctcaaccgcggcatccctaggttctacatcatgagattggagagcaggccgctcaggttctcgaccatcacccaccacgccagcgccacgcagtgcctgggctccatcggccgccaggagtggtacctcggcgtggccaagccgtccatcgtggacgagcacggtggccagcatggtggcagggctcccgggcagtcgcgcgccgggcagttctatctgcctccggatccgtccgacgtccgcgtcttccgggtccccggtgcccagttcctcaagctccacgccgggacctcggaccccgggccgctcttcaaggcagccgccctggatttctgtaacctggagctcagcgacaccaatgacgtggatcgcaccacgtactacttcaagaagcaggacggcgtgacctttgtgatgcgaggagtcgagtggaggcgccgcacgtccgccgacctggggcgcataaagcccagcgcagcgtgtgcctcggccggtacgctgttcctcgccacgtctgtccctctggcagtcgatgaacttcctattgtgtatgtatgtacgtatgtatgtatgtatggactcaacgaacaatgtgactgctgtccttctgccggcgatttgtttagcctactttattaaaaaaaaaaaaaaaaaaatctgggggggg

SEQ ID NO: 12874 - DNA, 521 bp, Triticum aestivum
  Clone ID: PAT_TA_12874
cgtccggcttcctccccgtcgccggagctccaagaaacgaaggccccgctctccaccgcgcagcgcccacgctgctatgatctccggcggtccggcgccggcggcgaccaatggaccggttctacgacgagcagtacgtgcggctgcggaaccgcaagctcgacaagtactacctccacgccgacgacgacggggtgggcgtctccatcagccagcgccgcaactcgctgaacgtggcgtggaaggtgcacatctaccaaggcgcctgcggcccgtacctgctcctccacagcgccgcctacggccgctacctcgccgtcacggccacgccggcgccggccttgtaccacggcttccgcgccgagctgcgcgactacgaccatccggaggtgccggatatcatgtggctggacgtcagggcggggctggggcctggcgtgctgctcctaaacgccggcgacggcgaccgctacctccgcgccaacggcaagtacctccgctggaacaccggcgtcaccgtc

SEQ ID NO: 12875 - DNA, 1000 bp, Triticum aestivum
  Clone ID: PAT_TA_12875
ttttttttttttttttttttttttttttttaaaaagcacaacacttttctgcattcttgagggcatgcttatgcttgttctcttttcttttctctcctagggttgacatgcacaacatgccattgcatattttgtgcttttttcatgacacattcttgcaagattgtctctctctctctctctcctcttcatggttggggacaatcatacatgctcttctgatcgccggtgccagacatactcgtatgtcatgtcgcttttgtgcatatgcttttggtttgcaatggggccatcaaaagggggcatggagccagccatcctatctaggagggccaaagccgcccacaagaacaccagaggaatgcaagggttgacatgacttgtgtgagatgtgtctgtacttattactcgattagctaccacacatcaatgagagctagcctgtctagtgacttaatctgcattagtgcattgtgattaactgtaagctgcctggtgtcatccttgacaagtagtagatcatcatgggtaggtggtagtgtgcctgttggaactgtagtaggtgcaaacgcagtgaaagaacatggcaaccatgaatgtgtatgtgtgtgtgtgtttgagagagtggaactttactgtggtgtgtgtgatgcatgttgcaagaaaagaacaagaatagaaaccatatagcagaacaattaatgggtcatgatggatactgggagagggtgtgaggtcaatgggccagaagctgaaggccagctctctgtctgccttgcaccaatgtgctgaggctgtgtgtgtgctgtgtgtgtgcacccctgcttgccttgtctcccctgccattgccatcataagggctcatgtcacttttcccatgcctagccctgcccccatgccccccctcttgctctctctcctcactcccttccaaacattcctagagagagggagagagatctagagggagatgcatggcatggtggcatggtgtggtgtg

SEQ ID NO: 12876 - DNA, 251 bp, Triticum aestivum
  Clone ID: PAT_TA_12876
gctctctccgctcatccccaaacccaattcctcctccacttcccaaatcccggcgagaaccaccgcctgcggacggcgacggcgcgccgagcagctgccggcctcctccccttccccagatcggccggtcctcccacggcgctgctccacgagctcccctccgccaccgagcggcgtagagcccgcttccgcctcgtgaggcttcgatggccacgagggctttgagggagggggtggtgagggaggagggt

SEQ ID NO: 12877 - DNA, 1166 bp, Triticum aestivum
  Clone ID: PAT_TA_12877
gggtacgggcccccctttttgacgggaatagcaggagctctgcctttgcattatagaagagaagaatacagaaacggatggaccaacggagaggaggtcgcatcccacattacaacgtgaggtttaggagacagaaaaattacggccctacaaagggaatccctctagttgcctccccaaagcacttgatgtcatccttgatgagcccagctagagcagtagcagtcagctctttattctcgaatactcgttgatttctctccttccagaggttccacacagtgtaggctgccacggtcatattcaacctgttttgctccttcgatccgccggcggagcagagcctctcccaccactcacccacagtctgcgcctcgtcggccacagcgaacattgcattttcagagctccgctcgtgcttcatcacgaaattgtcaaaatttgatgttgacaaaatctccaagccaaagccgtacatcgacgaaattctatgttgccaaatgcttgaggtcagtgttgacaagtggcagccggcaggttgggacacgtggacatgctgatcacacagatcggggatgcgctgctcacacacctcctccacgggtcagccactcacatagacacttcaattccttagtctgattgtcccccttgggttgtccggtcccctgccagccccccttgctgtatgagatgttccctcgccggctctgtgttccccttgctcccggctgtgggagcctgggcgtctgagcgcgccggtcgcgatgccctgtaagagtatggtgaggcaggggaggggccttgtgcaggtcttgctgacgacgtccgcccgatcccgtcagcagcgaggtgtgccatggtggcggtgccgacgttcctgattctagcggtcggcgccccggcagtcgacatcgacaccgcccacccgcgcctccgtctgcattagcaggcgggcaggtcaggatctcagggtggatatgaaaatttggctaggcgtttgctcgcagaggagatcggcgacacggcggcgccgatgtcggagttgaagaagaagatgtggtcacggcgtgattcggagggacacagcgcgcgttctcaggcgtggcaacgtcgagcttctcaaagatccgagagaggcgacggagagggaagaaggggaccgt

SEQ ID NO: 12878 - DNA, 1056 bp, Triticum aestivum
  unsure (1)..(1056): unsure at all n locations
  Clone ID: PAT_TA_12878
ccgccggagagagagggaggaaaacacaatggccgcctcttctgctctcctgattcttgtcggctcctcgtcggcgtcgcgccgccagattctggccgagatggggtaccagttcaaattacttagcgcggacattgacgagaaggagatcagaaaggagaagccagaggagctggtggtcgccttggctcacgcgaaagcagatgcaatattggataagatgcggaacaatgggatgatgaaagagattgttgactctcaagagaccaccttgttgatcactgctgaccaagttgtggttcatgatggagttattcgagaaaaacctaccactccaggaggaggcacgtaaattcatccaaggatattcccaaagccatgctgcgacaattggatctgtgcttgttacaaatgtgaagaccggtactagaagggaaggatgggataaatctgaagtttatttccacaagatacccaatgaagttgttgagagcttgattgaggagggcaacgtcttctatgttgctggaggccttctagtagagcatccactgacttcacctctcgtggaagccattgtcggtacaatagatagcgtaatggggcttcctaaagctctcacggaacagctcatcaaggattccctccaggagccatagctgcaaatttccgaactaagctggccggcgttgtggatatctctttgttagaaaatcactattcttgtgctgaacaaaactaaacactcatcatttctggcaaatggagtggactctaatcagcgtcatcagcctcgctataccaactttattaggctgaattttagcagccactgaattcctcttggtggctaagtgaactgggtagtagccagtaactttttggagacctttgtgactaacaccgcatcaatgggcttcattcttccatgtgatgttatgggtctgacggaccaaacatatgtacgtcatctgttctaccgcatgctatcaggagnatcagcggngttgcgaattgttttgggctatgactttatattctgaaaaaaaaaaaaaa

SEQ ID NO: 12879 - DNA, 759 bp, Triticum aestivum
  Clone ID: PAT_TA_12879
ttttttttttttttttttttttgaaacgcgtttgaatatgaattcaattatatgcttttcgtgaaatagaacacatacttctttttttatctaatagagggcataagaacacacacatgccctataaatcggggagagggagtattttagggctttcatacatgatattaacagctacatgaaacatataaccatacttttacccgaaactcaggcctaatcaaccaaaccattattcggttttcatgagcatgcatgtctccacacatactcaaaaaaacacttctacgggtagacctcgatgattgacctgaaccctagaactggtataatcttgtagccactaaacccagcttcgaggaagatctttttccactcttgctcatctcgctcaatgccatcgacaatcatcatgtagaggtcgaacatggactgcagctcccggtgctttacgtgtgacggcccggctccaatcactatgtcgatgattattacctttcctcctttccctctcggaggaatagatttcttgcagttcttcagtatcttgacacagtcctcgtgtccccagtcatgtagtacccacttgagaaagacagcgtctgccggcggaacgctctcgaacatgtcgccgacgacgtacttcacgtcggtgccagccggagccttgtcgacgacgtggtcgaggtccatcacggtgcattccagacttgggaacgccctggagatggcctgggccgccgcgccgaggccgcccct

SEQ ID NO: 12880 - DNA, 656 bp, Triticum aestivum
  Clone ID: PAT_TA_12880
gcccgtcgtccgcccacgcgtccgcgcacgcgtccgctgcactataccggctgcaatggccgcgtttaaccaccacctgctcttcttcctcgttgtcgcccttgccgccagcagcatcatcagcgcaggggccgctgccggcgacgaggacgacgtgcagctgcggaaggtggccatgtcgcaggccgtcaaagtgctgtcccgctacagcccggagaccaccgaccaggaaacgctgaagcgggcgctggcggtggtgaaccgggaggcacagcggtactggaagcccatcttcaacaacgtcgacaggctgatggacagcggcgccgacggccgcagcaaggaggcggcgttcgccgtggccaaggagctgctcaaccgcgagctcggccaaggccccaacgccgtcaagatcgacttcgaatatgcgtgacatgcatgcatcgccagtttgccacctctgccttttttttttcgtagggcttttagcgtgccctgtctttgtctgttgtgtgttgttgtgagtccttgtgctagctgcggcctgtcgcagttgtctgagccttccacttcccgtgtcgacttttagagaaaaggcacaaaggcccgacttcaaattaatgaagccatcaaaaaaaaaagatacaatgatgttg

SEQ ID NO: 12881 - DNA, 705 bp, Triticum aestivum
  unsure (1)..(705): unsure at all n locations
  Clone ID: PAT_TA_12881
ggctccatttttggagaaatttgagctgtattgagtccgatgttgtcaatcgagccgcatagccaggagggaggtgggggcaatatgagcccagataatcctgcggcgaaaacaagaggcggtctttgacgaatctctggtagacaccatgtttttggattcgacaaagaaggaagatgaataatcaaccatacctttctgaagaaaaaaatctcccttcctattcctatccctgttctcacggacaaacactgctgtcaagccagctggcgctccaaagaaaacgaagcagtagttctttcatggactaggctagatatgtacatacgggtatcttctatgttctgcttgcttatcaagcgaagttcaccattagaagggtgtcttgctgaagagagcttctcagctctgctgcgtcacagcaatggtctggccatcggggtctgaagatcgtcaactcagcacacttttgggcgtgcaccaggtttattttgtgcaactttgtaagacaaggctttgacactcgcataactatgtcgagccactgtcatgacaattcctctatttaggtcctcgaacaaatcaagtactatgcgttgtaaatatcgccgtcagccctttctgtcttatctcccttcttatgacaatttctacctcctgtaaatgccactgggccatgctgcttaatctaagtntttttgttct

SEQ ID NO: 12882 - DNA, 1922 bp, Triticum aestivum
  Clone ID: PAT_TA_12882
gcgcgaggtggcggcggtgcagcagatctcccgcctcgttcttcaggcctactgcacctccccgttatccgagtgcgacgcccccgcactcgttgatttcttcgcacgcatggccggaggacggtggtgtcacccctagttctggccgtggggctagacaggcctgaccctgtacaaaccatggcgatagttctcgaacttcatgcaggggatgagaccaagcttgttctttggggtgctcgagcgagtgactttgaggcagaagaggtccgtattgcaagccaatcagggagctgtcattactatctttgtggggacactgccaaaaacctaccgaggaattaaaggactaagtggtagctctgcatgccgctggtacattaatgaggacttgccagatatgaatgcctttcgtgctagccttccagtcagtcttgctgctgtcactgctcacataccaggagaacaggtaattgttccagcacctgttcgtgtgcctcttgtcgaactgagtcttcaacagctgcatgctcttgtcccgtttaataatctgaaaatccaatttatggtcaagggtattattccacgcatgggctctgacaaccgttggtgttatctctctcgcccggaatgccctacaaaagccaatatgtacgtccgtcagtaccgctgctcggaccacggctgctcttctgttgcagcagatccctcatactgtctgtgctctctcgggtccggcggcgcagctgaggcagaatttatgttctttgatagagctgcaaagagtgctgttgggaagccactcatgactttgatttaccgcaagtatcctggtttcacaagtgcgcttgatctgccttatataggaggtgctgatgtaggcttgcctgttgaaatttcacgccttgttaccaagaagtatagacttgtcgtttctatctccaccaaaagctttcagcctgcaagcacccagctgtccttccaagttggcagggttgatgaaacctttaagcctgaactggcatcctttggatttggcggtgcgtcatcttctgctgggagctcaggcatagcggtgcccattccgacgtctttcgctacaggatcatctacacttgttgacctacctcccgatgagatgaacactcccatatctgcattcagaggaaaaggacaggcttctatgcctaaaacacccagcaaatcaccatgcccaaaaagcgctcgccgcaaacttgttcttgagctctctaaatctagggacgaagagctatctggctctgctcccgagttggctacccagacgggagacgttgttcctcctggaaatgttgttcagcctacatccatgccaaatgttagccaggagaatgaagctgcagctactgaaaattcagacagcctccttcctgacccctctaaaaccaagagggcaaacactcctgcaaagggagttggcactccaaagaaagcgaggcagtagttcctccatggattaagctacatatgtacatacgggtatcttctgtgttctgcttgcttatcaagcaaagtccggcgctggaagggtgtgtttctgaacacagcttctaacctctgctgcatctcatcaactgtctgtccatcgggactgaagatcgtcaattcagcgcacttttgggcacacactgggtttattttgtgcacctttgtaaggcaaggctttgacacctgaaaaactatgtcgagccactgtcatgacaattcctctatttaggtcctcgaacagattaggttccatgcgttgtaaatatcttcgccggccttttctaccttatctccttataaaactttctactcattgtaaatgccgctgggccatgctacttaatctaagtcttgttgttataatgtgcacaccttcttatgttttaaaaaaaaaa

SEQ ID NO: 12883 - DNA, 504 bp, Triticum aestivum
  Clone ID: PAT_TA_12883
ttttttttttttttttttgtttgtttcttaaagaagaggaacagatgagatgagctagatgcatgcagcaggaagtagttgtttttacacttgtttgtgcagaatccattcctgattcctccctccctcctatgtatgtatagtgtaggtgaatgaagagcccggaaaagataagctactgtctgaactcaactcaactcaactttttgtttgtttgtttgttctgaaataaggggggacagttgagttcagttcagctcatcctcctctgctactctctctctctcaagttagggattaccaaaaaaagctttcgccctgctttataaataaagcaatctcaagttagggattactagtagtacttgaaatgatagaaagaaagaaacaaagagatttcatttgggaagaaagatgaggggaaatcaagcaagcaagcaagcaaagaaagaaacaatctcatcacgcacccaatcctaatgaatgaatgaatgagcgaatcct

SEQ ID NO: 12884 - DNA, 1210 bp, Triticum aestivum
  Clone ID: PAT_TA_12884
tttttttttttttttttggcagggataattcttttgtttctcatgtctgccttcgcttccagctcgcctgcgtggccgccgtcttgccgcttcccccaccctctcacttacagcagctggcccttaactgaaccacacacacccacgcagtcgatgacgccctccaggcttacgtcccccagcccggatcaagtgcgtgcgcgtgtgaccctcgccaggggctacacgtgttggcctgctcaagcctgcccgttcgcggtcgcggcgaagtgctggggatacctttgcgccagtccgaacagccccagggttccgccgctgtggatcatggccactttggcccctctgccgtctccgcggcacagatccacggcctgctcccaggcggccaaggtgtacacgggatccagcaggatgcccgtttgctgagccacctgccggcacgacgcgatttcgcctcccagcaccttgccgaatcttctcggcgaaaagcggtccacccaatgaaccagaccgtctgttccgaccaactcatggcagtcttcatggcaaagccccttaaaatcagatatcagggacttctcctgttctttatatctttcaaatgtatcagcaagcatgacagcagtaaccctccaattaagtcctagacataccgctccaagagctaacccaacagctgttgtgcctgtcccagcatccaccacaacatggacttcctcatcattatgaaacgacgacaaactagagaggtgctccaccagtcgcataacacctagtaacgcttgaacagtaccagccccttccttaataatcaccacccttctggaatcgttttcaagaacagtctcttcatccacacttaaatcatctctgacgatatcatcagcccacagcaccgaaccgccggtaccggcaaccttcttggcatgctcataaagcatctcatctcggtgtgcatagaccgaccgagatgcataggtcacgttgccaaacatcaaagagatcaaattgtagcctgtcggcacatctagctgctctcctctcagcagtaggtgtggcctgattccccattctgcacaatggaccgcgacggctgctgcatgggcgctctggcaacccccgcatgttatcacgtcggtggcaccccggcggcggaggagcggcaggagggcgtcgagcttccgggccttgttaccgttggcgaggg

SEQ ID NO: 12885 - DNA, 632 bp, Triticum aestivum
  Clone ID: PAT_TA_12885
ttttttttttttatcaattgtcgtgctgctgctgccatgccgccacatccggcattgttttgccttataggagttacaaattcctagatagtcatagatgcatacagataaacacttgattcgagctagctagttacttagacatggcacgatcggaaagtaattcagagagcagtgggttgatctggcaggcgcttcttgatatgaccgtagagacgggggatctggggtcccttgaggcgctgagcccccgcgaaggagcggcggatggtgatcttgggccgcttgacgatcccctccgccgcggcggccaactcacgctggcggcggcgctcggccttcgcgtgcgcccgctccagcacctgcttcatctctccgtccggctgctggaacaccgtgcgagcggggacgaactggatgggcttgttgtagtcgggcctggggcggggcgcgtcggagtcagactcgggctcagagaacgcgcagtagtagatgatctcgtcttcgtcgtcgctgatctggggcgcgcggtcgccgcgggcctgagagtcgccgcccacctccatggcgccgccggctagggtttgggtcttgggtgcgatttgaggattggggaaagaggagcctcgtgc

SEQ ID NO: 12886 - DNA, 1095 bp, Triticum aestivum
  unsure (1)..(1095): unsure at all n locations
  Clone ID: PAT_TA_12886
tttttccttcccacgtcctagtgcttttgcaacatgtaacttttacagcgctgatatacgaaacacaggtacaaaatatccatggatacacaccagagtcaaaaacaggtaaaaacagagataaggtgcaaaacacttgccctgttcggtttgaggaggtttggcagggattagcagggaatatagctcaaagtcctgccaatcaatcactcttaatccacggcaatccttgccaaaccgaacatgccctcaaaccatcggaaatcaagtaccaagaattaacactccacgcataacaggaaaaagaatcggacaccgagagatgcacgccagaccgatggaatggaggatcgcaaactactgtagcatcgccatggacgcggccatggccaatgccacggcatagcccgcgcggacgacggcggcgccgttggagttcggcgcgggcgcggtcgtcgttgcccctccgtcagacgtcgtcgccgcggcgggaggggtcgaggcgctgctgccgctggtgtctccggcgcgcggggacgccncggccggcgccggcgcggtggcggagggcgccggggacggggacggggccgaggagcgggccttctgtgtcttgagcacgcggacgttcagcttctggccggcggtgcagtggcccggcacgccgcagatgaagaagcggtgcccggggctcttgatggtgaccttgtcgtcgccggaggtgtgcgtggcgatgggcgtcgagttggtgcagctgctgtagtccgccttgttcacctccagcacgttgtggatgccctgcgggtacttgaactcgatgacgtcccccactttgaagctctgcttccccgcccagtcggcgtagttgacgttgccgaggatggtccacccggaggagccgccgacctggtagaccgccgccgacgaggtcgccaccatgccggccagcgccagcgccagcgccatcaccacggccatgcccctcacgcccttcatctctctctcacgcaccctctgctctgcttccgtgaaaggaggggtagatggagatgccaagagcagagcacacggaacgaatgccgagcagagcactac

SEQ ID NO: 12887 - DNA, 1710 bp, Triticum aestivum
  Clone ID: PAT_TA_12887
cgtccgcacccgcgtggagcagtataatcactcggccccgaggcgcaaacataggggggggcgcagggagcggcgcctggatatggtcgccggcgagggtaccgcagagggaggagcgatggaaggtgccagcccggcgtaagaggaggtgcggacgcctcatgacgtggagatgaagctggaacatggggtcgtgcatgcggaatccgcctcgtctcaagaggaatcgaactgaccttgctgatgagcgctagttctgtacggacctgtgcagtacgaggatgaagaagaagatgaagaccaggaaaaggtagaagggcacgccaggtcacggagcgggccgatgctcacaagtcataccgtactctacgcacgcacaaagggcttggtctactcgatgaatcgaatcaaggtcttgcacaatcggatgaggatagccgccggtactgcccacacctcccccgcgatctctgatcggtcgggccccccggggaagcatatggatggtcttagtaatctgagttcggctttaggagccgatcgcatttcagatgatgatgatggcgctgatgggtctggtgacgacgaggactcggccgaggtggagggaaatcttgctgcttgattcaaaagatggaagcagacctgcgccttcagatggatacctttatctgtcaaggcaagttgtttctgtagaaccaagcggacagctggaagttgaaatacaggcctatgcaccacccggcgttctccctgcaaaaacgcaggtctgcttcgaagcccaagaatgcaacatagatcgtggtcggtgttgcctcctcggtgccgaggtggagatctgtgttgcttggtcccgtcttgcttcggacgtggagatgcttgcgggtgttggcggggattttcaaagggaggaaccagaggttgcgttcacacaagtggggctgaatggagagcctgacacggaacgaatcttttaagaactgcttggtattagcttgttgaagtccctatagtagtagtatttctgcatcgtgtttagttatatatgtaaggtgtccaactatgccttatgctatgcatctgcatcggattagctatatatataccacctgtccaactatgactgatgcaccaggcatctgtttgtttggttgtgtattgacatgaacacttttaatatgacccgtatctgcacctgatcggcccgtctcgtgctgttttctttgaggactatgttaattatgaggtccagcttatggtgaaaggcagcgtcaagtctcgggacaggccgttgatcacagatacataccgccatatccaatgccgtattggtgtatccaccatctgctttcagaactgcttctgcacgatggagttacgcttgggagcgatttctaggttcggtccaagccaccatctttggcgtacgtctccgtcaaatgacaatggggcgttggcctttttggacatggtgttccggttgcttgctcccccaacatcacgggaacttatggaggacagtgatggtgaaacaattatgttctcaaccttcgtctggggaaacctgctgcttgatcaaaagatggaagaaactgccatcaaagggatacttcacttcaaggaattgttccgttgaacaagcggcaactggaattcaaaagagctatcacaaccgggtctccccggaaccacctcgctgcaagccaagat

SEQ ID NO: 12888 - DNA, 1043 bp, Triticum aestivum
  unsure (1)..(1043): unsure at all n locations
  Clone ID: PAT_TA_12888
ccgcccnccgcagtgtgagtcccatnagcgttgcggccagtgctgcccgcagttccntaaaggtgggcaaaacatgcaagggaggatcagtagaggaatacacaggattctacccaaatagagttatatacaagtacttgtcgcggctctaacagattgttctcataacatgaccaacagcggcaaggaaaaaagagaaaacgggcggcctagtctacgcgatcgccctcaaccctcttggcctcgctcaccttgtccacaatgggtgcgacaagggccttgagcgcctccagatcagcatctggcggcagggacctgaggacgttggtgaggttgaggcctgggttgcggaaggccaccttcaccagcaccttctgaagaactcccgcgcagatcttgcgcgactcgtcggccagctgctttgggatcttctcccggagtcgctggagggccgtcgccacgcctttgaagaacaagctgagcttggcgctgggttggaggtgctcatcggaggagtacccgagatcctccatccccagctgcgccagctccccgtcgatggctgcggcaacatccaccagaccctcggtccagtgctccacagtctccctgaaactgtcctaggcggcagcagcactcgccagcagcgcctcgttggccttgatcttctccttcaaggccacctcctgctccttggcaccgtccagcgtttgagtcaaagtaacaagcttcaactcaagatctgtgttggagtccttggcggcgctaagctgtttgctcctctcagcgagacgaccctgcagctcgccatgagcggcggcgtccttctcgcgctcacacttgagcgcagcaagctcctcgtcgctcgccttgagatnggctcaactgcgcatcttcgtctcagctccttcttggcggctcgganctgtgnatatcctctgctccctgagagccnccaaatggntgctcnccccggaaactctcctcgngtgtaaagttgactgcgctgcgcaatcgcttccgggtaaaancttcggganaan

SEQ ID NO: 12889 - DNA, 651 bp, Triticum aestivum
  Clone ID: PAT_TA_12889
gaaaacaaaacgatttgggtattctgaaatgatttcaatcctcaagagttgcttcagagtaaacttaatgaaatcagcaaatattctatacacctaaacatccttaacaccctgttcgtatttatcaagggcggagatagtgctcagcaggtcatccttcatcttctttctatcatcactgagctcaaagttactgttctccaccacagttcccaggtcagagaatgattgtattagctctgcaaggctggcatcagcttcaaccttgacaggatccttatcgtcgagcagcgacgcggcattcttcagaatcaagctgaatgtgcagacctcgacgccggttcgtgactgaaaggcgactaccgagttcctctcccgcggcacgcagtccctccccgccgcgctcaggcgccccctcacctcctcggcgtccgcggcagacgcattctccgaagcgagaaggtcctgggctttgacgagggtctcgcgggaggcggcgatgggcgcgagcaggaagcgcgccgacttcctcttctgctcccgcagcaactccttcggcccagggaagctgaaggagaaggcggcggcggcgggccttgccggcgaggcggccaggacgagggcgaggagggcggcgcggcgagaggagat

SEQ ID NO: 12890 - DNA, 635 bp, Triticum aestivum
  unsure (1)..(635): unsure at all n locations
  Clone ID: PAT_TA_12890
cgcccaatcaatcacacgcccacctttcaagtttcagccacgaacgcgaaagaggacccatcgccatcgcgtgccagtcacacgccgcccagttactacctccggccacactcactcatccgcatcccacaattccactaggcaacagcagcaacactacctccggacaaagcaagtgcgctaagcctaacgtgatcattcatgtaggatcgggtccgaattaagaattctttacaggggcttctaccggggggaggaaatggaaccaaaaaactcgcggacaaaacagtgtggttcgttcgtgtggccctgacgatggtctcgctccctccctcgctcactctcaccaacaacgtattggttccctcgccttggcctacatctgctcctggacaatgttatacacagatatcaagatctccacgctgatgaggatgatgatgagccactcgaggaagtccgacttcctgttctgggaggatttcctggaggaaccggatgttgtgctcgacgaatttcagcttgaaatcaangnttccgaatctttgggttagctcgtactcgtcccgggggaactcccaaatntnagcaaaatttgngttcttccaaacaaatgtctggncctcncaaaaaaa

SEQ ID NO: 12891 - DNA, 711 bp, Triticum aestivum
  Clone ID: PAT_TA_12891
tttttttttttttttttttaagaccaatcttttctatattagtgtatgggaatgggatcacacatacaacatatagcccacctattcatcctacattatctccaattgtgtacaaaagaatacccaaggctctgtgtcatcttctataagattatgtgatgacaagtaacgcctctacccgccacaacatctccaacatatatatagcatgacgaaccatgcaaaatcagaggctgccatcgaggtccttcctgccttgctttcgtagctgggaggaccggtgccggcctgagctcaagctcctccacgggcttacatgggatatagccagagttcaggcaaagaatcaggtgggcggccaagagatggggaaagctgctaatctcgggccgccttgtttttccaagcagcgattggctttggaatgctgtcaaaaagagggagggcgaaagcgtctggtttcaagctccacttgcttgctgaccatatggacgaggagctgctgttgctctctggctcttggaactcaggggtgctcgacgatttctttacggtttgaagcccgccgtcaaacgaaggctccgacatcgcgataagattctgatggctcttgttcatgtctggtcgagtgcccgactttggcctcaatgcgaggccttttcccgcccgtgacaacaaggcactgccattttcctcctaggtagcaactcg

SEQ ID NO: 12892 - DNA, 342 bp, Triticum aestivum
  Clone ID: PAT_TA_12892
tttttttttttttttttttatataagtgcattgatacagcatgtacatatgatagtacttttttttgcggttgatagtacattcatactagtgaatgcatcacacccacacagaataaaagaaaaaaaataagaagaagaatgcattactaataggattttcatatgatggaacaaatgaatgaatgcacggaaccaatgtagctgaacttcgacacgtttgaaagtgatcggttagtggccgccgcccttggtgctgacgcagcgcctgatctcctccgggaggtcgccgacgcgctcgatgccctcctcgaaggcgacccccatgcccagaagaagtgct

SEQ ID NO: 12893 - DNA, 433 bp, Triticum aestivum
  Clone ID: PAT_TA_12893
cgtccgcacgaacacaagacccgccgctaagtgcaagattgcagcttccactgctcgccgccagcagcgggttgggggtttagccagggttctgcaccccccgcaccgctagcgaaagccatggaaggggaggaggagataggcctcgtcctcgcccgcgcctccgaccttcgctccaggatctccgcctgcgctgccgccgcacggcccccgctgcggctgggcgccggggaggaggacgacggcggagaggaggcggaagaggaggtggagatggagagcctggtaggcatcaacgacgcgctcgagtcgctcgagcggcagctcgcctccctgcaggacctccaacaccaacaaagatatgaacgagaaaccgtcctgagccagattgatcgcagtcgaacatctctccttaacaagctgaaagaataca

SEQ ID NO: 12894 - DNA, 936 bp, Triticum aestivum
  Clone ID: PAT_TA_12894
agttttttttttttttttttaataaatgagggagtcacatccatcgatatacatttccattgaaggaagcaagagtgaactcaagttcagttacaacaaccaaaacccattctacagggttctgcatcatggccgaaacagcattgaactccccacagaaaaaaggaacaacatcaaactgcgacaaaattgcttaactatgtatcactcagtcagatccctagcctcttggtgccacactctgaacagaacttggatgtcgcccttaaatacggcgaaccgcactcgtcgcagaactttgcagggctgcttggaagaatattcgagcgtcctccaaggtggttgtgtccagcttgcatggaagatagatgcggagatagataggactggtgctgctgggggttatctgacagttgcgaggacgatgcacatggatgaatgggagggaactgagaactatgttggttttgctggatgttgtcatgctctgcttgatcgagaaagtgcaagtaaggttgactttctatctgttcaatgtgtcgcttcgatgatgactcatgttggttttgcatctcgaatggtggacgaaattctgaagaacaaaccaatggagaagtctcatcctctgacaaaacggatgtgccaggaatgtcaaatactggctgcagggtacgcctgtacttgtgtcgaggcgaatagaatttgtaatctcttgatgaaatggctacttcacttcgaccagtcaatcttttgaaccattccgcatcctgcattctcatattatttggcctctctatgatcaccaaaccattgattacaacaaaacggacccgcttttcttcctgtactacaagttcaggaaactttgtctttgttgcattagaagtagccagctccctcctcctgaagctacaatttcctttcttgggaaacttt

SEQ ID NO: 12895 - DNA, 1018 bp, Triticum aestivum
  Clone ID: PAT_TA_12895
aaagtggagactgctaggaatatgcatgtggcatacccgcattactaaaagacaatggacaaagatactactccacagacccgctggtgtattacgaaaacacacccaggacataacatctaaatccctctcccttctaccattgggcaatctaaagaaatgttccatcaaatgttagagaataggaaacatgcttaagaaaagtatgtaaagttcagaatagtgtacctattgaagctaattcaagggacctagaatttccaaaatggaccatcagatagtacttccataattatatctcacaatataatctgagttgaaaattggaagggaaatagatttacatcttcatggatatacatgattagccgatttctcaagtaatggacatgtccaaaaaatacacaatgtccagaacacaactggtagttttaacttgatacattatacgatcgatgtgaataaaggagaagactgtgcacaacatatggaaatattaggagtttgctattcaaccatgatgtgatgagcatgcttggtcaccagtagtttttctgggcatgtaaaatgggtaaccaaaactctaacgactccattcaccattggcatacaggaaagacacggagatggaaagggctgaccaaaactgtagtgacgccattcatcattggcctacaggaaggattttgagagctcaccgaggactgcttttcatgccagaattatattacatgaatcatcgtgaagaagaatgatgtcacaaatttcatcgacacttttgactaatcatcagttaatgttgatttgggatacctcccaggcagtatcactccacaactcaggaatatgcccgtgaggatacctaacctcgatgacgccgtgcagatagacagcagtgtcagggaggagagttggctctgtcgagatgtggaggctgtagcttgaaacatagacctcgatcaggaggctcgactccacgacacgcagatggacagaagcacaaatagcatgtggcgag

SEQ ID NO: 12896 - DNA, 442 bp, Triticum aestivum
  Clone ID: PAT_TA_12896
cgtccgcccacgcgtccgtaataccttcaatagccccttgttggcttcacatccaattcgagatagaagcgcgggatcccctccccgcgcgccctattctgtgtggacagatccattgagaggcgcccttgattcctggctgttgtatcatggggttgctagctctgaagatgctcatgtctaggcggcgggatagcaagcatctttgcggccagattcaagcccgtaatagattggttacttcagtggttaaaagaaagatctcttcatgccaacacaataacaatcaaggttgcaagagagtggcattttcaggggcagaccttccagaggacatcaaccgccatatacattccctactgccgctgcgagatgctgcccgtgttgcctgcgtatctcatgcatttttacgttcctggaaatgccatcccaacctttcctt

SEQ ID NO: 12897 - DNA, 800 bp, Triticum aestivum
  Clone ID: PAT_TA_12897
gtattagcaaaatatagttgaattttctgccgtagcaaaacatagtggccatcaaattgacataacagtggccatccaactgagatagcagaaatactatgtttttaatggaacaaaatacatctgtaggaacattatatagttgtacacattcaggagtaattttccccgtataagattgccctatcaggaataaaatatagttgtattttctaatggagcaaaatacagctataagcattaaaactgtacctgggcatggtactcaagatgctttttttattgcatcgtgtacactttaataagaggtgctgactctacaatttttcaagcatcaaaccatataagagtaattgcccgtgtgaggtattgattttgtcgctatttgttagaaatacatcatatcgaagcttcagaacccattttctcttaggtcaataacacgcagatcaaacattaaaacttggagacgggattaacaattccatggaacatcaacatctcctactgctaccaacaataggttagcacttccgcttaatcggggaattcaccaagagcttatggtaggcaagagggggacggacccgtgatcaagaaagagtgtggatgtatctaacatttctcgtatttgctgctgaccaccaatgataggtatctctgtatctacttgtccaatagcgcatagcactgttccaaagctctcagtttcaggcataaagcaatgtagatgctatggttacccttgcaagaaaatggagttcccatattttgctgaaaaggaatctgaagtagccccc

SEQ ID NO: 12898 - DNA, 740 bp, Triticum aestivum
  Clone ID: PAT_TA_12898
gtgttgataagtaacagaaatagcagttccttaatggaaaaccctcctgcagcacaatggcatttgttgcagctccttgcaaaagagttttgacttaacaaatggcaagcaaatgggtcagctgccggatactcgaccccaatagcatgattgtctcacctagagtggagagagattctccactatgaaactaggaaacagtcttcttccttccgaagtaacataacatctgatctcaaaagcctatggtatggacacaggaggggtacacggaatatacagggcaatgcaatccatttcatccatgtcggggaggaccggcatcgccgcgtcgctcattccgggcagatttccctgaagatgggcagcctgcgtcggccgctgcgcccgtagagggcctcggctatcaggtcttcttcctcctctgttggctgtgctgctgcagacgtcgcctgtgctgaaggtgtcgtcgaaccaggtttcggtgtcgacagaaggtccggcctgtttcctaggatgacggcgccatctggtgatcggaagttggaaaatgtctgcttgagttccgggaaacctggtgcgccagtgagcccgccagcctgacgtttcggcgcatagaggtaggccgcctcatggtccgccaccgcgtacatcggccgcggccgcgcctgctgcggcggcggcggcgactgcggcgagtagaggaggcggcggctgtccagctccgcctcgtccgaatc

SEQ ID NO: 12899 - DNA, 911 bp, Triticum aestivum
  Clone ID: PAT_TA_12899
ctgactgcagttgttaataaaccaactagtaaccaatgtggagacagctcactgatcgataattaaagaacataaagtaggcttctagatgcatcttttcacattttgagatatcacataactctagaggactgcgcaaatgcaaacgaccagtttgtaacccctgaagcatcacgagttagaatgtcgttcctctccttactgtgcgtgcaggagtggagaactatcatcatggtggtggtctgatggacatggtgctagcctgtcaaaatctttttctctctcatcaccattgctggctcctataatttccatgaatcatccttgcaaacctgaaaactatgtccaagaataaaatacgaccccattgatgtccaacctgcagggaaatcgtcacaaaatagaattgcaaataggtaacagatttccttcaattgcattgatacagcctaattactttcgaattattgtagaaatgtacgtgcagaatctgacggagtgcgttcttctaggtcttgcactggttatatcactaagtactcatcaccgatataacagccatctttgaaaagaatgtgcataccattcagccagcacacatctcttgattcaaatggcacatagtcttggcctttccagatttgttagcgctcttccatggtttccaatgtggccacacagtctaagttgaaaattcatataaaatcctgcagcggcaggttgattggacaaactttttgtagaccgctgtaatcggaaccagcaaaatgggcaaggctatggcctatggctaccaccattctgatcaggcacgactttcagaatgaaaatatccctttcacctgacattgttataacaaactaatgtctctaacttaatctgcataccaaggccgatctagttgagcaga

SEQ ID NO: 12900 - DNA, 623 bp, Triticum aestivum
  unsure (1)..(623): unsure at all n locations
  Clone ID: PAT_TA_12900
ccaagnnttatacggaccttgcatttgcgctctatctttcctgaaggccaanggtttgaagttagctgtgtaggcccccccgcgcggaaggggacaatatgccagaatctttccacttagcagaagcagtatgcaaacttcgaggtcaagaccctgaacaattccatggaaatgggtcaaatggatggactattcccttgtcatggaaatcaatttatggaccacctcctgatatgtctattttctagactgactgacctaggaagttgcaatcatggacagcgctgtatctagaatgaggaaggatattagctttaggttgtgtactagaaatccccaggatggtgagtcgccgaccctcttttgaagcaacaacagttttcaacttccgtttagaactggagggatcgtgaacctggaatttatctgccgcggctattcctcatgtcttagtgaattttttaataaaaaacctgggattccaggctctgatttgcggctattccccgtgtctaagtggaatactccgtccgtcggatgtaataacgttttatattatgggacggagtagatttattcctttttattttaaaaagattgcaccaaaaaaaaaaaaaaaaaac

SEQ ID NO: 12901 - DNA, 641 bp, Triticum aestivum
  Clone ID: PAT_TA_12901
ttttttgtttttttttttgatgcgccacgacccattaattccttctatgccatcccatagaacgaggtcatggcggttacaaaagtctacacacgactacaacgagccatgttatttcttatgcaaggcagccgatcgactacatgttattcctaatcatggcggcaccctttcttcttgcagttgttgttgcagtcattcctacaggtggaaccgcactggtcgtatatgctgcgcttgcaagggtcacattgtagggtgccgtcgctgacgctcatgcaacccctttcagccacagtgttgcagtcacaagtgcatgtgccgttgctactgcagcaggtaccctttacgttgcaatcctcgaagacgtatttcctgcagctcgatcgaggtccgccaccactggtgcagtaacccctgcaggaggtttcaaccatcgcggtgcagttggtacggcattgcgtctcacactcgctgcataaaggcctcggcccccccagggaagacgtgatcagcatggagaaaacaacaacaacaacaagaagaggtgctccacctgcagccattgtggccgagcaagctttgtagctagagaggtgaatatctggagcaagagaaggtgtcaagattggagatgtgaa

SEQ ID NO: 12902 - DNA, 498 bp, Triticum aestivum
  Clone ID: PAT_TA_12902
ttttttttttttttttttttttttaaagcaaaataatttccagaaaaagcctgttattccagtactttcgcaaggtctactacgtgtagaaaagaggcaaacaaaattaagttacatccaaagaagctctcagtcgttaacgctagactagtacaacggcctcaaccaaaatatggaacattctcgtgcgtgatggagctgtagtccgtggagctcgacgccgtggcatacaccgtggttgacgacgctgcggaagccacaggccccaccgccggcgctgctagccccagcgacccagccggccggtggcccccggcggcgaggagctgggaggcgtgcgaggacgggggcacgttgggcaccgcggacgccgcggcggcggcggcagggcggtacctgtgcttgaggatctcggcgcggacggcggcgagctcggcctcgagggcgtgcacctgctgctgcagggtgaggatggcgcccatgcagccgtagacggga

SEQ ID NO: 12903 - DNA, 696 bp, Triticum aestivum
  Clone ID: PAT_TA_12903
tttttttttttttttttgtggaaactgcaattttattgcaaactgaaaccagcgaaaactagaaagctggtggtatatcgatatgatgttacacgcggaacagagcgcagccatgtccggctagtgcacgagttccatcggcttgcatgtctcctgattcttcatttcaaagaactacagaccatagtagcaataacaaattgaacaagtgtacatacatagtaggataagatcatgcgatgatctggtgaatggcgcaagatgcagccacctgatgttccgtggactggaatctgttggagtccaaaagaaaagaaaatttgacatcaacttgatcaattccatggtgaagaactgatcaccttctacggaagggacctgagccacccagcaggtgtcaattttaaatcctcgatcggtcatgtcggagctctggaaataatgttgtagtttgctccaaggttgccggagtgtaaaacgccatagatcacagagagagaagtagagaacacagagaaacaattcggcctcttcttctgcccagctgaatctttctaattatggatagtaggatgaaccttgcagattaatgctgcatcatccgtactctattggatcttgctcttcttctgccctgcaattatcagtatggacccttcacaggtgacacactccagatccgcatggatggtcgct

SEQ ID NO: 12904 - DNA, 628 bp, Triticum aestivum
  Clone ID: PAT_TA_12904
agttttttttttttttttttagctgcaagtattgtccgtttattgtgacatagaaactaagacaacgatcaagcaagcacgcaagaagggatgatgacaacacatacatgacttcacgagggaaggaaagaaatgacacgacaggacatgacaacaaatgagctgagctccctagaaccaaacgagacatgtagtagagtcgagtcgagtcaactaaaggcccttgaggcaccgggacacgcattcgtcgtttttcttgtagcatccgtccacgcatccgggtttgctgccgaggtggcagtcgctatggcaatactggtccgcccgttcgcatcggaacgtgcaatcctggaacgctttgcggcatctcagtggaagtttctgcaggcactgccggcaaccttctaggcagatgaggcttcctaaccactcacggcagccggggtcgcacaacgtctgcacgcatgatttttcctcgtgggtgcaggccgacgactcccctgggcagacacaacccagggccagcgccgggcagaggaggaggaggagcaggagggtggccgccgcagccatcttacttttcttcttagatagactagaggtggaatttcttagaccagccgccgcc

SEQ ID NO: 12905 - DNA, 1203 bp, Triticum aestivum
  Clone ID: PAT_TA_12905
ttttttttttcttttttaggattcattcgcactaaatttcatggaaaaaaattcatctactccaacctctttgaaagaatcatacgttcttcctatgcacaatcaaaaatcctgacagatcctgtagtattcaaggtggcatgccaccctgttcctacatattacctatcccagtgctttgaaaatcatgtgaatcaaagaggcccaaggtcggagctaatttttttttattcctttgaaatatgaagaataggaaccaattttgcattggaatagcaattcattcctacagaccaaagggctcttaggggatatttgctgtaggaaccctatcctgcaaacttcatgtaaaccaaaggaggccttattggtgcactatttgtgcgtgttctagcaattaatcactcggtctgggtttatttgccacctagtatttagggccaagctttgactataaatttataactaataaaataaaactatgtcacaaagttatacggctggaaatccaatgatatactttgtgtagcacataaatcgtatttttgttagtcaaagtttgacccaaaatacgaggggccaaataaacccggacagagagagtagtttatactggaaactggattttgttggagatgatataatcgatgtgctatctttggatgaaattggttttagatgcaaatgatggatgtatattttcagagttctgatgtgaagctatcaagaaattcatagaccggaaagcattatgtgaccaagaaattcaccaattacaataataacaaagtaaaaggaaaggttacttagcaagatattaggcacgagggaatgacggttgcctcctcttcctcttattcaatgccgtctttgccatccattccgcccttgatgtcgagaaaggtgttgcccgtccatcgtgttgacgaacgcagggtacctgcctgtatatatagccccaaagagaggtaaaaaaaaaaaaggactgcgggtctgaaaggtgaagaaacaaagggaaaaagtgaatttcaaacactcaaaaactagagacgagagacggatctgtctgtgacatgagaagaacagaacaaaacagagggcaaaggaagaagaagaagaaaaacgcattcgcaaaaagcagatgtaaatcatcagctggcgatattttaacttgcgaggcaccgcggagaaaacctcgtgccg

SEQ ID NO: 12906 - DNA, 738 bp, Triticum aestivum
  Clone ID: PAT_TA_12906
tttttttttttttttttttaaatcaaaacctacaaattaccattatgtttatcagaacatgcaaacttgttcagtacagagaccagaaatcaagacatagcagaaaggctcacaataggctagtgttcaatgacattaccataggcaaataggattcagtatttacaagggaagttttcaaccgacgaactcaaataataaggttccgtttctcagaggtagcaccataaaaacaataaaaatcaccaccagttccatgttctatggtgcacaaaaaccttagaacataatcaatgaagggcacctggtcacctcggaactacctggtattgcgcctattattcatgcttggcattatagtcttcgtagctggcacacgccacaagtcagcatcagctgcctacgtggcatacctctctttgtaaaaccccttcaataagggtaacgcatggagcatcactataaagtatggcgacataagaagaattgcaaagaccgcatacaacagtttgcagtacatgagggcaccaaacatcagatagatatagccggcaagagtcgccacaaataaaaggttgaaggtgtgctctataaaagccgccaagatatattttctgatgaagcgcgcctcatccaccgacggagtgcctttctcgacgacggatatgggatgatactctatcatgaactcctttttgccattcgtctttctaggctccatggtctgcgagcaaagct

SEQ ID NO: 12907 - DNA, 758 bp, Triticum aestivum
  Clone ID: PAT_TA_12907
ttttttttttcttttttgcttaagaaaacttatactaattaaatacgtaaatgaaaaggtacatgctcaattagttggttgctggcactgccattgcaccgcaccacatcaatccacacctactctactgtatttagctagttgctgaacatccagacaagcaacagcatggactgaacacatagattgttatctgaaaagatttaccctttgcatccttcaacaacagtgccattcattccgtcaaaatttgcatgcatttgagttttgagctgatcactgaagggtatgagtttgcggtcacatgtgcttggaatctatctggtggccatggccctctggacaaatcctgcagctgattttagggccacaccatgtgaactgcaaacctaagcaaaagcctcctcatgccattttgccgaaaaagctttccaggttggctcttctcctgccatggggtcagctccatccaagttgccaaagcctccgagcaaggcagataaaacaaattatgctctgaccataggagcaacatgaacatggcaatggcgaaagaaggaaccgctaataagcacgtcatcaacaaacacatctacgctggtatctaggccttggccttgggaatcaatcctatggcttctgcaaccttgagcttcttcctcgcgtactgcgcatatgtctttggcaaagcgcgcttgaatctaacttcttgcgaaatcaactcttgggctatcctcgtgccgaattgcctgcagccc

SEQ ID NO: 12908 - DNA, 802 bp, Triticum aestivum
  Clone ID: PAT_TA_12908
agacgcgtccgcttcctcttctccctcgccgcagccatcgtcgcggcctccctcctcgccgcctcgctccgccgccccgcctccccggccccatggcggcccgcaaccggagcttcgtgctgtggctgcacggcctcggcgactccggccccgccaacgagcccatccgcaccttcttcgccgcgccggagttccgccacaccaagtgggcgttcccctccgcccccaactcccccgtctcctgcaacaatggcgccgtgatgccatcatggttcgatatccacgagcttcctttgagccctggttcgccgcaagatgagagcggtgttcttaaggccgtggagaatgtgcacgccatgatcgacagggaggtggccggcggcatccatcccgacaacatatttgtgtgtgggttcagtcagggaggtgctctgacattagcaagtgttttgctttatccgaagacgctaggtggcggtgccgtgttcagtggctgggtccctttcggttcgtcggtcattgagaggatttcacccgaagcaaggaagacacctattctgtggtcgcatggaatcgctgatcaagtggtattatttgaagccggtcaggccggcccaccatttttgcaaagtgcaggcatcagttgtgaatttaaggcatacccagatctaggccactcgatcgcaaaggaagagctatcctctcttgaggcgtggatcaagggtcgtctcaaagcctcgcaagataagcaaagttaacgtccttcagtttgggccgccccctccccccccctcttgagact

SEQ ID NO: 12909 - DNA, 823 bp, Triticum aestivum
  Clone ID: PAT_TA_12909
ttttttttttttttttttgagatgaatagaagtgcgctattctacttcgggaattatggtttttttctttatttagtagacataaaagttctattttctatctgtataacacttccgcagacagttactacaacttagggggagaacacacattaacatctaacagtgccttctcacaaaaacagaaaatggaataagaacgaaaaatatctaacattgccaagtatatggtgatgttgtttacaagtaccatacttggggagctaaggttgcttccaaactgtgtacacgatagtatgaggatgtaagctcaacagaaactcagagctccatcaactcggcagtccgaatcatccaatcctaaaaccaactgttacgaccggccgacgatcataggccagcccagtgccaagcgaccgataggagttccccttagggaggccgtgcctcctcggcgccgcccatctgcttctccctctcgatcttctccagcaccttggcgaatgcctcggtgttgcagggcagctcgaggggccctgcgtctgcgtacccaaatgcctcctcggcctcctccgagcagtgcctaggaacaacgggtggttcaggcactccgtccgcaccacgtaccgttgtctgtccgacaccgaacatacaccgagaagcagccctccgctggcttgttcctcgccgtggtgctccggcaccggtccagcgtcttggtgatcagcccggccttcctcgcccccgaccccttgctcagccatgcccatggtgcacaaaacctcgcaggctatagctagttgcaaatttgcaaagaatgtgt

SEQ ID NO: 12910 - DNA, 917 bp, Triticum aestivum
  unsure (1)..(917): unsure at all n locations
  Clone ID: PAT_TA_12910
gagcttcgtgccgccggcctcgcgcctcctcatgatcggctgcggctccgctcttatgtcagaggatatggccgctgatggctacatnggagataataaacattgacatttcttcggttttgattgagatgatgaggaagaagtacttcaatctcccacagctacaatacatgcaaatggatgttagagatatgagtaaattctctgacgaatcatttgattgtgccattgataaaggtactttggactctttgatgtgtggtgtggaggctcctctcagcgcagctcagatggtcctggaagtggacaggctacttaaaccagggggagtctttatgttgataacttatggtgatccatcagcgcgaattcctcacttgaaccaaccagtatgcagttggaaaattgtactgtacattctgccaagacctggattcaagggaaacataagaagatctgtcttcgaccctgttccactgactgagagtggtagattgcctgagggctttgttctggaggatcctgactctcattatatttatgtctgcaaaaagggccaagaattaacagggatagattctccaaccttaagccacttgaagttgcaagattccgagtgagctgtaggataattcatctcacaatatttgtgcattgttgtgatccttacaagatcaaacagcgtgatgctgccaccattatggccatccaaaaatagaaagtgcgcctttgcacgagtatacattttttcagtgatcttgtaagaatcatcaagttattatattgtgttaccacttgttgtaaaaaaaaaaaaaaaaaagctcgtgattgtttggcacatttgaggaacagaatttgtcccagtttcatcctctgtggaatagacagacattgccattaaaaaaaaaaaaaaaaaa

SEQ ID NO: 12911 - DNA, 254 bp, Triticum aestivum
  Clone ID: PAT_TA_12911
ttttttttttttttttttacgatgataaaagctataaatttctgtagcaacgcgtggggtatcatctagtttttcacaaaagctgagatctcaaacctcgtcatctcatcacagaaagttatatcctcctcctagatttcatcaacaatgctgggcagcgctcgtgtcgtgccggccggtcgccgtccagtcaaaacacaatagtcaaaagtaccagccacggccagttgcagcatccacctccgccctcgcct

SEQ ID NO: 12912 - DNA, 764 bp, Triticum aestivum
  Clone ID: PAT_TA_12912
cgtccgcggacgcgtgggcggacgcgtgggccacccccgacggcggttcccaaatcccaatacccaccccaccaacaaacccatccgcatccccctcgcgtcgccccccccatcgccgtcccagttcaacctcatcgcgtacccgccgtccgcaccccgtccacaatttcggccatcggattccgagagattattttgatgtggtcgatcgagaccgaaatctgagtttgcttggaggagcctggtgaggtcctatgctgccttcgcaggatgaaaggcggtgttctgcataggctccttgtcaacaagctatgcttgggccttttattagttctcctcgttgtgccgattgtcattttgttgctgggcacaactccagaacagctgaaacttctctcccaaggtttcctacagcagcatggactggaacatattggagataatgtatcagctctagttgtgcctgcaggtccagcttataacgacgacactcacacgagtataaccagacggaacaaatggaacaaagactgtaactatgcaaagggaaagtgggtggcagatgagaaacggccactctattcaggtaatgagtgcaagcaatggctgtccaaaatgtgggcttgtcgaatgatgcaacgcacagatttcttctatgagagttaccggtggcagccgcacggttgggagatgcctgagttttaggtccctacttggtgagcaggctgaggcataaaactcttgcttttgggggtggttccctt

SEQ ID NO: 12913 - DNA, 666 bp, Triticum aestivum
  Clone ID: PAT_TA_12913
accggtccggaattctccggtcgacccacgcgtccgcaggcaatgagtgcaagcaatggctgtcgaaaatgtgggcttgtcgaatgatgcaacgcacagatttcttctatgagagttaccggtggcagccgcacggctgtgagatgcctgagttttcagggcctaacttgttgagcaggttgaggcataaaactcttgcttttgtgggtgattccctcgggagacagcaatttcagtccatcatgtgtatagcaactggtggtaaatacagcccagatgttgaagatgttggttggaaatatggccttgtcaaagctccaggtgctttaagacctgatgggtgggcttatcgatttccagagactaacaccactatcctttactactgggtctgctagcctatctgaattgggaacctttgaacacaacaaattcaagtgactagctatgcgttgcatcttgatcggccagtaacattcctgaagaagtatttccatggttttgatgttctaagtacttaacacaggtcatcactggaacaagagggaaatccagtggaaatcattgggaattgtatgccaatggggagcctgtagggaaaggtagacttgcagttctcaaccgtgcaaagaatcttacactgtatagcattgccaggtgggtgca

SEQ ID NO: 12914 - DNA, 657 bp, Triticum aestivum
  Clone ID: PAT_TA_12914
ttttttttgaacggaggcaaaagctttgcctcatctcattagtaaagcagaagagagttgtccggttaataaacggaaaaccgaacgaaaaccgtaacaaaccgctgagcggcacacacataataccacatacacctcatatagagggtttcgtcaacatcacccaccgatgtcatcgtcatcacttctccccaacaggcgtcatcaccctccctaatctccgagaaagcgactctgacttctccgaagacaaatgtcgcccaacccacactgtagaggctgtgtggaacacaagaaaccccgcgccaaactcagccacccacacaaggacatcacagctccgactctgaaagatagcttcgaaggagaactatgcaaggctggcgccgcggaagaccaccgaacagaccacctgctgcctgtcatcgtcgccataggggccccgccgctgcagctccgacttcacggcaacaaaacaacccgaggtaatcccacaaacacgccggagaagagccgactaccgcaaccattgccgcgtctccgacattgcacacgcccatcatccttgccactgaagcctcgacgcaaaacaccaccaacttccatcgatcccgcttgatgatgctagctccaaagacgctcgtgccgaattcctgc

SEQ ID NO: 12915 - DNA, 521 bp, Triticum aestivum
  Clone ID: PAT_TA_12915
cgacggcgaggtccgcagcgagctgcaggagctgacggatgccagagaggcaggcatgtccttcatcacggggcgcgcgcacatgagggcgaagagcgggtctggcctggtgaagaagatcgccataaactacatctacgagttcctgaggaggaacagccgaggttctgtcaccgcggctaacatacctcatgcctcgaccctcgaggtaggcatggtgtgccaggtctgataccaagtcatcgccacgctctgttgttcatatgtcatgtgtgtgtgtgtgtatattgtagtatatccgtccgaaagaggtagagaggattgatgaagcaggaaaccgttggccagaagttgcagatcagaagtgtgcatagtcttatctatggtctcttgtgttgagttgatctttgttttggtctgccattatcgtcgtcgatgttgtatatttggtcgttgagatgtagggaatatagcatttttgtgtgtgcaaaaaaaaaaacacatcgtcactacagagggac

SEQ ID NO: 12916 - DNA, 707 bp, Triticum aestivum
  Clone ID: PAT_TA_12916
tttttttttttttttttttaataataataacaacaacaataataataacaataataatgataataataatagtaagtaatgaagtaagtcattggaataaacaactcctgtgtgggcggggtccaataatccgggccgttgctatccatgtacacctggggcgtgcgggagagtggaaccaagcacaaccccctactctttaggtcagtctctgcatcttccttctccatcccatcagaccgtacccatggcttgtaatccttgctactacacgacttcatgtaagggtcactcagcagctgcacttgctcatgcaaccacttaatgtaatttatcgcctcatatagaactgatgcggtatcggtcttcccaaatggtgaaaccatctgttgaagtgcagttatcttgtgtcctaactttactttagtcacctggcctttgggagacgacgacgtgggcgagcaggactcgtgcttggacttcttcacgttgccttccgatcccctctcctcttccgatctcttcttccccttggtggatagtgcactactccccttgccacagccgccgctggtgcttgtcttctcaggtaccggcgacgacatctcccgcccttgcttcttgtactccgccgacgacgtcttcgccggggagccggaaggcgcaggctttcccatcccccggccgaacgatatcaagcccgacag

SEQ ID NO: 12917 - DNA, 1221 bp, Triticum aestivum
  Clone ID: PAT_TA_12917
gcggggatcgatccggaattagagtgtggcggccggttccatccatcgaagaccgccggctgcgtccgtccacctcaagagttcaggaatgggatcgagtccatccggtcgatcccagcgaccggaggagcgggaaccagtccatccgctcgatcccaccgaccatctgctccatcccagcgaccagcggagcaggatccggttcgagccgatccaatacagcgcgtggcagagagggagagacacctcctctactggtaacttctctcctctccttcaagctcgcaatgatggcattcttctgctggaaactgctctctcctctccttcaagctcacaatcatggcaatgttctacaggaaactgctctgtccccttcaagcttgcgattatggcctattatcattcattaattcatttgcttaatacctgctaaagtcccaaacctcgcaggtactatataatgcctccctccctggctctctatgcacatcttactccagcagcaacatcttcttcggcgacatgctcagattctgcagcttcctattgtccatttttgtcctcagtcattcatcatctcaaatggcttttggacagaacctccgcaacccgcatcgccgacgaggaggacgacgatgttgacaaccagatcatggactttgcagttgccgactgcgtggcccgcacgccttccatcgaggccggggaggcattgggtagtaagggccaaggataagcgttgcacagcggcggacgacgtcgcccaggcgccaggccaacacatctccaggatgggccttaaggtcgtgccaatgatagcacccttctccaatctctgtgcagtcaacatctccggcaacttcatgggtggtgtatgaaattgctaatgaagggccacgacctgaaactcccgaagggactctttgcaacttaattgcgggtgatgttactttctgatgtgatgttctgttttccaggtttcgggtggaataagtgtagactcacgtcagcttattctgatctttagtttcagtttagggacaattattttgtttattacttattgcttggcaaagccccatgatcggccaagccttcagtagatccttgcttgctccattgcggatacgctgtatatgtatgatatttccaccagatagtcaaggatatgtgcaagtcagcaaagtggcagttcagtcaaaaaaaagaaaaaaaaaa

SEQ ID NO: 12918 - DNA, 527 bp, Triticum aestivum
  unsure (1)..(527): unsure at all n locations
  Clone ID: PAT_TA_12918
ttttttttttttgccaaggacagggntcaccaccttttttttttttttttttactatcatgcaatctggttcagtagtattgtatataccatatatgcaggtacaatctgaaaaaagacaaggtttctcgaaattctcgagccaattctctcatgagattgacagtcagaaaggaccatgagtcgacaagcgcactgtaatgttggttgatacataacaccatcatgtaactctacatgcatctaaaacctatacattcatcgtcgtcgtcgtcatcgtcatcgtcatctccatcatccgagtagaggagtcagggcttgtcatgtcatccaccgagagaaaacatggagacgaggaggaccgagacgagccatcagctaagctagacaagtgtggagtttggaggggtgatgcccatcatcttgtagtaggccttctcggcatccgccaacctcgtctggaacatgccccactccttccggcaccgcgccctcaccccttcccatgccggcttcccgccctccgcc

SEQ ID NO: 12919 - DNA, 620 bp, Triticum aestivum
  Clone ID: PAT_TA_12919
tttttattagtaactattattattatacaataaaaattcccataggatttccatgtctgacaaacatgtggaactacagccgtaatttggccaatagagagcaactaatcttcatacaatatcatcagatataactatatacaacaaatggacatatgaaggttctggtagccttaaacactacatgtacatgcatgcttgacagatctacatgcatccttgctttaagctttttctcaaggttctgctagccttaaaagctatgtacatcgtgcaaaaaaatatgcacttgacagctcccttgctccaagctttctctgacagtatgattatttataggctatatggcctattttaaatgtcagataagtgaacaaaaaaattggtagataggtacaggagggaaaaagaggtacaaccacaaatttagcaggggaatccttggttcaactcacttggtagtgtattcagcagacttggaacaaattgtttgcaagatatatatgttctccagttttcctaataggcaaggaatgatggctgacaatattaatactcgtactaaagaagaaacatgcattagtaacataagtaaactgagagagaagtgaaaaccacct

SEQ ID NO: 12920 - DNA, 777 bp, Triticum aestivum
  unsure (1)..(777): unsure at all n locations
  Clone ID: PAT_TA_12920
aggaaatccaccaggcatcattcgaacttttgtttctgatccgatccctgaactatttaaggtcatgatcaagagattggtaaggtggcgtattctgccaacggattgtgtgccagacagttgcattgtcaacatgtatgaccctggagattgcattccaccacatatagacagccatgattttgttcgaccattttgtactgtttcattcctcagtgaatgcaacatactttttgggtctagtctgaaaatcgctggtcctggagaatttacgggctcatttgcaattcctctgcctgttgggtctgtgctcgtcataaatggcaatggtgctgatgttgcaaagcattgtgttccagcggtaccatccaaaaggatatccattaccttcagaaaaatggatcctgcaaagcgtccattcagtttcaaggatgatcctgaactgctgaacatcactcctctcgaagcaccagctgcacccgagactagcagatcctcggatgaaggcaaggggaagcagcttggcgtacaaactcgggatccaggcagcagatcatccagaagcaggaaatccaaaggaagaacgacacctgctggaaaggctggatgggggggcattcttggagaccaacctccacaagcacccacaagagccccatctccagtgtgagtctgagaagagaganggactccattgggangtcgagagaaccaaggtatccaacgggttctgacagagaaagggacccgttnaaaggcgagagaccaagacaacng

SEQ ID NO: 12921 - DNA, 1009 bp, Triticum aestivum
  Clone ID: PAT_TA_12921
ttttttctgaaaaagataaacaactctgagatttgtaatccaaatggcacacctaaaaaatataaatgtctttgatgcagcttctaaaacagacccgccagctgggaaggtataatgtttaatcaatgtgtttgtcagatacaagacagggttcagctattcttcagatgaaacatcaaattaagggcaagacgcaagaagatacattcccatttatatattttgaagatggttcagtatctagcccctcgacatccttgctttggtatctgcgaggatgcaatgcatgcacttcagctcggacttgagggcctccaccttgtcaaggacttgacgcagagaactagcttcctggatcatgttggcgcctactttttgcagaacaatagttactgattttgtgttatgttcacatagaaccagaaaccgagatacaaatacacgattaaacatgaaatctttatgtggtgtgaaaagatgaacaacatgagagaatctgagtgggggccagaatagatttacgtggaagagcacgatgtttacatatatcgcatcataactgaagtggtggcatgtcaagagcgggtaataagtctgcctctgcgcacttgctgaatggctttatcccaaggaggtggagggagcttcaggtacgtagctcattacctcctacacaacagctataagtaattatgcatggtgctatatttgatctaatcagcatcatgcatcataccttatctgacatattacaaaagtagtatttagttatttatttattacatttgtactacatcaatgattggccgactgaactcccttcataaaatgcaagttatcaccatgaataagcagtgccttgccgcaagatctatatatttccgagtctaaagtaaaaagataaatattattcaccctaaactcttaaaccctcttatactttagacttcctaagtataagaagttgccagttaagcacacaagttttcttttaagtatactcgtgccg

SEQ ID NO: 12922 - DNA, 1042 bp, Triticum aestivum
  unsure (1)..(1042): unsure at all n locations
  Clone ID: PAT_TA_12922
tcgcgcgccatgggtgtccattggaaatggtccacctcccccaggccttccttgcggtaccccctctataggcacacccgggatgctgctcgctaactctgcagcgccggaggccagcgctgctgtaggtgttctgtcgccgctgatttttcttataaacaagggggtgcttcttaagtgtctatctaaatctatgtatgtttctttcctggctggatgcttccggtcgcattcgctttggaatggaagaagctcatgggaagggacaggcattgcagtttaactggttgtatgacaaaggagcttttatcttgcattctgacggaaaattctcaattgactttacaaaggtcgaggaagctgttgaaagccttggcagagagatcatgacgatacaggcaaagggcgacaagcctgccgcgcagtctctccttcagtcccgtgcaaccttgacgcagccgttgcgtgtggcattggagaaaatcgaacacatgcaggtgcctgttgatatagcccctatatttggcacggctagtaagctgctcgcaaacaattaatcaccggaggacagtgattcagaaagttttgcgcctcccattgtacctgagaaactacaaattgtttttttacatgagaaagtacaaatggttgaaacaagatgaagcaccatcctgagtgacacaaatggaaaataacacaaataaatcaatgacttcttaaaaggatggctgttagcatcactgcctaaatggatgaacttctaaaggtnactgttagcatcactgtcaattaccaaggtgtttttaaaaacctgatgtcaacggtaaccttgacatatcactcangaattagacagagacatcagaattcgctgaactttgcggtttgcacgcnaagncanctgtgctaaaatacanaatcnggannatggttgtncctgtagtnattaggtcaatanaaaaagggggccggtncaatcccnaatggtctttacccccanggctctttaatcnacggaaacctggtncantacctgnnaacc

SEQ ID NO: 12923 - DNA, 721 bp, Triticum aestivum
  Clone ID: PAT_TA_12923
ttttttttttggaaggttcattacatctcattgatgcatttcttatgatacataccactgatgcaccaaaaggttcaaagttcagtacaacatcataataataaattctttcatatcattctaagatatacatcaaatatactgaggtaaattaatccaaatagtcaaaagatgccttgacactgacatataatcaaggaattgtacaaaaatttcacagtaaataatctgaatcaacaaaacaaaagagtcaagaaaaaagatcaacatagaactgggctttggattgagaacttctatggaccataatctccaacagaaatctggacataaataaacgcctcttgtcccagtaaatgattgaatagcacactcatacttgcaactcgtgatttgaagatcttcatggaaagatatcgtccaattgggaaccacacgtgtagcatttagaaggcgtccataactacatcatcattaatcaaagggcatggacattgttgcaggttgttaatcgaaatctcaagcacttaaataagttggtgtctctttgatttagctgtacttgaaggaacagacctcccaaggagcaaattatcaaaaacctgtacgtgtggagatggagccgaaattggaggcgccacagatccggccatctccagggcatccgacactcctagcaacggctcccgtcggtgaacggagctgagaaccggagaggcca

SEQ ID NO: 12924 - DNA, 719 bp, Triticum aestivum
  unsure (1)..(719): unsure at all n locations
  Clone ID: PAT_TA_12924
tttttttttttttttttagaagaagaaaaaaggattcacccaccatgttactatataccgccgttccaagtttccacggtcagtattccaatctgttttgtgtttatggttcagtgatcagtggtttcaaaagtggtcatcaaacgttgctgtacttggaatttacagagcaagttcgcttgtatttattgcttgccgaagattgcaagaacggaaaaaagtttcccaatacccctgtgttcttccatctttacattgatgtgatacatctaaaattacctcccgttttatagaagaggctcaacaaggctcactttattttttgacttgtttgaatcaccactaggtttcttcagaattccggtaggctgttgccctggctgaccctgtccctgtgcacccttttgactcaataattttcgataagatggaacccttgcaactgctgatgcagcgactgcagcagccactcggatcctttgatggacatcaacatattcgtccgtctcatcaactatctcctcctgcaaagagttcttcaaatacgtcntcaatgtgatgataccaatgacactacaatatccatatcctctgataactgagcaatgcattngacgtgtncatccggctgcaccaatnggcttaattcaataaccgcagtcggttgccttantacaacaataatngaccaccttcacatanggtncaaggtcaacatg

SEQ ID NO: 12925 - DNA, 1344 bp, Triticum aestivum
  Clone ID: PAT_TA_12925
aattcccggggctgcccacgcgtccgcgttgacctctcttagggaaacatccttttatctttccatcacccttcaattgttgacgttaaggaatgtagttggcagtagtcttgatagtatttttatggtgatggagtacatggagcatgatcttaagggtgtcatggagacaatgacacatatacccaaagtgaggtcaaatgcttaatgcttcagctattagagggtgtaaaatatcttcatgacaattgggtacttcatagggatttgaagacttcaaatctattgctgaataaccgtggtgagttgaaaatatgtgattttggactgtctcgtcaatatgggagcccactaaaaccttatactcaattggttgtgactttgtggtacaggtcacctgaactattgctaggaacaaaggaatactctactgctattgacatgtggtccgtgggctgcattatggcagagcttctcgccaaagaaccactgttcaatggaaaaacagagtttgaacagctagacaagatatttagaacacttggcacacctaatgagaagatatggcctggttatgccaagttacctggtgtcaaagtcaactttgttaagcaaccgtacaacagattaagggataagttcccagctgcgtctttttctgggcgtccaaacctatctgaagctggttttgatctgttgaataagctcttaacttatgatcctgcgaagcgtatatcagctgaggctgcattggagcatccatggttcagtgaagtacctctacctaagtcgaaggacttcatgccaacatttccagctctaaacgaactggacaggcgtaccagacggtatatgaagagtcctgatcctctagaggagcaacggttgaaagaactgcaagcaaaaggcaaccgtggccttttcggctgagctcaaaccgcttgcttgggttttgttcgtactgactgctatgcttcaacctgaatcagtgaggtcagatggcttctgaggtgagatgtgccatggacatgaagtatcagatcttcttggtgtcttcaagcaactgacaacgttctttagcaggctttgtgcttagtgacttgtggcccatcatagaattcttttcacaggattagcactccgaccagattgatcatgaaagcaaatctaacctgcctccatcgtaaggtttggcctgttggctttattggctacacacttacacctgtttcacctttggaacctctgtatgtaaaatattccagattggtacgttgtaaacaatgctcagtgtgttggatttacaataagattataagaatctatcatttttcaaaaaaaaaa

SEQ ID NO: 12926 - DNA, 632 bp, Triticum aestivum
  Clone ID: PAT_TA_12926
agtttttttttttttttttttttgctagatgaataaatctcacaagttgaagttttgataggatgtcttgacggtcgcactagccgctacgagcaaagacaaataaaagtagcaatagctaaacttctctaaacaaaacccgagtctaaaccctaattttaactagctatttattaagaggagcggccgccttgtgtcctggtttacggaacgcaggacgtacggagtccaacttgtacacgcctcagccggaattgatgtttccttcggttgacaagatgtgtggccccaacgtgatgtacatgggcatcgtagcatgcaaggctggctcctccttgcaccttcctcacgcatgcatgtacaggagtacttccttggctcggctgcatgtgcatgggtgcatttgtatggcccgtgtaagcttcaagtgcataatctctcatcttgatacttattttgcaaatgccttcaacaattctacgcaagaaataaattggtgtagtatttttgcccctggtaataaaatataatatcatataatgatcaatacaaattacctgaaaattgtgtcgtgtaatatttgtagacgtatctatgcccacatcagtatctaagataatacaaattgcaga

SEQ ID NO: 12927 - DNA, 570 bp, Triticum aestivum
  Clone ID: PAT_TA_12927
gttttttttttttttttttggaattaaaagatttgcctcttcaattaaataagggaaagtagagtttagagttttacgacgcactcacaaataagcggcatgacaattactcatacaatatgatgtttcctagttttcttacgtcggcagtaacccaaagtttaacatctcctaaaatgttggttaggaggaccgacgggggtgcgcttttccaacggaatacgcggacgtttctctcatttcaaatggtccaaaaaacaagcataatgaggaaaatcattgtatggaggtgagggttgcggtcgtcggttctcttttgccaccactcagtgacaatttcatctaactgtcattcgaagctgtccatgtgcgcgagcccaagcttctctatgattgatcttcagagcctaagagcgtttatgacattaataagtgtcaaaaataattttatattatgagatggagggagcataatactcaagaatttgcgcaaattgcactccttctgtattatttatatactacgtgccaacttaaaagtgcgtactttgagtagttggaggcgccggc

SEQ ID NO: 12928 - DNA, 390 bp, Triticum aestivum
  Clone ID: PAT_TA_12928
tttttttttttttttttttatcttaacttagtgtttctctttttcaacattgagaccacaggcctgaaaaacatccacacactggggggcaatttattcagggaaaagaggcaaaagggcaacatgacaaatactggtacatctccaacgttttattttctttctttgacagtctattattattgcaatgtttgtctcatatcggtatttctgttgagattcagcgaaccccgtctagcaatacaattatggtgcaaccacttgtaattgatgtatctttcattggaagtattattcaacaaatattccatggcagcctaggcagcactgtttaacagatttttgtttatcgcacccctccgtccagtgaagaaccttgcgcgcccttct

SEQ ID NO: 12929 - DNA, 365 bp, Triticum aestivum
  Clone ID: PAT_TA_12929
ttttttttttttttttttgataaattatttttttgtttggctatgcaaaatagaatttggactgacacaaacacgactatacaaattgtggcttatgtaccttgtgtaaaagagagcaagagtacgtggcacaccttttttacaagtgccggttcaccaaggctttggggattgtgctcgagagttttgacatttcctcttggaatgacaagcattccgtcaaggagtggtggctcaatatgtccgtcaaaacttccaccccaagtacgcggcgccgaacatcctcctagtctcctaggtgccatcaacaaggaggccacttcttggctattaccggaccaaagcgaccgaggcaaatcatacct

SEQ ID NO: 12930 - DNA, 701 bp, Triticum aestivum
  Clone ID: PAT_TA_12930
gaatctcaagtttgaatggtgttttcttctcttccttgcgtctcaaacaactccaatacaaaacgagcacccaacaaagcatcattgctacggcatacaagacctcaatgcatcccaaacaaataaacataggaagaagagatatgtagcttcttttcacagggatacatacagcataagtgacataacagaacaggggagagcaggggctgctagtgggtgtccgtcaaagccatcgccaaagccgtacccattgtagtcgccattgccttcggaaggtcaccggagctcgtcgtcgctccaagccatgcgaggccgaggcggccgtcctgctgcatcaagcacagctgcctgcttcagcttcttcctggcagagcatgcaaacatggcagaatatgaagaatcgaatactctatgcatgacagaggaaatactctcaacaaacagtgtaaacaatcatcatatggaccaaaccagaatatggaaaaacaagagctatgttctccccttgtcatctagtaggttctccacaatgattttcttgatattgagcatttgacaaacatttatataacatgaaaacaagggcagaatggcactgttgagacatctaagattatttagcaaaacctaagcaaacagttgcaattcccacattctggcattgaacatagatgatataaccatggcacccagtttaa

SEQ ID NO: 12931 - DNA, 497 bp, Triticum aestivum
  Clone ID: PAT_TA_12931
gttcacgttcatggccgggcaggcggccgggtacgcggcggcggactccgtgcaggcgctgccgctggtgagcacgctctggggcgtggtgctgttcggggagtaccggaggtcgtcgcggaggacctacacgctgctggggagcatgctcttcatgttcgtcgtcgccatggccgtgctcatggcctcctccgcgcacaggaagccgctctgacgcaaccactgctcccatgcatcatcgatgcatggcaaccgggaccttgtgtagcaaagacagagaggctacaatagtaagctcttcaacgaggatggatgttgtgtaatttggacaagtgcgacgtatgtcacatcttttttttaatgatcctaatctatgatcgaagttcgtcggaagtaaaaagtactcaaacataataaaaattacatcgatattttgagatcaaaaaaaaaaaaaaaaaaaaaaaaaaaaaaaaaaaaaaaaaaaaaaaaaaaaaaaa

SEQ ID NO: 12932 - DNA, 840 bp, Triticum aestivum
  Clone ID: PAT_TA_12932
atagtaaatacgcctactcagcactaccaagacaaataataagcagagattgtatacatgctacataaatggcatcttcacaagcctctaccaaagggctatgatgtttggaaacaaataagaaataggggagccttatgcatctggtcacaaaaatgtaaaactcccatgggagacagcataactaatatagcgagcaccatcatgtgccagcactagtagaaaagggatcatttgtcccggttcataaggcccatttgtcccggttcctagcatggatccagtacaccttgcatggatccagtacgtccttcttgaagttctcaacctagatatcattgcttggttatgcgctagtactgaaataaatttcagcaaagagtcggtcaaattttatcgcatgaatacctacatacagaaaaaacgtaacttgaatcctctttgacaacacaatatccgttcaacttgaaacaaccaaactttctacaatatttgttaaaaaaattgagtaataacagtctagcctgattggcacacttcttctgttctttcacctgacatggagccatcacaagtttgacctatcactaacacggcagtgaaaccttgtctgacaaccaaatacaatgtcctaaatttaaactcggccagacatattaagaactttttatctctaggaattatatactgagaggagacgttctaaacaaatagaaatttataggaatctgcagcaaacattgctttctggtaaataatttggcataccttggaacagtaataagcaacatttgtatttatgaggaatgggaaaatcagatggaacagatcctcgtgccg

SEQ ID NO: 12933 - DNA, 867 bp, Triticum aestivum
  Clone ID: PAT_TA_12933
tagcgtcgtcgctcccttcgtagtcggtgacggcgtcctcaatccccccatacagcgctctcaccccgtctagcactccactccacgggtcacatcgtgcctcatcctcgccctgtcctgattgccatcgaccgccacccacgcccctacgctcccattcatgtgcttccctggtccccaagccccactcaggcaagaaagtattgttcctttctattgccacagaatctcagtaaccctgttggcagaacagctgttgggtcacatagtgccccatccccattctgccatgagaatatcgtgccattcctgtagtgcatacactctgttgtatgttcttcctctggtcgaaaattccactcacgcaagcaagaagtatttcactaccttactccagtaattcagtgcatacatttgttgctcgtcgtgcttgcaaccatgggtggagaacaggcagacagaattctggcgaagtcgaacgacgagattctgccgaaatcggcaaaacggcgacaacaatgtcaggcatggaaagcaattgaacatgggtttcgggctgagggagtccacggcgttcttatagccaaggcgatacgaagtagtttttgtactttaatttcctgcttgcaaatattgttgtcaatctatccccatagctccccttgcgccatcttatgaaggtccaagtaccaagtcctgactacatagacccccgcggtcgctccctcccgtcacatgtctcggtgacgccggcacacggcgagcggccgccacgccgagttgctgcaggactcatagaataaatatcttcacaggatgtaatgcttacattagcattagctgatggattagcagaaaccctcgtgc

SEQ ID NO: 12934 - DNA, 1516 bp, Triticum aestivum
  Clone ID: PAT_TA_12934
atgcatcaggcgttcgtccacacgtccgtacaacgatgcatacattaccagtgggcgtcatgcgcagaatagacggttgacgccaagtcgggagggtgcatgcggagcgaaagctgtagagtctgcaggaaattctcgccgcgcgcgacctcgtcggctgcaagcgcttcgccgagcgcgcggtggaggcggatccgcttctccccggcgccgacgaactcctcgccgtcgctgacgttctcctcacctcccaggcgatgctctataccggagagcctgacccatacgccgtcctccaggtgccctccaaaaccaccgaccacggcgccatctcccgcgccttccgccgcctggcgctcctcctccaatccagcaacccccaccccggtgcggatgtagccctccgcatcgtcaacgacgcctacgaactcctctctgatccatcacgccagccactgcgttctgcacgtaccaacatcccttctggtgctccctctcatccagccgctgccgccgctcctgcagctgaggcaacggacttctggactgcgtgcccgttctgctgctacgtccatcagtatccgcgcgagctagttggccgcgcgctcaagtgcccaaacgagtcttgccgccgggggtttgtggctgttgagatccctacacagccgaccatcgtgccgggcaccgagatgtaccactgtgcttgggggttcttcccccttggtttccccaactcggcggatctgggtggcaactggaagccattttacaaggtcttcccttggaacaatgcgccaagtggtgggggtgccattggtaggaactatagtaaccatggtggaggcagcaatgaccggcagccgcagaatgggagtgctcgtggtggatcatccagaggtagggtcaagaagacaactgctcgcaagaaggttggggcggggcccaagaggcgttcttttggtggtggtgtggagagcggcattgatgcatcgatgcttggacaggatgggtgggctgagggtgaggagggtgaaggtggacagcgggaggaggtaagagggattaacataaatgaggaggcacaggctacagatggtactggcagggcaaatgtcacaggaggagttgaggacctgggcagcttccatttggatgttgatccaaccgaggatatactagggaatctgggaaatttacacaacttgccgttcttgagggtggataatcttgggaggatgctgtaactgttgccattgcttgtcatggtgctgaagacctgaagtattgtatgattagctgggttggaacagatgctccaaggactgtctttaccttgttgtagttcttgttattgtgctattatctcatcttggcagtggtagtgtactttgttgtagtttgctagcaatggagtcgtttgattcaggctgccacagaagtactttgtgactttgtggtgtctccaaatttgtcaggatacgtgctcttgtctttggcagacaaacttgtcggtatt

SEQ ID NO: 12935 - DNA, 817 bp, Triticum aestivum
  Clone ID: PAT_TA_12935
ccgtcgccgcgccggtgaagaagcgcgaggtggagtcgcggcgtggcagctcgcggtgccgcgccaaggtcaacaaccgcttcaagcgcgaggaggtcgtcatcaacgggtgggagggcgaccaggtcgagaaggccagcgcatggctcaacaagtacgagaggaagctggaggagaagcgggccaaggcgatggagaaggcgcagaacgaggtggccagggcccggcggaaggcggaggacaggcgcgcgtcggcggaggccaagaggggcaccaaggtggcgcgcgtgctggacctcgccgcctgcgcccggcccgtcgccggggccccccccgcgcccgcggaggccaaaaggggcaccaaggtggcgcgcgtgctggagctcgccaacttcatgcgggccgtcggcagggcgcccaccaagcgctccttcttctgagctgccctgcttgctcctcctccttgatcaacttcccgccattatttcgctttttactcgccgtcgcctgatcgttcaccgcttcgcttcataggaacctcctgtgctcgctgcttcgctgtgtggaactctcgttttagtgttgtatccacatgtatggtgtgtctttctttcttctgcatttctcgtgtttgatatggagtagtacatagcataagaatggaagggtgtgctctgcctgctgagtccaagtgcaagagctgcctgtattttgtttttgtttttgtttttgtttccggtcgaggatattgtgtgtgtgtcaatatgaacaagatatgcagtaaattactgttctatgaaaaaaaaaaaaaaaaaaa

SEQ ID NO: 12936 - DNA, 638 bp, Triticum aestivum
  Clone ID: PAT_TA_12936
tttttttttttttttttttttttttttttttggaaacaattctctggatgagagtgtctcaaacatttgtcaaacttgtgggtgctttgtctccttctgcactactcggggacttgtccccggcgtgcccccccgcgcgttgcacctccgccccggcccagcctgcagctactgctacctactggcccatgtccccaattctccactctcccggctgaatgtgcttccgcctcggcgggtgctacgggctccgcgtcgtccttctgctccctggggtcgctacgggcacctgaagtttcaaaccgagcccaccctgaaagtcatcctgcctcaccagtatagctggcacaaggtctttgtcgaacctgacgaggtgaaggaagccagtgaccattcgctgcaaggttgcgtcgcccacatcaccgtcagcctcaatgacttgcttgttcaaagcagcaaactcgtcaagcccctttgcatcctcatacaaagaagccagcctttccagaatcttctctctgtgcgcctctgcctcatcaaaaagagccgaaactgaggactgaccttcgaaacatcactgaaatgggggcttgtttgcttgataacagcaatcattgattcctccacaagcagcagct

SEQ ID NO: 12937 - DNA, 670 bp, Triticum aestivum
  Clone ID: PAT_TA_12937
ttttttttttccttttcttttttttttttttttttttgccagaagaatgaagagattctacaaggctatgagaaagcccaagtccaggacagatcccatatctgcacagggaggtgataccacccaaggacatgaagcacacactatgtgtgaatgcaagggcagaagaatttgcgactccatgcagaggcctgcaaagtaggcagtttatgtacatggaggcatttacagatggattgccaacttcgtgaaagacataacaaggcaaggctagaagaatgtgcgcatccaagaatggctctgcacatagagaatattaaccagtttagcaatggatggatgctataaagggggatcttcatgcatgcatgggcagcaacttcaggaactgtgcttggacacaaagaactgggtctacaaggctaagctagaagaatgtataaatccaagaagagcccttggattaggtgtagcctttgattataggaatgattccttttaacttgcggcacttcctttttagctcctcgctgatgccactaaaaacttctaatttccatagtgaacttgtcaggccgtccttgggcaggagatttgacgaacggacaacgctcgatcactaattcttgcagaagggttcagaggatgtccttgggcagcaactggacag

SEQ ID NO: 12938 - DNA, 397 bp, Triticum aestivum
  Clone ID: PAT_TA_12938
tttttttttttttttttagaggataaatcaatatacttcattcatatgcactaaacgcattgtaaaaaggtataagtactgaaatggaatcaaaaaaccagaaataagatttgcataatggagtgagatatgattacgttagtgatttttaagagagtgaccagagcttgtagagttagtcgttgagttttgcttctctaccacaacagctccgtcacgcgcgaggttcttgctctggtactgctgcccatgcactctgcaacttagccttcgacaatctacatcgtccttgaagtcccggtgctcttacttcggatccaacaaaactgaaggatccctgacccgacaaatcaatccatctaagcatcaggccaaaggcagcaggagcgaagtgcct

SEQ ID NO: 12939 - DNA, 911 bp, Triticum aestivum
  Clone ID: PAT_TA_12939
tttttttttttttttttttttttttggggattaaaactgttaattaaagtgagtcactaaaattcttaggaaacttgacaaagtaaaaatgttgtcgaacctacgggatgccagactgcatccatgcttgtccacgaaacacaattattttgtaatgtaaaatagaatagttctctgaatggggactgttaaatattgcattggccaagaacataactaagaccaacaccagttaaatatttacattttcgcaaaacttaggaagaaactctcactcgacaattgaatatagttattatctatttcttcggttgggttgcatgactcgtacaacagatcctgcaccctgatattaatttgagaaatcccagtattagctagctccagctagcccataggacataatccacgaaagaaataccattcccaattcgccatcttcctagaggtggattctgttgagctatgcaaaacgctggaggccaactcggagggcaggctcaggcatatgcatctcattcaatagctaaaattagaaattatggtaatttaactcgtctgcatctgtagagattggcttcctgagaacgaaattgggatggctgatcaacatggtctacaggattggctcaggcattatttatcatccaatttcaagaagagaaaccagtagtacatcctgaaccaggaaccacccgccgaggttgcccaacctcagatccaggatgtagctcgtccagatgcaggtccggcgcgagcgggcacggcgatggaccagcatatgatgcagcaatcttggccatggtccaagatctgttaaggttgaacttgtgtcggccaccattctgattgcgacgatgctgcttcaagctcttcatggccatctgcgctcttgtgttcatggtccttca

SEQ ID NO: 12940 - DNA, 747 bp, Triticum aestivum
  Clone ID: PAT_TA_12940
ttttttttttttttttttgcttgatcattggttcagccaatgctgcaagtacactgtacttgtgctctgacttgtgtcactgtatccagtagtgtctctctccttgcaattactattacactgttgaaaagagagcaataaaagagcaaggagttcacgctatctaattaaatggtagaaggagaagattgaaccgtactagcgtcaagaacattcacacatattcaaggctgccagtataaaaaaacattcagaaatatcagatggcaccaaaaggtaattcatgcacattcaaattacaagaaaggttgtttctggctcgtctgcttagctagccaggcagagcacagttaacttcagattttgggtcatccgccaacttttacacatgagattaatataattcaaaaaaatgaaggtcaactcattgaataatttctgaagttgccactttgaaacgtacagaagaatatggcctgaatcggacaacatatattgtagtaatataaagagcatccatggaaaagaaaacatccacaattcagttaaacaatagatccttatcaggccgtagcaaaccttatttttgacaaaattcagtaaaagcttgatcattatctgactatgaaaaaatcgtaataccattagctgacacacacatggatcaaatggggtaggaggaatagacctgtggggaaagctacgccggcgagtacgctggtgggattaggcgggatgatcaatgtg

SEQ ID NO: 12941 - DNA, 640 bp, Triticum aestivum
  Clone ID: PAT_TA_12941
tttttttttttttttttttgttaataacacaacaatatatattttgaataaccactgacgatacaaactttaggtacttttgacacacacctaactaagaactaagaagagatcgaagggaatgggctagcaaattttacacacacaaaggcgtacaatatcaatcagaccacaataagcacgaaaactgtagatgaatcataaaatgatttaacaacacgcatgcttcacccggactgctatggctgatgctgtttgagactcatcaaggttctgaagatacctgcgagcacaccagtaatagagagcatgacgacgattgtcttgaagttgttgtagacgaacctatgcagggctatcctcacaggtctttcacgcttgaacttatctatcttctcagtgatgacgaaatagcggtagccaaggcgcaaatggcatgcgagactcttgaagaaaacaagcagctcgtggttactgagtaagctgcgaacgaggtgcttcgctcgcaacttgtgcacgtcctcttccttgtccatgagcattgtcaggagggagatgtatgagctaatggcgaggccatctgatggccatttgctggatacacacatctcgtaagctgccatgttgacaagccagcaag

SEQ ID NO: 12942 - DNA, 407 bp, Triticum aestivum
  Clone ID: PAT_TA_12942
tttttttttttttttttttaatttaacgcctataggtgcatttcactcgaacaaaagcgttctctgaggttattagtacgtgatgattgttcacagcacgatcggccgtaggcttgagagctcagacagtggatgtcgcctgcaaccattttcccgtcgctcgacgatgaaacactgataatttacacactaccagcccgcccctatggcctaactctctaggcccacgcaaagtccatccatccacacgcatgcgtgcgtaccgaatccagcccattaagcattcgacttcggtgcgctagccgcctcagcgtcaccttgcgcgacgcccacgcggcgccgcgccaccgcgtacgctagcccgagagccgccaacaccaccaccgctgccccgacgaacacgccgg

SEQ ID NO: 12943 - DNA, 440 bp, Triticum aestivum
  Clone ID: PAT_TA_12943
ttttttttttttttttttatttcatcaacttttagaatcactattctttcacaaccacaaaaagactgtaggtatccatatcgcaacagccaacaatgtgacatggctgcataaaatggcaccaggaagggggttgcggaacagttgagctcttgccatcaaaactggtgatgagaactcaaggccactttgttacacagacaaggggtcctgaacaaacccgacaagaggaataaccagggaggtacacaagtggatgtatttctacaagttacctccgcctcggcggatcagaggacctgcgttgttgttgtcgttgttgttgttgtctggcattggtatccggtttctccgtgtccggctgtttgagctttctcaccagatcatccgcatatcgtctccacattgactctcgatctttgcttgccactttgctgtac

SEQ ID NO: 12944 - DNA, 968 bp, Triticum aestivum
  Clone ID: PAT_TA_12944
caagaaaaaaaaatactgaaaacttcgactgggacaaatttcggagacaggcctttgctgatggccacatgaaagaaaggaagtctgaaagaagagactctgttgattgggaagcagtacgatgtgcagatgtacaaagaatttctcaggccatccgggaacgaggaatgaataatgttttgtcagaacgaatccaggaattcctgaatcgcttggtcagggatcatggaagcattgatcttgaatggttaagagatatcccccctgactcagcaaaggactacttgcttagcatacgtggactggggctcaaaagtgttgaatgtgttcgtctactgacattacatcatctcgctttccctgttgacactaatgttggccgcatatgtgtaagactgggatgggtgcctattcaaccccttccagaatctctgcagctacatctcctcgagctatatcctgtcttggagactatacagaagtacctttggcctcgtctgtgtaaacttgatcaaaaaacactgtatgagctgcattatcatatgattacttttggaaaggtgttctgtacaaaaaacaagccaaattgcaatgcttgtccaatgagaagcgaatgcaggcatttcgcaagtgccttcgcaagtgcacggcttgcacttcctgcacctcaggagaaaagtttggtgatgtcgagcaatcaattcagtttccagagtggtggcatgccaactccatactcaactgtgcttcctcagcttgagggaagtgcccagggacaggatttttgcactaacaattcagagccaattattgaggagccagcacgtccagcacgggaagaatgtccagaaactcttgaaaatgatattgaagattacgatccagatactggtgaaatcccactaattaagcttaacttgcaagcttttgctcagaacttggaaaactgcattaaagaaagcaatatg

SEQ ID NO: 12945 - DNA, 1778 bp, Triticum aestivum
  Clone ID: PAT_TA_12945
ccccccctcgccacccagcccccccctccctgcaccggctccccccgcaccggctgagcggcgaggaggtactgagtggaactcaaagggaggaaagcccaagcccaagcccaccactaagtcccactgttgcacccgccgccacccccgcactgactcggccgagatcgggccgctactcgatcctgcctatcacctccgatttgcctgaggtcaccatcgtttgtactgatcgcgcgcaaacccgttctactgctgtgaatgactcctcatgcatacgtggctcccgcctcgaggctgctcgcatctgtgatacgagctgagctatatcttcggtttgattggtcgctatgggatgttgctcttcctcccttctcgaggtttcggggccccctgtttcgccctgtcgtgtccggagtgtgtatctatctctcgcccagctcttctttggtttcttgttccatgctgggagccatggatgagaggatcccgccgccccctttcttccagtactcgccgtctggcgtccattcttcccctcaccaccacaaccccatcaggtcgtctgcctccgagagggagaggtatattgctgagttacttgccgagaggcagaaactagttcctttcctgcaagttcttccattttgtaacaggcttttaaaccaagaaattctgcgggcatcttctttgccacctaacccaaattttgttgaacctgagagattcgattatggtagcccattaagattagctggccaccctatgaacggtcaaccaatggatatggagggatggactggaatgcatgcagagcatatggggatacaccattcaccatccatgggctgggatggtggtcctggagttgttggcggccctgttgtgaagaaacttgtcaggatggatgttccagcagaaaagtatccaaatttcaactttgttggccgtttgttggggccacgaggaaactccctgaaaagagttgaagctacaacacaatgtagagtctatattcgtggacgtggttcagtgaaagatactgtgaaggaaaacaagcttagagctaagcctggctatgagcacttaaacgaaccactgcatgtgcttatcgaagctgagttcccggcggatatcgttgatgcgcgactaaaccaggctgtggtcatactggaagatcttctcaaaccagtagatgaatccatggattacttcaagaagcaacagctgagagaattggcaatactgaatggcactctaagggaggaggaaagcccaagcccaagcccacatctcagtcccagtgtatcacccttcaactccaccgggatgaaacgtgcgaaaacgggccggtaatcgaccgtgcttctgaatactgatttgcctgaggtgaccatggtttgaacagattgcgcgcaaacctgttctactgctgtgaatgattcctgatgcatatgggggaccggccttgaggctggtcgcatctgtgatacgagctgagatatatctttggatgaatggtcgctatggaagaaattcgttccgttcggtctgctcgtggaatcggggcctgctgtttggtcttattgattattctctgtgtatctatttgactcccaaatattaacgctgtcggttcgggttagttaacgtgattgatctgtggttcaaagtgaaatagttgtggacaataatcagggtttttgtcagttgtaaaatgtccgaggggggttgatgttcttgtgaaccgccaaaaaaaaaaaaaaaaaaaaaaaaaa

SEQ ID NO: 12946 - DNA, 667 bp, Triticum aestivum
  Clone ID: PAT_TA_12946
tttttttttttttttttttttttttttttttttttttttgtaatgacaacaaagggaagtggttccttttatgtacttcaagatccgctttatagcaaccatatgggacattgtatgttcctgcatggatctacttacaattcccactgagtaagcaagatatggcctggtgttacacaaatacctcaggctgcctacgagactcctctacattgtaagatgcaccatctcttcatccttttgacttgtgtagcttcagttttggttccattggaatctaacttacatccctgccttctcatgaattttcaaggcatatcatgtttggcaaagtgtgataccatctgggccttgagcaacttcaatgatcaaatactaggatgacaatccaagaacacgcatcttgaacaaatccatcatttgactcttgaagtttgcaaacctacatgtttttcggtagaccttaacagtgactgcttgtgtactttcaacagcatgagtgatcttcttcattaactctcacatccagcatactctcaaactgacaatatcgattattggtttaatttgcggaaaggagaacgacagggataggtcacaggccccatcaatcatttagctgctcttttcctctttttcatgtgtttccttcatcaatcaatctgct

SEQ ID NO: 12947 - DNA, 1002 bp, Triticum aestivum
  Clone ID: PAT_TA_12947
ccccccgcccggctcgtccccctcgccgtggcggcgccccccgtccgcggacgcgtggggtctccctcagatgcagccgcccgccgaatcgaatcgcactgccaggttcgtccgcctcgccgtggctgcgtcactcctcggacggaggcgacgatggagggagccactggcgctggccaggcccccggccgatggatgcgccgggtcgtcgctcctcagggacagcccctcctgccgcgctggatcacgtggcagcctagggaaccctaaccagcccccgatcttcgcatctctccctgaatccctcctcctccctccccaaatcgacatggatctcgcgctgctggatcccctcctctccctccctgacttgccgtgaatcttgtgctgcgagagctgctcctatcccttccctggccgccatggatctcgccagccaccatcgaaggaagccccacatacccaagcttaatgggcttgccagcggtgtcgaggtccttgccatggctccgagcctggagagtagattgaggtggacttcggttacaaggaagagctccggagggagatgatgctccacttgagagagcaagagaagataagacctgtatagaagtactactccatctgcaagcgttcgttgctggatttctttcacgcctatgtggtgctgtgccatggtcgctctccctcctccagggactgagtccagagatacacaacattcaattatgatgatctaggaaattaatgatcattcagtcattgatgatataaaaagaggcatgaaggcaacaaaaggggcagtattttgatctcatgtcatctcgcacatagattatttgttcttctttgcataccattttattagttatttatatatacccggcgtatcgccatattactgtttcttgaaattgccgtatcgccggtgcttcacagctatgaagcatgaggctacactgatctatttttagacgtgcacatgttctatcaagaagt

SEQ ID NO: 12948 - DNA, 585 bp, Triticum aestivum
  Clone ID: PAT_TA_12948
ttaacaaacatgttcatcaggttactgctttattagccttacagattacactcaacagactcgcaaaaagtaataaaggaaaaaaagagggaaagttacacaacagaacaacacccacacaactcgatcatggagttcagagcaacacacacagtagaaaggacgtgtctttctgtttctttacaggaacacgcacgcgcgcaccagtttattatctgaagttatgaacacgctagcaggcggcacaccatcttaaggctacgagaaccccacggccattagccacgtctcaaaagttagtagaggctagctagctctacatgccgtccaggttcacctgggcgcctgagccccccgacaccgggagattcccggacctgatctcgactacttcttcggtctggaacttctccacaaatgccaacttgctgggcttctgtgcatctgcagaacggaaagacgcgcacacacgtagcaaatcatgagcattgagcaactacaagataatgttgactgcaacatgaacaacactgttttcagagcggcgctcgtacgtaccattgtcgtcgtcggggcggacgctgt

SEQ ID NO: 12949 - DNA, 890 bp, Triticum aestivum
  unsure (1)..(890): unsure at all n locations
  Clone ID: PAT_TA_12949
cgtgcgcccaaacccgattccccgatgcaccgacacacgcacgatctaaaattcctcctcctgcggcggcggcggcggcccagatccctcaaccaagagctgggcgagtacgaccaatggaggcgtgttccagtggggaagcacctcagagctgatcagatcggagaggagcagatcggatgactcctggccgttgtgtcgccgcccacccggttatgcagagcagatccgagctcgccggctactaagctccgccctactttgtgctcgtcactggtcactgcctccccatccgaggttccaggagcggtgggttcgtcgcttcctccttcacctcgtcggctgcaagcagcaatgcagttcattagcagatacaaactgggattagcagcacaagaagctcaatgagcaagaagcactcggtgagcatgaagcacaagatgcaaaggctgtagcttttatgtgatgtaccaccaagatagtaatgcagcttttaatggccgtgcttgttgggttgtgattattttagtctacttagtcttgcccgtgttgtaacaaaagtaatcctctcatgctatgtagcatttgatatgtatgtatctcttctgtttgtgtcttatatgggatcgtcaggtttgaaatgtatgcttaggtatgcgtgatgccatctccagttctgttttcctgtacttttccatgtcactgctcatatgggaagatgccattttataacttcaatttgatgatgtattgctactgttcttagtggtttggtagtctattttgaaagttctgtttcaccggtaattacttagataaccaagttggaaggttgcagatgggtagataaatcctcgattntaggacaactcaataaaaaatataattac

SEQ ID NO: 12950 - DNA, 1420 bp, Triticum aestivum
  Clone ID: PAT_TA_12950
ctgctccacagttgatgttgctaaaatctcagtggaccaaagttattctgttttattgcctcaactgcggagtgacgagacccaaaaactggacttgcagaaactgattttctatgccccagtgctgagccgccgtgatgacaatcttttttacatgatggccaaggtgaatgctgaagacgagactgcctgggccatcgcagttgacatggaatgtgcagctgtggaagcaatggccccgattactcttggacaggaccactaccacattgcaatgttctgtccatgcgacctccccaagtacctcaacatgaccccaggggcagacatggataatccagcggacaagtgctctaagcggatgcctgttgccaggtggagtgcgaagcagtgtgtggtgcaagtgctgtggactctagactggcttcgagaacttgatcaatgcttggaaattgagaggtcaacttactacgcatgcagattattacttcagttttctccagtatcatctctgcgttccagtatcagaccaatggtaaaatatgcttcctataatggtcaagatgaagctgcatcaaaggctgtggatttttgcctaagagctttggaagattttgatttggctctacacggatcaccgagtgatccatcagcatctgttgaagccatgcgtagcaaaatcagcgatgtcattcaagctttggacaacgtcatgcaaattgtgccatcaacactgatacaaaaagaaaggttgcttggagatgccagcggccaaaaaagatcaaaggcaacatttgaaacttgtgagaagccaatcgagacaaagaatacagcccatgggtggctgcaagtgagattcaagcccattcatcaggagaggtatcaatgtcgcaggggatgggggaaagctagccatgaacaacgagctgtggtcgatgcaaaggatacacctggcaagtgggagcaagggaaattcaagcccagtaattctcgaaggggaaaggcggtggtcctgggtgtctggttgttgcctctctgcttgctgatatcgatggtcgtggttatgtcatcttcccgccattatgtaacggagccggtatcttactgatatggaatgtctgtaggagcataagcttattgtatatggaatgttgagttatggtttcggccgtggttaatgtatgaacatgatcatgtgaaggtgctggttgctgctacctagtagacacctaattgtagtactacatatgttgttgctacttgctataccttcttgctgcttgcgtgcatgaagaaactggtggcaggttgtgctcttctgaaaaaatactatgacgcatgtattattttggaagccaatatacgtttccacttgtaccaaagatatataaaaagattaaagattatattaaaaaaaaaa

SEQ ID NO: 12951 - DNA, 392 bp, Triticum aestivum
  unsure (1)..(392): unsure at all n locations
  Clone ID: PAT_TA_12951
cccacgcgtcggagaagagaggagagccatcgcggcaaccacaaacaaacccagctgaaaggcgcacacaccaccgtgcaggttacatgggaggaggccgcggtctggtcaccgggttctacgtctggggctgggagttcctcaccgcgctcctcctcttctccgccgccctctcctgctagcttctcgatcaacccttgaatcttgattgattataatccagttctacacatacatagatacaccaaacttactagtattaggtagagagacatctgttaggtgattgtgattgagccggcgaggatggccggggcggcggcgcagcagcagcagaagggtggtgatggtggtggtggtgtggtgaggatcggcggnngagggccggcgcc

SEQ ID NO: 12952 - DNA, 1684 bp, Triticum aestivum
  Clone ID: PAT_TA_12952
gttttttcggacgcgtgggcggacgcgtggcaaggcaagcttagaacacaaattaggatccgtgagccacgccgccgcggcaaccacagacaaacccagcaggaagccgcacacaccaccgtgccggttacatggggggaggccgcggcctgctcaccgtgttctacgtctggggctgggagtttctcaccgcgctcctcctcctctccgccgccgtctcctgctagccgcctctgcttctcgatcgatccttgactgatcatatatacatagatatatacagcaacttattattagttagagtaatctgttaggtgatgaagcccgggacgctggcccgggcggcgacgcagcagcagcagcagaagggtggtggtgcggtgagggtcggcggcggagggccggcgccgttcctgaccaagacgcaccagatggtggaggagcgcgggacggacgaggtgatctcgtggggcgagcaagggcggtcgttcgtggtgtggaagccggtggagctcgcccgcgacctcctgccgctccacttcaagcactgcaacttctcctccttcgtccgccagctcaacacctacggttttcggaaggtggtgccggaccggtgggagttcgcaaacgagaacttccggcgaggcgagcaaggcctcctctccggcatccgtcgccgcaaggccacggcgacgacgacgactccccagtcctctaaaaccagcggaaccggcgtaaacgtcgcgttccctccgccgctgcctgctctgcgtcccgcgtctgccagcacgtccggcaccggcaacgaccacagctcctcctcggcgtcctcgccgacgcgcccggatctcagcagcgagaacgagcagctcaggaaggacaaccacgcgctggcagcggagctggccctggcgcggcggcactgcgaggagctcctgggcttcctctcccgcttcctggacgtccgccagctggacctgcgcctgctgatggacggagacatgcaaggcgcggccggggccggcggcgcccgctcggcggaccaagagcactgctgcgagaagaaggtgaagctgttcggcgtgatcctcaaggacgcgtcggcgaggaagaggggccggtgcgacgaggcggcggccagcgagcggtcgatgaagatgacgaggatcggggagccgtgggtcggcgtgccgtcgtcctgcccggcgcgctgcggcggcgggaactgatgggcgcttcgccgtggccggacggctgcacccagcaggcgcgcgcgctgttgtacatttgtacgcgtgcatgggcagcatggctacgctgatggcaagttggcaacaaagccagcaatggacccattccatcaacgttgttcttacaaacaaaactttagaaaaagcagactttggacacaaaagtccatagcaatgtacccgtgtaagaaatataagaactaatgcaggtacgctgggaagtactgtaatagggagattggaagatggagctctcctccttgtcgttgatcagattacacacataaaggtttgcagaactaatgctaggagcactaagtttgacaaggtgtaaagctatacaccccatttgagatctacagattgtatcctgaggttctgtcttgaaatacatattgatattcttttctcctccaaaaaaaaaaaaaaaaaaa

SEQ ID NO: 12953 - DNA, 579 bp, Triticum aestivum
  Clone ID: PAT_TA_12953
tcgcgagctcgtcctagaaagcgtgggccgagctgagcctactgtgctgcctctgcctgcaccaaccaagaaagcaaagcccaatcaagaagaagaaggagaatgggggaggcgccgtgcagcgtggtggcgccgcgccgttccccggcgcgcttccgcctgccgcgccacgggctgcgccgcaaggtccacgtcgtccggctcgggaacggtggtgccggtgccggcgcacgggctggcggggtccgccgcctctgcggcctccggcgtcggatcaagctccggtggttccggagcgccatgtggcgcctggccgagctctgcgtggcggtgctgtcggggcccccggggacggccgacgccccgccgtcgtggaccggcgtggagccgtgcttcgccgcgcccttcctgccggccgcgctggtgaggcgcgcggggcaggagtagctaagcctagctggtgacggtgctgccctgtgaccatgaagacagcaacactaatgttattacagtactcttttttaaccgcgactcaagcgatttgttgatgtctggaaaaaaaaaaaaaaaaaaaaaaaa

SEQ ID NO: 12954 - DNA, 763 bp, Triticum aestivum
  Clone ID: PAT_TA_12954
tttttttttttttttttgtttctgtatatacaaatcatatatacatatattccagtgaccgcaaaatgctttctgccgcaaggaattaataccctcatctcttgttgttctttaaaattcgccgtttatcttggacggatccacttccattataggccggaggcccagtctagtgagatcaacaggagagccataatcttggcacgcctccacttacggtgtcatacgactttgcagagagcttgagcccttggttggaggccctgatgtacatctcataggcaagcttgggcttaccatcctgcacaagggcttcgatcaacacctgatatgtgacctcactcggctcaaccttgtgcatcttcatcctgtggaaccactcgaacgccgcgccgctcctcgtgcaagcggtgatgatcgcgttgaaggtcacgacggtcggctctatctttcgcggacaccatgtcccggaagaacggcgtccgccttgtcatggtcgcccttgccggcgtaaatggacgccaggatcgtgtacgcgtgcaggttcgggtcgacgccgaccttgcgcatgtgctcccacaccctcagcgcctcgtcgtacagcctgcccttctcgagcgcgctgagcaatgctccataggagaccacgtctggtttcagcccccggtctatcatcctcttgaacgtgtccacagcggcggacgactcggccgctcgggagcaggcgaggagcacggcgttccactcccggcttccgggctcc

SEQ ID NO: 12955 - DNA, 611 bp, Triticum aestivum
  Clone ID: PAT_TA_12955
ttttttttttttttttttttttatcttgtgaaaatatctccatcatagcttggtacagagtacaggttacacatactgcaatagacgagcagccgcactgtcctagtactgctcactaaacaaaagtaatattaaaaaagactctgttacgagttcatcaccagccgaacaaacttattgatatttggagtatccaaattgctacagtaaccgaaggcacggaagggactccagaagtattggaaaagactataggccttatccttgtacattcatgttattgcctgcagtaaaaaaacttgtgaatgggtggatggtggatgtcgtacattcggcgaaaggattgctttcaaaaatcttcttaaactgcaaggactcaagatggaccatgaagacgcctccacttgttgacacaaatatcacattctcatctccagctacccccaacaccgtttgcagatttgtccactcgcctggtctcagcggaagaagcttgttcaactcaactgcttgtgccggcatccatccagcaactccatcaaaatcagtcgtcctcacccatagttgagctacgaagtcgtctgacacaacgatgaagccaagcccgccac

SEQ ID NO: 12956 - DNA, 570 bp, Triticum aestivum
  Clone ID: PAT_TA_12956
cgtccggccggggttcgggaccgtgggcgcgcgctgcgtcgtcaaggccaaccacttcctcgccgagattcccgacaaggacctcacccagtacgacgtcaagatcacgccggaggtgacctcccggtgcgtgaaccgggccatcatcgccgagctggtgcgcctctaccgggagtccgacctcggaatgcgcctcccggcctacgacggccgcaagagcctctacaccgcgggcgccctcccgttcgacgcgcgcgagttcgtcgtccgcctcaccgaccacgacagcggcaccggcgtgcccccacgcgagagggagtacagggtcgccatcaagttcgccgcgcgcgccgacctccaccacctccggcagttcatcgccggccggcaggccgacgcgccgcaggaggccgtccaggtcctcgacatcgtcctccgggagctcgccagccagaggcacgtggcgatagggcggtcgttctactcgccggacataaggaagccgcagcggctcggcgacggcctgcagtcgtggtgcggtttctaccagagcctccggccgacacagat

SEQ ID NO: 12957 - DNA, 625 bp, Triticum aestivum
  Clone ID: PAT_TA_12957
tttttttttttttttttttttttcgacaaagggtggattttattgactcaatatgaagcatcaagagaatacaaacataatgaccatacacccggcctctgcatagttaggatgcacacagccaacaccaacacacacaaaaaacacttcgggcgaatagcaaagtcttataagaccaaagctttgcctaagcgtgaagaaaaaaaatgatcaaatccgcgatcgacaaactataacaatgacatggttgccggccacgaaccttcatgggatcgtgaggtcttgtaaccctgcccgtgtaagatgtaatcgtgcggccccccccgcccgtacgcgagccatggcgccaactgtagcaaagagtcaccacacttcaagatcaagtgtgccgccgccaactgtagcaaagagtcaccacacttcaagatcaagtgtgccgccaagagaccacaagggccatcagacggctccatgcacgaagatccaagagatgcctgatgagccaccgtgcatccatgtaagcatccatcatgtacctccgccccggcctcgctcatgcaaatgagatgccttccagccacgatctggagtctctacgcatgagaagctgcgagcctgcgacttg

SEQ ID NO: 12958 - DNA, 1238 bp, Triticum aestivum
  unsure (1)..(1238): unsure at all n locations
  Clone ID: PAT_TA_12958
taaacccgagagtacaaaatccttatcccaaccgtcgccccggcaggttgctctcctcggtcttctcctcactctccccgaaccctcgctccatcactctctccctctcccactcccactcctacttcggcgcgcgctcagctgaatcctgccgcaggagcaatcgcgtcggtgcatctgtgcggccccaaggtggcgtccgcggcgatggcgaagccggcgttggcggacgggctccgcgtccccacttcgtccggcgcctgtcccgtgccgacgggggggaggctccggggccgcgtcgtcagggccggcacggtcgggtcccccacccctctttgtatacgacgcgttcggaggctagggtgctaaggcaacgaggccggctaccagggcagcaaggctagctgggccggagtatacttttgtgaaacaattgagacatagggtaatagtgaagaccaagactactgaggataaaaatgctggagggatattggcagcaacatcgtcgagatgcagtgttccggttagggtgccaaagttatttactcataaatacgctggcaccgacatggaattcaatgataccacccacctctttatgaaagaagctgaaatctttggtatcttgacactgatgacgtgaaagatctgaagccactgaggtgaccgtattctccttaaggttgcagggtctgaagcaggaaactgctggcggtttgctattggacacagggcgtcgagagagaaaccttgtgttgggaacagtggttgctgttggacccagggccattgggtcgatgatggcagcatgacgccattgtcaatcactcctgggaagcaccgtgctgtactccagaggatgcaggtagcccgtgcaaggggtcggcaaggtgagtacatcgttctcgaggtcatcccggacgtaagagccgtgctgtcatcatagtcttgtcctggccagcccagctcatgtgaactaggtaatttagtaattaggacatatagcctgatagcttgtttgtctttttctgttgcttttgaattggggaattcttttcttttctatattctgtcatggtggaaatgattttttaataatatgatgtcggcttatatgaacagaaaaaaaaaaaaaaaaaactaaaagtggaaaatgctgcttgactcgtgtctagttctctctgaccgggttaagacnttcaaaannaaaaaaggggggggngcnnggtacccaa

SEQ ID NO: 12959 - DNA, 898 bp, Triticum aestivum
  unsure (1)..(898): unsure at all n locations
  Clone ID: PAT_TA_12959
caggctagaactgaactttgataatagacatgacttctaacagggtcatcgcttctttccaacattccaagaaggaaatttgatgtttatgcaggatttccagctaagaattaagccacagaaaagtgtctgctgcatttacaatcagttcaggttgagatgcagcatattctgatagatttagggttagggctctggtacaattaaatattttccagatgctattaactaaaagtagtggtgttctactcaatagaccctccaaaaagaaagagatattggcatatcccgcttacattatcatgggcacagaaattgtgtatccgaataaacttgaaatttcccaaatgtcaacctcctccttcagacaagttcacttgacttgcggtgtatcgtccaactgcttccaggtgagctctgcaagcctcgttgctccatgtcccttctcacccgctgtgcctcctcatgcatacccaagcccgaatagatattggcaagcgaaataaagttccctgcattctctggttcaatctcaaacaacgctctcgctgcaacttctgccagccccacctccccatacttcctgcaagcagcaaggagagcaccccaggcctttgcggtaactctaaccggcatcgtccggataacatcataggcctgatgcaacctccctgcccgtcccaagacatcaacccggccgcgtgggcggtcgcctcgtgcttcgactccatgcgtcttggttaacacatcaaagtacttcaaagcctcatctgcgcgaccagcatggccgcaggccttcaacacgccaaggaacattatgccatcaggccggnacttatccagctccatacgcctgaaaagcgacatcgcgacgtttccatggccatggaacgcgtac

SEQ ID NO: 12960 - DNA, 654 bp, Triticum aestivum
  Clone ID: PAT_TA_12960
ttttttttttttttttttgagaaactaatacatcaattggattatcaaatgttgaaatgattgtcacacaaaatccattcttacacttactacacgctatatagcaagaaacatacagacacatacatgcttatattctgctggagaacatgagcaccacaccaacaatcaacattgcagtaagaaatcaagacaaaatcttccactggcagcatcagcaccatttgtcaagcaatggtttccccagcgggcggcaatggcctagggcatgtcaccttctgcagattgaccatgtctgccttgggaatcgaaaggaagaggctctgacatgtgatgcctatccgccagtgtctccattcccatgaacgaccaaaggagataaatgtaggtgaggcactccccgccgtcacccaagctcttggcatgcaggtagcccctgcatctgctggcggaatagcagagcatctccacccacacgccttggatcaaggtccacctctcatcgccacccaactccatcagcgctttggcaagcttgcatgcattggaaaccatatcaggtgcagagggtgacaagttaaaaatctcacgcgccaggctttcttctgtcggttcgagtagtcccttgctgttttccacaattttatcgctggc

SEQ ID NO: 12961 - DNA, 563 bp, Triticum aestivum
  Clone ID: PAT_TA_12961
ccggttcgacccacgcgtccgggcgacgatcggcattgcacctgcgcgacggcgatggcgcgatcttgctcgacatcagcatcggcttccggcacggtctccggcaacggtgagccccgtccggcggatgatcttgagaaaaggcagaggacgcagccgggggtggtgtccctggaacatctgctgcaggggcctgacgcggcgccgcctgagtatctgacgctgtcactcacgcccgccggggaagtacagccgcgggagcagccaggggaggtgacgctgaagcatatagacgcgccgcgtgactacctgaagccctcgctcgcgccctcggatgaagatgaactttgcgcaggaccaaacgccgaccgggcgtcgagcggcggctctgtcgtccaggaagatagctcggccgcgtcgagcgatgtggtggaaacggcgctcgtgatcgtggatgccatcgcgccgccggcggccaatgcgaacagtattctaccgcccaagaagcgaaagtttgcggcttgtgtttaccaaggaacgccggggaatcagcgccggcagca

SEQ ID NO: 12962 - DNA, 451 bp, Triticum aestivum
  unsure (1)..(451): unsure at all n locations
  Clone ID: PAT_TA_12962
tttttttttnttgaaagttgtgaacatgcatagccatgctcatcgattatttttcatatacactaccacagcattacaggaagcttacccaaacccaacacacgacttggggtaaaactccactcggacattaagtactgtagtatcaacgcgcgtccttgcacacggcgagttcagtgcggttagaccctctgcactgcggcgccgtggccgccgccgacggacgccagcgcgctcctcaccgtcacggcgacgcggcagcccttgagcgcccgaaagctctcctgccgcaccctgaagcacgtcgccatggccgtctcctcgtcgtccgagaacgacgacgacgacgacgagtgcagcctgctgctgctgccgcccgcgcggcggaaggacgacgtcgaggaggacgaggacgacccggaggagaaggatgaggtgggcgataccgacg

SEQ ID NO: 12963 - DNA, 758 bp, Triticum aestivum
  Clone ID: PAT_TA_12963
tttttttttttttttttttttttttagtaaaactgagatattcatcaatcaaatgctaatacccgtatgagaaaaccagcagtgtaagaaatcgggtcatagaggagctcatacagagtttagtaccatcgatctggccgcgtggatgccggatgtagggagaaacgatgccttctcttcttgcttccaaatcaccacaatatagcaggggttggagccggctgtagctgggaaacaaaggatgacgatggagagtcggcggtgctgagccgcctcccttgctggcatcaactcctaccccctccttccctgaccggcgtggtggtcctccccctctccctcggcttagccgacacgggatgaatcaaaacaaccaaaatcaaaagagatataaaattcccaaccttgtcgacgtgatctcaccagtggaagtgagactcaaattggttcctgacgacattgtagatcagcgccgggtagaacaacatcgatcgctgtgcgcttcgcaccgaaagccatctgcaccctcttcctcctccgccgctgaaacacaaccgacatccttgccacacaacttcagctgccaattgtcgacgccgtcatcctcccgacccagctgtagcttccccttcccatcgaccaccacacctccacctccgccacccgaatcaccgggaagcagcaggagggccggcgaggggaggctatggcgtcgcaggtcgacgatgagggctcaagggaggaggagtgaggagagg

SEQ ID NO: 12964 - DNA, 862 bp, Triticum aestivum
  Clone ID: PAT_TA_12964
cccagcgtccgatcgaatcgacgcgaggcgaggcagaggcggcgacggagacaagcgaaaaggaaaccgcggaggaggcgaaggaagatgcaatcatgttccggcggtccgtcggttccctcctcgcacgggggttcgcgccacgtgcgaccccaaggactgctcctgcgcgctctctccactccttgagggatctcgccatcggtaatggccttcttaatgcttatctggttggttaataatagctggtgcaagtcaaagtgagtggctggtgtccttggaaactgctcgaagtttagtttgctgctacggctgctgctggcaagctgaaccacaatgtcaagtttaagaagccggacatgaaggacaggtttgagcgttggatcgtcgtgcacggaaagacataccgagatgaggaagagaaggctatgcggttcgaattgttcaaggcctccctcgagagtgtggaatcgcagctcccgtcggtcgaggagagtggtgtgcttccaggggtaagctgttttgcagactttacagatgaggagattcggaacttgctggcctttcccgacggaattgacgagtctgagtacgacgagatggtcaagtctgcctgggccaagcaacagaaaggaatgaaaacaggagagccattgaaatggaggccaggtatgactcagggcgacatgcgggcaactcaaggttctgcatagaatggtgtctatttggttaataatatcatatctggtgaaagtcaagtggctggtgttcttggaaactgctctaagtttagtttgctgctatgttaactctgaacggagaaacatgtgaggaccaacaatgttgtttgcttgatcaaaaa

SEQ ID NO: 12965 - DNA, 899 bp, Triticum aestivum
  unsure (1)..(899): unsure at all n locations
  Clone ID: PAT_TA_12965
ttttttttttttttttttttttttttacacatcagaccacttagatgtctttcgatcaacatcacagccattcaaacgtgacagttgtgacacggacacactgacatcatcataaccatttgtggtgtgtcgattatacagcccagaaacagtgttcatgagcagaacttgccattccgatacatggctgaaagggttagcgtcgttaatgcagtcgtaaccttctagttggcgaggatttcgttcacaggagacaaaaaggatcgctcaatacggcaacaaaatcttttgcattaaccatcagcagtgccagtgcgccccgtcgtaagaaggaaacatgcaagcttcttcacccggggaaattgcaggctcagctagctgtacttcactcagctcgcccatcacttcctcaagcttcgaaatatgcgtcaaaaagtaatcatggtggtgcttgcttgacttggattcagtagcgtgaattgtttcctcatcaatatagaagtcaaagtctgcactggatgtgatctttccgtaattgtcaacggcatgagttttgcgggtgtacgccagaaggattgcccttagagcgttctcatccaatctcatgtgctgcgcaagtctgccaatcgttatcactgaaaacacttttagaaagcttctgatatccccaagaaatagctgttgcttcacttcatcaagaaacagcttcaactgaagacgatatacatcctggttgtagtttgtgaatggctcttttaaaactggaggccatgcagcaatgaacttggggcaggcaagggaaaagagttcatcataatgtgcctgaccatcaccnnnaagcancttttccatttcggtaccatacttcccnntcagnncagtgctaaccggacgcgtgg

SEQ ID NO: 12966 - DNA, 740 bp, Triticum aestivum
  Clone ID: PAT_TA_12966
aattgtcaatcaaaacgctgtattaaccaacaatttcattacagtaagcatcggtttgcatcaccgcaaaccaaaaccaaaaccaattaagcagacaagagcctttgtaactacggtaaccaaccaacatggttttctacaacgatccacaagatgcatatctcgacaagggaggctaatcaactactagtacaaatgctggcgcacgttggcatgcgccccagaatgccgaatgcagcgacgacggcggcaggggctggattggcctccctggcctaggccctctccccgcggatgcggcgggcgagctggatgtccttgggcatgatggtgacgcgcttggcgtggatggcgcacaggttggtgtcctcgaagagtcccaccaggtacgcctcggccgcctcctggagggccagcacggcgtggctctggaagcggaggtcggtcttgaagtcctgggcgatctccctcaccaggcgctggaagggcagcttgcggatcagcagctccgtgctcttctggtacttgcggatctcccggagggcgacggtcccgggcctgtagcggtggggcttcttcactccgccggtggtcggcgccgacttcctggccgccttggtggcgagctgcttgcggggcgccttgccgccggtggacttgcgggcggtctgcttggtacgggccatggcgtctggtcgactgctcctcctcggcggcgacttcgaaacttggcttcggtt

SEQ ID NO: 12967 - DNA, 676 bp, Triticum aestivum
  Clone ID: PAT_TA_12967
ggtcgatcaacagtatattaaccaacagtttcacagtaagcatctgtttgcatcaacgcaaaccaaaattaacacgatctaaaacggcaggcggcgaatcaactactgctggcgaacgaacggcggcatgccctcgaatgcagcggcggcggggacgtctggggtcggattggtctggctcccgctcaggcgcgctccccgcggatgcggcgggcgagctggatgtccttgggcatgatggtgacgcgcttggcgtggatggcgcaaaggttggtgtcctcgaagaggccgacgaggtaggcctcggcggcctcctggagggcgagcacggcgtgggactggaagcggaggtccgtcttgaagtcctgcgcgatctcgcggaccaggcgctggaagggcagcttgcggatcagcagctccgtgctcttctggtacttgcggatctcgcggagcgccacggtcccgggcctgtagcggtgcggcttcttcacgccgccggtggtcggggccgacttcctggcggccttggtggcgagctgcttgcggggcgccttgccgccggtggacttgcgggcggtctgcttggtacgggccatggctcctctcgccggcttcggttgcctttgttgtgcgggagcgggcggtggaactcgaaattgaaggcggcgcgtccgat

SEQ ID NO: 12968 - DNA, 770 bp, Triticum aestivum
  unsure (1)..(770): unsure at all n locations
  Clone ID: PAT_TA_12968
ntaggggcctttttttttttttttttctacttcagagtacctcaaaattgcatatatcgataatggtcgatcaacagtatattaaccaacagtttcacagtaagcatctgtttgcatcaacgcaaaccaaaattaacacgatctaaaacggcaggcggcgaatcaactactgctggcgaacgaacggcggcatgccctcgaatgcagcggcggcggggacgtctggggtcggattggtctggctcccgctcaggcgcgctccccgcggatgcggcgggcgagctggatgtccttgggcatgatggtgacgcgcttggcgtggatggcgcaaaggttggtgtcctcgaagaggccgacgaggtaggcctcggcggcctcctggagggcgagcacggcgtgggactggaagcggaggtccgtcttgaagtcctgcgcgatctcgcggaccaggcgctggaagggcagcttgcggatcagcagctccgtgctcttctggtacttgcggatctcgcggagcgccacggtcccgggcctgtagcggtgcggcttcttcacgccgccggtggtcggggccgacttcctggcagccttggtggcgagctgcttgcggggcgccttgccgccggtggacttgcgggcggtctgcttggtacgggccatggatcctcttgtcggcttcgaaacttggcttgtgtttcctttgctgtgcgggcggtggaactcgaaatcaaatgcggcgaattgggtagtgggagcccggaccggccggc

SEQ ID NO: 12969 - DNA, 955 bp, Triticum aestivum
  unsure (1)..(955): unsure at all n locations
  Clone ID: PAT_TA_12969
tttagatcgataattgtcaatcaacgctgtattaaccaacaatttcatcacagtaagcatcggtttgcatcaccgcaaaccaaaacaaattaagcaggcaagagcatttgtaactagggtaaccaaaacaacatggttttctacaacgatccgcaagcatgcatatccaggccagggaagctgatcaacgactacaaatgctggcgaacgttggaatgcgcccccggatgccgagtgcgccggcgacgggggcatggggctggattggcctcgctgcgcttaggcgcgctccccgcgggtgcgggcgggcgggctggagtgtccttcgggcatgatggtgacggcggcttggggcgtgcattggggcggacaggttgggtgtccgtgcgaacgagtgcccacccgaggtagcgccgtgcgggccggccgtcctgggagggccaggcaccggcgtagggaacttggaagcggaggtcctgtcattgaagtctcgtgcggggcctctcgcggcacctaggcgctggaagggcagcttgcggatcagcagctccgtgctcttctcggtacttgcggatcgcccggagggccagcggtgcccggccctgtagcggtggggcttcttcactccgcccgtggtcggcgccgacttcctcgccggggccctttggtggcgagctgcttgcggggcgccttgccgccggtggacttgcgggcggtctgcttggtacgggccatggcggcgcgtctactgctcctcggcggcggcggcctcgaaacttggcttcggttggtgctggcggcggaactcgaactgggaggcgacgaattggggggtcgccgggggttccacgccccccccccccgccgcccccccggtggtgctcctgctttgggtccctttagtgagggttaatttcgagcttangaancaaaattcnagcnaacgannaancnc

SEQ ID NO: 12970 - DNA, 1849 bp, Triticum aestivum
  unsure (1)..(1849): unsure at all n locations
  Clone ID: PAT_TA_12970
cgtccgcggacgcgtgggcgagagagagcgctccaccggctgccccgtctccgatggccacaccgccggctccggtgcccccggtcaccgccaactccgcgccgacgcctgcgcagtcaccgttcaaggccccacccttctcccagcccccgtccactgccggtaccctcaagacggagatccctcccgcctccacctcgtccggccggagtcgccgccgtgggagcctcagccgaggactcatcgcacgtcatcaccgtccctagctactcagggtggttctcctacgacagcatcagcgacacggagcgccgcctgttgccggagttcttcgaaggggaggtcgcggccgtgtctgggtcccggggcccggaggcctacaagtactaccgcaacaccctcgtcaagaggttccgggcaaggccagcgcggcggctcacgctcaccgaggccaggcggggccttatcggcgacgttggctctgtgcgccgtgtgtttgacttcctggaggaatgggggctcatcaaccatggtgctcccccgctgggggcgaagcaggggaaagacaagagggaggaggcgacgacttctcagtcttccgcattgcctgccggaccaaccacacccaagaagctctgtgtagggtgccggagcgtctgcggctctgcatatttcacctgcgataaggcggatataagcatatgttgtagatgctttgtgcgtggcaactatcggcctggtcttactccagcggacttcaagaaagttgaaattagcgaagacgccaaatcagattggacagacaaggaaactcttcacctacttgaggctgtcttgcattatggagaagactggaagaaggtttctgagcatgttggtagtcgctcggagaaagactgcattgctagactcatccgattatattttggagaacagttcatgggatccaaggagcagaaaatggagtttgagattgatgatgttactaatgaatctagagcagagatcccaaaccgactccgtctcacaccactggcagatgcaagcaatccaattatggctcaggtcgcgttcttgtcggcaattgttggcgcaggcgttgcagcagcagcagcgcaagcagctatttctgcacaatcccaggttgatatgaatgacagccagactgattctccaatcagcagcactaaagaagaagaatcttcttacactaatgggcttacagccaacgatttactcaaagaggcatccacaaatgcacaagtgcaacttcaaaaggagcaaaaagatatagagcaatctttatcggctatagtggatgtccagatgaaggaaatccaggataagataagccgttttgagcagaaagagctgcttatggagaaagagagggagcagctccatcacttacgggaactgcttttcgtggatcagctcgcggttgtgcagcatcagcgcagaccgcatgctgtagcggctgagaacaaggaggaggagaaaccgaaacctattatcaccatgagttaaatcaaatggaccttcgtcggtagcatcagagggctgtgaggattggaactctgttcctcctatgtcagcaaaagggagataaatattgctggaatcctgtgacgaacactaaatttactggctttagattagtgtattttttctgtatgtggctgcatcggatgttgtattaatgttgtctgataacattgtagtctagctaatggaaatggtgttcttaaaaacaccaaactgatatggagttgccatggaatggggccgatgtttttggtgaagtgggggagcttaaaacatgtttaaaagnagtgtgtgtggtaccggg

SEQ ID NO: 12971 - DNA, 652 bp, Triticum aestivum
  Clone ID: PAT_TA_12971
ttttttttttttttttttgctcttctttgcttccttttccctcctttcctcgcttgtctaagtttggcttgaattggcctgagttgtccagagccgtcctgatccaacccgtgtctatccctgccttcgccgactttccctgattaaacggacttgcgagggcttgcgcggggggcctcagcggccttcgtcgccctttcagacgccaacactccgccaatctcctcccgtatgctcgcctttgcgcgccggcgtgccccggctttccccctcgtggtcccttctgttccgctcttttggccattgtcctccagggtcctgccggtggctggctgtgcctgcggtgcctggctgagcttgcgctatgtttcgcgccgcttgaacctaggcccaaaccctctcccaatccccccccgcggcttacacttggcccctcagcccctggcaaccgtcccacgcggctcacggtccgcctctccgggccttggatcagtacgacgcgtttcacggtcctggacccctggcccttgcagttccccgcaaatacgcacacatcattccgcgggcccggccttctttcccgctccagagctccagtgttgtattcttgtgtcctggtgtcttcttgggttctttgaataaattagggccc

SEQ ID NO: 12972 - DNA, 1020 bp, Triticum aestivum
  unsure (1)..(1020): unsure at all n locations
  Clone ID: PAT_TA_12972
ccacgcgtccgcccacgcgtccgcttctccacgccctcgcgagttagcggaattgccacgcgagtcctccaagtttctcccgccgcgatggagccacccggttcaggttcaggttcaggagcagcagaaccggtcgaggaggaccgcatccacgaacccgactccaacgcctcctccaatggcgatggggccccgagcgctgctgcgccgccacctccccgcgcggcgcccctccacctcgagcaggccggaggcggcgccgatgggtcgagccccgccacggtggtggacctccggaagggcaaggggatcgccgccggtccctttccgccacctgtttccccaagctccgcgggcagcatccccgactccgcgtccgccttcgaagccggggggtcaagctcctcggcggggaggaggcgtccggttccgagggacgcgacgctgccgttcgactacacgcgggtgttccagcaggtggtacgagcggggcagtcggttatcatcgaggagggcgaggaggagcaggtggaatcgccgcacgccaatgacgcactcccgggaaaggaaaaggagaagaaactaccacaagtcaaggtgagacccaggcctgaaaaggggaaatcgctctggagtcggctcaagaacaaggagaaactaccacaagtcaaagtgagacccaggcctgaaaaggggaaatcgctctggagttggctcaagaacaagatttttcgtagagaaggaaggcaaatatgttcagaacatgtgaagcaccagatttttcatagagaaggaaggcaaatatgttcaggacatgtggagcaccagacacgtcccatcaatgaagtaaggaatcgttatatggtttcttctaacgaggcgaaccatcttgatgcctattcggaaattagactggtgattggagatggggagtgtttctacaggagcttcatatttttctacctagtaattgacctnctctctttttcttagcatatgatgtagggttaggtatttaac

SEQ ID NO: 12973 - DNA, 563 bp, Triticum aestivum
  Clone ID: PAT_TA_12973
cgtccgcgcgaccggagcccatgaccaggtcggccccatcgcgccacctctccctttccttcctctggttccttccttccgcttacatctcgcccctctctgtgttttcctcgcagcagcgccgccatggggacctcgcaggagctttgcgcgggatgcctcctcgccctccctcttccccttcctcccgcgaccggatccggtcaccccaacgccctacaccctcgtgcccccgtcggacctccttcctccatgccaagtcccaccggcgccatgtcccaccttcgcctccgacctcgtatcctcccgctcgcctgcaaatgacgcgaggcgtctctacctccttgcgttggccatcgctaggcctcaacgccctgaagccgtacgtcaccactagggaggcgtccctcgtcccgcctctgcttgccggcttcgccagcccctcgggaagcaaccggtggagcagctcgctgtcgggagacccctcctcgacctccatcgtgcccagtttctcgcccttcgtccttcgccgccgcgcaggagatccccgacgccgctgctct

SEQ ID NO: 12974 - DNA, 763 bp, Triticum aestivum
  Clone ID: PAT_TA_12974
cgtccgcaagaatctcccctctctccttcctcatctccggcgaggccccgaccccgcaccccacggcggccggaggcgatggggaggaagggcgtgtcgtacgggacggcggcgccgccggtgtccatggtcagcgacccgcgcgtcgccatcatcgacgtcagggacgaggagcggatctgcgacgcgcacatcgccgggtcgcaccactacgccagcgacggcttcgcggaccggctgccggagatcgccgaggccacccgggccaaggacaccctcgtcttccactgcgccctcgagccaggtgcgcggtccatcttgtgcaagaatgttcctggactatttatcagaggccaaggaagagtcagcggtgaagagcatcacggttctaggagcgtggattcaacggatgggagctttcagggaaagctgtttgccgctgcaaggatgctccttgctggagtgtatgctcttgaagtattgagtaattaatgtaatcacacatgatgcatttttcaactgcaggggattacaggctagccattcatagttgattacttctatagcacacattgcaatggcatatccaagcttgatggtggaataaagccattggatgaaccagcatcaacgccatgtgaattgaaacatccatccatccatccatccatggaataacaggcacttcatggcatgtaaactggatataaaccttattggcgattattgagaatattttgctttcatgaaaaaaaaaaaaaaa

SEQ ID NO: 12975 - DNA, 543 bp, Triticum aestivum
  Clone ID: PAT_TA_12975
tttttttttttttttttttttttttttttttttttttttttttttttttttttcggcgaacttcagggaggcttttttattgaaatgaacagaggttcttagtatccaacatacatgactgcaatatccagtcttctaggaagagtaataacttaaagtacataccctcctatacagcagaagtcatactcggtgacgatattacaaagatcaaacacaggagggtcattcctcttgatcatgtcctttgttcagtgtcggaaagataggcggccaggtcatcataacaggagagatatggaagcggccatagaccggagtgatagccgtaggcgtcggcctctgatacaccttctcaaccaccctgttcctgagatgaacataaaagaaaatgcagcttgctggatgatacaagatcacaaactcggcattgtccccgacaaaatcaacagcaataaaattataaaggggcacccaataacgatccacaagacgtgtgcatgtctcatggacacaaaatgtgtctaccagcctccagttggc

SEQ ID NO: 12976 - DNA, 821 bp, Triticum aestivum
  Clone ID: PAT_TA_12976
tttttttttttttttttgaagaatgatagtggcgattcgcaataaaaagggaatgatagtggataacaaaacttttgcgactcaaatgccaccatttacaaagccgtggacaaaattctggaaaaccctacatgtgtacatttggcctacaaaaaggctgaaaccttaatcctacctattccgatcatccaggaaaaaggctgcaaaactatgccagctacgccagcccctcgtatatcagtatctatcctgatctactagtggtatcaacagatgcttacggacgtccgcttgtgcttaacacgcctcttgtatagcgcggttgttccgaaggtcatccacgttcacttggacgctgcgcagtgatcctggctggtgtcgtctgaggtccttggcttggtgtcggctgaggtgtatgcggactactcattcacgagtactgtagtaaggatcaagaccccaaaacctcagctaatgttgcttcggtgaaggatgttcttgtcccatctccttgcctttcccttctcgataagtgccattaagaactgcaacgtgccctctgcatcttcgatgtttggaagctcgacactgaaatgaaatagtgggatgaaggctgagctcagggcaatgtctcttgatctgcctcttttgtccctcggcgatgtttcgccgttgctaccaacaatgttcactacctcctgagctctgtccagatgaacaatagatttcaggttcatctcagtttcaatcgcccactgtgggtcaggaggaacaccaacaaactggggtgaccccaaatccaccaagtaccggctcgagac

SEQ ID NO: 12977 - DNA, 795 bp, Triticum aestivum
  unsure (1)..(795): unsure at all n locations
  Clone ID: PAT_TA_12977
ctttggnnntcattcggngtacctacaccttccnacctgtagggggaaacccggacntntcttggttggtacccggcccctggcgtgcagtagggccccgcctttttcttttctgatagtctcccgatttttcttttttttttttttttgtttttgtttcgattacctcgcgtgcattatatttcacaacactttgaattcgattgatgagggttttggagggaacatcaaggatgaacttctactgcgcctactgtagcaggttgctgcatcgccacttccggcctctgtttctccccgccgccaccatcaacgacgtgggtgacctcggcgttgtacacgtacatccggcacacggcgaagaagacaaagaggttggcgcagttgaggaccgcgaagaaggcgtagtagtggtccagccgggaggcgttgaggttgttctggatccaccctccctgcccgtgccggcgcgtgacgcgcgataccgtcgacagcaggaagctgctgagaagttgccgatgccgaggctggtcatggagtaggaggtgccgaggctcttaccgccgtcgggcgcctgctcgtaaaagaactcgattttggcgaccccagggaaggcgtcggccacgcccatgagcacgaactgcgggaacagcgcgacggtgcggcgcccgtcccccgtgccccggccctcggctatcccgcgcgccaccgccacgcccagcccgtgcccctccgtcagcgccgccctctcccggatcccgtccccggntntgcaaccccataaggncaaagggn

SEQ ID NO: 12978 - DNA, 553 bp, Triticum aestivum
  Clone ID: PAT_TA_12978
tagcgtggtcgcggccgaggtactcatgttagttataaaaagaagtttgaaaacaacacgatcaaactcctctataatgcaagaacaagcaaaaaggtccaccctagacgtcagcctattagcatcgcgcccaccgcagaccacgagactaatttctaaccttctgctttcaagagattatagaacaaaactggcgacccttgccgaatacagccacaccgaatgattactgtagtctcgctcagtaaaaaaaaagagataatgattcatgtacctgcccgggcggccgcctgtttattctttgtggcctcctgtcctgtcaaatttgtgtgatgtgtgcgcaaccagccttgtccgttcccgtttcatcttgcttcttggacggtcggcagctcgacgtttcctccccagttccgcacccgctcttctgccagcatagcctctttctgccatttggttctgaagaggatcacaaacaggatgacggtctgcagaaccgtgccgatcagcatccccacccaaatccccgttgcgttaagcttcagcttgaagc

SEQ ID NO: 12979 - DNA, 560 bp, Triticum aestivum
  Clone ID: PAT_TA_12979
tttttttttttttttttttttttttttttttttttttttttgagcatgataatccacctctttgccttttggaaggtaagtgaaccagaaagagtttaaagtcccatcactttcagactatggcatgcaccaaaccatctctacatagcgctatggttcctaacaaatcacatagttgtacagataaaaactacaccaacaagtagactagattataactactgacgcctcaggtggacatggtgatatcattgatcttcttctgttgaggtcgccaactgcgaatagtcccaataacatttttccctagcaagctgcatttttttttcaaacaaggactgttgatgtagatagggcattttattttcgtgtcatttggggcttctagccacggctccatccaaaacataacaaatcccatctaatttggaaacctcgtccttttgtagtcggtagactccccatgcttgcagatgacctcgatcgagatatgatatcccaataaggtgtcctcttctgttgaacacaggcgatcccaaatatccatattcatgcatcgc

SEQ ID NO: 12980 - DNA, 1370 bp, Triticum aestivum
  unsure (1)..(1370): unsure at all n locations
  Clone ID: PAT_TA_12980
cgtccgcggacgcgtggggggcacgcgccgtggcacggctgcaacctcgccgacttcgtcatgccctgcttcctcttcatcgttggcatggccatccccctatccctcaagaggattccagaccgcagccgggcgatcaggagagtagtcataagaacactgaagctgcttttctgggggatcttgctgcaaggtggctactcccatgctccagatgaactcacctatggtgttgacatgaagcacataagatggtgtggtatcctccagaggattgcccttgcatacttggtggttgcagttatggagatcgcaacaaaagacgcgagggttcaggatcagtcaagttcaggcttcttctcagttttcaggctgtacctttcccaatggattgtcgcatgttgcattctcctgatctacttgtcccttgtttacgggatttacgttccggactgggagttcacggtgcgaaatgtcgacagcccaaactatggcaaagttttaacagtgacctgtggcacaaggggaaatctgagccctccttgcaatgctgtaggttacatcgaccgtaaagttctcggcatcaatcacctgtaccagaaacctgcatggaggaggcacagggactgtactgatgattccccacacgaggggcctttcaaaagggacgccccggcctggtgtgcctcgccatttgaacctgaaggcttactaagctcattttctgcggtgttaagtacgatcatcggcgtacactacgggcacgtgcttgttcatatgaagagtcacatggacaggctaaagcagtgggtcaccatgggcatagctctcctcctcctcggaatcattctgcacttctctcatgcgattcctctgaacaaacagctgtacacgctcagttacatctgcgtgaccgccggcgccgctggcatcgtcttctccatgctttacttccttgtcgacgtcgtgagcctgcgttatgtcttcgcaccactgcggtgggtcggcatgaacgcgatgctggtgtacgtgatggcggcggccggcatcttcgagggtttcctcaacggctggtactacgacgggaccaacaacacgctggtttactgggtgaggaagcacgtgttcgtccgggtgtggcactcggagagggtgggcatcctcctctacgtcctcgtctcgcagatcctgctctgggcgctcctcgccggcctcctccaccgggccggggtctactggaagctgtagcgagccaggaagacatcggtgtcactgtttgcttgtgtgtgttggaacttagaattgtgtagcatctgtgtaagaagacaaganacgagaanaaangattgaagntcaatgaacnccattan

SEQ ID NO: 12981 - DNA, 672 bp, Triticum aestivum
  Clone ID: PAT_TA_12981
tttttttttttttttttttcgacaacaaaacacaacccagcttcaagatggctattacaagtacaacaactcaaaggcccagactgctactatctccaaaccagttacgaactacccgtatataacacgactgcttcacttactagtactatatatacttactaaatcagaactctgcataaatacacacaaaacacgatttccacgcaactacaccgacttgcaccaaacaccgtagagaccccctatacatttgacaacctcaaaaacgtactgcaacaacatacacagcacacgcctactcagcgtggttcgaaccatccccgtcggagagcatccagcgcatgtactccgccccatcatcaagcaatgagacctcgctggggatggtgaccctcttgcgagtcagcgtctcgaccgtcacagccgacctcttccgcccacctcctcggcgcgagcgcagctgctcatccatctcctcatagtcgccctctacgtatacatgacaactcgacttctcatgattgtccctgacatgcttgtaggggaatgtcttgccacaccccgcgacccgacactcaaaaggtctgacttggtcgtggcacgccttcatatgcttgtttagatttgatttggtggagaaggagcattcacagccatcaaaactgcatt

SEQ ID NO: 12982 - DNA, 798 bp, Triticum aestivum
  Clone ID: PAT_TA_12982
ggcttttcaaaggatgtatggctcgcggcttgacggagatgggagttctctgccacgtatgcctaatgacggagacacgtggtctgtgatgcaaagctgggttttgcctacgagatccgtccgggaatttgtaatgttctcaaggatgtttgtagatgcgctggatgcacagatgtacgacaagcatcatcaaactgggcattgcatcttgagtctccacagggacaagcactgctactctggtgttctcgagttgattgtaaacgtttgggcgttccacagtgcacggcggatggtctatgtaaacccagagactggtgcaatgcaggagcagcatccgctggagggcaggagaggtcagatgtcaatccagtggttctcctacgctaccctgaagagcatggacgaagacttggcagaagaggctgatgcggaccaccctgacagaaggtggctctggccacaaactggcgaagttgtgtggcaaggtctgtacgagcgggagaggaccatgcggcagcaggagaaggagcggaggaagcaacagaccaaagacaagatccagagaatgaagaagagggctcggcaaaaaaccatagggaggtacataaagccaccgtcagatgatgccggtcgcttaaacgacacaaggacggacagttgattgagtagcgcttaaccacatacttaggacagttattcattcttcaggaaattttgttcattctttgtttctgctaatttcctaactggttgctcccaagtgggtgtgattatttttgtccagttttgccctgt

SEQ ID NO: 12983 - DNA, 501 bp, Triticum aestivum
  Clone ID: PAT_TA_12983
ttttttttttttttttttttttttagcacatcaaaggctgtagcacatttcagacaagattcgcaagttctacaactaggggagaaccaaaacaaacagtcgtttattccaactttctttttgcggaaacatttattccagcttattacaagtatccttttacgaactctatgtaccacatgcttgtaccagtgtgtgtgtgtgtaactcaagcaagaggtgtttgtgctgtgtgtaaacagtgatacatacagtgttgtccttctttgtcacatctggtgcagttctaatctttaaaacaacagaggacatcttacacgagacctgtctccgtctagcggaagtagccgtacagctccaggaagcagatgcagaggttccaggtgttacaggtcgtcggccccgtcagagcaagccggaagaaccggaatggcagcaccgccgccgggcctgtgatcggccacgacgcaaactgccctggctggcatatggcccgctcgt

SEQ ID NO: 12984 - DNA, 873 bp, Triticum aestivum
  Clone ID: PAT_TA_12984
gggcgtggtcgcttccgatttccactcttgtagtttccatttgcagacctaatcacttgaaattcaacccatagcctatagtggattataacagataattatgcctatagtggataactgtttaagttacaaatacctaatctagcttgcatttcccttcaaacttttaccatacaggtgtatcatagttcatcagaacggtgatatgttatgtttccatgtgtatttcttcatcacgctcgcagtagagtaagctattcacaatatatatagggccatggagtagcaaatggttagcgactccttatttggtctaagaacccttgtcgtaaaccttaatttccctgttagagagtccaactatgagcttttcatcccagtacaatattgaagttacaattgaatcacaagagatggaagcgacatctctgatttccaactctgactcgtcttctaataactcctgaatatttacggctttattcaatccaccggtatagagccatttaccattcaatttaacagcgtaaatagaagcactttgaagtttctctgatttaacgaggacatcatccttccaaatcttcaaacagccattttcatatgatgaaacaacaaaattagcttctgttgaaattgacaacacaggggctatgcttcccggtgcatcatcttcaagtacagacaacgggctgtgatcagtaagccaccatgatcgaatactaccatcccaacttccactgtaaagaataccgctagcaactgcaaggcaagacacggttgatttgtggcctgtcatagtgcatcgaagtgaataatcctccagagaccaagctttaatagatttgtccggacgcgtgggcggacgcgtgg

SEQ ID NO: 12985 - DNA, 655 bp, Triticum aestivum
  Clone ID: PAT_TA_12985
gcgcgaggcggccgggggcagcagatcgtcgccgccgcaggcccgcagccgtcccgcatcgcagtcgccgccgccgcgtcgtgccagctttgagcgagacgaaccgatggcgggcaccgcagccgtgtaccggagggtcatgaaggcagtgcagaagcacgtcggcgggagcgccgataagaagcacttccgcgagttcgtggccgccgagttccgcagcccggccggcacggaggccgacgccagagcgagactgcggctcgccggggactacgcgtaccatctcaccagcatccaacaccagaaggaactgctattctcatacaatatagctgtggatcgatctgatgaaatgaagaagatattgaacaaatctgctgccagtgtaggccttcagcttccagatgtctaccagccttgagagcttgggcgacccgtggtactgcttttgggcaactttgcttgagttacaaatttccagttgttctggatagtttagcgtgctatagctgtaagcagctgtactctccccaataacgaccagtggcattgattctcttgatgctttgtactaccttgttccatggcgtctgcttacccttaaattataaattcagctgtactcttgaagttaagttatgtgcatccatcaaaa

SEQ ID NO: 12986 - DNA, 707 bp, Triticum aestivum
  Clone ID: PAT_TA_12986
gtgtcttgtttttttttttctttctcttttgcttgcttttttcgaggtgccggatgtactgtctctggcattggcgcgacccttcacatgatcctagcagcaccgtacacgctctttcataatagcatcataaatactatattccgaacttattatctcaggcaatagagtgaccatacacataatggtggcagaacataacacaccaactaagactgcaagcacaactaattacatgatacgaagctaaaacatgtaagcacaactagagcaagtttgcggctaccatgtctcaggaattcagatggatcttcaaatgacatccttttcccgacatcagctctgccacacaatctagtcaccataagctgaaatgtagcgccgcattcctggcagttcagcacatcattgatcaaaatttacaggagacatttagcatattgtagcttacaggagacacaccttatcaagcaccttgttcagtagggttcaagatcgctggcggccaccctatcgtgtaaggatatatcagcggagacgggcaattcacgtccagggacagcctcgtcatcttcatggtctcaagatgaatggagagcagacaactgctgctgcgcaagaacaccacaccagcagccaccccgatgacatcgccctgtggagtctggtccaaaggatccgaaagaacatcgcttccatcgccccgt

SEQ ID NO: 12987 - DNA, 1913 bp, Triticum aestivum
  Clone ID: PAT_TA_12987
cgtccgggcagcagccaaaggcaaggccgaaaccgcgtcggctcacggagtccaccaccagtctcctcccctcctccttctcctcctacccccgcctccaaggcccctccgcccgcccgccgacctggtccgctggtccggggtgctctgtccggcacgaatccagcggcgcttgttgcgggaatgcggggagttcattggtgagccgctatgggttgcttcccgtgcttcgattcgggctccgacggggagctgctctaccccaagcagggcggcggaggcggcggaaatggcacgggcggacggactgcggccgcggcatcgtcctccggcgtcggcgcccgcgaggagagacccatggtcccgccgcgcgtcgagaagctccccgcaggggctgagaaggcaagggcaaaaggcaatgccggaatgaaggagctttcagatctcagggatgccaatggcaatgtcctctctgcgcagacgttcaccttccgccagcttacagctgccacgaggaacttcagggaggaatgcttcattggcgggggagggttcggacgtgtttacaagggccgtcttgatggaggccaggttgttgctataaagcagctcaatagggatggaaaccaaggaaacaaagaatttctggtggaggtcctcatgctcagtttgctgcatcatcaaaaccttgttaatttggttggttattgcgctgatggagagcaacgccttctggtgtatgagtatatgccccttggatcattggaagaccatctccatgatctccctcctgataaggaaccgttggactggaacactaggatgaaaattgcagctggtgctgctaaagggctggaatacctccatgacaaggcacaaccaccagttatatatagagatttcaagtcatcaaatattctattgggtgatgatttccatccaaagctgtcagactttggtctcgctaaattgggtcctgttggtgacaagtctcatgtctctacacgtgtgatgggaacatacggctattgtgctccagaatatgctatgacagggcaacttacagtcaagtcagatgtctatagctttggagtggtgttgcttgagttgattactggccggaaggccattgacagcaccagacctcatggggaacaaaacctcgtgtcatgggcacgccctcttttcaatgacaggcggaagctcccaaagatggctgatccagggctgcagggacgatatcccatgcgtgggctctaccaagccctcgctgtggcgtcaatgtgtattcagtcagaggctgcttcgcgaccacttatcgctgatgttgtgactgctctttcctacttggcgtcccaaatttatgatcctaatgcgatccatgcctcgaaaaaggcaggtggcgaccagcgaagtagggtttctgatagtggaaggacgctcctgaagaatgatgaggcaggcagctcaggacacaagtcggatcgggatgattcccccagggagcctcctccggggatccttaatgacagggagaggatggtggctgaggcgaagatgtggggtgccaacctgcgggagaagacgcgtgctgctgccaatgcacaggggagcctcgattctccaactgaaaccggatagcggcagtcttcaacctgcggccttgtgttttctctctgtcgactgtgcttgctttcgattggcgggaaaagatgaattgggtgctttccggtggtgttagatgtgtacatttataggggcaaaacaaaaacaaaacaaaacaagagaagaattgggtgactttgtactggatatggtcgtacctgtaaattctcggaaaattttgcgacgatggagaacaaatctgaactcgtatctgttgtccctgttccaaaaaaaaaaaaaaaaaaaaa

SEQ ID NO: 12988 - DNA, 716 bp, Triticum aestivum
  unsure (1)..(716): unsure at all n locations
  Clone ID: PAT_TA_12988
ccccccctcttttttttttttttttttttttttttgagagagagaacggatgcatgtattattttcacgtagcttttcgttgatcccagtttaccttacagttggcttctacccacaaaaaactccaaagcttgcttagcttgcaagatcacgagtgcgagagagagagagagagagagagagagagagaaagagagagattacccagttcaaaacgcatcccttgctgatctagagggtagcagcaagcagtgctctgcggtgatcagaagcgaccatgcaactatcatcatggctagctatggctacccatgccatgccacggctcgttgctgatctgctgctgcggcggctgcggctgcggctgtccttgttgctgtggctcgtagcagggagccatgttggtgttgttgccggccgtgttcacggcggcgcccatgcacgacgagtcaaagccggcgaggccgaggatgtcgcggtgcgagaaggcgcgcagccccaggaagtccctggtcatgccgtcgttggcccctcccgaggcgccgccttcctcgccgctccggccctgggaaggcggtcctggcgaggctcatcatctgctcgtgccggaggcacgagaggccgagcccgaacgtgggnctgccggtcgcgctggtcgccgagccggccatctgggtggtagtgcactcccgccccgccagcgccggccccgccga

SEQ ID NO: 12989 - DNA, 1536 bp, Triticum aestivum
  unsure (1)..(1536): unsure at all n locations
  Clone ID: PAT_TA_12989
gcacgaggcgtaagcgcctcgaagcaatccccgtccggcgcctcgaagcaatccccctgctttcccattcgatccacctgctcccgccgccgccgtcgccggccgttcatctgaccaggggcgaacgattcccccctcccctctctgcctcctcctcgctgttgcagctgtgattccgtcgggggcgggccacatggcggcggcgctcgcggtgacggacgagctggccctgcctctccgcgcggtgggggacctggcggcggctgccggggtctcgcgggaggaggtcgtcgtcatcacgcagtgcgcctcgctcggtgggaagttgccttttgatgacgcgtccgtgggtgctgttctgtctgttataaaaaatgttgagagctttggagataagttggttgctgaaattagccgagtgctgaaagctggtggaattgtgctggtacagagcttcacaccctccactgaccagaagccaaacaattatatcgagcgccagctactcatgggtggttttgttgaagtgcaagcttctgccacaagctcgcaggatagcgtgcaatctgttactatcaaggcaaagaagccctcctggagtatgggttcttccttccccctgaagaaagcagtaaaggctcttccaaagattgaaattgacgatgatgatgaactgattgacgaagacagcctcttgactgaggaggacttgaagaagccacagcttccagttgtaggagattgtgaggtgggagccacaaagaaggcgtgcaagaactgcagttgtggcagggccgaggctgagcagaaggtggagaagctggggctcactgcagaacagattgataaccctgtctcagcttgtggcagttgtgggttgggcgacgctttccgatgcagcacctgcccatacagaggcctggcgccgttcaagttgggcgagaaggttaccttgtctgacaacttcctctcggccgacatatgatgacggacagcagctgcggatatgaaatgcgccttgttggatttgttggttcgttaggaagatatatctgcgtatggttttttcgtggtgatggtggtggtgatggtggttacagcaaaagaaggggagtgcgtttggagtagcagctcgtgttagcatgtcgtgcgtgtccttgctctcccacctaggttgaagcaagaattggatcgtgtgtgcgcctctgtattcggcaagaagattacatgcatgtaatttgacgaagaaacatatgatggaaagactttggtctgctacatgttcttgttttgctccaaaaaaaaaaatactactactccctccgttccctaatataagacttttagcttttttattagtatgtatgttaagacacactttagtatgtattttacttatttagtgctcctcccgtactaaattacttgtcgcagaactaaatgtatctagacatatttttggtattttcagttttggatacatccaattttatnnnnnnnnnannnnnnnnnnnnnnnnnnnnnnnnnnnnnnaaa

SEQ ID NO: 12990 - DNA, 693 bp, Triticum aestivum
  unsure (1)..(693): unsure at all n locations
  Clone ID: PAT_TA_12990
ttttttttttttttttttttttttttttttttgatccaccacacatatttctatacataattaagggagaggtacggtccgatcaagtggtagaagtcagggacaaacaccatccatggatgcggcggtacagcaaaacacaagaaggagaaacaagcaaagtaaacatatgcattcatgccaaatagtagactagtaaatcgattaacactcgcgcgatcaagataggtaataattcaggtcgttgcaccgccacctaggtcttcaacatggtgaatctttttcctcgtcagcaacctggcctgacagaggggcgagggccgctcgctcggctactgcccggcgccgcccctctcgtcgctgccggcgatgccgggcttcaggaacggcgagccgccgagcatgccgagacctggcaccgaccctgcgccggccatcccggccgccgagtacccgaactcgtagccgccgttcagccccagcctcgcgatgggctcggccgcctcgtanctcctggacagcatctgcacggcagcgaactgatggtcttgcccgaagcccgtgaccccgccgacggagccgagcgccgcggagtgcccaacgttgatgaagctcgccacgccgttcggcaccgcgctgccgatgaactccgccatcgactgcgacccgttcggccccgccgccgactggtac

SEQ ID NO: 12991 - DNA, 814 bp, Triticum aestivum
  Clone ID: PAT_TA_12991
ttttttttttttttttttttttttttttgcttttttgaaataattaccttaattcattcataccgattcatttatacaaactcgatggcacatgttgcaaataacgcgagttaaatcctgacaagttcgatgtcaattaccaaatcactctagcggggcataacttgctctcgcttggttgctccaacatatatatgatgttctggctgcgtgcaatggctacttctctcatgttcattcgctctcttggagacagacgcgtgcaagatagagctacttgcacaagggacaccaagcactgatataccaagtctcctgcttccgctgatgcaccaatgaatcccttgcattcttcttgtaggtgagcatcaatgatttctaatatctgatctggggagttcctctctgcgaaattgacaatgttgagttcgttgtcaaacatagggtctgttggtcttttacctatcaacatctctagaagaactattccaaaactgaaaacatccccattggttgatgcttggccagtttgagcatactctggggcaatatatcctatagttcccttcaatccgattgggctatctgaagttgaggctgaactggaatgtccaactgatgttgagtttgaattacacacgaggtttgcaatgccaaagtcacccaaataacaaatactccattttgtggtatttccccgtgcagttggttgtacgagagatccaactttgctcgtccaggtcgcacaaaacggcagcctttcttcttgcatgcgtctttgccaggtgctgcggtgcgtgagctctgaagcgtg

SEQ ID NO: 12992 - DNA, 1499 bp, Triticum aestivum
  unsure (1)..(1499): unsure at all n locations
  Clone ID: PAT_TA_12992
ccccgcgtccgccctcctccccccccgcccccgcctcgcgagatctcccgactccaatgccgcccgcctccccccgctcctcctaaacctagccccaacccagcccccctgcagacgcccgcccccgtcgcccgggagcgggagggggcgcggggcgcggcgcgggggcgccccgtgtaccccctcccccccccccgcccccgcgccccccccccccgccgcccccccccccgcgcccgcgccgcccccccgcccctcccccccctccgcccctcccccccgcgccccgccccgctgctcccccccttcctcccgcccccgccccgcgcccccccccaggccccccggcactgcgtcgccgtgcggcccttccgcgcttccgcgcagtctccgcaggtccgcacgatcgtgcatcaccgcatcagcgagctggggcgcccggcggcgctgccgcgcagcgactccggcgctccccgcctgctgcgggcctagatttgttgagcttttgtggcaactctctgtacatgccttgagggaagtccataggagaacatttgcggctgatgtagcatcaaatccactgccggcagcactcacagacgtttcttatcttcatgcagctgcattacttcctgtaacaaaggcaaggattgctcttgagaggcgtaaatttcttaaaaatgcaaacattgctgttcaaaggcagacaacctggtcaaatttagcccatgaaatgacagctgaattccgaagtctatgtgctgaagaggcatatctgcaacaggagttagagaagctacaagatatgaggaacaaagccaagctagagggggaactgtgggacgaacgtatctcaagctcatctggacagaattcacatttggtatctaaggcaacacgtttgtgggaatcgatattggctcgcaaaggccagcatgaggtcttagcttccgggccaattgaagatcttatagcacaccgtgagcataggtaccgtatatctggatcgcaattgctagtagcaatggatacgagttcaagcatcccacattctgaattactatcagctcgagctggtgaaacgtctcaaattttggacaaacaggagcagatatctttattccagggaaaggaagaagctcttccaagattagatgataggaatngggcgtgtccaacaaactgttgacgtagctgaaattctttcgacgttggactcatgctttgcagcgtattcataaacaatctcttcatttggccaaagcaaatgatgggnngaggggccagaattactcccgcagtggcgtctgacagcgaaactagtagccatgccgactcattaactgcaacattggctgaacatcgccagcatttaagtcagtatacagggcctaattaatcaactcaaggaagctattccagcatggcagcagtcaataacaaaaacttctggaaagaagtaaatagtgtacctagtaaatccgagggatcaaacaaac

SEQ ID NO: 12993 - DNA, 505 bp, Triticum aestivum
  Clone ID: PAT_TA_12993
ttttttttttttttttttttgcttaaaatgtgtagtttctattttctacttttgacaaatttcaacatctcacagccctaactggtcctgatttacaagaattgacaagcactctctaatctacagtctgtaccacctcttgatgtgtgtgcgcactctgtagtctgtacatgatatgcacaactgattcaaacctcgtcgtcctccggcgccgagatgagcagcgagtacttggccttgagcgccaccttgccgccttccacgcagagcttggcgccggtgaccacccagtaccccggcaggtcgtcggggcccctcgtcacctccgtcgtgtcgatgtacttcgccatcttctgcacgggcagcggcaccggcgggcccttggggaacacggccgagttcacctccaccttcccctccatcggctccccctgcggcggcacggcggcggcggtgcccgacagcgccgcgctgagcatcgccgacagcgagcccgacttgcggg

SEQ ID NO: 12994 - DNA, 522 bp, Triticum aestivum
  Clone ID: PAT_TA_12994
tttttttggagaatcaaaagtctcgactcagctttttggctttctttttccacgtacacatgggacggatggatgagtagcaaagatgcaacttctaagtgacactatgcagaaaagaaatgtacaaactaaacctacgacgcgcaatcgggaagatcgaccattatttgcatatatatacgcgtcgagtcgatcggtcgatcctcccaatccgcagctcgaccgatcaatggtcgagatcgtatgacaggatgtcctcgagatacgggtaaccatcaaagagcactccaaaggcaccggcaccaccgtactgcagggtggacgtgacgtcgccctggtcaggccaagccgccgccgccgcggcgccgccgtacagggcagagctcccgggcgtgcggctgctcagcacctcctccaggtcgccgccctcaagcttcaggccaggcagcagcaggccggaccccgtcgcagcgtcctcgccgaccttgttgctgttcgttgtggtggtgctggtggtggtgc

SEQ ID NO: 12995 - DNA, 401 bp, Triticum aestivum
  Clone ID: PAT_TA_12995
cgtccgggcgaatcttgaagttgagaaggcaaaggcgttcaccaaagccaagaacaaaaacttttctttgccagctgcactacaatgtctgaagaggaagagattatatgagcaacaggtggagcagcttgggaatttccaattgaggattcatgatcagatgataatgctggaaggtgcaaaagctacaacagagactgtggatgcattgagaaccggagcatcagcaatgaaagctatgcacaaatcaacaaatattgatgatgttgacaaaaccatggacgaaattaatgacaacatggagaacatgaggcagatccaggatctactatctgcgcctatgggagcagcaagtgatttcgatgaagatgagctgtaagctgaacttgcggatttggagg

SEQ ID NO: 12996 - DNA, 1114 bp, Triticum aestivum
  Clone ID: PAT_TA_12996
ccccgccccccgcccgcccccgctaccccttcttctccccagcccgcttcccccgcgccgacgccgccccccgcgccccgccgacgcagccgccatcgccaggcgccccccgcgaccgagaggggagcgctccggtgccgagatccgagccgatcggagcgccatccggcagggcggaggccagccatgtcgggggttctcggcagggtgttcgggaagtccaaggagcagagccaggcgtccgcgccggcctccatcgacaagctgagcgggactcttgaaatgttagaaaagaagggaaatttactaatgaggagggcaaatctttcaagataagaagagaaaagagtacgccgaagtcaagaacctaaagactgcaatattgtgtttgcagaagaagaggttatttgggcaactcgtatagaggattcgggatcacatgttaaggctgcaaggtgcaaaagcaacaatggaagctgtggatgcatcaacaaacagtgcagatgcaatgaaaaccatgcacaaaacaaatgacatcaatgaggatatcaagaacatccaggatattcttgccaagcctatgaacgcaacgaatgactacgatgaagatgcgctggaaactgaacttgcaaatttattgcgatgaaggatgagcgcagaagctttagcttgcggatctggtgggcctggagttgctgccgcggctgctcctcagcagtagagtcggccctctgcgcagaccagtaaaactgcagccgctgtcctggcggctttacaagctgagttggctatgcaattagtttgcaggacttggcgtggtcacgttgagagaccagattgtgcaaatatatttgggaccacggtattttcaagagaggtcttcctgggaagacgtcagaagtacagacagaatctagatgcatctccccctgatgctctcttatgtatctctgatcatgttacttttgtaatcaaaaatctatgatatgttgtcgtgcgcattataagtctgtaatcggccactcccataatcgcagatgtgcgcattatcagctaataaagggcatccgccatcatggcatctgccatcatggaacattcccgtatcgagtga

SEQ ID NO: 12997 - DNA, 753 bp, Triticum aestivum
  unsure (1)..(753): unsure at all n locations
  Clone ID: PAT_TA_12997
tttttttttttttttttttttgagccggggcctcccgcccccgctgttcgttgcaccctgcccgggtccccgacctggctttgggcttcggccccaggtcccgggccaggggctcctccgcacgtcccccactgggcgccatgtcgtggctcggccccttctcccgattgtgtgccccccaccgggtacggcctacttctaccggtaaggtttctggcgccccgtgccccctccagtttttattcggccccgccaaaccgcgttcccttagggtgcccctcccaattatttgggtgcattcgcnttagcaatgttaattcagcacatcatttgtagcccaaaccaaagttgcttaattaatgttgtgacacctgaacgaaaaagaaaaaattatagtcaaacagtagcataaaagattttcagggaattggagaaagatgcacaaacaaagacaatgaaaagaccataatttctcattatgcagtgagatgtgtgcatcgaagtcatttttcattgagctcttctgttagatgtttagaaataaactcaatccgaagaatgccggaattctgatgtactgatgcaaaaggtatgcaccccaacactaaatgacagattatatgaagcccaagtcagatggaaatgtgaaggtaaattagttatttaaattttgatactaactgatatgagtcacacctgtggcagtcaagtgttcttatattttcagaggcacatgatagttagattagatgc

SEQ ID NO: 12998 - DNA, 764 bp, Triticum aestivum
  Clone ID: PAT_TA_12998
tttttttttttttttttttctttctttgcctcctgtcgctgcaccccttggtatcaatggtaacgtgctactgtagctcaggtcatagccattcagattgtacagactacacagcaaaccaacatctgcagcacaccgattcaaataattgcatgtgcatcttgtcccacggcttgcatcgagacattcaagcttcttcagtgagattgcatttcagacgcaatctgaaatttgtttggttttcagcacaggaaccagttgcaacactggaaccgggacggcacgtgtccggtcttccagatgcgctccacctgtcgcgccaaccagactgcctgctggtcccgtctcacctcgaccctcacttgcttcccctccaccttgtgcctcaatgtgggaagcctcttggtgaagttgttcttcacccccgccttctcggcctgcacctgaaataaaatttgcacaattacaaccagctgagatttgtttcagtcttatctggacggtgcaacaagttcatggatgctgagctctgcattcatcttggcttcgaatttggatttctggcagttctcccactcctgtatcgtcacctccttcctttgatatctgatccatcatgaccaaaacaacacaagattcagaagaaaatacgtggagattttgttcgtgacttgatgcaagtttacacttcttggactctgctcatgccgcaactcgagcttcaaactcctccttcgcctcgtattctttgccggcgctcttct

SEQ ID NO: 12999 - DNA, 1006 bp, Triticum aestivum
  Clone ID: PAT_TA_12999
ttttttttttttttttttttttttgagcaaccttacacaaggccaaggaaatttattatcctttagtagtaacttcagcaagctctgtatttgataaaagattgtacagatgaccatttgaacaagcaggatatgctctcacagaatgtgtgttcaataaatttcctacataactttaaatacataggcttgataaagtcttactaaaagacatgaatgatgtatgagcagctggccttgatgcagatgcactgtttggaagcaaaatggtcctgggttgaattattgaagttcatgttcttgcaccatgccctgagcatttgaaaatggtcttgaaggatatagccgcacgatatgtcatgtccttgagcaggaagtaaccatctagctaggcagttatgaaccagccagcaaaatgctagaatctgcttggcagtagtacacatttacataatctttgtagtccatcggtgtgttggtctcttgtaaattcagcggcagcaaccaactgttatcgtaattaatccttggtgatttcacagaaactattgacactcaagacatttcagtaggttgtggaaaaccctgatggcctccatgccctagctccttgttattcaattcatctgtatctgaaccaaggtcttctatggattcttggacatcactctcttttgaagaaggtagtaaaactgcatttttcttgtagctccatacaagcattgaaatgtgatcctgtggtgttataagcccctcctctctaatgcaactccgctgctcttccagtgtttgttgatctgtgagctttatatattctagcaaaaacttctcgtggtccgggcgccacccgcttggtaatggtgtatagtcaggatcaggaaccattgacatccttgtatactgaagtccatcaactgagtctacaagacccattctcagcaaattggtgtactctggtgactgccctttcttatcttcaataggtcgactaagattccttgatgca

SEQ ID NO: 13000 - DNA, 517 bp, Triticum aestivum
  Clone ID: PAT_TA_13000
tttttttttttttttttaataaagtagtaggagtattattttgtaagtcccgacttacaggtaatcataacagagtgatgcatccagccactaggtaaagctaactaactagtactacatggctcagattgggatgatcggataggtaataaaacgagtcagagcacacagtggatacttaagttttcaatgttgtaacgttgggacttgtggtggataagctggagcccgtcggcgcagcggaccacctccacgccagtcaagagagtttgcacacccccatttccacccaaactcctaatattctccagctcgtcctcctcctggagtgcagacctatccttcctgcagtgggtcgcgatgcaaaacttgcccgagcccaggttcaccaaggcacgccccaccggcagcaactcgtcggggaggagatcgaggtattcccaatcatgcaggggtgaaggagcacattccgccatggcagaggatgaaaggtcaaatgcacataagcgattttgcc

SEQ ID NO: 13001 - DNA, 406 bp, Triticum aestivum
  Clone ID: PAT_TA_13001
ttttttttttttttttttttaggacgaagatatcgatcaaaattcaatataagggggaaatttgcgtcctccccgccgtggtacatacatggcatgcttgcgggctcatcaccagcatccatcttccgcccaagaaaccaaaaatgaaatcgaaaaagaagtttgtgtatttttttcccttttgtatacacgccttcagaaaaaaaaaaactggcatgtaatctgcacgctcctcccctgttagtgcttagcacccaccgtctacctcccatcataactgtcaaaatcccgcaaaaaaagaaagaccctctccttttcccccaaaaaattctgcatccaggaggcgtcagaagctgagcagggagcgcctacgccgcctctcgtacctgcccgggcggccgctcga

SEQ ID NO: 13002 - DNA, 566 bp, Triticum aestivum
  Clone ID: PAT_TA_13002
ttttttttttttctccgttttctactagttggagtgcatgcgtagcgtgggggaacaggagcatgcttcggttggagtttctggtttttacatggacgggacgggacccaagagcagcagcggtacgtactacacacatgaacaacgtatccacaattagcactacccgcacgcaactttacaagcgctgtccatagccttatctccatttgcattggttggacaggtcaggctcaggcagcagacacagcctgataagtgataaaataaaaaaaataaaaactgggtcgagcgtcctgggtctcctctccggcggcgacgttgttgacgtcatgttccgatggacggtggtgagagagacatgcccagctccagttccagcggggagcagtggtgaccgtgcccgtggccatgaggaggctgctccatcagaaccgccgggaatggcgccctcggtgacgccgacaaaagtggaacccccgccatcgccatgtcatcctcctgcgtggagttgagatcaatggacgccatgtcgggggatttataccgcggcagagaggtggagg

SEQ ID NO: 13003 - DNA, 784 bp, Triticum aestivum
  unsure (1)..(784): unsure at all n locations
  Clone ID: PAT_TA_13003
nnnnnnnnnnnnnnnnnnnnnnggtacataccgggttcctcctctgtcttcgttccggacaaaaccacagcgaaccaacctctcctcctccttcctccggcggatctcatcttctcatcccaccaagaccaccgagatctcgtcttcacatccaagcggcgcgagcaagggaggagacgcgctcgctcgctccaccgtcagcaaccaagccaggcaaagggcggcgatgacgttcgacaaggtggaggagctccggccgggcacctacggccacaacctgcagctccgggtgctcagcgccaagcccgtcgtgctccacaggccgcagggcggccgggccggcggcaacatgcgcatcgccgagtgcatcgtcggcgacgacaccggcgtcgtcgtattcaccgcacgcaacgagcaagtggacatcatgaagcccggggcggtcgtggaggcgaggaaggcgagggtggacatgtacaaggggtcgatgcgcctggcggtggacaagtgggggacgctcaaggctgccgagagcccggccgacttcaaggtgaaggaggacaacaacgtgtccttggtcgagtttgagctcatcaccgtgatgcagtgattgaaggaggaggcacaggaggctcagcagctgttaggctgagcacaaagcaataaaccggccaatcatggctcatgttcttcaccccctccccccctctctctgtttactgtttatttgctggaagttttgctagtcctgctaccttggattaattgtcgttagtaatacaat

SEQ ID NO: 13004 - DNA, 950 bp, Triticum aestivum
  Clone ID: PAT_TA_13004
cgtccgggtttggattcataccacaacttgggtcccccggcggtttcctccttcctctcggacaaaaccgaacgaaccaagagacaaacttcttcttcttcttcttcttcctccggcggatctcatcttcagatcacatccaagcagcgcaagcaggagacgagacgcgctccctcgctcgctccaccgtccacaaccaaaccaggcaaagggcagcgatgacgttcgacaaggtggaggagctgcggccgggcacctacggccacaacctccagctccgggtgctcagctccaagcccgtcgtcctccacaggccgcagggcggcagggccggcggcaacatgcgcatcgccgagtgcatcgtcggcgacgacaccggcgtcgtcgtattcaccgcccgcaacgagcaagtggacgtcatgaagcccggggctgtcgtggaggcgaggaaggcgagggtggacatgtacaaggggtcgatgcgcctggccgtggacaagtgggggacgctcaaggccgccgagagccctgcggacttcaaggtgaaggaggacaacaatgtgtccttggtcgagtttgagctcatcactgtgatgcagtgattgaagagggctcctcctcccccttgcctaggaggaggaggaggaggaggaggcagaggaggctcagcagctgttaggctgagcacaaagcaataagtcggccaatcatggctcatgttcttcaccccctcccccctctctctgtttactctttatttgctgaaagttttgctagtcctgctaccttggattaattgtcgttagtaataccatatatgtttgtgaggagttgcatccagattgttgtgagtgagccctgccatctctttgtgttagacctggtatatcaattaactaattatgttaagcactggtgacatatatctatgaaactccttcacaggcgcc

SEQ ID NO: 13005 - DNA, 965 bp, Triticum aestivum
  Clone ID: PAT_TA_13005
ggccggtttcctcctctgtcttcgtcccggacacaaccccagcgacccctccccctttcctccgtcctacaacggctgcgaaccaacctctcctcctcccctgcgtcctggtttccttcactttctcatcccacaccaaggagacaaacctctcctcctcctccttcttcctcctcctcatcctcttgggtggatctcatcttcagatcacatccaagcagcgcaagcaagagaggagacagcgctccaccgtcggcaaccaaaccaggcaaagggcggccgatgacgttcgacaaggcggaggagctccggccgggcacctacggccacaacctccagctccgggtgctcagcgccaagcccgtcgtcctccacaggccgcagggcggcagggccggcggcaacatgcgcatcgccgagtgcatcgtcggcgacgacaccggcgtagtcgtcttcaccgcacgcaacgagcaagtggacatcatgaagcccggggcagtcgtggaggcgaggaaggcgagggtggacatgtacaaggggtcgatgcgcctggcggtggacaagtgggggacgctcaaggccgccgagagcccggccgacttcaaggtgaaggaggacaacaacgtgtccttggtcgagtttgagctcatcaccgtgatgcagtgattgaagaaggctcctcctcctcctcgcctatgaggaggaggaggcacaggaggctcagcagctgttaggctgagcacaaagcaataaaccggccaatcatggctcatgttcttcaccccctccccccctctctctgtttactgtttatttgctggaagttttgctagtcctgctaccttggattaattgtcgttagtaatacaatatatgtttgtttgtgcaaagatgcaaccagattatgccgagtgaaaaaaacccgagacacctcggccgcgaccacgctaatcaactgtgtattc

SEQ ID NO: 13006 - DNA, 777 bp, Triticum aestivum
  Clone ID: PAT_TA_13006
ttttttttttttttttttgagcaggtaacttcccaattgaattagtggccgtggcctaaaacaacttaagtacaaattacagctctctaccaatactttgtgggggaaggccttagtacaagtatacaccatgcggtaaactaaagcataatttgttcctttcggctcccattaggaagcaagtcgtggaagcacttgttgcctggattaaacaataatattcccatggctgctattctagattaaaagaaccacgtgggaagagattatctaccatcaatcatcaatgatttcatgcccatccacctcacttgcttcggtagcagcaattgtagtggtatgaatggtcttgttgctaccacggcagtgcagcagctgccgttgaaggctctcgataagctcattaagctgttgaatgtttttctcttgagacaagagtatcttctccttgacggcgtcctccttcgcaaggacttgctgccgccggcgcgcggtgacagggtccgcgtcagctgcgtcctcgatctgctgcttccactcgaactgcgacgtgatgatgagcacgatcaggaggcagaccagcactacaggcctcgtattcatcaccacgctgggacggcgccaaacaatccagcgaccctgaatcgcaacctcctcggtaggccaagaaaccaacagatccccggttagacaagaaggctgcagatgttagaagggctcccggccgaaggcgggtgatgccggcggatggaggcgcgcgccctgtccggcgcgagg

SEQ ID NO: 13007 - DNA, 519 bp, Triticum aestivum
  Clone ID: PAT_TA_13007
cgtccgctccttccacggctccccctcctccaagctcgccggcctcatcgactacccgcgccggatcctctccccgggccgcgtctcccccatcgaccccgacgcacacccccctcctacccccacccccacccccacagaccacccgcaccacccggagcagcagcagccgcccgctctggccccgttcgtcgcggtgcgggaggaggaggaggaggggcagggggacgggctggatctgaggctctgcctccgcgggagggacggcgccaccggctgcgtcatggacctcgactccgccgtgctctgcgggagcagcgccttcttcgccgccatggcgcccgagcccaacgcctctggtgccggggcccggaggatcgaggtcgacggggtcgacaacgtcgccgccttcagggacgccatcgagctcatgttccatgccgacgctccgcggtggctcgccagggccggcgtctcgcgagccatcgccgtcctcgaggtggcttcctcgattatgtt

SEQ ID NO: 13008 - DNA, 599 bp, Triticum aestivum
  Clone ID: PAT_TA_13008
ttttttttttttttttttttttttttttttttcccaaaagaaatatctctccgccaaaaccgttgttccaggcatcgcgtgacagtgcacaacaaagggtgtttctctgtctgttattcccgaaaattctctcctccaaaaaagttgttccaggcatctcagggaatttgtgtgatggtgcacaacataatgagaaacacagcagctgcacgggcaactattccccagagaaataaacttgccgcaaaaaatgtcgttccaggcatcttgagtaactaatacagttatttccagcaaaagtcctcctgagttttatgtcacaagaatcccgctgcaccctgcgactgagacgttccctgctctggcgtcctcactgtactggggtctgctgtggctgctgctgttggtgatatgcatatccaggatggcctgtgtaaccaagaatgttaggatcctcgggacagcaaccataacctggaccagagctttgagggtgtccatggtccacaccattccattgatcctgcttcttaggagcaggacgagcccagttaactgttatgcggacgcgtgggtcgacccgaaaattccggaccggt

SEQ ID NO: 13009 - DNA, 662 bp, Triticum aestivum
  unsure (1)..(662): unsure at all n locations
  Clone ID: PAT_TA_13009
tttttttttttttttttttttttttctcctaaacgtttgtctacccaagcattgacatttataacatcaacagtgtaagtagccatgttacttaggcacaagttagttcaaataaatacaagaacaccacatttccaagacaattctgactgaacaccattatcacgttgacaagtaacattcacttcaaaacttaatcaaataatgtaggttttggctcacgcttcgggtgacgactcggataataccaatatggcttagggaccggccaacgataattaggcttctctgtaattccagcagcagcagtccgctctgcataaaaactcctcaatagattctgaattatgtcacttggtaggtaaggagttccatccgagtcatagaagttcatgccaacaaagttcccattcaaatcaaagaggggacctccaattccagccttagtgattttacaagtggagaacttaagctctctgcatcaaattgtttcgncccaagcactgaccaactgtggcacagttccagattaangggcnccagggctacacnacttatttgagtctcaagatatgcncangattttgaaaatcggatctgcacacaaatgactaacanagtgaagtccannaagtgtcattgaganctaactagtaanactt

SEQ ID NO: 13010 - DNA, 522 bp, Triticum aestivum
  unsure (1)..(522): unsure at all n locations
  Clone ID: PAT_TA_13010
ttttttttttttttttttgtcctttgccctgcgtaaaaatcacattcatgccacacatcggtatcactatgtacacacatcatcatcgggtccgggccgggcactctgggtccggcgccatgtacaaacttacagcgtcgtctaccatcatccgcttgcaaacaaaaacccggcaaaaccacaatacatagggataggggggtatctcacgctagaacggggtgggggaacaggggagggnngcccctggctccctggaacactagctataatactgttcttgtgacacgagctagggtcaccgatcggatcggcgaggcgagcttggagctgtgcccgttgagcagcaggagaaggcacatcagagcgcggcaaccgtaccctgctggacccaaggtctagctactggatcatctatctacctggggtcttctaacaaaacaagaatctcttcgtcgtcgatggttccagctgtcaatggcgtactgcaaagccgttctaccttcgcggtcggacgcgtgg

SEQ ID NO: 13011 - DNA, 736 bp, Triticum aestivum
  unsure (1)..(736): unsure at all n locations
  Clone ID: PAT_TA_13011
ttttttttttttttttttaacaaaaataaacaactgtaatttttaggaaaggaactggagtgccatcaaaataaaatttagagctgagacaaatgtatgctgagatacattcgtgttcctatttttaaccatggtatagtccatggtgatatttctttacaaaaacacaaaactaaagtaatatgaaccagtaaaccaataatatagtatgaaagagttttatttttcatatgaaaataactagaacaaattattgctttaaatttgatggccaagcacttgcttgaggatctctagaacaacatcatgctccactatcatgaagatttcacggtcaattctttgtcctttcagatactcgatcatcttcagatgatcacttgctgagagatctggtatggtcttaagttttacaatgcaattggcaatgcaataaggatctttgtcaggatctttttttttcatctgtgcctttttcacttctctatagctctcaatttgttttgtccttacatccacacaagttttaagttcttcttttctaacagcaaccagatcttcaatcgctgtttcttttcctctcttagccttaccttcatcattgcctttagaagtcctagcctttttcataggtggtgggtcaggaagtgtgttcatgttttctgtgggaatttggctactgttattctcncacacgttctgtgttgttaccaggaaatacttcaacatcctcacc

SEQ ID NO: 13012 - DNA, 659 bp, Triticum aestivum
  Clone ID: PAT_TA_13012
cgtccggaaatgtatttatacttgcaagaatgttcacattctaatgctgactttgttccaataggagaaccctttggagaatgacaataaccagggcacacttgcagtgattaacctagaccagtctgtaactaatgatgatcttcgtcatatatttggtggctatggtgaaatcaaggcgattcacgggacatcacaaaatggccatcacaaatacgttgagttttttgataccagagcagcagaagctgcactttatgctttgaacatgagagatattgcaggaaagaaaatcagattagagcgctgctgcctgggcgacggtaaacgtttgacgcggcacaggcctcctgagttggagcacgaagagtatggtgcatgcaagctaggaaatgcaaacagtctgccgtcaacttactacggttctgtcaacatggcttccatgacttccgctggtcctgaacatgggatctctcgggttctgcgtcccagagttcagccaccaatacaccaattcagggagggagctttcctggatgttccctcaaatactatgcaaagtatatcctctcctgttagaattgcaactgcagtaacgcataacaaccggtcgactgtcggtgagaatggtcattcacttggaaagatgggtggacaga

SEQ ID NO: 13013 - DNA, 576 bp, Triticum aestivum
  Clone ID: PAT_TA_13013
gaagaagaaggccttcccctcccccttcaccgccccgccccccccccgtccgcatccatccatccatccacagtatcccacacaccctcggtgcgacgacggcgggatggcgaggcggtgctgctgctgctaggtactaggtaggtagggtttctttcggcctggaacaagaagacgagggggagggatctcgccgctgcccgccgaggacgaggacaaggaggaggagcgtccagggggcggcggatctgctagcgtcttcccgttgcaggaggctgaacgtcgcaaggaggcaggcatggagcactacaccatgaggctcagcgcgggcggaggggccacgcccacccagcagcagcagctctgcccctggggggagcccctcatggcggtggcgcccgaccgaaggtcgaggttctggcagatggacgtggccgtggcggcgcaccggcccgcatcgaggtcatatgcccgctgtcgagccgccccgcccggccttcccaccccgttgagccctttggcaggggcaccttcaagcctattaaacgggacgcctccagggtttagaacacactc

SEQ ID NO: 13014 - DNA, 1655 bp, Triticum aestivum
  Clone ID: PAT_TA_13014
cgtccgcaacccggccgcccccagtttcttctcctcttctctctccgcgctgccgtcccgacgtccccccccgtcttctgctcctccgcttctcgctgtgccggcccccggccggcctcctccaaatccgtacgccgagcgggccctccctccctttcgacctcctcccctgccgcagacactgcccccgtgatcccgtgcctacagataatttgactctgaaaaggtgacggctctggcctcggagtgatctgacacctaaaggatacaggcgcccttattaccctgcttcaagtaaagggacaacaaagcgatttgttgtcccgttgttttgagctggaaaacccccggtatggctgatgctagttcgaggactgacacatccatagttgtggacactgacgataagaatcaaaggatggaaaacggacaaaatggagctatcgtgccttctaattcatctgaaccatctgacaggtccgacaggcctatggaccaaaaggtattgcggaggcttgcccaaaatcgcgaggcagcacgaaaaagtcgtctgaggaaaaaggcgtatgtacaacaacttgagagcagtaagctgaaacttgcaagcctggaacaagaactccagaaagctcgacagcaaggaatcttcatttctagctctggggatcaaactcatgctatgagtggaaatggagcgatgacatttgatttagaatatactcgatggctagaggagcaaaataagcagataaatgagctgaggactgcagtaaatgctcatgcaagtgatagtgacctccgtcttattgtagatggaataatggcacattatgacgaaatattcaagctgaagggcgctgctgcaaaggctgatgtgtttcatatactttcaggcatgtggaaaacacctgctgaaaggtgttttttgtggcttggggggtttcgttcgtctgagcttttaaagctccttgtaaatcagctcgagcctctaacagagcagcagttgatggggttatccagcctcgagcaatcctcacaccaggccgaggatgcactatcacaaggaatggaggcattgcagcaatctttggctgaaacgttggctggttcccttggtccatcaggatcttcaggaaacgtggcaaactacatgggtcaaatggctatggctatgggaaaacttggaacccttgagaatttccttcgccaggctgacaatctacggcaacaaactttgcatcaaatgcaaagaattctgacaatacggcaagctgctcgagctctccttgcaatacatgactatttctcacgtttgcgtgccctgagttctctctggcttgcgaggccacgggagtaaaccatgtgcgccatcttttggcgcttcatgagctgatcctagaaatgtggacaaattgcgacgcatttgcagaagattggtggttcagttccctctgaaaaatatatattgacaccttgtgttctcatattgtacttcgatgttgtacaagtagccaggtaggggtaaggcttgtaactgtaagttcccatgaatttatgattgacatattgtacaattgtattagcaataaataaacgtagataaaaggtgcaagaggatccattgattgcacctgttggaagcaagaaaaaaaaaa

SEQ ID NO: 13015 - DNA, 758 bp, Triticum aestivum
  Clone ID: PAT_TA_13015
ttttttttttttttttttttttttttttttttttaacacaaggaaggcgccatcaagcgccactatttcattcaactcatagacaacatgaattacatagtcctgaacctgaaaattgaaaaggggctgcaaaaaagggcaaggtacattgttcaacacacatatactcaacatactcaacacacatatacatttaccagctgttaagcacacggtgagaacaactgctctgttaaatctccgtgatcaaacgagtacaataattcactactggttgagcgaccgaggaaggggatcaacgggtggagatttacacattcacagttatatatctggacacagtacacagtaattactagtagcacagggataattgagaaaacaattacttaagctagcgatcgtttccacgatcgagatcaccagtgggtatggtaatcaacatcaaagtgagggggcgcagacgacgcaggcgagcagcagcatggcggacgacgcggcgtcctcctcctcgctgaagcagctgcgcttgaaccggcacgcgcccctgcccttgttgctgtgcagccccagcagcagctcctgctggtaatgccgccttcccccgccccctgacctcgccgccgtcgggtggtcgtgctgctgccggccctggccccgccgcgcgccctggccggccgaccgttgaaccatcctgtatgtcctcctggtctatgtgttctgctctgtgagtttcgctggaggagaggagagcagag

SEQ ID NO: 13016 - DNA, 1204 bp, Triticum aestivum
  unsure (1)..(1204): unsure at all n locations
  Clone ID: PAT_TA_13016
tttttttttaattttttttgttttcttttttttttgaaaaaaaaatgattttccgtgcggccgcccgggcaggtacacagagggagcttatgtcatatgttacagaagccctgcctacgttagcaatactgatcctacaggggcatatcaagcaacgcatgtttgcagctagcagcaatctcgcggcaaagcttgacacctaaccttgctctagggccagtgagatttatctctcctggcatgtctcaaaatggaaatgcccatgcgcatgtatttataactatgagaaagatggtatcctgttaagcacactaaagcaagtattgcaatcccagaaagaaaccatccagctgcagccttgttgaagtctggttatatcaacagaccaaatgtgtcctgcacaattgcagaacactgaggacctggggcagcctttttctactgtaatctgaaccacccaacagagcgccaacctcggccgcgaccaccctacgtcagtggctattgttgcaacatgccgccgagaggcctactcatttcatgaggaatcctctcattatgtcaatagcaatgccttctccttaacgcggccgccccggcaggtacatcttccaataggtgatgctttgctccaaccaagcttcatcccaaggaaactcatcattgttacgcgctcgcaaagatgaagatagcaatgcattgtcttcagacttctctccgagaaccattggatgaattcggcctcttggccactccaaactgcaaactttccctagatctatcaccagagcgtcccaggtcatccaaattccggtaactagcatttcttggaacagagttaggacgctcatcctcatcagccctcatgccaatcctggggtccggaagcatgtccagatgcctgggtcttggtccaccagtcctcaagttccttgggttgttcgaagaattccttcctggagtgttggaagagatcttcatggccagaaagtccttggggatgctatccaagtccatgaaacatttcctggcctttgcatcagctaccagcgccgcccagtcctctgactgcatgagagcactggcattaccaacaacccatagagctctcctagctcgagtaagagcaacattcnatgcgccgtatatctgcaacaaaacccacgccatggtnttgaagcacgcctcggccgcgnnnacgcta

SEQ ID NO: 13017 - DNA, 1194 bp, Triticum aestivum
  unsure (1)..(1194): unsure at all n locations
  Clone ID: PAT_TA_13017
accaatggggagagagaccacggactcgcgatggggccgagccgccggggcgcggccccgctctgggccggtcctatctccacgaagggctggacccgtagcgtgcccaccgtgacgtcacatccagcaatagcctcatcgacacgcagtggaatgctaaagtatcggattttgggcttgcaaaactgctgtgctcggaggaaagctatgttaccacccgtgttatgggaactttcggctatgtggcgcctgaatacgccagcaccggaatgttaactgagaggagcgatgtgtatagctttggcgttcttttgatggagatcataactggtagatctcctgtagattatactaggtcagctggagaggtgaacttgatcgagtggctgaagaacatggtggctgagaggaaagcagaggacgtggtcgaccccaagctccccgagaggccttccccgaaagcactgaagcgggctcttctggtcgcccttcgctgcgtcgaccccgatggccataagcggcctaaaatggggcatgtgatccacatgctggagatggaggacctaaacccccgcgacgacaggaagccccgaagggatgcggcaacggacagatccagctcgatggaggacgggagcctgagcaagcgcgagaaccaacggtaccgatgatgatgggaatggcacaagaacgacgatgctgccgaaccgccgggacatgatctgagtttgtccggatggactgcctcttgctagatatgtacgtacgtacggtaccattaaccaagcatgtcgtgattgcattattttttggcccctgattggatctcatagtacttatgatacataaccaactcaacccccctccttgctctcgattgtattatatgtgcgagcatcgttctatgacagttcttgatatactcacttgttgaaccgcacaagtgcaggctgatggtgttctcctctgactaacacccccagctgacgctcatggcagtcttaatgataacccactagctaattgcaagtgttgctttgttttggtgcctcctgctacgctgatctaacaacacttggnccttaatatccctgcactggaagatgagcagtgatnaanctccttgtccttgctgctgctnacgtaaggcacatgcaattgcacaagcaacagtgcgccccagtaagtcgacat

SEQ ID NO: 13018 - DNA, 1031 bp, Triticum aestivum
  Clone ID: PAT_TA_13018
cccacgcgtccgcaccttattggcgattctaatgagcttacacaagatttggcatcccaaggtatgagtattgtgtatgaacttggtgatgcttctatgaaagggcagttggttcatgcactggtgaatacactgactggtgcagcggggaagaaaaaggccattaagctgatggaggattcagaggtttttcaagaaggaaccattggcagtaatcctgctggaggaaagcttagcacatacaaggagctctgtagtcttgccatgagatgggacaacctgacttgatatacaagttcatggatctggctaactatcaggctgctctcaattccaagaggggtgctgctttttggattttccaagatagccaaacaagctggggaggcgtccgcccacgcgtccgcggacgcgtgggctaggcttgtccgataccaatatgatcctgataagaacatccaggattcaatggggcatatctggaagttaattgtttcagatcccaaaaaggcaatagatgaacattatgatgtcatagtagaggatctgttggttcaatctggatcacggctttggcgctcacgtgaagcttcttgtcttgcacttgcagacatcatccaaggtcgaagatatagtcaggtttctaagcatttgataaaaatatggacaaccaccttccgtgcgatggatgacataaaggaaaccgtgcgaaatgctggtgacagtttgtgccgagctgtaagctcattgacagttaggctctgtgatgtgtcacttactaccgcttctgatgcaaaagaaacaatgagcattgtacttccattcttgctttctgaaggcatactcagtaaagttgcaagcgttcaaaaagcatctataaatttagtcatgaagcttgccaagggggctggcattgccttgcggccacatttgccagaacttgttagttgtatgcttgactgtccgacaagtctggaggatcaaaggttaaactatgttgggatgcatgccggaaatgctggcctccaaac

SEQ ID NO: 13019 - DNA, 510 bp, Triticum aestivum
  Clone ID: PAT_TA_13019
tcgagcggccgcccgggctggttcttttcttttcttgacaacaaaagataaattgttcaacttgcaagttgcaaggataagcttcagtgcattacagacaaaatacatcatacttcacaacaatagatcatagttcagaacagataacctggctttagtgtttgttgcaactaccaaaatgctattgtgttaccaacactaccatcacttctaaagtcctgttaccatactctgtcaacaaaggcacttcccaggttaccatcactagcattctaagtcttgctttcccgattgttggagtcgtcaccgccaacagcttcacccgaatcaccatcaccggtgttgtcatcaagtgcttgggttccaatatgagatgcccatgtggctgggaccttgctccttggcgtagctcctctggtagttctttacccatctccttaaaaaggaccaagaagagtcgttcatgcatatccactttattttgcaggtaccccggccgcgaccacgcta

SEQ ID NO: 13020 - DNA, 1294 bp, Triticum aestivum
  Clone ID: PAT_TA_13020
cgttgcgatgtccgcgtgtgagctgtctgagccgccgcctgggaaattagctgatattggaatcgcgatgggcattacagggactgaggttgcaaaagaagcttcagatatggtgctttcagattataacttcagttcttttgcctaagctgttggttaacgaaggttcacatccatcagcatgtaggcttttatgagatatatgagatcttccaacattggaggagttgagtccagcttcatcacgtcggctttagggtgcctagaagtcctcattccagtgggacttcggcgggtcgatcttactactgatttttcttcggcaacagcgttgtcattcaattcatcagctagggatatcatgaagaaacctcctagaagaagtgatgattcattaatcactccttggatcctgttccgctacatggttattgggctgtatgttgggattgcaacggttggaatctttatcatctggtacacccatggctctttcctgggaattgatctggctagtgatggtcacactcttgtttcatactcccagctctcaaactggggccagtgcccctcatgggagggtttcaatgtgtcatcattcacagcaggggcaaggacattcaactttgatgagaacccttgcgattacttccagggcggcaaaataaaagcaacaaccctctccctttctgtcttggtgtccattgagatgttcaactcactgaatgccctgtctgaggatggcagccttctgagcatgcctccatgggtgaacccctggcttcttctggcaatgtcggtgtcttttgggcttcatttcttgatcctctacgtgcctttccttacccaaatcttcgggattgtgcccctcagtttcaatgaatggcttttggtcgtagcagttgcattcccagtggttctcatcgacgaggttctcaagtttgtgggacggtgcttgacagctcgggccagaaagcaattaggaaagcggaaggaagagtagagggtagtgattgagtattagatggccacgggggagtagacgtctggtgagaccccattatttttctcgagatccgagggcactgctctttgttgagcatgaaggaagttagggtactctatagaactcataatcatgcctcgagtttaacagactcatttattcgtttgtaacaaaaattggtgttatgaatgtgctggagatacagcatgatttcttgcccatttactgcagtaatcttcacttatatccatgaaatattctgccctgaatgcagtgacaaaaaaaaaa

SEQ ID NO: 13021 - DNA, 775 bp, Triticum aestivum
  Clone ID: PAT_TA_13021
tttagatataagccgagtatttttatgtaagtcgagggccaacaagacacacagtttatatataacggaagtcagacattaacggcaatgccacgtgtgggtctatgtaagctgagggccgacggacacacggtttatataaactgtgggccgagcagcacagtttacatataacccgggtattctgtttatagcactcggtaaagcttaatttgcaaaacagaaaaaaaaaatcagtttgcgtgcgggatgagatgggcgagcgccgggcgagcacggccggtctgaatcctccggcgagcgagcgtgggtggcgagctctctgtcggcctgcatccgagcgatggaagagcttcctgaccacaggaggaggcgagggagaggttgcgtgcgcatcgcgtccgagccgaccaggccctagagacatcggacgccgtcgtgctccgacgagccgcgccgcccttcgcgagcccaatccgccccgcgccgtccagcccttctcctgccctccgttgtggcccatccaatcggaccgacgcgtgccgctgcctgcagcgcggccggagaggagccccgacgggagcggcggctaggactccctcgactgcgaccagaggaacagcacgccggaggcctccatcccagcgggagctcgcgcaggtcctcctgtcctcctaccacggcacaggcgggtggccgtcgagccaggcgaggcatctgtaagggttggtgcaggactcgcgcgggtaatgagagaaggtggaaggggccgacg

SEQ ID NO: 13022 - DNA, 734 bp, Triticum aestivum
  Clone ID: PAT_TA_13022
cccccctcgagttttttttttttttttttcagttcaattagtatgttttctggtgaaactgcaataaccattcacctatttagaaacacaacatggacaactttcaacggtaagtttgctaaacaaatcttacactgaattagtacgcaaaacatcgacctgaacacaatgctgcctaatgttacaactcataaatacaacgtgtgtatgagtagaacagcagatgtggaagtatacagtatccagcattttagcaaggactaacttcatgtatttgaattctgccgcagcttctccatcctttctctccatgacatcttttgcattgccagaacttcatcgccaatgagggaactgctaggttgagcttcaacatcttcagctttcttgccttcaccattggttttaagctcatcctcagatgtttccgtatcaacattcgaagacataggtacaccaaacatagcctcatcatgtgcatctctgactatgttctcattctttgactccaccgtagaaagtcggaagcctcgtcccatgtgcttaacaagtgtagcgtcatcattagcaacttcaacatcattgtcatcttcatcaagtggagcatctttgttgaattcaaacctcccccaactcacagtggcagtcccaagggtggaatccttcgaagctgtctctgcaagctgaagcttcatttttgctttgactctctcagcaggagtcattccggacgc

SEQ ID NO: 13023 - DNA, 852 bp, Triticum aestivum
  unsure (1)..(852): unsure at all n locations
  Clone ID: PAT_TA_13023
tttttttttttttttttttttttttttatttaaatattttttccagataaaagcacttcttagcaccaccatttttcataatgagatgtatagtctcacattgagcatctccggttttgaaaaagaaagatctacagagttacagtctgctttttttttgccttggtcttggaggctcaggaagcctccttacatttgtgcctcctagcatagaatacaaagacaaatatattcagtaaactcagcccagccatcatcaggtagaatctatccaaatgcccttcattcaagttatcaggtatccaccctgggctgcctcctctggctgtgaataccggcacaagtgaaaggataaacgaactaaggtaatttccggccgagatgttaagaagcgagaatgccatgcctaagcttctcatggcgtctggagactcatcgtagaaaaattcagttagcccaatgttggagaacacctcggcgacgcctagcagaaagtactggggtccttgccacaggatgctcattggaacagcccccttgctgtgcaccaaaccttcggactgtgcaatctgtaaccggttactctccaccaatgctgctgacaccattgagagcatcgagaaacataaaccgatccctatcccccgcggcgacggcatcccctccgccgtgcctgtcaattttcggactactgccccatggtcgctctctcaaattggatcctgcttagtcgcagttcacggttctctggaccgagtggttcctgcgccctgcccgaaggtccagacgtccttctccattgtcatcccttgctctacaaatgttgaaaacatttgtnnnnggannnngtgg

SEQ ID NO: 13024 - DNA, 504 bp, Triticum aestivum
  Clone ID: PAT_TA_13024
agcaggtatatgtgtcaatggttactgttcaaaacaaccaagaacacttcaggcgatcagaattattttgcactccttgtccttgcccatctttacacggcttgaatactggatgcctggttaatgcttaggcttataaagagattgccaaccactgctatcatttcaaatctaacatagtgtgggaaatatagtctgccaatgctattaactaacttgcttgatgcctgactcaaggtatgagatcacaaggtccgctgtgttacttcctgaagctatgacatttccaacagccaacccatccttgttatttcctgcatagaagaaccctggaagatcactttccatctttcctatagcttccagtgccgaatcataatcatggccatacaaaggaaaagcatttctccaatgtatatgtttcacaaaagttggctgccccactacccccaatagctttgtaaggtcagatgtcacgaattgtttcaagatagccgttggact

SEQ ID NO: 13025 - DNA, 805 bp, Triticum aestivum
  unsure (1)..(805): unsure at all n locations
  Clone ID: PAT_TA_13025
agtccccgtgtttcctcttcctccggcccctgtcgcctctcgtgctagcaccgcaccgcaccggctctcccctccctccctccctcccatcccgtcgccccgtcgccgacgcgtcctgccgccggcgcccgaccgattcgccgatccacgcaccgcccgaatggagccggcggaggcggaggcgggaggcggcatcgccgccgcgaggagcagcccggccgccgtgcaggccaccaacgacgacgccgcggcgagcaagctgtcctgtgttaccaaagggtacatgaaggatgattacgtgcaccattttgttaggcggacaacaaaaagggctccaataatcaatcgtggctactatgcccgctggtctgttcttaggaaacttatgctccagttcctcaatgctgggagtggcagtgatgatcagaagaggaaacagatattatctcttggcgctggctttgacacgacatttttccagttgcaggatgaagggcttgctccatacctttatgtagagctggattttcaggaggtaaccagcaaaaaggctgccatcatcaaccactataatgacatgaaggagaaattaggacctgatgcttctatttcaatagaaaaaggcgaagtgacgagtacaaattacaagctattttctgctgatattcgtgatataccgaagctagatgcagttattcgcatgccctgaatggacccaagcttgccgacctttataattgcagagtgtgttctaatttacttagatcccacttcaactgatgctatggntagttgggcatccgaa

SEQ ID NO: 13026 - DNA, 443 bp, Triticum aestivum
  Clone ID: PAT_TA_13026
gagtttttttttttttttttttttttttttttttaagttggcttaacagtcagtaaatgcaccatgtaaggtttacaatcataggccatttgaaaagaaaaaacattacacgcattacatcttcttcttgcatttatttaaagcaaactagctcgatctcaaatgagctagcttgtagatcccaaatagatagtagtgggtcatatcacacgattggttgtcctgcaacctgcgacgtcagcacgcagcagggcggaaacccacggacccgccgccgacgtcgtagagaacctcgtaagtctgctgctggacgttgccgatgaagccgacggattcttcaccgggggtgggcgcgaacgccaggcagccatccaacattatggatgccgggtcgagctccaaggtggcgccaccagcgaatacgagagaaaccttggggacct

SEQ ID NO: 13027 - DNA, 369 bp, Triticum aestivum
  Clone ID: PAT_TA_13027
tttttttttttttttttttttttttttgcttccaggtaactttgttatttgagctttgaagtgattatcgaaatcaacttctgttacaagcaacatcaggaggaaacacactcctgccaatgttattttgagtgtgttacaaaaaaaaattaaaatcaacgaattagcagcaaactaaaaaaaaaaaaaaacaagtcgagcggtaatgtcgatcgatccccccctatttcaatttttaacttaaaaataaagccgcgatgcagaaacccccaggagaacaagctcatctccttcgcagcgtccccaccccccccccttcggttgtgtgagcagcagaaaagaaaaccaaaaccaagcctcgccgtcggt

SEQ ID NO: 13028 - DNA, 1241 bp, Triticum aestivum
  Clone ID: PAT_TA_13028
aagtcctcacgtggtgatccgtccgccccccctttgtttttcggtctcactatttggttttttgctttactcaattacgtggtccaaagcacaagatgccctttacaacagtagaccaacatatataattaattttcaactaattttacagccttctgtctcttgctcatgtgaaggccaggttctcaacagaacaatccaaaagggctccataggggggacagagtatattcaagcatgtatacgttccgccggtacaacggggaaaatttcaacatttcaaatgttactacattgctcactccaggggctaatctatggcaattatgaggaaccccaccgagatgtacatgaggaatacaggatagatggccagagcctttctccttgggttcacagcagcgctcatgaatgggtaggcagcccaggagctccacgccagtgtgactgtcacgacgatgatctttagtatgacattgtccttcagcaagcaaattagggctccaacatccagaggaaacaaacaatagccaaggagactgaggctttggaagaagatgatgtgcccacccagaagcagaacatttagagttaagattatagccccagctgccagcacagcgaatgcgacagcaaatacttcagacttcttaacagaggcggaccaggacagtgtgaggccgaggaagacgatgaagaagaaggggccccagaggtcccagtccctgagcgccttgccggggtcctcgcggttggggttggggaagacgacaagcttgaggttgctgacgatgcgggcgaggtcgcgcttgacggtgtcccagacgggctcggtgagcgtgttgggcgggggcccgaagccttccgagccgatggcgacggagacggacgcgggcggggcgggggtcggcccctggggcacgaagatggggacggaggaggcggggaggggcggcttggaggacggcgggggaggcgaggtggagatggggatggaggcgcgcggcggggagggcggccgcgcggggaggacggtggcggagggcgcgtcgtacatgaggctctcgatctcgtccatgtcggactgcgccgacgacgggtgcagcgggatcgtgtccccgtagttgtgcgacatggcggcggcggcggcggcgcggcgggcgggcggtgtcggcgaggcggatctggggggagggggggggagatctcgcgccctcgcgggagtgggggttggggaggtg

SEQ ID NO: 13029 - DNA, 577 bp, Triticum aestivum
  Clone ID: PAT_TA_13029
ttttttttttttttttttgactaacataacatgtatataaaacacaaagagcatgtaaactacagtaatcaactagctagcttgcatagtccatggagcctgaagcaaaactaaaacttaaagccgggtatagtctgctgcaacagatgagatcattcatcatgttcgtctgcgtactcttgagccatttctctgcagcaggagcatccgccaccggtcgaccagcgcggcagccggaggtcccggatcctgctctcgcacctggccacgagcctttttcccgttgcttccaaggtgtagcagccgccggcgtcgagcagccggagacgcgggcagtggtcgaggaccgcgcacagcatagcgtggtcgaagtagcctcccgccaccacgagctgctccagaagggtcagcttccccatcgccgtcgcgccaagttcgcgcccgcgcatgtcaagcatgctcgtcagtcgtcacgtggaggctcctcagcaacggcgcgttgtcggcgaggtagacgaggaagtcgccgttgacgcggccgcggaaggactcgcaccggccggcgctgcggtccacg

SEQ ID NO: 13030 - DNA, 484 bp, Triticum aestivum
  Clone ID: PAT_TA_13030
tttttttttttttttttttttagcaggaatctcaaagcaaccatgccatgcatttggtagaattgctttcgtgttgatgcaccgaagcatttgtggaaggagtacgtgatacaatcgggatctaggacccagggtccatggacggatgcatggaagcatttaaggaaggggcagtggatggaggcgctgcgtgggcaggagcacgagcggctgcttcctcgcggtgaccagccccgcctcctcctccatgtccagcggcggatttggcacctcccagtcgaaacactgcaccagcgcggccaggaacgccggcacggcctgcatggccagccccatgccggggcaggcgcgccgcccgctcccgaacggcatgagctgcatgtgctgccccttggggtccacggcctcgccggcgccgccgggcatgaaccgctccggccggaactcgagcggctcctcccagtacgccgcgtcgcgcccgatg

SEQ ID NO: 13031 - DNA, 715 bp, Triticum aestivum
  Clone ID: PAT_TA_13031
ccacgcgtccggttccgaggtaccgcgccgatgaacctcaccgaccggctccaccatgtgctgcgggggacgacggcgtccgtggagatcttcttctcccgcaacaacgcattgttcgccacccggcggatgaagctgctgcagcgcgtggcctacttcaacgtgggcatgtacccgttcacctccatgttcctcatcgtctactgcgtgctccccgccgtctccctcttcaccggcaagttcatcgtgcagcacctgagcgccacgttcctcgtcttcctgctcatcatcaccatcacgctgtgcctgctggcgctgctggagatcaagtggtccgggatcacgctgcacgagtggtggcgcaacgagcagttctgggtgatcgggggcaccagcgcgcacccggcggcagtgctgcagggcctcctcaaggtgatcgccggcgtggacatctccttcacgctcacgtctaagcccggcggcgcggacgacggcgaggaggacacgttcgcggagctgtacgaggtgcggtggagcttcctgatggtgccccccgtgaccatcatgatgctgaacgcggtggcgctggcggtggggacggcgaggacgctgtacagcgagttcccgcagtggagcaagctgctgggcggcgccttcttcagcttctgggtgctgtgccacctcccccccttcgccaaggggctcatggggcgcc

SEQ ID NO: 13032 - DNA, 1171 bp, Triticum aestivum
  unsure (1)..(1171): unsure at all n locations
  Clone ID: PAT_TA_13032
ttttttttttttttttggttggtacatatcataataagtcgtataatcatcttttataaaacatgtcgaacaaactcagcatgaacaatcacagcaattgctgcaggcaatcttctggcaatgcaatggaatggctgtaccgagctgcacatcaaccagctcgtggaagcaacaaacaaatcatcagtgtaagtggaaaaggaaaacggagtaggcaccggcgaccttcagaggagcagcacggccatggacttcagccggcaggacatggcgtcggcctccgccgccgcgttctcccgggcgatgcggctccagctctgctcgccgccggagacccggcacgccgtcgcgaagtccaggaccttgccgaagatcctgaacatctccacggcgtagatcctgtcctggccggcggcgaacaccgcgttggaatccatgggcgcgtcggggtgcgcggacccctcagtccagtggagcagcggtgtcgagccgaggttcagctcgaacaccttccgcacccccttgtctctgcggttcgccgggtcacaccatgagacgcagagcatgaacagccgggacgcgcagcagaccagcgccggcgtgtagtctcggagccgcggcggtggccgggacgtctggacgacggaccatgagcaggcgtcgagatggtaggcgacgaccgtgtcggactcgcagtagacgtagaacatgtcgccgcagacggcaccggaacatgccaagccgacgtcggtggggaacccagcgatctcgacccatttgtcggtcaccggatcgtatatctcgccggacacgaggggctcgtcccatggccctcggccacccacagcgatgagagcttgccttgcctgagctggctgcttctgttgcctggaagccttgccgtgaccgtgagctgggacagtggaatcagtgtcctcgttcagtacatccctgagacggagccgccggagcgagagccggtgcgggtcctcgtacacggcggaggtgcctcccggcccgaacttgccgccggcgttggcgcgccggacatgcttctcagcgcgggcgtggacaatgctgcgactggcagacatctcgaacacccccagcaccggccgtgaccgcgcggcccgcatcggggagnnnttccgccacgcgcccggacgcgtgg

SEQ ID NO: 13033 - DNA, 558 bp, Triticum aestivum
  Clone ID: PAT_TA_13033
tttttttttttttttttttttttttttttttaatcggacaactctcttttatttaagtgatagaggagaggaggtccttgactgtcacaaaaagggttaacatatttgaactccggtaaaagggaaaaaatttgtgtctcctctctgacaacctaacaaatgcttcgttgacacaccagtttattgttcaatgttatgcagtgaatatataaatcttacggatggcaagttccgatttcagagaataggaccacttggaaaaaagcacaatgcacatacaaccacgatggcataaacctttggcgagctaggcagccatggtgaaattgaagttgctgcacgtcgtctgcctgccccagagcagcgagctgaagccgagccgctgattctcctcgtcgaacaccagcaggttgttctccatctggaaccccccgatcaccgccgccggcgacccgccctgcttgtccacctccccctgcttcatctccacgaacgcgaggcacgccgtgttgtcgttcacctgcaccatggagttgccgccgaacaccgtccagttcc

SEQ ID NO: 13034 - DNA, 1271 bp, Triticum aestivum
  Clone ID: PAT_TA_13034
tttttttttgttcagataaagcacgagccattgtaatgtgtgttgctgttctcaaacctctctggcataaactcgcctggatggtgccagtttgcaggagctcgagagatcgcgaagacataaacgtatccattggtgcctgttggtgtgtcataacccatgctattattatcctcacgggaccctcgtgtattcaatgaggttctcggattgtactgcagggaggtcctactgtacacctccataaagacatcattggcatggccggaatttgtagggatgttaccttgcatagccacatgaatatgcaagctttctctgtcactttgaccgcatagctttgaaccacaagtgtggagtagcttcaagtttcagatcatactttttgcttactgcaagcccaaatttctcggacatgtcaagcgaaatcgggctagcaccaccaggaagcttccagttgaagtgatacagaatatttgtcaatgtcatctccaagaccgacgagctaaactgaatcgcagggcattgtcgtcgcccagcaccaaagggagtgaattcaaagtatgtgccgttgtaatttgtgttgttgttctcaaacctctccggcctaaactcttcaggattgttccagtatgcaggatctcgagaaattgcgaagacgttaatgtttacattggtgcctttggggatgtcataacccatgatagtacaaccccctctgcacgcgcgaagaactagagaagcaggcggatggaacctaagggtttccttgatgatcatctgcatgtagtcgggtttagcgaggtcgctattagtaatgacagctcggtcttggccaagaacctctcggacttcttgttgtgccttggccatagtttcaggactgcgcacaagctctgacatagcccacgtcaaggtagttcctatggtcgacgtggcacctgcaaatatgtcaaacaagacggcgcctattatctcggtggttagagggaattccaacgagtcctcctgctgcagcctaagcaacacatccagcaggtcctcctcatcagtgctggaggcaccaacgccggcggccttgcgcccctctatgacgttggcgatgatgcgttggatgtggccgtggcacctcctcatgcggcgctcgtcgttgctgagccaccggactagccgccacgacgggaaaaggtcgacgggggagaagccgctctaccagcgcaaacgcctcatccagctcgcggaggtactcttcctgctgcgtgaacttgcct

SEQ ID NO: 13035 - DNA, 535 bp, Triticum aestivum
  Clone ID: PAT_TA_13035
cagcaacgtacttacagctaattagttcaagccagccatgggtgtgggttccaggaagaagcactgcagcggcagcgttgtgtcctgtgtagtcctatgcctagccctgctcgtcgtcggggcgaccgccaagaagagcatacgccagtgcatcgctgagtgcactggcagttcgaatccaaaaggctgcatgacatattgcatcagggaagccgtggtgctggtggcccatggagaggcaagaggagtaggaggagaaggaattgggctgctggcgacgccggtggagcgtgccagccaggaggaagaagaagagaagaggaagcaagaggccgccggcgccgaccaactgactttcgacccgtgcgatatgtgccatccagatgactactggtacgaaatgtgcatgagggtatgtcatcgttagggccacgcggcggcccacgccctccttctgcccatggacaggggaaaaggtagtaaattgtcgttgagaagttgatgcgtcctcctacatggacctttcgcaactcgt

SEQ ID NO: 13036 - DNA, 442 bp, Triticum aestivum
  Clone ID: PAT_TA_13036
ttttttttttttttttttttttaccgtaaggccattctcttggtgtacacaatgctacatttttctgcagccctcacggccacttttctcattgctcattgacgtatatataaaaggtcatacacgcaccgaccagccacctctctcgggcaactaatcccactaacctatggatggactatcaggccttatcctactcctggaatcactccaacaaccagcacgactcagccatatctaaaaactaactccgcgtctcgacgtggcctactacttcatgcaccaactaattctccagcacatgcgcagcttcacgtagcacgcacactcgccacggcggagcgtcccgcacgcacccgacgtgtccgacgagcccgaccgcatcagtgcatcccacacgtcccgcgcgcacctgacgtgcccgacgagcccgaccgcacct

SEQ ID NO: 13037 - DNA, 424 bp, Triticum aestivum
  unsure (1)..(424): unsure at all n locations
  Clone ID: PAT_TA_13037
ctcaaatccccnccaaaagaacagntaaccgagcatatcctctgaaacttaaaatgggaccatatatattccgtaatcaagacttctggacggatgcttaggtatgtattagtttggtttggtttcatctcaaagattcagcgcaacagaccctgctgttacctcatgaataagctgaatatttctgctgctagcgagtaacagcaatgagaaggtagaaaattaagtaaaccgtaaaaatacctgttattaatcacaatggcaactataattagcaagcagcaaccaatgcttggtgcatatataaacaacaatgagaaggtggcctactggatcctggaacacatacacatatttctcccaaagcactaacctgaacacgactaacctgaacaggtactgcagtgcactgaaaactgggcac

SEQ ID NO: 13038 - DNA, 731 bp, Triticum aestivum
  Clone ID: PAT_TA_13038
tttttttttttttttttttttttttttttttttgacatggcaaatatgttcttattttccagaagagctgccgcctcgtgccgccttcggcacgtgctccaacgcaaaacttgtatggctggagaagaattagaaagatacagctacatattttgagctccaatcaatcaacgcacaagatcaaccagagttttcctcctggggaaccgctgcggaagccggaggttcatggaatcctcgatctcaatgggcaaatgcgtggcgacgatgacgatcccacccttcttgcggtgctccgctatgatgtactcgagcaccttgacaccctcggagtcgagcgcgacggagggctcgtccaggagccagatcgggcggtcgatggcgagcagcctggcgagctgcaggcgcttcctctgccccatggagagcatcctggccttgtcgttcatgagccggccgaggcccatgagctcgatggcgggggcggacctgccgtgcttgccctcgaggagctcgaaccactggacgttctccagcacggtgagcttctccttgacggcgtccttgagcgacatccagttgagctgcagcttgtactgctggaagacccccggggaggtgacgtcgtggccgttccagaggatctccccggccgaggggcgcgagaagccggccagcatccgcaggaaggtggtcttgcccgagccgttggcgcccgtgaggacgagcgc

SEQ ID NO: 13039 - DNA, 669 bp, Triticum aestivum
  unsure (1)..(669): unsure at all n locations
  Clone ID: PAT_TA_13039
ttttttttttttttttttttttttttttttagccaagtcatcatggcttggcaccctccgctcttttgtttcagattcaaataagatttggcatgaacttcgcgtcaggcaaaagttctgttatgctgagtatttgagttacagacagtacataatggcagtactaaaagttagtacaaagatctgaacctattgtgtgatcacaccctgtcctagatagagtaccaaaaataaactaatgcaacaatcaaccagtagcatttctttgcagcgggaaaaaaattcatcactaattcatcgtgtccattcgcttgagcaattcaccgatcacccgcttaaaattatgtacaggtgtcctgctttcatccttcacagggaacaatcagaggatgtaccgcgacgacctccgcttaggccagcaccgcaccgacctccgctccccgccggccgccgctggccgccggcggcagctgagcacgcttcgacactgtccggttccttgcccacctaaccctcctcccatataacttgnttatatgatgctgtcccacacgcagtgngagantttggntaccttcnccacnttagagcanacngcccctactanactcacgncgcttcctnatntcacancganctaacggtcaancatcgagctccaccatnnng

SEQ ID NO: 13040 - DNA, 778 bp, Triticum aestivum
  unsure (1)..(778): unsure at all n locations
  Clone ID: PAT_TA_13040
tttttttttttttccaaacgcccttcgggttgaattcattattattgataatcatatccaagaaatcgtacgacgcttctttacgagtgcccttttttaagcatttctttacgagtacataaattgtacgacatttattcgctgcaatcttgtcacacatgcacgcatgaatagcatacgcctgcaatcgacgtacggaggatcgctcgatcgattattcactcaaatcgcttcattttctgaccgtccaaaaaataactaatgtaattccccggccatcttcaccgtcgatcagtgcctctgaaggaagtcctggatccagtagctgggacttcttgcggtacctggcgagcgtggcatagtcgacgtagatgaggccgaaccggtccttgaatccgtcaccgaactcgaagccgtccaggaacgtccatgtgatgtaacccttcacgttcacccctcccgggatggccttgtgcaccaacttgaggtggttgacgtggaaggagatgcgggtgtcctccttgagcgcctcttggttcgggattgtgccgttgtccgcctcgtcagtgccgtttgcggcgatgtacatggggcggttcccgtacgtcgccggatgtaaagcacccgccgcccccgccccgcggcgtagttgggcgtgcccggcgccttcgcccccggcccgccggccgggccccggcgcggaccggtcggggccgtngcccccgggncggnattccngaattggcgganntgncctaaantgggcctgaancgacgg

SEQ ID NO: 13041 - DNA, 678 bp, Triticum aestivum
  Clone ID: PAT_TA_13041
tcgtgcggccgcccgggctggttcctgaacttccaaatctccccctcctcgctcctggaacgtggcgccgctccaagcatctcctcaaaaaatacctgaacaacaaattcacgccttccacaatccaggaacatgtctgcagtccaatcaactcctgatcttatttagttgtcaacaagaactcttgatcttattttatccctcgttgtgctaaagcttagctgatctcttgaggtgacacgatcaacttcattgaaccaaaggcatgtgaagagattggtgatgggtatgtgctctcctataattacacaaccctcagggacatctgttcaagataaatgtatcccttatgttctcaggagaaatatttctatatcagaattcagcaagaagaaccatttgccgcttgtaataaggagcttagctgatgaataatgggttaatccctctgtcttgtagaacttcatttggttatcgattgaagcattatcatacttccagccttgttggcctcagcttcctcaaagacatcaaagcgtctataatacctggaaatagtgaagcgcacatttttcctccacaagaatctctttaacagctgataaggatccttcacaagtttaagtttcccatcgatctagagtgaataccgcacattaggaaagagccgatgaagcc

SEQ ID NO: 13042 - DNA, 506 bp, Triticum aestivum
  Clone ID: PAT_TA_13042
tttttttttttttttccttttctttttctttttttttttttttttttttttttttttttttttttttttggaatttttttcgattttttttcaaatttactgttcacacgggaagcatttgagctcgagcttaaaaacttcacatctgtacatgtaccgatgtatattactagcctgctatacaaaactgaacattcatagttcacgtttcggcgttatcaggaaagcttagctgcatcaacgctgctcaattctgcagcttcatagttaagtagcttgtgcagcggaaggaaatatggtgctattgatgccagcacaatgcaaattaatgctgcagttcccacccaccaggcaaaaagtgggatccccagcaaaagttcgtcgcaaacaatgttgaacagggcaagctctcgctctggcacatttggctttgcaaccacaccctcaggctccaccatgacaagaacataaaccggcctggtgctctcacccttgaaaagtatctt

SEQ ID NO: 13043 - DNA, 630 bp, Triticum aestivum
  Clone ID: PAT_TA_13043
tttttttttttttttttttttttttttttttgagcagtaacatttcagctagtaccatatttattcattgccagtaaatgctatgtatacaggtatatttacaaattacaggtgctgtacaggggggcagagctgatcggttctaccctacaatgcccttctcttcttctgcagaactcataggccatggttagctttcttctatacatacacaaacctaaaccatatgatcagacatccatccatctatccatctagctgaagcttcctgcggtgttctaaaagcttacattatgcaagtcatttctttttagaaccactgcgggcgtaggtgtgggctctttcccactgcgcgatgtcctcgatctgggacggcggcggcggcaggatctcacgctctaccatatcccacccgtcgacaatgctgtcttgtgctccaccgtgcttcggcggcttaccggtgtacaagaaactcgtgttcgagttcaggaggaggtcatctagagagctcggcatgatagctgtgtgcgtgctgtccagcatactgctgttggatgagatggccgaactcgccttccatattgatctgtttagctgttgtgcctgcttttctgatcttgcctcgtgccg

SEQ ID NO: 13044 - DNA, 1018 bp, Triticum aestivum
  Clone ID: PAT_TA_13044
tttttttttttttttttttttttttccaaattctgtcagatagctcacctattcaattcaagatattttggtagtggtgcatggtagaaggtgttcttacaaaatgcagccagaagtaatgaaaataacacaaattgacaataatgaactctgggtgtcctccatttgttctcactccaggatacattaaaccatttgactcaagaaaatctgatgacagttgtacgcattctgacaagttctcccatttctggagcttcctttgtttcccagctctctgtttctcacatatctgctacattacatccaaaaaatttcttccctgttccgttgcttttgctccgactttgcaggttagccccgtggtacatctgttgcggtggcctggttattggccgtcggctgggcgtgctccgatgctcagcgctcctctcttgccctcatctgtcatcagtatctctcgagggcgagagcccagagggagcttagggcacggaggcggttatggtactcgccaatagccaagaaacatcgagctgcctgcctaactgtcagaatcctgtgcatctggtgaagagtctgctgcctcaagttatcagcctgtatgacaaagccttcaaggctagccagcttgccgagagcaacggccatgtcgcccatgaagctccccaggttggtatcgtcgctaagagacccgctgcctgccaccgtgattgctaatgactgatggagctgctccaggccctgggtgagagcttcttctgcctgctgcaatgactgctcaaggctgcagatgccaaccatttgctgttcagtcaagggatcaagctgaggtgccagtgtcttgagcagatcagagggccggaagccgcccatccaaaggaagcagcgctcggctggggtcgcccacatcccagtgatgagatgaaagacgtccgccctggcagcggcactcttgaggcgaaagagctcatcgtagtgggtcaaggtgtcgtcgatgatggccctgaggtcacct

SEQ ID NO: 13045 - DNA, 954 bp, Triticum aestivum
  Clone ID: PAT_TA_13045
ttttttttttgaaaaagcatgtttgcgcaattgggccccccccccttccttttcgcgcaatatttggctcataatgggataaatacaatctaaaaatttacacgatcgcacacatagagagagtacccaaaatatacaacatcaaaacaccacaaccatatggcaactttgcaaaccattctgaactgaaacaaatagttcttctcaaaagcccaagctcagcaacacaactaacactcctgtcaacatcgttgttggtagggtgaaagcttgtgcattgaatcccgagcttggcgacgaggtaggcgggggcaccccttcttgcgtggagctcttgattgggcatgcgtagttgcaactgctggggtcgaccaccctgtacactcccttactggtgagcaagtataagtccttggcgttgtcctcgccgaaggagaagatgtagcccaacgacggcagcgggctcttggccgcgacgtcgcacggggatcggtgacgtcttggagcagccgaatgtcagtggcgtcacattgtacaccccactgttctctggcgtctcgatccccgaccacatggactgcgcatacaggtccgcgtaaatgtacctgccgttgaggcacgggttagtcatggagcggtagacgtagccgccgatgatggaggcagagccaacattgttgttgacggtgttgtgggcgtaacccatgaccggcattatggcgttgatggagtcgaccgaggtgttcccaccgggagttgacaacgccgggtacgactgggggccctcgaacacgcgccacccgtagttcccgccattcaccactaggtcgacttcctcatacaaagactggccgacgtcggcgcagaagaagtaggagggcttcgtggagtcgaagctgcaacgccacgggttcttgaagcccatggcgaagacctccggcgcgaacttgggct

SEQ ID NO: 13046 - DNA, 836 bp, Triticum aestivum
  unsure (1)..(836): unsure at all n locations
  Clone ID: PAT_TA_13046
ttttttttttttttttttataaaaacaatcactacagcacaattcagcaacctgagcctaggtcagttctgcaaaacgcttggacatcacatcatctaaaacgagcgcatcagaacctaccatatgtttgataaaagatggcctcaatatggcatttctatctggaaatgcaaaagaatggatgatgtgcttagacaataataatacatgtaacggactgtacaagacgcaacaaagagaaacttctcatttcaggtccacccaggtacacaataggtgtagcctggagtcgagacttgttcaggtcttggtaacagcagtcttgcaaaccgggcaaacgttcttctgagaaagccactgcttgatgcagtaaacatggtagctgtggccgcagcccagccttcccccagctcgtcatttgcttcaaactcttcttgacagatactgcatttcttctccgcttccgtcggaagccggaatgacgaatcaggcttgaccttcctaaggttgcgaactatctcatcctcgcgtagccctgtgttgacatgccntattctttctccaagctcaagcaactcctcataagtcatgttgtcgacatcaaggcgccaatcctggtaccgatcatacatgttcattcctcccaacaacactcttgtctgaaacatcatgatctcttctttgaggccgccgggggaggggcggtacccgcgcatccggcggaggcgcgcggaggggagcaggtcggcgccgaagaagggcccgtccaggtgcgccggcggcggcggcggcggcgactccatgaacgacgacgatatctgctcctgcatgctcgc

SEQ ID NO: 13047 - DNA, 497 bp, Triticum aestivum
  Clone ID: PAT_TA_13047
tttttttttttttttttttttttttttttttcgcccattcaactactttgttcacctcttgttagcacatacacatgacaatggtgagctctttcatcaacatattatgttgctacttcatgtgaaaagtaaagagaaatgcatgacagccaatacaaacgaatctcgtctgtagcacagtacagacacactgcagcttagcttcttttcggatgtgcataattacagctctagtaagagcgcccatagttttttcttcccttctctgcgttcagcgccctcgcctaaagttgatgccaagcgagattgagacaggcaacggcagcggtggctcgccggagcagtaccagccggtgtgcgtgaccggagccaccaactcatccacaccctgctccggcagggcgtcttgtccacgccacggcgaaggactcaggatgtgtcacctattggttctttgcagattggtgctgaatatcaatcaatatggaacctcatct

SEQ ID NO: 13048 - DNA, 487 bp, Triticum aestivum
  Clone ID: PAT_TA_13048
ttttttttttttttttttttttttgaggtttcaacactttctgtttagcagaaaatgacgtgatcacagtaatcattacagaacatgttatatgacaactgccacatcatgccacgatcttgcattattagctgtctgacaaccgcccaagttccagctaaccacattatattaccctataaacactgtatttcagtgaagacacaaatttgctactagagcaaacctgaaaaaataagaagaaaaacgacacggccttctcatgcgaagtcgcatctgaagtaaggagaaacagaacaggttgcccttccttgtcttcacaagttgcggagcctcttccgacattcagtatccgtctttttcgcgtattttccgggccaaacatacatgccactcctttagtaaccgaagttacaaaaaagcttatgaaggacattgtattcggcctctatttacgcctgagagagatacagctgcccagtatagc

SEQ ID NO: 13049 - DNA, 520 bp, Triticum aestivum
  Clone ID: PAT_TA_13049
gtcgagttttttttttttttttttttataaaatgtagtaagacttaatatatcacatgttttgttttataaagtacatctcctctctggtaaaccctacctcccgccctaacaacatatcaacatttatcaatcggaacaggtaggtaaacagatgatccaagaacaaacatacacacgcaagatcaaacaccgacaacccaaagcagtagatggatgcttgtgaatcccatcttaggttggaggtgagaacttgatgatgaagtcgtagatatgatcactgacctcctgtgccctctccagctggatgaagtggccggcgccggggggggacgaccacctcctctagcagtggcacgtcctccttgaacccgcccccgtggatgtactcccgaaccccctcgaagtggtacgtgatttcaccttcacccaccacatacttggtcggcacctgcaccttggcgtccgcccacgccgcagccagctcgcagttcctgtccaggttgcggtagtagttgatg

SEQ ID NO: 13050 - DNA, 587 bp, Triticum aestivum
  Clone ID: PAT_TA_13050
ttttttttttttttttttttaaataaattactcgtatacaagggatattagggcatctccaatgtggatcaccaaacagataccaccaacacgttcacgaacatccgtcaagcgttgtcattcaacacaatttaccaaagtggacgcaaaaagtgagacaccgagcattataaaaaccaaataaaaaagttcactaattccgttcgaatcaaggtcgatgacccagccaccgacgtgacttttttgcatcgccatcgtgctgcttctgtgcctcgtcatcctcagcttcaatctccttaatgagccactcacgttgtgcggagataagtcggccgctgcatgtgacgaagatggtgcagggatggaggcggcgcggggcacagccatcgcaatcctcttctgccacttcgcggatgcaggggagaactgatttacgacttttgacaaccttcatacgatgagactgccagttctttaatgcctcaggaacatcctaaaaaaaactccttgcaattttttcctttcaaatccagtcctccatatatgaccatggaattacattagaaaaaaactcgagactagttcct

SEQ ID NO: 13051 - DNA, 581 bp, Triticum aestivum
  Clone ID: PAT_TA_13051
atattcccgatgcaatgctgccctggagctgctgcgcctgtgcactgacgcattggagcgtgcagctgaatccatgctctcccatgctggcaacgtccgggaaacatcaatctcctgctttaggccagttcagtcagaagcccagtatacctatctttggcaggagctggctcttctgaaagcttctgtactagaaacacgggcgaagctgatgctccgaggcggacagtatggcatcggggatgacctgatacggaaggccatattcatccgcacttccatctgcggcgagcaccaccccgacacggtctcggctcgagaaaccctcagtaaactaacaaggctccttacaaacgtccaccttagttgattcgtatagcttaggacttcacccatatattctttttagtgtggctttttcataatcgccgtacaaatacccccagaatatcaaataacaaagtatatttaccttcatcatttcacttcttttttctttttgctactgttactaaatgtaccctatcttatttcatccctgttacgactctcttcagggttctaccaatatatgttgggct

SEQ ID NO: 13052 - DNA, 365 bp, Triticum aestivum
  Clone ID: PAT_TA_13052
ttttttttttttttttttttaagcagaaaaactgaagaaaaaaaatcaagtgtatagcttcatttatacattggtgtcacttgtgagacaccaaacaacacaagatgagacagcaaatctgcatcgatctgcatgggctcatctggatgcaatgcagagtatgaacaaccaccactggcatgaagccagctctatctagctagccagctagctcatcatcctctggaactcatggaagtcgaggccgccgtcgccgtcgacgtcgtaggcccgtatcatggcctcgcagtcggcgacggaccggtcgtcaccgagctgggcgagcacccgccgcagccccctggccgtatcctcccggcgggctg

SEQ ID NO: 13053 - DNA, 693 bp, Triticum aestivum
  Clone ID: PAT_TA_13053
ttttttttttttttttttaggaaaacatagatttattgaaatggagataaaaaccagacaagaattctagctaagctagctcgctcttatttcatgcacgcatggaaggccgttaacgacatatgatgggatctcaagctgatgccgcgagatcagcagtaggccccttcgggccatgcaagttggcccagaagcagctgtacttgcggatctcaccattgtttccgaactcactcggcaaatgtgccatcttcctcatggaggtgccgaactgggaaaagaaccacccttggtcctgcgcaaagccgtcgaccagccagctggtgctggcgtcatgtgtgagggccatgtcggagttgagcacccccttcccctccttcaggttgttgtagtacacgttgtcgaacttctcaggggtggtcacgtcccaggtcctgcagatggttagggtttctggcgcaggtgccttggagccaacgaacaaagtcggcgttctctccaaagcggttcttgaagctgccgcagcttgacctcccgatcgtgtgcgcaccggagagggccacgacgtcggtgatgtcgaaaccgcgactctggaaggattcgatgagctgggtggcgttgaagtcggggcccggcagctgctctacgttctctctgggagcgggcgcgcggctatccagtagaccgagcggc

SEQ ID NO: 13054 - DNA, 726 bp, Triticum aestivum
  Clone ID: PAT_TA_13054
tttttttttttttttttttttttttttttgataaagagtgaattttattggctcaaaagaagcatcaagaggatacaaactcaaagagcacacacccgacctctgtatagctaagatgcatacagccaacaccaacacacacacacaaaaacacaccagcaaatagcaaagtcatataagaccaaagctatgtgtaggcgaggaaaaaaagaaaatccaaggagaccaaatccataatcgacaaagtataacaatgatagtatccgtcgctgccaccaggggacgctgcgcacagggatcccgtcgacggtcaatggatggcttggtgtggaagggcgtgagtacatgtcgatccggtttcttcggacatggaacctccgccagcaggcctcgggtagaggaccagatcgggccggtcaaccacgcaacatactccacactcgtgatcgaaaccaccgttgggtcgccagcctagggagcgccagatctgggcggaggactcgccatagcagccgcccaaggtccgtagtcttcaccgagcgtggtcgccttgcctggcgggcaggctacactcagccctgccgctgcatatccagcaagccaggaacccaagagccaagccggacacacaccagaggcacgccgtccaccacatagcaccaaccgacggaacgccccgccgccgccgtcaccggaacctgccgagcttcactgaccggtgcctct

SEQ ID NO: 13055 - DNA, 989 bp, Triticum aestivum
  Clone ID: PAT_TA_13055
cgtccgggcgtcagtgccgttctgtgccccaaggattctgtagaaagccatatgcaagacacaattgttgcaggggcttatctctgcgacgaggagaccgtcaggatagtatgcacagaaggtcctgagcgtgtcaaggagctaatagccatgggtgcttcatttgaccatggtgaagatggcaggctccaccttgcaagggaaggtggacattctcacaacagaatcgtccattctgccgatatgactggaaaagagattgaaagagcgctgcttcaagcggttgaaaatgatgagaacatatctgtgttcggccaccacttcgccattgatctgttgacctgtcagaataatggtgaaatcttttgttacggagtggattcattggacaccaaagctcaaaaggtagtccgtttcatctcaaaagtaacattgcttgcgtccggaggagctggccatatatatcccacaacaaccaatccaccggtggctactggggatggaatcgcaatgtgccatcgcgctcaggctgtgatatccaatatggagtttgtgcaattccatccaactgcactatcagacgaaggccttccaataaagccagctaaaataagagataatgcatttcttgtaacagaagcagtcagaggagatggaggaattctttacaaccaatccatggagagatttatgcctttatacgacgaccgtgccgagttggcaccgagggatgtggttgcaagaagcatagatgatcaactgaagaaacgtggagagaagtatgttctcttggacatcagccacaagccaagggagaaaattcttgctcattttccgaacattgcagctgaatgcctgcggcacggtctggacatcacacagcagcccatacctgtcgtccctgcagctcattacatgtgcggtggtgttcgggctgggttgcaaggggagacgagtgtgaaaggcttgtatgtcgctggtgaggttgc

SEQ ID NO: 13056 - DNA, 441 bp, Triticum aestivum
  Clone ID: PAT_TA_13056
aatcagaactggaatccataaggcacactgccaaatatggcccgctcaagttactggcttttttgttttccggtgctctctttttctagggtggaactatacataatccgtagcacacaacataaggtggaactatacataatccgtagcacgcaacataaggtggaactatacataatccgtaggacgcaacataaggtggaacgataatctgcgaccagcatcacaggcaaatgtatcagcaaacgtaaaagtctcggcataagatgctaaaaactagagacgaaaaaaaccggatgccctcagttcggctgacactttccatccgtcccatttgctgctttcagcccgcgccctgcatttgagaacttgttgtattcagtacttcccccagtcagacgtaagagccaaagacataataaccgacgccatgtttggtct

SEQ ID NO: 13057 - DNA, 688 bp, Triticum aestivum
  Clone ID: PAT_TA_13057
tttttttttttttccgggaggttcggcacggtacttcattccatcaggggctccaccaccgccttttctacccctttatgtttccagtaaaggttccacttgacgttcctcgcgtcagggatggcatcaggtgtatgtcatctgctcttccagatgttccaagtcttggaaagctcttccagttccaccacatgtgctcctcatggcagggtgtatgggccgcatttgtagccgatggggcggttggcgatggcgcaccgcttggggatggtcatcgcgacggcgggcttgacgccggcctggcgcgcggtggcggacagcatgacggcgcacaggcacttggggctgcgcccgatgctgcgtatctgcgcgcagcagccgggcgccaccttggccccggggttctgcgtggccgccgcgcacggggccagcttgagcgccatcctgtccgccggcacgcggccgcactccccggcgccgcgcgccgccccgagcccggccaccaggagcatcgccagcctccgctgccgcctcgccgcccgggtctccttctcccctccgctcccgctgcgcgtcacggtgcgcgtgcgagagagagagagagagagagagagagagagagagagagagagagagagagagagagagagagagagagagagagagagagagagagagagagagagag

SEQ ID NO: 13058 - DNA, 610 bp, Triticum aestivum
  unsure (1)..(610): unsure at all n locations
  Clone ID: PAT_TA_13058
tttttttttttcttttatgtgccaattttagggcgtatacaccaccattcccccacaatatatcgcactgttgaaaggtaaagacaaaatctgacatgagatttatttaaaatgcagaggctggatgatacttaaaatgcagagtctaaagctctgctcaaatctctaccgatgtttgaaagagcagctgggatattatttttttttcctgtaccaaaacaagccatgatccacattcccaagttcttccgcaatccaatacccaagatgggtgttgacgccaaggagcatgtaaagtccgtccaaaatgcactcctaaaagatgccatcctgtttgcacattggacaagatagttgtgtcntcancagaccccttgtgcatggggtttnnatgccaccaaagatgcatcacgccaagcatcaagaatgcaaacgcaaggagcatcatcacgggatatccaagacggtatatcctacgccactcaagtccttgcgatccgtgcntttacaacctatgntccttgatctgggaaantncagnaggaaccccgcaaacatagcnggtacccttatcacttctcacangcttcaaaaaagttgcccggcgntn

SEQ ID NO: 13059 - DNA, 757 bp, Triticum aestivum
  Clone ID: PAT_TA_13059
cgtccgcggacgcgtgggcggacgcgtgggctgcgtttcaccaaggctcatgtgactcaccctgaactgaaatgtacgttcaacctcgacataatttcggtgaagaaaaacccaaatggtccaatgtacacttctcttggtgttatgacgaggggaacaattattgaggtgaatgtaagtgaacttggtctcgtaacccctgctggaaaagttgtttggggcaaatacgcacaggttacgaataacccggagaacgatggatgtatcaatgctgtcttgctcgtgtgaagctttgatacaattctggtcaagacggcgagtctgctgtttgtatccggtctaacaagggcaattttacagcaggttacagtaagggaagaagactattccacccccgcgtggcgcagttcgcggggttcctgagctacgacgggctcgggaagctggtgtacctccacgcgtgcgtgacggagacgctgcgcctgtacccggcggtgccgcaggaccccaagggcatcgcggaggacgacgtgctcccggacggcaccaatgtgcgcgccggcgggatggtgacgtacgtgccctactccatggggcggatggagtacaactggggccccgacgccgccagcttccggccagagcggtggatcggcgacgacggcgccttccgcaacgcgtcgccgttcaagttcacggcgttccaggcggtgccgcggatctgcctgggcaagggctcggcgtacctgcagatgaa

SEQ ID NO: 13060 - DNA, 1141 bp, Triticum aestivum
  Clone ID: PAT_TA_13060
gccggacccccgacgcctttccgccgcctccccaccgcaaaccccgaccagccctagggttcgccgccatgcctcagggagattacatagagcttcaccagaagcgccatggacggcgcatggactacgaggagcgcaagcgcaagaaggaggcgcgcgccgtcaagaagaactccaaggatgcccgcaagctactcggtgccaagggcaagaggttcgccaagaagcggtatgccgagaaggcgcagatgaagaagaccctgaaaatgcacgatgagtcttcttcccggcagaaggttgatgatgatgttgaggagggtgccattccttcgtatctgctggatcgtgatccgacacagcgcgccaaggttctcagcaacacaattaagcaaaagaggaaggaaaaggctggcaaatgggatgttcctttgcctaaggtcagacctgttgctgaagaagagatgttcaaagttctacgcactggcaagcggaaaaccaagcagtggaagagaatggtaactaaagccacctttgttggccctggatttacaaggaagccaccaaagtatgagaggttcatccggcctactggtctgcgtttcaccaaggctcatgtgactcaccctgaactgaaatgtacgttcaaccttgacatcatttctgtgaagaaaaacccaaatggtccaatgtacacttctcttggtgttatgacgaggggaacaattattgaggtgaacgttagtgaactcggtctcgtaacccctgctggaaaagttgtttggggcaaatacgcgcaggttacaaataacccggagaatgatggctgtatcaatgctgtcttgctcgtgtgaagctttgatacaattctggttaaggtgctgagtgcgctgtttgtatccggtctaacaagggcagttttgtcggtattgcagttcgtgcttgtctttggaatagacccactatctagtgtaatgtcaaggtggaacagtcttcttcccttactgactaacctgctgtaagatctgagctatagagctggcaaatccttgaatggaagcaccacatgtcttttttctaaaaataaagcttggctgctgcttggtgtgcttaattagatgtacctgcccgggcggccgctcga

SEQ ID NO: 13061 - DNA, 575 bp, Triticum aestivum
  Clone ID: PAT_TA_13061
tttttttttttttttttttttttttttttttttgattttgaatcgtgcggtttggtttggcctaaactcaggcacaaatttcagccggaaatcttagccacgtacataaggagattctcgataaaacagaggaacacacaggtcccaagagaatgttaatagagattgacacccaatactaagaatttttcgcaaggaaagaaaatccaatccagcccatgtggggatgccactctgcatagcagattactgctacgagtccacgtcacacgtacagcacacacgtcactctcgattggacgagttcatggcgtcgaccgatcggtcaccagccaagcgccggcaaggctcgaggacggccgggcgcgaccatgttgccggcggggtcgtagttgatgacgccggagaagtccgggagctggcacttccctcccatgaggatccctttctgccagacgcaaggcggcggggacgcgtcggcccctacgccgccgggctgcacctggtggatgctgatgaccgggtccgtcctccgggggctcacgctcgccagcgcgcgccgcagccgctctgtc

SEQ ID NO: 13062 - DNA, 310 bp, Triticum aestivum
  Clone ID: PAT_TA_13062
tcttttttttttttttttctttaccaaactattaatgataatcagcctgaacatcgagttacatggaaacctataccacctaaatatccacaatcaaataggagtagctctgttcatgtcaaccatttttacgtttcgatatttgtcctacaagtcggctacaaccattcaggtttctttgcagtcttatcctaccacgaccatcctagctagcccgctagtaatcaccaccgcggggtccccgctgcctggccgcgctcctccgatcgctgccgtggacgtagtcgtcgtcgacgaagctcggcctctc

SEQ ID NO: 13063 - DNA, 1763 bp, Triticum aestivum
  Clone ID: PAT_TA_13063
ttttttttttttgtctcgaattcactagtgattagcgtggtcgcggccgaggttttttgtattactagttcattacacctggcatgtgcatacaagatgcataaatgccgatttattatggagttcaagcaaaatagtactttgcataacaggtgacaagcaacccctgataaaactcaaacatcatagtacctgcccaccaaaaaggttaggacataactttccaaaataagcaactccggtgtcataacaccactctgcttcggttccttatttagcaaaccctggacggtcacccggattgatgtgctcgagttctatcggcaggccttgcagtggcgacgggaaggagaccctcacgaaagtcttctccttgcagcaaagcttccatctgaagtgtctcaccaggtgggtgcatcatcaccaatgtttccatcttgggaaaactccatcccagggggatattctggggccgcctcccgaaggggacgaaggagcacggtggcgtcacggatgactggctctggaacctggaggggtcgaacttagctggctcgtggaagatgctcgggtccatgtgcgtcgcgattgccgtccaaatcacctgccagccttttgggatgtggtagccgtcgaactcgatgtcctcgagtgctgttctgaagttgccgaagataggagggtcgatgcgaagtgtctcctgtgcaacttgccatgtgaacttcatctttgagaggtcttcccaggtgagagcctctccctcagccttgttccttgcaatctcttcatgctcttgcaccatagcggcgagggtagccggatcattggcgaggtggccgaccatgcacgtcatgagtatggaggtggtgtcatggctggcaaccagggcgaacatgccgttgtcgagaatctcctcattggttagcagctgctcgccatgctcgtccgtcatgctgagcaggcgagtgatgaggtcgctatttggcgatgccttgccctgccccagcttagccttcttgtcactggtaatcacctcgagcagccgtcgtgcccttcggccggccttgaggctccggctgaacgttgtgaagggaaggttcatcggggatggcaaaaacaccctcgatcatgcgcccaaaagtcactggtgaaggcgtcccggcgtggcgcccgtctcaaggccgaagagtagcgaggaggtgatgtcgaacgtcagcgccctcatgagtggcagcaccgtgacggtcgggtggccgtaccagtgctcctcgaggtggcgcctcaccttggcgtcaatcctcccagtgtatcgcctgagcatgtccggcttgaggaactccattagcgccccacggatgcgccggtgatcttggccgtgcatgtccacgatgctctttctccccggaagtacgctggaaggaccggtgcgtcctcatccgcagcccgctgctaaagaacatgaacttgttggccgccgggcccgtcaggaaaaccgtcggcgtgcagaacaccgacgccttggaaaccggcccgtacctcttgatccggtcctgtatccactggttgccggcgctggcgcgcgcggctcggaagacgctcaaggtctggcccaatcaccggaagacctagggagccagggggcaggttggccggaccccatttcctggctctggtcaagaggtggatgcctatgaccgaggccgtgacaacaagtgctacgactttgagcaaataatccatctcaagagattgtgttcacattt

SEQ ID NO: 13064 - DNA, 717 bp, Triticum aestivum
  Clone ID: PAT_TA_13064
cccacgcgtccgcccccgcgccccaagccaaccaaccaacgccgcaccgccacaacaaccgccgcgcacggccgagcacggtcgaacacttgccatggctcccaagaacgcgctccccgtcgccgtcgccgccgccgcggacgccggcatggagcccaggttccgcggcgtgcgcaagcggccgtggggcaggtacgcggcggagatccgcgacccggccaggaaggcccgcgtctggctcggcaccttcgacaccgccgaggccgcggcccgcgcctacgacgccgccgcgctccactaccgcgggcccaaggccaagaccaacttccccgtcggcaccgtcgccgccttcgcccacgtcccgctcccgccgcccaaggcgctggccgtcagccccagcagcagcaccgtcgagtcttcgtcccgggacacgccggccgcggcgcccgccgctcctgctgctgctgcccccgcgcccccgccggcgctcgacctgagcctggcgatgccggccatggtggcggcgcagccgttcctgttcctggaccccagggtcgcggtgaccgtggccgtggccgcgccggcgccggccccctgccggtcagcggcgatcagcggcatgaacaaggtggccgtccgcgaggaagagcagagcgacaccgggttgtcgtcatccgtgggggacgcctcgacggtcgtgggcgttgggttcaacct

SEQ ID NO: 13065 - DNA, 667 bp, Triticum aestivum
  Clone ID: PAT_TA_13065
ttttttttttttttttttagaatcccagtttacaacaaataaatcgactgtaggctttcaagttacatggaacaaataaaagaatgtgcttacaacaaaggagcacggcatggagtgcatacaagccaagccaaaatgcctatgtacaggagtgcaagccaataaaaagcaaggaaacccacaaccgaaagcctatgtacacgagagcaagcaactcaaaaaggctagctctccctttttaaaaacaaacacaccaagcaatcctctctaaagaaaataaaaaatgaagcaatgaacatgtgaatcaatggtggaccggcggcgacgtccaggacggcaagtcaagcctgagttgctcgcagctggtctgaacattcaacgatcacgtgagccaatcacggagcggaggaacgatcagaccaacaaccatgggtgcgatgcgacggtatcattgtggagcggcaggcggctggccgccggcgacgcggcgcttgagcatctgggtgtagttgaagatggacttgaggcgctgctgcctgaggtcctccttgaacccctggatgaactcctccgccttggcgtccacctcggacccggccgcctcctcctccgtcggcggcgcccgctgccgccccgccagggcgagcgcgtacgcctcgtccatgct

SEQ ID NO: 13066 - DNA, 783 bp, Triticum aestivum
  unsure (1)..(783): unsure at all n locations
  Clone ID: PAT_TA_13066
tttttgttttcgagcggccgcccgggcaggtacttttttctgccctactactagtcctggggaaacatgtatccacaaactctgaaggaactgaattaaaacactaagaaactgaagcgcatgccaatgcaaagtaggaggagtagtatgagagagatggtccatttttctttcatgacattgctctatttacggactccaatccgtcaagcctcccctcttctcgtatcataggcagccttgttgttccacaaatatccgaatctgaatgcgcccgcgctcctccccactgttcgagttcgacccgtccaagttcggaaacacgcttacgcaagaccatcactcgcgctcaacaacaacggccaccgactctggccgcgacctcggaagctgaatgcgcccgcgctcctctccactgttcgttggaccggtccaagttcagaaacacgctccgtcaagctggagaccatcattcgcgctcaacaacaacggccaccgactcggccacgtctccggactccctccggcccgctcgcctcctgtggcgcccctcccggctgcctccccccctgctcccgtggccgcgccgcccgacggccccccgcggccccccgcggcgtgcctcctcgaccccgcgggcccccgcgcgcgcgctggccgcgccggccctgggcgcgccgcgcggcggtctgtcgcggccgcgccgggggccactccggcggccaacntaactcntctgctaaanccgcagagtaccgncggtacctctgcataccggggaag

SEQ ID NO: 13067 - DNA, 568 bp, Triticum aestivum
  unsure (1)..(568): unsure at all n locations
  Clone ID: PAT_TA_13067
ttcccgtcanacgtntaaagacgccgtggncggtatagttctctttttttttttttttttttttgaagataaatacgacgtgtattaattcatagtatgtagctgtgtaccaaagcgcagtgcgcgcgtcaaccgatcagaacataacccgtacatggcacatcatcagctaattaaaatagtgaccattgcccgcaaaaaataaaaataaaataattaaaatagtgacccaaggcgggaacacgagtacacgactgccgagggccggtccagccagcagacgcgcgcgacgcagcttagcagaagaggtacccaacggcggcggcgacgagcgtcccgaaggcgaaggcgggggtggtcgcggcggctccggtggccgggctgggagccggcgcctcagcagccatggccatgcccaccacggacgaggccacgacggcggcggcgaggatcctgagcttgagggtggccgccatttctgctaggtagctagcttctcggtcgaccgatactaattgggaattagtcgaagatgtataagcactgagcaaagaacaggaagctggcg

SEQ ID NO: 13068 - DNA, 736 bp, Triticum aestivum
  unsure (1)..(736): unsure at all n locations
  Clone ID: PAT_TA_13068
agttgacagaaaattagcaaaaccgcaattttacagtaaacatatactaggacattttttcacacgcaagtcggctcagatcagttttctgctgacagtcaagcctgagtaccaacaaatattacacacacgattacatgggttacaagagcactaggtacatgtacatacatctccctctgatgtcaagcaattaaaaactactgcaaaagaatggccatctgctctagcaagattccatcggctcagtactagatacagcgcttgcacttttgtgaaggcaagcacacagaatggtcctgcagtgaaaaaatgaagggctatttgtaggacagagggccagatcttgacacagcaaacctttgtagtgagccggcaccatggcttccagagcttgaaccctcgacgaacttcgctttcctgcttgcaccgtagtcgagtggcccagaacgcctcatacttcgtagctgcctctctccggttcttcggtccacttcatagccgtcgtcgtgctgggagccagatgagctgtggtagcccgactcgtaagtgtgcgacctgggtgttgtgtccgatcggttcggcctcattgatggggaagcgtgcgccagagaaatcagaggcgactgccttggggatggctccgttggttctgaacccatttgtgaagctccgtacagctcgtgatggatcgaacgcaggatggtgtctggtagggggaaaccnaattntagnn

SEQ ID NO: 13069 - DNA, 658 bp, Triticum aestivum
  Clone ID: PAT_TA_13069
ttttttttttttttttttttttgggaaatttgtactccctccgttccataatatcacaggattttattaaaacagagatgtaagacaacgagatcaaaacatctaggtacaagcaaggagtggacaacaatgacacaaacacaacgaagatgatactatttggcaaagaaaaccacccctccatcccgtaatgtaagactttcttgacactagtgtagtgttaaaaaaagtcttacgggatggagggggtagttagccggtggatcaggtggcgacgcagtccctcttgcagcgggtcgtgcagtcgtccgtgcacatcccgatgaacatgtcgatggtttcgcggcactgctgacgggaaacgtggcaggcggcgcactgcctgttgcacctagcgtccgcgcaccgggcgagggccttggacttgcaggcctgcacgcagcctgggtccggcggcgggccacagggtccggaggtggtgcaatcaagccagggtgacgcttgggcgttgatgttgtgggtgcagatagagctgcagttcatgcggcagtccccctcgcatgccgtcgtctccgccgccgccggccatcccaggcccaacagcacaaccaccagcaccgcgaccacagctgcgcttgatgaggcccattagaagagg

SEQ ID NO: 13070 - DNA, 754 bp, Triticum aestivum
  Clone ID: PAT_TA_13070
ttttttttttttttttttttttaagtcaagactatggatcttcattaagtagggacaatagttgggttgttacatatccaagcaagccagagcggcctatgtagttctactaaatcataatgttcagtagtttcacgcggtcgtctcattgtttctctccttgctcgctgcccaactcctcacgtgccgtggctgccgaagctggtcgatgtgggttgccaccgggcgtccatcctccctgtctcgccaggaaaggaatgtagtagggctctatggaccaacataatttttgttgcttcattcgtcctctgaccaattttttaaatagaaaaaaatgccagtggaaagcaccttccgctggttcctggctacagcttctcttcaaaccctagtttgtggttagcctgctaccggggtcctaataaatgatttccgtgaaagaaacaacgcggtgaaaatgtctatagtctaccctcctccatttgttgcctattccagtaagtagatggcctgaggcatgaataatgaatctatgtaactgaaaagacagagcattcacatgacagtgccatggatcaagaggccatctaagaatataaaagaaggaaactatacaataagtgcaacgaaaaccaagcaaactgatacttccatcacacattatattaataaataggactattaaaaaggtgtgcgcaaagccatcacgggcgtgcaaagccatcatgggccaggtaatcaataagggatcact

SEQ ID NO: 13071 - DNA, 1137 bp, Triticum aestivum
  Clone ID: PAT_TA_13071
tttttttttttttttttacagctattatcaaacattgagtacaactgtatttaaaggcatacttaaacggtttacacattctctagatcttataaatatattccaatagcagaaatagtggctaaaacgtctactaattttggccgccagtatgcacataacaccaagaagaaacaaaacctcacacgagagatagctggcaacagtgcctcaaaagctttaattaagggtggaaaaacaccttgctctaagaaattacggtctctgtttgcttaaccaagccaagactacatagctgtttgacacaggttttaattttggctacatatcttcaatgcaaaacgacggcaaaaagaacagaagacctataccaacagcaacaaatgatgattagttaaatactggagggaatagccctaccatcgaaaaccagtaaaagggtaatcagaacaaacaacatgctgctaatacatatataccctcctgccggctcaacagagcttgactgctgtggcctacatgctcgcttcgctttgctgtatttaccctatatgtcttcccatctgttattccgaaagggcactctgcgacgaattgtcgatggaatcattgttcaagcgaagcagctgggaccccagcaacaccaggtttcgtttcttttgttgcccatggccccctttgggctgggttggaacctatggaagcgctgcacttttgcagcatattttttcgaggtcggcgacctgtcggccacattcccaccccgcgaaagcctccgtctcttcccaagccggaacaagaaatcttcggtgtcaaggacataggagaccttagaggtcttgcaggatatcttgcattcaagaccattcgcaactttgataccatccatggccttcaacgaatctgaaggctcgccgtcatttgagtgtttccgcttgttccttccaaggtagacgccttcaggcagcttcgtgcctgacgtacttcacagatactcgctgaaaagatatgaggcaaaatttggctcaatggataccgcagtcacctctggcttctcgtgaccatattccatcagctgaatagacccctcattggacttgagcaacattcgaatcgatacatgctctcatcatggag

SEQ ID NO: 13072 - DNA, 837 bp, Triticum aestivum
  Clone ID: PAT_TA_13072
tttttttttttttttttttggtggtttatatgttaatatttttcggtctgcctggtcctcgtccgggccggcccgcgttgccgtgtctcgcgcccgtgcctgcagcccgtccggcgctttggtgcctgcctaaacaccaaggtcgcggtcgggtacagccggagcacctccatgaggacagcgttgaggtactctagcttcccaagaacctcctcgcccacctcctcggcgtccgcgtcaacagcagcgttgatctccctacggacagcctcttgcatgtgtgggcgcttcaccaggttcgccatgatccactgcagcgccgcggccacagtttcagttcctgcaccaaggaactcggagcacatgcccacgagctcgccgtcggtgagccgacgcggccgcctgcgtttgttgtggtcgtccgggacccggaggtcaatgagcgtgtccacatacgccggcgtctcgccagatttgcgttgccgcctgcggcccgcgggatccagcgggaggtacatctcctcctgcttccgccgcagcgcgactagcttgctccaccgttggcggtggatcaacctagccaccgctggcaacttcgcgaagacgcgcagctcagggaagaactggacgaggtcgtgctgggcgtcggccatcgcgcgggtgaggcccgcgtcgacgccctcgccgaagcacatggtcgtgagcaggccgaccatggcggtgcggatgctctccgccgcgaggactaggccgtcgggtttggaagtgcactgctctcttaggtctgcgacgagaccgcagagcgcgtcgcggcgggcgacggcgtagcggtgctcg

SEQ ID NO: 13073 - DNA, 634 bp, Triticum aestivum
  Clone ID: PAT_TA_13073
tttttttgttttgatagaaagatgcaaactttccttgcacacacatattatcagataacaacattgagcgtcgcttgcacacatcgatttgattgacaagcaatcagcgagtccaggggcgcataagaataatttggtttttctgtgtcaacggaacaactagcaaggggtaacagcatgttctcggatctttgcaagaggggcttaagaaagaacacgataaatcagatgagatttaggacaatcacttctgcttctttgatttcttgggcgggtttttagcaagtacctcaccctcctcatccgatgggccctcgatggattcatcagggacatcgtttgggacgttgtgcttggtgatgtactccttgaggatcaccatgctcttctccctcatcgccgccagctgctccgacagggcacccgactcggagctgactgtgaacgattcccctccgagaaccagggtggcctttgctctcggttctagacttgtcgcagcattcatctccatcgtccagggattattaaccctcgggctgtggagaggcggcggcggcggacgctcggccggggagagagcgggcggcggcgcgcgcctcgacggcgtcactttttttccccctgagacaat

SEQ ID NO: 13074 - DNA, 1760 bp, Triticum aestivum
  Clone ID: PAT_TA_13074
cgtccgccgaggcgtgcggtcgcgcgtgtccctcccgcggctcccggaggtcccatctccccctccctctctctctctccttccctccccctcccccctccccgtaaccctatcttcctcacccgtcacccccttccctctcgccctcctggcggcggcgtcggcggcgcgtgtctgactgggagctttagcggcagcttgcgcagccgccgatttgaacgacgccggcgaccaggacctcaccggcagcagcgcatcttatccaagtttgcagatttcccctacaaagtccgagaagtcctccgtgctattggcatgctatgagatgaccttacgaagccttcattggagaccccaaccaaaatagaagtgtgccacaggtgggacccatacttaaggtgggaaagactctgctccatcatcaaaaccctgtggatcaattgccaccagtctttgggttgcaaaatctggacagagccttctgaagtttgacagtcatatcttgtcaactgtacattgccgtgcaagatgccaaaaataaagaacctgtctgatgcatgtaaagtatcattttctccagatggacctatatctgaagaaacactcgagagagttcgtgcactgttagatgagatcagacctttagatcttggtttagataacgaagcacaaattgcacgtacttggaatagttctacgcgtcaacagaatgggaggcgaggacgcggtgggcctaatcagtacgcgcccacaatcaaatatctgcacattcatgaatgcgaaagtttctctatgggtatattttgtatgccaccgtcatcagttattccacttcacaatcatccaggaatgactgtgctgagcaagcttctttatggcaagctgcacgccgaatcgtatgattggattgatgtagctgatccaactgacccgttaaagccaagaccagcaaggtgtgtgagagaccgtgaaatgactgcgccagagacaaccattctttatcctgataggggtggtaacatccacactttcagagccatcacaccttgtgcgctctttgacgtcctttctccaccatattctgctgagaatgggagagactgttcatacttccagaagtcttcagtcaaggagccatctgttgttttgccgagtgaaatagatagctcagaggtagtctggttggaggaattggaggaccatcagcctccggagggctttgttgttgctagaggtttgtataaaggccctgtgataaggagatagttaggtttttataccacttttgccaatggattgaggatgcagaggcctcctagtatcagttgtatgtggcttagtagagcaagtatcgtccaggcaacctgcacgcagcctgcggtttacgttgtacacacacgacctgatgtggatgaatgaagagcgtttgagaccattttcatcgtgccttgctctgtactggagcaatgctgctggtctgtgatgtacccacgtggctcttttatcagatggaggccttggagtatatacttcttttgagaagatgagagttcttgccacgctgtattaggtagaaaacaagtggcatgggcttctcacctaatgattgtttcagaaaaaagatttggtgtgatgaaccgattattccgtgtcattatgtaaacaatcgcataaacattctttgggataaaactgtctttgcaaaaactgacaatgcggtgtatactgtaaagagtctagtaaccactcctttcccttcc

SEQ ID NO: 13075 - DNA, 655 bp, Triticum aestivum
  Clone ID: PAT_TA_13075
tttttgcccaaatggtctaaatattcagtttgcgggacttgcagtacactagcggccgtgcatcaacacatcttcagccacaaatagccaagaagagagacatgccggtggcagcaaacaaacagagactacaacatgtaaacaaagcctctactgaaaattgctaaagctagagctagaacatcatgatgtgccgccgtgattcgcttaactatctgggcaagctgaaaagctgaacagacatggcgagaccgaggtcccctgccactttgatagtcaccgagcgagcgttgtgccagttaggtatctcattgtgatccatatatatacatagcacgtcaaatcagcaaggcaccgattttctgctccgatcttcaacagtagcaccggcaccaattctctgagccgaactggcaatgactgcagcgctaattgcgagattcaggcaacatagccagtataaataaattggtgccagaagttgatgttcatttgcacgaaaatgctcagcaaacaaatactccctcttaattttagactgaggttgtaggttttgcgttgccacatgactgttgatttgatcatgccctgctccagctttgacccatgttttgttctgctcgccaataatacaaactgtgatgttcttctgctc

SEQ ID NO: 13076 - DNA, 375 bp, Triticum aestivum
  Clone ID: PAT_TA_13076
tttttgagttttttgcttttatacacaactaaaaggtttattaacatgcaaataggtaaatgcagccgtaacccaaacatatatacaaatcggagcgtctaggaaagctggctgggtagtcatacaccgaaacgtggcagccgagcttgaaatcaccggtatgggctacggtcgtgactgactactcagaagctatatgcagatgtaaccaaatctacagatgatcgggcggtggccgtacgttaaatcatgaacactcattccactactcagcatgcctcttggccatcgtcttcttgaggccttttaggatcttggagaaccaaagcacattcatcacgaagattatgcaaggcgcaataagtaccaaaaaat

SEQ ID NO: 13077 - DNA, 730 bp, Triticum aestivum
  Clone ID: PAT_TA_13077
gcaccggcagcagagcgagcgaaaggaagtcacgacagcaagggaggaggagaggcagccgtcgccgacactgatcccacgagcggattggagaactcgcctccatcgaagatctgaatcccctcctcgtgctttcggaactcggatcattccttccttcattcccgatcgatgcggctacagcctcctccggatccacggatctagccttctgtctgctgcagcagctgccgctgctcgattgattggcgggggagatgaggttctggagggacggcggcgcgagcgggagcgggcgggacctcaacggcgggatgccctacggccaggtgcgcgtcctcgtcgtcggcgattcaggtgtggggaaatcttcattggcacgtctcattcttcaaggttctgcgattgctcgaccgacccaaacaattggatgtacagttgatgtaaaacatattacttacggaagcccagggagttcatctaatagcattgtcggtgatgctgaaaggaacttctttgttgagctttgggatgtttcagggcacgatcgctacagagattgccgttcacttttttattcacaaattaatggtgtcatatttgtttatgacctatctcagaggaagacaaagacaaatttgagcaagtgggcagttgaggttgctgagtctgggaccttttcagctcctcttgggtctggtggtccaggaggtcttccagttccttacct

SEQ ID NO: 13078 - DNA, 1170 bp, Triticum aestivum
  Clone ID: PAT_TA_13078
tgtgtgcttcgtgttctgtttgatggccgttggacgcggctcctgaggatgtccggcgatggtgctgcccccaggcggaccactggaattcgtgttgggcacgttctgactgatgtctatcgtggcgcgctgctgtggggtttccgcgcctccgctcgcgccggcatccgagagcaccggctagcaccgctgtcacgccccccggccacggagagtcagccgtcggcactggcatccgccaactgccacgaggggtggttgccgtccccccaagcagttgcaactcataagaaacaagatttcttaaaactgaatcactggaatactccttagagatctaggcatgctgttgccaccctgcagacgctgctttgtacgtgctgtgctccgggctcactttcgacccttcccggtgtggcgtcagagtgacatggccgatcttgaagcttgcctcgaaaggacgataagaactttagttggtaacaatgaaacagatttcaaaagattgctctacattggggtatccactccttagatatctaaggatggtatcggcgctgataagaacatgtataagggcccctccccgtactggcaacagagcaaacaggaacagagaagagaggtggaaatcatcagctgactgccacaaaatctcagcattctcaagttctttgttgacgaattcacctaatagcaatgcgtgagcagaagccgcaatataacttgcggcatccaagcagttgcaactcataagatactaagtatttacaaagaatggacatgactaactaactatctactattcacagtttggtgtcaaagagaaataacaaatctagaaacatgcatggctaaggaatgagcacaaaagctgggataatgaatgggaagaggagtcatgtacagaacctatttctagattatacataattttagtgccattactcaaccaacacttatttcagaagggcaataatattactttagttgtgatgtcaaaaaacgtaaacatatctaaaaacctatccacctaaggaatttaccggattagttgagatgattgattgggaagagtcaagttcagaacctgttttcagaatatacacaattttagggccgttacttaggtacttcaaaatttggagcctttaaatatttgcggacgcg

SEQ ID NO: 13079 - DNA, 464 bp, Triticum aestivum
  Clone ID: PAT_TA_13079
ttttttttttttttttttagtgtaaacagaatatatcacataggtgtagagatgacatgaacatgcggccccccgggctggtacatctacaggcgccgcatgcaccatcaacacaggcacaacacacacacaaaacgcatcacccttttcatcatcatctactggtaagtcattgccgcttggtggtcgaacagtcgaccttgatatgtaatcggtctgaggcgccatggggcaagcggtaggtggaactggacaagtcgtaagctatgaaatggactggaaaagttccagcagccttaaaaaaatctattcaaaaatgatctgcacagccgataagcccatcatcattattcccagctcattagttatttctacgcaccaccaaattggtatggcagccagatataccatcatccagcacctgtctagcggtaatccaacgtacctccgccccgtccgcgcta

SEQ ID NO: 13080 - DNA, 949 bp, Triticum aestivum
  Clone ID: PAT_TA_13080
ttttttttttttaactaacagaactgtctcatatattaagtcaacttggttgcattacaaggatctggatacaaagattacaagatgtgaaactagtactggtcctattcttgatcttgcaaccaacgtctcagccattttgaaacataatgatctaaacattgacaccgaaaatgcctgaatcataatgattgacacatcgacaatgaaaatgacattctgaaacacaatgtgaaactatctagttgcacccatgttcttgaccttgcaatcaacatctgaccatgcatcaccgatttatcttgcaatctcctagcaaatccagcttggcaccagtagtcttttaggttttagtgccaacaacattgtcttggaacaatcaagtttctgtaacctgacacactcacacaatcgccgcatctgatcgcttagccgtcaagttaacggttgtatgtatcttcccaccaccttagtgtgccctggccaggagtttgtgtgatgaccatcacacatcattctattgttggacgctgatgtgcctttcccctctacaggctctttgtgctaaactggtgaaggacctgtttttcccaaagtttaaatgcggcaccaatctcggcctaggggtgaggtttcgggaatatatagtagtcatatacatacgacgagaatatcaatgttatgatgttcttgtatctcaccttcaaattgtatcaatcattcaacagtttatattggataacatgagtgtaggaactattgccatctgagcttttgcataaaatttgagattgtgctgtgcacatttttactgaataagaacatgaaacaaacattactttttgtcaggggaaaacaaatgttacatcaatcaaaaatatataatacgcaaaatatctaagttttcccttaccagcggaagggccctcaccatgatatatataattac

SEQ ID NO: 13081 - DNA, 353 bp, Triticum aestivum
  Clone ID: PAT_TA_13081
ttttttttttaaaaaaaaaaaactgtaaaataaacagtttatcattgtcccggtctcagcgatataacacggctgctcatctcaacctcaccgatataatccttcgatgcacagaggcacgcacgcagtgacgcagaccacttacgaccttagaggaatgcgagttcgtctcaggcagccgggtcgcagtgaatggaagagttgctctcaatgaacgccttaatttcctccacgaccctgccagcgtcggggagctccgggaagccgtagaaggcgtggaaggcgtccgggaactccaccaggcgcaccgccttccccttgcgccgcagcatggcggcgtaccgccgctgcca

SEQ ID NO: 13082 - DNA, 381 bp, Triticum aestivum
  Clone ID: PAT_TA_13082
tgttctttggctttttctttttgaattcgaaaaggacggattagagaaaatgaacgtatatcctgaagtatacatagtatagagagctgctttacagaaacgtgaacatcagtcaaagaattgtgtgataatgtatcctactaagaatattaaaagttgaattgttcttggtctagtcccgtatatgcatcggtccttcagccaaagcccatcaccttcggcgcgaatctcaagaagcgggtgagcgagttgggcaggaacttcctcgcgaacaggaagcagacggtggtggtcctcccattgtactcacatgtcgtcccgcccctgagccaccgcaggagtcccatcgtgacctccatcctcgtgaacctcgacgggtgg

SEQ ID NO: 13083 - DNA, 728 bp, Triticum aestivum
  unsure (1)..(728): unsure at all n locations
  Clone ID: PAT_TA_13083
tttttttttttttttttttttttttgggcccctttaactgattttcgtgcaactacatcatgggacaagccaacttttacaacatgtgtgtaacaaaacgcagaaaatgtgcaaaaatataggagagtgcacatagagaatcttattcacacataatgcagaagaacagatgtacatgtagcaaaaaaaagtgttgtagctactatgaaaagataactacctactggacaagaatctggtttggaagtgtttttttcctttgatctttccacacagtagtatatgtgactttgtagctgagaattgtgtgcacaaatctatagcagctcctctacccccataacctgtaaaacctcaacaactgttgcaaacgatgtgccatcttcatacacaactcccaccagcgcggccgccttccatttccatcgtttcacaatgcagaattggtcaccaacctcatcatcctctacctccctatcgatatcaacacgacgagactgccgatcagcatgccgtttcgaattctgccgagaagaacggtttgcagacccctatccttcactaggagccacatctccttctacaaccatttttggtcgaatcaatgaaggagtccaggcatcgtgtgaagccgcagatggaggagtccaggcacgtcgagcctcagcgagcgcccgagctntggggacagcctgatgacgccccaaagtcggccgccaccatagtcg

SEQ ID NO: 13084 - DNA, 501 bp, Triticum aestivum
  Clone ID: PAT_TA_13084
cctgacaatgctgcattcaaaatgcttgcccagatccactagccaatcgtcagcgtcggtagcctcaacacaaccgctgaacgtctttgggccattagcaaggaactggttcagagtagcaaagtggtgctgattgttgccttgattcccttgactgccttgattgcgctcttgaaggatttgcatgatcaactgtgtgtttgcattagtagcggccatcacagcttgccatgcttccggaggaggcggaggtggaggcggattaggattcggagtcgtgcgcgttggaggagccatcctgaacaggttgaccaccattagcacatagatagacaacaatatagaagctgaatccaacggaatgaaaattgcaacatatagtcttcacatccgaacaagatgaacgaatgcattcctcttcaaatggtcacatatccataaattgagaagccacgtagaattaaggtagagaaataaatcaacaaggtacggatcaagaac

SEQ ID NO: 13085 - DNA, 457 bp, Triticum aestivum
  Clone ID: PAT_TA_13085
ttttttttttttttttttttttttttttttttttttttttttttttttttttttttttttttccacattgtgaaaaacgtaaattctcctctatcgtcattatgctctataaactgcttattccatctcaacaaggatgtctctcaacaccctctgcacctccagagacctctcagcttccaaagccttgctaaccatccccttcaactgagccccatcagggccactctgaccaaacacacctctcgccttggccttgaacaaagcacccacagccttagccctcatgactctctgtgattcagtgccagtatcaaccaagtcgatatcaagactcagaagataagtcaatgccacggctccttcgtcgttttgctgctttgatggagacactgcatcgtccatgagatcgcgaacgcactcgtaccagacttgtcgcttgattgaaacaaagtta

SEQ ID NO: 13086 - DNA, 899 bp, Triticum aestivum
  Clone ID: PAT_TA_13086
ttttttttttttttttttttttctaaacagtctctcaattctattaaaaaatgacccatatgtgcacgtgagttggcatatacacgtacataaatcttttttagcttacacgtacatagaaaaaattacattcacgttacacagattcatgcaatttctcaggatccacacgatttcacaaacacaaaaataagaggaaaagatccctcgcccaggttttcgactccttttttcgcacgccgccaccatgccctgtggaggaagcttgcatggggatggattttgccctaggactcttacagccgcttcaagtggtggtacgctgcagttgagcagcagacagatgcttacgacaccatggcagcagcaacatcggagagtaagacgccggggccacgctgcagcggcgggtgcagatggaggcagacgaggcactggcgtccatggagattggagagcgcatgcttattcccacatgatttccatatgacatcgatcatcagtgcagatggttgcagccatttggacgagcaaggtcggcccaggtctgaagcagcagagcaaggtactctcctcggtccaaagaacagcaggcgcatcgccattgatctttgtagtcgtccgtcgcctgccactttctttttaaatacataaataaaggtgatgaccaatccgcggtgctaatacgaaacaatgagatcaagagatgacacgtgttggagaatatttcaatttgaaatgcacttcagagatccctgcattgaaagattaactttccacacagtagatggagacacacaagatgtgtgaggaagccagagaattaacatatgcagagttcccgtcaaaataggtatggaagaagaaagacacgaagtgaagcaaaaggaagaaatgaa

SEQ ID NO: 13087 - DNA, 943 bp, Triticum aestivum
  unsure (1)..(943): unsure at all n locations
  Clone ID: PAT_TA_13087
ttttttttttttttttttttagaatattattttaatattttttaaaggggaatatattaatatcaagtagatatcaattacacccagcctctgcaccaacaaaatgcctaagaacatccaggataaacatagacaaaaaaacaaaataataagagaaaaaaccaccatggtgatcagtaactcactgtaggagcactctaaccatcatcaaagacaacacccggattagaaagaagtttctccaaaagcaacgcctccagaaaggaaacaatgcacaagcgttgtcgttgcccgatcaaagatcataggttttcaccctagagaaagaccgtgtttccaaaacaatgccttcaacaaggccactatgaggcacaatcaataaaggccagaccttgggttttcaccnctggaaatcacgactcggtactcaaaagagcaccaccaacaaagaagtcatccaatgttaccgcccccactcgcagaggctactactacaagtcacttaccaccatgctcacaggaactcatgcccggtccatatcctgcaagccaattctaaacaactgtctgtgaagcaaagtcttcatcgcgtccaagaccccgcttccaccacttgcaggtcctccaatcacaccatggcattctctacatgtgttgatcccttggaaatcttgaagtagatatgttccaaggtgttaacaaaaacatagcttcgcgatatccctatgaagctggttgtgtccctccattacgaagtgtacacgactgacccttatctaatcatggtgtccaaagaacgtatacgccagtccttgtcttcctccaaggagatgtctgaaactcaccaatggctagatcaaagaggactgatcacaggtagaacgaggacttcacgcgaagaccacgagagccatcgcctggccgattgtattgggagacatga

SEQ ID NO: 13088 - DNA, 724 bp, Triticum aestivum
  Clone ID: PAT_TA_13088
tttttttttttttttttgttgagaaaattgagaatggctaggttcttttaccgtgccaccacatcgtctgccagtcagcccattattaacgggccactgctccgagaggtggcctacacgtctggtgaaccgggctgaattgattggatgatgttggtttttgaatgagctgctgccccaagctgctatgtgtgtgctccagatgttttgcagactcaggaggtctttcgcctcatgggccggcttagcttcatttatttacaatctaaagaaacgcttcgtgggttttctttgttaggcttttctcctccttgttgtcggatttccttacacgaaacattagtggttcccactactctcttcgatccatataatttgaatgttcctatttagaggcaccaggttcttgtttcgcccaggccctcgaaatctcagaaccagccttggacgagctttgcagacaagagagatgccactcctgcacagccttgcggatggagtcgctgtcctggtagtcgtctcggaaggtctcgaacttgtccatcatgtcgtgcacggacgacctcagcagctcgtactgccacctctcctgacgagggaagtcgcagtacttctccccgaaatcatccacgtacgagcacttgagcgagcggatctcgtgggtgtacttgctgggcacgccggcgatctccctggcgcggtagaactcctccacggaccgaag

SEQ ID NO: 13089 - DNA, 993 bp, Triticum aestivum
  Clone ID: PAT_TA_13089
ttttttttttttttttttgaaataaaatcataatttttattatagtaagaatattacaatgtctttacaagtttccaataaaaggaaattgcaaggaaataaaagaaaatcctaaaactaatcttctagtaatcttttcttctttttcatcactttatccctgcaaaatgtaacaaaataaacagaaagacaaacaaactatttataacatgtcaacactgtcattttttatgcaaacctagatatgagcgtatatttctagaattacatggtgtgaatattgtatgagtaagattataatggaaatgaattttgataggagcccactttcgacgagtatttatctgatagagctaaataatcagggtatttatctgcttcttactgtacacatgaatacaaggagtacatgggtctctattactacttcatgtctacatcagtgcttgtctacaggagtaatatgaacatcattctacatgggtctctgaacatcttcttacaaagttggctacaaaacagatcaagacaatgcaagaatacttctgagtacactgctgatatgctccagctaaatgagtacacacgtacagtacaaatgagtactcctgctgcttaatgatgcatcttaattaacagaaaatgtttcaattaatttaaattaaagtaatagtcatgctgcttaatgatgcatcttatacaggcaaaactactcctgctgctacttaatgatgcatcttatacaggcaaaactactccacttaatgatgcatcttaaataggcaaatgagtagaaaaatatcagttaatttaaattaactgaaaaggtttcagttaacctcttcactgccacaaactgtccatcagcaagttgtcctttgtacacctcagcatgccgtcccttttcgatcaaattatcgaggtagaaggcggcgtactcggcgtagacctcaccgcagcggtcgtaggcatcgcccgggaggccccagccga

SEQ ID NO: 13090 - DNA, 576 bp, Triticum aestivum
  Clone ID: PAT_TA_13090
ttttttttttttttttttataccatgctagaaatagttcaattgttggtctagaaagattcgcgacacacatttacatggagcaaatgttccaaaaagaaaactgctaaattctccggaagaaaaacattccaagcaaagatgcaaagtttaatgttgattatttggcggctggaacgaattctaaaacagagtaacagtacaacatctggaattgtctccgcttctgctgcggcttctcatcacgacaccacggcggcatcgtggccgtccctcttccctccccagctgggggtgggggtataagtccatcatggctcgctaggtgggggtggtggtggaggcaaaagaagtgcaaggcgctgcttgtatctctcgatccggacttgccgctccttgcgcaatttggcacgtatattttttgcacgagttacatgctctctcaacaagtcagacgccgtatattcactagtatcattattggtcaatgctctgtccatcgcgtctctggtgcacagggtgttcctttcttgggcatgtctctgctcttcttctgaaacttgatcttcaacatcat

SEQ ID NO: 13091 - DNA, 413 bp, Triticum aestivum
  Clone ID: PAT_TA_13091
gccagggttttttttttttttttttgtagaaacaaaatataattaattttatttataatacaatcaaattacagtcttgcctcggttcaaccaatgcaggcttacacagcaacgctgacatggcgatgaactccaaaacaatatcaaatcaaaacttgaaaatagcgacaaagaatctgttcctcagaaaacagagggaacgaaatgcaattgcgaataataaaacaaaaaatagtacgcagccgaaatccaaagcccgtccactgagccacgcagcaaattaacaaggccaaatggttcggccaccaacgacgtacactgggtggatgtaagtcagcggaagtgcttgcacccacccggcggcccccggcgagcaggccacgacttcgaaaagatccggccccgcgtggtga

SEQ ID NO: 13092 - DNA, 491 bp, Triticum aestivum
  Clone ID: PAT_TA_13092
gcggccgcgtcgactttttttttttttttttttttttttcaaatgaactgtgtttctctttcttctgtaaatttagactagccttttacaatgttgtaattgccaggtggaactactggttctttacatatacatgcacatgctgaaattatttacacaacaaatttacatggtacacacatctacattttacaacacagagaatgacaaccagattatcacacgacatgctcacatcatacagaagcagacctcccaacagagacactgagtgttatgttagtagaactgcagaaatcatatggaaccaaaagaaaggattctgtagggtgcagaccttcccactcctttgcatttgtgacagaggccttgagttgcatgcagttttcagggtttctcgtactggccgcttcgatttcgttggagaacttccaggtcaaaccgcctgtcctgaggcaaaccacggaaagggcatgcccgaagggtgacat

SEQ ID NO: 13093 - DNA, 703 bp, Triticum aestivum
  Clone ID: PAT_TA_13093
ttttttttttttttttttttttttttttttttacgccaacaatcttgttgtacaagttggcatcttgtaatctgctgcagtcttagcaactgactattgtctgacatgctactataaaaatatacagcccagacgaaaaccatgagctatcgaaccaattccctaatcgatgcaatctatgattcaatcccatagtaccaacagaaaccaaattaagaattggctcctcttaattacgaaaggtgtaggcaacatcagtgcctagcttggccagcgtatgcacaaacggtcgatggagcctcgttaactttgggcttcaatattaaccaggtatgaactgatcatgcatgcatggttctcttctcttgccagtaagaatggcttgggggcccaacaaaattctgtacttctgccaggtcgagtgccaaaagatcctctccgagatctcccaatggcgattggcgccctctccagttcccatgcaacgcgtccaccgatcatgcacaacctcctcttcttcaattcgtcttcgccttcgtcgacctccccttctcttctccctccaacaagaatggcaagtacagtagctagctaggataaataagagctagcctcactggtccttgcatgcatgcacatccccattctccagtccctccgaaacctcaccgaagccatttgagcagccgcaagatcaagcacc

SEQ ID NO: 13094 - DNA, 1356 bp, Triticum aestivum
  Clone ID: PAT_TA_13094
ggggcgcggtgctctagtctcgagtttttttttttttttttttcaaaccaaccaacaaccatccaggttagggcactttttattattattgtcgccacaggccacacacggacctaacaagcaaaagcatcatgttcacaaaagtatccaaggacacacagtagaaataatttcaacgcaaccacctaaacacatcaattgggttggaacgagcagaccctcgcctccctgtacaccttcccagggcggcagtagtagccctgctccggtgcacaatgcgagtcttctgagcagacgcaaaggccctcaatggcgcaacccttctcgacgatgatcgggctcccattaatgccgagcacctggtcactccattcactgggagaagatcccatcagggtcatacctgccctttacctctaggaacttgccagcctcggggtacttggaaatggcgccttcaaaggcaaagttgcggttcttgccccagtgagggatggcgccatacttgtgtagcgccatctgttggagttcgtcgagcacgtcagagtgtgggttgggctcacccttggtgtagctccggtagtaggttatatcaaagtcgaccgagtcctccggcttgccgaggtaggcagaggatgccttgatatagcggaggagaatacccaaactggcgtcgattccgcagaaggccttcgggttgctattacggagctgcttcatgtcggcgatgaatgctggcaccctagagagcgcgatgctgtaggcattgttgtagaagaagattccccggatgcggggatcccacggacacgtagtgaggagtgcgtcttctgggttttcgagacacgaaccggatgcttggatgcggtgctggaatcctaccaccggataccccatgaacaagctgtcgttgtttgtaaagccgtatgctgccttctcaaacagcgacgcagacgtgggtgcctccttgcaccgagcgacggtgttgttcttcttctcaagaagctcgtgcatgactctgccgctgatgaggtcggccgtcggactggatcgcaaggccaggtagtcattgaggtcgttacccactgacgtgatggccacgcgattgtccttgcggtaaataacattgcgctgctgtggcagccacgccatatcgccaaattcatggaggccaccccacacgacggcctgctctgccatgtcagagtcattgcgtgtcacgaacgtcaccgaccgcttgaacatcggctccaaggccagtgtaacctgggaaacgacgcccaggacgccgagggagaccttggccgcgtcgaggtcaggatggtcggcgcagagctgccgtaccaccgcgaacct

SEQ ID NO: 13095 - DNA, 867 bp, Triticum aestivum
  Clone ID: PAT_TA_13095
tgtgttgttttttctttactccatatgggctccgctcctctgcctctgccctcacatggcaggactgtgtacaatatctagtccagcacctctgcttatgcccagcaactgacatgaaagggaaaagcaactgccttgaatattacgttttacaagtttctgagtgtagaataaactatacacaatatgtactcagctcttctgcctatgccaacagatggcatgagagggaaaaatagctagctgaatattaagtcttttaaggttctgctacagaacagatgcacagcaaatctgcttacgctgatgagcaacagtaaagggaaaagtagttggctgaacatgaggtcgatatcatctaatactggtatgtttggctccactactactttggtggatcattgatatattacataacataagggagtttcattggcaggaatagtgaacatgcagagtcggatgagcttaaacgccagcatcttacgctcatgtgaccatccaaacgcaagaggtggtgggtgtctccctgtttgggagccatcgtcgcccctcgtgggcctcgtcggcggtgctggggctgtaacaacagtcttgtcaatcttagatttcttaggaggggtagtctgctcagtggaagttcctgatgcaactgtaagctcttcagcagcgcagtaatgcatgttgcaaacaagagctcagaagagatgtaaagatagtagacaaacagagatacataattatgaaagcggaacaaaatttgttggtgttttccaaaaagatagtgaactaagtgactggttttccaggacttcaatgttgttgttcttgatcgtgtttgtggatttgtatgtggcagaagcgaca

SEQ ID NO: 13096 - DNA, 527 bp, Triticum aestivum
  Clone ID: PAT_TA_13096
ttaacagcaagaagcaatctactatttcagataacatacatacaaatgtgatcagcatcaagtttacaattagataacagctctacaagtgtacagtctaccacatacaaattatataacagctctatcacatgagccctacaagttctgctacatcacacatacaaataggatcagcctaaagggtttcattactcccagaactagctccaactagcttcttccaacttctttgtcttgaagctcgtgaagaaacatgaaaggccagcatctgtccaccattttgcaggttgtgtggctcaaggtcatggtgccggacaccgcgacagttgccaacaacgagccgcctaccgccatcacctcctcccgcgcgccgggcgtcgcgcaggccaggtcaacaataaataggtactaaatccagaaataaccatctgaaatgaacttaatgagacattttaaaatcaacttgacagttaacagtaatgtttgcattggccacatccagaactagaactgaaatcatttac

SEQ ID NO: 13097 - DNA, 800 bp, Triticum aestivum
  unsure (1)..(800): unsure at all n locations
  Clone ID: PAT_TA_13097
tcgagttttttttttttttttttggcaatgcacacaaccattttatttattaaaattgatgcaaggcaacaaggccaaagtcatcaacaagcggagtacatagcatagacaactacaacagaaccatntacatgagaaacatatttcaaatctttttcgtgctttgacatgtacgccgttataagtttatctggattctcatcatgttctaatcacgtgacattgtaaatttatcaggatcatctcaatgttctgacccataagacattgtaaccttttctcggtcatcttcatgttctgacccatatgacattgtaagtttatcaggatcttcttcatattgtgacccatatgacattgtaagtttttctggatcctcttcatgttgtgacccatatgacattgtaagtttatctggaccctcttcaagttctggctcatatgacattgtaagtctttttggatccccttcatgttctgactcagatagctcctttaaaccatattcaacttcagatgcaatatgaacatgtttatctccattatcatcttctagtttgcctcttccatatcctggtctaattttccgcagtcctttgacaaacttgaggtcattggatccaatagtaatgtcatcatcttgttgggctatcaagtcgctgatagctgggggcattggagttttgggaagcactgcctcccagttcttcgtcagcgttaacgatcgcgagtttggtgatgtcgtacatggcagcatcaatgaacctcgcatgctgacgtctcctccagcaatcaaaata

SEQ ID NO: 13098 - DNA, 529 bp, Triticum aestivum
  unsure (1)..(529): unsure at all n locations
  Clone ID: PAT_TA_13098
gacattttttaaacactacaccagtgtaaaaaaaacgttttacattatgagacgaagggggtatttaattagcaagcacacgttcttgcactatttttacacancaaaaggcctntgtagagcaacaacttttacacacacgcacatatatatataccagcaacgatctagttggtggtgttacaaatttacaatacgtacatacgtacatacacaaaatataaataacaggcaccacaactgtccttcatccgaacacatagctgttctccagaactttgaaaacggtcggctcctcctctatcaccttcaccagctccggcgccgcatgcacgtacaccacccactcgccgtccccgcgcgcgctcggcatcggcatcacgtaagccgcgccggcgggccacgggaagtggtacgacgcgaacgccggcaggcccgtcccaaagttaatctcccggactgggaaactcatccccgacgacacgatgcacgccgtcgccttgttgccgccggtgccgcctaggtacgc

SEQ ID NO: 13099 - DNA, 706 bp, Triticum aestivum
  Clone ID: PAT_TA_13099
cagaaagataattaagttcatcagagagatgcatacagggtgcaaatcttgcaaacacaggaaccaataagctacatgcacctccttaaaattcttatttggcactagaaacaactcaaaattcagtcagcaaaaatgcgaattccatgttaaactgtacaccaatatttctacttcaaaaaggtctgcttctgttttctttttcctgcgcccgcgcaaacccgggctgcgccactatttagtgatgatagcattaggcttgccgcttgccaagtcgcctgtttttagctatcatgttctctgaattgtatggtaaacagcaactcaagtggcatttcagccgttgctgtttttgctaatatctctggatgtcaaagtcataacgaggaacatctcatccatattttgagtcattgtgttctcacaagcttgggtgtccacttgtgccatgtaagccatctaccatctccaagctttaatacctgcgatcctcctcttcagatcaaggcctttcctttttttcccacccctagccaattcttttgaatggcttatcaggggatgctctggtgttccaaggtcactgctatcgacaatcttctgcaccatctccagcacctcgctcatcttaggtctataccttgcatggcgcaccaggcacttgtttgccagcgaggcaatcctgactgccgatttcatgctgtag

SEQ ID NO: 13100 - DNA, 619 bp, Triticum aestivum
  Clone ID: PAT_TA_13100
tttttttttttttttttttcttagtctgctcgcgactgtcgtcgcggcgaccgcttgtatgtttttgcatttgtttgagtttgcgcagtgcaaatattgctgtcctccttgtgggacctactaccgtacagttttgagctagtgctctggtatctcttgatgtgaaattcgaacgaacgtgatggtaataaacctctattggttcaaagcccaacaagaacaactccgggaaatgcccattgaccccactcctaatatacgtggcagacatcgtggattgccaccccaatttctaactccgtgccatcaaggcgattgcccaagttaaacgtagtagccagatagttctaaaagtccagagccggagaatcgtccggactggtctagttttataacgccaaaagaaaacaaaccgcaccaacaccgaacgagaaatcaatcgctgttcgtgtcatcgtgactttttcgaaaattgtataaacacatcgtgaagaagcatatcgtaataaaaaggatccagagggccagaagagaagagcggcctagtagacgtggaccggggccatcatagaaggctggaaggacacatgcttgaccaggttggccgcctggatgaatg

SEQ ID NO: 13101 - DNA, 568 bp, Triticum aestivum
  Clone ID: PAT_TA_13101
tttttttttttttttttttcagaaaacaagtacgggcaggcaaaccctcatggaagtagacatggtaataaccttcgaaaaagaactagaaattagaacaacaggtagggactagaacgttatatctcaatcgctaatacaacatcatctgacataacgagataatttaaggcgatttttacacgagttacatcgaccatgcccttgctcgcagctccttaggcgccactctgctaccagcgggaagccagagacatcgaatcaaaatcaggcctgaaaagagcaagttcttgcgctggtacagttcccatgatttccgcagccaagttttgtttcaaatttccctaaaaatatgtgttttaaatccatccagccacttgttatgtgccatcactaacctgacagctgcaaactcgtcaattggaaattatacaaagacatgaacttctatacgtccccacaaaatgcacggttcatgaactattcatgatctaagttctttggctccaaatcacaaacagtacatcatcaactgacatataaccatagagtacttaattacttcttt

SEQ ID NO: 13102 - DNA, 630 bp, Triticum aestivum
  Clone ID: PAT_TA_13102
tttttttttttttttttttttttttttttttttaaaggcaaaagtcataattgttccaatttatcagcgttaaagcaacgcgaatcacgcattaagtcccaaactcctattcatgccagaggtatcgtgaaagccttccaaggctattttagccgtaacgccgaaagcatgtgatgacacaggtctctagagtgactgctgctccagtcggtagatcgcatcttgcgcaatcgcgtttgtttgaacgcgattgcctcctttctgccttttcgcagtgcatctgaccatcccttgagtcgcctaggcctcgccaggacgcttcgcgttacaggagacgatcttgacgcggtcggcatgaacttgatgggtattgtccagcttgaagttgatatccttgataataaaggtccatacgtcgtcgcagaagcggtaggtatcgagatgtcccttgaatgtcaagcgcgacttgaccttctctgagagcacatcggcgacggccttgtcaaagttgaggaggatcttcatggcgagctggggttctatccggcgctcggtgatgaggttgtccagggtgtcagtgagagagccgcccaggctgttcggcggtagagctcgtagtacttggtgttg

SEQ ID NO: 13103 - DNA, 1406 bp, Triticum aestivum
  Clone ID: PAT_TA_13103
ctcctctttagcccatttaggcacataggagcccgccgatgccagaattcagagtccagcttccgtctccggccctcccctgggccgaccgcagcctagccccccacgagaaattaggcgaggcaggaagccgagacagcagcgtccgtctccctcccttgggccgaccagaccctagccccccaccgcatcgccgccgggcccctccgccgctcagtcgccggcatctcgccgaagggcgcctcgagcttgccggatcggccccgccgccgcggatccaatggctcttaatgaacgtctcagcaaatttaaacaacagcaggagagatgccagacaactctatccagcattgctgcaacccaagcttcaaccacaaagtcacacaatgctccaaggtctagaccagcaaatgctccgtcagctccagcaaaacagatacaggctattaaattctcaaatgatacagaaaggcttcaacacatcaattcagtgaggaagtctcctgtcggagcacagatcaaattagttattgaactgctttacaagacaagacttgcttatacagcagagcaaataaatgaagcaacatatgttgcaattaatagtaacaaggcagtctttgatagtctgacaaacaatcccaaagtacaatttgatgggaagcgtttctcttacaagtccaagcatgatttgaaggggaaagatcaattgcttcatttgatcagaaggtttcctgagggtcttcctgttgtggaggtcaaggattcatatccaaccgtattggatgatctacaggctctcaaagcctcaggtgatgtctggtggctgtcaagcatggactcccaggaagacattgtgtacccaaatgatcccaaatcgaagatcaaggtcgatgccgacttgaagcagctgtaccgggagatagagctgccacgggacatgatcgacatcgagaaggagctgctgaagaacggccacaagccagcaaccgacacgaccaagcggcgtgcagcggcgcagattcatggccagcgaccaaagccgaaggccaagaagaagcagaaagagatcactaaaaggaccaagctcaccaatgcgcatctgcctgagctgttcgacctgccccgttaagcacaagaagcaaatggggcatataagtttcggggcatttattcatgtgggagctcgcaataatacttttatatacacaatcatttttgtttctgtgttactctaccattgggggaaatgacttgatgcatctcaaaacttaaaactgaggatgggatgcttatgcttgttatatatcaaagttatactttgacaatacattgtgcgttcctgtataaaatattataatgaatcgagatgaacaagcgaccttgcaatggtcattcatatcttt

SEQ ID NO: 13104 - DNA, 805 bp, Triticum aestivum
  Clone ID: PAT_TA_13104
ttttttttttttttttttttagggtaacaacttgatacatatttcagttagggcacgaggaagagcactctgataagctcacaaaaagagcaaactaacaagttagccccacctgtcgtgctgatatggcgaagacaaataagtttgaccgactgatgtggcaaatgagatgcaggccccacctgtcaatgactaaacggtcatctccttcacaacattttttctatggagcattccatcgagcaccttttgtgcgttcatcctctggtcattgaagaaggcacgcacgccatgggcacgcccgagcagtgaccagaggaacggcgggccggacgcctccatccccgccagctcacactgctcttcctgtcctcctaccaaggcggtgaccaccttgcggaagctggcatacgcggcggcgcgagcaagtggggaaggggcgagtggctcaccttgagcacgtatgcgtgctcggacgcgccgacgccaggcgtgaagaagatgaccgtcgtcgtccatggcgaactcgccagtgaactccgtcgcgctgcccgccgccgtcgccgtgtccaggagccagcgcgggagctgcgcctcctcgctagccctgcccgcaggccagcacgccgacgccaggggtgaggcggccctgggctagctcgaggagggctcggctgccgtggccatgaagctctcggctcggccgtccatgccggcgggggcggcggcgggcttcgagggttcatggcgcgcggggaacaggctgaggcggcccggggctagcttgagcaggggcccggctgcc

SEQ ID NO: 13105 - DNA, 1216 bp, Triticum aestivum
  Clone ID: PAT_TA_13105
cgtccgtttatcactatgctcttttttcggacaatgttctggcagcatcagttgtggttaactcaaccatcgtgaacgcaaaggagcctgagaagcatgtctttcatcttgttactgacaaactgaactttggggcaatgaacatgtggttcttgttgaatccacctggggatgccacaatccatgttgaaaatgtggatgacttcaaatggttgaactcttcgtactgccctgttttgaagcagctcgagtctgcagccatgaaagagtactactttaaggcagatcgtcaaaaaactctctctgctgggtcctctaatctgaagtaccgaaacccaaaatatctgtccatgctcaaccatctaagattttacctgccacaagtctatcctaagttgaataaaatccttttcctcgatgacgacattgtggtccagaaggacttgaccggactgagggatgttgatcttacgcgtccggtaaatggtgctgtggaaacatgtggggagagtttccaccgatttgacaagtacctcaatttttcaaacccaaatatttcgcagaattttgatcctaatgcatgtggttgggcttatggaatgaatatatttgatctggaggagtggaagaagaaggacattactggaatttaccataagtggcagaacatgaatgaaaacaggctgctgtggaaactggggacgctcccgccaggcctcatgactttctacaagctgacgcaccccctggacaaatcatggcatgtgcttgggctagggtacaacccgacggtcgagcacgcggagatcgacaccgccgccgtcatccactacaacgggaacatgaagccgtggctggagattgcgatgaccaagtaccggccttactggacgcagtacatcaactacgagcattcctatgtccggggctgcaagatcagtcaataggcagtaactagagaagcattcgctttgacaggactactgaagaaagtgttcccctgttgctagtacagctatagcgcatgttcttcgttcgtgttattattagatttgttttagttggtgtcttttctgcttgtatgtagcttcttcgcccgatttgttgtgctacctcgactagtccgctgcggcacgtgttaatgttattctcttgaaaagaatggtgaacttggtgacacatgtgaatttatcgatgcaatgtttctgaaaaaaaa

SEQ ID NO: 13106 - DNA, 963 bp, Triticum aestivum
  Clone ID: PAT_TA_13106
cgtccgcccacgcgtccgcttcagtgcatggtccaacaagtcatattttaaaccacttgttttcagcagtattgttcttttcttgggtaatgtctgctatgcaatggcttatgatacgaagtccctgacagtccttattgttggccgcctactctgtgggttgggttctgcaagagctgtcaatcgccggtacattagtgattgtgtccctgcaaggatacgtatgcaagcttcagcaggattcgtaagcgcaagtgcacttggcatggcttgtgggccagcgctggctggtttacttcagtggagatttaaaatctacatggttaccttcagtcagtcgactctacctggttggttgatggcagttgcatggctagtgtacttagtttggctatgcatctcattcaaggaaccaaatcgtgccactgaggcagatgatacccaacataatcgtgcttctggacaaagtgtggatattgggcaagttgaaaatggacttgcacaaccattgcttggagattctgaaagcaaacaaaacgaagatgatgatgatgatgaagaagatgaaagtgaagagtctgcacaggattctcgcaagcctgcaacttcgattggttcagcatacagattgctcactccatcagtaaaggttcaattgttgatatacttcatgctcaagtacgcgatggagattttactttctgaatcaagtgttattacaagtcactatttcaattggaatacaagctcagtggcaatatttctggcaattcttgggttgacagtgcttcctattaacgctgttgttggaacatatatcagcaacatgtttgaggacaggcaactcttgatggcttctcaaattacattgctagtaggcattattttcagcttcaaagtcacgagcacatactccgtcatccagtatgttgtctcagcactcattacgtttgtttctgctga

SEQ ID NO: 13107 - DNA, 506 bp, Triticum aestivum
  Clone ID: PAT_TA_13107
ttttttttttttttttttaccaaatcctgccaaacaggtttgtaaaatcagcaaagatctgtcatttgcatcaacactatgacattttagacgcatccagtgaaacgttcttcacgcatccagtgactggactgcaagtggagatggggaacatggagggcgtcagcgtactgcatgggctcgtggtcggaactgcaagccgccgccgatagagccgcatgttgctctgggccgagctgcacaaaatatataagtgaaatgcgcctcccatcccattaaaaagaagtgaaccggtcgctcatagcgatgcgttagccagccacacaaattggtgcccgagccttttttgtgtggactgcgcagagggcgagctgcacgatgtgcactgccgtactgcacatccatggccacgcacacgtgaaacttgaaccaaatgagctgcaggcagtggacggaagctcgggcgcagttcactggtttttgggtactgtaccgacgacccacct

SEQ ID NO: 13108 - DNA, 748 bp, Triticum aestivum
  Clone ID: PAT_TA_13108
ttttttttttttttttttggtggcttttttttggttgtgtgctttgtttacagaggattagcactgaaagacagcgagaaaggaggagaaaaattaaaagcttcatcggctctgcgacactggctacggctactaccactactacacatcaaaaagaaaaaaaaaactactagtagcataataaagctgctaaagacgccatcatgacgagcccgaccaccagcggcaccataccgggtcgagccaaagcagctccgcccacgtcctgccgcttgacgccgggcgcgggcatgggcaggatggtggccgtgtccctgacgccgcgcggaaccggcacggcggggctgctctcgatgaccggcgccccgcttccggagtccggcgccggcgcgtaggatggcgctggcgcgcgcgccgggcccgccgaccacggcgcgtgcgccggggcgtgcgcgccaccacgggcccgcctctcctcgccccggccccgtttccaccgctccgtcggcagcctcggcctcagcccgtcgtcgtcgtcggcgcctgtcaccggcggcggcgcggagaacggcgacagcaccggcgaggggtccggcacgatgaagctcaacggcaccttctcctcatgcagcttgaatgcttgcgacggatgcacgagcaaggagcagagaagcaacggtacccgggccgaggagtagcattgcacgatggaaactcccatctcttccttccacggcacttgtcctgc

SEQ ID NO: 13109 - DNA, 634 bp, Triticum aestivum
  unsure (1)..(634): unsure at all n locations
  Clone ID: PAT_TA_13109
cgtccggcggtcgtcgatgctgacttgcaccgttgcacagcgcgcacacacactatagtgggctcgtgcagtgctaactaaaacgaaagaagcaaaattacagagaacagaggagtaagggtgacactgtaatgtggactcggcagatggatgctaaactagtgcgtactggagtattatgtttcaatcttccatttgctaaatgggatcccacttgagcccatataatttatgcatgttttgatggggtgtcgagttactcccactaaacatagtgggatcaggtgggntggaggtgggactcccatgtattgtcccacctgcagcctgaaagtggactgaagttcacaaacaaatatgattgaagttcccaaaaaagctgttagagaaacttgttaaaaaagtaaggtgctcgtgaagttcagtttattatttcgagacaaagtgtagtttacttggtcaacttgccttgtcgattcacaaattggcttccttgtgtgcgccagccgaagaatttatgtatgatatacnttttgttccaanccgagctgaccgctaagatttgtgcgtcnttgtctttgatttctgtttgttttgcanaaaccgatnaaaaggattcctgggntagngctca

SEQ ID NO: 13110 - DNA, 623 bp, Triticum aestivum
  unsure (1)..(623): unsure at all n locations
  Clone ID: PAT_TA_13110
ttttttttttttttttttttttagcaagaacaaggatggtttttctgtaaaactgtagtctcaggataatacggaaaatcgtaggactggaaaaaaatagcacgggccaaaaccggtaggcccataagtgcacatgaaagggggcactggaggggctgctcactttggccatgggccactanagcanaggctaggccgggcggactgggccttttcacggcccacgcgcggggtcaacgcaggcgctggaggcgtcggccccctggttcgaagcagaggcggggcgtgctcgttcccgagcagaacgagtgggcgccagctgcgtcttgaagcgggagtttggcggcgaggaagagacggaggcgcaggggatggaggggcgcgtctccaggcgcgggacggcggcctccggcgatgggcgtccagatccagggcgtgggcatgctgagagcgtcgaaaccgggtgcgagcaacgcatcttgaagacaagggtggccatggcgggtccctccgcaggtcgacggcgacgaggcgagggaaggccctgggcgatggaggtcgttcccggcggcggcttgacagatcgaggcaagagaagacctgggcggccaggcgctggcgtg

SEQ ID NO: 13111 - DNA, 909 bp, Triticum aestivum
  Clone ID: PAT_TA_13111
cgtccgttcaaactgaacgacaactttgagaaagatatttctccttacttctatgagagtatcaagagacttgtaagcgatgaggtagaaaaggtcaaagggtttccattagactcaactgttccttacagggaaagattgaaaatattgactgggttggttaacccagatgatatgaatctgagttctgcagagaggaaacttgtgcaggcttataatgaaaagccagttctgtcacggcctcaacacaacttctatgtgggatcaaattacttggagatagacctagatgtgcaccggtttagcttcatatcaaggaaagggctcgaagctttccgggaacggctgaagcatggtgtaatcgatctgggtctaaccatacaggcccagaagcaggaagaactccctgagaatgtcctgtgcagtgtaaggctaaaccggcttgatttcgtcgatcatggacaaataccaacactccttccttgcgacgacgactgacacgtgacctgggtgtgctaagttaaacctgaagtttcagtcaggacctcaaaaccatttccaggtgctcacaagttctgacccttgaggattgacgaccttccctttgctatgtgtgcttggaggggttgcgttgctctgcaagatgaacggtcctgccgcaacccgcaatgttgttatgtaaaaacatgcgtatatagtcatgtttattaacaatctggatatgtgggtcaacttcgaatctgtgaaccccgcgaatcaggagttgacgatgctatctggaccgccttattggtttatttattcaatttatctcttgtctatcttctaatatcatattgtatgtacattatttgttatgaggctatgccaacctccatccaattaaacatctcattctgaaaaaaaaaa

SEQ ID NO: 13112 - DNA, 904 bp, Triticum aestivum
  Clone ID: PAT_TA_13112
tttttttttttttttttttcacatccaatgttctatattacatcaaaggtctaccacaccaatcaacgctcaggattaaatgttcttctagggcagacgcccacgtcctacttctcccaccatctacctcacgcaaagaagccgccgcacaatatgccactttattacggatcccatgcccgcacaaggaaacagcacgtccaattcgcatggacttgctcgactatacaaaaagaaatctgctaaattaggggggaatcaatccaggcatccggcttgacgtgcgccatcattgctcgctgccctgcacagacgccgaggcatcggacgatgaccgcgacgacgtgttcttcgctagcacaagtgcatccgccgagtcacctgacgacggccacaacgacgagctcttcgccctcacatgtgcaaccgccgaggcgcccgtccacggctgcgctgacgagctcgtcgccaacacaggtgcatgctcttcagtatatttcggaccttacctgagtgccttcctgatgattctgaccgaacaaaatcccacactatcatgaagtaaacctgtcaagtacttcttttgtacaacgctcaaaagctttgggttggtgtatatcgcaggcaggtatgcctccccattcacatctttctgtttattccagagttccaacaatttatgatgcaacaaattcgaggactcttccatggtcttcaatatccattcattgtaagcctgcaaaagccacttcatctagaaggttgtgctatatcaattattcattcttcaacctgtctctttgctttgctataaatctcggaatttggaaagttaaccatgaactttctgaaaacatgcttccgtcttttcagaagaagtaaatttctttggcaggatcaagcc

SEQ ID NO: 13113 - DNA, 485 bp, Triticum aestivum
  Clone ID: PAT_TA_13113
tttttttttttttttttttagagttaaaggatttattggtatctcatatccattatcatggggctatcgtgaacccggcgagagtcgtagtgctcatcgctcaaaccatagtggtatcgttctgaaccgaagtgaaatgtcgaaccggtgctcaagtactgagtacttagatggagcgcttgttggcctcagcggaaccctcgtgcttctcctggttcatcttgtcggaagcagcgttcagggcaccggaggcacggtcggtgagggagtcctggccagggacgttgcccttagcctgctgcttgttggcctccttgttggcctcagcggtctggccctggacggtctcggcgacgtagttggcggcgttcttgacagagttgacggcctggccgacgatgccctcgttgggagtgttggcgttgggagcagacattttgaagtgtttggtatttgaggggttgggtttggaagaagtggtagtg

SEQ ID NO: 13114 - DNA, 748 bp, Triticum aestivum
  Clone ID: PAT_TA_13114
tttttttttttttttttattataagtagaggaacatctattgcacaaccataaacaagtggtagcatagtttccataaaacggaattgatcttacaaaagagaacaaatagtacatcaaaagtagatgcccggacaattggtagcatagaacacaaaattaatcatgttggctacacttgacttcttatcaagagagaaaatagcacatcaaaagcacctcaggcaggtctaaaagctcgattagcatggaggtgggtgttgtcatggcagcagtatcattggttacatggcgcccgttggacatccacaaggagagttgggggactactacttctcatttttttcacataaagtaaaaatgttatacgtagccacaagcagcggtgccaggtggtgcatgccccttccactttcctatttctactttgcatgagactgaaagtactgcaagtttctgactggaacaataaaacaggtgcgtatcaactgacagggacttaggttacaggagcgatagcatacattatactggttcaaaagcaacggtcaggtccacgtcgccaggatcggaccggctaccacatggtgttgctggacgagacaagccaaccgaatccgtccatgcatgacggcctcccgtccgtcgggaagctcatggtgtagcttttcttctcgcccaccttggtgatggtcagcgttgatctgcatgctgcccgccgtggtagtggctccactgccgcagaaacg

SEQ ID NO: 13115 - DNA, 679 bp, Triticum aestivum
  Clone ID: PAT_TA_13115
cgtaaacggcagccgagccatcgagcacaaggatgcgctgacgaacccggccgatcgaccccccgaccagcggcgcccccgacgcgcgcgcctccgtacgtggcagagatgacgatgtccgggcggtacgtggcggccacgggcgccctcatggcgtgcggccactgcggcggcctccgccgcgtcaggatggagggcgagttcgtctcctgcgactcgtgcggcaaggtcctgcagcagcggggccggaagcagcgcgccttggaggtggaggctcggcggcggcggcgctggttgggggccaggaagagacgggacggccgcgcggcggccggtggcggaggcatggtcgtcggacgggaggcatctgatgccgagtccgacactggttgtgtttgtttcgtggaatcgtcgtcgtagtgattgcatcctcctcaactgatgttttagagcagtttgtggattctgggctagacagcgtcactgaacaagatatcgatgataatgctgggaaagttgcaatttatagcctgtttggctgaatttaatccttggaggacagccagacaggtgggagtagattagcgcgtgagttttggtgggtgcactgcctacctaaccttcacttgttataagcaggggccctctgtaaacatctttgctatattatttttttggc

SEQ ID NO: 13116 - DNA, 859 bp, Triticum aestivum
  Clone ID: PAT_TA_13116
ttttttttttttttttttagcaaaacaaatgttcagtttgatcaataattgtattcatggttggaaaacaagtgatacatgatacatgcataatacttgaccttatttaagtaggaacaaaagtacatatgaagacgtatttcatgggtctcttggacaatttctccctcgatgcaatggacgtcaacgtacgtagagatgtccatgcgtatgctgcattatgcaagcagtagttctacttgacgtcgatgttgacattgatcctcctgcgtgcgcactccatgactttacgaatgtgaaccttcagaacgccggaggcgagctccgccttgatggtctccttgttgtagcccgccgggacgagtagccgcgcgtacatgtcaccgtcgtgcgctgccgctccggccgcgtccttggatatcccgctggcgatagcgtctgccctcgcagcctctatctccgccttggtcttcatcttccgtatgacgagcacgtcctcgtccagctccacgacgaggtcctccttggacaggcccggcacctcgaaccacatgctcacggtgtcggccctctcctgtatcccccaccgctccccctgcggcgacccggggtgcagcagagcgacgggagagatgccgaacggcggcaaatccgtctttggtacgtgctgatccccttttgggttgcttgcacagcacacggaggaaggcctggactgccgctggaaacaagggagagcgaccgcggtagccttccccgtcgtcggtggaaaccgattgccggaggagagcgatggtgcggccgccggacggccgctcaggagggagcaagagatgaccgtcgacattgcagctgcttg

SEQ ID NO: 13117 - DNA, 987 bp, Triticum aestivum
  Clone ID: PAT_TA_13117
caggaattcggcacgaggtaaaaatcacaggtctgaaactgaggatgaagaacaagatgcgttgaacgtgaatgtctattcagataatctgggtcggttcatatggagcagtgagctccatgaaaagtttttgcaggctgttgaagtgattgggctgctacggcaagaaaaattcaccagaacatgaatgccaaggatttgaatttgaccatacagcacatcgcaagccatctccagaaacaccggctgcgggcgcagaagttatctcacagtgaagaggtgtatcaacgttatgccagcatgaaagaattatctgatatgattgcatcagcataccgtccgcccacgcgtccgcccaataattatccggcaacaacccagacgcagttcacacatggggttgcctcttctatctgggacaagtaccctgggatggtgtggccacatgtggagggaagttcagctgcctctgctatgtggtacaattaccccggaaagccgtggggacaactgggggagagttcggccagagcagaagtttcccagattaatgcaggcccaccttctgttctgattcatggtaccaagtccatttgggaccggtacgaggagagcctgcagtactataatgggagcctggcaaataaacgtgaagtgctgcctgtgaagagcaaaacagctgatgtatatggacgcaagattttcatcaacctggagagagaggagaccagtcgtactgaagcagcaggcaagattgtcatcggcctggagagcgatgacatgcacgaaggcaccatggacaacgtgcatgctgcagttactccgcagaaagataccatggagaaggtgcatggcgcagttactccgcagaaagatgcgatggacgaggtgcacgctgcagctattccgcatggagtgaacgaggtgcctgctgcagccatgggcgctggtgatctgatggaccttgggagcgaagccctgcttgac

SEQ ID NO: 13118 - DNA, 510 bp, Triticum aestivum
  Clone ID: PAT_TA_13118
tttttttttttttttttttcagcttactcacagtaataattcagacttcagtgtatatagacatctagtacagctgtacaggcactacacttacccggggtgagttgccggcgtggcgcctcctcaccctttcgcttggttgcgagtgtcaccggagcgacgccgcatgctagatccgcctgggtctctggtgcccgccggccgctctcctctccgttctccagcttgccgcgccaaagaacggaacggtattctcgaactcgacggtggggcaagagaggatggagctcgccgaccgcgggaagggcagccacggaggtgagctcactcggttactccggtggccggtctgcgatgtcccatggcgacggcgcatgggggctgcagcagctggtccagcgtggccacaagctcatcaccaaaacttttctccgcccgccacgccgcaccatcttctcctgctccgtcgcgccaccccttctgctccgtcgggccgctcttccgccacag

SEQ ID NO: 13119 - DNA, 1192 bp, Triticum aestivum
  Clone ID: PAT_TA_13119
gtcgacccacgcgtccgacaatatcagaaggttctagctgcttactcaacatgaaaatgcaaggcatgctgctaccagagataattcaacagataactgcctatactgtccaaaatcagataatgagaaaggagacgatctaactcacttccagagtcactgggttaaaggagaacctgttattgtacaaggggtactacagaaaatgccacatttgagctgggagccaccacatatgtggtctgaagtacatggtgctagtactacccctgatatgaaaaatgtgaagtgtattgattgtttatcttgttgtgaggtcgagatacgcacacaggatttcttcaatggatactattatggtcgggtgtatcaaaatgaatggcccgaaatgcttaaattgaaggactggcctacttcaaatcattttgaagagcttttaccttcgcatggagtggaatacatcaattctttaccctttcaaccatacacaaatttgaaatctggcttgctaagtgtctccgcattgcttcctgatgacacgtccgcgatcgcgtggggttgtggtgatcatgcccttaagttgagacagatgtttccaaaagattggttaaataagcttgaaagcgatgctctacagttgagtaagcagctagaaccttctgatattgtcagcggatatacaaatgaatgcccgtgctgtactaaacatgaaaatgcaagacatgctgccaccagagataattcaacagataactgcctatactgtccaaaatcagataatgagaaaacagacgatctaactcacttccagagtcactgggttaaaggagaacctgttattgtacaaggggtactacagaaaatgccacatttgagctgggaaccaccacatatgtggtctgaagtacatggtgctagtactacccctgatatgaaaaatgtgaagtgtattgattgtttatcttgttgtgaggtcgagatacgcacacaggatttcttcaatggatactattatggtcgggtgtatcaaaatgaatggcccgaaatgcttaaattgaaggactggcctacttcaaatcattttgaagagcttttaccttcgcatggagtggaatacatcaattctttaccctttcaaccgtacacaaatttgaaatctggcttgctaagtgtctccgcattgcttcctgat

SEQ ID NO: 13120 - DNA, 1056 bp, Triticum aestivum
  Clone ID: PAT_TA_13120
tctcgagccgttttgttttttttgctcgcggtaggcttaattgccatctctttgtgtatctctttgtgttacgtgttcgtctggctatctttggcctgttcttgtcggtgttgccctccgcgggtgtgtggccattgttgtttcttccacggtcccggcccacggcgacctcgtgtggattggcatcgtggtgcagacaccccctagctactttgcttgtttccgtctttctcagtttaaattaataaatagatatcatgtatctgtccatggatttttattttacacagttctgtgtggggttttgtgtgtccacaaattgatttactatcataccaatgccctcagtcgttcggtaattcttgaaacatctatgccaattctgatgctgaaggcccgagagtgtatagtgtaaaatactttgtggccagcaacggagtgatgggcgttgacgaggtcggcccctctttccgcctggcgccggctctgctcctgccccctccccggctcagccagccgccagcttcgcctcacgtccatgcttgaatcgtcgggttgtcgcacctccactactgttggtgatgcgtccaaatatttatctccttccagtgaccccgcaccactgcttgtggtaatggtggtagtgggcattgagatgtcactaactctccgtaaggtagccatggcttgtgcagaggtcttcttacgttgtagctcatcgaccctctccttgagcttcttgatgtatgatgcggccacatccaggctgcctagttgggtcattgtatcagcgtgggggttgtcttctttggggatgagggacgagagcttctcgcagagcctcttcatgtgctgccgcctctccttctccgactccttcttctccatcagtacctttgccgtcggcacaccagccgtgccgctgcttgccctggtcctcttcccgcccctcgccggctttgctttcacctccatcgaggcgcaggcagctgctagcttcatggtggcaggatgagaatggaggaagaagaacaagtgcttgcgtggcgtggttta

SEQ ID NO: 13121 - DNA, 528 bp, Triticum aestivum
  Clone ID: PAT_TA_13121
tttttttttttttttttttttacatcaacctgccatgtattcctctaccttttccttttcgtgtacgtacatgtacatgtacatgtggtatacttaccaagtacgtatgtttatacccctgctagtgatagattttgtaagaagtggtcacagagtaagtcaaagaatggatcagtggatcagcacgcgccgggcatgaacccgacggtgccgccgtcgaagcgcaccgcgaaggaccgctgctgcacgttgccgaggatggcggcgtcgccgtcgccgccgttgggcgcgaacgcgaggcacccgctcgacaggatcccgggggcctccagggccagcgtcgcgccgccgctgaaggtcagcgccaccgtcggcagcgtcaccacgccgtaccggctgaagtcgtagcacgtgtccaggatcccgttggccggcgccgacgggtacccgtagggcgcgatggcgccgcggaacgccgaccgcagcgccgcgtacgccgcgggcggcagccgcgtgatcaccgtgccc

SEQ ID NO: 13122 - DNA, 1173 bp, Triticum aestivum
  Clone ID: PAT_TA_13122
gcgtccgttttttttttttttttttttttttaacatgaaacaacacctgtctatattgcaaccaccactctaacctcaagtttttcccaagtttttcgacatcaaacagaccggcctttcattcatcaggcacatttttcacacagggctgccctataagtttgaagctatgaatgcagttgaatctatttcgatttacgttctgaagctacgaatgcaattgaatctaatacgaataactagatacagcgtagatcaacactatgtcaaactgttaataccctacaatgtgggggcacgcaacgtgcgtcgcctaaatattgacaggaagagcggtcaagaacgccagcgtgtaaggtgatgtcgacttgcctaaagctgcacaccagcgtggaagcttctcgagaaccgtctcgaccattggcgtggccctgttcacgtcggttcttagttttaccaggagaggagggtcctcgaccttggcttcggttggcggggcctgtgtcgctgcgctcgtcccgcctgcggtctgctgggtttgccttcctgcgacctcgctctcaccacccagttgtaccaacttaccggcctcctcgcgcttgccgccctcttcaaccaacttatctgactccacttgaacagtgaagtcatcgatttcttgcatattgattgcgagtgaccaccgtgtagatgacttggtatcaactgatactactgttctgcgggcatcatcggtagcagaatcgctttcaacatggagcagtggaacttctgatttgctccatccagtactgctccctttgtaactcctgcagccatacttcacggtaaatgtcacaaaatcagttgtcatattctttccgcaagaaactctgtgaatgctggaacaatgccgcttgataccagtacaaggcaagaccaaagatgcacacaacacagaaagaagtgtttttttcgcacctgaaatatggacatacgaaaggagatacacaaacgtgaaggacacgactatagcgatggcaaaggttatgagtttaaaactaaatatttagtttaaaaaaaaaaaaaaagagcggcttttctccccgccgacttgtttgtaagtagatctgcgatccgatccaatccggccggcgatcccgcgcggcgcggcggtgggcgaccagccatgga

SEQ ID NO: 13123 - DNA, 682 bp, Triticum aestivum
  Clone ID: PAT_TA_13123
aagtctcatacaggttccttctcctgtttgtttttgcaagagtcaaggtacatatatacaacaataacatctcatagttcttccaaaggttctgtaaagtgtcattacgctactatctcacaagtcacaagacatcatcttcttgcaagtacagaccaccatccgtctcacaagacatcatcttcttgcaaatacagaccaccatcggtctcaatgggcatagaaggcggagttccaggtggaatgcaatcggccccggcctcacctgcaatggtacacaatgcctcggcgtcctgaatagcccggtcaatattgatttgaccacttagctcattgatgaacttgagaagggtgtcgaagtccattccttccccaattatccgcaggcggtaccttttcaagataccgacgcacaagtacaggtgaaagtgttctgaaaaatagtgagtccacaaaacttcccacaagagcatgatctgatcaaaactgaactcccttttgaattgtataagaacccagcggaaacagaagaagtagttcaggcagtcgttctgcctaaaatagttgtgcaatgaaggatcgagaagctccaccagcttggataatccaagtagctgagcatgcatgccattctggtcacgattaaaattggcacctagacgttccatcagggaagcaaagc

SEQ ID NO: 13124 - DNA, 556 bp, Triticum aestivum
  unsure (1)..(556): unsure at all n locations
  Clone ID: PAT_TA_13124
ttttttttttttttacctcaaacaactcgtattttgatgcgcccaacagaagatcaaaagagttgatggaacggaaccactccaagataagctgctgttacaaacttacagttacagcatagagcttcatctgtaccgaagaaaagatgtcctctactgaagtactccgtattcactaattctattttcgtattcttatatacctaagcctacactttagatcagaggtggtacaaaggagcaccaaggaggcaaagaggtcaaatgactagctattgccttgctgtactatatatattagcaggaaccaaaaagaggacctcaaggtcagttggatgtacagcaggttgctcttcctttacagacatagaaggctatagaacacaaggggtatgaaagcgttatccagctgtgtcgtatatgcttccagtaataagctcaacgtcacagcaaccgaaagtgacaaccnntgctgtgaaannatgtatccgcttgaagctaacagtgtcaccannattgannnnnntgnnngtacnnnnnnnatgcctgctgnnnt

SEQ ID NO: 13125 - DNA, 1162 bp, Triticum aestivum
  Clone ID: PAT_TA_13125
gccggccggttcggggctcctctagggtttttaccacgcagccccgccgtctccctccgtcccccgccgccccgcctcctccctacccggcaggccaccaccgagctcgacccagcggccatggccgggaagaagcgcaagtccaccgagaagcagcccaagggcagccgcctgccgctcggcgccgacgccgacgcggtggccgacgccggcaagcgccgccgctctggcgccgccaagcgccaccaggccgaggaggaggagtccgtgccctcctccatcagcgccaagatcctccgcgaggccctcaggcagcagcaggaggagggcctcgccgactcccgccacgccgccgccgccgccacacctgccgccccagctgtttctgcagccccgtccacgtccttccccgtccctgctgccgacggcggcgacgatgatgacgaggacgtcgacgagttcgacggcttcgacgccctgagcgagtacgacggcggcgtgccggagatcgacgaggaggacgagaaggcccttgccgcattcatgtccaaggacacctcctccaagcaatcgcttggtgatatcatcctccagaagatcagagagaaggacgccacggtctcaacagaaagcacggcctgctgtcaagttggacagccgaatcattgaactctataaagaggttggccagctcttgagccgatacaccagtggcaaaatccccaaagcattcaagcgtatcccgtcgttggaatgctgggcagatgtgctgcagttaactgagcctcagaactggtcgcctaacgcagtgtaccaagcaacacggctcttctcttcaaacatgaacgcgaagaacgccgtgcggttctacgaagctattctgctgccgcgccttcgccatgacataaaaactaacaagaggctccattttgcactttatcagtctatgaaaaaatccctctacaagcctgctgcctttttcaagggaattctgctgccactctgtcaggaaggaaattgcactctgcgtgaagcagtaattattggtagtattatccagaaagtcaccattcctccactccatgcgagcgcggcattaatgaaactagcagatctggagtactgtggcaccactagttactttatcaagctgtttctggat

SEQ ID NO: 13126 - DNA, 481 bp, Triticum aestivum
  unsure (1)..(481): unsure at all n locations
  Clone ID: PAT_TA_13126
nnttcgttnttgaattgtctaatgtntttngcactaattgaatcctangattatcatcaatcaaatggaanccttattaaattgaatgccaactntcatgggcattaacaacaacattgcgtactggattagttacaacataatacatcccagttttttacctttattgcttgatcaaactagctctttctcgcaaggtctgttgttgcatcacagtagcaagtataattgggacgatttgcagaagctggtagctggaccttcgaagaggacgagcgcctgcagcgcggccacctagagaagaaaacggatcgggaagggaatgtgagggaggacgctgccgtggatgtgtcccactcggggatggaggagctcgctggagacaccaccacctccatgagcgtgagatgcatcctgaagtagccgacgacggtgaggcaagacgagagccagccaaggagcaccactcacaccgtctccg

SEQ ID NO: 13127 - DNA, 627 bp, Triticum aestivum
  Clone ID: PAT_TA_13127
cgacaacgtctactgcaccctgcttgcgcacagcgccctccatggcgccatggcaggatacagtggcttcaccgtcgcgcccgtgaacggcagacacgcttacatcccattctatagaatcaccgagaagcagaacaaagtcgtgatcactgacaggatgtgggcgagggtgctgtgctcgacgaaccagccctgcttcctgagccacgaggacgtggagaacatgaagcacgacgacgatgagcgccaccacctgcacaacacgcagctcctcgatggctcaccggcgaagtgctcacccaactgtaacgggtcagctggagccgagtgagaggcacaaagctgttgggatggatatattgagcatgtgtaattatagctattcttttttaaccttctcttgtgagtttttagcttgccttgtagtagagacttctccggagaattactgtataactatataataagggttccacgatggcaatctttggtggtagaagctcgattttgtagattagaaaatgctaagttttgggttcgagctcttcgcaacagaagctcttttgcaacacttcatctgaatcctggtttattattcagttgtaaagaattgccttaaaatcaaaa

SEQ ID NO: 13128 - DNA, 1137 bp, Triticum aestivum
  unsure (1)..(1137): unsure at all n locations
  Clone ID: PAT_TA_13128
gcgcttggttcatcgcaatcggaggacctctcgctcctcaactctccgctccgttgatcgcccaagcgtctccattctaccctgatgggaagggagccctcagtgctatcgtcgcggctcggctcaaagctggtggtcctgtgatcggcgtgggggccgtgggtgctggccaacgcctcagcgcccaaagcacgatctttgcggacactcaggatgctgctggaaataggcgccttctgccagtggccccatgcttcccccaagggatcgggggtctcctcaagatcgtcgccaactgccccatgaccatcgggcacatggtcagggcggcggccgagggcgctggccaagatctcatcgcccaaagcatgaactttgtggacactcaggatgcttctggaaataagctgcttctggatgttggcctttggctatcccagaagatcaaggatcatttcaagaagaagaccaacttccccataactctcaagtacattgacccgacatacatgatccgcgcggtccggtcaaacgcctccgacaacgtctactgcaccctgcttgcgcacagcgccctccatggcgccatggcaggatacagtggcttcaccgtcgcgcccgtgaacggcagacacgcttacatcccattctatagaatcaccgagaagcagaacaaagtcgtgatcactgacaggatgtgggcgagggtgctgtgctcgacgaaccagccctgcttcctgagccacgaggatgtcgagaacatgaagcacgacgacgatgagcgccaccacctgcacaacacgcagctcctcgatggctcaccggcgaagtgctcacccaactgtaacgggtcagctggagcagagtgagaggcacaaagctgttgggatggatatattgagcatgtgtaattatagctattcttttttaaccttctcttgtgagtttttagcttgccttgtagtagagacttctccggagaattactgtataactatatataataagggttccacgatggcaaaaaannnaaaaaaaaaaaaaaaaaaaaaaaaaaaaaaaaaaaaaaaaaaaaaaaaaaaaaaaaaaaaaaaaaaaaaaaaaaaaaaggaaaaaaaaaaaaaaaaaaggccccta

SEQ ID NO: 13129 - DNA, 1161 bp, Triticum aestivum
  Clone ID: PAT_TA_13129
ggcggttccatcccccgtcgtctccgacggagaccacatcaacctcttctccggcggcgtgtggggccgccgtccgcgccgcgcttgcctccgctagcggcgggagaggcgcagctcgggagagggagcctgcgacagacactaagccaaaccctaagaagcgtaagaaggaggaggaggttaggacggcggggcctgacgacgagaagtacaagctgggttatggcctcgccggcaagggcgtggctacgccctggtacatgtcgaagcctttggcttcctcctctaaggagaggagagattacgccgaaggcaacggggagaagaggagtggagggaagaagagtatcgaggagcttagagaggagaggaggaagagggaggccaaggagaaggagcgtgagcgagccttgcttgctactacagcaaggaaggagaggcagccagaccgggggtactcgtcgaggtatatgcgtcgatgatgcaagggtctgtgtgattttatctgcaggatctgcaatggatgattactggagaaaaccgaagatggacgtcactaacttgcatgcaaatattttgaaagatcaatgcggaggcaaaaagccacggctcaagtgccattggatgaactttcaagcagttcaagaatatctcaatataaagattcattagcgattagcttgtgtatttttttctactgtaagacaaacaactgtatttgtgtagcgtgccgatccagcaatcacgccctctgttgtaaattttatcaactcttacctggtgtacacaattgtttgggttacggtctgcactttgtaaagaaaatgctccaatgtgttgcactatactgctagagttgttgctttggacgttccaagtctgctaccaaccgattcaagcaaacgtagcgtgggcgcggcccaggtacatcaattggacatttgcaaacttcatcaatcttggtttgatctgaagtttcaaaagggggaaataaaaatactgttccctgtaaccttggtagctggccgacgatgaaaaccacaagatataaccttttatttactggtggggttaaatcattggactggtcttcaaactgaaaccctcatttctttacaagatagcccagaatgatgctaagcaaactgcccgggcggccgc

SEQ ID NO: 13130 - DNA, 670 bp, Triticum aestivum
  Clone ID: PAT_TA_13130
tttttttttttttttttttttaaagaaacaaattcatgtcttagtaatttcatagagaatatctaatctgaacaatccaattagatatacaagcagctatatatgcaacacagaagtagaggcatgacagtataataaacactgtcgatctcttgggttgtacattgtaggttaccatcctaagttaacttggcaacatcctagattgcaagctatgtcgtggactggcgggagacatggaggtgacctgcaagccaagatgatgggaggggggcagttagagagagagacacgacgacgacgacgacgacttgcaagcatgtgaattatagtccagtaaatatcacatggcattgggaggaaaacaaaaattaaggcgctgacaattagtagaacccaataccagatattgataaggtgtgacgctaaagttagtccaagcatctctctgtcagaacatccacaacatttcacctctaaagttcacctctacatacttttttactaaataatgtttcgccaaaatgtcataaaccttgtaagcacaacaatccttttttatatacagaacagtgtgaacagaaattaatcttagtgaagtaaaatttatactccatgctaataaaaagagtcaatcagatagcatagaagagcatattgccaccataag

SEQ ID NO: 13131 - DNA, 611 bp, Triticum aestivum
  Clone ID: PAT_TA_13131
catagaaacagaaactattattgcacttagcatttttttgcaactattccatgcagtctgggcgtcagtgtgcactgcaggccccccttataatagaatacagcgtactactttaaaagtcatttgaaatgagatccacagcttactagcatttccaacagatcagaaataaacattgactcgggataatctgggaagaaacagtcgcacccagaaaaaccgagcagttgctaaattgggtccaacataagtgtacaccataggccacgatgattaacaacacatcatggtcatggaagctgagtttatccccatccgacccagcaaataacatctgctgctctccttgattcgacacggcaggtcaagcttgggaagctccgcaagcttctattgcaagccatcggagcataagctctaggcagcagaagtctctttaggaaacccagaattgatcgttcatcttctagagctgtcatcttctttcaccaggttcggggggtatatcgtgtcaaagacaaccagcgtgaagagatttcttacctcagcaggtgtaccatttgctaaattgtgataatcgatatttccatcgctttttggttcataaccaa

SEQ ID NO: 13132 - DNA, 1313 bp, Triticum aestivum
  Clone ID: PAT_TA_13132
cgtccgcttctaatccggcggcggcggcggctgctgccgcgcccgcgccagtctgctcctcgccgccatcacctcctttgtccggcggcgacgcatgccgtgcccgtctgctccgcccgcacttgtgccgccccctctcctcgtcctcccgcctcacctctctctccccctcctaaccctaacccacgcccgcctccctgccccgtcgccgctggcccgggtacccatcctcgacctcaagctgggcggccacggatcaggatgggcgaacccgacggcgcggggcacggcggctgccaatggagccgacggatgtggaggctgccgagcattggtgttcgcgtgaaggaggaagaggatgatgagcttcgggaatgacaagactcttttgattcatctctccacagatcaagtttatgagggagtgaaatccttctacaaagaggaggatgagacactgccggtgaagatgtatggcaaatcaaaagttgctgcagagaagttcattactgagaaatgctcaagctatgcaatcttgagaagcagtattatttatgggccacaaacaatctctcctgtggaaaagtcgctccctgtccagtggatgaactctgtcctttcacaaggccaacaagttgattttttttatgatgagtaccgctgcccagtttatgtaaaagatatggtggatgtaatattgtctttaacaaaaagttggttatcagatggcaaaaaaattcaggtacttctgaatgttggtggaccagatagggtttcaagactgcagatggctgaggctgttgctgaagttcgtggatatagcaagtcgataatcaaatctgtccctgcatcatcggttaaccggggtgtagcttcaccgccagacatatccatggatatcaccaagctaactcagacactcggtatccagccgattacattcctggatggagtcagagctacacttgatgcagaagccagtacatgatattcataaattgtttgttcaagttcctccacaaaatatccaagtgtgacacaaagaaccccctttcttttacctgacaaagaacccttactagtttgccgaaatcgcagcagcggtagattttgttggatctgtatgcgtgaaagatgtaactttgctaccatcgaacgacttgcccttggttttactgtctgtaccattctgaataaaaatggcattccatgtgtgctcttcagaagtctgtacttctggtctgccataatatcaccaatgaagatcttttcactctgaaaaaaaaaaaaaaaaaaaaaaaaaaaaaaaaaaa

SEQ ID NO: 13133 - DNA, 689 bp, Triticum aestivum
  unsure (1)..(689): unsure at all n locations
  Clone ID: PAT_TA_13133
nnnnnntacaancgnnncaggtgcaagctggannnncgnnnnntttttttttttttttttttgtctgcgtatgccacgtttgtattggacgtatcaatcctgtttctatacggtcacatttaatacaagctgaaacacgtcgctgtcccgttggtatgcctaccaggagcaggcgagctcgtccataccatcgccgctctcgtacaacacccaggaacataaaactagctacaaagatgaagcgttcccttcttttaacttcaacctagagctctcttcttcaaaggcacttattcgcttcacacatcatttgttccttcctttggaggtcagtgagctggtcaagcatacgctatgtctgcaagatttaatttcatcagcattcttttgtgtaacaaaatatgctagctagcataaactgagaaacaatatccaagttgcagcgccaaattatttcaggttttataaaacatatgaatgttgcagtgcattacagaataaaaaatttctgaatgtatcgttgttccattcctagaaaaatgatgatgaatcaaagagatccagctgaaaactgagtgtagttgaatgaacaggaactatacaaagctgctcactaatcagagattattttttcctgaaacaggatttttgtaaacatagactagcttgagatgtgctttgtcatttga

SEQ ID NO: 13134 - DNA, 783 bp, Triticum aestivum
  Clone ID: PAT_TA_13134
atggtagactcctataaaggggaaagggtgggcgccctgcaggggacccggtcccggaatttcgggggttggcagagttcctgtcccagttgccccaccccactgctcgcgctcggtacgacgagaaagacaaaaaaaaaaaaaagaaaaaacaaaaaacatgggctccttcctgtcgtcgttgtggacccctcccccgctcgccggcgacgaccccgactccgccgtcgtcgccgtccactccaagcccgcctgggacaagcactgggaggaacaccggaacgcgtccaagctgatggtgatcgacttctccgcctcctggtgcgggccctgccgcttcatcgagcccgccttcaaggagatggcctcccgcttcgccgacgcgctcttcgtcaagatcgacgtcgacgagctcgcggaggttgcaaagacattccgcgtagaggcgatgccgacctttgtactggtgaagggcgggcaggaggtgagtcgcgtggtcggggctaagaaggatgagcttgacaggaagatcaagacgttcatctcatctacctgatcctagcttaattaacctgcactccaattgtagtgccaggttctgtcttgttgatcccagtgtcaaggggctcctatggtttccccatggtgtagcactaccaatcctcctaaaatgctgcaaatccgacgtaaaatggtaataaaggttctgaaacttggatcgtgtaaaaaaataactctggcctgtctgatcgttatctgtcttcttcggcaatcaagttactg

SEQ ID NO: 13135 - DNA, 952 bp, Triticum aestivum
  Clone ID: PAT_TA_13135
ccccaccaccccctccccaccgggttcagtcgtagccgcccaccccaccctaccgctcgcgctcgcgacgacgagacagacaagcgcggacagagccaaggaaacggagtgaaacatgggctctttcctgtcgtccttgtggacccctcccccgctccccggcgacgaccccgactccgccgtcgtcgccgtccactccaagcccgcctgggacaagcactgggaggaacaccggaacgcctccaagctgatggtcatcgaattctccgcctcctggtgcgggccctgccgcttcatcgagcccgccttcaaggagatggcctcccgcttcgccgacgcgctcttcgtcaagatcgaggtcgacgagctcgccggaggttgcaaagacattccgcggagaggcgatgccgacctttggactgggtgaagggcgggcaggtaggtgagtcgcgtggtcggggctgaagtaagggatgatggtttggactaggaaggattcaatggacgttacattcttcaacctacctcgatccctatgccttaacttaaccctgcactcccaattgtagtgcctaggttctgtcatggttgattcctacgtgtcaaggggctcctatggtttccccatggctgtagcactaccaagcctcctaaaatgctgcaaatccgacgtaaaatggtaataaaggttctgaaactcggatcgtgtaaatgtgtaactctggcctgtctgatcgttatctgtcttcttcggcaatcaagttactgaaatataaagtttgttactggtatgcgtgtttttatcctggacaaactgtagttttgttactgaaaaaacaatactgtatgttccctttgctatcaagtgaatggacaagatactgttgattttaaaaaaaaaaaaaaaaaaaaaaaaaaaaaaaaaaaactcgaaagtcgagactagttctct

SEQ ID NO: 13136 - DNA, 1850 bp, Triticum aestivum
  Clone ID: PAT_TA_13136
cgtccgcggacgcccgggcggaaacacaccgcgaagctttggctaatccaacccacagagacggcgcgcatggcgaccgcggcggcggcggcggtggcgtcgctccggtacttcccctcctccgtcaggaaccgcagctatcccggaactatcggcggcggcgctgtggtcacgttttctccgcggcggggccgctgtgggacggcggccatggccgcgccttcgcgggaggcggagccggcctcctcgctcggggacctcacccgcgtagacttccccatcctcgaccaggaatttgatggtaataaattagtttacttcgacaatggtgcaacatcacagaaaccctctcatgtgatgaaagccttagacgactactaccgattttataattcgaatgttcatcgtggcattcatgctctcagcgcaaaggctactgatgcatatgagagtgcaagaaggaaagttgcaaatttcatcaatgcggctgatagtagagagattatttttactcgtaatgctacagaagctatcaatttagtagcttattcatggggcctatctaacttaaaacaaggagatgagattattcttacagttgcagagcatcatagtgcgattgttccttggccatttgtagattataaaactggtgctgtcctaaagtatgttgggctgactcctgaagtgggtccggccgtcgagcggtgagatgcccgtctggcagccgtgacaagggctgctgtcgtccatcacgttgcttgcggccggccttcatggctccctcgtccggaggtcgtatcatgtgcaaacaaagttggagctaaagttcttgtagatgcttgtcaaagtgttcctcatatgccagttgatgttcagaagcttggtgcagattttcttgttgcatcctcgcataagatgtgtggccctacaggcgtcggattcttgcatggacggacgcgtgggttgtcgtctatggagcctttcttaggtggtggtgaaatgattgcagatgtgttcgaagacaaatctacatatgctgagccgccttctagatttgaggctggaactcctgcaattggagaagctataggattgggagttgcgatagattatctgtcacactttggcatgcagaggatccacgagtatgagaaagtgttggggtcgtacctttatgagagccttctctctgttccaaatgttcgtatctatggcccggcgccttctgcaagtgatcaccgtgctcctttatgttctttcaatgttgagaatgttcatccaacagatattgccgaaattcttgatctccagcatggcatagcgattcggtcagggcatcattgtgcacagattttgcatcgcacccttggtatcaatgcgagcgcccgtgctagtcttcatttttataacacaaaagaggaggtggatgccttcatccatgggctaaaagctaccattgatttccttacttcccaccactagtgcagttcagttagcaaacattagcttcctcgttgtctctcactagttcaagtgcgatatagaaggcctacctgctcaaactgtctgatgtctttcagctttttcgtgtaaaccatgcacgggcaagtttatctactcttgcgctctggaagtttcgagataagtattgttggctatgtagcttgggcggctccgtttatttcctatatataaactgtattatacctggaccgttggccacaatagtcaatcttgtgatttacgatctgtcaataactccataacagtgagcatggtggatacttgtgattttgaggcctgcactttacacatgtaataataagagactgaataaagtttcgttt

SEQ ID NO: 13137 - DNA, 815 bp, Triticum aestivum
  Clone ID: PAT_TA_13137
cgtccgcatggatgtatggactatgcatcagctaaaggataacaaattacagtcagatggtccacccggtatgaaaggatctcttttggaaaatctgttaaatggtgaaggtccatttgtagcatttactttgagggagctctacagtgtatctgctgctattgttaagttgaagggcctcatatccttttcaggcgatgtctgtaggaaggcatgcaatcctttccagcacctgtcgctaaatccaatggttgggacagcttgcattgccctacagaaaattgcagacatgtctgattggccagatatgttttctcttgtatggattgatggaatattaagatatcttgaagttttaggaacatttcctgaactcaacttgtcaaaagaactgtatgctcagatagtaaatgcacatgtgagtgctattggaaaatgcattttacttcaaggaaagagtgcgactctacctacccatgagattggatcaagcacaaaaacacttcagttgcagaatacatctggctatgtagttacaaagaatattatcgataggcagaataggttaaattcattgatatcaagacttagactgtcgatgagaaattttgttagtgttgcatcaaacatgcatctaagtgcaactttacaagtcattgagagagccttggtcggagtgaatcaatatagccactcaatatatgaagtggagactggaacatctgatggtgggacagtttcttctgacgttgctgctggaattgactgcctttatcttgttcttggatctgtgccaggaaataagcgtgtttttc

SEQ ID NO: 13138 - DNA, 1594 bp, Triticum aestivum
  unsure (1)..(1594): unsure at all n locations
  Clone ID: PAT_TA_13138
gggggcttgcaacgtcctcggcgagctcgcgggtgtaccacgtcacggactacggcgccgaccccaccggcgccgccgacgccacggcggccatcaagaaggccatcgccgacgccttcagccccccctccaacgccaccatggccgccggcatccccgacctcggcggcgccgagatccacctcgacggcggcacctacctcgtcaacggcccactcaccctgccggcctccggcggcggcaacttcaagatccacagcggctcgctgcgggcgtcggcggagttcccgacggaccggcacctgatcgagctctcggccgtccccacgggctcctcctcctcgggctaccactacgagtacgtgacgctgcgggacctgatgctggactgcggctaccggggcggcggcgtggcggtggtggactcgctgcgcgtcgccgtcgacaactgctacatcaccggcttcgagacggagggcatcgcggtgcgcgggggccacgagacgtacatccgcaacaccttcctggggcagcacatgaccgccggcaccgacccgggggagcgctccttcggcggcacggccatccggctcgacggcaacgacaactccgtctccgacgtggtggtcttctccgcggccaccgggatcatggtcaccggcggcgccaacaccatctccggcgtgcactgctacaacaaggccaccgggttcggcggcaccggcatccacctcaaggtgccggggctcacgcagacgtggctcagcaactgctacatggactacaccagcatcgtggccgaggaccccgtgctgctgcacgtgtccggctccttcttcctcggcgacgccaacgtggtgctcaaggcggtcaacggcgtcgcccgcggcgtgcagatcaccggcaacatgttcaacgggcggggcaagggcgtggacatcgtgcagctggacggcgccttcgggacggtggagcaggtgtacgtgcagcagaactccgccatggggatgaacctcaaggccaccacggcgcgcggctccgccgagggcaacggtagctcctggaccgtcgacttcgcgccggtgctgctgttcccggaccggatcgggcacgtgcagtactcgctcgtcgccggcgacgcgttccccgggcacacgctcaggaacatctccggcaaccaggtcgtcgtggccaccgacaaggccgtgtccgccaccgtgcacgtgctcgtcgaccagaacagcaactgagctgggaaatggcggcgcgttcgccgccgccgccgctgcctgctcgcgctgcgtggtgcgcgcgagcatggcgtcattcgttcgtttgttcctagtgaaatttatggattggacacccggatctggccggagaggatttgaacccaggtggcgggtcttcgcgacagttctttcgattgtttgggtaataattcagagtcggccatatggttctagaaaatgatccagaatggatcattttggagttcctcgtgcccggccctaatgttcaaagatcatcaagcaattgcaacacntgaataantgtgccatataatatacagtttgnccaaatccaaaaaaaa

SEQ ID NO: 13139 - DNA, 605 bp, Triticum aestivum
  Clone ID: PAT_TA_13139
tcgtgcggccgcccgggctggttctagtgagcagtctcgttcggcgccctccacgttctcttacgcttgtcccgtgtctacacagcctcggggcacggcaccgcggccttaagccttctccctgtcacctcccccctctttcccagctgcctttctctggaaacgacagcctcggctcgcgtgactgcggcgccgaaccctcgacgtgccacttgggctcttttggcctcctgtcttggtgtgtgcacgggcgcctcctctcgtccggccgcgtggccgctctccagtcgtgcctttcggggccgctccgcctcctgcttcggtggtggcttcgtcgacggctttccccctgccgctttttgtctgcccgtccatttttagccggacgcctaccagctcgcccattcgccctccgtccgccctcactggtcgcgcagatggataaaatgggagccctctcgtacgaggccacatctgggtccccccattcctccgacaactgtttcccgaccgcggccgcgtcctcgctaggctatccgaaaacagaattttgtcagctacctctccattcattgctttcagagctgcaccaccagcttcttctg

SEQ ID NO: 13140 - DNA, 676 bp, Triticum aestivum
  unsure (1)..(676): unsure at all n locations
  Clone ID: PAT_TA_13140
tttttttttttttaaaagctagaaccgacgccgctttattttagcacaaggggataccatatgtacagcctttcaagtacagtcaagcaaccggcctccctgccttgtacagcaccaaaatagatatgtactggccgccgccccggctggtacaaggtagggaggcgagctgcacgccgatgatacaaagggggggaggggtgtgaggtctctacaagcttttatcgaaaaagaaaaaatgctacctggagactatccggcctggtgttaaacctgctggggttggtggttatcttgagagaaccacctgttacctgtgcactatatgaagctttctatgtgggcctatatcatcatattaatctcgttgatgtcgtccatggggatctcgaggcccatcaagtcgagatcctggaacccatcgtcgtcgtctatattattcaaccagccgccgaaatcgccgtcgattcctggcagctcaaggttagacaagtctggtatttcagcatcgtttgcgggatttgcctgttcatcacgtctagtggcagcaaaggtgctactgtccttgctcttgttgtctgaaggagttactatcgtctgcggctgtggatccggatcccggggaggagcactgcccacaggagcagatatgttggctgtcctctgtttgggnnnn

SEQ ID NO: 13141 - DNA, 599 bp, Triticum aestivum
  unsure (1)..(599): unsure at all n locations
  Clone ID: PAT_TA_13141
tttttttttttttttaaccacataaccaaattattggcatgaagcatggattgcatgactacacatggcggaggcacgaaatacttctatcacccgaatcgaggcgccgcccggccaggtaccaaggactccagggtgtggaagttcacatttaaccggagacaagacaccgcgatgcgctacaacagctgattaacagagtaacctattgacctccctcttcagccacagagggcgaagcctcggctcatacgagaggaagatctcccggttcaccgcatccttgaagacatcagcagctagaaccctgacctgatcagacacatcggtcatagaatgcagagccttgatacaccttgaaatcgagaactgctcgccgtcctttttggtttgctctttcgtgcgagcctgtttcattctgaagtctagataagcctccatggtctgctggatgtcangaccgccttgccgcttcttgcgcttgtcctttttgcggttcctaatgcaggaactttgactgcgcgggttcatccgctcctggttgcggctttgggtctgccccaggctgtggtctttccaatgcctcttcatcgtgattt

SEQ ID NO: 13142 - DNA, 484 bp, Triticum aestivum
  Clone ID: PAT_TA_13142
gcaaaggttgggctcaaaccagatggtttttttgttctgaaagagaacattgcaaaaaatggatttgttttagacaaggaggataacagtgtcactaggtctgatgcatatttcagggagctatttaacaagtgtggattgtatatccacagcatcaagaaccaaaaggagctaccagaggaactatttgctgtcagaatgtacgcattggtgaccagccagccaaaggtcacaaaaaatggcaagagagggcggcctaaaaattcaccccgtataatccgctcttgaaggggggactattgtgccagcgtattgtctggcaatgtactgttgttcacttgtttctagtcgcaatttagctcggtctacattttgttttgagcatgctgtctttttcagagatcaaatccactagttgctgtcgaaacttaatgcatatggcatctagcaccttttgattctgaaatgaagggtatctgaacca

SEQ ID NO: 13143 - DNA, 3306 bp, Triticum aestivum
  Clone ID: PAT_TA_13143
ccatgggcctgctggcctgaaggcgatcgccgaccgtgtccatggcctggctggtactttcgcccatggtttgaagaagctcgggacagtgacagtgcaggagctgccctacttcgacacagtcaagatcacttgcgccgatgctaatgcgattgctgaggaggcccgcaaaagcgagatgaaccttcgcgttgtcgacgcaaacacgatcaccgttgccttcgatgagaccaccaccttggaggatgttgacaagctgttcaaggttttctctggtggcaagccagtggacttcacagctgaatccatcgcacctgaggtctcaagctcaattcctcccagcccccacgcgtccgcccacgcgttggctcacccaatctttagcatgtaccacactgagcacgagctcctccgttacctgcataagttgcaatccaaggatctctcactgtgccacagtatgatccctcttggttcttgcaccatgaaactaaatgctaccgtcgagatgatgcctgtcactgatcctaagttcgccaacatgcacccatttgcccctattgatcaagctgcaggctatcatgaaatgtttgacaacctgggcgatctgttgaacaccatcactggttttgattcgttctctttgcaaccgaatgctggtgcttcaggagagtatgctggactgatggttattcgtgcctaccacaaggcaagaggagaccaccaccgaaatgtctgcatcattcctgtctctgcgcacggtacaaaccctgcaagtgctcgtgatcctggcaccggcccggctcgggttaaaaagcacctggcgctatttgcgccatctcatcgagtgacccgggttggggggacccccccccgtgttattagcgaccctcttggttccctttctgctgctccgtggggatctgctttgattcttccaatttcgcacacctacatagccatgatggtctctcagggactcactgaagcttcaaagattgctatcctgaacgcgaactacatggcaaagcgtctggagaaacactacccagttcttttccgtggagtcaatggaactgttgcccatgaattcatcattgatttaagagggttcaaggcaactgctggtattgagcctgaggatgtggcgaagcgcttgatggactacggattccatgggccaaccatgtcatggcccgttccaggcacacttatgattgaacccactgaaagtgaaagcaaggctgaactagacaggttctgtgatgcccttatctccatcagagcggaaattgcagaggtagaaaatggcaaagcagatacacacaacaatgtcttgaagggcgctcctcacccaacccaactcctgatgggtgacgcatggactaagccatactctagggagtatgctgcgttccccgccgcgtggcttcgtggtgccaagttctggccaacaacatgtcgtgtggacaacgtgtacggggatcgcaacctgatctgcactctgcagcaggcatcccaggtggcagaggaagctgcagctgccaccgcgtaatcttctgatgatgacgatcctggtgtgtgaaacagtgtgaagttatcatgcttcctgtaggagggaagcatgcttgcttctaaatccctcatgtactgtatatattctcctcaaatgccaccttctcctgtatcctctgtaccccccacggcccccactgcctccccattcccatttgaaagtgaaattagctatattggctagcatttccactcttctctgaatacaggacaaataatggagatctgttttgatgtcctagccatacgtggaaagaagagctaattattcacagttgccgtgggaactgatgccaaaggtaacattaacattgaggagttgaggaaagctgctgaagcaaacaaggacaacctgtctgctctgatggttacctatccttcaacccatggagtctacgaaagaaggcattgatgagatatgcaggattattcatgagaacggcggtcaggtctatatggatggagctaacatgaacgctcaggttgggttgacaagccctggttttattggagcagatgtttgccatcttaaccttcacaagacattttgcattccacatggtggaggtggtcctggcatgggtcctattggtgttaagaagcacttggcgccatttttgccatctcatccagtgatccccactggtggcttccctctccctgagaaaaccaaccctcttggttccatttctgctgctccatggggatctgctttgattcttccaatttcgtacacctacatagccatgatgggctctcagggactgactgaagcttcaaagattgctatcctgaacgcgaactacatggcaaagcgtctggagaaacactacccagttcttttccgtggagtcaatggaactgttgcccatgaattcatcattgatttaagacggttcaaggcaactgctggtattgagcctgaggatgtggcgaagcgcttgatggactacggattccatggaccaaccatgtcatggcccgttccaggcacacttatgattgaacccactgaaagtgaaagcaaggctgaacgttataggttatgtgatatccttattggaataacagaggaaattgctcaggtagaaaatggcaaagcagatgcgcacaacaatgtcctgaagggcgctcctcacccaccccaactcctgatgggcgatgcatggactaagccatactctagggagtatgctgcgttccccgcggcgtggcttcggggtgccaagttctggccaacaacatgtcgtgtggacaacgtgtacggggatcgcaacctgatctgcactctgcagcaggcgtcccaggtggcagaggaagctgcagctgccaccgcgtaatcttctgatgatgacgatcctggtgtgtgaaacagtgtcaagaagttatcatgcttcctgtaggagggaagcatgcttgcttctaaatccctcatgtactgtatatattctcctcaaatgccaccttctcatgtatcctctgtacccccccactgcctccccattcccatttgaaagtgaaattagctatattggctagcatttccactcttctctgaatacaggacaaataatggagatctgttttgatgtcctagccatacacggaaagaaaatctagttattctcagattgtgtactcttatatatccatagatactgttgataacttgagcctaaaggtcagcctgactttggaaggccagcaactgctctaataaaaaaaaaaaaa

SEQ ID NO: 13144 - DNA, 666 bp, Triticum aestivum
  Clone ID: PAT_TA_13144
gcattgcacattcctgagatatgaacatacatccacatatcatatcagcgcttacatttacttaaactgcttaagaatccatctaaaaatgcagtacatgtccatagtttttcatctacaaggtggcaggtgtttgtgctgcaaaatgccccaacaactaaatcgggacaattcaaccaaaagatcttgccgggctgcacgtagagtgaacgaatacttcatcactttagtcgaggatctcctcgtacaggaactctgggatgcatcccttattctccttcatcgtcactatgtcacatgcaatcttcttgcggaggtgctcgatctgctcctggttcatattcgatctcaggtaaaggccagtgaactccagtatgtagtgcaggacatacaccacaccgtcttccctggtgcatggctcgtgttgcgcaaccaacgggtacacaaatgaccatccagtcgtctcgaccaagcctgctccaaacttgtcattaaaaaggttgtaaaacctacgctggaacttccttgccagcgcctcatgcttcctcttcatctcatctgatggatctgtctctgttggatcaagcaccattacaatcttcttctcagtgtcgagaatgtacaaggaccagcaatccatgaacatcacagggagacatgaatggt

SEQ ID NO: 13145 - DNA, 569 bp, Triticum aestivum
  Clone ID: PAT_TA_13145
aaaataatgcataccatataaattttacaacccccaatcctatgtagggtacctttttttaccactgatgctcttgccaaaatacagtagggaaaggatcatagtgcagagttttacaaattaaaaaaacatgtacatagagaatatttacaggtgtgcagagagtgcaggaagtgttacaaattacttatgttgtatccaacctttgaagttattcgagtgttttgtactctatggataaccagagtaagatccgctctgaaatttctgagccatctctcccaagataaagcagggagcacaaaccgccccgcttgcccagaaagtaccctggggatgatcttgagtacattgcacgtcgaggagcgcaacaacgccgccgaagggcatcgcactcttcaatgtcatgtcgcgatatcgagagccgctggcgccaaatgctaagcttagacaaccactgcacctcctgtcactaacttactcgacagacaacagccaacacctcaaaagcaactctgagcaccttgcgaagcatcaccgccaacacggaaaaaaaagcctggaaagtt

SEQ ID NO: 13146 - DNA, 972 bp, Triticum aestivum
  Clone ID: PAT_TA_13146
gattcaactcaacgacaaaaaaacactcaaagtgattgtccgaaaaaatactcaagtacaaatgcgccctccccaaaaaatagacagcggaggctttcacaatgaacgagcacatacggacatatggggaaaatatccccctccgttcccgcccatagtcggtggggcagaagcccgtttctctccctacttgcggttcactgcactgccggtgtcgaccttgtcgcgccgtggccgtgtctccacgccgcggcgcgcgccgcctgcccgcctcgcccgcctcgccggcgtcccccggctcaggccctccgagtagcacgatccggcatccatgccgccaaaccagtgctcattcaacagctcgctggacatggacagggcgctcggcgccggcgagccatcgatttccttctcgtcatcggttgtccgcgcaggggacaatggtgccatggacgcgaccgggtgctgcctttggaacgccaggacggcgacggcgacggcatccttgatctccttggccgtgctgaacgggccggcgaggacggggagcatccgccaggcggagtcggcgaagttgaggcaagcggcgcggccggagagcgcgagaacggcggcgtcgtgcgcgcgcgctgccatctcggcggtggtgaaggtgccgagccaaagcctggagcccctcatcccgagcacgcgcacctcgcacacccaccggccggcggggccccgtcgccgcacgccgcggtacagcgggtggcgcgtctccttgaacttggtccggccggccggccgcttcggcggttccgaccacaccgtcctgtgcccatcacacggggaggcggcatcagcggcgtccatcgatcgatcgcagtgtcgccgggagcctgccgactgtggggtaattaagcagggagtttagctgctgcgttgagagatttgagagagatggatgctggagaggaggagcgctcgtgc

SEQ ID NO: 13147 - DNA, 509 bp, Triticum aestivum
  Clone ID: PAT_TA_13147
aaggtaaccattatataaatatattcgggtcctttcttcatgttcctggtagaccctctcactagtaaacacacagacgcaaacttgaatacaaactcttttactaactacaacacacacatggatgaatgaatcccagccaaataatgtacctctgtgaatacatctctacaccgcgcgctcttcttcccttactctcttactctactctatcccctcctcgactgtcgacggacggcgaaacccctcgagacctcggctcgagggcgaaactaaacaaacacccgtcatccatccatcataaaaggaaaaatatccttgccaactgtgcattgaatttgcacccatcattcaatgttttgctacatcagggtgtcaacttccccacgtcgacagatttccccaccttggcaacgctaagctaaaccccgagttggcgaagagagtcgggacccaccaggtatatccgtctccggctgcccttgtacctgcccgggcggccgccccca

SEQ ID NO: 13148 - DNA, 420 bp, Triticum aestivum
  Clone ID: PAT_TA_13148
gaatgcggttacattgctgctaatctttatgccaagagtgtgttcggagaagatgctttggtgaacatcagcattgagaagcaagtcgatggcaagcttagtggtcacatcagaataaggagcaagacacaaggaatcgcgctcagcttgggagataagattaccctcaagcagaagggaggcagttaattctgatgttgcctgctcacaaacaccggattgtatgacatgttttcttcaagagatccacttgccagtgtcatactagaggcacaatgggattgattgaattaactacaggaagtttttgtgtacagaatatcaaagagaagaatgataaaagaagaggatcgtagggaagtcagtcttgggagctgaaaaacgatcttgacacttcctttcgcgataggtgtttattga

SEQ ID NO: 13149 - DNA, 2159 bp, Triticum aestivum
  unsure (1)..(2159): unsure at all n locations
  Clone ID: PAT_TA_13149
ggctcgcccacccgctcgcccactccccccctcctcccgctcccagatccccatccacctccgccgcagatccaaccaccaataccccacccgccgtcgccctccggcgcgggtgcacggcagatccggcgccatggacaagccgtgcacgctgctagtccacttcgacaagggctccgccgccatggcgaatgagatcaaggcggatctggagggcagcgacgacgccgccagggtcgaagccatgaagcgcgccatcatgctcctcctcaactggtgagaccctgccgacgccagacaatgcaaatctacgtcaccgcctcctccctccgggaccacaccatccagatgcttatgctcctatagttctttgtgttcggcagcttggcaatactggtgatgatgtgagaaagatttggctgcagtcatgtaggcagagttttgccaagatgcttgctgagaagcaattcagggagacggaggagatgaaagccaaatcacagatctctcatgcccagccagatgatcttattgacttctaccacctgaagagcagaaggggcatgagccagcttgagttggaagatgaggtccaagatgatttgaaggctgcaactggtggattcagtaaggaaacagatgatgcaaacagacttaaccgcattcttcagttgactgggttcagtgatcctgtatatgctgaagcgtttgtgacagttcatcattatgatattgtacttgatgttactgtcataaaccgtacaaaggagacacttcagaacctgtgtttggaattagctacaatgggagacctcaagcttgttgaccggcctcagaactatccttttgttcctgacacaagcatgctaattcgtgctactttcatggtcatcagcacggagaagcgagtcatttgtcaggccttagtcgatgcgacttcaatagggagggaaagatcaggggttgtcctcaatgatattcacattgacatcatggattatatctcacctgctacatgtgcagatgttactttccggaacatgtgggcagaatttgagtgggaaaacaaggttgccgttaatacagtaattcaagacgagaaggaattcttgaatcatgttatcaagtcaacaaacatgaagtgtctaacaccaccgtctgcgcttgatggtgaatgcggtttccttgccgcaaatctttatgcgaagagtgtgtttggagaagatgctttggtgaacattagcattgagaagcaagttgatggcaagctcagcggttacatcagaataaggagcaagactcaaggaattgcgctcagcttgggagacaagattaccctcaagcagaagggaggcagttaagctgtgacgcgacctgtcgcaattgtcatgtaggagatccactttgccagtttcataccatcggtacagtgggctagtaaagatgtttttaatgtacaaaagattaaagagagggatgagaagaggaagctcgcaaggaaatcagtgttgagactgaaaatggatcttcaactagtatcctggagagatgcaatgatatctcccaactcccttccaagatgaggccttttttttgacaaaaatggtggtgtaagaatagatgtgaggtttgtgttgtttattcttgatatcggcggattgagatattgtattacgggtcccttttaatgtctcgtgcttttgtctttcagccttacatctactacctcgagatcattgacaagcgcgacgccgctggccgcgtcctcccggagatgatcctcatctgccagaatctccgcaacaacctgcagcaccccaatgagtacatccggggcgtcacgctgcggttcctctgccgcctctccgagccggaggtgcttgagccgctcgttccttccattctcgagaatctcgagcaccgccaccacttcatccgccgccacgcgctctccgccatctcggcgatctaccgcctcccacacggcgaccagctcatccctgacgctcccgagctcgttgagcgcgcgctcgcttctgagcaggacgcctccgcgcggcggaacgctttcctcatgctctgcctctgtggtcaggaacgtgctggtgcgtacctattctncaacgcgaacgtgttaccgagtggcccgatcttctgca

SEQ ID NO: 13150 - DNA, 623 bp, Triticum aestivum
  Clone ID: PAT_TA_13150
ttttttttttttcccgacggtagaccaatgactagtttgtattccttcaaaacaaaattggtcaaccatgatcctttgggatcacctataacttatagccttaatgtggtgtctgctgcagctccagagttcacaacctgggcctggaattcatggcaacctactcctaaatcggtgaattcgttaatgagacccttaaataatatctctagcgagcacttgaaattttgtgagcagcttttgtcaccctcgtcgacatcttgcactccgtctccagcaaggcatccaacttgggcaccgcccatgtaagctttgcatcctacgaggatgtcacgcccatacttccggaaatgtccaccaatgaagtgctcaaaatgctttggtggattgcgaagagaatacagcatggttctacaggatagcagaaaagtctcttcattataagccagggactgcttctccccaaggggtgtgttagcatacatcgaatgaccaggttcattgaaataaggtttagcattcagcaccaaggcttgaatagagaccaggacctgcaacatagttgaagtggatgggttccacatctcacacccactaccagtccatgtgtttaagaggctaag

SEQ ID NO: 13151 - DNA, 932 bp, Triticum aestivum
  Clone ID: PAT_TA_13151
ttttttttttttttttttcctcaaacacacgtatatatatatatgcatgtataccaatctggtcccagcaatgtaagtgcgtgattggtctgtgtggatgttcgtatgatatcaattagcgacatactgattgcagtcgccgttgtaggtcaactacaccgggtccccacaggtcctctgcattgtcatggttgacggctgtcctctcttgccctgcttttttcttgttggagctgtgacaaattcattaatagcgctattgttatttgttgataagctagctgtaactgaatcatgatgcggtccctcgactggtcgcccgcacgatccctctccctgtgttctctcaccggtggcgcaccccgcgcgccttcctgccgcggccaggcttgtgggggggtcttcacaagtaggtgagtattagaaactggggccagaagaagcgtgggcatgagttcttcgacccacggccaagagatttccattgaaattacaatgttttcttgtgggtacatgatatggaaggttagagtcttttcttcttaactctaaatacaccccatagataataggacatgttccatctttgaaagctttttggcaggatattggaaggaaatatgagcaattcagctgtttcaatgtttcctcttgagtgccaaatcgcctttcagcatccattctactaacttactgtaatgcctctcataactctggatatcttgtgcaaagaaaaaaagaccaatactgtcatacgaaaggccatttccatggaactgtggggggaatatattccggcgaggaagttgctcaagccggattttagaagggaatttctttgctatttccaaaaccttttgtgaagcagaacatgataagtgtccttgcaagcccttacaaaacttagatggccgtccagtcctccatatttc

SEQ ID NO: 13152 - DNA, 1243 bp, Triticum aestivum
  Clone ID: PAT_TA_13152
cgtgggccccccgacccgaggaaagaggaagttagagcagagtccacacggcagtggccaaaggcgggaggaggggcgggatgccgatcctgtacgcggtggtggcgcggggcgcgacggtgctggcggagcacagcgcggcggcgaccaacgcgggcgccgtcgcgcgccaggtgctcgagcgccaccccggcggcggcgccgacagccacgtctcctacacccaggaccggtacgtcatccacgccaagcgcaccgacggcatcaccgccctctgcatgcccgccgacggcgacagacgacgtatcccatttgctttcctcgaagatatccatggaaagtttgtcaagacatatggccgtgctgcactgacagctcttgcttatgcaatgaatgacgaattctcaagggttctcagtcagcaaatggattactattcaaatgaccctagtgcagatcaaatcaaccgtatgagaggcgaaatcagtcaggtgaggagtgttatgattgataatattgataaagtccttgaaagaggtgaccgtttagacctattggtggacaagactacaactatgcaagggaatacagttcgattcaaaagacaggctcgccgctacagaagcacaacttggtggagaaatgtcaaactcacggccgcgttgatactcctcctccttgtaatagtatacatcgccctcttcttcgtttgccacggcttcaccttgccgacttgcatccggtgagagggcccaggggcatataaattcgtctggtggtgtgtgcttgtgtccactgtatgtctgtctccctgcccaggagagcgaccgttgcgaaattattttttgtgtgtagaaagagaaaggaggacggacctgctatttattctgtaattgtgacgccttggattgtggtttggaacgtaatcgagtgtcttgctcattcaacgctggagtgggaccgttgtgttgtgttgtgtagccaccgttgctgtgggtgggtgtgcttacatggtttcaaactttcagcaactcgtatgctgacatgggtccagtccaataagtatcatctgtgcaggttgcaactgtttttctttgggtgcaaatactccctttgtttctagctcccagccctttttgagatttcaccacggatgtatatgaatgtactttagagtctaaattcactcattttctccgtatgtaatctgtagttgaatctctaaaaaggcttatatattagg

SEQ ID NO: 13153 - DNA, 696 bp, Triticum aestivum
  unsure (1)..(696): unsure at all n locations
  Clone ID: PAT_TA_13153
tttttttttttttttttttttttttttttttgacacgaacacaatacactcccattcatcacctatacgaatgtttacaggtggttcttgatactatagcgatgtagtatgttatctctgaacattagctactagttcaccgaaaagcttaattagcaaaaccatcgccggccggagacggatgaacaccnggcggacgagccagtcngagccnggagcgagctaactttgccgttgctttgaggccggcgggggtcccgggcggactttctttgatggacggcgaatccttcttgcagcctgaatcttgcttcttctgaaaccctttgcggatgaactccctcccgcctttctttgtccccctcgttctcgtccaccctccggcgtcggcggcgactccctcggcgagttcgtcctcgtggagtaggcgccaacgccgtcctcgtcgtcgtcgctgctctcggtctcgtccgaggagaccgccactatgcccaggattgggtcgctgctcctcctctcgtactggaaccttgggacggcttggtactctctgtatccatatggctcttctgatccatgcgagctatccggtgcattgccggcttcgtcttcgtcggtcacttcttggattttgggttggatcccttctcttggcctgattgttctcactgatctaccgactgacggcgatgacgg

SEQ ID NO: 13154 - DNA, 920 bp, Triticum aestivum
  Clone ID: PAT_TA_13154
ttttttttttttttttttgatcatctgcttatcttaaataacagtgcaaaaacggacagaaaaatagatacaggtgtgtcggggcaatcgtctttggcagctactctagtcgcaaaggatgattggcgttgttcggaatggtctggcagtgggttcggagctggcgcataggaagatcaagggaggcattttttacaacactttgggagggagaaatggtgttgcgccaattttggctctgtccccttgagaagctcgctacacgcgcccctctgtctgctccaccgtgtatgcttcctccacaacttgttcggaattggtttctgggctggtcagtaaaggcgagatctgtgaaccgttgttggcaaaaaatatctgtttagggcacatctgaatttcggagaaagaactccaaaaagatactgaataagccatttgcgtagttttagatcatcaatttgaggaattaaatatgtgttgtatgccatggaaaatatatcactagatctttgtatggatgtagtttctaaatatatatttgttgtcacatataatgtacatatttagatagttaaatcgtcgatctaaaactacacgaatgacttgcatttggttccaacaatttttttatgtcgggactagaaaaattccctaacaaatcgaagactcttccacgactttttctaaaagtccttagaagcacctacttgaatttctcccccacaaagtcctaagaactagaaaaagtcgtaggactagaaaaccaatacaccacctgtttaaattaagataaatgataggaatcaacaagatggattaaaaggaaaataaaaagacagaagaaaatgcttgcagactcttcgtgtaaattaatgatccaattttgtgcatatactaaatgtgtgcctagacaaacctta

SEQ ID NO: 13155 - DNA, 556 bp, Triticum aestivum
  Clone ID: PAT_TA_13155
ttttttttttttttttttttcttccttttctgtgcccattgctcctttcgtcgcacccttaattcggctgcctccagctctggttcggcgctgcactcgtcttccacatgggcgcttccggcgctccccgttttggcctgctcggggctccctaaccactcggtgcctcctcgttctctcatcctaccccattcggtgcctctcctgtttcgccttccaccccggcctgcccccaggtggctttccctcagcggttccccccctccccggtccagtcttctgcgccttttggtgttctgtggtaattgtctacttacccttcactgcccatccgtcggctctcctatgcgccatgtggcgcctcgacgcatctcgtgttctgttagctggcccggcgctcttaacagtccgccgctcgtttcctcgcccgtcggtctttcggcttggccttccgccgagcctttttcctcgcccggcggtggtaatattccgcaagttcctcgcttgtctaccattctatttagtcttctgccgagctatattcctcatttgtcct

SEQ ID NO: 13156 - DNA, 696 bp, Triticum aestivum
  Clone ID: PAT_TA_13156
tcgtttttgtttctttgtcttgctgctctttcttgcttttaccgcataccccgttcaccgctccgtctctcttgctttgcatgggcttgccgtgcgacttgcgtgcctccgccgtggcaaggttagtataaacccccggtgaagagccaattggcacagccgttcccaaaggacacgattccaacctgcctgccgttttcatccacagcggggccgccagaatccccttggcaggtgtctttgccctgtgcggcagcgcaaaacattgcgtcggtaattttggccatcaaaacgtaagataacgagcaggtccatcggcgcaccgtctgcaccttagtagtgcgcaggcccagcggaggtgtcttattgccctcctgcactacgccccagccactgagtgttatggtgctgcccactcccggctccgcgcccaccgccaccagctgcaccggctgcaccgccgggcccaggaccagcggcgtctcgagcttgatgagccccacgtcgtaccgcagattcttcatggtgaagcgggagtcgtacatgacctttttggcgtgcgggtattgcccacccgacgtacggagagctggaaccggcacgaacgcggacatgccagtcactctggacgtagtagaggcaatgggcagctgtcaagacaaattttcatttaaaatcgaaccaccgcattgaagg

SEQ ID NO: 13157 - DNA, 622 bp, Triticum aestivum
  unsure (1)..(622): unsure at all n locations
  Clone ID: PAT_TA_13157
tttttttttttttttttttaagcttgcttgtgttcgttactgaatagattcacctgtgatttatttagttatacaacactggaccactacggaggcaaaggcactacaataactggcttactgaaactacagagcacgggctgatcgatggagctaagttgcactagtagagtagtagttgttcttgctgctgccgttgacgtctgcgttggcattggccatgtcagacggcggcgggcctctccacgttcctccatctcctcctcccggacgaacaccgtctggtccagcaccgacgccggcccgcccacgcctccgtacaggtgctgcggtggggcgggatgccgccccgccgccgtgggcgtcggcgtcggcatcggcatcggcggggacgaaggcgcccgtgtcctggtcggcccaagacgccgctgacccctccgtggcacctccgaacaggtgcggtggagncggcagccgagccgccgccgtgggtatcgacgtgggcggggccgaagacgcccgtgtcctggtcgggcacccacgacgcgtcctcgccgccgtcaagcgcgccgccgatggccgcgtccctcggccccgtggcgacgtgctcctcgccctggag

SEQ ID NO: 13158 - DNA, 569 bp, Triticum aestivum
  unsure (1)..(569): unsure at all n locations
  Clone ID: PAT_TA_13158
tttttttttttttttttttttttttttaatcaaagccacgatgttagtgtgttatttgaatctgagaaggacaatacacgtactcgtgggcagatcctacgtttttacatgctcaagtttaggagaacggaatgaagtttttcttttttactataacgactcgcacagcttcagaaaacagaggcggctgcagcacggatagacagagacaggctcgagaaccggagccgcggatacacagggatgccctctgcggtgccacctcatgccgtcaaacgggcaccgcggcagcgagccacgcgatggcggggccggcgaggcgcgcggcgcgcgggacgacggcccgcgcaacgcccggcagcatcgggtaggtgagcacgcccagcaggaaccagttgaggctcagcagcgccacggcgccgtcggaggccgccgacgccggaggcaggccgcggcgggccgcgggcgccctggaagaggcgcgacacgctgcacatggacatggccaccacgcgcgacgagccccccgaaggagcggcaggcacgccggcttgnncccccnaacaacn

SEQ ID NO: 13159 - DNA, 1203 bp, Triticum aestivum
  Clone ID: PAT_TA_13159
tttccgtttcgagagcgggtatgagcagaagaggaaggtgatgaacaagaagtatgaggtgtacgaaaagcagatgaaagcagcaaggaagactgggagcaaggctgcacaagataaggttaaagaccaagcaatgtcaaaggcccataaagaagttgccaaggggaaggggaaaggaaagaatgtggcaaatgatgatgataacgtgaagccagcggatctgccacaaaagtggcatgactacaaagttgagttccacttcccagaacccactttgctcacaccaccactccttcagctcattgatgtgggtttcggctaccccaaccgtccggacttcaagttatcagatgttgatgttggcattgacatgggaacacgtgttgccattgttgggcccaatggagcaggaaagtctactattctaaatttacttgctggtgatcttaacccatccgaaggagaggcaagaaggagccagaagctgaggattggacgatactctcagcattttgttgacttgttgacgatggaggaaaatgcagttcagtatttgctcaggctccacccagaccaggggggaatgagcaaagcggaggctgtccgtggcaagcttggaaaatttggcttgccaggtcacaaccatcttactcccattgttaaattatctggtggtcagaaggcccgtgttgtgttcacttcgatatcaatgtcgaatcctcacattctcctactggatgagcctacaaatcacttggatatgcaaagtattgatgctttggcagacgctctggatgaattcactggaggtgtggtcttggttagccatgactcacggttgatatctcgagtttgtgacgatgaggagaagagccagatatgggttgtggaggatggcacggtgactaaatatgatggctcgtttgaggattacaaggatgaactaatggcagaaattaagaaggaagtcgaagagtaatgctgctcatattgagctgcacattgcttattctttgtagaatgagctggtttgttctcctgaaatcccatgtattattagcagcttttgttcgctttggtttgcagaagaatatacatatggtttgtcatatgcgtaccatctatatggccaagatgagttatttgtttgcctcttttactctgcatcgtactggaaatctggtggtgtttcttcaaaaaaaa

SEQ ID NO: 13160 - DNA, 482 bp, Triticum aestivum
  Clone ID: PAT_TA_13160
tttttttttttttttttttttttttttagcggccagaacgatagtaaacacaattaaaggatggaaatgttcatacatggtaaattgaaggatgcaatgtccatccatgcaatgttcgtacaaggatggatagacgcgccgtcgtgttcacaaaagaagagggagatcacacggttgtttacatggtacctccccgggccgccgcgcgtcatatatcaccgggtacttgccagagttagaataggtgcaaagccatggccgtggtgtgaagaaagcaattggtgcaaacacctcatgctcttgtgcctgagacgccaaacaattagataggtataatatatttgaaaacagaatgtgccaggcatgcaagctcaaaaataagaatccagccacccacacccaacacaaactcgcatgtcctcttcgtagccgttgcactgtgtcatgtgaggcacgacgagttttcaattactataaaagtg

SEQ ID NO: 13161 - DNA, 664 bp, Triticum aestivum
  unsure (1)..(664): unsure at all n locations
  Clone ID: PAT_TA_13161
gtttttttttttttttttacaagttanatgctcgctttccttttctagtatgtatactacattttanaagtagatttggctgcttctgtcttctgtgcccgtaggccacgctgccacttcttagcttacaaacaggtacaagggtggcaattaaaggccaagtcctctattggctaattacacaaggtcanacacgcgggattctttgcagtaacaaagatactgggtagaaaaaagcacataataatggctgatcttcngaccgatctaagctaaacctggcctgggccatcttgccgggcttcgtcgaccccgccgcaccgccggtcgttcgccatcggccgcccccccgttcctgccgtcgccgcccgccgccgcgtccccccccggtcccttgcccccgccggccgcgcccgggcccccggtgttccggtagatggcgtagaggatgagctgcgcggcgcccaggacgctcccgcacccgttggggatcgtgacgaagaggtcgtggccgagcaagccgtagatgaaccacgacgtgccgcacaggaacaccgccagcgacagcaggaacggcatgtactccacgctcttcgtcttgatcaccatcctcatgatggagaggggcgaggcgtacatgcagatggagaagacggtcatggcg

SEQ ID NO: 13162 - DNA, 847 bp, Triticum aestivum
  Clone ID: PAT_TA_13162
tttttttttttttttttttttttaacttttttcaagagtacgcaaattgcgtaccataactttataaaaggagagaaattagtacataacatctatcactcgctgcgaacaacgagcatagcacgacaccacatccggatatcctcaggacaacaacacacaacaacacaactacaatacggaaaaacctgcccaaaaccgaaacacctcgccgcgtcttgattgacgccgaacacctccaaagaacagcaactccagcttcctttggattcatccgcgacgaccatacatagcgccggaggtgcgcggtcagggccacgacgaacaccggaggagcgccaacaggaaactcagtctcctcgcacgatgctcccaacagagaaacgacgtcgcagacgccgccatcatgccgccccagaggaccaaggctttcgcccggagacaactgccaacaccaagcacgagggagatggcgacacactcgacgtcgcctccagagaggggaacgacacccgcgggtgccatcgacgccggccggccaaaaccggacaggattttcatccgtaatgttgcgcatctccactccgacgaggtgccgggcagcaccgtccctgaagcctcgcaccgccgtcaccgcagcaaatccgccgaagccgcgtagccgtggtccagcaccacccgcactgccgagagagcgcgaaccagacctccaccaacatcaccgacgagaagcgaccacatcctccaagcggagcaaaagccagaaccgccccatcggccttcatcaacaccgagagactgccgccagattggatctagcccgcccctccaacctcacctcgtgccg

SEQ ID NO: 13163 - DNA, 636 bp, Triticum aestivum
  Clone ID: PAT_TA_13163
gctccatgtgtattattgggctggactatacaaaatgtgaaatatggtcttgtctattgtgattcaaagactgggattctaaccactgtgtgggatcaatgatacaattttgggcatccagggcttaatatctcattcatgtgatctcataagtattctcattcctccaacctgcgtacatccaccagctaaatattctgagtctaataagtccttcaaatgaatattgtccttcctgataaggaataacaatctccttgctcctgcttctccggccggcgagcctccctccacggccgaccctgcccgcaggcgccggtcgttgcgcccagacctgacctgtgcttcaccagcctaagtgacgggccgacgacgcgtccttctctacctcgtaccctcccatcagccatagatctgttgtagcccatggaggcattggggcaacgatggggaagaggggggaaggcgacgacgggcacacacatgcaagggagaaggagggggaggattcctggcttcgtgttgtggcagccgacgagggagagagggggagaccgaggagggagggggtgcggcatgcgggcgaggggattgggcgacgggatttcgcaaaggaaaacagaagaggagcagcgc

SEQ ID NO: 13164 - DNA, 361 bp, Triticum aestivum
  Clone ID: PAT_TA_13164
gagtggagaccacagcggtgtgcgatttccctcgtaaattcatcgcccttttcgcccggaggctggctcgctgtgtctgcggtctgtctgacccaccgacctaccaccaccggcccagccacaccaccgtctttaaccgctcccagcccatccttcgtatccgcccgaggagggatgcatcgctcagatgcaagccccaaaggctgggtcgtggttgcacgacgagtcggatcggagcaaacgaggggctaaggctgtgctcggtttggctgctgcaggtgcccagctcagcgaagccagagagcgtgcgatgccgtgctcgtgctgtgctgtagcgtcccgcgacgaagagcttcgccct

SEQ ID NO: 13165 - DNA, 592 bp, Triticum aestivum
  unsure (1)..(592): unsure at all n locations
  Clone ID: PAT_TA_13165
agctttttctattcgtagacatatgcacacgtacaagaaataaaatggaagcactaatggcaaggctcttctcgcaaaaacgcaaaagaaacagcagaaagaaaaagcctacacctcttgcctctaaacccccttaaggcggccaccngaagacaactttccaatgcaaagaaacgccgtgctagtgctggtgctcgatcttgtcaaaagcacacgcaagttcgcctcttacgatgcaagcgcttcaaagcgctggataatgtaaccgccattgtttgccccagcccaaatgtgccagtgctgtacgaagggtgccgcacactttccgccgctcgtttgtaattgtaggcgaaaagttacagccactctcattgaagcctcgctcgacatgaaaacagctcacttcgctctcgctcagcattggcatccgccttcgctttcgggctttggctggttgacattgacgtcgattgtctggttcgccgcctgctggccctcgccctccatcccaggcaaagcctgcgcgatcctcttaaacagcaccttcacattatgcccgaccttcgcactgtctcgacgaacaaacaaccca

SEQ ID NO: 13166 - DNA, 1226 bp, Triticum aestivum
  Clone ID: PAT_TA_13166
gaattcggcacgaggaaaccctctccaggttcccgcgaagtgggctcccccctctcccctctcccgccgcgcccccccaaaatccgatcggcggtcacccagccggcggcgcccaatccgagcggccaggggtcgattcgagccagccccgcgaggaatccgagggatttgaggcggattccctccggggtaggaaggatgatgatggggttcatggggaagaggaaggagctggagcaggtggtcgacggcctctgcgacttctccctctccggtcccgccgccaagtgccgccggctggaccctggtctcccacctattttggaagaagaaccaccgtgtccttccatcccatatcaacatcagatgctgggagaggaaatcaacagtggtgttaacatgcccattgtggaagatatgatagaaggtgccatgccatctcatctgtctagcgaggacaaggcacttgttatatacaagccagtaaacaagcctaccctctttggtctcagtatcgcgaacccttcaatcatagtcagttcagacttgatacgtggattaaagaatcaacctttcaatcaggggaactgtcatgggctggaggacaattctcctgagcgcagcaattgcttggccttagttccttggacgccacagcggattgccatgacatctgattggtcagctgccccacctgaaagcacacataatgttgaagagccaatggacgctgatgagacagaagttatttctatggactttgaggaagcgcctcaagcaactccgaggggaatcgacgtggataacattcaccagtggcaccagcactgcatggacccgccatcgctgccgaacccgtcagcgccagtcatgtggtcgtggtgacaaatctggagatgtcggcccccttaaccgcaggttacttacacacgaaggatgaagaaattcctatagctggcctccaccggaagtgtgtgtctacttttgatggattgagaaatgattgctatgtgcataatagcccctctttagcgtagtgctgatcttcatcagtaacgtcaatagacttctgtgttagaaacgtcccttttacagctacatgactacatcgttggacttgtgtgttagaaacagccctgttaccggcttactgttggcgccccccagttcaatttgatctggtattgttggtgcaacatgttagtgccctttgcagctattcttgc

SEQ ID NO: 13167 - DNA, 500 bp, Triticum aestivum
  Clone ID: PAT_TA_13167
ttttttttttttttttgccaaggtaaatcctgtttataaatatgattactgaaaatgccacacctgcattagcagatcactaccactctgttacactgttgactgttttatctcatttaaacatgctgttgggtccctgaacttgcctgtagagtttgatgggcaagtcttgattctaaatttaatcgcatatgctatcctgcagtttgataagagacgcaatgtgcagaaaatccaccgacatagtcggtgcaattatttgttacatcatatactaggatgaattctgaccgaggacagttccttggtcgaggcatgtgaaaatcggcacgcaatcttgcctgtaccgtgagctaagatatgggtaccgatcaatttgggacagggagagtctgatggtgacccacctccgttgatactggactgctcaggttgcatttgtagtccaattgggacccctgtgcatgcaaggtgatcagcttgttcaccaacttaaggag

SEQ ID NO: 13168 - DNA, 554 bp, Triticum aestivum
  unsure (1)..(554): unsure at all n locations
  Clone ID: PAT_TA_13168
ttttttttttttttttttataaaatattgatagtcgaataattttcctcttaaaagggtacatgactcacgacagggagcagcggctactgggcggccttggcctttttctgtttgtcctatagtttatatcgatccaatatatcataggtaccttattattatggataatgatgtctcgccattaacatgaagttctcgaaatcaaatgatacatttgaacaagcaacanaacancggagactgangnanacatacatcaaaaagttatacattattatttcctccatcanttaagcaagatgagntgcgctagaccatgtcattcttcttcttgttgagtganctcttgaatgataggggcggaggaggcctccatcctcattgggttttggnacaaataaatcagnanccaacactcatgaagggcctccaatggcatgatcatngggaggngatccccaaccatctttcaacantnagtttcccccaanngnaacgaaatgctttcacaaatttgcctctggggaccnaggtcatngatgggggcaattc

SEQ ID NO: 13169 - DNA, 1022 bp, Triticum aestivum
  unsure (1)..(1022): unsure at all n locations
  Clone ID: PAT_TA_13169
gtttggttcgttggagggcccctgctgtgttgcttgtctccgagccaagaacgaagccttactgatttggtgacaactagcaacagtcacgttcgttctacctcagcaagaacaggcaacgatgtaactgatagtaggtctatacagcagatagagaaagaaaagaaaatgagatgtacaagttgagttctgctgggtggctcagactacaacgaacaaatgggtgtctctgtgtctaattcctaagtgtgtgttgtattcagtcaaagatgtaacagcaactctctacaacgtcttcagatcattgcagcgcaagccccatttcgactccgggtccaagcatgcgtctggttggtgcttcctctcccgccgcgcccgccgttggggttccgccgcttgtctccgggctcgagcggctgcatgccgcctcggcgcccgttcccccactcctccccccccacgccccggcggctggtggtcggatgccccgatccaaaatgaagagtgccctctgttcacctgttggatttctcaaccaccgacagaacatccatgctgccccagcgacggatgagacagacaggatcgccaggaagccgaaatgagagacgtcatttgcaattatagccatcgcaagcatgactaactctgcaaggcttgcaattgaaacctccattcctccaataaggtttgcttttgaagcaggaactcctgtttggatgatctgtgtccccacaacatcntaagacatgtgccccaaccgagntaatgcaatggaagcaaggaagatgngcagaggtgttctctgtgagatgggtccagcccaatacactgtgagagcnactgacaagagtgaggcttgaaatntnaatccagctgctcccgcctttagaattccaactcttttcaccaggcttgaggagatgaatgttgcaacaagacccatnacagaatacaatccactgaaagcaccgacgatagatggactaataccccgatgcatcaacaatgcagtcattatt

SEQ ID NO: 13170 - DNA, 493 bp, Triticum aestivum
  Clone ID: PAT_TA_13170
ttttttgattttgatagagcataccaatatatcgtaatatatatgtatgtacctttctaggtttacatggccagagagattgttgaacattgggacaagtaaaaaaagagatagcttattcaagccaggtaacaggattgcatttagatgaatgcatgcctttggaaggaggattgatcaactacgggcacttgagcttgccggtctttgagtcgaccaagttggcgtagcaggggcattcactacgggtctcctggccggtgccggaagggacgcagttacacttgtcgcaacaaatattgcagtctttgttacatatcttgttcctccagttctgcgagcaacgagcattgcaggctgacgggcaatctatcttcggtgccggctgagcatccgcaaccatgaggagggcggtgaggaggagagtggcgagtatgatgacatgcttggggaaccccaggatgcagctcaagagagcaattacgtatgacct

SEQ ID NO: 13171 - DNA, 937 bp, Triticum aestivum
  Clone ID: PAT_TA_13171
aggaagcacccgactaaaccctagccgccgtccgtccccaaccttcaccgccgctccccctcaaccctccgccccccaaaccccgccgccgcctccgccatgcggccgctcgacgagaaggagaccacgatggtcttcgagaagctcttcaagttcaccggccccaacctgaagcacctcctggagcggccctccgtggagggccccgacccggagcccggccgctactgcctccgcctccacaagaaccgcgtcttctacgcctccgagtcgctcgtccgccgcgccaccgccgtgtcccgcacgcgcctcgccggggtcggcacgcccatcggcaagttcacccacggcggcgccttccacctcaccgtccacgcgctcgacctcctcgccgcccacgcgcgccgccgcatctggctcaagcccgacacggagcgctcgttcctcttcggcaactccgtgcccaagtccgcgctcgcgcgcatcaccgagaacaccaagtccggcgatggcgtcgtcgtcatgtccatggccgacgtgccgctcgggttcggggtcgccgccaggggcgcgcaggactgcaggaaggccgataccaacgccgtggtggtgctccaccagtccgacgctggcgagtacctccgcaaggaggaggagctcatgtgaggtgatgtgtgactgtggtgctgaaagatgtgttccctccatggttgcgatcaccgatcatctgtgcttgcaatcagtgtgcagttcgtcggccattctgtattctgcagtttttatacagggcaaggacaagcggatgtccgatcgtagcggagtagttctgatggctataaattttgtcacgctgtagcttatcagtaagctactgcattgtatcgtgtgaactgtgaactaaagattatgataatgatattttcccgcttggagccct

SEQ ID NO: 13172 - DNA, 612 bp, Triticum aestivum
  Clone ID: PAT_TA_13172
tttttttttttttttttttttgcaccgacagcatccatctccgccactatcaccacaaaacacccgcaaagaacagcctacacactacaaggcagaaatgaccggcgatcgtatacacaggccctcatcctgcgaacgtgtccagtgcatacccaggtttttaccattcaatgtcttctagacttagcacaggggacctcaccagacatccgtttacggacttgccatcaaagtgtgattacctctggtaacacctatactgctgcaatgcttccttgaaaagcacaagccagctctgctctgcatggacgatccacgattgaccctccgcctaactttcctcataaccattgatgttattgaggggttcgattaagccagaatccttgcaaattggggccatttcatcatactcccacttcattttctccaggagctgtgcattgcggctagcggtccggtccatcacaaggtggtaccatccaatggcctcggtccttcgctctggggtcctcgccggatatccgttttgactcgggccctctctgtgtgctcccccccggccacgcctttcctgctccttgccggccctccttcaggttcagcaatcac

SEQ ID NO: 13173 - DNA, 753 bp, Triticum aestivum
  Clone ID: PAT_TA_13173
gattcggacgagttttttcgaccgaaaccaaatttattttcaagcaactattgaataggcgatcccatatttctgaccaataaagctgtatttggatcattggactgatacagaaatgtttataagaaatcgctttccctcattactgtatatgatatataaatgattaaaactggaagaagataagagccatgtattcagctcggatcttttggtgatcatccatgagaatgcagcatcagctcggcaattccggaggcaatgacggacaagaagtcagcgttatggttctcctgatctatggggttcctcttggcgtctccctctatcaagatgaggtcgcaccaagcaggagcgtttgcctttgccacttccaaaagcttcacggaagcgtcggcggcgcgcccgcctcggatgtcgtcgagcgcatgccgcaccatgccgttaatctctctgtagtcggtgagacaacggcccagattatcgacgaggtccgcgatgatgtgctcggtggatgttaggttggcgacagtaaggcttgccgcggccgccgctagcccgcgggcgtccgtggcagacgaggacgccgtgtcggctgaaagcgcgcggacgcagaattcgtagtcgacgtgcactgtgacattggggctgtgagcgagcgcagcgcatgtggtgttgatgatgggtgtagggctgatggccacggagaggccatgggcggcggcgaggagtaagagaaggagggcgatctgc

SEQ ID NO: 13174 - DNA, 699 bp, Triticum aestivum
  unsure (1)..(699): unsure at all n locations
  Clone ID: PAT_TA_13174
gaatttgatcagcattttcttgagcgccattttcttcagcattttcttcaggtgcattagctcgacgttcttcacgttctggaatgaattcttcagcagattcttcggtaggaatgacatcctcagtagccttgaacttgatagtttcctcaggtgctggttcatctatcacagaaggtaggtgctttctttgcgagccattagtttcatcgaatcgcacatctacagtttcaacaaccttgtgaagaacgttgttgaagactctgtaggtgtgcgagtcctttccgtaaccaagcataaaaccttcatgtgctttcagtgcaaattttgagttgtgatgaggatctctaatccagcatttagcactgaagactttgaaataactcacattgggtttcttgtcagtgaggagttcataggcaactttttgaagaattgtgaagatatactctgttgatgatgtgggcatgcagtatcaattgcctcaatccaagaaacgacgaggattttgtattcatccaagcataatgcggancatctccagcaagancatgtccttgcgctcccacgaaccgtctccctggaggagtgttaagtagcaaataanccatgagtatcccaagtcaatcaagatanccatcgaaacagattctttgacccaatgcatggcacttccgangtgcttgatcttcacaccaa

SEQ ID NO: 13175 - DNA, 502 bp, Triticum aestivum
  Clone ID: PAT_TA_13175
gtagtaacccgaatgctgaaatgagcccaagaataaatgggccctgcgaaggttgaaagataacatgggctggaaatggcccaatggaataatgggccgctaatgggtataaagcgatacactgttcattacgggccagtttcaccacaggccgttaatgggtgtaaagtaatacactgttcattacgggccagtttcagcacgggccgctaatgggccaagagttacaaagggcctcatatgggccgaaagacgtcatgggccatacatgggccagaagtgaaaatgggctggaatcatattggatggcctagatgacgctactgggcctaattcggatagggcgtaacgggccttgggttagcgggttgtaaatgggctatatgcgaacaggccgttaacaggctttccatgggccggcccgccaacttttgaccaagtcaaacgggccggccttttcacaggaatgggcctctattgggccgtgccacgtgtggacccg

SEQ ID NO: 13176 - DNA, 1009 bp, Triticum aestivum
  Clone ID: PAT_TA_13176
gggcacgaggtcatgatagcctagcgtaagttgcttgctaatttatttccttattgtcttgtttatttgttttcttgtagtcagtgccggtcgtgtcccgcggcctcctaccggccacaggaaccctgggccatctacctgctgtaggtaccctgggccccctacgggccgtagaaacagtgggccttctacgggctctagaaacaatgggccttctacgggccgtagacacaatgggccttctacaggccgtatcatcaatgggccttctacgggccgtttgaccggtgggccacctatgggtcaaagccgtgccttattccggaccgtaaacgggctagagttggaatcgtccctttaatgggccgaccataacgggccgtcggtaattgccagtatttggtgatgctatgaaattggcccaacgtattaacggtccacaaacgggccgactgtaatcacggggtgagtttggcctacaagcacgaaaatgtcattaaccggccgtaaagtaaccgaatgctggaaaacgagcccaaagattaaatacgccctgagaaaccagaaagatagcatggtgctgcaattggcccagcggactaaggggccgttaatgggtataatgggattcaccggacttgcacttcctttgcaacgccaggatgagcaggttgtcgtcgaggaatttgatccacattttcttcaggaccattttgcccatcagcactttattcaagtgcactagcccgacattgttcatgatctggaatgaattctttaacagattctccagtggaattggcgtcggctgtaatcgcattgccaagaggccttacagggttcgtgttcggatagggtgtaacgggccttgggttagcgggctgtaaatgggctatatacgaacaggtcgttaacaggctttccatgggccggcccgccaccttttgaccaagtcaaacaggccggccttttcacaggaatgggcctctgttgggtcgtgccacgtgtc

SEQ ID NO: 13177 - DNA, 2073 bp, Triticum aestivum
  Clone ID: PAT_TA_13177
gcgtcctcgcgccccaggcggccgctttggcggggccgcaccccggcgcacaagcatgggctgaggcccttagccaggcaacccgggagtgtatttggcgtgactcttcggctccttctggaactgttcctatttaccaagcacttgagaaagttaacggtattgctgaagatctgagctgggaagtcttcagggacactttaattgaacaagccgagcagggtgttgattacttcaccatccacgctggtgtgctgcttcgttatattcctctcacagcaaagagaatgaccggcatagtttctcgtggtggatcaatccatgcaaaatggtgcttgacgtatcacaaggagaactttgcttatgagcactgggatgacattcttgacatatgtaaccagtatgatgtggcattatctattggtgatggcctgaggcctggttccatttatgatgctaatgatagtgctcagtttgcagaactgctgactcagggggaactaactcgccgagcatgggagaacgatgtgcaggtgatgaatgaaggtcctgggcatattccgatgcataagattcctgaaaatatggagaaacagctggagtggtgcaacgaagcacctttctatacgctgggtccattgaccactgatattgcacctggttatgatcacatcacctcagccattggtgctgccaacattggggctcttggcactgcacttctttgttatgtaacaccaaaggagcaccttgggttgcctaacagggatgatgttaagacaggtgtgatatcctacaaaatcgctgctcatgctgctgatttggcaaagcgtcacccctatgcacaagcatgggatgatgcactaagcaaggcaaggtttgagtttagatggttggaccaatttgctttatccctggatccagttactgcaatgtctttccatgatgaaacactgccgtctgatggcgccaaagtagcacatttctgctcaatgtgtggtcccaagttttgctcgatgaaaatcaccgaggatattagaaagtatgctgatgaacatggttacgggacagtagaggaagcggtgagacaaggaatgagtgagatgagtgctgaatttttggctgcaagaaaaacaattagtggcgaacaacatggtgaagctggaggggaaatctatgtgccagaaagctacgtagttcagaaataagatgtccttggcagccgtctgatccaagtgatgcagatttggtggctaggtcgtttgtcagcagcacttctaccatcttctgttaggaggtggtaagcaggatatatgcctcaataaagctactgctgcttagcgtcagttcttaatgtcattatggattatgggttgtaataaaagtgaactctatgttgtgttacttatgttataattgtctttgcatatcattatgggattgctagtgatgaaagttgcaccaggggtgcttgtattcccaacgatcttaaggccccttggcctggattgttgcgatatgggctgagaaagtccctttgaacctgaacaggataatgcctgcgaagggagtgtgcatttttattttcatgtttcccaggatacactcaaccctcgacattctggaaatcgagggaccaagttttcctgaatgtgtggagcgcacctactggatatgcatgtttcctactctgacgcaacatggtaatgtacacgatttctttaaccagcatacatattggcatttctccaagaggagaggatatttacaggcatagtgttatcatggaacacatcaaatttagtcatcatggaacacataaaatttacccatcacagcttttttttgaggaatcccattacatcttgcaaagcattgacaatgtcctgtgtaatttactttttacacctaatcatgtacatatttctatagtagaagtataaaagatgcaactagactgactgattggaatggttatgtacatgccacttgtcagttgagaacaaaatcaacggcagaactctttccgacttgattatgtaaaatgtgtctactaagaattattttgtagag

SEQ ID NO: 13178 - DNA, 896 bp, Triticum aestivum
  Clone ID: PAT_TA_13178
tttttttttttttttttttagccacatcaataacttcattaacattcaatcatagctacaccaggcaaaatgagaacaaaaatgctacaaaaaaactgtatctagctttagctacaatgttttcactttatggctttacaatgccgtgaagcttccatcccccaaggccagcctgcgaaaaagcctcaatccatgatttcccagcagcttctagcaatgcagcattacacgtcttgagcaccactgaatcaccagaaaacatagaggctgcttcttcccatcctttattatgtcccatgcacatcacccgttagtatctcatcagttgaatattcacaaattgccttttgcaagtgctcggcagtttgaccatccattgcagcaatcgagtagaaacttgggatgaaatgcacaagtgcttgagacaatccttgaacatgctcttgcatgatctgaagagtttcctttgtacgagttgcatcactgcataggataagctcaggtatccatcccatttgatggaatttatcagaaacgcttattgcatcagctcttccagctttgctcagtggcctgtcatgatctctgggtgaagcgctccccaaccgcgctgtccccgtggcggaggaggatgaggcggcgtcgcggcgtggcggaggagcccggctcggcggcggcggccggggcgtcgacgacggtggtggagacggagacggagcgggcgacggcggccgcggagggagggaggcggcagaccgcggaggaggcgtagaggaggaggtgaggagccgtggcggaggaaggaggcgacagtagccgaggaggagctctcatcatccgccgctgttgccgctgagctgagctgattttgttacatgggatggagaagggagaac

SEQ ID NO: 13179 - DNA, 698 bp, Triticum aestivum
  Clone ID: PAT_TA_13179
ttttttttttttttgccggagtgacaaagcttagtgaacttcaaagatgtttattcctttcttttatgcaatgcactgcaacacacatctagagaattgcaaacaatattaaaaaagaaaggctctatagtccacggactcacacgcgaattacaccgagcacaaagttaactgcaaggatactcttcaaaagcaaaaaaacaaaactactgggggaaaacaacacttggtcatgggacggaggcaacctgtggtcaggggaagcatcaatgatacacccgcgacggcgtcaacaaccctccttgccgcaccgccatcagctgctttgctcccatacctaagcgccgcgacacatgcaagcgagctcaaacactggcgtggttgaatgttcgtcggtggggagaagaagtaggggagtcccgtgcaccggcaccagcactgaaccgcatcacgcatgccgccgagctgcacggcgacggtcgccggacggagatgagagatggaggctgcctggtttcctcctcagccccggcggataggtgcgcgacggggcaccggtggtggtgcagatccgggtggtgatggcctgagacgaggacgacgacgatgtggccgggccaggctgcatcctcgcgtggcccgatagccgacaaggacggtgacgcagaggcgcaggaggaagggaggacggagacgcg

SEQ ID NO: 13180 - DNA, 562 bp, Triticum aestivum
  Clone ID: PAT_TA_13180
tttttttttcggttgtatcacacatttattccacatatccgatataattaagacaagcacaaagcacaaactggacacacatatgtatatcgatcgatggttgtctcatctctcgagcatagtctctggaccaatcgatcgagtagtagtaggtagcatatgaaccgggtaactgactgtgccatggcacatcttgaagctccagctccatgcacgcatgcagcttaattgtaggccaggtagctggatgcatggatggacggatcgagcattcaggcttggaaggtgttcctggagcagggcacgtagaccctggcccagaggtgcctgcccttgatgatgaacttggccgtcggctcgcccccgagcagcgccgggatcatgtccgcgctctgcagcaccaccctcccgtacaccggcatctgccccggcgccgccctctccaccatcacgtcctccacgcacgggcgcccgtgcagcgagttgaagaactccctgatgtcgtccttgtcgatggggtagccgcgggagaaggtgatgaagagcgagcggaactcctctg

SEQ ID NO: 13181 - DNA, 884 bp, Triticum aestivum
  Clone ID: PAT_TA_13181
tttttttttttttttttttatgtcaccttggtcgataagtaataagttaccaaacatgacaacagcttttcatcaacctttgatgtacaatggacgtgcgtgcacaatcgcgttggttgtgttctcggcgggtgagaagaatatggccggccctggcgaacggacacctcggccgcccgttcggacgaaccccgcgctagcagcgtccgtgaccggggcctccgcccctgcgctggctcgtcgtcccgctcggcgcgtttccgtgccgctggatgcctcgcgggagtgcgtggcaggccccgccggtgacgccgacaagcacgagcacgcacaaccgcagagacccaccgagagcacgcgcgcgtcaccggccctcgccgcgcggcttcggggagaggatccagtgctggccgtggggccggacggtgagccccttcaccctggcgaacagcgtcacggcgcgccggacgccgcggtcgtcggcggccgtgaagtagtcgtggccgaacatgacgccgccggggcgcagcacggcccaggccaggttgatgtccgcccacgccgagtggaagtcgtggcccgcgtccacctcgatgtggtccgcgtacacgccccaccggcacagcgccccgagcgtggacgccgtggagaagggcagcggcagcaccgccgccgcggcctcgggccccgccgccagcacgttggccatgaactgcggcagcagcagcgcgtcgccgtgccgctgctgcgggacgtcgcggcggaagcggccgcggaaggccggccagccgcggaagtcgtccacgcagaggatggccggggacagcgacaggttccgggccacggccgccatgtggagcgccgaggcgcccaggaaggcgcca

SEQ ID NO: 13182 - DNA, 733 bp, Triticum aestivum
  Clone ID: PAT_TA_13182
ctcacgcgccccgccacgccacccctcgccgcgcccgctatgtctcacccccctccacgccgccgccgggaggaaccctagccccctcgcccgctcgcccgctcccccctcgctttcgcccactctcgctccccccttctctctcctcacgcgccccgccacgccaccgctcgccgcggccactatttatcgcccccctccccgccgctgccgagaggaaccctagcccgctcgcccgaattcccgcccccgcatgaggcggaccgctcgccgccgccgccgcttcaccccctccgcgaccctcggctgcttgctcggtttggcccggtagggttgttgctgttgcttgggctggttggtgcgccgggccgccgcggcggatggggaactgctggggcacgcggatcaaggatgggagcacccacccgggcgcctcaagaatgttctcaaggggtagtggtaaagatgggagtaggcttagtgcctgcagcagtcgagctaggtcagcttccatgcctccaagtgcaaagactgaatgtgagatcttgcaatcagccaatgttgaaaagtcccaacctaatgatctcaggtgggccacaagaaacgttggtcctgacagtatgctcggcgaaggagggtttggatctgtctacaaaggatggattgatgagcatacattgtcagcttgcaaacctggtactggaatacctgttgctgtgaaaagactcaacct

SEQ ID NO: 13183 - DNA, 890 bp, Triticum aestivum
  Clone ID: PAT_TA_13183
ttttttttttttttttttaaagaacaaaaaagaacaccgtaaaaattactagtaggagtacgtacgtactacatttagttgcagaggatgcatgaagcactccaactaatcaaaagaagaagaatcataagaagaagaaaaggtgtccggtccgcctctaaacattacgaactatggcgtcgtagttttagttgatgcaacaggatatgggacgcaaaacaagtgcaacgaacaccgttggaggtgatccgatccgcctctagcgagcttagctagtagaggttgatggaggagacggcgatgtaaagctcatcgtcctccatggccagcgcgccttgcattgccggccaccactccggcatgttgctgctgctgctgctggcagcggcgtccacggcacccacgacaacgttggcttcgctcatcatcgaggacacctccgccgccgtgaactccggctgatctgcgactgcatcatcgtcgacgttgcgggcgaagcggcccttcaccctcggccggctgtccgcgagcgtcttccggcaagcgtatgtgatcttcttttggaagttgcgctggttgcgcttgctcctgtacttctcgatgcgctcccgccgttcgtccgtcctgcacctcccagccgctgctgctgccggcggcggcgccccgaggtctcccgcgctcagcacatggcggaacggcggcgcctgaccctgctgctgctgggagtagttgtagtagcagtgctgctctgcttgcaacagatcaccgtagctcgacgccgacggttgggaggggaggaagccattgcttccctgacaagtataggaagaagaagaaaaagaggagtgatgatgatacatcacctagtgcgcacgcgtgtgtatgtgtgt

SEQ ID NO: 13184 - DNA, 703 bp, Triticum aestivum
  Clone ID: PAT_TA_13184
ttttttttttttttttttgataaaatttgatttgattgatttataatacatgacgtacacataggttgccacacatatgcgtataatcatggcgttccccatcataacccgatcaaacacagcacgatcgtcgcattcatgcacccaggaacagaaagcaccacacggagaccagacacaacgcacggcgcaccagcggtaccacagcttgggtgccactcgacgcgggcggcgcgggcggcgcgggcgccgctgcggcagctcggtccaccgaccgcggcgacaccgacactgtagcccgcacgtcgacccgcagcttcagcccgcccttgcacttggcggggtctgcgctgaggaaatacctcgtgccttcgtcgtcgaggcctaccctaaccctgctgagcccgtccgtgtacgttctgatgggggtgccgccggcctcgcacggctcgaactccgcctcgccggcgacctccgccgcctcatacgcaaaccagagtgtgtccccgaccgtgaagagcctgcccgccgaccaggcaaggacgtcggaggccacggcccagcccgggtcgcctccgacgacgtggtggacggcagcagcgggtgcggtcctgcgacgtgttgatgcatggcagcggccagaaacaaaatgccggcggcggccgcccggtggctcgaagcggagacgaaagacatgatgtgt

SEQ ID NO: 13185 - DNA, 1286 bp, Triticum aestivum
  unsure (1)..(1286): unsure at all n locations
  Clone ID: PAT_TA_13185
ttttttttttttnccccnaattcggtgtttttgtgtttttcctttttgccccttgaactaccaagttagcggctgcacaagctaggttaacgcgtagattttcgattcctgtatgtacacattttgaacgatcagaccatagaccagccctttttaagtcttggggtcgcaatcagctatgtttgcggcaacttctctatatttcagctcagaaggggacaccgcttttatctctagccgctgctgaggggatggtaatgtgcgagctttagcttcgaagggatcctccgcagaatgtacaggacaagagccgaaggaacgatttcaacaaggaggtaatatatgaaattcagaattggatggtcaagaacatccagatcagcatctttattgaaggcagcgaaacacatcattacgcatcttgccaagaagcaacaggaacaaatagcggccactctgccaacctcgctcagcttttgttgcctccctttagactcgatagggaaacgcttcaacatgaggaatagcctccctccgtacagcagaaaacccagggcagcggaaaatgacagtcccgcaatgaataactttgaaagcacaagcatagatgaatttggattcaaccacaacaatacccacaccaaaacctgcatcgcataaacgacaccgttaatagtatagaaacctgatctgaggccatcagtgtctagaccacgtgcttgataagatatttcagcccagaaaagtgccaacattgcataggtagtgaagaatgcaagccccggcagatcaagaataacatgctgaaagatctgagggttcactagttgcacttggcgacggaaagcaaagatggaacaccttgctccattaaccaagaaattaaggaactggaagaccttttgtgttgtccatccatattcaggcactctgtgctgtattctggcaacttggatgaaggaggaggcggcgctgaggccgtagagtgcggcgagggcccagaagatcccgtcctgccacgccggcgagccgttcacgtgctcccaccaccccgcgaaggccgccggcaagggcaccggcgccagagccggtgccagcgccgccgccgccatcgccgccaggctgcacggagatccctggaaaagagagacagacggccttcctctccggtagtagaatcaaaaaaattgggtggcttggggaatctggtggtgccgctggcggcgacgtggatttgtaggggcggctcgcgtcacttcgtagctcggacgggagggggaacacag

SEQ ID NO: 13186 - DNA, 878 bp, Triticum aestivum
  unsure (1)..(878): unsure at all n locations
  Clone ID: PAT_TA_13186
tttttttttttttttttttttttagtaacaactccaatttattgagaattaaattttgtaataatgttacaagggtattctagcaacaagtaaatgccagaagggaccaccattcagtcctgcgtccggggtccccggtttccttcgggcacggtcccggccccagggccccgtctggcggattcccttctatagtagttgtaccaaccaactggaagcaatatgcttcatgccaggatgcaatttttttgcttaagaatgatgtacagatggcttcctagtcctagcaacaattacatgccagaaggacatatctttaggatgatgtatcaataatacaaccatccatggagacatgcttcagatctataattgaattacttccagtgaatccgaacccaaaggttccatcttcataaagccaaatcctcccctctacattcctggtatcatcaaagggagctaacagatgaggatgaaccaggtcaaaacttgaattgatgcacagtatccgagagactgccttgttccaagtctctgtatggccacaagtaacaactccaatatgctcaaggcaactataacgatccagctcccgttcagagaatggtggttcaagaaatgtagcatctgtagtccagaagacaggggagtagcctgagttttgccccctattctcactaactcgtcgacaagtcactccaccaatgtcgtcatagctgataatgtaaaattccagagtcttattctcgcatacacccttccacaggccctgcagcggccgcgctttggtcggctcagcatctggaatcctcacaaagtgttcaggctccattcgaccacctttcctccttccatgcctctcccgccttctccnn

SEQ ID NO: 13187 - DNA, 661 bp, Triticum aestivum
  Clone ID: PAT_TA_13187
tttttttttttttttttcatcctattgcgccatatttatattggtgccgatcaagcaatatatcaatgccatggaatcaaggatagcgtctcatgttcttcaagcttagaacgaacaaactttaacattaatgtttcaaaattaaacaacacaatgaaactaaacaacacgacaatgcatacataagaaaacatagttccatgagcagaaaagtatttcatccatcgctcaaggaagttcgaatgtgctagaccatggtgttcttcttcttgttgacgacttccttaattacggactcgagatcctgaaccttgataggcttgggcacaaaaatatcagcaccagcacttatgaacacctccatggcatcgtcatcagctgacatcccaacaatcttcacatcactttcccccatagcacggatctttacaactgcctcaggaccagtcatgatgggcatgtccttatcgcaaaaaataatgtcaaacttcttccccttgaggaataggtccactgcttcttttccattcgcggcgagagtaatctcacattgataattgcgtaacttctgcgagaggaccatccattgaactgtgttgtcctcaacaactagtaccttcatagagtaggatccttgggccttggatgccatgatcagaat

SEQ ID NO: 13188 - DNA, 974 bp, Triticum aestivum
  unsure (1)..(974): unsure at all n locations
  Clone ID: PAT_TA_13188
gggggaattggtccngggcccccccttttttttttttttttgggtgttgttcccacatgcacgcacgatccatgccctcccatcccttttttcttgtcgtgactactagtttcccattggtcgttgggcctggaccgcttccctatgtcatctgcagcagaatcccacttggaaattgcagaattaatttcccccggactacaacacaccaagaaaaggggtgttctaactttgcacaacccaaagaaatcatgatcgaacgtttcggatccagcctagcttgcctgcgaagttctttttacagcggggagctccacggagctgaggtctgcggggtacggagtccacagccctaaccctcccctgctctccttcagtcccttcttcaaaatctcgtcgatcgtcttggcccactccaccttcgacgagtgctccctcgtgtgtctgtgcaggatgaacagggaattgtactcgcagttggggaacatgaagaacttgagagcgtctccgagccgatgggccacgtagccgaagctgagctggtcacgaggagtgaagaggttgacttcgttgaaccagaggcagctgaacagatccgttatcgtcgtgtgctccctgatcagcactgctccttctggtatgtcactaggcatccttttcttttcgtcccaaggctccatcccctcgtggtagtatatcttcatctgaagatcaaccaaaggccgagcatatcgcttcctccgtttgattgcatcaccctcttcatatatgcttctatgatgcttatggacagctactgcaaatgtgtattttccccgccagagatatctttcaagaataagcagcggatcaaccataagctccattttcccatcaatccaaatgctataccaggcttgaggaaatagcctatgcgtcaatatctttggtacttttccattccttctaggttcatcaaatggagggcggtgcaa

SEQ ID NO: 13189 - DNA, 1088 bp, Triticum aestivum
  unsure (1)..(1088): unsure at all n locations
  Clone ID: PAT_TA_13189
tttttttttttttttttttttagcaacacactatattattttgcacacaacaaaatttacatgagtactgctgatcccagtttacaagatagtacaaaagcaggtccatgtcgcaaaatcaaactactcaaccaagactgtagaagaatcagcgtcaccaaagacagcagtggcatgattgcgttttgctgggctacaaggaaaagaacgagcatattcttccccacaactttgaaaataaaatgttgacacagaattaatgtcagaattaatccccattgttagtagcatcctcctacgatgtcagcactgcccagtacaaaaccacccagctgactcaacttaccaggtcatgcaaccccatctttgtgttacctgtagatcattctatgaaaaggataagttgtgcaggagaactcttagcacacattggatgaatataaaattacatgtttattgtcagaaaaaaaaagaggtaattaagctagaaaaacgtgtaagtgcagcatgcatggattagacggattatatcagagttcaaagaccaaaaggcatcccaaangaaagcttaaccattaaactatgctcaaacgtaacaaagaaatataaaggaaagccaatgaacaaactaaagtattaataatcaatgtggctgttccctgcctaagaatttgacaatgaaattaacagtttcaatcaatctaaaagccaacaaatgatgaaacttcatgactgattatagcgattctggctcaaaatagagtaactcacgctaccaaacttactcatgaattgaagattactaaactgtatcttctagtttgatagttactcaaacaagaaatctgaagctttcactaatcctcgaagtccatgagcattttgtatatgaaatcatcaacatttcagacttcatattctgtatgtgaaagtcgctgccgcttcttctcggacccatcaaagtttcgtggagtgtgatgacaagcattttgcgtctgtacctgagctccatctagtacacaaagagcggaaaaccattagatacatgagcactggctactcaatagatatgataacagtgacagcat

SEQ ID NO: 13190 - DNA, 627 bp, Triticum aestivum
  Clone ID: PAT_TA_13190
ttttttttttttttttccaagcaaagaattaacttggcattgattcatgtatagtccatgcaaaacatgtcattgcatttgcatacactgggaaactaggaagcaaaatgtttacagtaaaaattaaaaaaaaatgtttacagtagaagtcaatgaaactgagctatcttttcgcttcgacacacaaacagcgctgcatgaatgcatgggcgctcgcttacaccaaacgaaacaatgtcacacgcacttgaagccgtcggggatgtccgtcttgcaggcgctggcgaggagctcgacgccgacggaccactcggcggagacgaggccgagcacgccctccttggcggcgacgcagaggcacgcggccgcctccgccgcggcgagcccgcccacgagctggcagcactcgctcccgagctgcgcgccggcctgcgcgtcagcgaggccgagcaccgccgcgcacgcgtcgaacttgacggcctcccacgggcagaacgggtcggccgggacgcccttggtccacagcaccctacgtggtgcgccgccggccgtgggtaacgcggcggaggagagcgtcgccgcggcgaggaggagcgcgaggaccgacggggtggtgccgaggcgggc

SEQ ID NO: 13191 - DNA, 1040 bp, Triticum aestivum
  unsure (1)..(1040): unsure at all n locations
  Clone ID: PAT_TA_13191
tttttttttttttttttttttccaaagaattatgtgatattggggagagaacatgtgtaaatagctgattacaaacagtctaacctaaaacttgcatctaacttgctcaccatggttggcatatgcactgatcatggcgctccatgacacaacaccaggctcgcgcaaaccttcaaaagcctgtcttgcgtaaacaatctcgccacattttgcgtacatatccacaagaacattgccgatactcgcatcagtctcgagcccatgactcctagcgagctcgtgcacccacttccctgtctcaagggctccctggcgtgtgcaagctgaaagcacactgaccagagtgacagcgtcaaaccccaccttctcactaagcatcctngtggaagaacttgatcgcccgaaccccatcgccattctgctcatacatggcaaccatcgtgttccaggacaccacggttcgcgcagccattccatcaaacaactcttttgccgacgcgatgctcccgcacttgccatacatggcgaatgagcgcgttcaccagcggcagattcgcatcgaaccccagcttgatcacgaacccatgaaccatctccccggcagcgagacattcctgtccctgcagacacggcaggaaactgatcagagtgatctcatttgggagcacgccctggtcaaccatcgagccgaacaccgcagccgcctgaccgaacaagcagttctgcgcgtagcccgcgaccatggccgtccacgagacgaccgtgcgggcaccggcggcggctgccaagaacacctgctccgcgtccgccacctccccctcctggcagtacatggcgatgagcgcgctgtgcacgaagccgtcgccggcgagcgcgaacctcaccgcgtccctgtgcgcggcccgcccgagccgcggggcgcgcgccgccgcgcacgccgggagcacgatcgggtatgtgtagcagtccggtgcgacgcccgcggcgcgcatccgcttgtagagctggagcgcgtccgcagcgggggagttggccgggac

SEQ ID NO: 13192 - DNA, 1196 bp, Triticum aestivum
  unsure (1)..(1196): unsure at all n locations
  Clone ID: PAT_TA_13192
ttttttttttttccgggcccggcccggccccctggttttgtggttccgtgaaccccatggccgtcctcgccctccgcgtcctcgggttcttgcgcgttacacggttgtgtttcttccttccaactcggcggtcatctccccnttctgtggccaatttaacccccggctctccagggggatcctggtggctggccgccttgcaaccccggtgtaattccaccttacccttggggatccccaccacgtcgaagaagagcatagccatttctcccccagcctgctccccaagtatttcgtaccagccagaacttgttcccacgactgtcagttccgaaaccaaccagcaatagagcatggttgtggcctttacccttccgaggaggcggacactgatgatgctcgataatggttttaccatcatatcttacaaagtacttgttgacgttgaaccgaacagaaagaggtgaggtgaacaaagcaatcttaaattgatcttcaacaggtactggagggtcagtgcgaagccgtttgacatagtcatcatgacccaggaactggtcccactcaatgacctgaattgctccaggtttgggtttgtcagcaggctgaattgctcttggtttgtcagcagcctgacaggggccttggcgccgaattaagtttatcggatagtcaatgtcttgaacccaatccattcatcatcatgtaggtaaatgcctccagacataaaaccccccttacatccatacagtaagccttttttgcacttaccaaggcaatctatgacctcctgaactgacaatcgtgagtacttccctgtttcaattagcacaacagactccagattttgcacggcaacaatggcaaaacaacagccacaaccagtgttgatatggcgaggtgacacaggagctgcgcagcctgggttgaccctcttttctccttgctctataggtgttattccatcttcctctatgggtgtcaaatcaggttgggaactgagagacaaaacgaacaacgatccacacagacatataaaaccacctaggaagcgcatgagagagccacctcttttaggaggaccacccacctgctgtgtagagaagcctctgatagagaacacggtggcacggtatggagtgaacaggcctcaacccaaatggagggacatggcttgatgagacagccttggtgat

SEQ ID NO: 13193 - DNA, 714 bp, Triticum aestivum
  Clone ID: PAT_TA_13193
tcggcacgaggcccactgggcttcgtcgacgtcatggcctccgtcgtccgccgccacagcgagtggcagtggcagaccatcgtcatgggcgtcgccttcctcgccgtcctcctcggcacacgccaaatcagcgctcggaatccaaggcttttctgggtgtcggcggcggctcccctgacgtcggtgatcgtctccaccgtcatctcctacttctgcagaggccacggcatcagcatcatcggcgacctcccgaggggagtgaaccctccatccatgaacatgctcgtcttcagcggcgcctacgtggctctggccgtcaagaccgggatcatgaccggcatcctgtccctcaccgaggggatcgcggtgggccggacgttcgcgtcgatcaacaactacaacgtggacgggaacaaggagatgatggcgatcggggtgatgaacatggcggggtcctgcgcctcctgctacgtcaccacgggctccttctcccgctccgccgtcaactacagcgccggctgccggacggcggtgtccaacatcgtcatggccgccgccgtgctggtgacgctgctcttcctgatgccgctgttccactacacgcccaacgtgatcctgtcggccatcatcatcaccgcggtggccgggctgatcgacgtccgcggcgccgccaagctgtggaaggtggacaagctggacttttgcgcgtgcgtg

SEQ ID NO: 13194 - DNA, 573 bp, Triticum aestivum
  Clone ID: PAT_TA_13194
cggtgttgtttttttttcagtaatagtacatggcatatagtaagtggcaaaggttcagtgcatgctagcattgaaaatctcctacgtcgtggcatgcatgcatgcatgcacgtcaaagagtctcacattgcggcaaaattgtcggcacctcccagacaagttaaggcgccaaccatgcaacgacatgcatcgcacccccaccctcgcatcgcaggggtcggccgacctcggccgcgaccacgctcctcacgcgtgatctccggtcctcctgcaccaccgtgcatgtgggcatgttgccctagctagctacctactacgtccctgcgctgcgtgctatgctagccactcactcactcagtcgttccaaagcgcaaacaccgggagcgggtgcccgctggggacgccggcgaccggccgggccccgcctggcatccagttccctccgccgttgctgccctcgccggcctcttacttcatggcgtgcgcgtactgggggccgtgcagcaggtgcccgccgcggtggccgtccgaggcgtcggagctgttgtcggacgcgccggcctcggggcgctc

SEQ ID NO: 13195 - DNA, 652 bp, Triticum aestivum
  unsure (1)..(652): unsure at all n locations
  Clone ID: PAT_TA_13195
gggttttttttttttttttttttttttttttttttttcttcttttttttttttgacgccgctaaactgaacttgcatttttgctcaaacatgtttcctgcgagaaatgacactcgatggtttctaactgcagagaacaatagtgtaacccaagaaaatggggtaaattctaagggattctagcaactgaaatcacccgtcactggttaaagtaagggcaaggacaacacaggtcagcgtgaaaataattgtagctgcagcaaaggccaggatggctctctgtgaaaagccaggcttgtcatggcctgctagctcaacctccttcagcaagatcccggatctcattgacgtctgcgtccttcgctgcatgaattagcctgctctgaacctcctcaagcttagcaagccttctagctcggctggcatctctagcaaaccaagatgaaccgtgtcatcctccanaagangattccgacgtanattgccgcgaccaatcaacgtgtaatgatgccgttcncgnacncctttgtgaacgtncaggacgagaaacatattcaacaagaatcaactcaataacttcgtcangcaaggnantagaacaggacacaantgccactatcntaagtnattgaacncaanggtttnaaaaaggn

SEQ ID NO: 13196 - DNA, 551 bp, Triticum aestivum
  Clone ID: PAT_TA_13196
ttttttcgttttccttttctcaccgaagatcctaaaccgatggacagggttacagacgcgggctcgctgggcgcgtacgtgtccaactaaacacactcctatttgggtgcccctatatattttggcgcaaagactaaagaaaaaaaaaagaacaagaccaaagaccaggcgtctgccccgccttgcattccgcccgccgtcccccaatgcccccccctcttctccgcctggccagacaccgcctcccggccgaacatccctccccccgacgcgtccacaccgccccctccctctcccccctgcacccccccctcccctctcctcgcctcttcgccgccgcgccggccggttcgctgccgtccaacccgccgtggctcttgcgcttgcaggcggccgccccgcctgcccctccctcggctcccccccctggggcttcgtctccagctccatctcatttcctgcccctccgcctcgccccccggcttttctaatggaacagaacattccatatcaacactcacttatctagtgtacctcgggcgcgaacacct

SEQ ID NO: 13197 - DNA, 934 bp, Triticum aestivum
  Clone ID: PAT_TA_13197
gctccacctctgccgagcaaggtttttttgtaagaaaagaagaaaatctagatggatatcatgcagactagtgactcttcacatcatggaattgtagagaacagcccttatacaactccctatgatagacgtgtggaaggtgaccaacttggtgcttcgtggtattttagtagaaaagaaatagaagagaattccctttcaaggagagatggtattgatttaaagaaggagtcttaccttcgcaagtcatactgcactttccttcaagatttcgggatgaggctgaaagtgccccaagtaacaattgctacagctatagtattttggtccggttttttccttcgtcaatctcatgccaaaaatgacagacagacaatagccacagtttgcatgttcttggcgggtaaagttgaagaaacacctagacccctgaaggatgtcgtactcatctcttatgagatcatccacaaaaaggatcctgctgcagtcgctcgaattaagcagaaggaagtgtatgaacaacagaaggaacttcttttgatcggggagcgccttgtgcttgtaacacttggttttgacatgaatgtgcaccacccttacaagcctttggttgaagcaataaaaaaattcaaggttgctcaaaatgcacttgctcaagttgcctggaattttgtcaatgatgggctacgcacttcgctttgcctgcaatttaagccccatcatattgcggccggcgcaatcttccttgctgcaaagttcctcaaagtcaagcttccagcagacggggaaaaggtctggtggcaagagtttgatgtaactccacggcagttggaagaggttagcaaccaaatgttggagctctacgagcagaaccgtgttggaccaccaccttcacaagggaatgataccgaaggcaggtctgcaagtgtggtta

SEQ ID NO: 13198 - DNA, 2260 bp, Triticum aestivum
  Clone ID: PAT_TA_13198
gcacttttaaaactcaagattgctcaaaaggaacttgctcaagttgcctggagttttgtaatgatgggctgtgtacatctctttgcctgcaatttaagccccaacatattgcggccggcgcaatcttccttgctgccggctgcagcacccatacaaccccgtggtggtcgcaaccaacgccctcaaggttcctccaccgttgccggccacaggcaatatcacgccgccccctgatttcttatctccctcgcccccccgccccccacgcacacaccctcctcgcctcggccgcgacccctcggcgacggcgtttgccggccacctctgccccttcacgtcgccgccgggccgctgccccccgctcggcccctccccaaagcccccctccgagccgatccccccaatgccgggccgcgatgttttgccacaaccccagggcaatgggaatagatgccgcgctgaatgtttgacccttcacctcgccctggatgtagagcctggagctgctgaggcgcctcctgagcataaaatgcattcagcaccccggacaaccgtcctggccagactgccatggacataaccagcataaccctgaaaggcaaggctcaaaccagaggatagcacaacccgaagcgagggatggcactgccactagcaatgaaggcctcaatacgtcgccatctgccacggccgccggcgatgaaggcccgactatgccgccgtcagggatggatgcagtggaaaagattgctgatctgtctgagagggagctgaagcatggagtggaattggttgccgaggatgacgaaaaacacgacagaaggcagaccgtcccccgtcccccgcacagagaggatcatcagaaagccgctcacacgacagagggcacggaagagggcgagccgtctaaggacagtcaagagtgccattcaaagcggaaggagcacaggagccatgatcacagcagcgagagggaccttaagaggttgaggccataaaaggaagtatcatcaccacctgggtagaatgatccgcggtggcattgtgctaatgcaactaccagggtgaaaacctattcttttttctctgttgcaggagctgctatctcagtccttgctggccatgtcgggagttttgaaccgtgattcgagaataaaagtcacgcttccgacagagggcgtgcaggtctggtgtgttgattttgatgtaaccccatggcagttggaagaggttagcaaccaaatgatggagctctacgagcagaaccgtgttggaccaccaccatcacaagggaataatactaaaagcagctctgcaagtttagctgatcaacatgctgcggaaaaagctcctggagtgccgaggagcctcctgcccatgaaactcatcaagcacctagacagtcgagcgtaccaggccgtcacgggcatgaccaccctcagcctgaaaagcagaactcaaaccagaggatacccaagagtgaagcaagggatggcactgccaacagcaatgaaggcaccaatatgtcctcatcaatgatggatgcgatgaaaaagatagacaaggataaggtgaaagctgcgctggagaagcggaggaagtcgaaaggcgatgctggtaggaaagtggacgtcatggatgatgatgacctgattgagagggagctggaacatggcgtggagttggctgccgaggacgagaaaaaacacgacagaaggcagagctggccccaccccgcgcaccgggaggatcaccagaacacggctcgcaaggcggagaacaccgaagagggcgagctgtccctggatggccaggaataccgctctcctggccccgacaaccggaagaggaaggacgcgcacgagcacaggagcaatgaccgcagcgccgagagagacatcaagaggccgaggccatgagatgaagtattcattgtggggggtgatcagcggtgacggactgagaactggtgttttgagcgccagtgcgtgatacctagtttttgcatcgcgggaacatacaggtgcttgtttgcctatgctgggagatttgaaatgtactgtactgtaacttgaaaagatgaggagtatgtacatgttcaggttatggaacattcggcagccgtttggtgttgaggaacgataggaaagaggctgcatggcctgcacccgtaggctatataaatagcattttaaatacatggattccaagcatttggattgggacatttatatggatttgaaacaaatttgtttgggac

SEQ ID NO: 13199 - DNA, 559 bp, Triticum aestivum
  Clone ID: PAT_TA_13199
tttttttttttttttttttttgaagcccacacgacccaatccaacagtcatcattaatttattcaagatctggtgtgcgcttagcagtttcaatagactgaccatactccacaagaggaaaatatgaaactctccgtcccgcatccgcagcccctcaaatcacgctaatctaaccatctaaccaactcgcaaaaaaaggaaaccgaacctaatcgtgtccctggccccactccctgcctttcctcgccaccgccccagacgaagctcagcagtcactgtcgcctccctgcacggcggcctggatccctgcatcgcatcgtcgcctcgctggacggttccctcgccgtcctgcaccgcattgaggcctccctgccggcctccctcgccgccctacaccgcaccgtcgagtgggcggccgctcctccttcaccttcgtttctaatatccgtccgacagatcgccagtgcctgaggagcctgctccggctcccggtgcccgcggccgccggcctgcccctcccctgtggccagctagcacttccaaccataattcttccttg

SEQ ID NO: 13200 - DNA, 1027 bp, Triticum aestivum
  unsure (1)..(1027): unsure at all n locations
  Clone ID: PAT_TA_13200
tttttttttttttttttttgggatcgaggtggtggggttttaagaatcaggctcaagtttacatgggctgggtgtttacaaaaggaggccacaaatcttcagacagagaagataagatgctacaaatatccctcgagcagcaaagttccattcacctccttgtgctccacattcttgagtgcaaacgactggctgccaccaaacgccaggtcgctcggcccagggctcaccacccagacaggtgagagctccacaacaaccttctgcaccagcttgtcctcttgaaacttgctcagcagcggcaccaggacgcctccggcatctcggaaatcaaccagcacactgcacaaccctcgatccgcgagaagtcgaaggatggactctaggttcatctggtcgaggaccgagacgctgactcccgatggctccacggtgacgggactatcggccaggactatggcgttagatgcagactcctcgtcgagaaacgggatgtgtacttcggaaccttctccctgcgctatgatgatgtaaagaggctgctttgcgccagcctcgcgtgatattggtaaggtagtcccctgggccatgtcgcttgaaattataactccgtcgtattctttcgctagttgcgagtagtatcctcctggttgatcagctccgctcccaatttgatttatgacagttccgttcatcgagagtgtagttctcaaagttgcaaaggccttcccagtaagcatacggtgaatgtaagcctcatttaaatntctgagacataatgcttcctccacgccaacccctacatctatagccgggcatttctgaggttttcaatccctttggatgctacaataggatttgggtcagtcatccccaccacaacctccttaactttggctttgatgagtgcttcagtgcagggaggggttctcccgtagtggttgcagggctccagactcacataagctgttgcattctctgctaaatgccctgcgtccctcaaagcaaatactcggcgggggctgcc

SEQ ID NO: 13201 - DNA, 889 bp, Triticum aestivum
  Clone ID: PAT_TA_13201
ttttttttttttttttttttggaacaaataaatagttcagtatgatgatgattatatataattccaaacacacaccagtgtggtttccagcaacacgaatccggtcggttttgcttttatgcaaaacactatcaacagaggcggatcacgagactgcttgagtttgagaacgaggtgccgtaacacgtgtgccagttgatggttatatacatagctcatggagatcccctcactcctcgatacggactaccgatcttaccgtgtaatagtatcctgtgtgtttggctgattgggagccttcgtccgttaggttaggatctatcgaatgaatcttgcattctagatctactacgggagagcaggttctcctttatgtctttgaaagattcaagctcctcgaatgcatcagatgttctacgggacatgaacgagctggtgttgcctgcttcggtagattcggcccttgatgtcacagatgaattgctaggatctcgcaacggacgtgcagacctcagcagatggacaagatagccaacagcagcatcttgcgatttatgggaggaccgaccccccccgtccccccttccaccccggcccccgggcctggcaccaggtgcagcgacctcatccactgctaaagcgcggtacgcatcatctctggcaccttgcgtagccggtccccttgaactccttgaaatcccgtgtcgtggagaaccactagaggagaaaacacctgagaacctaccagattcctccctactgtccttagtctttggagcagcaggcaagttagcgtagagatcggccatccggagcccctctgccttccgggatgagcggccgctctctgtgagtgactcgtgtgaccgtgcctcccctcgcacgctct

SEQ ID NO: 13202 - DNA, 822 bp, Triticum aestivum
  unsure (1)..(822): unsure at all n locations
  Clone ID: PAT_TA_13202
ncnttnggtganatntggaaggaatgtgggctttgttatnncagtggaangggatttngnagngataagttgnnacgcaggtttcccgtcagagtttaaacgaggccagtgagcgnngtaatagatcnttttggggggaattgtacggccccccctaaatnnaaattcaatggacccaaccaaaaaaaaactttttggtggcaaggcaacattcagcaggggagataaggttctagtatcattgtccgggcaaatcttgcaaaatcccaatgctaacaggaaattggtgaatcatcatcagtgatcccatcatccatttacctgacttaatcctttttactagcgattgatttgattatctatctctaccagagagagacgcaaaactctaaaaatggttcgattccttcctgtgctgtccgtccgtgactatctactctgtccgatcactcaacttcagccgatgcatctgcacgactgcatcatcatcctcctcctcctcgtccagcctggtaagcagacccttgacgcttgttccctccaccctccgccccatcaagttgccgctggccacggagacacggtgcatgatcatcgcctcggctgcgcggatcgcctctgatgttcccctcataatcacctccctgtcgcgcgcccccggcatgaactcccccttgcctgagatgtcaatccatgctccactaaccttgctgatctcattgacaatccttccaccacgaccaataacagaacccatatgctcatcagcaacagcaatagtgacagattcttgggcatccttattaacaggtgatctcattg

SEQ ID NO: 13203 - DNA, 477 bp, Triticum aestivum
  unsure (1)..(477): unsure at all n locations
  Clone ID: PAT_TA_13203
tttttttttttttttttttttttttttttaagtcagagcacaaatgttcactcttngaaatggaaggacggaaggttagtctctgtcgtcgagtcccacgagtgatcatagagaaagcaatgacatgggtctctttccttcccttgtcccgtacattggcacagaagcacaggaaccaggaatcagtggcaacgatttggggacctcctcgcacaaaacgctgtcttcggtagtccatgacagccacgaaattgcaccacgcctcgcaagtagtgactcacgggggaacaggtggtagcaggctggcagctcaggcgtaagaggctccgaggtggaggaggccggagctgccgcacttggggcataggccgacgctcttgggcaccatgaagtacatgaaacacgccctgcacccgaccgcaacgagcacgtggctggtggcgtgcccactgtcgctggaggagggctcgttactat

SEQ ID NO: 13204 - DNA, 1418 bp, Triticum aestivum
  Clone ID: PAT_TA_13204
cgtccggaaaaagaaggcggcggcggcccgcaaggcaaaggcaggccgaggcagataaattacgacacccccgcccctcgaggaggagagggagcggcagtcctccccgccccacccaaatcccccgccgccccccctcgcggaggaggaggaggccggcggccatggaggaggagaggaaggggttccagccccacctgatgggcctgggcggcgggagcaggctgaggggcgcggcgggggcgatgggcctgcagaagcagaactcgtggtcgcccgacatcgagcgggacgaggcgtgggagcggcggcggcgcgggattctcggcaggggccgccgctcgccgctgcagcgcgcgcagagcgtcaccgacgaccagctcgacgagctgcgcggctccctcgatctgggcttccgcttcgacccgccctcgcagcgctgcgccgcctgcgacgccggcaggagccgcctcgtcgagacgctcccggcgctcgacctcctctacgccgtcgccgccaacgccaacgccgggggctccgccggcgcggcccctcaccagtgctcctgcggcgcctcctaggaggcctccgagccgtcgcccatcgggagccccctctccatactctccccagatgacccgccggagacggtgaagatcaggctggagcagtgggcgcaggtggtcgcgctgtccatccgcggccccgcctaaaccaacccacccggccgcgcgacccgccagtgaacctcctacgcatcctcggggacgtacgagcagtagcagatcgagagccccctctccatactccccccagatgacccgccgggaagacggtgaagatgaggctgaagcagtgggcgcaggtggtggcgctgtccatgcgcagccgttcctgaaccaaccagccatgaaacaccaacgtgaaagctataccgaattcagaggagggacaaccagcgacgcagaaggaaagaatcaaccatccctccctgcctcgagatcgaagtaccaatgatgagcaagcaaccaacgagaagagaatctagtgtcgtcggacgatcggccagccgccttccacatctgctctcgcatcgcatcttggactagctatagcttagcctgctgctactaatcgactttctgtcacatgtttatcgttgagcaactcgaaaatcatactccgtaattcgcgttacttctgttaattagtttctcctcccccctaatattcagtcgcggaggcattgcttccgttagtagtcacctcccctgatttcgtagtaataatttcgacatccctgtacattggcgcatcaccaccatcaatcatcagcagatagtagattaatttcaatttgcgtcccggaatattagataatataaactgttggcgggtaaaaaaaaaaaaaaaaaaaa

SEQ ID NO: 13205 - DNA, 2147 bp, Triticum aestivum
  Clone ID: PAT_TA_13205
cccacgcgtccgacgccgccgcggccgacgccgtcgtctcggcctccgcctcctccgggaagaaggccaaggccgccgtcgtgctgcgggtgcccgccgtctgctcccggaggcaggccctcgcccgccgcgaggccgccatgcgccgcgccagggaggccggccgggactacgagctcgtccccaccgcccgcggcgagacgctcttcacgcagtcctggtggccgcacgcctcctcctccgtcaagcccagggcgcttgttcttgtcatgcacgggttgaacgagcacagtgggaggtatgatcatctggccaaacggttgaacgacatggatgtcaaggtttatggcatggactggactggccatggtggaagtgatggtctccatgggtacgtccaatctctcgatcttgctgtgcaggacatgaaaatgtatctgaagaagatctcagccgagaaccctggcgtcccatgcttctgctttgggcactccaccggtggaggcatcatcctcaaggctgtgcttgatccggaggtcgatgctcttgtcaatggcatcatccttacatcgccggctgtccgtgttcaacccgcgcatcctcgtcgtcgcggcgcttgccccggttttcgccctgatcgcgcctcggtaccagttcacggggtcgagcaagaacgggccggcggtgtcgcgcggcgtgtcggggacgggagaaacctccgtctgtccccgacagtgatgacgcggtcggcccggtgcgcaccggctacgagatcctccggctcacggcctacctgcagcagcacctgcgcagaggcacggtgccgcgcgtggggatgtgcggcgccgacgacatggtgaccgacccggagggctcgcggaggctgcaccgggaggcctccaccccggacaaggacatccggctctacgacggcctgctgcacgacctgctcatcgagcccgagaaggaggtggtgctgggcgacatcgtcgactggctgaccccgaggatttgatcaggcgggtcgccgcgccggccggccggtccgtgggctgaggcaggcgggttggaccacatcgccgagctcgtcggggacgggagaaacctcccggtccctgccggtgatgacgcggtcggtccgaccgcctgcgccccaagcgaggacggcgaggatgatgatgatcttcttcatcctccctcccggcggaggaggcagttttgcgagcgcgggaagctgcattattagtaactagcactacaactagtacgtgtggtgcggtacggggtgacgactggtggtggccgagattgctctgctcccagtgtgcgtgtccccgagctatgtttttgacccatatttttgtccggtaggggtaaacaaacgttcgttcctttggagtcgcccggtgtggcgctcaataatgtagacgcattcctcccctctttgcaggggtcgtttttctgcgtctcgaaagattctcaatcagaatctgcggctgaattgatttgatggacttccttgaaggccatccggctctacgacggcctgctgcacgacctgctcatcgagcccgagaaggaggtggtgctcggcgacatcgtggactggctgagccccaggatctgatcacgcgggtcgccgcgccggccggtccgtgggctgaggcaggcgggtcgggccacatccgccgagctcgtcggggacgggagaaacctcccgtccctgccggtgatgacgcggtcggtctgatcgcctgcgcccgagagcgaggacggcgaggatgatgatgatcttcttcatcctccctcccggcggaggaggcagttttgcgagcgcggaagctgcattagtaattaccactactactagtacgtgtggtgcggtaagggtgacgactggtggtggccaagtttgctctgctctcagtgtgtccccgagctatgtttttgacccatatttttgtccggtagggtaaaacgttcgatcgttccttggagtcgcccggtgtggtgcgtgctcaataatgtagacgcattcctcccctctcgcaggggtcgtttttctgcgtctcgaaagattctaatcagaatctgcggcagaatcgattgatttctttgaaggaaaaaaaaaaaaactcggccgattc

SEQ ID NO: 13206 - DNA, 930 bp, Triticum aestivum
  Clone ID: PAT_TA_13206
ttttttttttttttttttttaacagccaaaacatctttacatttctgaatagagggtgtacataaaaaatcacctaaaataataaaactgaataacgcacaatatttccatactccaatatatacaaaaaacagtttgcacaaaatgaaaacagacaatctgcacaaagcaattgcgccgaaatgtgactcctgtgctcctaaatcctaatcaccactatgccccccactgtcatcttctgcggattgatatgttccatcgtcagtagaatccgatgtatgctcgtgtgatgcctcgtcatcctcagccccaggtccagctgctgaagcatgctgtgaaatatccgatgatgccatgccacgcatactcttttccaaagactgaaacctgttctcccaagtttcattcatctgccgtgtggcgtgattgatcatctcctgcacctgatcctgcgtgaacagctgccttctctttcgacctaaagaacctgggatggactttgacaagttgcctatccgacctttgtcaatgataccagggagtccatagtacctccgtcggttacggccccctacctcctccgaccatacaacatgggggtctagttcagtatcacctgcctcctctaaacgccgctggaaggcctcctgtaaaatatatagcacccagattcattgaactgagttctgtgacatcagtataattattaatcgacttatgatgcaaatgactgaatacataccacggttcgccttgctttctcggtaacaaattcccacttaccgccgccatgtttatgggtcttattaaatagttcaacttccgataccggcttcccaccattctctatcatctatttcaattcaataagagtcatatgtaggtgccccagtgtgtatcaggaaaaatgacagtcttaccataagtttg

SEQ ID NO: 13207 - DNA, 680 bp, Triticum aestivum
  unsure (1)..(680): unsure at all n locations
  Clone ID: PAT_TA_13207
tttttttttttttttttttttttaaaaaaaaccctgtgtttcttaattgaggataaggattgcatatatagaactccttaaggcatgctttgatgaggcgtgattgtagggaattgttccatatcgattggcaacagaagaaagcatggttccccacatccatgtgttagttatttccaacaatgggggaagtgcccctccctttcatgacgtgcttcatgaaccccgggatgtgcacgttggtgaagtattccttccactcgatgctccgcacatcgaagtggaactgcgccttctcctccgatgacatctctgcgaaaagcgccttggtgttggcgttgtcaaacctgcagccgtagaagccgtagggttggtacatgcgggcgaggtggatgatcttgtcggcgtacttgctgaaaagcatccgcgcccgaggcgagagcgtctcgccggcgccccagagcagcatgtccctctcaacattgttgttgaactggtgcatgttgccgaagatcctcatcggcgccaccttgattgcctgccctgccgcgaggttcanggggtacctcgtgaagtgctcgaaaaagaactgaacatgtcgcgccatattagcgggttcgctgtcgatgatcccacatggtagataagcatctcctgtgccgcgcctatggcctgagcat

SEQ ID NO: 13208 - DNA, 873 bp, Triticum aestivum
  unsure (1)..(873): unsure at all n locations
  Clone ID: PAT_TA_13208
ttttttttttttttttttttttttaaaagcaaaaaaaaaaaccaacgttgtaattgacagcacaccgtagtcattcatgtacacattacaatcacagttacaggcatgacatacatccagttagtacgtatagctccttaccgtggtggtttctttagtttagttatacgagatattaggcatgctccttaccgtggcagtttcttcgattcagctaacatattaacagaactaatctagagctgacagtatgcaaagtgtttgtcatccctgccaagtgccaaccaccagaacatcatgagctgacgtgccatggttttacgtctgccgtcagcatctgtagttccatcatcctcttaacttcccaaatatgtactttccctttgcatcaaggccaggctcaattgatctccaagaattctcgttgtctacctcacttgagataacaagtttcgagtttgtatcgttgccgatctgttcactggcactctttggcagatacaagatgaaggcatttcatggaaatcatctcgtccatgtctgggatcatctggttcccccataaggccccgctggattttctttaccttccgtgaaaatgtatcccaacccgtttgattccgtgtctgaaataatacattgagctttctcgtgtttgggcgaatagttctcttatggcccatgtatcgcctgcgtccagctaacaccttggccatgtttccgttattattggtaacaaaaacatcactctcatcacatacaatgaagtcaacagcagccaatcgtgaagaaaaaggaaggaatggtttcagatcatccccagcaagcatctccttggtgtagaagtttggaaagagttcgcgcatngnccga

SEQ ID NO: 13209 - DNA, 444 bp, Triticum aestivum
  Clone ID: PAT_TA_13209
ggcgggcagctcgccaagcccggggccatcatcatccgccagcgcggcaccagggtctatcctggaaataacgttggaatgggcaaggatcacacactcttttctttgatagatggactcgtcaagtttgagaagtatgggccggacaagaaaaaggttagtgtttacccatatgagaaggagcctgaaaacccaaacagttacagagcaaggaagagagagtacttccgcatgcggcgtgaacggaagaaggcgagagcggagggcgccgctgagcctcagttggtactagctgctgttgatgaaaactctgaggtcagcgcggactgctgataagtttcctgtgtggtgtttctctttttcacagcccttgttacactttttcttccttaattgtaagaccacatgatctataaaggtcatatttacatgtgttgtttagat

SEQ ID NO: 13210 - DNA, 761 bp, Triticum aestivum
  Clone ID: PAT_TA_13210
ccccgcgtccgggcttgctcctgctgcttttcgcttgctgctgctgcgtttctccgagcgacagaaatggcgttcacgctggtgggagccttcaagggcctgtccctcgcgtcctcctcctccttcctccgcggcgaccgcgccgcgctccccggcggcaccaccgggggcgtgggcgtggcgacgctgccggcgcgcgggctgaccatccagatggcgcacaagaagggggccggaagcaccaagaacggcagggactccaagggccagcgcctcggggtcaagatttacggcgaccagctcgccaagcccggcgccatcatcatccgccagcgcggcaccaaggtttatcctggaaataatgttggaatgggcaaggatcacaccctcttttccttgattgatggacttgtcaagtttgagaaatatggaccggacaggaaaaaggtaagcgtctacccatatgagaaacagcctgagaacccaaacagttacagagcaaggaagagagagaacttccgcttgcagcgcgaacgcttgaaggccagagcagagggaacttatgaaccagaattggtattggcagctgcagatgcaagtgttgaggtcaatgcagactgctgataggtttactgtaatgtatttctctttttacaaaatccatgcttgacaaatctttctcaaatgtaaatcatcaactgcaagatgaatgcaagttcagcactccagcttcattttaaaaaaaaaaaaaaaaaaaaaaa

SEQ ID NO: 13211 - DNA, 1112 bp, Triticum aestivum
  Clone ID: PAT_TA_13211
cgtccgcccacgcgtccgcaaagagtggggttaagattgaaacagatgcacaggccactaaccaagagagtgcatcagttgatcgtgcgggtgttatcgaagaccttttaaccaagctggaagcatgtgccaagaaactaccttcaggattccaaatgaagcccattcagtttgagaaggatgatgatacaaatttccacatggacttgattgctggtcttgctaatatgcgtgcgagaaactatggtattcaagaggttgacaagctgaaggccaagttcattgcaggaagaatcattccagctattgcaactacgacagccatggccacaggccttgtgtgccttgagctgtacaaggttctggcaggtgaccacccagttgaagactaccgcaatacgtttgccaacctggcactaccaatgttctccatggctgaacctgtaccgcccaaggagatgaagcatcaagacatgagatggacagtatgggaccgatggtctatcaagggcaacattactgtcgcagaactcctgaagtggttaagcgacaagggcctgactgcttacagcgtctcctgtggcacatccttgctgtacaacaccatgttcccgaggcacaaggatcgactgaagaggaagatggtggatgtcgcccaggaggtggctaaggtagatgttccagcatacaggaagcattttgatgttgttgtggcttgcgaggatgacgacgggaacgacattgatattcctcttatctccatttacttccgataggcaggcgctgtcactctattgtgaggatagatgacgagtgtgcaaagaattcctgtggagagatgtttgaaacattcctaaactcttcttagtcggcttggtttttttatgcattggtagcctagtgatcgctgatggtgttagcgtccatctccctagcgttttgtgtgggtcgttccgctatgtttgttgcatgccaactatttgcaggtgtgcgatgctgtctgatgatgttttaatgaatggatcataacctcagggtaacattgggttgatgttttgggatggctacatgcatatggtagttcagttgtcctttacctcaaaaaaaaaaaa

SEQ ID NO: 13212 - DNA, 334 bp, Triticum aestivum
  Clone ID: PAT_TA_13212
cgtccggatcaagcacgacatactgtcgcggttcatcgagctgggcgaggccggcggcgacgacggcggcagcctgttcggggacgacaagggcctccgcgacgtggtgctcaacttcgtcatcgccgggcgggacacgacggccacgacgctctcctggttcacctacatggccatgacgcacccggccgtggccgagaagctccgccgcgagctggccgccttcgagtccgagcgcgcccgcgaggatggcgttgctctggtcccctgcagcgacggcgagggctccgacgaggccttcttcgaccgcgtggggcaatttcgcgggactcct

SEQ ID NO: 13213 - DNA, 1070 bp, Triticum aestivum
  Clone ID: PAT_TA_13213
aggaattcggcacgaggatgatatcctgagaaaaacgaaggcctgcggcaatttgatgtaaattctgtacgggcagaagttgaaattacattcgatccagaagtagttggtttgagatcggttgtggatattattgatatggaaagcagtggcagactgaaagcccatgtacagaatccatatgtacggtcttcttcaaatgatgcacaagaggcttcgaaaatgcttcacctccttcgctcaagcttatttctaagtattcaagtgttttttatgcgcatggtatgccctcacatatctttcatcaactcattcctactcatgcactgcggaccatttcgtataggagatctgctcaagtggatgctggtgagtgtagtacaatttgttgttggcaaacgtttctatgttgcagcttatagggcccttagacatggctctacaaatatggatgtattggtcgttcttggcacaactgcaacatatgtgtactcagtttgcgcgcttctttatggggcattcactggatttcatcctccgatgtattttgagaccggtgcaatgcgcgtgggcggtgtcctattggggaagtatcttgaggtgcttgctaaaggaaggacatcagatgcaattaagaagcttgtagagctggttcctgctacagctatcttgcttctgaaatacaaagatggaaaatatgctggagaaaaggaaattgatgcattgttgatccaacctggtgatgtcttaaaagtgcttcctggttcaaagattcctgctgatggcattgtcacttggggtacaagccatgttgatgaaagtatggtaactggtgaatctgcgtttatctgcaaggaagtgtccagttcagttattggaggcaccatgaacctaaatggcatccttcacattcaagcggcgtaagtaggatcagggacagttttgagcccgataatatctcttgttgagactgcccagatgtctaaagcacctattcagaagttcgctgattatgtgtgccggcatttttgttcctattgtcatcacattgtccttactgacattctgta

SEQ ID NO: 13214 - DNA, 577 bp, Triticum aestivum
  Clone ID: PAT_TA_13214
ttttttttttttttttttttttttttttttggacagtgccgacaaacatacatttatgatgtcatcaacagagatcaacaattccatcccataataacaaagcgaattgctgcaggctgaggcatttgttctctttacacgccgtgtagcactgaacattggcgtccctcaggtgtagctcttgcccattgggccaaaggattggcccgaaagaatttgtacgaaaaatgatcagcatagaactgcactttttgcggttccaagctgtgcaaatgaaaagactcatctgactctataataaacaggtttcatgctgttgtgcttcttggcctcctaactgtagtgttctggcaggaaaccattttagcttattttccttcctcgaattgacgcggtgccaccatggtccccggaggtgcactcgatacatcataaatactgcatcccgtttctccgaaaaaatatcccttcgtggaagcaagttcacgctgtttgctgcttcaaattcccacaaatgcagactatgcagtgtgtgttacatctcatgtcactgctgttaatgtatattgcattctgc

SEQ ID NO: 13215 - DNA, 571 bp, Triticum aestivum
  Clone ID: PAT_TA_13215
tttttttttttttttttttttttttttgagcactttctcataatttggtgggcaatgcttatgacctttttagcccatccgaattattattacatggtagttacaataaagtcaaatgcgattgatttgcacagcctgaccactagctagttcaagggaagtggcggtatgctctgctcgttgcggaagtagtcggtgcggtcaaccttgcgcttgatcttggcgagcctcctaaagtttgctggcccgaaatacctcttgccccacaccttggcagtttcgtagcacgtgaccccgcccaccaccttgttcacgcccatgtcaaggtcccggtagttcacgtacgcgcccctcgggctcttgctcacgtacggcgtcatcaagtcgtacaggcccccgatccagttaggcgtaggcgtaacgtcgcccccggcctctttgccgttccatagctccacgtactggatgttgtagagcacaccgctacggtgcgggaacgggatcttgtcggcagcgatcctgcccattgctccgccgtgcggctcgaggatgagctgccccgacccgccgc

SEQ ID NO: 13216 - DNA, 412 bp, Triticum aestivum
  Clone ID: PAT_TA_13216
ggattgcttattatcacatgcgtcacgaccacaattaaaaaaaatacctgcttcatacaagccgcctagctaatgtcgcaccatctgtagtagtttgcttcgcacctgctcgtccctcacggccatttccctgacttgatcgaccgtgaatggcggcggcagcgtgcatggctcgtccacggccacgcacttctccctggactccatcatgaactccctctcgcgcccgcgcctggggcaggccatggactcgaggctgacctccacagccctctccggcacggtgggcgtgtaccggagcagggcactgtactgcctcaacacattgagcatgtactcgtacacgtagtccatcccccgcgccgccctcgtgaacccactgccctcctcgcccatgcgccgcgcctgcgcc

SEQ ID NO: 13217 - DNA, 737 bp, Triticum aestivum
  Clone ID: PAT_TA_13217
tattcctatattgcaaataaaccccataacgctcaagcccaatcttcttcagtctcatcagcatccaaggctcctatctcatatttatcttcagtttcatcagcatccaaggctcctgcctcatctgcatcatcagttccacaaggtagatttacaaggaagaccaatgatgatctgcccaactttgcagttctagactcgcaaaaagccaaagacgctgttaagtcagctgtccttgattcccagtatgagtacgaggatgagtatgatgactcgtttgatgatcttggcttcagcgtggcggagtcaagttacgaggaagcagagggcgccaatgatgctgagggttcctccagtggcccacgttggtcttcacagaagaagccacagttttatgtcaaggacgggaagaactacagctacaaggttgctggttcagttgctgtatcaaatgctcgagaggcagcagtcttaaacaatactcagaaagatacaattcatggtcttggtcgtggtggaaatttacctattggtggaaatttacctatgggagttcccaacaggcagcatagagttgtggaggaagaggagggtggtcatgcaaacagcttcagcagaggaggcttcgaatccccgttgtcggtgcaggggcaaaagaggtggctgggatcatggtaacccaccagaggagatcgagaattctagtgggccacaaagcttttgccgtgatggaagaa

SEQ ID NO: 13218 - DNA, 2259 bp, Triticum aestivum
  Clone ID: PAT_TA_13218
cccccatcccgccccacccaaccctaacccactccaccctcgcgccgccgcccccggatccatccgcaccgccgccgccgccaccatgggcgtcgacgtgggcgtcgtcgccctctaccccgacggctggggcccccccgccgccccggccgccgcgccgccgctgcgcggcgccgccgccgcggccgcctccccctccgtccccctctccccctccgccgagatgcgcggcatcgccgacggcgcgcgcccccccggccaccccggggggggccgcccccacgcggccgccgccgcccgcgacccgggcttggtcttcgcctcggccgccgccgccctcgcgcccgccgccgacgccgcgtacttcggcctcatcgacgccaagccgccgcccacgccccagcgcctcggccccaggtcccgcttcaggcaccccctccccctccccctgcgctgccacgtgtccgcggcgggcagaagcccgagtcccagcgtggtgctgtgctcgctacacagctcaggagcaatgccaacaacctagctcgctggcctgcggccccattgcctcctggtgctgacgtcctcaagttcggccatggcccacatctaggacgccgcgaccacttcaaccacaccatcgtcaatgagctgcgccccccggcgagcgccactgaccaccaaaccaccgttcccaccaccaacagggcttgcatggtcaagtcgattgtggacatctgcatgaagtttgaagagggaaagtatgtgcttgtgaaagatcctgccaagccacagatgaggatttatcaggttcctaatgatgcatttgagaatgattatgttgaagagccacttccagaggaggagcagattcgtccggctacagatgatgtcgatgctactgcacaggagatggatgctgctgccgaggcagaggctaataaagcaactactcagggtggtgagggtgagaagagtgcagatgctgctgctgcttgaagggtataatgggccatctttgctttatctagataatgtgtcttttctgttttatgacctgtttttgtggattaaagagttgaactgccttgtcttgatacagtggtcttgttttggtccatgagaaaagatggtcctcctaaattcgaggcttagatgtgctaaccttctcacctaccggatgacatcaattccgcgccggctcttgctgtcgaggccacctacatcaaccagaacttctcgcagcaggtgctggtacgtgatggcgagaaggttacctttgatgagcctaacccgtttgcctctgagaatgaggaggcggcgcctgtttgctaccgttatcgccgctggaagctggacgatgatattagcatcattgctcgctgtgaagtgcatgctgctggtgttgatccgagtggtgctcgccagttcctcacgcttaatgcactcaatgagtttgatcctaagattactggtgttgactggaagcagaagctcgagtcccagcgtggagctgtgcttgctacagagctcaagaacaatgccaacaagctcgctcgctggactgcccaggctttactttctggcgctgacatgatgaagctgggttatgtgtcacgtgtgcacccccgcgaccacttcaaccactccatactcactgtgatgggctacaagccaagggattttgctacccagatcaatctcaacactgcaaacatgtggggaattgtcaagtcgattgtggacatatgcatgaaatttgaagagggcaagtatgtgcttgtgaaagatcctgcgaagccacagatgaggatctatcaggttcctaatgatgcatttgagaacgattatgttgaagagccacttccagaggaggagcagattcgtccggctacagatgatgtcgatgctactgcacaggagatggatgctgctgccgaggcagaggctaataaagcaactactcagggtggtgacggtgagaagagtgcagatgctgctgctgcttgaagggtataatgggccatcttgctttatctagataatgtgtcttttctgttttatgatctgtttttgtggattaaagagttgaactgccttgtcttgatacaggggtcttattttggtccatgagaaaacttgttactcttaaatttctaagcttagatgtgctaagcttagcacctgctgttttggattaatgatattgattctatgtggttgatctgctatgtatgttttagcccgtgtctaggcctctcc

SEQ ID NO: 13219 - DNA, 569 bp, Triticum aestivum
  unsure (1)..(569): unsure at all n locations
  Clone ID: PAT_TA_13219
tcacgtttattcctacacaaacccagtgcgaacaccgtccaaatgaagcagcgaaatgttcctactccctaggagtagtatcttgcagcagcaacatcgatcttagaatgcactcccaaatgattccctttctttgcccgtacgtacaacaacgactgataatgtgatttctatttacaagccaaggtgctagctagctagatcaccacacccatggagttacatttacctggctaaacctaagaatgcactgcggctgagctaattaattatcaagctgctagtaggagtatcaattaaagaatagcgcagcgcatgcatgcatgcaatggcggtctcttgccgccaccgcatgcgctgcgttgcatccgtctacgtatgtaccttggcgagctgaacgattcggtcggctaatctgtgtccgcactccggcttcactgcggcggcgcctggccggcgtcggcggccatttcgtgctcctgcggccagggggatgaggcactccggcgggaagcangcagtcgcactgcccggggcaccgccgngggcactgggncccgcgcgcaccg

SEQ ID NO: 13220 - DNA, 579 bp, Triticum aestivum
  Clone ID: PAT_TA_13220
acatctttaattgagcacgcaacaaggtatatgaacgctataaagaaggcttggttgattgcatacaaggactcgcataagcaaattcaagactatgaactcgtgtactcctgcctcattcaagtggttgttctttgtgcttctaggaatcttaaactctggttgggaaatctcttcagatcaacaatgcatgctcatcgtatctcacagtaaaatgtgtactatgttgatattgcatcagtgcatctgcaccaccaacggcacctaccagtgtgtcttcagctacactctttctacatctatccagagcatccgcagtgttgtgattttcggctgccaaggctgcttctaacatcttcgtaagtttcgctgcctccaagcttggcgtcgcctctagcctcagttgcaagtggtcagaaacacggacatatcaagttcagtctccaatgtctgagcctgcggggaacactgctattcacaccgagcataccaggaaacgttcatctcaaaagctgtaccagtgaatggggactggcatagctaactgaatacttcaacctcgccaaacaatcagaacga

SEQ ID NO: 13221 - DNA, 1281 bp, Triticum aestivum
  Clone ID: PAT_TA_13221
cgaccagcccccccaatcgacacctcccgctgtttggccgacccacaccgcctccgcagcagattcggccggcgccggccgcctacgccgcagattctgcgggctccggcggcccccgccacctccggcgacatctacgtgctcctctcggcctcctccacaaatcccctttgcttggttggtccgcctccagccctccacgtatatcgacgacaccaccaaaccctacttgccgccgccctccttagtcgttgacatcgcgggagtggcgttctgcgccgtcgcttcttctccatctccctcaaccatcgcgttcctcagccgatccagaagcctctagaagcgtcgcgagcgccgaatcccgcggccatggcggagaggctggcacccgagaagcgccatgccttcgtccacaatgggcagaaggttttcgaatgggaccagtcgctggaggaggtgaacatgtacatcgagctccccaagaacgtgcccaccaagctgattcagtgtgtgatccaggccggccacgttgaggtcggcattcgcggccacccgccctacctcaaccatgaccttatgcaccccgtgaagaccgattcgtctttctggacgatagaggacggtgaattgcatatcactctgcaaaaaagggaaaaggggaaagcatgggcatctccaataaaaggccaaggtagcttagatccatatgctgcagaccaggaacagaaacggcttatgctgcaaaggtttcaagaagagaatccagggtttgatttttcgcaggctcagttcagtggtacctgccctgacccaaggaccttcatgggtggaattcacactgattgaagaagctcggctcaaaaaatcttgctggatttgacgtatcttctcaaatgcgacaactgtacctatcgcatatgttaattgtgaaaacaatgtgttttcggattattcagtgtttaccctggaaataatgatgatgtgtgatgttgaccttctcgctgatcatgccaaggtgaaactttgttgctgaacctgctctatccactgaacctaataagagtccctcgatggtgggaacattatgcatatgtggtacttcacgacacttattttggataggagggagtattatagttgtgaacgtgtggtggattggagggagtattatagttgtgaccatgatgtggttttgaagttcaagtgcagcgtgagaattgtatctacgatgcgtctgtcttgcttcttggtaaaactttctctattaaaatagcattgatt

SEQ ID NO: 13222 - DNA, 414 bp, Triticum aestivum
  Clone ID: PAT_TA_13222
ctgataaaatactttattgaaacttttgcatgaactagacagatccatggcgcgcatgtatcttgagcctatcttacacgcatcgatttattaccacggcccatccattgtttctacggcgtttaattatagcagcagcaagaaccaccattgactggttcacagtggctctttttgaattcgaaaaatgagcagtggttcctgcacgcctcttcgaattcatggcctttctcacagcttgcaagacgcacacacaagttcagggggattggttttgttgaacctgcatggcatgataatagggtggtagacatcatcacaagagctaccaagagtagggctcttgtgttgttcttgataagttccatgaggaatggtttcttgtttctttatttctacgtatgtgcaagtcct

SEQ ID NO: 13223 - DNA, 674 bp, Triticum aestivum
  unsure (1)..(674): unsure at all n locations
  Clone ID: PAT_TA_13223
ggcatcacaacacaaccagatatgcgcattcatccgagccgagagcgtgcgtgcgcgccaccggggacaggtcgaccccgagccgtgacctgcgagttgcacacccgcctttcggcgacgcgcggcggcggcatgccctngaaggaacgacggagctgctggcgcgggggaggtcgcggcagcacccaaggctctcacgtcgtcgcctccgccacacgtgagggagcaccagcgggtcagcctgcagtccaggtactggacgacggcgtgggtgccgttgttgtatatcttcacgacgtagcacggatcatcgcggttggggacggccggcgatgcaggagtcgcggcgggaaccgcgccggcggcgggcggcgggtgcgggtcgcagagggcgtggcagtcgggccagtaggtggggcagaccctcctgtttaacaggtcgcggccgaggcagatgtggcagaggtacgtctctatggtctcgtcgaccgccgatgtcggcgctgaggagttgccgccggccgccgacgtcaatgccgctgcgttgctagacgccgtgtcgccatcgacccgtgcggcgccggtggctgagaggagcagcactacgaggacaagggagagggcacggcgacggcaggccgccgagagcagctgctcttgggtgggaatgggac

SEQ ID NO: 13224 - DNA, 527 bp, Triticum aestivum
  Clone ID: PAT_TA_13224
gagttcaaatataaaaaaattaaaaataaaactatagattaaaagatatgggtgattgaaattgtcaaagcgaaaacaaaatgcatgcgtgcttcataggtacttgtgtgtcagcaagagatggtcacacatgcatgtgtccttcatctgacatatggtgggtcctagtgtagaaaatacactgcatgcaaatctagaaaaatgagtgaaatacatcttccgtatatgagtgcttgatgtggtgtcatgtgctgattggcaagctggttgccggtaatcccggcaccgataaaaaaagagctttgcgtgtcgactgggttctttggccaatggagataggcattatgctgtaccataaatcttcagaatctaagatctgtgtgtcatgtttcgatgatattacccacccagcgtcgatatagcagaaacgtgatttccacctcacaattaccagttgcttttttttttactccgacctacgcatcatcagcagtacaggcattattatttcccagtagctagatcct

SEQ ID NO: 13225 - DNA, 630 bp, Triticum aestivum
  Clone ID: PAT_TA_13225
ggaatggacagttttaatagccttttagatatgatttcaacaaagaaatttgcctacttttcacagggatatatcccaaattttaaaggacagcccgagtgcaaagcaccatcctgatttgtcaaatcgacagcagccaaacagaaccgaaaatgttcatacaacctcaaacgccaaaaccaatttcagttcaatggacattatgggcgatcatacaacggaataatcaaactccttgggtgctaaacaagacaatcacggtcttgcctggaaaagatcttggagatcgattatatcagcgagaactcctgcggcggtggtgtcgttcccggctcctgcaccctggatcaccagcggggagctctcgtagcatctgctgtatatctccaccacattgtcacttcccctcaacctccccagtgcagaatcttttgggacctcttgaaggcccacttgggcaccctgtctttccaatgacacaaacataggcgcagaacatttcccctcaaagatgctgccttgaccttttcttcaatccgtctcatcaaggtttgccaacccactctcaaagaaatccgttgtggacataactcaggtcctaactcactcggatataaactctcaacattg

SEQ ID NO: 13226 - DNA, 361 bp, Triticum aestivum
  Clone ID: PAT_TA_13226
ttttttttttttttttgaaggaatttcgcaacaatctgctcagcactagatgggtccaggaaaattttgatcgttccagacccgactaacaatctatgtccaccaccaaaactttaggactacagcttgctaggtgcaaaccaaggcataatcatggagggagaggggcggattgactatatgtaccggagtcataacaccactgtccaattcgacgcacacaggattgatactaggtctcgctctccccctcgctaccactcttggggtactgacagacagggcatgcatctgcaaccctatcgcagtcggcgcacaggcacaggtggcggcacggcatcacccggacgcgtgggtcgac

SEQ ID NO: 13227 - DNA, 737 bp, Triticum aestivum
  Clone ID: PAT_TA_13227
gcacacaccgccacgccgcgagcatgccctggccccgcggcatacaccttctcctctgcatcctcacatataacatagagaaaacagtttcttgcgtcctctctcttggtcacaagaaagagatgggttcgggttcaaccaccgtcaggctcatggccttcgcctccgctctcgtgctactgacgcactgcactcacgcggcagcggcaccaagctttcagcagaaacaggcggcggccaagacgtggtgcgtggccaagccatcgacgggcgaggcggcgctgagggccaacctggagttcgcctgctccgagagcgactgcagcgcgatccagggcacggggggctgctccgcgcagaacggcggcgtgctgctgtcgcgggcctcggtggccatgaacgcctactaccaggccagggggaggaacacctggaactgcttcttcaacgccaccggcatcatcagcatcaccgaccccagtctaggcacttgcaagtatgcatgagcccagggggggtcactgaagccgagaaaataagatgtttctaggatatatgtgtctgtcccctagaaagtttagcgtgtttgttttcaccatcagaactgccattgttcgaatcaggcatagcttcagtgtttgagtgatcataagatgtccatcctatgcttttttcttcgttcccaatgaaatcatttcagttgccctggtgttaaaaaaaaaaaaaaaaaaaaaaaa

SEQ ID NO: 13228 - DNA, 484 bp, Triticum aestivum
  Clone ID: PAT_TA_13228
acttaacatgatagtacaatgttgtctttacaaagaaaagtaaagacaaaaacagggaaatccctccaaacacaaaaatcctcaatggtgcaaatagacctaaaagtaagtaaatagatatcgcataacaaatgcgactgcgacaaggatctggaccatcagttcatcaccgacacaagattattcattcattcagagcacccactcaatgtcctcgtcggtgaagacaaaacgtgcgcacttgtgcttgaccatctgaagggtgtgctggtcatcaccggcgccagcaatcatctctacgccgggtgagcacagaaaagcacccgcctatttctccttctgcaaaggtcttagcggtgagaaacttgcggtcgccaaggtagagaagctcgagctgtttcggaagccacgcctctccatcaggcaggttcagatcttcccatattttgggtgctgtgggctgccgtccattgtccatggccct

SEQ ID NO: 13229 - DNA, 1063 bp, Triticum aestivum
  Clone ID: PAT_TA_13229
ttctgtgatacgagtgtaccatacatatttagttttgtaaggacaaaaaattgaagaaagtaccctatcctccaatatctagaactaatccaaaataattactgcagaatttttgttacaaaaatagagcttcatgtccattgaatgataaaacacactgaacactgaaagccttggtgctggtcacttgggtgaggcattaaatggcgtcatatcctcagttgatcaataatcagacaaagccattggggattattgcacatcaacattccaagaaccaaaatatatcttgagcagaccttattcagagatatccaaccctatcaacacaatcaagttggactgtcattcagagtttatggtacatcagtgagagtatttacaggtcaatgcatgcttacttcagtgtattctaatacttgaaactggctttagtgtcatcagcagctcgtagcctgagaatcaaatcaaaggctgagaatcaaatcaaaggctaatccagctagcagcaaaactagaagcagtgatgttacttgctacctagcatggactgccaatcatggattctgggctgtcctctggtaaacccaagcactgctccttcgtaggttgctgattaaaatccccacaagctgatgaggcctatgatgtctttcatggacaaaccagtgtgcccaatagtgacccttgcctccggaataggagctagatgaactgaaattttgactgtttggagatttgctagtttatatacatgaaggcattcctgtaaatctgcatcgcatgtcatcaagacccactctaaatcatcatccaggtactttacaatcaaaaagcttgtgtctactatactcaaacgtcttgccatctcctgcttcagttcttgaaaactacactcaggcttcaatctgaacctgaccttttccgagccaaatgtggcctttattctcatacctgcatctgcattctgttttgggggtgatgggcttcgagaagaatgctgcccacctaaagcctgttggttcagattatgcaacagatctggtgcctcctgaactgggaa

SEQ ID NO: 13230 - DNA, 571 bp, Triticum aestivum
  unsure (1)..(571): unsure at all n locations
  Clone ID: PAT_TA_13230
ttttttttttttaactgnataatcatatttccagtaccaaaatacaggtggtggaccgtcaacggagattttgggcantatttttngggacttgattcatgagtaatctgacttcagttacattataccagtacaaatcttaacttggaaactagtgggacttatgtgctctatgtatatagtgttattatttgcatatcacttctcctctcccaaacggtacatttgaatgcgctttatttgtcacaccaaaaaatgaattgaattgtagtagtgtagtgcatgctttctaacattagttggtgttacatcttgaactgtttgggagttctgcaatcctagagcgtgctgcaatgacgccccatgctgttagtcctcttcgacttcatgaaaaggaagtggaacaaccttcacagctctgaacttccctgcattgtttaggtgttcgttctccagcctgtcgtagttccaaaggccccgtcgaatcacctcaagagctgccaaaaagaacagagttactctagaatccaggcttccaatgttagggtggatgacagtttgaagccaagca

SEQ ID NO: 13231 - DNA, 929 bp, Triticum aestivum
  unsure (1)..(929): unsure at all n locations
  Clone ID: PAT_TA_13231
atgtgttcagttgaacatatggttgatcattcaagattatttcatgggtacattccagttctgtaggtatgatacatgtcctatactcttttgaactgaacgatgcatagaatcaatagtagacactgcaagcacacttatatgactctccattgcatgcaacattttcagcaattgaattgccaaatcacctaatcttcttcagctatctgttgaaaaataaccaaattcatcaagtaatcatactgacaaactccacgcaataaagaattgcttacagcaggacaaaagaacgaagccattatactcatgatcaatgaacataaatttatctaactaaaactaagaccagctagatagatacatttcagaatatatgcatcactttgcaaattctacatctgattacggaaaacgaaaccaattgctttcacaaattagttgaaaaccactcaataataccaaagattacctctataaaaagtcncacccaaattatgagaagcacagtatattagaactatcatgaacatgaaaaaacagtactcaaacaaaaatgcaccacagtttgaatacaagcgaataagtcaaactgataattatttaataaatctgattccacatcaacagttagttcttggcaccagctctccgcagcgctgaacgacctctccccatcgccaagtcctatgccggactcactagtgcgggaggatcgatccagtcgtcgacagcatggtgtgccactcgtgatcaccaccataggcggcgtgccatccctgtcgggcgcaatcaaggaaatcccccgggagtaacaaatggtgtctgttaggatgaacttggacaaccagccgtcaagggcttcaatgcatgccttctgagcgctgacgtacctcacgaaggataacctctggtgaaggaattcatct

SEQ ID NO: 13232 - DNA, 1147 bp, Triticum aestivum
  Clone ID: PAT_TA_13232
gcactacattcaacatcaactcgtattattaactggggttgcgtgataaacatcatcagtcaaagtaggtccttgccgtgccatccttgactccaaagacctccatgactccaaagacgccaagcaatattcagggaaacaaattattagaagcaatctgcagaaatgttcaactaaaatggagtaaagcttaaccaaacaggttcagagtgggtgggtgggatacttacaatgagatgagatgagatgagatgagatgagatgagatgagatgagatgagatgagatgagaccgccgagattgttgtaaaagtaaacagagattgcagcaaatctgatagggatattgacccgaaaacagcagagcaaattataactcattttctgtgggagcaaattataccacatgaatgaatcaaatcaaatcaaatcaaaagaagaaaacaggtctaagcaccctgatctgcaacaaacaagccaagggatctgctctgcttgggcaatgaagatgttccaaactaatcaacgagaaagttggaaaagaagggggaaaaaagtgcataatcaacgagaaacatgcctaataagacggtaatattatattactagtagtacatctaaggcacagcgaattgcaagccatatgacaagaagaatcgtcgccatacatatgacaagagtaaaaacggaattcagaactgagagggccaagatttaataaacgagcatgcaagatggcgcctgcacaagctagatccgttgtttctgcctgcgcatggataaatcaaatcaaaagaagaaaacagatgtgcatcttgcatgcgatttgcggccaaggatttgtagatctgagaaacagaaaccgccgcaaaaaccaaaaaaagaagaagctcgctctcatcctcgccggccggccggctacccctgcaacggcccagcttccggcgaccggcctcatcatcacggatgcggcgccgaccccgtgaatccgtgaatccctggacaggcgcgccgatggatgcagtccggtagtatcactgggcagagggatgaaggaaggcttccctcggagccatggcggcataggctaggctagggtttgcttctgggatgaggaagccgcgcgccgcttctgcttctgcttctg

SEQ ID NO: 13233 - DNA, 482 bp, Triticum aestivum
  unsure (1)..(482): unsure at all n locations
  Clone ID: PAT_TA_13233
gactcggctcccccaaagaagctgggggcctcccccatccctttcttcccccttgcccccctgccggtggtgtcctccggtggggccatcccccaggtctggcggccttggggcctccggggcccggggggtggaatcccctggccgggccggggccaggttggggtggccccccaccagcaaatgtgttcccaaaggatgccagtgcgaagcatgctgggcaagaccgccgagctcggcctccaacccccccacggggttggccccctgggccttaaaccttttttctcggggtttgtgtgtggtgggaatgttgactctgtggttggtcgtgggacaacagtgagggcaagcgtcaagcatccactaaaaaaaatacttccgaaccattctccccacttgtccccgttcgttctcaaatactcctactctggggggtaaacccttggggttttnccaaaanttaatcccccctngcnana

SEQ ID NO: 13234 - DNA, 452 bp, Triticum aestivum
  unsure (1)..(452): unsure at all n locations
  Clone ID: PAT_TA_13234
cggacgcgtgggctcccagcaaaaaaaatagtcctcgcctggctcagcatctctatccaatcctcccttcccttctctctccacctctctctttccttctctctctctcgaagatttcttgtcctcgtctgtgcgctccggctcggcgtggtcaatctctcggcggacgcacccacccgccgatccgcgcgtgatcctccgtgattttcgctggatcttgcttagctagctgcgggtgcgcgcatgtcgacggcgctggcgccggggatggcgcgggggcacgggttccgtggcgcggggaaggggaagcagcggtcggattcggaggagccacgaaacgagtcctgcgcgggggccccaacgggttctacggtgaggaggagcgggggggggtggttggganggatganctgctggnagctggnggaggcgctctccgggntgncctcctc

SEQ ID NO: 13235 - DNA, 599 bp, Triticum aestivum
  unsure (1)..(599): unsure at all n locations
  Clone ID: PAT_TA_13235
gcacgaggccctcttcggcgacggcggatggcctccgcgtcgtcggcggcggcgtcgctccgcctcctccgccgccctatcggcctcaccccccttcgccccggccgccgcctcctctgcgtcgcctcccccacggccgcgctggccaccgacggcgactcctcccctgcttcttctgcttccatggcgcagccgacagtggtggatgtgaacccgccgcgcggcaccagggacttcccgccggaggagatgcggctccgctcctggctcttcgacaacttcagggaggtgtcccgctccatggccttcgaggaggtggacttccccgtgctcgagtccgaggcgctcttcatccgcaaggccggggaggagatcacgcagcagctctacaacttcgaggacaagggcggccgccgcgtcgtgctcnnnccagagatcacgccttccctcgcgcgccttgtcatcaagcaaggaaagtcagtctccctcccactcaagtggttcaccatnnnncaatgctggcgatacgagcgtatgacaaggggnnnnngccgcgagcattatcagtggaacatggacatttnnngtatgcctaaagn

SEQ ID NO: 13236 - DNA, 250 bp, Triticum aestivum
  Clone ID: PAT_TA_13236
cgtccggataactttgcaaagctttcagaagcattgtatgttgcagagcagaaggcgagggaagcagtgcagatgcgctccaaggtgcagagggagctaatgctaaaggagaaggagaggaaggagcaagagttgagggcacttgcacagaaggcccgcatggaaaggtctggtgctccacctccatccacgggtatgcctgttggaggtgggagggagagagagcgggagagggttgatgatggcgatg

SEQ ID NO: 13237 - DNA, 1492 bp, Triticum aestivum
  unsure (1)..(1492): unsure at all n locations
  Clone ID: PAT_TA_13237
gcgtccgcgtcctccctcctctcaggnactcagggtgacctccctccacccgcaacgcgttcgccgccggcgccgccatctccaccgacaccgcctcccccttccaatcctccctcctttccatggcgtcgccgtcgggaagcgccggggacctagcagagccttgcgggggcgcctcctctactatctccccaatccggccgatgctctctgcagctcctcctcctactgttctcccgtccgcgtggaggtgggcggacgcgtgggcaattgcaggcgcatttggagaaggcatgatgcatccagttgacaccctgaaaacaaggcttcagagtcaagctataatgtcaggcgctaaggctcagaagaatatttttcagatggtcaggacagtttgggcttctgatggactgagaggtttctacagaggaattagtccaggcgttactggttcacttgctacaggtgcaacatattttggtgttattgaatcaacaaagacatggctggagaacaataatcccaatcttagtggtcattggtctcactttattgctggaggaattggagatacacttggatcttttatctatgtgccttgtgaagttatgaagcaacggatgcaagtccaaggctccagcaaatcttgggcactaaatgctacaaaaggaaatgtttctcaatctcctggcactcagatgtatgggtactataatggaatgttccatgctggttcttctatctggagagatcatggtgtgaagggactctatgcaggatatgggtctacgcttgccagggatgtcccgtttgctggcctaatggtaactttctatgaagggttgaaagaacttactgtgtatgggaagaggaagtatttgccagacagtgatttacaagtcagcaactcttttgaagggcttgttctaggaggattatcaggcggttttagtgcatacttgacaacccccttggatgtcatcaagacaagacttcaagtacaaggatcaacaactaggtacgatggatggctggatgctgtaaaaaagacatggaatgctgagggagtgaatggcttattcaagggaagcgtccctcggataatatggtatatacccgcatctgcattcacgttcatggcggtggaattcctgagagagcatttcaacgagaagatcgatatggatgcggagacggccttgaactagcctacctgctgagtctgaggctgaggtgcaagagagaattgacccagaggattttttggtttgtctgacagcggagttccatttggctaatgcaggagtagatatgcattttcagcaatgcagaaacatatgtaggtagaagagaggagtagagctggctgtccttcgttaagtcggagatttttgggagttagagaccagccgtcttggagctagttgcctgtaccgattccgtttgtagcccctaccatttttgccacattaagattctaaatgcagtacga

SEQ ID NO: 13238 - DNA, 751 bp, Triticum aestivum
  Clone ID: PAT_TA_13238
tttttgttcttgtttttccggggcccaaggggtcgcccccaccaagtaagtatcgtaatagatgatgccgctacatcacagttccaagtttctcaatctcacatatactggcatctcgcccttgtctccagaacgccccatgtactacaatagttacatacatcccatcggtccgcaactagctatctggcactgtgctacctaacagctattcaagtttctgtttgcgatcccgagctttcggtggcaaagtttccattcctcttcatggaagcgctgatccagacgtcgatcgactaggtatcttcttcatggaagcgctgatccagacgtcgatccactaggtatagtacctgctaatcgaacttctgctcggttggcgcctcaagcctctgcagcagagccttcttttcctcttcggggagggcgttgaatatgaaaaccgacttgtcaccgatgtcatccttgatgggctgctggaatttccttgctgcaaacacggtgaagagcgccatccacactcctaagaggctcatttttgtcccgtcgtccatcaaaccagacaggtgtccaagaagaaggatggggataacaaacgtcaagataccagcttccagttttccatagcagagaccttccttgaagacgaggcctgtgagcgcggcgaaggtcggcccgacgaaccacatcgccccggggtgctccagcacgtaccggaccagcccctcgcgagcggccgcgcggcgagggc

SEQ ID NO: 13239 - DNA, 686 bp, Triticum aestivum
  unsure (1)..(686): unsure at all n locations
  Clone ID: PAT_TA_13239
gnattcctngctcgaaatnaaccctactaaagggaacaaaagctggagctccaccgcggtggcggccgctcgtgcgcttcggcacccccccgccgccccgatcccccccccccgatcgccgtcggccggccccccagatccagcgcgaatggccactctcgtgttcgacgcggcggtcctcagccggaaggacgacatcccgccgcagttcgtctggccagccgacgaggccccgtccgtcgacggcgtggaggagatcgccgtcccggtcgtcgacatcgccgggttcctggcgggcgacggcgctgccactggcggcctccgtgacctggccgccgcgtgcgagaagcacgggttcttccaggtcgtgaaccacggcgtggacccggcgctgctcgccaaggcgtaccggtgctgcgacgccttctacgcgctgccgctcgccgagaagcagcgcgcgcagcgccgcctcggcgagaaccacgggtacgccggcagcttcgtggggcgggtcggcagcaagctcccctggaaggagaccgtgtccttcaactgctccgccgcgccggagggcgcccgcaaggtcgtcgactacttcgtcgccgtcctcggcgaggagtaccgtgacattgggaagaggtgtggcaagagtacttgcgaacgagatgacgcgccttggcgctggg

SEQ ID NO: 13240 - DNA, 291 bp, Triticum aestivum
  Clone ID: PAT_TA_13240
cggcacgcggctcggtcgccgccgccgctgagatccgagaagagtctcccttcgccgccgccaagatcccgtgcctctctacagatccccctctctcttcttcgcccatccacctagatcgaaaaccgtcgccccttggtcgctgctggtgctcgagggaagacgagggcggctcctcccggcgattccgcgtgcgagtataaatccagctcggtatgaatcgctgttttttttcctatgttgtaatctgatacacatgcgagtataaatcaaagttttcccatacagcct

SEQ ID NO: 13241 - DNA, 877 bp, Triticum aestivum
  unsure (1)..(877): unsure at all n locations
  Clone ID: PAT_TA_13241
gaggcgagatctatcggcgatacatggatgcggaggggatgcgtcaagtatcacgtcgggtggttgaacatgcctcggaggaggagcggagtcggatcttagggaaggccccactcgaaatcctctattgggcggtgatggaggcggagtccggcgatccgatgcggcgcgagcagtggcaccgctacttgtcgtacgattgggtttcgtccgacccaatctgggataatgtgcgggtggtgaccatgactgggaggtcaccgccacgcagtccgacgatgcccgtcctgactgacaacgacgtgcgggtgttgccgagtcaaaatgttgcccaggtggtttcacagctgcctcgtcgctcacctcggtttccccggcgttctgcgcggatccaggcacttgcacagagcgccgccgatgagtaggcgccttctcggctggcagccgattctggctgctgtccgggngaggagtccgacgatgaggactcctgcgaccgttttgttgcttcgttttcgaataaagaagggaaatcaaagggtgttgacgctgggagcaaaagtcatggagcaggtggcgggtgaagcatacagtgcatcgcaggggtggcgtcgtctgggggttccaaggatcactggctgaacttcctcgactggctacgtccctggcatggtgcacagctcctatgtcggccttgcttctggatgcgttgaatcttctttgatgatccatttatcagactgagttttgccaccgttctttggttaaactgttgtgcgactttggtgtgtaataataaattggagtttagggatttgctgcttgtttagtcgctttgctattcagtatgaggggctcgtgatggatcgaaccaatt

SEQ ID NO: 13242 - DNA, 412 bp, Triticum aestivum
  Clone ID: PAT_TA_13242
tggtggtgcaggtggcctcggcggtctgggcggcggctccggtggacttggtggccttggcggtggctcgggcggacttggtggactcggcggtggaggaggcggccttggtggcgtcggcggtggaggaggcggccttggtgggctcggcggtggaggcggcgggctcggcggtggaggactcggaggtggtgccggtggactcggcggtggctgcatccacccgtgaccgtgacatagatcacggtgcatgcagtacgtacgttgcatgcatgcatgcatgcggaggggcaacggtcaaggtcgaagtagggtcaacgctgcatgcatgcaggccagattgtcagtaggaagtgtatccacgtgttgatgatgtgatgttgaaataagcatgcacgtacgtgtacacgta

SEQ ID NO: 13243 - DNA, 783 bp, Triticum aestivum
  Clone ID: PAT_TA_13243
ttcgattcggacgaggtggaagaggaggaggaaggtgcagacttgggggaccttgatgtccccgggaatgggctcttgggagggtcaagctcggtcctcaggtctgcccggaagcacttcgacgacgacgatgaactatttgaggattccatgtcactaaagaattttgggatttctgatgcttgtctggctaccctgtcctctcaagatattgatttttctgcaagcccaaagatgcctgacagaaaacttggaagtgttgatgatgaccaaaagatcttggaggaagctgaagaacccacacctccccaaattgaaacctatgagcaagatgacaatgctttccaaggaatgataagggcgtcgaaggaggagtacgataaacttcctccttacatgaagactcttgcatcatgggaggaattgcatgacgccgtttcaaaactgaatgcatactttggtggtgataaggctcagggaagtttaaatcaggatgatgttgcatcaatcggcttggggcgcaaaggaagatcctacttgttgatccttctgcggttgaatcaactggctatggagacgattgatggctcaatcttctacaacctacgcaagaacgactcctagatgattttttcagagaacctggggaaacagaaggggatatactgatactgcttccatactgtaatgcgttttgatgtagttagtctggtgcataacttgttctctcctaaggcattggcttggatttgattgcactactgtttttagaatagcttggtt

SEQ ID NO: 13244 - DNA, 686 bp, Triticum aestivum
  unsure (1)..(686): unsure at all n locations
  Clone ID: PAT_TA_13244
ncaataanaacatttgttcttgctnatgttcgtggccttatgcgttgagnttgcgcanatttggccagcanttgcatctgcgcgtcccntctganatgctgtttccctcattctgcgagctcggtcgcgagggtctgcacgctgatttgatctcatcaatgccggctcccagatcagcaatggcgccgtctgtgcgctcgtcgcttggcttggggtcgttgcagtcaccgcgccgcgtcgacgacgagatcacgtcgtcttcttcggagattatctccggcgatgacctcctgctggatctcggagggacatcgtccgcgacgctctccggcgcctcgaacttgtcgtggacattgggcatgccgcattgcgctgtgtagctcggcgcccgcgggagacggtgggaggacgaccggtgcagcctcggcggcaacgcctggtggctcacgttggaccgcacccactccttctccctccggatcacctcccctatgtccgacaccgtcctcgccggcctgctgtcgccgacgtcctcagaggcatcgagatccgagcacagctcctcgagccgcgccgccgggagagaggcgttcctccccgacgacacgtttttctgggccagccttcttagccaggggaggtcgatgacgccgtcccggccggggggcgggcgcgtaaggaccatt

SEQ ID NO: 13245 - DNA, 2328 bp, Triticum aestivum
  Clone ID: PAT_TA_13245
ggcacgaggaggtatgtgggtccagctcagccaccttcagggatacccacgcgtccgggggcccaagggttatcgaggcagagtgatgcttgctttcgaagaaaatggatcgtctaaaattggagtccgattcgacaagcagatccctgatggtaatgatcttggtggtttgtgtgaggaagatcatggcttcttctgttctgctgaattgctccgcccagacttttctggtagtgaagaagttgaaaggctagctatgaccgagttaattgaggtcatctcagaagaaagcaaaattggttctctgatagtgttactaaaggatgtagagaaatcattcactggaatcacagaatcattttcatctttaaggaacaaacttgaattgcttccacctggtgttctgattataggatcccacacccagatggacagccgtaaagagaaggcacatcctggtggatttctttttacgaagttcgctagtagcagccagacgctcttcgaccttttcccagacagctttggtagtcggttgcacgaaaggaacaaagaaagcccgaaggcaatgaaacatctaaataaacttttcccgaacaaaatttccatccagcttccacaggacgaagcattacttaccagttggaagcaacaattggatcgtgatgttgaaacccttaaagcaaaatctaacatcggtagcattcgtacgtttttgaatcgcagtgcgatcgaatgcaatgaccttgaagaattattcattaaagatcagtcactgactaatgaaaatgtggacaagattgtcgggtacgctgtcagttatcatcttaagcacaataaagtcgaaacctccaaggacggtaaacttattatcacgagcggaagccttaagcatggcctcgacatgctacagagcatccatagtgataacaagagctcaaaaaaatcgttaaaggatgttgccacagagaacgagtttgagaaaaggcttctggcagatgttataccaccgaatgatattggagtcacctttgatgatattggtgcgttggagaatgtaaaggaaacattgaaggagttggtgatgctcccactgcaaaggccggaattgttctgcaaagggcagttaacgaagccttgcaagggaatattgctcttcgggcctcctggcactgggaaaactatgcttgctaaagcagtagcaactgaagcaggcgccaacttcatcaatatatcaatgtcaagcattacatcgaagtggtttggtgaaggggagaaatatgtgaaggctgttttttccattagcaagtaaaatatcccccagtgttatttttattgatgaggtcgatagtatgttaggaaggagagaaaatcctggggagcatgaagccatgcgcaagatgaaaaatgaatttatggtaaattgggacgggttgcgaacgaaagataaagaacgtgtactggttcttggtgccacaaatagaccttttgacctggacgaggctgtgattaggaggttcccccgcaggctaatggtaaatttacctgacgcatcaaatagagagaaaattttgaaagtaattttagcaaaagaagagttgggacaagatactgatctggagtcacttgctaatatgactgatggatattcaggaagtgacctgaagaatctatgtgtaactgcagcgcactaccccattcgagaaatcctagagaaggaaaagaaggagaagaatgttgcaaagtcagaaggtaggcctgagcctgcattgcatggaagcgaggacgtccgtcctcttagtttggatgacttcaaatctgcccatgagcaggtttgcgcgagcgtgtcatctgattcggcaaacatgaatgagcttgttcaatggaacgacctctacggcgaaggaggttcaaggaagaagaaagcactgagctacttcatgtgagagcaagaatgtgccatattgtacagtcgctatactacccctccctcctcggcaggtgcatcttggcgacttgtccggccaaaaccagtcgggtttttcctcctctccccttcaggagcagcggccgcctaccatcctgatcctcctccctcccgtgtaattaaaattgtgcaccgagtctgggttatttatcagcttctgtttgttcctattaacttcaaaaaagagaatcctccatcctcctctcttgatcacctacctgtttgcagccaattgtcgttgagcttggctataggccccttgtgtgcacctatgtacatgtttaatgaaagggcatggaataagaaccttttcctcttgtagacagtcaaaaaaaaaaaaa

SEQ ID NO: 13246 - DNA, 1725 bp, Triticum aestivum
  Clone ID: PAT_TA_13246
tcgtccccggcttccgcttctcccgctgcagctacctcctcagcctcctccgccccgccctcatccgggagctggagctggagaggcacgggctggggctcctgccgcggtgcccctcgtcgctcgcgccgtgccgcgacggccggcaccggcgccgcaggcggggcccgacgcgcaagcgctcccatagcggcaagttctccaacaaagatgcagaggcatacccgaggtacgaggagcagctagagaagttctgcaagctcatggacttcgtcatagactcgcctccgccggagctgaggcagctgtaccatgcctccatggtcgacaggatgaaggataaggtcgacaagtcagtgttctggagcaagcttcttggcctcgtgatgcaacaggggcaacaggacatggtgaacttcttcggcctgcccctgccgccggcgtcgtcggtctcggcgcgctggtttgagggtgatgtattgaaggcgaccctggcgactgatgccgtgataggtactatggctggtgtgaacactccaggatcaggatatgttctcctgcaccacatcatgggggaaactggtggtcaacgtggtgtttgggcgtatgtcgaaggtggtatgggttcagtctcatcagctataagcaaagcagccctcgaagcaggcgtgcaaattgtaacaaatgctgaggtttcgcaagtaatggtcgatgaaaatactggaaaggtgcaaggggttgctttggctgatggaaccgagttgcactcatcagttgtgttatcaaatgccacaccatataaaacatttgtggaccttgtgccagccaatactcttctagaggagttcctctgtgccatcaagacagcagattatagctccgcaacaacgaagatcaacgttgctgttaatgcgctgccacagtttcgctgttgcaaaaacatcaaccctaaaggtggcccggagcacatgggcaccatacacattggatctgaaagcatggaggaaatcgatatagcatacaaggaagctgcaggcggcttctcatccacaaggcctgtaatagaaatgacaattccttcagtcttagataagaccatctctccaccaggtcagcatgttattaatctttttgttcagtacacaccctacaaactgtcagaaggcagttggcaggatccggctgttagaaaatcatttgctgagagatgcttttccttgatcgatgagtatgcaccgcactttagctcatcagtgataggctatgacatgctgactccacctgatcttgaaagggagtttggcctaacaggtggcaacatctttcacggagcgatgggcttggattccctcttcctaatgaggcctgccaagggatggtcagattacagaacccctgtgaaggggctgtacctctgcggcagcggtgcgcacccaggcggcggggtgatgggtgccccgggccgcaatgccgctgctgtggttttggatgatctcaaggcaagatagatgcaattaatggaagatggaaatggcagctgacactagggtagcattttcaagcacaaggctgcatgcaaaagcagcaccagtgtgtaatcttgtaccgaaatgcgaaccttgtcgttaagccatctggtagagaccattttgtcatgcatacttacatgataaaaaagatgagacatgagaagcattttttgaatgaattgttgcagctgttctc

SEQ ID NO: 13247 - DNA, 595 bp, Triticum aestivum
  Clone ID: PAT_TA_13247
cggtcccgcaccccccctttccctcctagcccgcctcgctcttgcgcaatacaaagaggctgggttggcagttgtgagaacggtggccgaggggttgggtctccgagaatgcccatcgcagaacacgaagcgtaggcccttgcaacggttatctgataggagcggtgcttggctgtgatgggttgctcgatcgcgaggcctttgaaacggtggtagggcgccggtgaacaagaagccctagcccagtgttgccggcaactacgaccgatagcaaagcagtgccgatgtgaggccctttggtgagccgtccaagggaaccttcgtggcatctttggttttcagcaaggccagacagccagacaaattaaccgagccaagacatagccctccaaatgcacactccaattgcaacttcgagtctggcgccaatttcggcccttccaagtgatattaccattgttgtcgccaattctgctgacacatgccctggcatataccataggatgtgacaagtagatgtggtcatgaataaattatatgaataaaatatatgtaggtttgtctcgcaaacatctatgtaaatgtgaatatgagt

SEQ ID NO: 13248 - DNA, 1551 bp, Triticum aestivum
  Clone ID: PAT_TA_13248
attaccaaaaaaaaaaaaaaaagaaaaaaaatatgaaaaaaaaaaaaaaaaaaagggaccctcccccaaacccctccccgctctcgcactcgtcgccatgtcgcccgccgccgccgccgccagagccacatccttcgctgccaacttcaccacctccaccgccccctcctcgggcggtcgcctcctccgtccgttctgtgggaatccgcgcccccgccgcgccgtcgcctcgatggccgtgtccgctcccaagtcgccagccgccgcctcgttcctcgagcgccgcgagtccgagcgcgcgctccacttcgtgaagtaccagggcctcggcaacgacttcataatggtcgacaacagggattcggccgtaccgaaggtgacaccggaggaggcggcgaagctatgcgaccgaaactttggtattggtgctgatggcgtcatcttcgtcctgccgggggtcaacggcgcggactacactatgaggatattcaactccgatggcagcgagccggagatgtgtggcaatggagttcgttgctttgctcgctttatagcggaggttgaaaatctacagggaacacatagcttcaaaatccatactggcgctggattaattattcctgaaatacaagacgatggaaaggttaaggttgatatgggcgaacccattctttatggaccagatgttcccacaaaactgccatccaccaagaatgaagctgttgtaaaagcggaattggcaattgacgggctagcatggcatgtaacctgtgttagtatgggcaatcctcattgcatcacgtttggttcaaaagagttgaaggttctgcatgttgatgatttgaagcttagtgatattgggcccaaatttgagcatcatgaaatgtttcctgctcggaccaacactgaatttgtggaggtcttgtctcgctcacacctcaaaatgcgagtttgggagcggggtgctggagcaactcttgcttgtgggactggtgcttgtgccgttgttgttgcagctgttcttgagggccgagctgaacggaaatgtgtagttgatttgcctggtgggccattggaaattgagtggagggaggataacaatcatgtttacatgactggtcctgctgaggctgtcttctacggatctgttgtacactaggtgctggggatgaagatggaagggttacataactcagagcctgaaaaaatgattacaaggtctttcaaaacactttcctggtaccagtgtccctcccttcttgataatgactgctcactgtgggcaaaaacgagggaatgctatgggcagaattagaggctttcttttgaaccaatttaggtgtattttacattttaaccttttgtactccttcagtatcatgttagaaccctgtgttgggttatggatctgtcctgtcttctttctttgctaataagcttgggctgcctatgcatagcttgaatattgttgtctacaaatttaccttgatttactgcataatgattgggcttatctgttaattggtgagatttggtattatccccaaaaaa

SEQ ID NO: 13249 - DNA, 854 bp, Triticum aestivum
  unsure (1)..(854): unsure at all n locations
  Clone ID: PAT_TA_13249
gtcctccaggtcgatggagtcctccaagaagaaccgcggcgagatccaccgcggcgacggacgcggcaggcgcgtcctcgccgcctccctcctcgccgccgcggtcgtcgcggccgtcatcgcgctcgcgctcttcctcgtctaccgccccgcgaagccgcaggccaccgtggcgcgcgccggcgtgtaccgcctcgtgagcgccgcggccgcccccggcgccaacaactcggcaccgacgccctacgcgctctccgccaccgtgcagttcacgctgctgctgcacaaccccagcgaccgcaccgccgtggtctacgaccggctcctcgcctacgtgacgtaccgcggcgagatggtggccccggccggcgcagctgcccgctgggtgctcctatggacccccggcggccgacgtgggcgagtgtccccgccggctggggcggcggcgggggcggccccgcacccgtactgcgtggccgcgcgcgtcccgctccgccccgtcggcatggggcggcgcgggcacctccggggccccgtcaagggcccgtgccgcgtcctggtccgggccgtgcgacgccgcccgccgcctcaccgtcctgccagctgatgccatcctcggcctgaccgtcgcacgcagccgccggagccggcggcgccgggggcgtgcctcagcttgtgtcgcgccagtgctcccaagttgcccgagccagtaacagtccagccagctgtggcaagtttcagtgggcaataacagaataatgagccctggacccatccgttgtgcttgggaaccgcaacnccananctccggagcanaacaatccgcaacacaagaaatcaatttcaatcaaaan

SEQ ID NO: 13250 - DNA, 830 bp, Triticum aestivum
  Clone ID: PAT_TA_13250
cgattcggcacctcgagatctctcgatctaggtagcggcggtggcggtggcggtgggcgttgccatggaggagcacaagccgctggcggccatggtggtggtgcagtgcatctacgcggccatggcgctgtgggccaaggccatgttcagccgcggcatgaaccccatggtgttcgtcgtctacaggcaggccatcgccacccttgtcctcgtccccatcaccgtgcttgccaacaggaagaggctgaaggagattctttgtatcgggacgacaggcttcgcgctggtgttcttggcctctctcgtcggggcgacggccaatcagtacatgtactaccaaggcatctacctgggatcatcgtccatggcgacggccatgacgaacctgataccggcgatcaccttcgtgctggcgacgtcagtagggcgagtaccccgccgggatctgcaagccgcgagccgccgccatggcactcggcacccccgtcgtgcgtccgcggcgcctcggccaggtccttcctctggggccccaagctgctgcccggcccgctgcgcgtccgcggcgccgggctcggccgcctcgccccgctgcctcccgacgcgcccccgggccggtactgggggatgggcccgctgggcctcgtcggctcctgctcctgctgctccctctggctcttcgtgcgggtgcccctctgcatatcctacgccgatcccccgacgctctcggcctggctgggcttcctgtccccgccgctgcttgcgttgctcaactccttcgtgctgccggacctcgacgcctggaagatcaactcgctcttcgagctcatggg

SEQ ID NO: 13251 - DNA, 312 bp, Triticum aestivum
  Clone ID: PAT_TA_13251
attcggcacgaggcacttagttatttataggacaaccaattaccaataattcgacaattacaatgaactactcaagatgggcagaattcggtggtggaacctctgtagaatggtggccagatgattgcacaaagcaattcacacacacacatgaacctttatcacagtaccctttcgtaccaccaaagagacgacaccactcaaaacatttgacccaattatcacaggagagcttgatgcgttcctcgcgacacttcccttgaacctcgtcaaaagacacaaggagcatcaatatcgacatggatgccacct

SEQ ID NO: 13252 - DNA, 592 bp, Triticum aestivum
  Clone ID: PAT_TA_13252
cgattcggacgagcaaatatagcacaagtttttcttggaggttcttatctaggagtagaaactagtgagcgactagagatgtcactcttatcaccaccaccaccaccaccaccattgttggtcacaccatatgggtcaacaggaggtggtgattcgtccgtttcaatcgacccttacgtaccattgatcgtgactttgatcatcattgccgccctcatggttgcctctttggtttttgcaaatttatgtgttaagcgttgggcattcttcaacagttcatatgctacacagtcattcgtgaagcaagaatgtggcatgtgcactcgtgagggcaccattgatgttgcttatcctgtgatgaagggtaatgtggagaatgtggcttcagaggagttggtggagtcagatccaccacaaaacgaagaggatgacgaggatggttcttccgaagaaggtttttaagacatcaattaatctatgttttacttatctagaattttctagatattatgttatgttccctcgatgctttgttcaaagagatttggatgtgttttggaagcttgatcctactggtccaaaggataataaa

SEQ ID NO: 13253 - DNA, 587 bp, Triticum aestivum
  Clone ID: PAT_TA_13253
gattcggacgagacccatcttaaaacagtggtgtttaagatattcataggctatgagaaacaggttaactttgcgaggttctttcttgtgaatgccaaagcgctaaacaaaattgaatttgaagtatatggtgcgtgcgatgctatatcggtggcttattaccatagtctgctacaagtggaaaagagagcttctcaagatgctcaggttgaattcaggagtgaatatcaacgtactgggtacgataaccatgtccatgatttgtctgtggccgaccccttcggacagccatagacagggctgaacctgaagattgcactgtctagtgtcttgtgctcattttgaagacaaagttgatgcccaagactacatcgtcttctatatgaatccgctcaatttctagtctaaagttcttctgcaattccagtacttatgagcttgcccctgttaaaattgcaaaagtttgtggagaagttcaaatggtttgtaaccgggaggcacctggtaactcctcttaccttgtgaatttgtgactttgttctgcctaaggtggtttagaaacacatgcatgtgttggaaacttgatt

SEQ ID NO: 13254 - DNA, 964 bp, Triticum aestivum
  unsure (1)..(964): unsure at all n locations
  Clone ID: PAT_TA_13254
ttcgaattcggcacgagacgcatcccatcccccctcgtcatcccggatcccaccggacccgaggcgtgagggtgcggcagcgacctgcaagggaagggcgacgctcgaatcgatccagcgccatggatcggtccctgcggaagaaagagaagatgagggagagagaagtaaggagaggaaggagaaagagagaggaaagaggagagggaggtgcagcgttgaccgatggctcgcgccatggtgcggcagacggccatttcgatgagatccaccacctctcgaggttctcatctgccccaggttgcgacgaagccgcgggaggtggagagaactcgatgcgaggaaggtacggaggaggatctcaaccagcgtgtcttcagccggaggagggaagcagcggatgcgagctaggaggcggatcggctcggcccagccatggagctgccgctgcggactccccgccggcctccttcgtcgtcatgtggatttgcatggcaagtgatgttgcgttgccaatgacacatctggaattgccgttcgtgactcctgtagcgggtcctgtgtcttcctgtgcatgcggtcgggggcggcctggaaaccggcatcagcgccgcgatgcgggccgccgcttgtccccttttcgtctgaggcagttgttgatcgggcggttccttgagctcatttccgcgaagtccttgatctttcggtgtccgccgctctcgctcccaagtttgggttgcttttcttatatcattattttgtagtctgcttcacagtgaacttgaatgaagaccatattgttatctaattgtgaaagcactgagctgctgctacgcgcactaagaagattgactgcccatgtggcacagatatcctgaatttccttgtaatggntgggtcctgcatacaagtgganaaatgtcccggatttctttaanggtgggtccgcaaaaaacttaacana

SEQ ID NO: 13255 - DNA, 1055 bp, Triticum aestivum
  Clone ID: PAT_TA_13255
atgaattctgcaatacctaggcttgaggggtaactcactgactggaaccttgtcacctgacatgtgccaactcactggcctgtggtactttgatgtgaggggcaacaatctaacaggaacaattccacagagcatagggaactgcactagcttcgcgcgtccggacatttcctctaacaaaatctctggagaaataccttacaacatagggttccttcaagtagctacactggcacttcaaggaaatagactgactgggaaaattccagaagtgattggcctcatgcaagctcttgctgttcttgatctgagcgaaaacgaactagtaggggccattcctccgatactcggcaacctgtcctacactggcaaactatatttgcatggcaataaacttactggtgaagtacccccggaacttgggaacatgactaaacttagctacctgcaactgaatgacaatgaattagtgggcacaattccagctgagcttgggaaacttgaagagctattcgaattaaatcttgccaacaacaatcttgagggtcctattcctacaaacatcatttcttgcactgcactaaacaaattcaatgtttacggcaatagattgaacggttctatccctgctggtttccagaatttggagagtttgactaacttgaacctatcctcgaacaattttaaaggccatatcccatctgaacttggtcatatcatcaatttggacacactggatctttcctacaatgaattctccgggccagttcctgctactattggtgatcttgagcatcttcttcaactaaatttgagcaaaaaccatcttagcgggtcagtgcctgctgagttcggaaacttgagaagcatccaagtaattgatttatccaacaacgccatgtctggttatctccctgaagaactaggccaacttcagaaccttgatagtttgattcttaacaacaatattttggtcggggagatccctgctcagttggctaactgcttcagcttaaacatcttgaacttgtcacataacaacttttctggacatg

SEQ ID NO: 13256 - DNA, 491 bp, Triticum aestivum
  Clone ID: PAT_TA_13256
tcgattcggacgagggacacaaagtctggacagtaatccatcgccgagcagccccgagaatccttaccagcaagcctgttgttatatatgtgtatatatatgtccatgtcggccatgatcagtcagtcgagtagatcactgccgcctttggtgatgatgctaccatattatcttggtgtcggtcttattttcgtcattgccgtgtttagttcagctttcgggaggattctatttggtatcagttatttctgctagctactgtcggtctaacgcactgcagtgtttctgctagctcgtgtgtattggcattgtcagtatcagtatgagaaataaatagaagagtacccagtatatagcacgtatatctgcagtgactgtatctggatgatatcgatgtacagtatcctgttgtgtctatgtataatgtaccccttattaccatgtattttaggcaactgtacttgtttgcttactttaaaaaaaaaaaaaaa

SEQ ID NO: 13257 - DNA, 467 bp, Triticum aestivum
  Clone ID: PAT_TA_13257
cgattcggcacgaggctcaatattaataggatgttattttgccccgcgggtccttacaccgatacaatgttgtcggtacgagagaaatacattaattagacattgttttattctatttaggcagaaagggaagaaagcgatatcctttaattccctgcaggcgcaatctgggctgcagacgattgagatgcaggtggtatcacgcagactacgcaccagcatccgttatcggcacatacaccatataccgtgtccgccttatatttataggtgcacagtgaggtgcatgaagctatgcttggacatgccttggagacgttgtactgggcacagcgagcagcgatgcctgaacagagcaccgaaaggacaaggcatatgagcaccacctggacagtcttcatccctgatttgtagaaaaactatgttatgtagggagatttttgttttacttaggagttgtgtttccg

SEQ ID NO: 13258 - DNA, 547 bp, Triticum aestivum
  Clone ID: PAT_TA_13258
ttcggacgcgccgctgcctaacctcgctacaatcagacagtttctggctacgacacggcacgacgcgacgcgaggctctcgagagcgcgagcgagatcgtcgtctgctgcggctagggaggtgtcgtcggtggtggtctgcctcatgggctccgccatggaccacgtcggcgcggcgggcgggagggccaagaaggcgtccggcggctcgcagctgtggaagaaggcgctgctgcattccagcctctgcttcgtcatgggcttcttcacgggcttcgccccctcctccgtctccgactggcggtccgtcgcgcccgccggggtggggagcagccacgtggtgaagacgccgcaagtgatcgcgtcgggcgcggccatggaccggagcctgctggcgcgggacgcggccgcgagaatcgggggcgtcccgcggcctctcctggtggtcgggacgacgaccgagtcgacgcctacggcggccggcgagcgggcggcgatgctgaccaggatggcgcacaccctgcggctcgtgccgccgccgctgctgt

SEQ ID NO: 13259 - DNA, 435 bp, Triticum aestivum
  Clone ID: PAT_TA_13259
cgaattcggcacgtcgaaaacaaatacttgctaaagcatagttcggtacattgccaatttattctgttacaacaaaaagacaatcttcctaggagctcaaatctttccatggtggtgtccaccaaggcacaagtgatgtatcttcatggctgccccagcggcggaagagtccgatgatcattaacaggtataacagacgcattgtttatcatggcacataccacccatgtactttggtgcctcatattttttacaagcacttcgacaattgtcgttgtcataatcataatctgtctcgcacctaccatgatagtaaggatgagtcttgtacatgcactgcgggccagcttcagcagtaccgaggcagaggaagaatgctaacaccgatagagacaagactactgccatcttgctggccattgtgaaagcttggaa

SEQ ID NO: 13260 - DNA, 411 bp, Triticum aestivum
  Clone ID: PAT_TA_13260
gattcggacgagtcggactgcggccgttgattgcagtggcagagatagctattcgaggccgggtcgactcggaaacggtcggtgtgatcgggttagagccggtgataggcgacttgacggcaaccggcggaggtacaagcgcgacgaagcggcaccggtgagctggatgcgcaaaccggcgacagcggaggcgcagcgtttcgacgaagcgagtcgcaagaggagtccaagcccggagacatctgcttctgaatcgtggccggctcaatgaatccacgtccgtgttcctttgtaaggacagtagccccctttctttgcaactttgacttttctctccatctacatcttgtaagcagatcaaacgtgactcgccatatgagaaataatagctcgtgccgaatgctgcagccc

SEQ ID NO: 13261 - DNA, 341 bp, Triticum aestivum
  Clone ID: PAT_TA_13261
cgtccgcggacgcgtgggtttttttttttttaaaaacttagcacatgcttttttttgcgggttaaacagtgcacatactgatgctgcaacaaaagttcagatggatgccccgttggtggatccatgtcaaagaattttgccacgatcaactacagaattgtgtttctttcgaacaaagaagtactagtacgtagaacaactgcagagccattgatgcaggccgcttcttctggacggcacgcacactggtggcaggcaattctgagccctcctcttatctcatcgccttggtctgttcttctgagccatcccgcgccaaggatacgccgaccatctgcctc

SEQ ID NO: 13262 - DNA, 412 bp, Triticum aestivum
  unsure (1)..(412): unsure at all n locations
  Clone ID: PAT_TA_13262
cccgtcgcgatgtggtgaagctacagggaagagggaggaggtcggcgatagggtgaagggagtaggccggccctcgtggaggctgcgctgccggccggccagggaggcggcccggctcgcctctgcctcccaccctcacctccttttccatgcctcttcctctgcatagtagcatgtgcgaggttgcgggcacaggcaaccatgggcaaattttggggagacgccaagatgagcttcccctctgttccatgccctaatctctctctaaagatttgtgtagcctaaatgtctctgtaccgtgtaagcaggcccaacctaatgcacaccatcggcctgatgaatgaccaaatgatttgtttttgttgccatatagactanttgactggtgtgtaggagcccttcaaaaaaacct

SEQ ID NO: 13263 - DNA, 636 bp, Triticum aestivum
  Clone ID: PAT_TA_13263
cgattcggccgagagacagccttgattcataggaggcttattcatatagtcgcgatcgggttcattccactccatgtccaagccagagttacagtaggcagatggatgaaccgccagtatcaaccaatgcgcggaaccgtgatccgccccgtggccataacccggcgggtggtgccggtgatgctcagcaggtggtgaaccgggctcgggcacgcagagaggccgagttagcggcccagcacgaggcccgtcagcttactccggttcgtccaaccacatcggtggaaccaggagtcacctctaggtccttgggagtcccatgtcttgtcccagcgttgtgcaatgtgcgcttgcccaaggatttcaagggcctgcgtgagctgccatattactctgccaatttgtcccctgaaacatgggttgaaagctacgagatggccatggagatgctggacgtggatgatgcggcatgtgcgaagtacttcaccatgatgctagaaggaacgacccgcacttggctaaagagcttaccggctaattctatcaggtcatgggccgagttgagagcccggtttttttagaattcaaggatacatgcaagcagcccatgtcaattgttgacctagctgcctgtgt

SEQ ID NO: 13264 - DNA, 775 bp, Triticum aestivum
  unsure (1)..(775): unsure at all n locations
  Clone ID: PAT_TA_13264
cgtccgcccacgcgtccggttccacctaatttttttttttaactttttgctccaagccagcgacgaatccccggatctggcgtcagcgaggaaggatatggtggatgcgaggacgtacacgccggatccgggccagcacaaccaccagatgggggctgcggcggctggacaccttcgaggtgctgccgcgggcaggagaatatcgctgcagcacccttcgccgctgccaagctcctggcgctggtggacgcgagaccctaagttgccgtccaccacgaggtgctgctacgggtaggaggagctgctgccgcacaccactaagtgatgctacgggcaggcggaggtgtgaccacgacgacgtaccaagacaaggtacctgctccctgtccaatttctaacaatccaattttttgtgtaatactatgatttgttaatggaaagaggctgtggtttcccnagatattgtacatttttatggcaangattatccngnactgnttcaattaatcattagaaaatccgggcaaatcttactttgctcaaaatacgccaaggatncaaacngaactacncaanatatcctgtatgggttatgttnccagattaaagtgtgtccctgccacgtaaatatcncnatcatntnangaattgatatttcaaggaacatatggggaattccaaaccgcattcaattacaaccgtcacgtaattaggacactcttacctgcgtagtanaatcananaaatcnttatgnttcgctcggagcataaccca

SEQ ID NO: 13265 - DNA, 748 bp, Triticum aestivum
  unsure (1)..(748): unsure at all n locations
  Clone ID: PAT_TA_13265
gattcggcacgagcagaagctcttagtgaacatatctcgagtatattgaagttcagtgaccaaaaagaatatatgactcaaattcagtgaccgcggatgtattttacaattccacacaattagacaagacaacgctttccaaaacttcgcacacaaaccaagtttctcttataacatgaatgtgctcgttgagttagagaagcaacgccttctacgcttgcatggttgtgtacaggtgtcccgactgaaaagactctgcaatatggtgggagccgtaggcacaggttcttcgaacacccgaacatagaggtgtttatcaagtgtcagcttctccaacaaggtcctgcatgtctgaggattccatacatccatcttgtggataacatcgtcctctactgttcctggatattgcatcacatagccaataattcgacgagttaaaccttcatagaccgtactattgatgctgccatcaccatttatccatggcaatatagggtgataaatatgcctttcacaagcatggcagctatcactctccatgttgtcttgtgatggagtagacagtatttccttatctccacaattttgactgcacatatgagatgaacttgacttgctttcaccactaagaattgtcactgtgtgcccatcaccaagtttttttacagttccctgcttactagacatggcatgcttnnctttcaaacattttctgtgcctccagtcttcattatcnnncgcgtgg

SEQ ID NO: 13266 - DNA, 1079 bp, Triticum aestivum
  unsure (1)..(1079): unsure at all n locations
  Clone ID: PAT_TA_13266
cgagagctcgcgtagcctctgctggatcggcggcgcgtccgcttatatctatctctctctcctccctcgcctcctcatctccacctccacctctgctggctccgcggcccatccgatcccatcgccgcgccgccagctccagatccgccgccgcccgccgcccgccgccgagctcgtaaacgagggggaggggtgaggagccagtcactcgcctggaatctcatcaggccctggtgtggtgtggcagtgaccttcacgtcgaaataaccggaccttttagatgatctggagatggtgaggagctgagagcacctagagatcggcagtgggggctgtggggcagcaaggacatgactgtcatgccgcctgcgcgccatcggcccgcggccaagaggcccatgtggataatcgtgctcctgtgcctcgtctgcgtcgtgctgatcggggcgtacgtgtacccgccgcggcactactcgcagtgctacctctctgcttctagcgtctgtacgccgttcaaggattggctcccgtccatcggccgccgggagaaaaccgatgacgagatcatctcagccgctgttatcagggatattcttgggatgcccatgtccacgtcgaagaatccaaagattgcctttatgttcttgacacctggctcattgcccttcgagaaattgtgggagaagtttctgcagggtcatgagggaagatactccatctatgtgcacgcgtcgcgtcagaagcctgtgcatactaagttctctctttgttggccgagatattcatagtgatgcggttgtatggggaaaagattcaatgatagatgcagagaagaggctattaacaaatgcgctggaagacgcggataatcaatttttgtcctgctttcctgatactgtgttccgctcaatcaatccnacaatgtccttnaataccttaagggaacaaacacaatttcaattgatggtccaagatcctggccacaatggnaatggaagnatccccttgaaatgctccctgaatanaggnanagactnaaaaanggtgccatgggttgcaatcacnnaaaanatgcttng

SEQ ID NO: 13267 - DNA, 972 bp, Triticum aestivum
  unsure (1)..(972): unsure at all n locations
  Clone ID: PAT_TA_13267
cgtccgcgcaacgccgccctccagcaaccgccggccggaagatcctcttcggttctctccttgttcacaaccaccatcaattctgttactagagaacaccaaaaggtcaaaaccctagccgcctccctagaactctcgcagcaccatgtcgacatccactagcggcggcggatcgctctcgccccaggcggctgcagcgctccaggagggcatcgggctggtgttcgggcggtggacggcgctgcagatggctgtggagaacaagtggggcggccccgactcccgcgccaaggccgaccagctcgccgcgtccatcctctcctggttcaccaactccaagggcccatattattatgaggacttggaggatatgatgtttgacaacatatataaatccctcaattctaactttgcggatggtagcattggggaggttgctgaacaatttttgataatgcatgaagaatgcctggaaaacaacttttcatcgattgagaaattaaggaatacacggcctcaaggaaatgctgtttcccaaagtagacagatggtacccgaggatgatgatgatgatagctcggatgatggtgatgagccatcaatggggaaagatgaagcagctagatcagatgatatggtgatagatcagccaaaaccttccaagcctacccctgatgctgatgggtggactgttgtgcctcctaggcgtggccgaggcaagaattaagcgcagaagcaaaccttggcaagacagctcccagttagaggccgttttctgtctgaaggttttaatatgtgattagcaaaaccttggcgcaactcctacttgtgccgttttcgtctaaaggtttggattttatcaggaatgatgtttgtgttagcatgttatctttttcactcttgttcgacatggcaacgaaatactnctagttgtaaactaggtaaaaagtatcttttttggggtagccccct

SEQ ID NO: 13268 - DNA, 616 bp, Triticum aestivum
  Clone ID: PAT_TA_13268
ggtttttgaccccgaaattatttgattgttttccattgataacaggtaactcaagcatgcatggagacatggaaccttaaacacgacaagcaatcatttctgacatgttatttcatctttgcttgcctcactaatttgcttctatagaaagatcggtcttcagtgatggtcgacgccgatctacgaggagatgtcaccctggtcatccatgccatcgtggtcgtcggggttgatggagaccatctcgagggcggtgccccctttggtgaactcgagatcggcgccgccgttggcgaaggcctccttgcgcacgatgatgtactccggccaggtgagggcgcggtaggcgggcctgccaccgcccacgacttccttaagcggccctaccttggcgtcggtggccgggccgaggaagtaggccagcgaaatgcgctccctgtcacggttgacgacggcgcggtggtaaacgctccggaagcggccgttggtgaggatctggaagaggtcgccgatgttgacgatgagcgctccgggcacggccggcacctccacccacctgtcagccggcggcccgtgccgccccgggtcctgccccggcacctggaacgtgaagaac

SEQ ID NO: 13269 - DNA, 1327 bp, Triticum aestivum
  unsure (1)..(1327): unsure at all n locations
  Clone ID: PAT_TA_13269
accgggaagcggcagaacgaggcgatcgcgctggcctgggccaccaagttcgccaccagagactccatcttcgacaagaacttcagcctccttggcaccggcgacgggaaggacacgccgctcctgctcaaggaagggcaggacgtgtttaagtcctacgcccacgcgtgcaggcgcgtgggttctgccagggggtgctcgccaccatggagatgcgtgcgcggcacgacctgctgtccaagctgctggagctggtcttccccaggaaggacaccatcacgttcgaggtggtgatgaacgaggatgccatggaccacgtgatggttgctgtggctaggaagaaggcggccaaggcgatgcagaaggaagagagagatctgcagaagtttgcctctgttcttgctcctgcacccgctgggaagaagtgggttgcagatgagcttgcagtagtggccgagtcaaaggaggttgctggggatatgatcaccgaagctgtgctggatcaggtgcttggtgagaaagctttcgagaaaatggngaagngggttcatcttacttcatttttcagatcaactggcaggctctntacaagaagtcctctcattcaagtttgtgctgccagatgcaaacacatgggtgatatgacanaattagttgctcttgtgccattctacattgatttggttggacgctacaagctgagctcacatgcgcgctcgaaaacagatgctgctaggacaaaggccgcccaggaggctttcagggagcttcagggtgtcaggcaggaaaccctgctgaggaaaaaggccgaaaagaaaaaactcatggaagaggcagaggccaaactgagcgccgaggtactccggaagaaagaggagaaagagcggaatcggcagatgaagaagggggcgcccaaagttaaaatgctacgctcttaataacatgaagaatctgtcatagttattggctttcgctgttcacttgctgattagcctatctgtagttcagcatcggctagactcttttatgttgaaaattttccatcagcctccctggtatgagaatcaagcgaaagtaagagaaaaagaaatgctgacaagatgcccggtgaaagtgttttcgtcgcaggttggttcagtctatctgattcgggtacacagcagctcatttgtaaggaaaaaaactcaagaagacgcttccctgatttgctgtgtaatatgttgatagatctgtggtcagaaactacacttggattacatggtttcatgtttaagcagccggcttgcttgctgttagcctgttaatgctcactttacgcatatctttt

SEQ ID NO: 13270 - DNA, 2189 bp, Triticum aestivum
  Clone ID: PAT_TA_13270
ttccgggccccggcgatgcatcgcgttggccgggcctggtccagggagggcaggcagggtttatttcctacgcccgcgtctgtcttctctaccagggggcgcttgccattatgtagacgcatgcgcggcactactgcctgtccgaggcgctggagcttgtcatcgacaatatggtagcccttgcgccacttgagattagggtggtggatcgctattaccatcccactctcgacaccacttacataaacgaacttcagatatgcttctcccacctggaagtaaaaccggatctctacaaaatcggatgctatattgctatttaatcaagtatcgacacaagttacataacaacttcagatatgcttctccacctggaagcaaaaccggaacacatgctctgatgcagttcactgccacttacatgttgatggtgactaagcaaaaacttgccgagttttaattacttatacagaatcgagcacaggaggatgttagatcctgttaattaaccatggatcatgtgctcattccagagactctcgaaggagcatgatgcatgattatgtcttgaaaagcgatgacttaattgggatctttgtatccaacacaagcatgcataacaagtttgagctataatgccacaccttaagcaacaccggaacacatggatttagggggttatctgccacttccatgttaagatgactaagcaaaaacgttgcctcaatattaatactaaccagatgaacactaggaggctgtaggtcatgttaattaaccatgtaccatgtgaatattctgagactctgtgaggaagccttcattatatctgactagaaaggcaagagatggatcctttttctacaaattcagtagacaagcttgggcatcaaactcggcaaaatcaacggagccagactcgattgagggcatgaggtacgcagcgatgatctcagacactagttgggcaataagaggaaccctctttaggttcttcaccaggggcatgtcgttggactctcctatagaaatgatcttcaggttgatatctaccatcctgtctagcttcctcttgaattcagggttctcaacatccggtacagcagggaagatcctcgccgtcgtgcggttggtctcatagatgacatgcatgtcgaattctttggtgttgagaccaattccttcgtagaaggcactacgttggcagtcattcaggtacatggttatatacaccgagaggcagaagaagcgtgaccagagcttggccttccagtcattgaggaactgcggctgcgccttgagcagcgcggagaagaaatcgccgtgccggttctcgtcctggcaccagttctcgaagtacttgaagatggggtacacctggtactccgggttggccttgaggtgcctgaagatggtgatgtacctccagtagccgatcttctcggacaggtacgtggcgtagaagatgaactttggcttgaagaaggtgtacttcctagccttggtcaagaagccgaggtccagagccaggttgaagtcggacagccccttgttcaagaacccagcgtgccgggcctcgtccctggacatgagcgagaagatctcagccaccaccgggttggttttcttgagcctgcggccgagctccttgtagaggaggaacccggagaactcggcggtgcaggagcgctcgaggaactcgacgaagatctggcggagcgggccctgcatcttgtcggcggcctccttgaactcggggttgcggatgaagtgggtctggttgtagtccgtcttgaactcctgcagcagcgcgtcgaactcgtcctggttgagctgcttgttaatctcggcgttgaacagctgctccatctcgtcgaagtccgtggtgtagaagcgcggcgtgagcagcgactcgttgacctccgtcttgccccgcttcttgggcgagccgggcttcgcggcgggtgcgggcggcgccgcggcggcggccctcacgcggaagcggacggcgccccggcgcgcggggagaaccgggaggtgggaggccgtcttggccgcgatgccgtggtggtgcattgcggggttgaggagggagagctccatggcggacgccatcctgtgtgtgacggacagcgcggaacggcagccaagagttcgggggaacggagagggagccctgtgccggattc

SEQ ID NO: 13271 - DNA, 729 bp, Triticum aestivum
  unsure (1)..(729): unsure at all n locations
  Clone ID: PAT_TA_13271
ngggattctcaagcgttaagtggtacccaggtttccngtcaggngtttaaaagacgccagtagcgcggtaatagatcntataggcgattggtacggccccccttcggctcgtgttttttcttcttcctgtacgggtgcccccccacatccagtgacagcgtcatggaccctgtcatgtcatcatcttttcacttcactaatactaaacagtgtaccaactactaaatggtgattcgatattgctctcttgtgtaactccctccaaagggcacgctcagtttgacatgactaagactaggctacgagcgggcgcacgtcgtccttgagcggcccggcgtggcggaagccgtaggcgcggagcacctggtcgtcggcgaggttgagcgcgcggcgcatcccctcggcgcagctctcgttggagtagatctcgttgggcctgccgccgcaggggttgcagccggtgaagtgcgtcacgaagggccggcgccaggcggacgccttctgcccgcccccgtcgggccccgggacgccgccgcccttcttcctcagggccgcgttcctcgccgccgcgtacagcgcgtggtccccctccgcgtgccgccggcggagggccggcccgaaccgccgctccgccgccctgtaccgcgccgcgacgccgtcgagcttgtccacgatctccgcccagtatccctggaagtagtactcgttctcgaggtacgtccctcgtgc

SEQ ID NO: 13272 - DNA, 614 bp, Triticum aestivum
  unsure (1)..(614): unsure at all n locations
  Clone ID: PAT_TA_13272
ngttgttgaaccaccccttgngtcaatgttcggaanttcatgtctccctcgggccctgtccgcctgctctattcggagatcgccatcggggttggacaggttcacaagtactaccagccgagcaagagccaccggctggtgtcggcggtgatccacggcgagaaggtgcccctctacggcgcggggggcgggctctcgctgtccggcaacgacgtgacggtgccgctgacggtggacttcgagctcgtctcccggggctacgtcatcggcaagctgggtgcgggtgacgcacagggtgcaacgtgtcgtgccgcatcgccgtcgacgccaagagggcgaggaccaggatccccaagaaggcctgcgccgtgtacaaggcctgatggaccgccgccccttggcttccggtcctgttcctgcagctgaaaagcctgtatttactgttctgctgaagaacaataaacatgtactggcagtatatataaggaacctgtttgagcttcggttttgtttatataagttactctcttgtgccgcggcggttttgtctatgagggagggggcggtccttggtctggtgttagggtttggttggttacaagatagtagtaatg

SEQ ID NO: 13273 - DNA, 467 bp, Triticum aestivum
  unsure (1)..(467): unsure at all n locations
  Clone ID: PAT_TA_13273
tttatttagtatgataacctatgaacgaggacgttccttcttctccttgtacaagggccaagagagaaacatctggcaaccttcacgaccttgaaacggacaccgggaatatcaccgacggcgtgaccttttctaccgaaccctgccaccaaaacttcatcgttttcttcaatgtagttcaaacaaccgtcattggggacgaatgcggtgattttcttgccgttcttaataagttgaaccctgacgcactttctgatggcagagttaggctgcttggcttcaacaccaactttttccaggacgaattcccttggcgtgggaagcacctccgaaaggggttggccttccatctggttccaaggttggccttcnttgaagtcgttgtcggcccacctctgctcacgcctggtggttgacgtgcttacgcgcagtacgaataccacgaggcttaccctcgtgccgaattc

SEQ ID NO: 13274 - DNA, 725 bp, Triticum aestivum
  Clone ID: PAT_TA_13274
agcgactcccacgcgcctttccgtagcaagaaccctagcttttgtgggatggcgaaccaaggtcaacaagatccggtggtcctccccatagttccttgcccggactgtgggagggacgtggtcatgtatgtcgcacggcgaggacagagcgccggccagaggttttacaagtgccgcaatcacaatcctgtgggcaggtggttgtgatttctaccgctggcaggaagcatacgccgctcattttgggtgttgttctgccggcagcagagccaggggatcaaatccaagcggctgtcgaccaacctcaggcgcagatcaaccaacctccagttcatcaaccactacagaaccacggaccggagtggaagacattgccgccgtgatgaatcaggtggttgcatctcttatgggcatcatcgatggtgcacgccagaacgggcgctcgcccgggcacgcggcctccattaacatcgggatgtcagtggcaatcttcatcataggtgtttgtacccttgtgctgcttgtagctgtcattcttatgagggcacaagagtaggagatggggtttcgtagtggcagcacccctagtagtttaactatcatgtagtagtgtggagttatgagatggaatctgtggatcaagaactgaaagtatgatgaagatcgtattttgtaatgtccaagtatgcgaaatatgaaatatttagaagctttgcttatgcttt

SEQ ID NO: 13275 - DNA, 706 bp, Triticum aestivum
  Clone ID: PAT_TA_13275
ggcgaccagagccagagtaaccatccctctcctcttcctcctgggaaccagccttctcttcgccgcggctgtttcggcctcccatgacgaggaggacgacaggcgcggtgggcactcgctgcagcagtgcgtgcagcggtgccagcaggaccggccgcggtactcgcatgcccggtgcgtgcaggagtgccgggacgaccagcagcagcacggaaggcacgagcaggaggagcagggccgcggccatggccggcacggcgagggggggcgtgaggaggagcagggccgtgggcgtggccggcacggccagggagagcgtgaggaggagcagggccgtggccatggccggcacggccagggagagcgagaggaggagcagggccgcggccgtggccggcacggccaggaagagcgtgaggagcacgggaggcgcgagcaggaggagcacggggatagccgccggccgtacgtgttcggcccgcgcagcttccgtagcatcatccggagcgaccacgggttcgtcaaggcacttcgcccgttcgacgaagtgtccaggctcctccggggcatcaggaactaccgcgtcgccatatgggaggtgaacccgcgcgcgttcgtcgtgccaggactcacggacgcggacggcgtcggctacgtcgctcaggcgagggggtactgacggtgattgagaacgcgagaagcggtc

SEQ ID NO: 13276 - DNA, 459 bp, Triticum aestivum
  unsure (1)..(459): unsure at all n locations
  Clone ID: PAT_TA_13276
gagagagagagtcctcccctccagcatgtaccatttgacattggttgatggagaggagcatattatttcacnttcatcctctgttgctgcttctgctgcttatccttgagggaagatctgtctaacgttatgtgtacagtgatcgatcaacggggagagtgtccctcttttgttgctgttgatgtggtagtttctttcttgtgtcagctacgggctggattggatggtgctctctcggctcactctcgtccaatccgtgcatgtgaaaaatacgcctatcttatctatctatcctgtgtggtgatatatgcttctagtccagtccagaccagtagtagtctaggctagcagtataaattctcttctaactttttgtatctttctctccttttctgattgatgtactctgatgatccttatgtatacacatgtttggagtttggactgctaaaaaaaaaa

SEQ ID NO: 13277 - DNA, 503 bp, Triticum aestivum
  Clone ID: PAT_TA_13277
gcacgagagccagtgacacagagatagttcaaccatggcgaccagaggcagagcaaccatccctctcctcttcctcctgggcacaagccttctcttcgccgcggctgtttcggcctcccatgacgaggaggaggacaggcgcggtgggcgctcgcttcagcggtgcgtgcagcggtgccagcaggaccggccgcggtactctcatgcccggtgcgtgcaggagtgccgggacgaccagcagcagcacggaaggcacgagcaaggaggagcagggccgcgggcatggccggcacggcgagggggagcgtgaggaggagcagggccgtggccgtgggcggcgcggccagggagagcgtgatgaggagcacggggatggccggcggccgtacgtgttcggcccgcgcagcttccgccgcatcatccggagcgaccacggggttcgtcaagggcccttcgcccgttcgacgaagtgtccaggctcctccggggcatcaggaactacc

SEQ ID NO: 13278 - DNA, 557 bp, Triticum aestivum
  Clone ID: PAT_TA_13278
ccacgcgtccgctcctccaccaccgccgctcgccagccgtactccgccgcagcaggggctgctgcatgacgcctctgccccaccgacagtcggcgacgtccgcgcctgtcgccgccgcggccgagatggtggtcgccgtggcgaatggggcgaagagggaggcaaccgccgccgccaacaccaccgccgccgccgccgccgacgcagattctcccatctccgtcctggaggaagagaaaatgtccggatccaaggatgggaaagcgggcgagctcaaggccaacggcggcgaggcgcaccccattgcggaggcgctgaaagctgaagaagagctactgaactccgtcaaagacgagacatcggttgagccgctggatgcgacttctcctctgcctatcgacctcgcggccaagaacggcgacacctctttaatcacagaggtgatgacgaaggaggaagaggagatgtatcaggcccggattaagctagaggaagaagaggatgtcagaaagagagaggaggccgcgaggcaggcctttgacccgaatgcaaagttc

SEQ ID NO: 13279 - DNA, 674 bp, Triticum aestivum
  Clone ID: PAT_TA_13279
gtgctggaaggcgagggcgaggtggagatcgtctgcccgcacctcggccgcgacagcgagcgccgcgagcaagagcacggcaagggcaggtggaggagcgaggaagatgaggacgaccggcggcagcaacgccgacgcgggtccggctccgagtcggaggaggagcaggaccagcagaggtacgagacggtccgcgcgcgggtgtcgcgcggctcggcgttcgtggtgccccccggccacccggtggtggagatcgcctcgtcccgcggcagcagcaacctccaggtggtgtgcttcgagatcaacgccgagaggaacgagcgggtgtggctcgccgggaggaacaacgtgatcgccaagctggacgaccccgcccaggagctcgccttcggcaggcccgcgagggaggtgcaggaggtgttccgcgccaaggatcagcaggacgagggcttcgtcgccgcgctctgaggcggcaaggccgctgttgttaagtgaatgtgtgagctggagcccgtgccatttgagagctgaacttgtatgtgtgtgtaagtttgtcagtacgcgggagtagcataaataagtcgtggcacgggctcagtacgatgatgtaagttgcgtacctaccttctaccaaggcatgcatgcccaacataaataaacacaagggcgttgcg

SEQ ID NO: 13280 - DNA, 517 bp, Triticum aestivum
  unsure (1)..(517): unsure at all n locations
  Clone ID: PAT_TA_13280
aggtacgagacggtccgcgcgcgggtgtcgcacggctcggcgttcgtggtgccccccggccanccggtcgtggagatcgcctcgtcccgcggcagcagcaacctccaggtggtgtgcttcgagatcaacgccnagaggaacgagagggtgtggctcgccgggaggaacaacgtgatcggcaagctggacaaccccgcgcaggagctcacgttcggcaggcccgccagggaggtgcaggaggtgttccgcgccaaggatcagcaggacgaagccgtggagggcttcctgagaatggcaaccgccgcgctctgaggcggcaaggtcgctgtcaagtgaatgtgagctggagcccgcgccgtttgagagctggacttgtgtggtgtatgtagttcgtaagtacgcgggagtagcataaataagttgtggctcgggctcagcagtacgatgatgtaagttgcctacctaccttccaccaaggcatgcatgcccaacataaataaacacaagggcattgcgc

SEQ ID NO: 13281 - DNA, 402 bp, Triticum aestivum
  unsure (1)..(402): unsure at all n locations
  Clone ID: PAT_TA_13281
gaacaaccgggtgtggctcccggaagaacaacgtgatggcaagctgggcgaccccgcccaggnagctcgccttcggcaggcccgcgagggaggtgcaggaggtgttccgcgccaaggatcagcaggacgaacccgtggaggcgttcctgaggatggcaaccgccgcgctctgaggcggcaaggccgctgttgttaagtgaatgtgtgagctggagcccgtgccatttgagagctgaacttgtatgtgtgtgtaagtttgtcagtacgcgggagtagcataaataagtcgtggcacgggctcagtacgatgatgtaagttgcgtacctaccttctaccaaggcatgcatgcccaacataaataaacacaagggcgttgcgcctctttttcagtaaaaaaaaaa

SEQ ID NO: 13282 - DNA, 662 bp, Triticum aestivum
  Clone ID: PAT_TA_13282
tagatgtggtatgcaacccactgggaaaatctggaggcgccttgatccagcagttcatgatcttgtcatttgggtctcttgccaactcaacgccgtaccttggaggaatattgctggtgattgtcatcgcgtggttgggcgctgtaaggtcccttgactcgcagttctctcccctggcaaagcaagacctggagagggaacagaagctgaaagcagaggcggtagaaacgacggctcaagtcgttgggacagggaacggttcccttcaagaaaatgttgccagccagaactccacaaacggtacggtcatcaaacagtcgcaagaacccgagatcactgcccctgaaaaatctggcaagcagtcttaataagtttccacccccagaaatttagttagtaccgagtttttgatggaaccaaatgttgcttggttgggcctgccatggggagctgctgggaaaggcagtagagtgattgataagaaaaataagatggcctgttcttctgttgttgtagcatatttttgacttcatgcaagtatctatagctgtttactgggagtatctgtagctgtttggtttgtcgctccgtagatatgaaactatttttcttgatttttttatattacaattttgcggaaaatcaaaactctgccgaattcg

SEQ ID NO: 13283 - DNA, 957 bp, Triticum aestivum
  Clone ID: PAT_TA_13283
ctcgtgccgaattcggcacgaggctccgaagcgcctccctgctccccctccgccgctcgcccctgcactcgtccggcttccagccccgagccgccatggcctccgatgccgccagccagttccagaagatccagatccagcgcgaggacacgacctttgatgtctatgttgttggcaaagaaaatgctcctggagtcgtagtgttgcaagagtggtggggtgttgactatgaggtcaagaatcatgccatccatatttcccaaatcggcgatggatacagagcacttattccagatttgtaccgtgggaaggttgctttggaggtagctgaggcacaacatctgatggaaggactagactggcagggtgcaatcaaggatattcaggcttcagttaaatggctgaaggaaaatggatcgcccaaggttggtgttactggttattgcatgggaggtgctttggcgatcgcaagtggagttttggtcccagaggttgatgctgttgttgctttctacgggacgccatcttcggagcttgctgatgcttccaaggctcaggctccaatccaggctcattttggggagcttgacagttttgttgggtttgcggatgttaccgcggccaagtcattggaggagaagctcaaggcttctggagtggcacatgaagtccacatatactctggatgctcccatgccttcatgaacgcatcgcctgaggccctcaagaggaggaagggcatgggtttgactgatgagaatcagggggccattgacctggcatggtcccgcttttccacttggatgggtcgtttcctggggtctgcatgagccattaccatatccatatggtctctgaatgatgtatatggagtctgksggctcagaagartaaaatgtttgggtgcratatgtagccagtgcccaatctagacaagcagtgtgttkttgtgttagt

SEQ ID NO: 13284 - DNA, 675 bp, Triticum aestivum
  Clone ID: PAT_TA_13284
tcggcacgagggtagcaagcagagtgacaaaccatggcgatcagagcaaccattcctctcctcttcctcctgggaaccagccttctctttgccgcggctgtttcggcctcccgtgacgacgaggaggacaggcgcggtgggcactcgctgcagcagtgcgtgcagcggtgccagcaggaccggccacggtactcgcatgcccggtgcgtgcaggagtgcagggaggaccagcagcagcacgggaggcacgagcaggaggagcagggccacagccatggccggcacggcgaaggggggcgtgaggaggagcagggccgtggccgtgggcggcacggcgagggagagcgtgaggaggaggagggccgtggccgtgggcggcacggcgagggggagcgtgaggagcacggaaggcacgagcagggccgtggccggcgcggcgagggagagcgtgatgaggagcacggggatagccgccggccgtacgtgttcggcccgcgtagcttccgtagcatcatccggagcgaccacgggttcgtcaaggcccttcgcccgttcgacgaagtgtccaggctcctccgaggcatcaggaactaccgcgtcgccatcatggaggtgaacccgcgctcgttcgtcgtgccgggactcacggacgcggacggcgtcggctacgtcgct

SEQ ID NO: 13285 - DNA, 1265 bp, Triticum aestivum
  Clone ID: PAT_TA_13285
tcggcacgaggcaccgacggccggaggaagctggtcatcgccaagatcctccacaccatctccgtgcccggcaagttccagtatttctcggccaagcctcttctcgcgagtttgagcaaacgcgtgctgagagcggctctcaagacctcggatgagcagctggacaggctgctgttcggcaggcgccaaggccaggaggaggaggagtccatctccatcgtccgcgcgtccgaggagcagctccgcgagctgcgtcgcgaggcgtccgagggcgggcagggccaccactggcctctccccccgttccgcggcgactcgcgcgacacctacaacctcctggagcagcgccccaagatcgccaaccgccacggccgcctctacgaggccgacgcccgcagcttccacgccctcgcccaacacgacgtccgcgtcgccgtcgccaacatcacgccgggatctatgaccgcgccgtacctgaacacgcagtcgttcaagctcgccgtcgtgctggaaggcgagggcgaggtgcagatcgtgtgcccgcaccttgcccgcgacagcgagcgccacaagcaaggcaagcagggcaggtggagcgaggaagaggacgacgcccagcggcagcaacgccgacgcgggtccggctccgagtccgagtcgtcggaggaggagcaggatcagcagaggtacgagacagtccgcgcgcgggtgtcgcgcggctcggcgttcgtggtgccgcccggccacccggtggtggagatcgcgtcgtcccgcggcagcagcaacctccaggtggtgtgcttcgagatcaacgccgagaggaacgagagggtgtggctcgccgggaggaataacgtgatcggcaagctggacaaccccgcgcaggagctcacgttcggcaggcccgccagggaggtgcaggaggtgttccgcgccaaggatcagcaggacgagggcttcgtcgccggacccgagcagcaggagcaggagcgcggggaccgccgccgtggtgaccgcggccgcggcgacgaagccgtggaggccttcctgagaatggcaaccgccgcgctctgaggcggcaaggtcgctgtcaagtgaatgtgagctggagcccgcgccgtttgagagctggacttgtgtggtgtatgtagttcgtaagtacgcgggagtagcataaataagttgtggctcgggctcagcagtacgatgatgtaagttgcctacctaccttccaccaaggcatgcatgcccaacataaataaaca

SEQ ID NO: 13286 - DNA, 1480 bp, Triticum aestivum
  Clone ID: PAT_TA_13286
accggtacccgtgcgcgtacgacgacgggtggaccgcgctcaagtgggcccaggcccagccgttcctgcggagcggcgaggacgcgcagctccgcgtgttcctcgccggcgacagctccggcggcaacatcgcgcaccacgtgcgccgtccgcgccgcggaggaggggatcaagatacacggcaacatcctgctcaacgccatgttcggcggcaacgagcgcaccgagtcggagcggcgcctggacggcaagtacttcgtcacgctccaggacagggactggtactggaaggcgtacctgccggaggacgcggaccgggaccacccggcgtgcaacccgttcgggccgaacgggcggcggctcaagggcctgcccttcgccaagagcctcatcatcgtgtcggggctggacctcacctgcgaccggcagctgggctacgccgagggcctccgggaggacggccacgacgtgaagctggtgcaccgcgagaaggccaccatcggcttctacctgctgtccaacacggaccactaccacgaggtgatggaggagatcgccgagttcgtccgagctaacctcctgtagcacatacaccagcccagtcgtctcgtcgtggatgagctcgccgtccgtcccgacgcaatcaaatacgtacgtactacgtactactgcctataggaagctaaatggtaagcttgacttatactagtatctgttatactaccgccgccgccggtgctgctgctgcttggggatgtcatcttggagcccggcaatggcttctggcaagtgatctctaggctccaaaggggatccccatgtctgtccgtctgtccttctgatgataaaactcaatggctcttcctcgtcggagcgcgggaagccattgccgtcccactaattgttccccggccgatcggctcggccggtgtgatccttgggtctcggatctgtatccatccatgtgtttgcctggggttaagacaagagagagagtgccttcgctccagcatgtaccatttgacattggttgatggagaggagcatattatttcaccttcatcctctgttgctgccgctgcttattatctatccttgagggaagatctatctaacgttatgtgtacagtgatcgatcaacggggagagtgtccgtcttttgttgctgttgatgtggtagtttctttcttgtgtcggctacgggttggattggattggattggatggtgctctctcagctcactctcgtccaatccgtgcatgtgaaaaatacggctatctatctatctagtagtatctatctatcctgtgtggtgatatatgcttctagtccagtccagacagtagtagtctaggctagcagtataaattctcttccaacttttttgtatctttctctccctttttgattgttgtactctgatgatccttatgtatacacatgtttggactttggactgcgagtgctgtaaaaaaaaaa

SEQ ID NO: 13287 - DNA, 3276 bp, Triticum aestivum
  Clone ID: PAT_TA_13287
acttgaaaaaggcgcaacgcccatgtctttatttatgttggacatgcatgccttggtagaaggtaggtacgaaacttacatcatcgatcgtactgagcccgtgccacaacttatttatgctactcccgcgtactgacgaacttacaagacacacatacaagtccagctctcaaacggcacgggctccagctcacgcactcactcaacagtggcctttcagagcgcggcggtcgccatcctcaggaacgcctccacggcttcgtcctgctgatccttggcgcggaacacctcctgcacctccctggcgggcctgccgaacgtgagctcctgggcggggttgtccagcttgccgatcacgttgttcctcccggcgagccacaccctctcgttccgctcggcgttgatctcgaagcacaccacctggaggttgctgctgccttgggacgaggcgatctccaccaccgggtggccggggggcaccacgaacgccgagccgcgtgacaccctcgcgcggatggtctggtatctctgctgatcctgctgctcctccgactcggactcggactcggagccggacccgcgtcggcgttgctgccgctggtcgtcgtcctcttcctcgctccacctgcccttgccttgctcgcggcgctcgctgtcgcggccgaggtgcgggcacacgatctgcacctcgccctcgccttccagcacgacggcgagcttgaacgactgggtgttcaagtacggcgcggtcatagaacccggcgtgatgttggccacggcgacacggacgtcgtgctgggcgagggcgtggaagctgcgggcgtcggcctcgtagaggcggccatggcggttggcgatcctggggcgctgctccaggagaagacaggggggtccatgtccatcgtccgcgcgtccgaggagcagctccacgagctgagtcgccaggcgtccgagggcagccagggccatcactggcccctccccccgttccgcggcgactcgcgcgacacctacaacctcctggagcagcgccccaggatcgccaaccgccatggccgcctctacgaggccgacgcccgcagcttccacgccctcgcccagcacgacgtccgtgtcgccgtggccaacatcacggccgggaattctcccaccttctccgcccccatggagtccggcctcgtcgcaagccaccgccttcgcctcccggccctcccctccgcggcacatgcccacctcctccgccaccgccgcctcgtggccacgcccctccgcctccccaccaccccgacccctctccgccagcccgccgcgctcccgctccgtccgtgcctcaggcctccccgcgccgcctccgtcgcctcccccgcgccggtgcccggcgatgcgccggacaattcccgcaagttcctcggcgtggacgcgctcacgctcaagaagatcgtgcccctggggctcatgttcttctgcatcctcttcaactacaccatcctgagggacaccaaggacgtgctcgtcgtcaccgccaaggggagcagcgccgagatcatccccttcctcaagacgtgggtcaacctccccatggccatcggcttcatgcttctctactccaagctcgccgacgtgctctccaaggaggcgctcttctacaccgtcatcttccccttcatcgccttcttcggcgtcttcgggtacgtgctctaccctatgcgcgacgccatccaccccacggcgctcgccgaccgcctcctcgcgtcgctcggccccagctttctggggcccgtcgccatcctccgcgtgtggagtttctgcctcttctacgtcatggcggagctctggggcagcgttgtcatctccgtcctgttttggggattcgccaatcagattactacggttgaagaggctaaagagttttacccgctgttcgggcttggggccaatgtggctctcatcttctctggtcgcacggtgaaatacttctcaaacatgaggcagaatttgggtccaggggtggacggatgggctatttcattgaagggcatgatgagcatagtggttgtactgggtttcgtcattgccggtatctattggggagtgaacaagtatgttattgataaaacatctctgccggtcgaacggaagaagaagaataagccaaagcttagcatgggggagagtttgaaggtgctggtatcatctcaatatgtgagggatcttgccacactggtcgttgcttatggtataagcatcaaccttgtagaggtgacatggaaatcgaaattgaaggcacagttcccaagtcctaacgagtattcttcattcatgggtgatttctcaacggctactggcatagctacgtttacaatgatgttgttagggagattaattcttagaaaattcgggtggggagttgcagctacaatcacccctgcagtgttgcttgtcactggagttggattcttctcactgcttctgtttggtgagccactcactcctcttctagccacgtttgggatgacgcctttgcttgcggcggtcttcgttggggcactacagaacattttcagtaagagtgcaaagtacagtttgttcgatccttgcaaagaaatggcgtacattcctttggatgaggacatgaaggtcaaaggcaaggcagcaatagatgtggtatgcaacccattgggaaaatctggaggtgccctgatccagcagttcatgatcttgtcatttgggtctcttgcaaactcaacgccgtaccttggaggaatattgctggtgattgtcatcgcgtggttgggcgccgtaaggtccctcgattcgcagttttctcccctggcaaagcaagacctggagagggaacagcagctgaaagcagaggtagtagaaacgacagctcaagtcgttgggacaggaaacggctcccttcaagaaaatgtcgccagccagagctccacgaacggtacggtcatcaaacagtcgcaagaacccgagattactgcccctgaaaaatctggcaagcagtcttaataagtttccacccccagaaatttagttagtatgagtttttgatggaagcaaacgttgcttggttgggcctgccatgtggagctgctgggaaaggcagtagaatgattgataaggaaaataagatggcctgttcttctgttgttgtagcatatttttgacttcatgcgagtatctgtagccgccgtttacttatctgtagctgtttggcttgtcaccccgtagatatgaaactatttttcttgaaaaaaaaaa

SEQ ID NO: 13288 - DNA, 2358 bp, Triticum aestivum
  Clone ID: PAT_TA_13288
cacagagctagctagttaacaatggcgaccagagccagagtaaccatccctctcctcttcctcctgggcacaagccttctcttcgccgcggctgtttcggcctcccatgacgaggaggaggacaggcgcggtgggcgctcgcaccactgtgcgcgactgcttgcccggcttctcgtgcccgctagggagggagggaggggggattcggagccggaggagatcgccggcggctgggctcctgccggaggactcggcgggcgggatccacctcgcgcttcttggaggcccccatgccgtgagcgaagcagccagcgccatcctttgttccccggggagatcttgctcctgcctgcagcagctgagagccgagggccgacaccgagaggaggcaccgcccgccgacatggccggcagcgacgaggtcaaccgcaacgagtgcaagacggtggtgccgctccacacatgggtgctcatctccaacttcaaggtgtcgtaccacatgctccgccgccccgacggcaccttcgagcgcgacctcgccgagtacatggaccgccgggtgcccgccaaccccaggccggtcgagggcgtctcctccttcgaccacttcatcgacttgtccgtcggcctcgaggcgcgcatctaccgcgccgtcgccggcaacgcagcgggcgccgccgagggcgccgccgcgctcaccctgcccatcctcgagttcctcggcggggcgccgtccccggacccgctcccggtgatcatcttcttccacggcggcagcttcgcgcactcggcgtccagcacaaccatctacgacaacctctgccgccagttggtgaagctgagcaagggcgtggtggtgtccgtcaactaccgacgcgccccggagcaccggtacccgtgcgcgtacgacgacgggtggaccgcgctcaagtgggcccaggcccagccgttcctgcggagcggcgagcgacgcgcagctccgcgtgttcctcgcccggcgacagctccggcggcaacatcgcgcaccacgtggccgtgcgcgccgcggaggaggggatcaagatacacggcaacatcctgctcaacgccatgttcggcggcgtggagcgcaccgagtcggagcggcgcctcgacggcaagtacttcgtcacgctccaggacagggactggtactggaaggcgtacctgccggaggacgcggaccgggaccacccggcgtgcaacccgttcgggccgaacgggcggcggctcaggggcctgccgttcgccaagagcctcatcatcgtgtccgggctggacctcacctgcgaccggcagctgggctacgcggagggcctccgggaggacgggcacgacgtgaagctggtgcaccgcgagaaggccaccatcggcttctacctgctgtccaacacgaaccactaccacgaggtgatggaggagatcgccgagttcgtccgagctaacctcctgtagtacatacaccagcccagtcgtctcgtcgtggatgagctcgccgtccgtcccgacgcaatcaaatacgtacgtacgtactgctgcctataggaagctaaatggtaagcttgacttatactagtatctcttatactactgctgccggtgctgctgctgctgctggttggggatgtcatcttggagcccggcaatggcttccggcaagtgatctctaggctccaaaggggatccccacgtctgtccgtctgtccttctgatgataaaactcaatggctccgacctcgtcggagcgagggaagccattgtcgtcccactaattgttccgccgggcccgatcggtcggtgtgatccttggaactccgatgatctgtatccatccatgtgtttgcctctggggctaagacaagagagagagtgcctccgctccagcgtgtaccatttgacattggttgatggagaggagcatattatttcaccttcatcctctgttgctgctgcctgcttatccttgagggaagatgtgtctaacgttatgtgtacagtgatcgatcgatcgatcaacggtgagtcttttgttgctgttgatgtggtagtttctttcttgtgtcagctacgggttgggttggattggatggtgctctctcagctcactctcgtccaatccgtgcatgtgaaaaatacacctgtctatctatctatctatctatctatcctgtgtggtgatgatatatgcttctagtccagtccagaccagtagtagtctagtctaggctagcagtataaattctcctctaactttttttgtatctttctctccttttctggttgatgtactctgatctgatgatccttatgtatacacatgtttggactttaaaaaaaaaa

SEQ ID NO: 13289 - DNA, 2067 bp, Triticum aestivum
  Clone ID: PAT_TA_13289
tcggcacgaggctagctagttcaacaatggcgaccagagccagagtaaccatccctctcctcttcctcctgggcacaagccttctcttcgccgcggctgtttcggcctcccatgacgaggaggaggacaggcgcggtgggcgctcgcttcagcagtgcgtgcagcggtgccatcaggaccggccgcggtactcgcatgcccggtgcgtgcaggagtgccgggacgagcagcagcagcacggaaggcacgagcaggaggagcagggccacagccatggccggcacggcgaaggggggcgtgaggaggagcagggccgtggcccgtggggcggcacggccagggagagcctgaggaggaggagggccgtggccgtgggcggcacggcgagggggagcgtgaggagcacggaaggcacgagcagggccgtggccggcgcggcgagggagagcgtgatgaggagcacggggatagccgccggccgtacgtgttcggcccacgtagcttccgtagcatcatccggagcgaccacgggttcgtgaaggcccttcgcccgttcgacgaagtgtccaggctcctccgaggcatcaggaactaccgcgtcgccatcatggaggtgaacccgcgctcgttcgtcgtgccgggactcacggacgcggacggcgtcggctacgtcgctcaaggcgagggcgtgctaacggtgatcgagaacggcgagaggcggtcctacaccgtcaggcaaggcgatgtcatcgtggcgccggcggggtcgatcatgcacctggccaacaccgacggccggaggaagctggtcatcgccaagattctccacaccatctccgtgcccggcaagttccagtatttctcggccaagcctctcctcgcgagtttgagcaaacgcgtgctcacagcggctttgatgacctcggatgagcagctgggcaggctgctgttcggcaggcgccaaggccaggaggaggaggagtccatctccatcgtccgcgcgtccgaggagcagctccgcgagctgcgtcggcaggcgtccgagggcgggcagggccaccactggcctctccccccgttccgcggcgactcgcgcgacaccttcaacctcctggagcagcgccccaagatcgccaaccgccacggccgcctcttcgaggccgacggccgcagcttccacgccctcgcccaacacgacgtccgtgtcgccgtcgccaacatcacgccgggttctatgaccgcgccgtacctgaacacgcagtcgttcaagttcgccgtcgtgctggaaggcgaggggcgaggtgcacatcgtgtgcccgcacctagcccgcgacagcgagcggccgcgagcacgagcacggcaagggcaggcggagcgaggaagaggacgacgaccagcggcagcaacgccgacgacgcgggtccggctccgagtccgagtccgagtccgaggaggagcaggaccagcagaggtacgagacggtccgcgcgcgggtgtcgcgcggctcggcgttcgtggtgccgcccggccacccggtggtggagatcgcctcgtcccgcggcagcagcaacctccaggtggtgtgcttcgagatcaacgccgagaggaacgagcgggtgtggctcgccgggaggaacaacgtgatcggcaagctggacagccccgcccaggagctcaccttcggcaggcccgccagggaggtgcaggaggtgttccgcgccaaggaccagcaggacgagggcttcgtcgccgggcccgagcagcagagccgccacgagcaggagcaggagcgccgccgcggtgaccgcgggcgtggtgacgacgccgtgggggcgttcctgaggatggcgaccggcgcgttctgaggctgcatggccgctggagacttgtgtgctgtgtgtactgtgtagtggttcgtacgtatgcgggagtagaataaataagagtggcacgggctcggtacgatgatgtaagttgccaacctacctactaccaaggcatgtccatgtcaatacataataaatacaagggcgttgcgtctctttttcagtaaaaaaaaaaaaaaa

SEQ ID NO: 13290 - DNA, 1149 bp, Triticum aestivum
  Clone ID: PAT_TA_13290
cagggtaaagcggagcgccgatggccacagcgcgactactgctccgaagcgcctccctgctccccctccgccgctcgcccctgcactcgtcccgcttccagccccgagccgccatggcctccgatgccgccagccagttccagaagatccagatccagcgcgaggacacgacgtttgatgcctatgttgttggcaaagaaaacgctcctggagttgtagtgttgcaagagtggtggggtgttgactatgaggtcaagaatcatgccatccatatttcccagatcggcgatggatacagagcacttattccagatttgtaccgtgggaaggttgctttggaggtagctgaagcacaacatctgatggaaggactagactggcagggtgcaatcaaggatattcaggcttcagttaaatggctgaaggaaaatggatcacccaaggttggtgttactggttattgcatgggaggtgctttggcaattgcaagtggagttttggtcccagaggttgatgctgttgttgctttctacgggacgccatcttcggagcttgctgatgcttccaaggcccaggctccaatccaggctcattttggggagcttgacagttttgttgggtttgcagatgttaccgcggccaagtcgttggaggagaagctcaaggcttctggagtggcacatgaagtccacatataccctggatgctcacatgccttcatgaacgcatcgcctgaggccgtcaagaggaggaagggcatgggtttgactgatgagaatcagggagccattgacctggcatggtcccgcttctccacttggatgggtcgtttcctgggatctgcatgagccattaccatatcttccatatggtctctgaatgatgtatgggcgtgtgtcggctcggaagaataaaatgtttgggcgcaatatgtagccagtgcccaatctagacacgcagtgtgtttgtgttagtagtactatattccaactcgtcattgttttgccagaatatcttgaggtacttgattggagtggaaatgaagcacttacacttgcgactttgcgagcatgtcatatgagtttgttttgtgttttaataagcttcagccgggtgttttctggccgatgggtgattgcatggattttt

SEQ ID NO: 13291 - DNA, 2136 bp, Triticum aestivum
  unsure (1)..(2136): unsure at all n locations
  Clone ID: PAT_TA_13291
gagctagctagttcacaatggcgaccagagccagagtaaccatccctctcctcttcctcctgggcacaagccttctcttcgccgcggctgtttcggcctcccatgacgaggaggaggacaggcgcggtgggcgctcgcttcagcagtgcgtgcagcggtgccatcaggaccggccgcggtactcgcatgcccggtgtgtgcaggagtgccgggacgagcagcagcagcatggaaggcacgagcaggaggagcaaggccgtggccatggccggcacggcgaaggggggcgtgaggaggagcagggccgtggccgtggcaggcacggccagggggagcgtgaggaggaggagggccgtggccgtgggcggcacggcgagggggagcgtgaggagcacggaaagcacgagcagggccgtggccggcgcggcgagggagagcgtgatgaggagcacggggatagccgccggccgtacgtgttcggcccgcgcaactttcgtagcatcatccggagcgaccacgggttcgtcaaggcccttcgcccgttcgacgaagtgtccaggctcctccgaggcatcaggaactaccgcgtcgccatcatggaggtgaacccgcgctcgttcgtcgtgccgggactcacggacgcggacggcgtcggctacgtcgctcaaggcgagggggtgctgacggtgatcgagaacggcgagaggcggtcctactccgtcaggcaaggcgatgtcatcgtggcgccggcggggtccatcatgcacctggccaacaccgacggccggaggaagctggtcatcgccaagatcctccacaccatctccgtgcccggcaagttccagtatttctcggccaagcctcttctcgcgagtttgagcaaacgcgtgctgagagcggctctcaagacctcggatgagcagctggacaggctgctgttcggcaggcgccaaggccaggaggaggaggagtccatctccatcgtccgcgcgtccgaggagcagctccgcgagctgcgtcgcgaggcgtccgagggcgggcagggccaccactggcctctccccccgttccgcggcgactcgcgcgacacctttaacctcctggagcagcgccccaagatcgccaaccgccatggccgcctcttcgaggccgacgcccggagcttccacgcccttgcccaacacgacgtccgtgtcgccgtggccaacatcacaccgggatctatgaccgcgccttacttgaacacccagtcgttcaagctcgccgtcgtgctggaaggcgagggcgaggtgcagatcgtgtgcccgcaccttggccaggacagcgagcgcgagcacgagcacggcaagggcaggcggagcgaggaagaagaggacgaccagcggcagcaacgccgacgcggctccggctccgagtcggaggaggagcaggatcagcagaggtacgagacggtccgcgcgcgggtgtcgcgcggctcggcgttcgtggtgccccccggccacccggtcgtggagatcgcctcgtcccgcggcagcagcaacctccaggtggtgtgcttcgagatcaacgccgagaggaacgagagggtgtggctcgccgggaggaacaacgtgatcggcaagctggacaaccccgcgcaggagctcacgttcggcaggcccgccagggaggtgcaggaggtgttccgcgccaaggatcagcaggacgagggcttcgtcgccggacccgagcagcaggagcaggagcgcggggaccgccgccgtggtgaccgcggccgcggcgacgaagccgtggaggccttcctgagaatggcaaccgccgcgctctgaggcggcaaggtcgctgtcaagtgaatgtgagctggagcccgcgccgtttgagagctggacttgtgtggtgtatgtagttcgtaagtacgcgggagtagcataaataagttgtggctcgggctcagcagtacgatgatgtaagttgcctacctaccttccaccaaggcatgcatgcccaacataaataaacacaagggcattgcgcctctttttcaaaaaaaaaaaaaaaaaaaaaaaaaaaaaaaaaaaaaaaaaaaaaaaaaaaaaaaaaanggggggggggccaaaaanaaaaaaaccnnnaaaa

SEQ ID NO: 13292 - DNA, 2109 bp, Triticum aestivum
  Clone ID: PAT_TA_13292
cggacgcgtgggcacagagctagctagttcaacaatggcgaccagagccagagtaaccatccctctcctcttcctcctgggcacaagccttctcttcgccgcggctgtttcggcctcccatgacgaggaggaggacaggcgcggtggccactcgctgcagcagtgcgtgcagcggtgccagcaggaccggccgcggtactcgcatgcccggtgcgtgcaggagtgccggggcgaccagcagcagcacggaaggcacgagcaggaggagcagggccgtggccgtggccggcacggcgagggagagcgcgaggaggagcaaggcggcggccgtggcaggcacggcgagggagagcgtgaggaggaggagggccgtggccgtgggcggcacggcgagggagagcgtgaggagcacggaaggcacgagcaaggccgtggccggcgcggcgagggagagcgtgatgaggagcaggggggtagccgccggccgtacgtgttcggcccgcgcaacttccgtagcatcatccggagcgaccacgggttcgtcaaggcccttcgcccgttcgacgaagtgtccaggctcctccggggcatcaggaactaccgcgtcgccatcatggaggtgaacccgcgcgcgttcgtcgtgccgggattcaccgacgcggacggcgtcggctacgtcgctcaaggcgagggggtgctgacggtgatcgagaacggcgagaagcggtcctacaccgtcaggcaaggcgatgtgatcgtggcgccggcggggtccatcatgcacctggccaacaccgacggccggaggaagctggtcatcgccaagattctccacaccatctccgtgcccggcaggttccagtatttctcggccaagcctctcctcgcgagtttgagcaaacgcgtgctcagagcggctttgaagacctccgacgagcagctggggaggctgctcggcaggcgccaaggcaaggaggaggagtccaggtccatctccatcatccgcgcgtcagaggagcagctccgcgagctgagtcggcaggcgtccgagggtgggcagggccaccactggcctctccccccgttccgcggcgactcgcgcgacaccttcaacctcctggagcagcgccccaagatcgccaaccgccacggccgcctctaccaggccgacgcccgcagcttccacgccctcgcccaacacgacgtccgcgtcgccgtggccaacatcacgccgggctctatgaccgcgccgtacttgaacacccagtcattcaagctcgccgtcgtgctggaaggcgagggagaggtggagatcgtgtgcccgcacctcggccgcgacagcgagcgccgcgagcacggcaagggcaggtggagcgaggaagaggaggacgaccgacggcagcaacgtcgacacgggtccggctccgagtccgagtcggaggaggagcaggatcagcagaggtacgagacggtccgcgcgcgggtgtcgcgcggctcggcgttcgtggtgccccccggccacccggtcgtggagatctcctcgtcccaaggcagcagcaacctccaggtggtgtgcttcgagatcaacgccgagaggaacgagagggtgtggctcgccggcaggaacaacgtgatcgccaagctcgacagccccgcccaggagctgaccttcggcaggcccgccagggaggtgcaggaggtgttccgcgccaaggatcagcaggacgagggcttcgtcgccggacccgagcagcagagccacgagcaggagcaggagcgcggggaccgccgccgtggtgaccgcgggcgcggtgacgacgccgtgggggcgttcctgaggatggcgaccggcgcgttctgaggctgcatggccactgttgagtgggtgtggggtgctggagcccgtgccgtttgagagctggacttgtatggagtttgtgggtactgtgtagtggttcgtacgtatgcgggagtagaataaatgagagtggcacgggctcggtatgatgatgcaagttaccaacctacctactaccaaggcatgtccatgtcaatacataaataaatacaatgggcgttgcgcgtcttcttcaaaaaaaaaaaaaaaaa

SEQ ID NO: 13293 - DNA, 1513 bp, Triticum aestivum
  Clone ID: PAT_TA_13293
cccacgcgtccggctagctagttcaacaatggcgaccagagccagagtaaccatccctctcctcttcctcctgggcacaagccttctcttcgccgcggctgtttcggcctcccatgacgaggaggaggacaggcgcggtgggcgctcgcttcagcagtgcgtgcagcggtgccatcaggaccggccgcggtactcgcatgcccggtgcgtgcaggagtgccgggacgagcagcagcagcatggaaggcacgagcaggaggagcaaggccgtggccatggccggcacggcgaaggggggcgtgaggaggagcagggccgtggccgtggcaggcacggccagggggagcgtgaggaggaggagggccgtggccgtgggcggcacggcgagggagagcgtgaggaggaggagggccgtggccgtgggcggcacggcgagggggagcgtgaggagcacggaaagcacgagcagggccgtggccggcgcggcgagggagagcgtgatgaggagcacggggatagccgccggccgtacgtgttcggcccgcgcaactttcgtagcatcatccggagcgaccacgggttcgtcaaggcccttcgcccgttcgacgaagtgtccaggctcctccgaggcatcaggaactaccgcgtcgccatcatggaggtgaacccgcgctcgttcgtcgtgccgggactcacggacgcggacggcgtcggctacgtcgctcaaggcgagggcgtgctaacggtgatcgagaacggcgagaggcggtcctacaccgtcaggcaaggcgatgtcatcgtggcgccggcggggtcgatcatgcacctggccaacaccgacggccggaggaagctggtcatcgccaagattctccacaccatctccgtgcccggcaagttccagtatttctcggccaagcctctcctcgcgagtttgagcaaacgcgtgctcacagcggctttgaagacctcggatgagcagctgggcaggctgctgttcggcaggcgccaaggccaggaggaggagtcgtccatctccatcgtccgcgcgtccgaggagcagctccgcgagctgcgtcggcaggcgtccgagggcgggcagggccaccactggcctctccccccgttccgcggcgactcgcgcgacacctttaacctcctggagcagcgccccaagatcgccaaccgccatggccgcctcttcgaggccgacgcccggagcttccacgcccttgcccaacacgacgtccgtgtcgccgtggccaacatcacaccgggatctatgaccgcgccttacttgaacacccagtcgttcaagctcgccgtcgtgctggaaggcgagggcgaggtgcagatcgtgtgcccgcaccttggccaggacagcgagcgcgagcacgagcacggcaagggcaggcggagcgaggaagaagaggacgaccagcggcagcaacgccgacgcggctccggctccgagttcgggggaggagcaggatcagcagaggtacgagacggt

SEQ ID NO: 13294 - DNA, 2453 bp, Triticum aestivum
  Clone ID: PAT_TA_13294
cacagagctagctagttcaacaatggcgaccagagccagagtaaccatccctctcctcttcctcctgggaaccagccttctcttcgccgcggctgtttcggcctcccatgacgaggaggacgacaggcgcggtgggcactcgctgcagcagtgcgtgcagcggtgccagcaggaccggccgcggtactcgcatgcccggtgcgtgcaggagtgccgggacgaccagcagcagcacggaaggcacgagcaggaggagcagggccgcggccatggccggcacggcgagggggggcgtgaggaggagcagggccgtgggcgtggccggcacggccagggagagcgtgaggaggagcagggccgtggccatggccggcacggccagggagagcgagaggaggagcagggccgcggccgtggccggcacggccaggaagagcgtgaggagcacgggaggcgcgagcaggaggagcagggccaaggccgtggccggcgcggcgagggagagcgtgatgaggagcacggggatagccgccggccgtacgtgttcggcccgcgcagcttccgtagcatcatccggagcgaccacgggttcgtcaaggcacttcgcccgttcgacgaagtgtccaggctcctccggggcatcaggaactaccgcgtcgccatcatggaggtgaacccgcgcgcgttcgtcgtgccaggactcacggacgcggacggcgtcggctacgtcgctcaaggcgagggggtactgacggtgattgagaacggcgagaagcggtcctacaccgtcagggaaggcgatgtcatcgtggcgccggcggggtctatcatgcacctggccaacaccgacggccggaggaagctgatcatcgccaagattctccacaccatctccgtgcccggcatgttccagtatttctcggccaagcctctcttggcgagtttgagcaaacgcgtgctgagagcggctctcaagacctccgatgagcgcctggagaggctgttagatccgcgccaaggccaggagaagacaggggggtccatgtccatcgtccgcgcgtccgaggagcagctccacgagctgagtcgccaggcgtccgagggcagccagggccatcactggcccctccccccgttccgcggcgactcgcgcgacacctacaacctcctggagcagcgccccaggatcgccaaccgccatggccgcctctacgaggccgacgcccgcagcttccacgccctcgcccagcacgacgtccgtgtcgccgtggccaacatcacgccgggttctatgaccgcgccgtacttgaacacccagtcgttcaagctcgccgtcgtgctggaaggcgagggcgaggtgcagatcgtgtgcccgcacctcggccgcgacagcgagcgccgcgagcaaggcaagggcaggtggagcgaggaagaggacgacgaccagcggcagcaacgccgacgcgggtccggctccgagtccgagtccgagtcggaggagcagcaggatcagcagagataccagaccatccgcgcgagggtgtcacgcggctcggcgttcgtggtgccccccggccacccggtggtggagatcgcctcgtcccaaggcagcagcaacctccaggtggtgtgcttcgagatcaacgccgagcggaacgagagggtgtggctcgccgggaggaacaacgtgatcggcaagctggacaaccccgcccaggagctcacgttcggcaggcccgccagggaggtgcaggaggtgttccgcgccaaggatcagcaggacgagggcttcgtcgccggtcccgagcagcaggagcaggagcgcggggaccgccgccgtggtgaccgcgggcgcggcgacgaagccgtggaggcgttcctgaggatggcgaccgccgcgctctgaaaggccactgttgagtgagtgcgtgagctggagcccgtgccgtttgagagctggacttgtatgtgtgtcttgtaagttcgtcagtacgcgggagtagcataaataagttgtggcacgggctcagtacgatcgatgatgtaagtttcgtacctaccttctaccaaggcatgcatgtccaacataaataaagacatgggcgttgcgcctttttcaagtaaaaaaaaaaaaaaaaaaaaaaaaaaaaaaaaaaaaaaaaaaaaaaaaaaaaaaaaaaaaaaaaaaaaaaaaaaagggagaaaagatataaagaatccaagattacgaacacagagaatgcaaaaaaattactttttatataggagaaacctaaattgggggggccggcctgaaaattaaaaacgttttgacggggaaaccccggggtttaccctttttatttgggtcccaaaaaataaaacctttgggcgggtgttttaaaaaccgaagaggggggaaaaacttggggtttcccaaatattgtgcctttgaaaaaccccttttttccccc

SEQ ID NO: 13295 - DNA, 2088 bp, Triticum aestivum
  Clone ID: PAT_TA_13295
cacacagagccagtgacacagagatagttcaaccatggcgaccagaggcagagcaaccatccctctcctcttcctcctgggcacaagccttctcttcgccgcggctgtttcggcctcccatgacgaggaggaggacaggcgcggtgggcgctcgcttcagcggtgcgtgcagcggtgccagcaggaccggccgcggtactctcatgcccggtgcgtgcaggagtgccgggacgaccagcagcagcacggaaggcacgagcaggaggagcagggccgcgggcatggccggcacggcgagggggagcgtgaggaggagcagggccgtggccgtgggcggcgcggccagggagagcgtgaggaggagcagggccgtggacgtgggcggcgcggcgagggagagcgtgatgaggagcacggggatggccggcggccgtacgtgttcggcccgcgcagcttccgccgcatcatccggagcgaccacgggttcgtcaaggcccttcgcccgttcgacgaagtgtccaggctcctccggggcatcaggaactaccgtgtcgccatcatggaggtgaacccgcgcgcgttcgtcgtgccgggactcacggacgcagacggcgtcggctacgtcgctcaaggcgagggggtgctgacggtgatcgagaacggcgagaagcggtcctacaccgtcaggcaaggcgatgtgatcgtggcgccggcggggtccatcatgcacctggccaacaccgacggccggaggaagctggtcatcgccaagattctccacaccatctccgtccccggcaagttccagtatttctcggccaagcctctcctcgctagtttgagcaaacgcgtgctcacagcggcgttaaagacctcggatgagcggctgggtagtctcttgggcagccgccaaggcaaggaggaggaggagaagtccatctccatcgtccgcgcgtcagaggagcagctccgcgagctgcgtcgccaggcgtccgagggtgaccagggccaccactggcctctccccccgttccgcggcgactcgcgcgacaccttcaacctcctggagcagcgccccaagatcgccaaccgccatggccgcctctacgaggccgacgcccgtagcttccacgccctcgcccaacacgacgtccgcgtcgccgtggccaacatcacgccgggttctatgaccgcgccctacctgaacacccagtcgttcaagctcgccgtcgtgctggaaggcgagggcgaggtggagatcgtctgcccgcacctcggccgcgacagcgagcgccgcgagcaagagcacggcaagggcaggtggaggagcgaggaagaggaggacgaccggcggcagcaacgccgacgcgggtccggctccgagtcggaggaggagcaggaccagcagaggtacgagacggtccgcgcgcgggtgtcgcgcggctcggcgttcgtggtgccccccggccacccggtggtggagatcgcctcgtcccgcggcagcagcaacctccaggtggtgtgcttcgagatcaacgccgagaggaacgagcgggtgtggctcgccgggaggaacaacgtgatcgccaagctggacgaccccgcccaggagctcgccttcggcaggcccgcgagggaggtgcaggaggtgttccgcgccaaggatcagcaggacgagggcttcgtcgccggacccgagcagcagcaggagcatgagcgcggggaccgccgccgtggtgaccgcgggcgcggcgacgaagccgtggaggcgttcctgaggatggcaaccgccgcgctctgaggcggcaaggccgctgttgttaagtgaatgtgtgagctggagcccgtgccatttgagagctgaacttgtatgtgtgtgtaagtttgtcagtacgcgggagtagcataaataagtcgtggcacgggctcagtacgatgatgtaagttgcgtacctaccttctaccaaggcatgcatgcccaacataaataaacacaagggcgttgcgcctctttttcagtattttcctgtactttagttacatgcaaatcatctgaaaaatgaattttccggcactttagttacatgc

SEQ ID NO: 13296 - DNA, 948 bp, Triticum aestivum
  Clone ID: PAT_TA_13296
atcaaagtaattcaccaatcaccgataggacaacgaaaatctactcagacatcataggatagccatacatcattgaaaaataatatatagcattgagtaccatgtttaagtagagattacagcgggtaaaagaggggttacactgctgcatagaggagggaagagttagtgataaaggcggtgaagttgttggtgtagatcacggtgatgatgatggccccggcggcgttccgacgccaccggaagcaaggcggagagagccccccttcttcttcttcttctttttgttccttgaccttctccctagatgggagaagggtttcccctatggtccatggtctccatggcgtgggaggggtgagagcccctccgagattggatctgtctctccgtctttctctgtttctgcatttttttattctgccctttcaccgtttcttatatattcggagatccgtaactccgattggattgaaaccttcgcccatatttttcttcgaaaattagctttcttgcggccaaagacgagcagcaaccgccttacaaggttcccacgagggtcaggggtgcacctgccccccccccccccagggcgcgccccgggtgccgggcgcgcccagggggggccgggcgcgcccaggggggagggcgcggcccccctgtctcgtggccacctcgggcaccgtttcgcgttgattcttcctccggaaaatcccaaatattccaaaataattctccgtccgtctttatcccgtttggactccgtttgatatggggtttctgcgaaacataaaacatgcaacagacaggaactggcactgggcactggatcaatatgttagtcccaaaaaatagtataaaaagttgccaaaagtatatgaaagttgatgaatattggcatggaacaatcataaattatagataaaacagagacgtatcagcatcccc

SEQ ID NO: 13297 - DNA, 1138 bp, Triticum aestivum
  unsure (1)..(1138): unsure at all n locations
  Clone ID: PAT_TA_13297
cgtccgggagaaaagaagggagcgattccgtctgtatcctccgactcgccgagttcgtgaccccgcctcgccgccggaccctagaagaagcggccaggcgtttccgcgccaaccgccaaacgagctgcagagctcgcaccttctctttcttcccttggtttgagtagccgtggcggcctgctccggccggtgccgctcagatctaccgcggcagagggggaagccccgggttcatgatggagcacaccgccgtcggcgaggatcaggccatgtccgaccttcgcgataagcatcgcctggacctggagagtttaacgctgacatcacagccattcaaaacactcgcattatttgtgctagccattggacagagtataagaagcacatgttcatgtgttctgaaagaaggttctcggttgaagttcctggttccgttgcttggtgctacctgtgtgcttctcctggtaactgatggcccacatgagaagcatatgcaggaactgctttggtatgccagatttggattatggtgggtcgtactaggggtggcttcatccattggattaggctctggcttgcacacctttgtattgtatttagggcctcatatcgcccttttcacaatgaaagcggttcagtgtggccgggttgatttaaagagtgctccttatgacactattcttcttaaaaggaggccttcatggttggagaaagactgtctggagtttggacctccaatatatcaggaaacaatcccattcagcaaaatactgcatgaagttcatcttgaagctgttctttggggcattggaactgcacttggagagcttcctccatattttatctctagagcactagcctgtcggcctcatggtgcttgcgggcgggctgggcccctctggctcagtggtggttggggatcatcaactntacatnggccaaggctgcttatgtntnctcacatattttaatttccgacatacngttcttgttngngccaaaccttgttaactgcggcatttgnggggcaattaacgnccctttgaantnttttgcacttaatggaagntntttaaggttaatgccnacacgtggaatactttngacacccactttttaantgggggggaaggtttgn

SEQ ID NO: 13298 - DNA, 384 bp, Triticum aestivum
  Clone ID: PAT_TA_13298
cgattcggacgagtttttttataccaatataaacataggcaagccgcaatatgccggccgagaatttggcggagacaaaagagagtttaatcccttaacctggcaacatgtttcatctagctccgttaactacttaactccataatttgcatccgttccaacttcctccatgtacagtctcaaggtaaccaatctaggccacacaagcttacaggaaccatctcgctgccactggagatcggcaaccttgtgagtctgaagagcctccggtcttggtggtcgaggacaagccaagcagctaagcgaggctgccgccgcaacggaggaatctggacggcggagttcgtcgcggcgaaggggggcggcgggtagaggcgccaaccg

SEQ ID NO: 13299 - DNA, 758 bp, Triticum aestivum
  unsure (1)..(758): unsure at all n locations
  Clone ID: PAT_TA_13299
caggcatctgctgcggttgccgcccgtccgaagccacccatgttacaccatccccttcgggtttgggggttgccggaggcataagaggaagaagaacataggccggatgtcggcatctcttcttgcccgtcgttttcttcacaaagagaggcgtcattcctcaccatggactcaaggttcatcgtgtgaacctatgggtttcgaggaaattattgatgaaactatgttagctgggaagctggaggtcatagaacattcagattcttgtagtgaaggcgatcctggttctcctgttgggttatctattggtaaaagttttggaactgcacctgctaatgcagtcacaaagcgtttgagtcaagaatgttccgctgaaagttccaatggtgcaaaactaaaacctacaactgggcagttttgtccggatgtcgtcgatgcacgttctggttggacggtggacgccaatcatgttttaaataaaatagaagccctcggagacatttcaactgccatggccatgctagtgaataagacatgcacatatggtggtccagatcacacgatgttcatggagaaaatatttgagcacgagaagatgatattcgaactgcgattagattgccaaaaagcaaaaactaagaggttgaacttctccattggcaacttgagcacccgacagaactagaaacncttagccgctgcatnctattgatccaccttggttttgttnctttgtacttgcnacaagttnatggtgt

SEQ ID NO: 13300 - DNA, 222 bp, Triticum aestivum
  Clone ID: PAT_TA_13300
ctagcgaaagattaattgaagagattaattagtgcataaggtgaaaaggttacatggacggctgcaaactgaaccgtgcatgaagtcacctcacatgccttcatcgtgagttacaaagcagtttctttttctatagactgttcaactgtctttacgtggaaacggagcaagtctttttctaccgctgtggccgtagagagaatcagaccaattggctcctct

SEQ ID NO: 13301 - DNA, 757 bp, Triticum aestivum
  Clone ID: PAT_TA_13301
acccagccaattcaaggcttctcgcaggccttgcggcaatggcaacatcacatatgaccaccaccgtcttctctgccatcgtcatcattcttctttcctcagccatggccgctcagagcagcggcgatgtcggtggcaagaagcccaagcctactgacttcatgctggaagcgtgcaagaatgcctcgaactggtccaagagctacaacgaaggttacaactacgtgaccgcggaattttgcatctcgaccctcctctccgacaaccggagcgccgacgccaaggaccgtcgcgacttggcgctcatacccgtcgacatcctcaaggagcgtgttgtcatcgccggtggcaacgtcaagaagatgctgcacagcaccaagaacagcacgtcgacgacagcacgccatctcagaacctgcgagctggactacacggccaccgcgggcatcctcaacttctgcgacgccttgatgagggactaccagggtgacaggagaagcgaggacgaagacaacgacgggcccctaaacttcgagctgcctgaatgtgtggacgaggcgaacgaggcctggggctactgcgggcttgctcttcttcatataccgggggcggaggcgctggtcaaggaaggcgatgaactacagatgctgatgaatctcagcattgccttgctatcaccatacagactggactgattcatgacagcttttttctgccagaaaaaaacatacagtattaatgttgcaacgtcaattct

SEQ ID NO: 13302 - DNA, 1044 bp, Triticum aestivum
  Clone ID: PAT_TA_13302
tttttatcagcatgcgactgccatgcattctcataacgaaacgatcacgagacagctgcaattgcagatctgagctgcaagatacagcagataaatataggatggtgcagtaatcttgttgaaaacaatgaccataattctgagtgctttcgtgccagggcacataaacgaattttcatctacatgcaggctataatactagattcccatgagcactcgcgcacacacacatcaatgtaccagttactgacacaccccattgtaacctgtcaccctgctcactttgttagacatatgctagttttacttggagaccatctgcacctgtgtatcagcagcagtttgaggtttagtcctcatccaaccattgttggtggcttgtaataagagctcgtctatttagggaggatctttttcaaaggatttctgagcaagtcataacatgattcctcgtagtatcttgtatccatccaaagctctgcaatgtttttcttccatgtatgacatactccttcaatgaccttttcaaaagcaacttgtccatttatgtcgcttctttgtgagattatccaatactccataattccttgaatagcaacatatctagggcagccatgtcctttgaaaactagttccttaaattcgtctatgagtgatacaaaacatgtcttctcccagtcaatagaatcgttatcaacattgaaaaagccttcctcctttagctcatgcaccaagttttgaaggcacaccttcagcttgtcatccgctgttatgtttttcaagttttcagaataaatatccacttgacgtattgtatccacaatctgagctcgatcctccaaagacaatttaatgagcttatcatccaggttcccgaaccgacttttcacgttgtttttttcaacaaattgcagaacagacttatcctgtgaagaactaaacttatagacatcatcatctagttctccggaagccaaatatcgatcaaactcctgatgccgacggaattgttcccgtgccgtaaaatacttctcgtgccgaatc

SEQ ID NO: 13303 - DNA, 729 bp, Triticum aestivum
  Clone ID: PAT_TA_13303
ccacgcgtccgatcaaacacctcccgtgggtcccggggcacccacctcccgagcttcctcctcatttcacaccccacttctcccgcccttcctcgagcgcgtctgcatggccaagaaaggcgccggcggtgaggagagcgtggtcgtgccggggcagacggaggaggccaagcaaggccctccccggaagcgcaacccgtgccccggaatccgctgcgtcggcggccggatctatgacccggagaacgggaagacctgccaccagtgtcgccagaagacgatggacttctcggtggcttgcacgcagccccggaagaaggggctttgtccaatccacttctgccacaagtgcctcctcaacaggtatggtgagaacgccgaggatatgaccaaggaggcgggctggacctgccccaaacgctgcggccgcggcaactgcagcttctccagaaagaagaaaggggagacgcctacaggactactggcccatgctgccaaggcgtcagggcactcgtccgtccatgatttgctgataaagggctccgacatggtggttgctgcacagacgctgtcctcgctccctaagaagatcaagaaggaacgcaaggagggcagcttaaagagggcgctagggatagatgatgctaacggtggattgttcgctgaaggggatgagaatattaagactgatctcaatgcacttccttcagttcctatccaaaagaagct

SEQ ID NO: 13304 - DNA, 552 bp, Triticum aestivum
  Clone ID: PAT_TA_13304
cctttgtggggggtggttggccagctcaatttattataacccaacggatggtaatagcaatgtttagggaaaacgcagctttatttagtagtactgccttctcttataggagtagctcgctgatttattcactgaagctggattgcaaaaaggccgagtagctaggccttacgcagcgccggccgaatggggccattggccgcggccctccgtcgacggcggtactctcggaggaccgacaagggatccgccaccatcacctcgcccgcgaacccccccccctccctttgctcccccggccccccccgccgccgttgttcggcggcgcccctccgctgcccgccgtcgcggcgccggggggcccggttcgaggccggcgtcgtgccggccgtcgccgcggcgcccgccccgggcgtccccgggcggccccccggcgtccgccgctccccccccgaggctgccgcccagcttgctcccgcccgcccggggcgcccgccccctgcttgcccccgcgcgcgcggtgctgcctgcctctgttttacccgggtctgg

SEQ ID NO: 13305 - DNA, 367 bp, Triticum aestivum
  Clone ID: PAT_TA_13305
attcggcacgagggggaggaaaaaaatagtacccacacttctgatggcacttaccaagaacaacacaaatgccctgtgtttggtaattcttatgatgtctaccactttgttgccatgcgaggcaactgggagaaacaaaggtacacctgcattgattgatgtgtgcaaacgtgaccggttatgcgagaacccgataggatacaatgttaccttgtgtaaggtttcatgtgaatggtctggctacagtttcgacaacagctattgtgaagagggtaaatgctgctgcgcatcctaaggaattaaacgaggtgccagaacgccatgcttggaagatatggtgaatttcaataaacaataaaagttagct

SEQ ID NO: 13306 - DNA, 597 bp, Triticum aestivum
  Clone ID: PAT_TA_13306
gcacgagggtttcattcacgtgggcacactgacattcagagcgaccagaccaaactgaaccgaacactgacattctcgggtcagcgcctcctcttcctcgttccccggcctctgaaatctcgcaaacccctgtaaggagatgctgcctgtttgccggccgtcggcggtgtacccggtggccgtggtcgcgccgccgccgcaggtagggctagcggatgctcccccgcccgaagtgtggacgaggatcccgcaggggacgccggggacgcttggcggggtcggcctccgcctcctgcaggccctcttcgctgccgcctcgatcgccgtcatggcgtccaccgacatcttccccttctgctccgccttcagctacctcatagcagctaccagtctgcaatgtttgtggagcatcgcactagcctttgtgtatatctatgcacttcttgtcaaatgttccttgttaaatctccgagctgtacgcatatttttcgttggagactggatcacagggaccgtaaccttgagtgcagcatgtgcatcggcaggcatcactattctgattgataatgatgtgaagtactgcgaagcccttccttg

SEQ ID NO: 13307 - DNA, 763 bp, Triticum aestivum
  Clone ID: PAT_TA_13307
cttcaatacatttcaagacttcctactagcctaatagcaatggcaacaatgtcggcgacctccatcttcttctctgccatcgctatcatgctcctttccactaccatcgctgccgaatctagtgcctctggtggggccaaacccaaggtaaccaacttcatggtggaagcatgcaagaatgcctcaatgaaaaacaaaatatacgaccccaacccaatcacgcaggagttttgcgtgtcgaccctcatgttgggacaatcggagtgccgaggctaaggatctccatagcttgatacacatcgccatcgacatactccaagggccaagttgctgccggcgaatggtaatgttcaaacaatggctgcaagacaccaagaatggcacggctacaatgcgtgccctcagttactggcatgggggactacgatctgaatggtgagcatactcaacatatgtgacacaatgataagggtgcaccgcccccgcgagggcggagccaatgatgggttgctgtcttctgagctgcctgcctgtgtggagagagtggacaaacctttcatcgactgttggttgggccttcttgctatggaggcgaaaaagctgttggatgaaaactttgcggtgggcatgtcggtcacacttaacttttgccttgctagcaccatatagggtcaatgattcataatttgtttttgcaatatgaaatggtggttgttgtaacatctatttaccttcacttggaataaaaagaatgttaccgtgt

SEQ ID NO: 13308 - DNA, 678 bp, Triticum aestivum
  unsure (1)..(678): unsure at all n locations
  Clone ID: PAT_TA_13308
cggagggntntcagngtagtgtaccagtttccntcagantttaagacgccttggggntaagcccttngggattgaccggcccccaaggttctgagatatgtccctgcaatgtatgttgtggngggaaccatcattaatgttgttggccanagggacgtgccccttccccaggccggctttctacctcagctcggtggcggccggtatattagactctatcctggttctgtatccgaagacttatacccacacacagaaactatgttgagcaatactagtcaggtggatcttgacaacatagatatgaatgagttcccaaaggtagaaaaccttgatttcatggactgcatattggaggaaggtgacatgctgtatattcctccgaaatggtggcattacgtcagatctctatcgattagtttctccattagcttttggtggcgtaccacagttataagtccgagcgcgtaatgaaaacattttggtctttgatacatcaggaccagatctcaggactcagggacttggtaagcctgactggacacattgtttcaacattctgtcgcccaccgttgcgtggatgtagtcgtttgtacctactatcgcagatgtacatggttacttttattataattattttggacatttgattgctgttatcgcagatgaccattgtta

SEQ ID NO: 13309 - DNA, 669 bp, Triticum aestivum
  Clone ID: PAT_TA_13309
ttttttttttttatttttagaaaacttctaatctattcctcttcagccatgggaatacaacgaacaacagaaataataaaagttatatccaggtccgtggaccatctagcgacaactacaagcaccgaatcaagccgaaggcgcgccgccgtcatcgcccctttctcgtcagagccgggcaaaagttgttgtagtagacagtcgggaagtcgtcgtgctaagacctcataggaccagcacagcagaacagaaaccgccgccgatgagaagtactatagatcggaaggatccaacccaaagaaacacaaacatagacgaactacaatcagatccgagcaaattcatcaaagatagattggtcggagacacaacttcacacgtccatcgatgatgccagacacatcgccgaaacggtggctagggcgtggaagaccttattccatcttcaggaagccgccatcgtctcgtctttttaagcaggacacaaaccctaacaaaatttgaagaaacatctaaaaatgaaggcctcccgtcggcaaagaccgggatctactgcgccgtcatggtcctaaggccaccgaaaatgaggcggaccgacaacggcgccagcgggaggcaaagtaaccctaagcttttctttggggaggaggctgctcgctaaaatttctc

SEQ ID NO: 13310 - DNA, 599 bp, Triticum aestivum
  Clone ID: PAT_TA_13310
ccacgcgtccgcccacgcgtccgcggtgggagagagagctgggcagagacgggggcaagtacatcaaagacgatggcctgcgatgtcgccgcccacgagccacccgccatcctcaccatactggagcttcgcgcgctcgacaaggcccccgccgtctgccccgcccaggagccccgcacgcccgacaaggcccccaccgtctgcaccgtccggtagctccgcgcgggcgacgcgccgtccaccatgggcagggcccccgatctctgcgccgacgacacagagcacgtggcacacgatcgagtaagaccaagtccacatcacgctatctccattctatttttttcgtttgtatgcggagttccactttggttccgctctgttcaactcagcgccgcgaattgaactgtagaatgtgtcggctcgctagtgaattttgtgtaggtcacgttggagtagggggttgggcagcaagggtatgaggattttgaatcattgagccaggaatttctatttgatagaagtctgtatctgctagagaaattgtgcagtaagtctgaatttgttagattcagaataccatagcatttctgaacattttt

SEQ ID NO: 13311 - DNA, 333 bp, Triticum aestivum
  Clone ID: PAT_TA_13311
ttccgacccacaccgtccgcccacgcgtccgcggacgcgtgggcaccgcccgcgaccagttcgtcatcctggccactgacgggtgcctagacatcaccggcaacaagttcagcactgtctgacaaggtgccctgcagggacaacctgacacggtcattgctcacccacgttcgaatctgaatcgcaaaggagaaggctcgcatcatgcagtgcgagaagacttgacgacagtcaacctctgttgacctgtcatcgaacttcactgtttgaggtaggagccgtgacttgcattgaccatgtatggagcaagaagcaagcgacaggcttctcatt

SEQ ID NO: 13312 - DNA, 355 bp, Triticum aestivum
  Clone ID: PAT_TA_13312
ccgtgccggcgcccaagccccctgctgcgtcgccggcgccgaagcagacacctagcccttcggcctcgccggtgccgaagccgccggctccgcgcgcgccggcgcaggcgccaaagccatcgtctccagctgcacccgcggcgtcaccggttccaaagccacccactccacgtgcgccggcgcaggccccaaagccgccgtcacccccacccccggcgtcgtcggcaccaaagccgtcacctgtcgccccagcgccggctcaaaagccgtctcctcctacgactccaccaccaccaccaccacagaaaccatctgctcctccgactccaccaccggctccgacacagcctccgac

SEQ ID NO: 13313 - DNA, 569 bp, Triticum aestivum
  Clone ID: PAT_TA_13313
ccccaattttccgaccccaaccctagctccgatccacccgatggcgaccgcagagggcaagaacaagatcatcaagctcaagagttcagacggtaaggagtttgaggtggagcaggcggtggccatggagtcgcaaatgatccggcacatgatcgaggacgaatatactgacaacggtttgttgctccgcagtgtcaactcaaagatcctctccaaggtcattgagtactgcaacaaacacgtccaagcaaaggccgccgacacatctgattttggaggaggagctaggccgttaggtgctacatcggctgtgctgcgcgcccgcgaaggacctcaaaaactgggacgccaatttcgtcaaggtcgacacggccaccatattcgacctcgcactggctgcgaaccacctcaacatcagggggctcctagacctgacttgccagaccgtcgccgacatgatcacgggaaagacgccagaggagatccgcaagatcttcaacatcaatgagaaattaagacccgaggaggaggagaagatccgtagggaaaaccagtgggcctttgagtag

SEQ ID NO: 13314 - DNA, 1129 bp, Triticum aestivum
  Clone ID: PAT_TA_13314
ggtttttgataacaaagtcattcctgattactgattccgctcgcgtgacaagataactgcctgataacataagtcacaaagtccacataccagtacacattggtaaacaagagatctagttgatatcaaccatctagaaaccatgaactaccattgctaaaatacggggcaacactcggctaagggggcgagggcatggcaatcagctccatcacaagagaatggaagctcttgcacaaattcttgaagccgtcagtggccacgactgccctccgatgtgccgggcagctgagaaaatcaaagcatgccttcttcaacccattgcagtggtactgctcagcaagtgctagaatggtcggaacagagcctgcatcaatgtacttgcataatttttcctcacaaatcagctttagcctctccatgttatacctgtccgccgcaatgagcagatgctggcacatgatatcttcctcttcttcttttgcctctcgcaatgagtcagtgtaggcaacgtagagcaactccttgaacacctgtgcctccaagtcatctatgtgtatgacactggctgtgtcgccctccttcatcacaccaaagagctccgcgctgaagactggagatcgcgacgcgagcacacaccggtgtgcaggaatcatctctccgcctacctcaaacacaacgtcagcgcccttctcggtcttgaggagatcaccgaggtgctgattcagctccggtgggggcacaaagacaaactttggagtgctggtctgtttggtgcagatgtcatggacgacgacaacgtcacacctgattgtgaaagaatcatccttgagatgctccgacttctccaaattctccctcttgatgaagtttggatatccccacatttgcttaccaccaaaaacatatccagttgtggatgccgacggccatgacagtcgcttcccaagcaccttggcgaaattaatagtgaacattgtcttcacatcctcggttacaatttcatcgagtttgaggtaaaaggaaatataatccactgtttcggagtccttgccattggggtaatagtagatgcgccagcaccggccgccgacgaagaactgactggattggaggaactcacccgcgg

SEQ ID NO: 13315 - DNA, 1089 bp, Triticum aestivum
  Clone ID: PAT_TA_13315
tcgttggccggcatccagcgcggccccgtgcggcccccacgcgttcggctgatgtacccaggagagcctcacttgctgctagtgtgtctcattccagaagtccaagcattgcaatgcagcaccgtgggcattcatcttcatcacacgagattcggaaggaacaaccagcagcaattgctcgagcatgttttctacactactgcatggcagttcctccctctattgataggcagaagcctggtggcttggacttccacacggcttgcatcaaccagtcggctggtaatcaagagaacttgccccatctcaaaaatgccaaaggtgggcacacaaacaccccccggcaaggagacctgttagcggcgctgctgctcaaatcggcaggcatccttccccggttcccccttttattgagaccaattgggtaatacggggtaaagtagataacaaacccttttttgcaccctttccaaatgacgaacgtcttgggcgtgttaggcgggcaggtagtaattatacatataggaggggggttaagcaatggaaacctctctaactgaaatggaaagacgacattgcatgtattagaccatggttggttttcgtttcagcttccgttcaaacctagaattgatgacattcaaaatttattgaatagtcatacataccgtgcatcaagcaatggctggtgatcaagaacacttgccccatctgtaaaaaggcagcgctgggcacctaaacaaccgcccgcaaggccgctcctgcggaaatctgcagggctgcctccctcccctgttctccccctttactagaccaaatgggttataagcggcaaagcaagcatgcaacacctctttccctcctcccaagacgcaacgtcgtcgagggcgcgacgggcaggtggaattatatacctataggcggcggggcaccacatggtgcacccctcttactgaatggaaaagccgacatcggctgtagtggacctggatggagttggtttctgcttctgttcaaacctagatttgatgatgttcaaaatttattgaaatgacattgttccattttaaaaaaaaaaaaaaaaaaaaa

SEQ ID NO: 13316 - DNA, 593 bp, Triticum aestivum
  unsure (1)..(593): unsure at all n locations
  Clone ID: PAT_TA_13316
gattcggacgagcctctggctaattcactcgctccgagcctccacccctccttctttcaccaccagtagatccaccggagcaagcagaacctccccatcccttcgcctcgtcactagagcaccatagccccagttccatcttcaccgtcatcggccgtcggccatggtcgatggtgctctcgtcccttcccccttcgaagcccgcatcctgcacggatggacgcggctcgtccccctggtcagtccgggtggttggagcatcgccggaggtggccggtgccgccgggcccggcgangtcacctccgctctgccccgtcgcggcgagaagaagacgaagatgcgaacccccctgccggtggaccccatggtccaccagctcagccacatgggccgttgaccccagtcgtcggccgaatcctctattttgtgaacattcatcggttaagagcagaaaagcacataatctgttgatttttctgcctaacgaacgaacgaccacaactcttcaaccgtagctccaaatcaagtgattccaaagcccatctctttgtatcgtcgagcccgttccgatggtatcattttgaccatgtga

SEQ ID NO: 13317 - DNA, 809 bp, Triticum aestivum
  unsure (1)..(809): unsure at all n locations
  Clone ID: PAT_TA_13317
ctcgtgccgaattcggctcgtgcgcccctggctcgctctccctgcgaccggtggcgacggcctccgcctccagcctccacctccgttcggtgcatctccgtccgacgaccggatagcgccgccccccgcgccctccctcaagagaaccgcctccacagtccgtccctccggcagcagcgacggcgacggaccgggcgtcatccatctcccctctgcctcaaagcttctatcacctccggcgacgacgatggccaagaggtcaccctcctttcaccaaggtgctgtatcatgagctagcagagtatgtgcatctgtgctcctgccgctccacttccaggtgatggcgtcgggttggtcagagagggtgaagctctcaagttcccgccaaagtatcaggtttcctaaagatagcaaataaaaatgttcaaagaagttgatgctggaagtttcagtaaagtatctatttcaacagcaaaactttttgctatggacgtgtcacatatgagcatttttttaatggagctaaatgcttattccttgctggatttttaaccgtagttagtttttaaaaaaacatgattagcacaataaattctatactcggtggggttgtgtacctcgcgcaactctatcgcggtacttgttggaggcaagtgctgggggtggagtgttaatttgctgaataagcgggggccgtaccantcccnnggggcatancgtcaggcnntttaanctgtggaacctggncantacctnagaagccttcatgtaanaggcccntnctcagtgactagangncctggataggg

SEQ ID NO: 13318 - DNA, 506 bp, Triticum aestivum
  Clone ID: PAT_TA_13318
cgattcggacgaggagattaacagctagctgtaacataaatgcaccacaagttgcataacatgataactgttagcaaagcataggcctcaaatcatcttgtgtagatgacagatcgtcttttgaactaaagcttcattctcctcatctatatatcgttccatagcttcatttttttttgtgtttaagaaattgcacatctctttcctaatttgcgcggatgcctcggcacacttatccacaacactgaaaccctagaaaggttccagcatggactatcttgccacactgtacacatgagtataattttcctctctaaatctggccagaacgcctactttgaagctggatcttggatgtagctaactcaccttgatgtggtagtttaccatggcaatgtgaacaatgagacaccttctggtctcagtgacactgcatgtgtttgtttcgcattctgtttacttgtctcagtccattaccattgcattcatctgcatctgttagcaaa

SEQ ID NO: 13319 - DNA, 379 bp, Triticum aestivum
  Clone ID: PAT_TA_13319
aaagaagggaggaaagagcaattgaaaaagcacagcatgaggaggaaatggcattgttagccagagaaagagcacgtgctgagtttcaagattgggagaagaaagaggaagagtttcattttgatcaaagcaaatttaggtctgagatcaggttacgggagggacgtacaaagcctattgatgttctcctgaagaatcttaactttgcggacgaatttgatgttgagttaaatgagccctacttggtgttcaagggattaacagtgaaggagatggaagagttacatgatgacattaagatgcatctcgatctggacagggaaagccaagtaaatgtcaagtactgggaggcactcatggtagtgtgtgattgggagct

SEQ ID NO: 13320 - DNA, 1017 bp, Triticum aestivum
  Clone ID: PAT_TA_13320
ggtacatgacatacttcagcgctacccagagcttatgactggatttagcgagttcttggaacattgtgaaaacatagatggttttctggatgcggcccgcgataaaaggcaaacatcacgaacagtcaaggcattggaaaaagagagagataaagggcgtgcaggggaggacagggaaagagatgctgaaaaactgagcgaaaaggaacgagaaaagcttgataaagtgtctgcgctcaattctaaggaagccactacccacaaagctgctgcgttctcttctaccaaagagaagtacctatgcaagccaatatcagagcttgacctctcaaactgtcagcggtgcactcccagttaccgacttttgcctaaaaattaccccgtccctgcttcaagttgcagaactgaccttggaatctctgtgctcaatgatcactgggtatcagttacctcaggaagcgaggattattcatttaaacacatgcggaagaatcagtatgaagaaagcttgtttagatgcgaagatgacaggtttgagttggacatgctgctggaatcagttaatgtggcgattaagcgtgttgaggagttgatagaaaaaatgcaagaaaattcaatcaaaccagacagccctatacgcatcgatgaacatttgacctctctgaatttgaggtgcatagagcggttatatggtgaccatggccttgatgtcatggatgttcttcgtaaaaatgcgagtgtggcattaccagttattttaactaggcttaagcaaaagcaggaggaatggtcaaggtgcaggtcagattttaacaaggtttgggctgaaatatatgccaagaattatcacaagtcccttgaccatcgcagtttctatttcaaacaacaagattcgaagaatctgagcacaagagctctattgtctgagccccgtgccgttaatgagaagaaaaggaaggaggatgatgtgcttcttgccattgctgctgggaataggcggccaatagttcccaatat

SEQ ID NO: 13321 - DNA, 464 bp, Triticum aestivum
  unsure (1)..(464): unsure at all n locations
  Clone ID: PAT_TA_13321
gaaaacaaatctaacttgcacggtgtgcgacatcacggcaaccagtgaggttgccctacaagagcacctcaaagggaagagccacgggaggaaggncactaaacttgcgctccccgcgcgtggaacaggtcaaccggaggaggatgcgttcagcttgaaggtaaatgggtcgccagccttaccggccaaggggaaaaaccctagtgttgctgttgcttcgatggctcttgctgaaaaaaaggtgcgacaacttgggcttgaactgcacggtctgcggcatcacagcaagcagtcagaagaacatgcaagatcacctcaaagggaaaattcatatgaggaagactgccatgatcgcgcagccatatcctaaaggaggatgggggtctgctcaaaaaccatatgcatcaagcaagccgtngctaccggccaaagccggaagaactccgtccttgtcccagccgcat

SEQ ID NO: 13322 - DNA, 573 bp, Triticum aestivum
  Clone ID: PAT_TA_13322
cgaattcggcacgagaaaaagtggcatcgtcctctcaaattctcaatgtaggagagatcaagactcaatgtaggagttctatattttggtctagtttggcgtaaatacggcatggggcctcttcaaggtctctgggcatggcgaactggagagcagtgcatgcccaacatatggcgctcgcttgacgccatggacgaccaggagggaggcctcatattctccgcccaacttgatccgatgagggcgggcttcgatcctactctgatcagcttccctgttccagcgctaattagtcgccttctcggatggagtaacaacagtggccaaggaaggccgcagggatccgtgatggtcgccgccgccgctgttgctctttacgtggctgcactctttgtttctggtcagcagcctcgccggcgacgtctggctgcttctgctgcagctaggccaacttctgccagacctcgtgctctccctctgcctgcgccggacggcgggctcctcagaatactgtcagggaataatcacgaatatctggagaacgtggtccacagcgcgtccatcggtgcccgg

SEQ ID NO: 13323 - DNA, 451 bp, Triticum aestivum
  Clone ID: PAT_TA_13323
cgattcggcacgagctttcgagcccaagatgactggcaatcatggtgggcgtagaagaaaggcgccacaacagggccgtccagcacgcgacgatgccgtggacatatcacaaagcaactccgatggacaagatggcgccgaggggtcacagcccaagaggcgcctgcagaggctcaccccccagcaaacccaagtgcttgaagggtttttcggcatatgtgcgcaccctgacgagaatcaaaggatggggatgagcgagtcgacaggtcttacgatgcagcaagtcaagttttggtttcagaacaagaggacacatatgaagcatgtgactggaaaagaagagacctacaggatgaaagcgcagaatgagatgctgagggaggaaaacaagaggcttgcatcggcagctaacacttcattttgcccctcctgcgttgctttaccaggactg

SEQ ID NO: 13324 - DNA, 623 bp, Triticum aestivum
  Clone ID: PAT_TA_13324
cgtccgctccgctccgcgatgcggcgacctccgcttctcccacgtgcccgtgtcctgctcggctccggccgaccgccacctcactcacctcaccattccactgtcgtcatcaccatttcttccgcggggggtctcgtctgaggcggattcgatcgagatggtcaagatcgaagattgtgatggggatggcgccgccgacccgccgcagcccaatccggctccggcacccactgccgtaaaggcggaggaggcgattgatgatggtcagccaggcacttcatccagctatctaaggtcacactttatcggtatgggattttcaccattactggttgacaaaatgcttcagaaacatggtgatcatgattctaatactatattggagtcacttttgtctcatcataattctgggtccgaatcgtcaagttccacaggtgtctcatctgattctgacggtgaagaaaacagttctgaacaagaggtcaagccctttcgattctgacactgaggaaggcggtcatatttactccgcacaatgaacttctcacagacggaaggtcggttgagcattcgacctattaggtgtggacgcccttatttgatcagcttgttgagctccctgt

SEQ ID NO: 13325 - DNA, 506 bp, Triticum aestivum
  Clone ID: PAT_TA_13325
cgattcggcacgagtatccccccgctcgtcggaacgcgttcgttgccgccacgatgccctgcaactacaggaaagcggtcgccggcgaacttatctgctgccaccgtggagccagcctcgtcacgctatataaagggtccccgagcccctccgagcactcacgcgacatcagacttcccccgtagagctccccgcgcagtagtggccaccctccccaactccggctagctcggccgctgctaagccccagcgcgattcgtcgccgccggccacccttttgccaatccagcgccaccagaaactttcccgaagtcttgcggagctgcccagctacccaactgcggtcggagaccaccggagcacctaagtcacttcaccagcgtagcctccctccgccgcgaagctcgccgccggcgattcctgccaccttctccgacccagcaaccaccccgaggaccgcctcggtctagccgttccatccccgcccgcagatgccctcgaggagc

SEQ ID NO: 13326 - DNA, 568 bp, Triticum aestivum
  Clone ID: PAT_TA_13326
cgtccgcccacgcgtccgcccacgcgtccgcccacgcgtccgcccacgcgtccgcggacgcgtgggttgccatggcaataggagcaggcttggtagaaatatggtgttataagtggtatgttttaggcggtcttggagtttacatcaccctgcgcacagtcaagcgcttcgtgcgaacaaattcccccgatgtctcctctgctttggcagcaacaaaatttgccactgagagtgccgatgctgcagctgttttgggaggctatgtcaaagaggttttaaagagaaaggatttggatgatttggatgtctgtactgtgacgacagattttggatctcttattgaaactaaaggggctgccgtgggatgctattgtgttgagcatttacatttaaaagtcatcaaccatttgaatgacagtgatatgaagcatttgctggatagattgaatagtgcttttgagagtttgaggaaaatgttggtgctgaatgcaaggatgggatacagattgaccgagcaaacagacaagtcacgatattgcatcctctcaaaagatggccaggctattgg

SEQ ID NO: 13327 - DNA, 643 bp, Triticum aestivum
  Clone ID: PAT_TA_13327
gattggcacgaggcaagttatgctttcagaagcgtaatctcacccagaccaagacaaatgcaaattctgccttgtctcaacaaaagagtaatggccaactgccagtgactgctcccaaaataatcttcacggttcgttctgcccattcttctgaaccagccatgaatgtcgcggctaaggttgaagctcagccagttgcaaaggtggaaactcagccaacgaaggtggaaacccagacagtcatgaaggtggaaacccagccaataccaaaggcagaatctggacctattacaaatgtggcgactcaaaatattgcagggggtgcaggttcagcctaaggctaaaactaaaaagccgaagacagaaaagccaaaaaaacctaaaaaagttcaggttatcacatactttggtcttgtttggaggaaacataagaatgacattggtggagaagatttcagggccaatgatgtaatcctaaaaagcaaggatggtataggttcttcaataaaaccagcttgcgtctctgtaacaaaccttatagtccagatttcatgtatgtccgctgtgagaggtgccaaaagtggtttcatggtgatgccttgcagcttgaggaagaaagaataactgaagtggttcagtaccg

SEQ ID NO: 13328 - DNA, 1129 bp, Triticum aestivum
  Clone ID: PAT_TA_13328
ctggcgcccccctttcctccgcccccacggtccgcgctgttcgatcccgagccctcggccgatggcgcccgccgccgcagcttctcccgcgcctcctctcctccgccggcgcctcgtcggcccggccggcggagcttatcgagctctcggaggtggagaaggtgctgcacgacgtccgggcgggggacgtgcgtgtgttccccgtcggtgagggcgggctccacggcggcgcttgtgcggactacatggtcgtcgccaccggccgctccgactggcacgtccgcaacatcgcacaggccatactctacaagataaagcagaaacagaagggttctaatcgaatattgatgccgagtgtagaaggccagcaagctggaaagtgggttgtcattgattctggaagtatcatcatccacgcgcttgaagaaagagcaagagagtactatgatttggaaagtatttggacaaaggcggtgtcccctaacatttctgttcaggagttggagacctcacttgtgaagacgcgccgcaagggacctgtcgcagaaacccatgaagagcatttgagttaaatgtgctgcggccatgatccatcatctgtagtgggtttgttaggttggcagcgtcaagcttgtttgtgtaaagaactttgaaggatgataggtttgcaaggctgcttgtgaatgagccagtctgctttcatgacaccgtgacgtccctgtccagtccgctactgttgtcttttatcacttcgtcgtttgcatgttcaaccccttggttgggccgtatttatacctctcatactgtcttgcaccccatcattggatagtaatcataatactatgatactatgtggaagccaaggtaacacattggccaatttagggtgtgtttatttgggctgcaacttctaagttgcaacggctccggctgaaaggagcagctgtagttgttagctgtggctggaaggctggagctgaggtgcagctgtttggtagttttcttgtagtagctgtggctggtgctgaaatgtgccctcattttagcaaataaatgtactcctaagcttaatgcccaaaaaataataaggggttggctcaagttgttcttaaaaaaaaaaaaaaaaaaa

SEQ ID NO: 13329 - DNA, 553 bp, Triticum aestivum
  Clone ID: PAT_TA_13329
gcaaagcgaagcctaatcgtgttcgtgttggccatggggttcaacagggcacagtcggttcccgcctgcgccctgccctcgccctgcccgtcccccgctgcgcccgcggtgcggccccgtccccgccccggccccgcccctgcccttccccatcccggctcttgcatcgcccgggcatccgcgggggtggcccgccgcgggcacttcaccggcggctactgctcacgtaaagggattgttaaaagacttcattgtgaatgtaccataaaatgcggccatcatagtcctccaccgccatcggaggtgccgccgccgccggcgtccgtacgcccccccccccctccgaggggcctgtgcccccgccatccctagggccccctccaccactcgccgtgccggcgggatttgcctctccgggcatgtacccttgtcggaagggaccgttttcgtgtctccatggaaatcttcaatttataaggaactagacatgcatgattgatcgtatgaaaataatttgaagtacagaagcaataataagaaaaacctctttact

SEQ ID NO: 13330 - DNA, 749 bp, Triticum aestivum
  Clone ID: PAT_TA_13330
ccgcggccccacgccccccctcccccctcgccccctctcgcccctcggcagcggataccaggcgggagctagcccgcgcacgcctctcctgcgcgcgcggcgagggtacggccatggcgtaccagtaccaccaccaggaccacgccgcggccgcgctggggatggacgccgcggcggcggcgtgggcggccgcgtgggcccccggcggcggcggcttcccgccacgtcctcgccctctacttgacccggtggtaccactcgtcccttctcaaggcagcggataccaagcgggagctagcccgcgcacgcctctcctgcgcgcgcggcgagggtacggccatggcgtaccagtaccaccaccaggaccacgcgctggggatggacgcggctgcggcggcggcggggaaccccggcggaggcttcgcgccaggtttgggcgcgggcgcgggcggtggcgggtgggagagggagaaggcggccatcgaggcgcacccgctgtacgagcggctgctggaggcgcacgtcgcctgcctgcgcgtcgccacccccgtcgaccagctcccccgcatcgacgcgcagatcgccgcgcgcgccccgccggccatgccccccgcaggcgcgcccgccggcgggcgaggagctcgacctcttcatgacacattatgtgctgctgctctgttccttcaaggaacagctccagccgcttgtgcgcgtccacgccatggaagcgaacatgggcttctggaaac

SEQ ID NO: 13331 - DNA, 493 bp, Triticum aestivum
  Clone ID: PAT_TA_13331
cgtccgcccacgcgtccgggacagactcatgctactgccatggtgacatgactatcggttgatgttattgccattcacagacataatcacaggaaaatgcagtctctggagttccagaaaagggtaggattccttaactaggccttccctacatgttcccttagcagaagagagcaagttcacgttgtgttacactcaagggcactgaaacgaagcatgttcagatttgaattacctattctggcaacgttgttgtcctgatcaaaatccatttgctgcttcctttggacacttgcttcgcagtagtcagtaccttgattgaagagctaatggtaggagctatcaggtacctggtccaagtagcataaggtaagctctattaaacccggcctgcgcgggaaagacagctctcgcggtatttttagaaggcaagaaaccccccgaatgcgcctgacggctgctcaacctcagacggagaggaataaacctggac

SEQ ID NO: 13332 - DNA, 440 bp, Triticum aestivum
  Clone ID: PAT_TA_13332
gattcggcacgagtgcaacaaatgaattccttgatgcttccatctcagccagcaaaaccacacgaacaagatgctccaaatcaacagtcgagttcatcaggacgccaacagaatgcctccaagtagaacagcagccgcaacaaaatcacatcaacagttgaggaacacaatccatccgcacaaggaaacctacaattctgtcgccgtttcgggcaaatgcatactaaagaaatcgaacggggaaacaaaatcaatcagtgcaggaaaatccgcgctaatttccggccgccgcccggcttccggaggccttccaagaacgccgcccctcctgaaatgcgacgcgaagcgcgcagaacgcgatcccgagcagcagcgccgcgagcctccggagcccgctcgtcctcttcctcctcctcgcccgcccccacaccgccgcccag

SEQ ID NO: 13333 - DNA, 765 bp, Triticum aestivum
  Clone ID: PAT_TA_13333
cggcaccagctctctctctctctctctctctctctctctctctcacacctcattctcaacctgtcatcaccaatggtgctaacggagccattccagcaacgcctaaaaccaccgtaagcacaaaatctggacctactgttgctccaagtaaggtcaaaccagctttgaatctgaaaatagatagagctacttcagtcaccccaagaccgctgccagttgataaagctgctacacttccttcaagcttgtcactagcaaacaaagctattccagttcccccccagtcgtctgcaccatgggttgctaaggccgcaaaaggtattccagcccccccaaaaccatctgcacaggctaataaggttactaaagctgctccagttcccatgaagtcacctacaccacaggttgaaaaagttgctaaagctattccagctctttctaaatcgcctgcacctcaggttaataaggtcgcgccacctaatgcagcaccacggcagttgccttcggtgtcttattcagaagctcgaaaaagtgcagttcctaaaaagattgttggcacttctgttccgcgaacttctactgcagtatcaaggccttcaagtgctcctctgttccaggcaccaaggtcaactttgccacccatacccggagctcaagttcccccatcacagtcacgttcgttgactgcatctagacgatccagcaatgagccctctgctcctgtgccaagttatgtaccgcagtcctaccgaaatgccatcatcg

SEQ ID NO: 13334 - DNA, 363 bp, Triticum aestivum
  Clone ID: PAT_TA_13334
cgatccgcacgagtgccaatcatgtgtcgatgggaaacacaaataatgtgttgatgggaagcaccgaaaacttgaggaatggtatcaggttactcatctttgctttatcagataccttgaaccttccaaacttagatagcaaaaacatactgctaagaaataatgagaattcaaaatcatcacgagtgactcactcctgtgacgattcaccggacttgtccatcacgggttccttagtgaagctcgaattatcatcaggaagcaccgccacagttgacaacccatcgaacaacggctttccatccacaccaccaccattattgccatccatcaagctcgtgccgatcctgcagcccgggggta

SEQ ID NO: 13335 - DNA, 508 bp, Triticum aestivum
  Clone ID: PAT_TA_13335
gattcggacgagcccacaaataagaagaggacaataaggagatttatggcatgatcagcaacgccaaaagaaaatatgcagatagtaataacctgatagttaacctgtataataagagaagctggaacaatacaatttcacaaaatgtacagcctctagtgcaggctataaaaaagtataatctctatatgttttcttactcaagaggctctactatacttcaattaccggactgaatttcttttttgaacttttgctccacttcagtaactctcaaaagttccatttgcaccatcttgatgcttccactacttcccacagatctcttttctaattcagcactacatcattgcctcaacccatttattgtttctcctgcttattagatgcctcttgtaacattgaatcacattgtgtagttccctactgctatctatctttaggttttcagcattcttgtatcttgtccctttcttctgcagatttctgaaacaatcatgcaactcta

SEQ ID NO: 13336 - DNA, 778 bp, Triticum aestivum
  Clone ID: PAT_TA_13336
cgattcggccgaggcgtccatcggtgtccgggacgatgagccggttccggtggcaagagttcagagcatgccacccgacgtggctggagcaacctctgcattggaaacgaagcacggtcagctggtcaaggaggacgaggtcgagcggttcaaggagctgtggctgtcgctcgtggagcgggagcagaggctagagctccggctgatgcacctcgacggccttagagagcagctcgagcaccgcctcagcgtcgccgccctggagacgtggatcctgaagctcgatgccttgttactccatgaggagaacgagaggctcaaggcccaggcggcggagctggaggccgtccgggcccagctgggtcgcgccaaggagaagcttcgtgcactcaaggagcgggtgcagatcgagcgggaggagtctcagagggaggcggccacgctccgggacaaggtaatgcagctggaaaagaccggcgagaacagggaaagggtgttggctgcggaggcggcgacgctacggaaggccaaggctgggctggaggaggagaacatggagcttgctcggaggctgcagcatgtggagcaggtctcctcctctgttactattagtctggttgatggggtaactgcattcctaattctcgatttcaattcaacattttctgccatttcgtctaaatttgtgaaaattactactcccccggcccgttccataatatgtatacttgatacttgtcgcgaacgacaagtattatggaacagagggactgcatat

SEQ ID NO: 13337 - DNA, 446 bp, Triticum aestivum
  unsure (1)..(446): unsure at all n locations
  Clone ID: PAT_TA_13337
aagccttagaaaattatgatgaagaacatgatgcaaacccgcagacttgttttgcttttgctggtgcttggatgctttacttctcatgcaaattgccaagctaagaaggagacgatggatgaggaaaagattgttatcccaccctgccgtttctgcttaaaggacaaacaactaataccacccacccctctcccttggtgttgtatccttgaaggcggtctttgctacaaaactaaggttgaatgtcagataaactgtggatgctagatgacgctaatgaaagattatgaaaaagttgttttttgtcaaaactaaggcaaaatctttgccacatctcattaataaaaaggaaggttaataaaaaaaaaacttcgtgccggctaccaaggcctccaacgtgcaatgagctcnncaacaattgcgcctggagaaagccaaccgncatc

SEQ ID NO: 13338 - DNA, 1534 bp, Triticum aestivum
  Clone ID: PAT_TA_13338
cgtccggcactctcgacccacgctttcgacacactcccgattcgtcgccttcgtcttcctaacagaaggagagagagcagagtaagagaggatggggtcggaggggccggggcatgggttcggatccggggcggcggagcgggacatcgacgatctcccgccgaacgacgccaactacacggcgctgacgccgctctggttcctggagcgccccgccctggcccagccggacagggcgtccgtcgtgcacggcccggtccggtacacctgggccgagacctaccgccggtgccgccgtctcgcctctgcgctggcgcgccgatctgtcggccacggcagcactgttgctgtgatagctccaaatgttccggcagtgtatgaagcccacttcggtgttccaatgtctggagctgtggtgaactgcgtaaacatccggttaaatgctgagacgatcgcctttcttcttgatcattccgtggcagaagccgcgatgacacaccaacaactcttcaccctagccgaagaatctctgaagatagtatcaagagaagaagaaacagaattttcggcctccaaccctaattgtcatcggcgatccaacctgggaacctaagtctctacaatacgctctaggacaaggggccatcgagtatgaggagttcctgaaaaccggtgacccagaattcaattggaaagcctccgaaggatgaatggcagagcattgccttaggttacacttctgggactacttcaagcccaaaaggtgtcgtgttgcaccaccgtggcgcctacctcatggcgctcagtgttgctatggtgtggggaatgcctgaaggggctgtttacctgtggactttgcctatgttccattgcaatggttggtgttacacctgggcgctggctgccttctgcggaaccagcatatgtcttcgccaggtgagcacaaaggctatatacactggtattgcaaaacaaggagtgacacatttctgcgctgcgccggtcgtcatgaacaatctcatcaacgctcctgcaagcgagaccttcctgccactcccccgtgtggtcaatgtcatgctggccggagccgccccgacaccgtcgcttcttgcggcgctctctatccgcggtttccgtgtcacccacacttacggcctgtctgagacctatggcccgtcgaccttgtgcgtgtggaagcccgagtgggacgacctgccgctggaggaacgctcccgtctgcactgccggcagggcatcaggtacaccgcgctggaaggcctggacgtggttgatccgaagacgatggtccccgtcccggccgacggcaagtcctacggggagttcgggttgaggggcaacgccgtgatgaaggggtacctgaagaaccccaaggccaacgcggaggcgttcgcgcacggctggtaccactccggcgacctcggcgtgaagcaccccgacgggtacatcgaagtcaaggaccggatgaaggacatcatcatctccggcggggagaacatcagcaccctggaggtgg

SEQ ID NO: 13339 - DNA, 988 bp, Triticum aestivum
  Clone ID: PAT_TA_13339
cccacgcgtccggtgggccatcgggccgacgtgcacctccggcatcttggacaaggacgccgacgccatggccggccgcggcaaccgcgctgacgtcgatgtcggccacgtcgtctcatggctcgacgccatgccaccggcgtctgtgctgtacgtcagtttcggcagcatcgcgcagctgccagcgaagcagctcgccgagctcgcgcgcggcctcgaggcgtcggggcggccgttcgtctgggccatcaaaagggccaaggccgacgccgccgtgaaggcgctgctcgacgatgaagggttcgagtcgcgcgtggaggacaggggcctcgtcgtgcgcgggtgggcaccgcaggtgaccatcctctcgcaccgggcggtgggcgggttcctcacgcactgcggctggaacgccacgctggaggccatctcccacggcgtgccgacgctgacatggccctgcttcgccgaccagttctgcagcgagcggctgctcgtggacgtgctccgcgtcggcgtcaggtccggcgtcaagctgcccgtcatgaacgtgcccgcggaggccgagggcgtccaggtgactagcggcgacatggagaaggtcattgccgagctgatggacgacgggtcggaggggatggtgaggaggtccagggccaagaagctcgccgcagaggccagcgcggccatggaggaaggtgggtcgtcgtacaccgacctggaggacatgatctgctacgcatcggagctgtcgaggaaaaggagccccgagtgcgggtggacgagctcgacgtccctcccttccgcggtggcagagctccgaagcaacgacagcgccaagatcgaagccggtgctgcattgtcactacagtcctaagttgtagtactataactcattatcggattgcaaagttgtttttttagtattgcaaagatacgagtataagctccttccttcgcctgataaaataagagcgcttttgccccc

SEQ ID NO: 13340 - DNA, 465 bp, Triticum aestivum
  Clone ID: PAT_TA_13340
gattcggacgagaaaacatgcttgatgcatgtcatattattcagaatttcagacaaggaaacaaattgagacaagaaaagaacaaagaactaggtgcaacatccagtgtaatatactacttgtgcaaagctaagcactgtggtgggtcttttcacacattttctttcgataataaaagattaggaaaacaattatgcttggcaacatctgatgtaagcatcttggcacacacattttttttgctaatacaagactatttttttcttctgtataggttggggtgcacctgccttggcaatagtgcaaagcccaggcgacacatgaaggccccactagcaagctagtgtggtggactttgccccataaaaaataaatttaatatcattgtgggcacatgtcccacatatcagatattaaactgataagaacagatactacacttgatcttagctcgtgccgaattcc

SEQ ID NO: 13341 - DNA, 605 bp, Triticum aestivum
  Clone ID: PAT_TA_13341
cgtccgcccacgcgtccgcccacgcgtccgcccacgcgtccgcaaagctaaccctgcggcggcggcggctcccgacttcccccctacccggacctccttgccggcccgcccctctccccctcgcattccgcatccgaggaaccgcctccgcctccgctgagtctccagtctccagcgcctgcgccgtcctccccgccttcctcaagatgtcagaattaaaaacattgagagctacgcccacgaacgcgttcccgaacttacagcgaacctatgactttctacagcatcaggttcatttctttgggcagactgttggtctgaagaggtcggtgggacaaaaggattactttgatattgaatttaagactcgagagggtgccatggaaactcttcaggaatgccatgtgaaggacctggactttgaatgggcgccctgcaatttcgcgcacaaaatggcaacagggctggctgtggtatcttttcaaccccctcggttcgattatggtgtgttctgcgaggagccgtcactgccgctcccttcaataatcatacccaataaatggctacaccaaaaacgacaaaaagaaaaagaaatgagcaacaag

SEQ ID NO: 13342 - DNA, 679 bp, Triticum aestivum
  Clone ID: PAT_TA_13342
cggcacgaggtgcgtctcccccttcggcgtggccacgccaatgctggtgaacgcgtggcgtcatggcgaggacgaggaagggggcgcgctgccggcgccggtgagcgcggaggaggtggagaagacggaggagatggtgcggggcatggcgacgctcaagggcccgactcttagagccagggacatcgcagaggcggcactgttcctggccagcgacgagtcgaggtacatctccgggcacaacctcgtcgtggacggcggcgtcaccacctccaggaacgtcatcgggctgtgatagaaggtgaagtcaaaccgattgagatgcagtcggagggtagtacgtgctcgagtgtcacaatcaagtatagctccagtgagtgggctaaggcgaatccatgtctcgtgcgtacttgaattattcataggttggcactagtggtaagtaggagtaactagctggatctatttgactgagtggttcatgtgatgaactgtggatttgaacaatggcctctaatttgcctttttcttctttgttaattaataattattgtgccggatcgagaaagatttgtttagttcagtagtacattccctggttgggaccaacgatgcagacgaactgttgagtgatgagggacaaagacttcagttcagtcgtaaaaaaaaaaaaaaaact

SEQ ID NO: 13343 - DNA, 784 bp, Triticum aestivum
  Clone ID: PAT_TA_13343
gatccccgctgcgggcgcgccgccaccagatccactccagcacttcctcaacaatggcagctgccgcgctcagagcacggctgaacaacctcgtcacatccatgttcgccacgggcatgctggacgagaatttccaccaactgcagtccatggaggaggatggcaccgcagcccggggctacgtcgccgacatgatcaacctcttcatcaaggacaccaagaggatcctcaacgacatcgccggcctgctgagccaacccgtggtgggactacgacatggtggacgtcctcgtgcgtcagctcaaggggtccagctacagtgttggtgctaagaaagtgaacctgtcctgcatgcaattccgtcggttcaatgagccaagaagcaaagaaaggtgcctcatgggcgttggctcttgcttggagtgagttctgtgaggtgcgaagcaagttcgaggctatgatgcagctcgaggagcagattgcaacctatggtcctaagtagtagctatggaaggaaaaagagcatagctacaagtgatccctcccatgatggggtgtatgtttctctccaatgtagacaatgttcaataggtgtctggctttggagggcgaatatgaaataacgcgcgtaggaacaccattctcgcaagtcttcaaacaaaacatgttgtcatgtgtcaatgtctctatcaactctataccagccgggttgtgtccgttgggctgccgctccatacaatatttatctctacctggttggttttttaaaaaaaaaaaaaaaaat

SEQ ID NO: 13344 - DNA, 322 bp, Triticum aestivum
  Clone ID: PAT_TA_13344
gaaggtctgccaccgcttgtttactggtgatgcttgtgtttgttccgaagcactaaatcatggagagaaatgtgcggtggttcaatttctgctcgtgatctgcaaccatctagcatgcaagcatgaatgtttgttttggggccaaggcaagaaggttcgcggattctggtgcaatcgaatgctccgtggcacctgcaactgcaatatttgctgggatgaatgaacttaattgatacgctaagcacaattaatgttatcaataaaaaattaataactttgtgtccctgaatcacccatttatgcatgggattgtattcttggg

SEQ ID NO: 13345 - DNA, 665 bp, Triticum aestivum
  unsure (1)..(665): unsure at all n locations
  Clone ID: PAT_TA_13345
cgtccgcaaagctgcacctctatcaaatcgggagagacttgtgctaaggaagcaagctctgcagacgaagaaacgtccagtacttgccattgggaggaataatgtcatcaccggagttgcaaaaacaatacggacacacttcaaaaagcatcctcttgctattgtgaatatcaagaaccgagcagatggaactccagttcaacagctgatatcagaactagaggaggcgacaggatcggttctcgtgtcgcgagaaccaaacaaagtgattttgtacagaggctggggagcggacgtgacccagacaagttccagggaggacggcacaaatgagggcgaaaaggaggtgatatcaccacagctccttgaagccattagattagaatgtggactgcacccaggtgaatcacaatagctggatcctggaccacctcctacaaacttagtgatatgatacagaggctggggagaaatactgaccgagacaagttcagtggaagacagcacaattgagggggaaaaggaggtgatatcaccacagctccttgaagccatcagattagaatgtggccggcccccgggtgtctcaccagtccgggtccctcggcaaactcctactgctggtggaagatgaccctcctatgttgggtacaaacgaacattna

SEQ ID NO: 13346 - DNA, 656 bp, Triticum aestivum
  unsure (1)..(656): unsure at all n locations
  Clone ID: PAT_TA_13346
cgcgacggccacacaggcacgacctccccgacagagtcgccctgctgatgacgcaccgctcccgccgcccgccgctccgcgcgttccagttcccgctcgccacccacctccgtcacacttgctctccttccccgccaccacctcgcctctcgccagctcccgtaccccgatggccgacgccgcttcgcgcccgcgcgttcggcgaatccatccgcggaggcgccgagccccctggctccaccctcgacgcgctcctctcgggcgcggagctgctctgcctcgcgccgcccgccatctgctctgcggtttgcgccgtccgccttatcgtcgcgcggggcggcccagtcaagccattcgctgctctagcgagtgggaggatgttcgtcttgcagtacgttctcctgggtgggggcggtggcggtcggggtgctggtccggcggaagcaatgggagcgactttgccgggtgggcgcgggccgcagcgcatcggccccgtggtgtggatttggtggggaaggtcanaangtggaggaganctgcgggttgtgttggcggncgttgtantgctgtcaaaacntggagaaactcggcgtnggttaaggtgctccgaggacgtgacgnttcaacagtagacncaacattagccaaagaatcaa

SEQ ID NO: 13347 - DNA, 806 bp, Triticum aestivum
  Clone ID: PAT_TA_13347
tttcttgttttagtttaaatacctagtaaaaaaaaaacatgtgagcctactagacagaccaattcagcgcgcggccgcccgggcaggtacacgagcgaccggccatcatatgatacgaggcgagcttcacccgttgagcttcgccaggaactggttcatatcatactcgtccgcatactgcgactggtcccacagctcgtccagcccactcaggattgacttgaggcccttgcgacccggtttccccttgttgctctcttcttccgtggcgctcgaactgcttgggagaaccgacgcctttctggaagcaggggtcgaagtgaacaaatcgagtagctggtcagtgttcatggtcttcaggctagcgttctcagagtttatgaccgcgttggcgaccgacaccttgaaccgctggagactcatcactttctcctccagggtgccgcgcatgatgagacggtgcacattcacaactttcctttggcccagacgatgtgctctgtccatcgcctggagatccttcattgggttccaatcatgttccatgaagaccaaagtgtcagcagacgtcaaattcaagcccagaccaccaacatgagtcgttagtagaagcacatcgatggttgggtccgaattgaacgttttgacaatttcaaatctcttgtctgtttgaacagagccatcaagccgcaaatacgtgacacttctcctcgcggactgaaacaggtccttctcaataatgtcaaggaaagccttatgttgagcaaaaatccggacgcggggtcgacccgggaatccggaccggt

SEQ ID NO: 13348 - DNA, 946 bp, Triticum aestivum
  unsure (1)..(946): unsure at all n locations
  Clone ID: PAT_TA_13348
gattcggacgagagaaagctttcctcgctcgtgcggcgatccccttttcctccctggtgcgatagatcctactccggcaagagaccgccgccctcgtggccagtgtctccatcgtcggcgtccgcgttgtctagggctccgtcaagctcggcgtcgtctagggttccgccaagctcggcgtcgtctaggccctggtcaagctcggcatccacaagatatgttgtataaaagtcgagaaagcatttttttgatggactggggttaactctggtgagatttgttgtagattacaactagcaggtatgactccagggattttccttcttcaatatctgagaaactacaaaggtctcggaatggagggtttccctaatgacgttctataagctcaacgtgagaaataccattttgagattgtcacttgcaaggacaatgaaattcagctgccagtcgtaacttctttcctgcagaaacatcagggtttccgcatattcaagtgaagctttgaaggccaatcatttttcgtcccgcatatgaactcatcttagggtctcatcactattatttattgccaacttcaagggaaattgcagtgcaagactttttttgaactgaaaggaattcttccatgagggaaatgtttccttaatgatacagttctctgcttttgtcatggtgcccagtgatgctttcttgcattactttcagttgcaaagaagattcaaaactgcagaattagtttgtaaagaagctctaggcataattactgtttttaaatgtttcttcgacctctcagtactgttattgaacaagcataattactgtttgtaaatgttcatttacttcagctatattcttttgtccagtcaagggggggccggtaccaattcgcctatatgagtcgtatacgcgcgccacggccgtcgtttanaantcctgacgggaa

SEQ ID NO: 13349 - DNA, 340 bp, Triticum aestivum
  Clone ID: PAT_TA_13349
gggatactccatttcttccgatgcggcgccagcacaaaacacatatgtgctcacttctcattgcactactagtctttgcatcgacttggaagcccaccatgcagcttccaccttgttggcaccacccagagaagttcagcatatgctttgccacttggagggaagaaatatgcaacaagctatgcattgccgagaactacgagtatggggcttgtgccatgatttacccagtgccgcgttgcgtctgccacaagcgtcattgtcatgacacttaaccatgatgagtgatgtatttaggatgtttatgtgataataaagggatggtggtgtttttcatcac

SEQ ID NO: 13350 - DNA, 694 bp, Triticum aestivum
  Clone ID: PAT_TA_13350
aaccattcggctccagttttttttggtctcatgcatatgtcgcctggtacaccccggcggatagtgcatatacaagccaatacacatacacacaatcgcaaaactagcacaagagaggcatgcctgcatgcaaactctctagcggtcacaatgagaaattaaatacggcccaaaccaatatacgggttgccatatatcgaacgaccgtcccatggatgataaatttatgcacgcacacacacactatatatgttatcttggatatctgatcatcagtactttcacatgtcatccatactcatgttcactgacgaggtcttgccacctgctgttgcggcggcgttgccctggtagttgttgctcagcccggtcacggcatcctcctgtgacaccattgacgatggaccacacccaggcttagccccgaccatgaaactctgatcttcacccatatacatcatcatttgctgatgttgttggtagaatggcaatggtggtgttgggtcttgacatcatctgctggcggtggttcccgatgtagtggtcattcatcataggaagcgccatgctgccaatcatcgatgagccagccccgatgtcgtgcaactggtatgaagaagctgcaggaagcaacgttggatttgctagcgatgacgacatgtcatagtccatgagaggaggaaatgtatctaag

SEQ ID NO: 13351 - DNA, 848 bp, Triticum aestivum
  Clone ID: PAT_TA_13351
gattcggcacgagggaacatgagcgctcaggggattgagagtatggaggcgaagaggaggaggggggagaagtccgccaccagcgcggctcccggccctctagaggtgctggactgcgccttctgctttgatcccctcaagcctcccgtctttcagtgtagggtcgggcatgtgatatgttcgtcttgccatcacaagcttcggaagaaggacaattgccatgtgtgcgccattaccggaggctacaaccgctgcatcgccttcgaccacatcctcgagtctattaaggtctcttgctccaactccatctatgggtgcaccatcaagacacactactaccagcaagaggagcatgagaaatcgtgtccgcatgcgccgtgcttctgccccgaacctggttgcggcttcgcaggctcaaccgcccaactccagcgccatctcactgtcgatcacatgttgcccgcaactgcatttgcgtatggatattctttcacccttcatatgcaggaaggaatgcgtgttctccacaggaaagaataaggtggcccccttttcctagcaaagttcacgttggtgccacctttcggcaatgctatctccatcttgtgcattcatcctcatgttgtgacagaaaatcatagattcgagtgcgatgttgatttctacagccgcaccatgggatggcaccaacattcaaatttccagatcataagcacgaatctctccaacgggttcccaggggaggaggccagctatacatttgttgtgccaaaaatttcttccgacccgcacaccaccaccacccgcctcctcattcgccccccaaagataacctgtccctaagtgac

SEQ ID NO: 13352 - DNA, 566 bp, Triticum aestivum
  Clone ID: PAT_TA_13352
cgtccgcccacgcgtccgcccaccggaccggagcaagggaccgaccatggccgccgaggtggtggcgctctcgccggcctcccgcctgccgtccctctcctccaggcctaacgctctaaccgcctcctcctcccggtcccgaccacctcgaggcgcccgtgccccccggtcaccgccgacgctcgccatctcgacgccgcaccggcgccgagcgctcctcctcctccggccccgcgccaccgagcagcaagggcaggtgcagcagcaggaggaggaggtggtggacggcaacgtgctcccctactgcagcatcgacggcaagaagaaaaagaccatcggggagatggagcaggagttcctacgagccctgcagtccttctactacgaccagaaggccatcatgtccaacgaggagttcgacaacctcaaggaggagctcatgtgggaaggcagcagcgtcgtcatgctaagcgccgatgagcagaggctgctggaagccttcattgtctacatcgccggcaaccccatcatgtcagatgcggagttcgacgagctcaagcttagac

SEQ ID NO: 13353 - DNA, 1598 bp, Triticum aestivum
  Clone ID: PAT_TA_13353
gcattcggcacgaggggagcgcggggtcgcactccaaccagcgccacacgggggctccaaccccccagccccccatatcccacccccccgccacagcttctctccgcccactcacccccacctgccgccctccggaccggagcaagcgaccgaccatgaccgcacaggtgctggggctcgcgcccgccccccgcggggtgccccctgccgcccggctcctccctgcccgccccctcctcctcctcccgcgcccaacccgctgcccgctcgggccccccaccgccggcggtcgcccgcacgcccttcgcggcgccgccgccccgccaagcaccgccgccccgccgccccccccccacccagcagcggcggcaggtgcagcagcaggaaggggaggtggtgggacggcaaccggctcccctactggagcatccgcggccagaaggaaaagaccatcggggagaaggaagcagggagcttcctacgagcccgtgcagttcttctacttacggaccacgcaaggaccatcatgtaccaacgcaaggagcttcgaacaacctcaagaaggagactcatgtgggcaagggcagacagacgatcgttcatgactaaaggcgcggtatgagccagcaggtctcctggaagcctccatggcctacatcgccggcaaccccatcatgtccgacgccgaattcgacgagctcaagctcagactcaagcaagatggaagcgacatcgtgacggaaggccctaggtgcagtctacggagtcggaaggtttacagcgatctgacggttgactacttgaagatgttcctgctcaatgttccagcgactattgttgctctaggactgttctttttcatcgatgagctgactggctttgtcgtcaatgtattccagttttcctggagccctttggattcatattcacataatatgccgctttggcctcggatattggtaacggcgcaagtggtaaccaaggccataataaatgatgtcttaatcatgaaggggccgtgtccgatttgcggcactgaaaatctttccgactacgagcggatactgtgagatcgagtattagtggtggcaacgaaacaatggtgaagtgcgcaaattgcaaaacggtgatggtatacgactcaaaaaactcggttgatcacacttccaggaattcatgaacaggataattggaaggtaggagcaacgaagatgcagagttggccattcatgtttggtaattaagggagcaaatggaattgtgaagtctgcaacgaactgcttgctgcttctatgttctagtatgattttctgtagatatgtatttgcaattgtacctgattcagacggattaaattgcagaatgtatagaaaatcaagatggttgtgagcctatgacattaaaccgaagcttatacgtagtcttggccaattgtcatgcgccacgaataaaagggggaaaagagaaagatgtgcttgcaagggccattacatttggcaactggaccatgggaccatggcttgttttggtttttgtctaacgagcttgtgtcgaatcacactgttgtggctcattgcgcaagtgacaacttttcctct

SEQ ID NO: 13354 - DNA, 1110 bp, Triticum aestivum
  Clone ID: PAT_TA_13354
ggctcagcagctcctgccctacccagcacccaccaaccaccggcgcagcaccactccacttcactgcgcgagcgcgcgtgccgagtgtcggcggcgttcggaagaattcgagggcatggggatggagtacgagccggcaccggcgcagaagaagccggcggcgggcgggcgggcggccctgaagctgctgctggccctgctcctcgtcggcctcgcgatgcggctgctcgcggaccgctgcgcctcccgcctcctgccgccccccgccccgaaggaggaggccgcggagctcgccgtgacggcgccgccggcgcaggaggccgacggcggggacgggcgtccggtaactcccaacggtgcagggaggtgtgatctgttccatggggaatgggtccatgattccactggcccagcttacaccaatgcaacctgccggttcatcgagactccacagaactgtatgtcgaatggaaggcctgacgatggttatctttactggaaatggaagccgtatggctgtgacgtgccgcggtttgagagcaagacgttcttggaggacatgaggggcaaacactgggcactagtcggcgattcgatcctccgcaaccatgtccaatcgttgctctgccttctttccaaggttgaagatcctacagaggtgtaccacgacaaaacctaccagtccaggcgatggcacttcccgtcgcacaacttcacgctgtccctggtgtgggcgccgttcctcgtcaaggcggagatattcgaggacgagaacggggtctcgtcggcggagccgcggctgaccttcgacgtcctggacgcgacctgggtgagccagtgggccagcttcgactacgtgatcatctcgacggggcagtggttcttcaagaaggcggtgtacctggagcatggggcggtgatcggctgccacttctgccaggacaagagcctgaaggaggtgagcatcgactactccttccgcaggccgctccgggaggccttccggttcatcacggcgtcgccgcaccggccggtggtgttctaccggacgtggtcgccgtcgcacttcgagggcggcgagtggttcagcggcgggcggtgcgaccggaa

SEQ ID NO: 13355 - DNA, 344 bp, Triticum aestivum
  Clone ID: PAT_TA_13355
cgattcggcacgaggagatgagggggctcaaggtgccaagcctactatgcttgctactgctcataccgctcttgcttcctggctctgaagccgacacatgcagtcggttcagcaggacctatattgttaagcctcccgaatgcaaccatgatccatgtgccaaggcctgccaaaaggagggatttaccgaaggggtctgtgaaatcattcgtgccacacctatttttatgcgttgtctctgcaagaaagagtgctaaatgaaaaacatgcttgtagctacttcaggatgtacgatgcaaaaagcaataagttaataacatgtgtagtatgatgataagaaaaaa

SEQ ID NO: 13356 - DNA, 912 bp, Triticum aestivum
  Clone ID: PAT_TA_13356
cgcggccgcgtcgacaatcaatcgatgaaggtgctctgctctgcgtgcgaggcggccgaggcgcgcgtcgtctgctgcgccgacgaggccgccctatgcgcgcgctgcgaccgcgacgtgcacgacgccaaccgcctcgccggcaagcaccaccgcctgcccctcctctccgccgcctccaacccgcccgccgtgtccgcgccgaaccgcgacatatgccaggagggccacgcctacttcttctgcgtggaggaccgcgcgctgctctgccgtagctgtgacgtcgccgtgcacactgccaacgccttcgtctccgcgcaccggaggttcctcctcaccggcgtccaggtcggcctcgagcccgacgaacaagaagaaccggtgccagagcctgagccggagccgcaaccgcccaacaacgcctcgtcggctcccctgccaccgccgatgtgccccgggaagaggagcccgacgccgtgggacagcgacggagacatcgactgggcggccggcccggacgtcggcatcaccgggaacttgcccgactggtcggtcatcgatgagcagttcggcagcggtaccccggcgttgaggcccgcggagccggaggtaatcaaagcccctccgaggaagagtccccgggtggccgtcacggcggcgagcgcggcactttttggcgggagcatgccggactggccgctggacgagttcttcgggttcaccgagttcaactccggcttcggattcgcagaaaatggcacgtccaaggccgacagcgggaagctcagctcgccgaaccgcggatcgatgtcgtcctcctcctccggcaacgccgcccagaacgcgcaagatttcttcggccaggtgccggagggtcactgggtcgagtcgaccatgccggagctcccttcc

SEQ ID NO: 13357 - DNA, 596 bp, Triticum aestivum
  unsure (1)..(596): unsure at all n locations
  Clone ID: PAT_TA_13357
cgaattcggcacgaggcaacgcctaggtatatacaaagtgcaaactaaaatggcaagcgctgcaacatccttggttatggtcctcgtcgtgctcgccgccttgtcctatggcctccccgccgcccgcagcgacatcgacttcatcgcccgcacatgcaagaagaccactaaccccgcgttgtgtgtggccgtgttaagcgccgacccaaagagcggccaagcgtccaccgagcatgacctcgccagcgtcgccctgcaaatcgccaccagcaccgccaaaaagaacgccgcggtcatctgtgacctaggcggtaagcaccagggcaaacccgaggggccccgcgtggggatgtatgtgtcaaggcacatgtcaatttgcggcaaaccgaactcatgggggttgcccgccccgcccccagcggtcggccgggtgccgagactctgcccggcgggtccctggcgaagggctcaggccgctcgggcgggagcgcgctacaggggctcccccaatgatctccggtgcccggcttggatcgcgggnttccaacaaaanaaaatnctcccnggtnggggcnggacattggantnccccaaaa

SEQ ID NO: 13358 - DNA, 1041 bp, Triticum aestivum
  unsure (1)..(1041): unsure at all n locations
  Clone ID: PAT_TA_13358
attcggcacgaggcgcaactccggcgccaccgccgcctcggcccctccggccgccaccatgcacggctcctacgccgcgccgcccgcctcctccgccggctacgccaagatccccacctacccgccgccgccctcctcctcctaccccagccccagccccagccccgtcccgcccgcggcttccgcctccgccccggccccgatccaggaccccacggcgccgccctcctcgctcgccaaggcggccgagctcgtcacgcggttccgggagcagggccaggcgctcatcgccgcgcgccgcccntggggggaggtcttccgctcccccgccttctccaagccgcccaacgtcggcgaggccgtctcccggatgcgccgcaacacggcctacttccgcgccaactacgcgctcgccgtcctcgccgtcgtcgccgcctcgctcctctggcacccgggcaccctcttcgcgctcctcgcgctctgcgccgcctgggttcttcctctacttcgcgcgccccgccgagggcgcccagccgctccgggtcttcggcaccgagttcgacgacggcaccgtcctcgccctgctctccggggtcaccgtcatcgccatgctcttcaccgacgttggctggaacgtcgtcggttcggtcatgatcgggctcgccctcgcgggcgcgcacgccgcgctcaggtccaccgacgacctcttcctcaccgagcaggaggcggccggcaacggcctcgtggccgcaggcttcagcgctgctggacccatcttgcccacctatgtccgcattggttgattgtgcagtctggcttggtgtgatggtactccaatcttctttgttgaacattctgggtttgtgttcttgtttgcaattgtgcactggcaattctgtttcatatatacggcacagtatctattgcttcgtgtgttggcgtgtaaaaaaaactagattggcttgtgatcttagactcaatacgaaattagtaatgtgtgcaatcatactatgaacatgttatacacttttcttctcaaaa

SEQ ID NO: 13359 - DNA, 950 bp, Triticum aestivum
  Clone ID: PAT_TA_13359
gtcttgtatggacgggacgagaaaaagagaaagagcgagagccgaggagaagataaaatctacaggaaaaacaggggagaggcagagagaacagaggcgaaggagcaatgccgacgggtcggatgagcggcaacatcacgcaggactgggagccggtggtcctgcggcgggcgaagcccaaggcggccgacctcaagtccgccaaggcggtgaaccaggcgctgcggacgggcgcgccggtggagacggtgcgcaaggcggcggcggggacgaaccaagaatgcctccgccgcggccgtggcggcgcccgcgcggaagctggacgagattgacggagccggcggggctggggcgcgtgggcggccgacgtgcgcgcggccatccagaaggcgcgcgtcgccaaagggtggagccaggcggagctggccaagcgcgtcaacgagcgggcgcaggtggtgcaggagtacgagagcggcaaggccgtccctgtccaggccgtgctcgaccaagatggagcgcgccctcgaggtcaagctccggggcaaggccgttgggagcgcccgcgccgaccaaagtgatggttcgtggggacatatcctgcctgtgaaatttgtgatgaatggtagtaaatcggatctgtaaatgctcgggttgctttgtggtaaatagggctgtaagtcgtgcaaagtgatgtctagttgtttcacgtggaatttgatgctaaatcctattgttagctgatgtggcaatcttcgccacctccatttgcgagaacggcggctgccctcagttgatcaggtcggagacccagccgacgtcggggccgcctgctccggcgccgccgcccccgcggccgcggggcgcgccaccgtctcggccgcagccccgcccactccctcgggccggtccggtgggtgcttgcgagctgcgggcaggcgcgctgcttggtg

SEQ ID NO: 13360 - DNA, 566 bp, Triticum aestivum
  Clone ID: PAT_TA_13360
cgtccgccgctcctcgacctccatccgctctctcaactcgaaccaaggcgagttcgtcagcgaccatgtccgggcgcggcaagggaggcaaggggctgggcaagggcggcgccaagcgccaccggaaggtgctccgcgacaacatccagggcatcaccaagccggcgatccggcgcctcgctcggaggggcggcgtgaagcgcatctcggggctcatctacgaggagacccgcggcgtgctcaagatcttcctcgagaacgtcatccgcgacgccgtcacctacacggagcacgcccgccgcaagaccgtcaccgccatggacgtcgtctacgcgctcaagcgccagggccgcaccctctacggcttcggcggataggcgccccccttcgtcagcaactctgccccgctgtggccgcagacgggagaagtctgccatgtcttatgttcagtagctgtagccggaacaatgtcacctgttctcccatctgtctatcgcagaatctctctagttaccttgtagctccatgagcccagtcgtgtaatcgaatatatcgtcttaccgtgc

SEQ ID NO: 13361 - DNA, 646 bp, Triticum aestivum
  Clone ID: PAT_TA_13361
agatcccacaatccacgaccgctccctcgacccgcatccgctcgcagctcgaaccaaacagagatcgtcagccatgtccgggcgcggcaagggaggcaaggggctcggcaagggcggcgccaagcgccacaggaaggtgctgcgcgacaacatccagggcatcaccaagccggcgatccggaggctcgctcggaggggcggcgtgaagcgcatctcggggctcatctacgaggagacccgcggcgtgctcaagatcttcctcgagaacgtcatccgcgacgccgtcacctacacggagcacgcccgccgcaagaccgtcaccgccatggacgtcgtctacgcgctcaagcgccagggccgcaccctctacggcttcggcggctaggcgtcaatctccgtccgcaacccgtcgcctcctcgccttcagccaacaactccgccccgccgtggctgcagcctgcagacgcgagaaaactgtcatatctttcgttcagtagctgtagccggaacaaatgttgcctgttcacccatctgtctatcgcagaatgtctctagttaccttgtagctccatgagcccagtcatgagatcgaatatatatcgtcttcccgtgcaaatgacgcgagttcgatgggatgttatgattt

SEQ ID NO: 13362 - DNA, 934 bp, Triticum aestivum
  unsure (1)..(934): unsure at all n locations
  Clone ID: PAT_TA_13362
gtaacggcgccccctgggaggccggggaccgctccctcgacccgcatccgcccctcctcgaccttcatccgctctctcagctcgaaccaaggcgagttcgtcggcgaccatgtctgggcgcggcaagggaggcaagggtctcggcaagggcggcgccaagcgccaccggaaggtgctgcgcgacaacatccagggcatcaccaagccggccatccggcgcctggctcggagaggcggcgtgaagcgcatctcggggctcatctacgaggagacccgcggcgtgctcaagatcttcctcgagaacgtcatccgcgacgccgtcacctacacggagcacgcccgccgcaagaccgtcaccgccatggacgtcgtctacgcgctcaagcgccagggccgcaccctctacggcttcggcggctaggcgtccaccttcgtccgcagctcgtcgccgcctcgtcgtcagtcaacaactccgccccgctgtggccccgggcgcgaggaaactgccatgtcttatgttcagtagctgtagccggaacaatgtcacctgttcccccatttgtctatcgcagaatctctctagttaccttgtagctccatgagcccagttgtgaaatcgaatatatcgtcttcccgtgcaaatatcgtcttaccgtgcaaaaaaaatacatttactccgcaaccaaaatgggtgcttnncttagaggtttaccccctctggtaaaagcttttccaatctggaaggccccccaaggggccacttggaaagaaattccggcaaattatttaattatttccggcggcactttctcccccgtgggcgcaccnnnnaanaaaaaaaaataatannataannttnccccttccgcgagggggggggggggggcccccgcggggtcccccccccaatattttcgcccccccttaatttaat

SEQ ID NO: 13363 - DNA, 442 bp, Triticum aestivum
  Clone ID: PAT_TA_13363
cgattcggacgagctccgatcgagtgtatttgtgcagcctctgtgtacaggttcagtgcgtgcgggcgctgcacagcgcgcaccctgctccatgagaggggatgcggatcgatcaccccaaggctgcggcacgctacccgtacagtgtatgttctcgccagatgatctttggtgacttcgtatgccttgaaatcagaagacgctgcaaccccttctgatgggttcttcatagacgtcgatgtcgatgagtaggctgaagcccaggtggtgatcctgagctcacgatggaccgtgtagtatagtcaggctttctcaagcctcttttattttctagttgtctgtactcagacaagttacttccgatgttggcttgtatgtttgtatgacttgaatgatgggtcgtgtgacccgtacttgtgtttatgatatgtatggcttccct

SEQ ID NO: 13364 - DNA, 537 bp, Triticum aestivum
  Clone ID: PAT_TA_13364
gattcggcgcgacactttcttcacgaccagctgagtactttgcgcggaatgcggccgttctgcctcgtcgtcggtgtgttcctgctgctccgatggccggcgttcagcctcgcttgggcgccggtggccaggaccatcaccgtggatcagcgtggaggaggggactactggacggtgcagtcggcggtggacgccgtgccgtacggcaacagccagtgggtcaggatctacgtcaagcaagggagctacagggagaaggtgacaatcccaagccagaaaggcttcatcttgctccaaggggacggctccttcaataccgacatcaacttcgacgggcacggctaccggcaccgacgcgcccggcatcgccccgatcaacgggcccggcaaccgcccgcaacctcaacgggacgtctcgccggccggcaccaccgcccccctcacagtccatgccgataacttcgtcgcccgcaacatcgccttcaagaacacgttcaacggcgggcaccccggcggtggccgtgctgatcgacggcg

SEQ ID NO: 13365 - DNA, 424 bp, Triticum aestivum
  Clone ID: PAT_TA_13365
ggccgacggcgatcaagagagggagtgggaggccaagaaaggacaagacagcagcagcagcaatgcctgctgacgctgggtctgcggggatcaagagagggcgtgggaggccaagaaaagagaagaagccagcagcagcaatgttggctgaaactgaagctggagatactgtgtcaactgggatgaagggggcgcttgagaatccaatatcaggtaatgtcgtgtcaactggaaccaatggagcacttcttagaacggagaatccagcggcaggtgattttgtgtccatggtaatgaagagagggccttgctttgattgaaacctggtttggagacatgtctgaagaagctagtccatgtgtaggaaaggaaaccaggcctggcctgaagatgcatgctggatgtgtaatttgagtcgagtctc

SEQ ID NO: 13366 - DNA, 292 bp, Triticum aestivum
  Clone ID: PAT_TA_13366
cgattcggacgagtgtacctgtgcctcgaacaatccttgtagtttaaactagcttatcacactactgcagcaatgcctaccagtggcggttgcaataaggctaccagtggtgggtagggcacctcgccatggtatcctgacactggtaatatgttacctgtggcgggcgtcatttctcacccatggttggcaacctattaccagtgggggctggcctattcacacttgtatgtggcacactagtggcggcacgttcccccacccgccaccggtaaaaaaaaaaaaaaaaaaa

SEQ ID NO: 13367 - DNA, 566 bp, Triticum aestivum
  Clone ID: PAT_TA_13367
ggtttcttaccataatactggaactgcgcctcggcattctacaataatagtgatcctgttatcaggtcgtatcgtcaccgtgtttatgtacatatttctctagtaagaagaggatgctacaatgcttggatgctatgatctgttatgtatcacccaccgctgtctagaaatcctcagtgaattgaagtttagtagaagcggtcgcggcagacgtgccacttttcggttctctttgttggttttttttttgcatgaaccgacataggaacagacatgacacaggaacacacggttggagaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggggttttaggggaacaaagtttaggagggggggttgggaaaaaaaaattttttttttgggggaaaaaaaataaaaaaaagggggggggttttaaaaagggggggaggggaaa

SEQ ID NO: 13368 - DNA, 667 bp, Triticum aestivum
  unsure (1)..(667): unsure at all n locations
  Clone ID: PAT_TA_13368
cgtccgggtcatcgtcggagccgcagcggcagcagcaaccaccggcgcggagaaggctgaaggcggcggggataggaatcagtgagctgaaggtcttgaccatggaggcggaggtgcaagcgcgcgaggagcaagaggaggaggaggtggcgtgcgagtgctgcgggttcacggaggagtgcaccgcgccgtacatcgccggcgtgcgcgcgcggtacggcgggaggtggatctgcgggctctgcggggacgccgtggccgaggagatgtgcagggcctcgccgccggtgtcgcccgcggaggcgctggaccgccacgcctgcgtgtgcggcgaggggcgccgcgcgtccgctcccccgtcgcccggcgacgagctcatcgcggccctgcggctgctgctccgccgcaggctgggctcgccgtcgccgccgaggctggnccgctccacgccgagcaggccgtggcgcgacctcggaaatcccacgagaaggtctttaaagcataaagcatgaagtcaaggattcagtctgccaagtctttgtatgattaaagtttcagtggttagcataattttgtgtactagtatatttccacctgtagatcaactaaatctatgtgtttcaagaaaacctgctttgcctctaaagattgctactacctgcttcaa

SEQ ID NO: 13369 - DNA, 515 bp, Triticum aestivum
  unsure (1)..(515): unsure at all n locations
  Clone ID: PAT_TA_13369
gaccgcgccgaccaagccgcccggggaaaccctaggggggcgaaacgggctcgcgcgcaagcatggccaaggggcccaagaagagcaaggccaagaatggcgccggcaccgccgccatggcgaacctccgagggcgcgcccgctgcatccaccgcagcggaagccccacaaccgatggatacggccgaggggaagcagccgtcctcttcatcggctgccctcagttcgatcaacaggaaaataaaaaagggcgtgcaaactaaaaggacaaaaaatatgaggaaaatgaaagcagttgcgagggccatctcaaaaactgagaaatccgaggagaaggtcctgaaagcaaaaagcaagaagtcaaggattcagtctgccaagtctttgtatgattaaagtttcagtggttagcataattttgtgtactagtatatttccacctgtagatcaactaaatctatgtgtttcaagaaaacctgctttgcctctaaaaatagctactacctgcttcaana

SEQ ID NO: 13370 - DNA, 887 bp, Triticum aestivum
  unsure (1)..(887): unsure at all n locations
  Clone ID: PAT_TA_13370
tttnntgacntcaacattatcacaagcgcaggtagtactcctccgttccaaatacttgattccattttccaaaaatggatgtacctatntactaaaacatgtttagatacatctatattttgacaaatgtttgtcttgttttttgtaacggggggagtacctcacaagcaaccatgcatggatatatatatttatctgctagctagctgagcacgcattattacaaactagctagaacctgcctgacacgctgtaccagctgaaatacaacacacgtactgactgaatacataaacgtttaatttcttggacaaaatcaagaaggctgccgctgctatataatatatgaaaacaaaatgatggaattgcaaatgatggagcgaggaggctgaacgacggatcatggatgaatgtggttgtagctagctagtcgtggaggtggcggtcgaggtggatgatggtggagaggttcatgggggagatgtagtcggtggagccggtgaggtagttctgggcgatgaggcggttggcgcgctccgtggggtggaaggcgtcccagaacacgtactcgtcgcggttggcgcagaggctggacaccatggtgcagatgccgatgccgttgaaccgcccctgcccgcagcaggcctcggtggcggtgacgaagccgtacgccttggggtcggcgatgaagtcgtcgtgcgcgcgccgcgtgttcacggccacgaacaccgcgccgttgccgttcccgctgccgacctcggcgttgagctggttgagcatggcctccatctgcgggttgtaggcctcggacgcgcgctgcagctnggggtcgcagctgccgtcgaggctgtgcatggcgagctcggcgggcacgcagccgatggggc

SEQ ID NO: 13371 - DNA, 890 bp, Triticum aestivum
  Clone ID: PAT_TA_13371
cgtccgcggacgcgtgggcggacgcgtgggctgctttccttgcctggtgagaatgggaatgaccacatggatgatgtggagatcagagccttaatgcaggacatgatcgctgctgctaccgatacttcatcagtgaccaacgagtgggtgatggccgaggtgatcaagaacccccgcgtcctccgcaagatccaggaggagcttgacgccgtcgtcggcaccagccgcatggtggtggagtcggacctcccccacctgacgtacctccgctgcgtcgtccgggagtccttccggatgcacccggccgggccgttcctgatcccgcacgagtcactcaaggcgacgacgatcatgggctacgacatcccggcgcagacgaggatcttcatcaacacccacgcgctgggccggaacccgcgcatctgggacgacgtcgacgagttccgccccgagaggcacctcccggccgacggcgggcgcgtggagatcagccacctgccggacttcaagatcctgcccttcagcgccgggaagcgcaagtgcccaggggcgcccctgggcgtgatcctggtgctcatggcgctcgccaggctcttccactgcttcgactggtccccgcccgacggcctccgccccgaggacatcgacaccgacgaggtctacgggatgaccatgcccaaggccaagccgctcatcgccgccgctcacccgcgcctgccgccgcagatgtacggctcctgtcctagccacggcatgcagatgcagtaagactcgagcaaaacatgcagggatctttatcacaagaatggtgaaagaatacatacatacatacatacgttcatacatacatactctgagacatatctgcgttctgcgcgatatcaacgcag

SEQ ID NO: 13372 - DNA, 460 bp, Triticum aestivum
  Clone ID: PAT_TA_13372
tttgtttctttctcgcgtcgttctcttgttgaggatcaaactactgtccctcttcgattcatcactgattcatcaattacaagcatgaattacagaggattatcaatgaagaaggggattagggggagacgatgaacaggagctatcctagcgagagagagagtctcggccgaagccgccgatccgttccggtccaagccaagttgctcgtggaggccttcccctgtatatgtagtgcatctccttcgtgggctgggtagtgcctgaggcccagcgaggcccaggtcgctaacaatccctcccccataagattcgacttgccctcaagtcgatgttgtaaagtgccgtcgggatcccatggaactcgcaaaacatctagaacccagtcttcagcctggtccacaaactgatattgtgccgaacctccgggatcccatgtcacttgaagagtggtaatacc

SEQ ID NO: 13373 - DNA, 544 bp, Triticum aestivum
  Clone ID: PAT_TA_13373
tagcgtggtcgcggccgtggtacgaaccgtcaagtgctctacaatataaaggggcagcagtgtcatgtatcgaaacctgtttagtttctacgaatcccggcggctatgcacccaacttcatgcaacttcgttgctgacttgcaatccagatctctatcgtcaacatgaaaactctgcaactttcagctgcgctattttacaagtggaagtgttattccaagcatcatggcgaccacagaaaaaaaatcggccctgcttgctagaccgtgtagtttcctgaagtgaggtattgagcagagagaggtggccctgctgcggatacaggatgaccaaaattaaaagggtgattgtacatgcaagctggcccaaacttgcagactccatagcgttcatagtatgtgcacacgggctgatcaggtctgagtggcaagccgagtggactaagagctccggctgttggtggaggcgcaagtgaccttggatggtgatacttacacttggccttgaatttacagaacccacttttaacaaaatgttgacattc

SEQ ID NO: 13374 - DNA, 470 bp, Triticum aestivum
  Clone ID: PAT_TA_13374
cccacgcgtccgcccacgcgtccggtttcggtcaccccgcacggcagcccgctgcaggggcactgccccaccgctgggtgcgacaccggcaaccactgctttgagcactccgtccccggcggcaactgccacggcgtcaccgagatcaagatcgtctactacaacccataggtccatgtcgatcgaccgcctacctagctgcttgctgcacttactatagctactctttaatgttgcagctaagctcgatcgtaagcaaatatctattgtgtgtacgaggttgtaccggagaggtgacttttaggaccatggttcaaccgaacctatggaccatggtcccatacaacattcttgggttgaccgtcgtcagtcgtgtaccatatatctgatttgcaatttaactactcattttgtgtgtgagcctacaatgtattaaataattaatcggagggaaaccctctcttttttat

SEQ ID NO: 13375 - DNA, 681 bp, Triticum aestivum
  Clone ID: PAT_TA_13375
cccacgcgtccgagcctcttcttcctcgattccctagtcatagcaccatactgatagctactcaatggcggcctccaagccccttgccctcctgctgctcgtgactctgtccgcgacggccatgtctgccgccggtcaaggctgcggcggccacaaggtgacggtgcagaacctgtgcggccacgatctgaacctgggtatcgcggcggtggcggacagcaaggtcctcttccccaacggctggctgctccccaacgggaagcacgagtcgttcgacgtgtgctcctggtccgggagcgtgtcggcgcatggcgccgccgtggccaagttccacatcggccacgacggcggggcgtactacgaggtgagcaccgaccaggccaacatgcccatccgcgtctccgtcaccccgcacggcagcccgctgcaggggcactgccccaccgccggatgcaacagcggcaaccactgcttcgagcactccgtccccggcggcaactgccacggcgtcaccgagatcaagatcgtctactacaacccatagatcgatccatccattgcccgcctagctagctgccgcacctgcttagtagtgttgaataatgttgcagctgtttctggttaatctgtgtgtgtgtgttccaacgaggtaccagtagattgtaccgtcgtcagtcgtgt

SEQ ID NO: 13376 - DNA, 1041 bp, Triticum aestivum
  unsure (1)..(1041): unsure at all n locations
  Clone ID: PAT_TA_13376
caccgaccccctagctactcgcagcgagccgcgcctcttcttcctcgattccctagtcatagcaccatactgatagctactcaatggcggcctccaagccccttgccctcctgctgctcgtgactctgtccgcgacggccaatgcctgccgccggtcacgggtgcggcggccacgcggcgaaggcgcacaccctgctcctcctcgtgctgcactcgggtatcgcgactgtgggggacaggtcaggtccgctgcgcccacggggggatggtgccgaaccggaacgcccgagaccttcgacgtgggtaccggggcgggggcggacggcaaggtacgctgcccccacggccggcggctcccatacgggacagcacggagtcgttcgacctgtgctcgtggtccgggagcgtctcgccgcccggcgccgccgtcgccaagtcccccctgggccacgacggccggggcgtactaccagctgcgcacccaccagcccaacatgcctattcgcgtctccgccaccccgcacgcgaaggcccgctcgacggggactgccccaccgccggatgcaacagcgacaaccattgcttcgtgcgctccgtccccggcggcaactgcctcggtgtcaccgatatctagatcttctactacaaccgatagatcgatccatccatcgcccgtctagctagctgccgcacctgcttagtagtgttgaattaatgttgcagctgtttcaggttaatctgttgtgtgttccaacgaggtgccagtagtagttgtaccgtcgtcagtcgtgtgtactagtgtcggatttgcagtttaactagctgtgtttgcatggatgtagtatgagcttagctcaaatgcaaatgtttgcgtgtcgtgatttgttggtccgacatataagtaccgatcttattttctacgcgcctaaattaagtaccagcagctgttgcttggccgtcgtgtgtcgtcgtcggacttgggaaaancttggntttncccaacttaatcgcctttgaanaaattccccnttttncaagtng

SEQ ID NO: 13377 - DNA, 722 bp, Triticum aestivum
  Clone ID: PAT_TA_13377
tttttttttttttttttttttttcaactcaactggagattgccactttgacactaggtctccagatgcttttctactttcaaatgtaccaactggagccaagacttacattgccaacaaaaagaaaatgctaagcagaggaaagaaaccattccggaacagttttcgacatacgtgagatttctcgtgtacttctccacagggagaagttgcaaaacactcgactagtgcggcctgcctctagatgcatcaatctgaatgtagctgacaaagtgcagatgcctcctctggaactccccgttgatgcattgcatcccatgtgtgaactaagaagcttcctggaacctgatgcgccgtgtttcgcgagctcgcagtaaaaatggcgattgatccacatgttggctgtctccatcagtatttgtggatcgcgacgttgaggtccgacgagatggaggtcaaaactgggaaggtctggtgccagacgcccttgaagacccgcttctggtgcgcctgcaccgactggcagggcttctggccttggtaccttatgtcgaagatatggatcacagggtctgctgacccagatgataagtaccagccgtccggagaccacgactggtttatcagggctgactgggactcgctgctcgtttgcttccaaccgatcgcgtgaacctccgtctgccccagcctgatgtcaaacaagcgaagctgcctccctgg

SEQ ID NO: 13378 - DNA, 713 bp, Triticum aestivum
  unsure (1)..(713): unsure at all n locations
  Clone ID: PAT_TA_13378
ttttttttttttttttttttttttgggcggcaggaattgcatcctgctgcttttttttggcattaatgttatgtattcgagctcacagctatacgcccccacacagtattatgtatttttctacagtagcatcccatgtcgtccagagctcgctggcaggctggcatgtcatgtattcgagctcacagctatacgccccacaccgtattatgtatttttctacagtagcatcccatgtcgtccagagctcgctggcaggctggctagacgtgtgaatccatttacccatcatgtctctacagtgctagcgagctcacacactgatgaaaatgggcatgcgcgggctctcatgttcacagccggtgtagccagccaactgggaatccaaacgttggggtttacgattctgaccgttttgagaatccggccgcttgggaaatcatctatttataccgcagaagaacaggagcaagcgtgtccattccagcacaagcaaagcttttggactcttccgaactctcccccataaccgttgtcatggcgtctccttaatcctcggctcgtttcagacggttctacagtattaacaaagggcgacatanccaaatgcatacaccgggtaaacaacacggaaattagtttttagacttaccaggttgcgcangtgttctgtgcctgtaaccaatttgcaacaggggttctagngcttgaan

SEQ ID NO: 13379 - DNA, 809 bp, Triticum aestivum
  Clone ID: PAT_TA_13379
gacgccgcctacacgcacatcccgctcccgccgaccaaggacgctgaccgtgagccccagcactcagcaccgtcgatgtcgtatgtcccgggaacacgccggtcgcggtgcctgccgctcctgctgctgatgcccccgcggccccgcacggctgctcgacctgagcctggcgatgccggccatggtgcgcggcgcaacacgctcctagttcctgcaccacaggtgcgcggtgactcgtggccgtagcaacgccggagccggcgccgcgccggtcagaggcgatcagcgtcatgaacaaggtggcgtaccgcgaggaagagcagagcgacactgggtcgtcgtcatacgtccgggacgcctcgccggccgtgggcgtggggttcgacctgaacctgccgccgccggtggagatggcgtaggagatggaccgatctcggtcgcccgatgacgacgcggcccggaagcaaagcgaagctctctcttgggtagaacttaaagtttagaagaatggcgtgtacttactagtaagaggttaatcggccgtttaattgccaggatcgatccatcgatgggtaagggtaagtaggtgtacatagatcgcgtgcgtgcgtgcgttttttgcatggggaggcaggtagcatgatgaggaacatccatctatctgctcccgatgttacttacaatttccttaaaagcaagggaaaaaaagacaaaaaaggaagaagccagtagtagagcattttgttcttcagtgtacaatattgatctctctctgattaatgtgaaatttatgatttcccgttccaaaa

SEQ ID NO: 13380 - DNA, 545 bp, Triticum aestivum
  Clone ID: PAT_TA_13380
cgtccgagggcctcgatccaatagctcgccatcgttgcttccaaccatggggggctcgtgcacacccgccgcaagcatcaactgcaagccaaagcacgacggacgatgttgccgcaggcggggaaaagctgtgtgccgccgatctgcaacgatgtgctgcctgtgcttcaagcgggctgcggttgctgcaacgaggggctcgtcagtgctgagtcgtcggggccaccggtgctgcggtgcaacatcgcgggggtcgccgccttgccggtgttgctatgccgcatcgccggggtggcggtgtttctatgcagcgccgccgaggctacgatgcagcgtcgccggggtggccggtgtttctatgcagcgccgacggggccatcgaggctgcgatgcagcgtcgctcgggctgcattggagcaccgccgggtcgttgaagctgccatgaggatggaacggactccgccggggctgcaatgaagccttcgtcgaaactgcaaggaagcttcgccggaggtgtcgcactcggtggtgccatggagcagccc

SEQ ID NO: 13381 - DNA, 415 bp, Triticum aestivum
  Clone ID: PAT_TA_13381
ttttttttttttttttttttttttaaagataaacaaaagttactaaaaacttttgaaccacagatgccttgtacttaatccatataataagacccacgaggtaatgcagaacaaaaatagtagctctgtatcttaaccaaaccacagtgcaaatattttccacaaatatcacagtgagcaggataagaacaacatgataaaaacagcagctctgcatcttaatcggcagttcatccctacctcgtctccctgtccgccgccacctcctcctggatctcatcgccggtagcacaccgcagtcggccagccagcaatcaacaccgcgcccaccttcgcgccccacgccggcctcccgcccgtctgcccctctgccttttctgctgcgggcccccattccctcttgatcatcctcctt

SEQ ID NO: 13382 - DNA, 740 bp, Triticum aestivum
  Clone ID: PAT_TA_13382
gttcgagtttttttttttttttttttttttttttttttttgcgtaacaccaattcaaataacaaaaagcatttcataggtacctaggcttttcttttgtcgtggggcttttttaggagaagcttggcactcctgagaaggcatgccattatcaacgtaatcagtggaagcgcctaaacaacttaggtagcgactagtagaagtgggagacgctagcagtctgttgcgggaagtggaacacacttgtctgtgaaggagagttcccacttgtcaaggataacaacgcagggcttaactacttgcccaggaattgtgaccgaatctcctttcttcctttcagcggtagtttcttgagcctgcgtattttcccggacagcattcctttcagcagtaacttcatttggagtggttggcaagatctccgcaccatatggagtggttggaatgagctgcggaatgtgaagaggcttccattcttgataatgacaagggggcaccttctgagcaataatgcgactgagctcctttcttccttcagcagtaccgaggtttattcttcctccagcagtaccaaggttcattcttccttcagcagtaccgaggttcattcttccttcagcagtaccgatctcctttcttccttcagcagtagtttcttgagcctgtgtattttcccggacagcatccctttcagcagtaacttcatctggagtggttggcgagatctccgcgccatctgca

SEQ ID NO: 13383 - DNA, 837 bp, Triticum aestivum
  unsure (1)..(837): unsure at all n locations
  Clone ID: PAT_TA_13383
cgtccgatttgcggcagcacaccggagtcaatttggttgactagcaatagagcaaaggtgtcctccaggttctgcatcatcagtgtgtacctctagattctgcatcattagtgagcaacttacctaagcaaccgagcccaatcaacaattggtagaagtagttatgagatgaggcagaggagagcagagaggaccggagaaggagttgcggacctcgccaacaaggccgtgaccctacatcactaaaaaaaatgcgccgtatttgtttctcatgctttaccatggcatgttcttattagttcaggttggtctctccggttcttttcgccaatggcttgatgtacgcactggcaacctcttactggaaggattcggcatgcctctgttcgagagatgggatatgaagaaatggcgttctgctacgtttattcaggttatagggcctctataggaaacacaataatctgaattcctaataggttgtcttcatgtcgctgttgtgctactgctaggcatgaacagaatggcctcctcttattgcgaaccacactgatgttggcttctgatttctgctgtaatggattatttactatggacaaatatggcaatattcatttggagcaccgtttcttgaggatattctcttctacagacttgagaaagaagagatagggcaataaaataagtggaagtatgctgatgggtcattttagcattacaatcgaccgctggcatctgaacnaaagattacgaactgacnaatctaacatgtcattagagaatacagttgattcatctgaatancatatgaggatagtctaccgggtcantnanact

SEQ ID NO: 13384 - DNA, 516 bp, Triticum aestivum
  unsure (1)..(516): unsure at all n locations
  Clone ID: PAT_TA_13384
tttttttttttttttttacgaaggtatacaatttttttttccccccctcttttttttttttttttttttccctgttggacacatcttttcatcctgtaatgaatacccaataatacatgtacttccatgcgatcaacgaatactacaatcctatatacaaggcgaaaaccaagctcccaatcgaaacattttccaatccaagcggcaaaccaaaccaagctatagctaatctacgcatcctcatggctaattaagtacatccatgagaagatgagttattattactagtatgatggaggtcataggcctcttgcaagcatggcctggagttcctcggccgacctctggctctgcagcctcatctcctccctgaacttcctgatgaacatctccgccctcacgtccaccccccccatcccaacgcctcctctgcccgggctcagcaagaancccctcacgccgaggctcttggcggccgcagtcgccgcacgtgctttgctgccaccggtagcagcg

SEQ ID NO: 13385 - DNA, 873 bp, Triticum aestivum
  Clone ID: PAT_TA_13385
tttttttttttttttttttttttggaagttgatcaaacgaagcgatcgatcgatcttttcattagccgaagggtaatacagataatcatattccgcgaagctaggaactcaacttcaagattcttaaaccctaatacatctgacgtgaaaggttttccatatgtgaaaacatgattacatgatcttgcttctgccaagtgacacgagttcactattagcttccggctctggatgggtgtccaggcagtactagtccggcccgctgggctccctgtcttgtctctgctatcgagatggctgtacgagggctggcattctcgcttaacccttccttgatcatatcctttgggtcaataagaggatatattctcgtcttcccggttccatggtttattcagaaggtgattctgctttagtctcagaaagcccagtaaagcatgttgaaatgactgatgcgtctttccatggaactaaatattcccgaggcatctcaaagtatcatcagctgcttgccagtaaaatgacctgctgctgactgatgtctctttggacgaactaaatattggtggggtatctggccaccagctgcttaccagaaaggcacatgcgcactctgggcaccagatgatccaacaatatgcagtcgcgtatgacgtaatcactcgcaccagagctaaatattaactgaagggtgtgcatcggttcagtatcagagccaagctatcgcatccttccagctacccgcgaggctgtggggcggtgccctgatcagccgttggccgtgacttggcgagtgggctgtggtagatcaccatcatctgccatagagattggccccagtgaaccaaattcaagcggttcagaggaagaacc

SEQ ID NO: 13386 - DNA, 975 bp, Triticum aestivum
  Clone ID: PAT_TA_13386
agtccccccactgtgggcctcgagcggccccccgggcaggtgcccacagcttcaggaggcacgaggccggcgccgccttgcgatctgccatctccctggtttgccgacgtgcggcggggctcttggttgacgtctctgcgggcgtctctctgtagagtggggggcgcgccgtcacggcgggcgtcggctccgggcgcgtcgctggttctgtgggggccatcagccgatctggccctgttgggcgacttcgccctccctccccccgttccgggctcgggggacggtcatcatttggggggccaacccaagtggcaagggatgaaaaatttctttccagagacttgttaatatgccccggggtacggcaccatgttgaaggaaaattttatgttagtagattggaaatatcatgtgcaatatttctctaattgcttgttgcaaatatgcagggcggagtgctgctattcgccagttcctattttgaatacattaggctgagcagttttctaaaatcttaggatgcgtctttctgtagaattggggaggtgacgttacagcaggatatatctcgtgcaaggctctggttctttgagggccaaaagaagatcttgctttatagtgagagatctcacttcttccacggatacaagatcaggggaggacatcatttggtcgtctactcattgcgagggagaaaatatttctatccaaagcttgtaaatatgctcggtgaatcagcaaatcccaggtgtaatgtgtttttttctcgtctaaacctccttaagctggagcagatcgtcggaatgtcgtctgcacggaggctgatttcttccgacaaggatatgtttgtcttctgttgaccgtgcgcatgagcgtatgacggccttaccgactagcagaattttggaacatgagctgaaaattcgctggtgactagtctagctgaaagtgtgtgtacctgaaggtgcggtagcg

SEQ ID NO: 13387 - DNA, 1005 bp, Triticum aestivum
  unsure (1)..(1005): unsure at all n locations
  Clone ID: PAT_TA_13387
cgtccggtgcagcccccaccgttgatggaggaggcggtggccccgccacaggatgtggttcagccggccaagggagggagggacctgctgcggatatttaaggagctgaagcagtcgatggtcacggactggggtggcgtgaggccaccactggtggaggaggacaaggagttcctggagaagaagcagaagatgcaggactgggagcagcagctcagtagcgcatcgcagcaggcggaagcacttgtcaagtctcagcaagatatgggtgacacaatgggtgctcttggattggcattcgtcaaacttacaaagtttgagactgaggaggcattgtatgaatctcagaggataagagctgttgacagcaaacgtatagccacggcagctgtcaaagctagcaggacatgtcgagatctgaatacacaaactgttaaatatctggatactttgcatgaacatttggggataatgctgtctgtccatactgcattttctgatcgggctagtgcattattgactgttcaaacgcttatgtcagaccttgcatcattacaatcaaggattgagaaacttgaagctgcatcatcgaaagtatttggtggtgatagaactaggctaaggaaagttcacgagctgagagaaacaataagagctactgaagatgctaagtgctgcgcgttaagggaatatgagagaatcaagggaaaataacaaaattgaactcagcagattagacagagaaaggagagaagattcctggagatgctggaaaggatatgttacaagccaggcttcatatgcagagaagatcgtcgatggttgggagacatggcggaggagactagcggtatgcgcgaagattcatcggtggacacaacatttagcctgtgttttgttggggtacatgtatgtacaatgtaatnaggtgcgttnccgnatagaaganagatgaacctaaatncaattgtttttcagttatctgtcgcgtcgctttgccatttn

SEQ ID NO: 13388 - DNA, 666 bp, Triticum aestivum
  Clone ID: PAT_TA_13388
ggcctcacaagtttgagctatatatcatcttcaggtctgagtacaaacacaagcacaatcacaacattgtctgatttaaaagtacatggaggccctggttggtctccatttctctctaacattttctgtcgaacaagacttacatttgcagagtttatgagtttctactacaacgaatgagttaagttaatgggcaacgaataatggatcaaatcaggccacacgaaatgtacagaatcactcaagaactgcacaggcaacgaaaatatgtttggcacagtcacatatatatcttcttctgctttggtcggtccctctgcaacttctcaccggatgtggcttctcgaaaaagaaaagagcccagcatcacgagcgggagcctgcgctttcattgaagggaaaatgttccagaacctaagagtttcgtcgccagctcctgttactattgtctgtccatcgggggacgttgcgaggtaaagcacacgcagcgtgtgtccggtaagagtcacaacctgtccaaagttcggatacttccacaccattatttggttctgggagtacccatgggtactcacaagctcattcacattcttgcaccaggcaaggttacaaacctggctgcctgtgtcaattgagttgagcatatttccattagcggtgttccag

SEQ ID NO: 13389 - DNA, 972 bp, Triticum aestivum
  Clone ID: PAT_TA_13389
ggttttttttctcctttcttttttttggcttttttgtttccctggagcaatcagtcaacactacatgctatatcaaaatttcaagggtatacaatatagtcctgcaacctaatcatccacagaaaacaacattctttgagcatgtatgagtacaggggacccttgcttagttctctctacaatctgttggatgagcatttcactatcgtggtcatcctcgtcgcccgactcgtctccatcgctctcttgagctctgttagggtccccgctcttcagcctgctcccaagtgctgtcctctttcagctccgtagcgctctcatcttccaagccccagatcaagctgcggtccactgagtaatcttcatttacctgaggcctcccgtttgtacttgtggtgcaaggggagtcagcaattctcatgaattcttcataggcttcatcgtaggcttctagtgcgtctccagatagatttagacagaaaggttcggcggaggagctagtttcttgtataaacaatggactatcctggttggaagaagaacctgaatcactgtttaagcacgtctgttcggagaagactcgctctcttgccatcatgtgcagttgcgcctgcttctggctctgagctagtgctgtctcaagctccttgattcgctcttccagcctatgctcgatcaccttgtggagacggagcgggcgcgcgctaggtgagacaggatagtttgtctcatgtgtgtaatctggggagctttgtctgctgtccctgccatggtcactatcactgctgtaatcagcaatgtcacgacgaatcatgtcgctcttcagttccccctgaacaatatctccaatgaactcctgatcgatctcgatctgggcaatccgttcttctgccctggggggcggtggcctatttaactcctcccgcgcaacctcggcttccgggtctgcttcctctttcctctctgacgttg

SEQ ID NO: 13390 - DNA, 1192 bp, Triticum aestivum
  Clone ID: PAT_TA_13390
ggccccccctcgtgtttttttttttttttttttccggttcaaattatcccttgattgtatatttcctctcaaagatccagagctggtagttgtacagtactggtctggcaagtgccagctcttaagcacttctgtattagaataacaaatagcaatcctgtgcaatatttgcttcaagaaaaaaaaactgtgcaatacaactcatttgttcatgtaactacaaactaaacatagatacagaatacacgagcgcgactgctcttgatgagggtgaccttattgaaaaatgacgaacatatgtctgaccaacactatgataaaagtacgttgtggttccagccagagccaatgcacaattcgaacatatggcacttccttgcttgccacctgatcacaggttggggcttcagaataaccacaaggtgccctgcgaccgctcgctgccatgaataacttggccaaatccatttaatcatgaaagcagttgcccctgaaactcactgtcactaatcaaagctggcactctgcgacaaattggatggaagtatctgtctttagaattcgattggcactctgcgagaaactatgtcaaactttagataatgccaacgagtggacaactgcctcagctgtagtttctctagagataatatatcaaacttttgcacaatacttcacaccataacacattcattttgatattattagggctgtaagttaatgctctgatgtgtgttgccaccgttccttcacgccttcaatttagaacggagattcaagtgactcgtcccaaacatctccacttgcattggaagcatcttcaccatcttcttccattgccaatcttatatattctctccgagcaaaacgatcccagtcggtcaaggatggctcttcacgccatttggcgaatgaggaatgggtctctagattcaaaagccatgaacttgttgaggttgaagagaacattgaagaaatgcccggacaatttgcacctccggaagtcttttatggtaaaaaagcctcctgccgctggtcctatcatatcaactagttgacacaatatgtcctcaaacagtacaggttcctgggccatgcattccatgcgatgaagttgctcctcaaaaaagtactgtagttcaatgtgtgtgagtatgccgttgccatccaaatctatacatttaaacctgac

SEQ ID NO: 13391 - DNA, 662 bp, Triticum aestivum
  Clone ID: PAT_TA_13391
tgctctcactgcccctccttctgctcgcagttcacctgcctctgcttccgcaggctccccgcgcggcggccgggctggtccaccgacacccgcggcttcccccggccgaccgcgttgtcttgctcatactttctcctagacttgcttaagtttgtgagtcgtgacaatgccgccatttctttggttagcttgcttggcatgctgagcatggtggcgtcacagacatagctccttctatctggccgccttgaccaccttcgcgagccccgcagggccgccgtacgccgctccggtgtctccgaacccgcagaagaactgccggtgttcgggcatgggccaccggggatggcagtggcatgccggtgccggcattggcggagaagctgggcacggtgcacgccgaggcggacgacgtcgacgcgacgcgcttgcgggagaggcacatgctgaggggggtgcgcggccccgccgaggcgcccttctgtgccggcggtgcggcctggagcgccctcagcgcggccacctcctgctcgaggcggttgtgctgcgccgcgtgctgctcgcactagcgcttcatgtactcgcagtccacctacgtctgcttgagcttggtccgagcgcggcggttatggaaccacacctccacctgctgcggccgcagt

SEQ ID NO: 13392 - DNA, 606 bp, Triticum aestivum
  Clone ID: PAT_TA_13392
tttttcgagttttttttttttttttttcaatggaatgcatcttcccagcaattagttattaatacaagccaagcgataaaaggctgaatgccaatacacctacagagctcaactactagtagtaccatcagtctacgctagagtagagtatcaaagccgatacagattagataactgaaatggataggtcagcacgccacacctgactgttaatataatcatcaagaacaaacaacaaagcaaatgagaatatacaacctctaaatgcggtgcaaatgatggattgcatccctcaattatcaacaaacaaacaacacacctacattactgatggcccatggatgggatgggacttgccagtgaattgactgcatagactcatccttgtgacaagctgcgcatttgagtctgacgacgagggacgccgatctcacaagagttcacccgagcagcaaaacgaagagagcaaatagactcgcttgtagaaaacacttccggggacaagttcacaaacattagcgttttagagtctccacccaagcatggctggagtagatacgtcagtttggagttcctgaatggaatgtgttcctctttcttagcaat

SEQ ID NO: 13393 - DNA, 1759 bp, Triticum aestivum
  unsure (1)..(1759): unsure at all n locations
  Clone ID: PAT_TA_13393
gccggccgtttcgggtcgacccacggctctgtttcaatcacacccctctcccaagtctcagtttcaatatctaataatctccctgctccttccgtcgcgtcgatcgccatgtcctcctccacggggagctgcagggttcacgttcacgccgccgcccttcatcacgtccttcactgagcttctgtcagggtctggcgccggcgacgcggaggggtcgccaagggggttcaaccgagggggccgggccggggtgcccaagttcaagtccgcgcagccgcccagcctgcccatctcgtcgccacgtcgccccttctcctgcttctccatccctgcgggcctcagccctgctgagctgctccactctcccgttctcctcaactactctcatatattggcgtctccgactacaggtgcgatccctgcgcggagatacgactggcaggcgagcgccgatctgaacacctttcagcaggatgaggtcggccgtggagacagcggcctctttggcttctcctttcacgcagtgaagcccaacgccacggtcaacgctcaaacaaattacttacctttattcaaggaacatcagcagcaacaacaacaacaagtggtagaagtgagcaacaagagcagcagcggcggcaacaacaagcaggttgaggacggatacaattggaggaagtacgggcagaagcaagttaagggcagcgagaacccgcggagctactacaagtgcacctacaacaattgctccatgaagaagaaagtggaacgctctcttgcagacggccgcatcacgcagattgtctaccatggcgcccaggatcacccgcagccgccccccacccgccgctgcggctcctcctaccaacggctcggagcgctctggcccgacgcccgagcattcatccgtcgctctcggagacgatgagcccgacaagcccgcggccacgcgccggaaggagcaggctgacaacgagggcagttccggcggcaccggcggctgcgggacgcccgtgcgcgagcccaggctcgtggtgcagacgatgagcgatatagacatactcgacggcggcttccggtggaggaagtacgggcagaaggttgtcatagggcaatcccaaccccacgagctactacaagtgcacaacagtgggctgcccggtgcgcaaaaatgtggagcgggcctcgcacgccaaccgcgcggcgatcacgacctacgagcataagcacagccacgacatgccgattcgcccgacccccgcgctgcgggcatcacctaccagggtaagctcagccaccacctgccggtccgccggggccgcgcgctgccggcgacatcttccgccgacagctcgggcggcatttggcctgccgccgtgccggccccgtacaccctcgagatgctcaccaaccctgccgccggacaccgaggctacgcggccggcggcgccttccagcgcaccaaggacgagccccgggacgacatgttcgtcgagtcgctcctctgctagctaggcaggctcggccgcggctcttggttcccatgtggcgtttacatgtgcgtccacctgtacaatataatagatacaacatgttttttagctgatgctttttcttgctgttgagtaaataagcaattgtttgattcatttaatgtaggaataaatcataagcatgacgtaaacagtaaaaaaaaaaagagaaaaaaaaaaggggggggggggtgtagangatgggacggttgacggcggggggggtg

SEQ ID NO: 13394 - DNA, 961 bp, Triticum aestivum
  unsure (1)..(961): unsure at all n locations
  Clone ID: PAT_TA_13394
ggggaccgggacttgtatggctactcgtggttccccgccaccgtggccaaggtcattgataggctgagttacctcgtggagtactccgatctggaggaagaggtgggtggggggaaggccatggagtacctgcattgcctcttcatcagaccagacgtggagcactctccgcgggagagcgagttccgcctcggtcctggtgccgcagtggaggtgtactgtgacggcgcttggtcaccaggggtggtgcaaagggctgttggcgagggtgagtacgaggttagcattgacggaaaggagggagagctgttgctgaagaaggtgccgtccggcattggatatatttcaatttgcatgacccactctagaaatttccttcatatacagagacaaggtaataggcggcagtctgtatctggaaaacgtccaagctcagctgttgaggtggcatccaatgatgatggaaatagccatcatacacaatctccagccacaaaaaggtcaaggaaagaactgccacgaaaaaaacttgaagagttaactgaaggttctgaacatgtgttggagtccgagatggacactagtttatctgcactacgcaagtcactagcaagcaatttttctccaaaaacctgttctccgcgatctagaaaaaataactttcaagcgatttcacgaaggatagtggattcttgtacagtgccgatgaaggggcttggggtttatcatgcttcctcagaaaatccaacacctcagaatgaatcaagagcagatggtattgtggaagttgttgttcaagaagccccgctcgacatgatgctttcaaatggtcagcttaattcacctgtctgtggaacaattgctgatgaagcccatgatatgcntttgactgcaggattaagaaaacagaaaatggattcctcttgcataaataatgctggccagaaaccacaggaaagcc

SEQ ID NO: 13395 - DNA, 786 bp, Triticum aestivum
  Clone ID: PAT_TA_13395
gtgctttgtttctcccttgccctcgggtttcagtttcgctgcccttccccttggccctagccgccctcctttggccgatggcgcccaacgctgacggtttgggtgcctccttcgtgggtttctgggcaatgtttgcagtgcttcttgaaataatgaagtcccggagcttgctgctctgtacatgtttctactacagtcctaatgttgtgagctacaacatgcagcatacaagctacaaacctgaaaatcaccaggtagtcagtagatctgaaaatgatcaggtcgttggctattggcatagaagcttgacccagagagctactgacatggcactaggttgccatctgtatgtacatcacagcaacccccctggaacctttgctctcgggtctctgttctgaattgatcggcccattgataacccgcagcaagaaacgaagaattctgcgcacgtatgtgaatggtacttgccaccatgcttcaggtcttcttcagctaatgcacgagggctgatccaccatttcagagggcggctgctcttgctgccgaggtgtgccaacttccaggaaatcctccgcgttgatgtcgattccttcccactccacgtctcgtgcggtcctccacatgtcccttgcgctttccccgggctcggataagagccagtaatccgcatcagtatcaagttcagaagggacaatcttcatcatccctccaatatcctgtgtagtaggagcgtcagggggcattatcagcccttgttgaacattctccatctccacatctttg

SEQ ID NO: 13396 - DNA, 560 bp, Triticum aestivum
  Clone ID: PAT_TA_13396
cgtccgcccacgcgtccgctcaaatccccacgccaccaccatcccacccctctccggcgaacacgccaccgcacgctcccaccaccgaagcacgccacctcgaacgcgccgatttcccccctcagtagccgtcggccggtcctcctcttcccctctagctactcgactggcgtcgcgccgagatccatccggggtcagaccggttcccgctgtcgcttacagtgaaccctgtattctcaatgttctctctgagatagcatgtctgaacaacaggaccaagttagtaaaagctcctgctcaagtattagcaccagtactcaggggagtgaggatgacgggaccgtcggtgcacttttaacggaagcaaagaccaacgggcgcagccttgggaagcggctgtcccacttagattcactcccgcatactcctcgagttaacgggaaaatccctgattttagtaatgcaaccatagaccatgaatcattattggaaagattgggcacttatggcttagctgaatatcagatagaaggggatgggaattgccagtttcgagctct

SEQ ID NO: 13397 - DNA, 1265 bp, Triticum aestivum
  Clone ID: PAT_TA_13397
agtcggcaccccccgcttctctcttacccccccgcccccccccgccgaccgccctccctcgaatcctcaagcccccaccacacccgctctctctcgccggctcgcacgccatcaccccctccgagctcggaagcaggccgcttgccctcttcgtagccggcgtccgggccagctctaccccgagagctacccggaccagccgcgccccaagcagccaccgggattcagaccggtctctgcgtgctctcaccgctgacccaatgtactgaatttgcacatagtcatgggatgcgcgtactaccggttcaagttggtatcagcaccatctccaggttgatggacagttaacaaatgcttatagaggacggttcggtcttggaactttgttgggaaggttagagacactcgcgcagcctcaggaagcaattggcccagtttgtgattgtcagtttccagccctggcagaccagatattttcgcaatcctgaatatcacaaacaagagaggaaggcagtcatgaagcggctgaagaaattcagattagggtattaaggctttgtaccaatggaatatatggtgtacttggagatgatggaaaggtactggggaaatggggagatcatctgaccttacaagcggcttgcagaccggtttggtgccaaaatttgcttactgacgtcatttagagacacctgcaaaattgagatagtcccaagggacctgactccgacaagagagctttggcttagcttctggtgtgaagtacactacaattccttgtatgcgactgacgacctcctgactcgcaaaactaagaagaagcattggttgttctagggcggtgccgacttcagaggggagaggagcttctctttgctgcagctgctcttctcccttgagcttagcaaggtatgcaatacttctcgcgagcttactatggaccactgcttcggccatcattgtaaaacctgttgtggaattctttacccccgccacaatttttggaactccatcccgcaacatctgctgttatacgcagtgacttgtgacgatcttattagcagtctcttatataacgcgcgttggtgaatattatttatggaggggacgaggagactgtaatagcagcgggagacgatgtacaggtagctccaagggagcatctagcaagcaaaaaacaaagtctcaaaaaaaaaaaaaaaaaaaaaaaaaactcgagactagttctcacctcggccgcgaccacgctaatcactagtgaattc

SEQ ID NO: 13398 - DNA, 1058 bp, Triticum aestivum
  Clone ID: PAT_TA_13398
gcccgaggcgccccccgccctccccccccccagcaccacctcctactccctgagctccttctcccgccgatgcccgtagctacagctcgggccccagtcggcctctcacctccatagccgtgccgccgctcgatctgctgctcctgagctcacccacctcgtccccgacgccgagctccttctcccctgccttcttttccccctgatctcggtgttctcttcttctctttttctcctgtttactcacatctccctctatctctcttgctctctgttacagaggccgccatggacgcccgaggtcctccgctccgagtctccgacccacaccccggcgtccctgccgacgtcgtcgcctaggaagaccaccatgcccgctgcaggagcttcgatgccgaccccgcagcatgtagaccggcgccacccgtccgccggcgggaatcaccagatccccccgtatccgacctgcctcgccatccttctcccgttcccgacgtctcctcagcgccagaatctcaggcgagcgacaccacaagaccctgcctcctctgccccggaggcccccatggagggcagccggtctcactctggatcagtcgacagccgccgccctgttggcgacccctaggcacgccaaggccaggtccgagcccctcacgtcgcgatcgttccgcacccccatccacggcagagcagccgagatccgtcgcctgttctgcgaccccgccccccgcctcgcctcccgcccggcctggcccgccgccccggcacccctttggcctcgcccggctgcgggcggcgctgcccttgcccggcccggcgccctggcctcgcgggttcggggggtcagcgggcggtagtggttgcgaccgcggcctgtggcccgaggggagggaggcgcggaccgtggggagttcgggggcgtgctgcgcggcgccggaggtcgccggaaacggccggcgttggtggtggcggcggtggcggcgatgagggagaggaggcgagcccgtgctcctcgtgtggtcgcgttttctttttctttacacaaatctgttcgg

SEQ ID NO: 13399 - DNA, 503 bp, Triticum aestivum
  unsure (1)..(503): unsure at all n locations
  Clone ID: PAT_TA_13399
ttttttttttttttttttttttttttttttttaaaccaagttaagctccccaatatttagcactaacaaattaacctacaatcacgataaacccatcaccatgcaccatgcaactagtgcgtttcttatattcgctaaaaaaaagaggaaaaccacaatcttgggctgttcttattctgagttttcagaagaaacaccaaatcttcagaggaaaaaccaaacagaaggaaagaatttgatcggtgcaacgtggtgcagacagaggtgcctctacgtggtaaggatgggcgggaggtagtcggacttgccgccgaggatccgccgccgccgtgtccgggaagaactccatcccgggcagctgcgtcanccgcgccgtccccggtgacgctgacggggtaggtgaggaggtggnccggggaggtcccgcctctgggccgtcgcccgcgtagagggccccgtaccttccggccgggccgtgcgccttgtgctcgcgcgcggggctc

SEQ ID NO: 13400 - DNA, 807 bp, Triticum aestivum
  Clone ID: PAT_TA_13400
cgggtcgtacccacgccgtcccgccccatttcaagcagcgaggtcttggaggcagagaggggaagagccatggcgattttggctggttagctttgtcgttgatctctggagagcgagccggtggttaggcgtccggtcctcctcccccccccccctgttgcttctccttcaagcgcgttgaggcagaggagaagttgacgcatggtgattcagcggcggtgtcttatctgcttccattgatttcgggatgctcctccttttgttgtggtgttctccgagccttgtgcctcccttcttcccacaaagaggttgcaagtctcttgctcttgactctacaaagaaagcatcaaatgattcgtcagttggctaaatctgccggcgttctttttgtattctatggtgttgacaacagcaataacttagttaaatatttttttctccaattttttcgaaatcttaagatcttctatgtgaatttcatgtcttttttccttttggacagctgcgactaatcttttgtcactgctttctttagcaatggaggcaatcccatgtgacgttgcgtggcatgtcctaccctattggtctcgatggtcgctggttttcgtttgtcgtgtgtatcgaaaatagagcttttgtgtttcttgactcagcgtttggagagaactcaatgtatcatagagatatctatgatgagctggtgatttttcttattcataatttcattgggctttgggatgggtatatcactcctatgatgcacaaatgaattagtatcgaaaagttttgtgtcttgtatacagttgt

SEQ ID NO: 13401 - DNA, 851 bp, Triticum aestivum
  unsure (1)..(851): unsure at all n locations
  Clone ID: PAT_TA_13401
ntagcatattccnnnnnngcttgctagaatatgtcacttggtgagcattgtcagtctctggtactacttgcttnnnnnctgctcgatcaaattcctagttactgcaaacaaggtcaacttctgacaccaccnntaattaagcagctttttttttttgcgaatcctccactaagcaacatagctccttaataaactctgcacacatgctaggtgttctcctctcgttggcttagcttgaagaacgatcttatattattagatggagggagtatattcgatattcatcatggcacgtctcaagccagcaataccatgcagtctttgaagcttagcatcgctcaccgaacaagtttataaaataaataaatagatatagcagatactaaataaaaacaaaaacgacaattctatacaagatagcaacaaatcctaataaaacttgccgtcctcatccgatttccctggctccgccgctgtctactgctcctggatcgacgaagaggagagcttggagatgaagaggtggtggtgtgtggtccagcagggcacattgcagctagatgctgatgatttccgcgcccccctttcggcacgtggccgcgtgcgagtaatagttagcctgacttcaataatccacacaaaaaatcgagttggactgaattaacataagatgcacacaacgcgaatctatctgccccttggttcgcgaaggaatacgttcctctctgcacgcatgatcacctctcctcctacctgcacgcagcaaacgagcagcaaattccgtaaacaaatcttggtaaagtacttcccaagattgtttatttatgtgtgatcacatccacacatgcata

SEQ ID NO: 13402 - DNA, 945 bp, Triticum aestivum
  Clone ID: PAT_TA_13402
ttttttttttttttttttttaggtaaagtctggaacggagagagcgcgtgcggtcggtcaaagtaaacccccaccgccacgcacgacgcgctcaaattccacggtctcttcttcaaagaaacacggagtcatccacaaggctgagaattactgcatcttcctatacataacaattttgcgtagatttgatctacggggtgctagtaagtgcaaattgataaccaggtgcactacatgaatcttagaatctaccactggcaatctgggatactgccacttggggaaaggggtttcaccttttagcctccccattgaccattttacctttctcctgtgcgctacgtggcatgcagtcacgaggagcatgctcacctaaactcacactaacggttgacagttgcctgtacgtactacggcacgagccgcgcgattgttacagctgcacggtcacggggagggggtggcgctcatcatcaccccacgggaaatcgcggccagcacggcctcggccgtgagccgctcgggccccgccgaccgcaccacgagcgtgtgcgtgacggtgtcgtccgccaccgccatgctcgatgccaccacgttcagctgggagtcccgcatggcgctcagcggcccggagatggggtgcgcgtcgaggggggtgctcacgcgcagcaccacctcgtcctgcattgccttcacctccacggacggcccggcctccgcccgcgccggcgcgccgccccggaggcgctcctccagctcctggatgtacgcgatggcgtcgctcagcagcgatgccttgtccatcttggagatcttgggcaccaccgcgcgcagcgcgtaaaaccgctggttcagcttctcccgccgctgccgctccgcctccacgtggttcagcggctcctcccgcccgttcgccggcttgcgcccccgcttccgcggcctccg

SEQ ID NO: 13403 - DNA, 924 bp, Triticum aestivum
  unsure (1)..(924): unsure at all n locations
  Clone ID: PAT_TA_13403
gggctgcaggnaattcggcncgagggttaaactttgttcgtgtccccaagggnaatttgccaatccgctccgcccgcgcttcaaaaccctagccgccagccctgctcgtcccctcctccccgctccctccatcgtccgccatgtcgtcgcccctcttctccccgctcgcctcggccgcctcctctcctctgccgtgtcgtcggccccctcccccctcctacctcctcctccctcctcccagtcccgtgccagccgccgcccaaaccttagcccccgtttccctcgatccccgcagtaaccgcatccacagccacccgctccttctcacagccgccgcaccattcctcccttccgccccctcctccttcccggatccccaccacggcgccgacctgcaggcaaagggcgacaaagagtggcagacgaggacaacgagggagagaaagaaggggagagaaaaggaggccggcggcggggggcaaggcccagcgactctcggcttccggccgcaggccccggcggcgcccccaccggccccccctcgcggccgctcctccgaccccgtcggccgggcggcgggccccgcccggcccgggccggcgcccccggcgccgccccggtcgctcgccggacgtggcggcgccaggttccagatcggacgcaggttaggtgagggcgtgaggccgatggtggtccttctcaacccgagctcacctcaccctcgcggcggcgaccagcagctcgagtaggaatggtaagggcccgtcaagatctggccagtgccgtgctccctggcgcccgcacatagcggactgtcctctgatggagcataggagcagcggtcgcggttggacgccatgagctgcctgaggtgaggaacgggcgcgcccaacaccgtcctccaataagtccttcccggtagag

SEQ ID NO: 13404 - DNA, 582 bp, Triticum aestivum
  Clone ID: PAT_TA_13404
aattcgaactttggatggactgtcacttgagtcggaaccttctgaccaacctgatgattcaaagacaaattctgattcagctcatcagtcttatgcattccaatctgattctgcaccaccaccagcagcaaataagaaatcagccaaaccaaagtggttcaaaaggtgagagcatcagagcgtcaatagtgcaccaccagcgcgcaacagcacttgattaggcctctcagcaatcccaatgcatgattgatcagatttcatggttcaacggcttcagctatgccgccctagtaggagaattcatcctgtgttgcataggagttgtcgaaccatcggaattagatctcatatgttcgtggtggtagcatgtaaatttggctagtcaaactgctttgtgggtgtgtattggttaacccacctctcagatatgtgtaaaaggccccatagaaacgaaggaaatgacagggcccgtgttgtttacactttactgcatgaatgatatccagtagcatcttcatgagaaagatggcttgagttgaccggaaaattaccaataaagtatcgtggcttctaacatgagtt

SEQ ID NO: 13405 - DNA, 1267 bp, Triticum aestivum
  Clone ID: PAT_TA_13405
gacccccgataaaccctctccgcctctggaccagggggcgggacgagggagggctcgagctcctgctgtccatggatctcgacgaggaggagacgcggccggagcagcaggcgccgccccgggttccggacaagctgaaagcagtgtcacaagagcttggacatgagatccggatatttacaagcacaacatttgagctaatgactagcaaattggccaaggcagatcaggaggaagacgatgacttttatgagcttcagcctagtgattattacaagttgatttcaaataggcttgcagaacaatcgaaagttctgaagactcgtaaaataagggaagcagaacttgctgctcaacgagcaaggctaacaaaggcagtggcgagggttcgattccctgatggttacattcttgaggctgagttccatccatcagagatggtacatagtctggtggatcttctcatgaaagtaattgctagaccagacctgccattctatctttacacagttcctccaaagaagcgaataatggacacctcgcaggacttctacacaattggctttgttcctggagctaatgtcttcttttcttatgatctgcctgaagggtcggagttaaatacagatgctgtaaaatccggaccatatctccgtgaagaaattcgaactttggatggactgtcacttcagtcggaaccttctgaccaacctgatgattcaaagacaaattctgattcagctcatcagtcttatgcattccaatctgattctgcaccaccagcagcagcaaataagaaatcagccaaaccaaagtggttcaaaaggtgagagcatcagagcgtcaatagtgcaccaccagagcgcaacagcacttgattaggcctctccgcaatcccactgcatgattgatcagagctctcccttcgccggcttgagccgtgcccccgtagtaggagcattcatcctgtgttgcataggagttgtcgaaccgtcggaattagatctcatatgttcctggtggtagcatgtaaatttggcgtgtcaaactgctttgtgggtcttacccacctcagatatatgtgtaaaaggccccatagaaacggaggaaatgactgggcccgtgttgtttacactttactgcatgaatgatatccagtagcatcttctactgatatacagtagcatcttcgtgggaagaggcttgagttgaccggaaaattaccaataaagcatgtggcttcaaactttagttactaaaaaaaaaa

SEQ ID NO: 13406 - DNA, 862 bp, Triticum aestivum
  Clone ID: PAT_TA_13406
tttttttttttttttttttttttttgggatctcaattccaaattttatcaactcgacgtatttacaagtacaaaaggggatcaagatggccagcagatagaatcggatctcatcttgtagagggagatttccttatatctaccctaaacagcaatcacatgcgtacaagcttaaatatgcagtgatacaagcaaacacaggcccaaacttattgcccaattcgtatttacaaggcactagagaaaagaaattatatgtgggctcagaaacttttggtgttttcacctccatcttgtctaaataaaaaatctggacataacttttctaccctctgctagtcattcctggagtttgtacggagcaagtcactcggaaaccccatccttcagcttatttcagactcgtactgatgtcgaccaagaaggtgatggaactacaaaaattgtttccaatgcataataccacatcgtgagcgcgagcagaccatacttacaatcttatacttgatctgagcaggtagtttgtgcattggcgacaaccttgctcacattggaagacagctttcctcttagctcagcacagacaagatgtgtcaagaggagcccagcaagaagtgctgctgccatcaacatcgtgcactcgccccgccagccccctgccgccgggtatcctgtggccccgggcccgcttgcggcccctaccggcccggtcccctccgggattccgggcacagtggccagtgcccgagaattaccattcaatgagctgtgagtgccaaggtcagctgacactgcagttgtgatcagggcataaggaccattgacaaacatgccagtgatgaacatgaggcaaatgttcgacc

SEQ ID NO: 13407 - DNA, 1476 bp, Triticum aestivum
  unsure (1)..(1476): unsure at all n locations
  Clone ID: PAT_TA_13407
cgtccgactttgtgtgtctcggggagccatatctaaattccatgctctcagagaagacagagcagtgttaggaaacttctgtggtagaacacctctgttgtttgcaacataccacaatgggggtactgccgaatatcttcttgatcatggcgctaatcaagacaaagctgatcacgatgggtcttccctgttacattatgccgctgaattaggcaattgtgaaatggtagagcttttgcttgcaaaaggagcttatgttgagccggtatctgcttgtggaacaccacttcatgttgctgctggtaaagggcattatggtgctatgaagattttactggaccacaatgcagattacaacaagatggtaaatggcgtgacacctcttattgttgctacagatgccaagtcaatgaaatgtatcaagctcctagttaaggctggtgccaatctcaaggaagctgcagcatatacaactctccacgcggaaaaagtggtttcagattactttctcaattgcataatggaggacgttgatgccaaccgtgatgttcctttttatgggcctatgcttaaacggaaaatcatgacatcagggcttatatcacgagggagcaactctttaaagaacaaggattatgttgtcgcagcaaaattgtacagtaaggcaatggtgcttgatcctgatgatgcagtcttgttctcagacaggagcctttgttggcttcaactgggtgatggaaaaaaggctttgctagatgctaataaatgcagaaaaatgcggcctcactggccaaaagcttgtcaccggcagggtgaagctctgatgctactgaaggactatgagggcgcaagtgaacggttcttggatggactcaaattggacccagtggacactgatatcgaggatgcattacgggaagctatgaagtcgttgaagacgtctcggagcacgaaagccaagtgactatttgggtgttgcaggggaatcagttgaagacttgaaacggctcaggagtttcttcatttgcgcaaagactgatttcctgtaggtagtgcgtagggtctcgatgggcgtattaccgttgcaagtttgtatgagcatggctgttgatcaatgcagtaatgttggtggaagctcttcagttgacatctatctatcctatgtcaggtttgcaggtcttgtttgaagctcactcgcccgccgcgccgtgtgccgcgtccaccaatagatcgcagccttcgcatttgtcttgttacggttttgctgaatcaccccccacccagggctctgcttagtgtttttactactcacgttggtacagtgtactgtagagacgacggaggagagggatatgttttgttggttttcttcgtcctgtggctgcacaagaagaggggagctagtatatacagtatatacaaaaccttttatggtatcagcaaattggtgtgcaagtaacagtcttncttgcagcc

SEQ ID NO: 13408 - DNA, 1172 bp, Triticum aestivum
  unsure (1)..(1172): unsure at all n locations
  Clone ID: PAT_TA_13408
cggacgcgtggggaacacgagcaagaaacaagcaacgaagtttctgtttcgagcaaggagtggtagagatttcaaactcagagnngttgttagttaacctcgagagttgaggagctggagcagtgctgaaagaaatggcgacgaccaagttgtccccgctctcgcctgtgcggccggacgataggcggcgcgcgccggcggcgtcggtggtgctgaaggtgcaggacagcacggcggccgaggcgtacgagcagtacctgcggctgccggagctgtcgagggtgtggaagaccgcgtgctgcccgggctggcccgacgagggcctggtcaagcccgcgctgcaggcgctggagatcaccttccgcttcgtgtccgtcgcgctctccgacccgcggggctacgccagccgccgcgagctggcgcggcggctcgagtcgcccagggtcgcgccggagcccaagaccggctaccgcaaccgcgagaacggggcgctcttcaccatccaccagattcttgaatcctggctgtgcgcggcgtctcagcttctcacccggctgaacagccggatcgaaccgaacgactgggacgcggcggcgaacgactgctggatcctggagcggatctggaagctgcttgccgacatcgaggacctgcacctgctgatggacccggacgacttcctgcggctcaagagccagctcaggatacggtcggcgccggacggcaccgacgcgtccttctgcttccgctccagagcgctgctgcacgccgcgaacgccaccagatacatcaagaagctggtgccgtgggtgatcgtgtngggaggtggaccccaatggcgggccgagggtgcaggaggcggccatgaggctgtaccacggccggaggcgcggcgaaggcgaggacgccggcaagatcgagctgctgcaggcttttcaggccgtggaggcggcggcccgnagggtcttcttcgcgtaccggcaggtcgtggcggcccgtgtgtggcacggcggnaggcgtcgggcaaccgggccgctgtttgcgccggcggagggggacggaccccctgtcgcagaatgtcctcgagccgccctacttccccagcctcgacgccgccaagacgttcttggccgactactgggttcagcacatggccgccgcctctgttccgt

SEQ ID NO: 13409 - DNA, 1633 bp, Triticum aestivum
  unsure (1)..(1633): unsure at all n locations
  Clone ID: PAT_TA_13409
aagctggtacgcctagggtccggtccgaattcccggctgaccaatgcgccatcatgcgttcggataacccaaaggcgtccggcttcctccccgaccccgccccggagcacatgccggacaagagggatgcaaagatgaatccgttgcgagcaaggagtggtagaaatttcaaactcggagcggttcttagtgaaccgcgagagtcgaggaggtcgcggattgcggacggcaatgtcgacgaccagcgcgtcccgccgcccgcctgtgcggcgggagggtaggcggccagcgcgggcggcgacggtcgtgatgaaggtgcgcggcagcccgtccgcccgggcgtgcgagcggtacctgcgggcgccggagctgccgaggatgtgcagggacagcccgatgcgcggggtggcccagacgagcgccgggtcaagcccgcgccgcaggcgccggagatcaccttccgcttcgtctccccgcgcgctcgcccggcccgcggggctccgccagccgccgcgagccggcgcggcggctcgggtcgcccaccgccgcgggggcgcacgtcgggctcccccacctgcggggcgaccgcgcgccgccgcgcgcccccccggacgcgcgagacccccgcctcccggcggggggtggcggcagcggagcctggccgcggccgcggggcgacgccgctgggcgcgtccatcaggcccgaccacggccggcgccgcggcgagggcgaggaggccggcaagatcgagctgctgcaggctttccaggccgtggaggcggccgtgcggaggttcttcttcgcgtaccggcaggtcgtggcggcggtgtgtggcacggcggaggcgtcgggcaaccgggcgctgttcgtgccggcggaggggacggacccgctgtcgcagatgttcctggagccgccctacttccccagcctcgacgccgccaagacgttcttggccgactactgggttcagcacatggccgccgcctctgttccgtcagggcgcagctgaaagtttggaacggccaaataccgccgctagatgggttgccacttgccacggcgacgacccgtgattttgcaggcttagaagttacctatgatccccagcctgcaatcctatagtgattcatttcagtggcggtagacgagtacatatactcagacatgtgtgtgttgtgacttgtggtgccatctgttctagtgtcctattacagagtatttaacggagatacattcaattatatcaagtagcctgatgtaatttcatttgcggttcgtttaatgtaaatacatttttgtcagaaaaaaaattgccacggcgacgacccgtgattttgctggctagaagttacagtacctatgatccccagcctgcaatcatatagtgattcatttcagtagcggtagacgagtacatatactcagacatgtgtgtgttgtgacttgtggtgccatctgttctagtgtcctattacaagagtatttaaacggggatacattccattttatcaagttacctggatgtacttcatttgcngtcctttaatgtaaaaatttttggtaagnangttgggccatgaagaaaattcgttaccctacttaanaatggaatctattacggacatatta

SEQ ID NO: 13410 - DNA, 649 bp, Triticum aestivum
  Clone ID: PAT_TA_13410
ttttttttttttttttttttttttttttttgatcccagcaactaaaacccatccgggactcgatgtatcacatctttacacttaaatacatgcagaaaaagaagagggtacatgcccacgctgtcacgcatgcgcaatcgtacgtacgtgcatgtatatacatgatgatgtaactgctacacattcgtgcacacgacgtattcctgtcccccgacacacgcatgccagccatggacaagcaagcatgcatgcgccgttgcgtgcgcacggtcaccccaccacgtccaagcaatcatggaatcgatctccggcaggcctcgccgcacaatgccgtcgcagctaggtaacttcatcggctcgccgatcacgcggcggcctcctggaggtagtacgggagcagcccgatgtggttctggcggcgcagctgggcgtagaagcgggcgatgaactcctccgcctcgtcgtccacggcctcgcccaggcccagctggtcggtgtcgacctcgtccgacgagaaagttggacacccgcaccgagaacccgccgtcggccgcgccgggcaccaagcggggacatcccgccggcgtgcattcctcccccagcgcgagctcgacttggaaaaaaataatcagcgcccccgggcgacgac

SEQ ID NO: 13411 - DNA, 749 bp, Triticum aestivum
  Clone ID: PAT_TA_13411
tttttttttttttttttttttttttttttttggccacggcctgacagcacacaatgcacttgcaatcaattaggagtgagggacacttctttgcacatcaactaatacacaggctgaataaaaaaagaaaaaggagagagccccaactgaacactacccaacaacaacaggctatatatgatttcccgcatgcttcctccactaggcttctgtttctcttcagtcatccccagcacattccagccatggagcctgtctaatcccgaaccccgaccggacccggcgataagcgacgacgacgccgttgcacttcccccccaacccccacggtgtcatgtcatcggagcccgacggggaggcaacacccctccgccgcggctggcttctttccgttcctccgtcagatcatcagtgtctgcggcgcctttgtcgctcgctccttcgccagcttctccatcgcgttcacgaacttccgcaggtgccggatgtactcggggtacgtctccaggttgcagtggccaccacctttgacccacagcggctcgtacttctccttcgctagctcccataggcgcttgccgtgcgagaagtcaacgatgtcgtccgccgtgccatgtataaccagcactggacattcgacctgctttattttgtcgatgttcttgaagatatcaaaccaaagtgtcactttcactggatacaaaacgcgtatgcctgacagaataccgcacctcggccgcgaccacgct

SEQ ID NO: 13412 - DNA, 734 bp, Triticum aestivum
  unsure (1)..(734): unsure at all n locations
  Clone ID: PAT_TA_13412
tttttttttttttttttttttttttttttttcttccctttttctgaacttgattgaatcatattcagccaagtaaatcagaatatatgttacacatgatacaaaggtacaaagcagatacaacaatttatatatgcatatgaagctatgacatgtacgcacagcgactcgacatcatcgatacaacagttcatacacccaaatacatgctcgatatgttctccgtacaccagtaaaaggatagcacatatagcttggtccgctaattttgatctattctcattcactatgccaggcaaaagagagtactcagcgtacacaaagttcctatcgattttgacctaatcagatacctgcaaagaaacacacctcagggtgcagctggtagcaggtggcatccatttcccataatcgtacacactttcaccaattttccacccaggatcctatcttcctcctcgggatacttcttccagtctttgaaaaattttaagagatacccagtctagagcctaggcttcctgttcggagggcaaagcttcttttcccgtcagtgtctcatcttgtccacttgaaataccatcgatctcatctgctaaggtagaagaatatccctcgtgccgaattcctgcagcccgggggatccactagttctagagcggccgccaccgcggtggagctccagcttttgttccctttagtgaggggaatttnaagctggcggatcnaanncnc

SEQ ID NO: 13413 - DNA, 474 bp, Triticum aestivum
  Clone ID: PAT_TA_13413
ccgactcccaaggctcttggtttttttttttgttttttaaaagtccccaactggggtcccatagctttatagaagagagaatttcaagtacaaaataactacaactcattgcgaacaacaagtatagcgcacactccacacctggctagtccaaagatagccaccacgacaaaacaactacaacgcaaaagagcctgaccaaaacagaagaaccatgccacgtctcaacctacgccggtcacctccgaagaaccgtagctcctgccaagcttcccttgtcgacgctccatccaccctttatgcctaaaggaggtggcaagtgtatggtgggactcgatcagaccggagaaaggcgcagtcttggaatcactagcgacgaccgtacattgtgccgcagaagatccatcatggacagcggcgaacaccggaggagcacaatgaaggacctccagaccgtgtccccagacctcgtgc

SEQ ID NO: 13414 - DNA, 388 bp, Triticum aestivum
  Clone ID: PAT_TA_13414
ctagtctcgtgttttttttttttttttttttttttttttggtaccaaaattgatctcttattatagcaaaatgatacattgttgctcgaagttcctggcactaattgtatgatattcacactgtatacacatcattctttgctcccatcttgctgatcttcattatctgggacatcacttttcgtcatcatctccttctcttgttcttcctccttcgccacctgggtccacattttccggtttgccagcgccatctttctttctcttgaggaactggataagaccggggggtgcgacgtccgtctcttcattcctcatgagcacctctgcgacctctgctggagtcaccatgacctccttgatcaattcttctatctccgggtatgtg

SEQ ID NO: 13415 - DNA, 541 bp, Triticum aestivum
  Clone ID: PAT_TA_13415
ttttttgcctttttctctctcctacttctctgcttatgccatgatcattcaacttatttcattgtatttgtatacatcataagttttttcttttttaggatgagcaacacgacttgtgaagtttggactccaactgggcagctcacgaatggcggacctagaaatttactgaaacctgaacaaagtgagtgccatttccactatctacatagccataaatttgcacccgagctgctcggacaggaggaacattaggaatgtcggattcttccaggcgaatcagagcgcgcagatcgctattcatcatagattcttcggccggtcccaccccgtaccccgggcagggggcctggcgcggcacctccctccccccggccccccgcccgccggcctccggccagctcgcggccgcgctcctgcgccgccccccgcgcgggagatgagcggccgcgctcgcgccgccaccaccgtcgccggcttcctctgtcgccgccgtcgccgacgcggcgaccgcgaccgggaagaccgcggcgaggcagag

SEQ ID NO: 13416 - DNA, 945 bp, Triticum aestivum
  Clone ID: PAT_TA_13416
tttttttttttttttttttttgcccctcaaaacatacatactgccattgatttcaacatcatgtcttcaatctaatcaacaaaagtaccaccggcttgttcatgctgaacatattcatcagcattcaaaaaagaagtttccatcccatgcaagacaatgaaacaaagtctatccatccatccacaaaacagataacacgagaggtctaaaaaagactagccatccatccacaaaacagataacacgacaggtctaaaaggagactatccatccacagtagaagaccttctcctggacacgggtttttaagagagacaagtgcaggccgccttccttctcctggaggcctgaaaagcctattgctgtctgatggacacccggactctaaaataaactcaaccattgatcaaaaacaagttgttctcatcaagaagctcagcccagggtgttaataataaatcagcaactccaaacttgttatccggaaggaaggggctgtcaaatgaaaacttgtccacatagccgccaccaggtttttgccttactgagaaggccacagacaagacttcaggctgagttgacttctgagcacacaaaaacatcccaaatgcacttggagcattggataccgcatctatagtagtttggcactgcacaaagagtctgtagccgccataggcaaaaacctcagtatatgtactcctccacgcaggattactcatccgggcaaagtcggccagaggaagatcaaaataggccaacaattcgttgtatggcagaaggttcgtcaaaatgactggcctaatcagataattccgctgggcataattccaatgagctaccttcactgtcgaacaattgatcttgaacaagaatgcactagaaataattgacttgacatcaactttgttaggcatcagagggcaattgagaaggccttaggcg

SEQ ID NO: 13417 - DNA, 637 bp, Triticum aestivum
  Clone ID: PAT_TA_13417
tttttttttttttttttttttttttttttaccacgaagaacaaccagaagacaatcttccggttttcattgaagttcccaagaggtatatgcacatgaaaaagagtacattttgttgagcctcttttttttctagaatacgcacgaacatgcatatcatatatgcatagaagaagaggtcaagatggccgatacaacaccttccggcacaatgctacaccaagaggttagcactacatccaccacgacaacaccgacacactaccaatcttgcccgaactcaagccaatatgtgcacacattacggagagctctcgtagtcgggatctcgagtttgtaagggtgccgaggcaagcccttggtcggagatataagttaccagcacgtactggagcaagcagccgtggcagccgaccggaggataggacgaagcggtcgtggtctaaaccagagccaccgctagcactactcacagagccaccaacaccacctgaactgtcgccgcggccagcagaccaccacaagctacgcttcccaacatccttgccatgtcgcgctcacctcaccgccgtggccaccgagcaccacgccgtcgtgccccagtggtcaaccgtatatccccacgacgaccaacctaa

SEQ ID NO: 13418 - DNA, 856 bp, Triticum aestivum
  Clone ID: PAT_TA_13418
gccccccaatccgccgagctcttgcttcttctccagccttccccttccttcccacgcgaaaaaagagaatccaaaatccccaaatccccctcccactccacgccagctccgccctcaatccccaattccccacgcggccggcctccccaccagctccccccagctcggatctccgccgccagcagctccgccatggagtgcgagcccgaggagctgcagttcctgggccccgtcggcatctaccgggagtcggtggccatcctgcgcgcgcaccgcccgctctacgcccgcatcgccgccgccttcgtcctcccgctctccgcgctcttcctcgcccacatcgccatctcccacgccctcttctccaccatcgactccgacgactccgccctcgagtcctccgcccccgggaccgcctcccagcagcggatcctccagcggctcggcgccgactgggccgccctcgtcctcttcaaggccgcctacctcctcgcgctcctcctcttctcgctcctctccaccgccgccgccgtcttctccgtcgcctccgtctactccgccaagcacgacgcgctcaccttcccgcgggtgctctccgtcgtgccccgcgtctggcgccgcctcgcggccaccttcctctccgccttcgcgctgctcttcgcctaccacttcgtcttcgccgtcgtcttcatcgcgctcctcgtcgccgtcgacaatggctccaccctcgccgggctcctcgccttcgtcgtcatcgtcgcctaactaagtcgggctcgtctacctccttaaggtctggcacctcgccagcgtcgtctcggtgctcgaggactacaaggggttccaggccatgcgc

SEQ ID NO: 13419 - DNA, 579 bp, Triticum aestivum
  Clone ID: PAT_TA_13419
ttttttttttttttttttttttttttttttggaggggtagcaggatgaaacaactcgattcatatataattataggattaatatcagacagacgctacatataatgaataaacatgacacgaatcagattataatataataatgaaataaaaacagcgccgcatgttcacgcccatgcaagcgcgcgcgtgccaccaatgcgacgctgccccctcctccccctcttctccatcatcacagcagcagcaacctagaacgaacgaacagagacatacaacgccgcgtcaatcagtggtggaggtagtaggcgaggaaggagacgacgagcgcgacgggggcggtcacggcggtggaggcagaggcgccgctggcggcggggccaggggcgccgccgggggcgccggtgggcgcctcggaggcgagcaccgcggtcgccgaggcggcgacaacgagagcggcgaacaacaccttcttcatctccatcgattgggtacgtacggccggcgcggcggaggtcgggcgggcgagcaggggagcggccggtttattcctctccgatcgagcagcgagcgagaccga

SEQ ID NO: 13420 - DNA, 439 bp, Triticum aestivum
  Clone ID: PAT_TA_13420
tttttttttttttttttttacaaagcagaactttttatttatcatttcaggaaaagtatttttttgcaattctagggacgcatgtatttgcaatagaaagaatattacagtttgcagttatccttcagtacaagtaatccgcccagcaaatctagaccatgtcgtgtcttctcacaaatccccaaaagggccagagactcaaacattctaatacacaaaaaagagcagactgggtgtctccagacgggggccatgtctcccgccgcgctttccctggctgcagagacccgccctgttcctgcccgggcgcccggcaaaaaccgaaacaacaagggccaagcccattctcatagactgaaatatatacagggcaaagcccaccctaatcgacgacaagtcgacctatgaccggacaacgcagctccgactcaaatgaaga

SEQ ID NO: 13421 - DNA, 690 bp, Triticum aestivum
  Clone ID: PAT_TA_13421
ttttttttttttttttttttttttttttttttttcccctccagtaatctacatcgaaagcctcgtctctgggcgttatttgtcacctacgggggttctaccacctggtccccgtggttgcctggggtgtatgggggctgggcccgtcccgcgtgcggcaccgcggccgtgcgatgaaccgacgcactacacactacactacactgcactagcatgcagaaagcatacatctcctagccacaagcccattgccctggatggaaagtgaacatccctagggtccgtctttgtactgacatggagcccagcagcatcgctgtgcatcagtctttgttgcgtcgcagaggaggggtacttcgttactcgcagagcatggtgtggggtgtgtgtctgtcctggagatcggcctccaccgcggggaagatcatcaagctcaatcctcccatttgataagtgagccaaagaggaaatgctgcatgatgggcaccttctcaagcacttcagccttgtacatcttgagcagcccactgttcaccttcttccagttcggcaccgcgctgatatcatccaacatcggtgaatgctccgcaaagggccccttcttcacttttttcacatacatgacgcacgccaggtacatgtactccttcgagaagttctccaagatatccgggttgtggatcgacttggg

SEQ ID NO: 13422 - DNA, 577 bp, Triticum aestivum
  Clone ID: PAT_TA_13422
ttttttttttttttttttaataaggctgcacatttttctcggagatcgtcaatttgaccgatgccacgccacgaagaagtacattgcatcccaaagtaattttaaggtgatgctggcgcgtccaaatacacaactcaatgtttcacggagaaatatacagatagagaagagaattaataaaacaaccaaagcggcaccggcgccatggcctcaacgacaacgaaaacgtgtgcagaagcccaagtcacgcggcgacgtaggctttccccgacgatgacgccggccgcagctcgccgcctttgagaaagccggagtaccagcgggcagagttcctcacgtatcttgtcctcccctcgctgttcatgtcgacgccgcgcaggccgaagcgcatccggtagccgaagaggaactcgaaaacgtcgaggaaagaccacacgaagtatccccgcgcgtttgatccgttccttatggacagatagagaacttccagataatcttgcaggaactctgatctgttgtcgtcgtcgtattcgaccttccgcgggagttcggaggcgtctccgtatcctgaaacatc

SEQ ID NO: 13423 - DNA, 654 bp, Triticum aestivum
  Clone ID: PAT_TA_13423
catctctgctcctctccacctctcgctcccagacctgctcgcgctccaacaagcagcaaagcgccatggcctgcatcccgtgcaccatccagctcgcgcgcgtccgggcgtcctcgtcgtcggggtggaggtcgccgcgggcggcgcgggtagggctgagggcggcgcaggtgggcggcgccgcagcgtggctgggcccgtcactgttgagcaaggtggcgccggcgagggagagcggcagggtggggttcttcaagttcgggaacaaggacgcggagggcgccggcatctacggcagccaagcgagggacgacttcgaccgcgacgacgtcgagcagtacttcaactacatggggatgctggcggtggagggcacctacgacaagatggaggcgctgctgaaccagagcatccacccggtggacatcctgctgattctggccgcctccgagggcgacttgcccaagatcgaggagctgctcaaggccggcgccaagtacgacgtcaaggacgccgacgggaggacggcgctggaccgtgctagcggcgaggtcagggagttcatcaccggcttcgccgtggccaagaaggcatgatcactcatgcttggagattccggtttggggtgtgtagattctcgtcccgtttgctacg

SEQ ID NO: 13424 - DNA, 1451 bp, Triticum aestivum
  Clone ID: PAT_TA_13424
tgaattgtttggatacattgagcccgcgcatggaacatcaggccttttccattaccgtgcacagggcgaaagcggaccaaacgtattagatggcatacaagtgccaccggaggacgtcggtgaattcaggagtcgtgccgacaatcttgggtatgaatacatgtatgagatgaacaacgagatctatcatctccttttgcgcagccccaataaggtctgatctctgatgcggttgactctcaccaatccaaccgatggttagagtggcttaccaaggagaagacccaatgctaggtaggattgttagtgtggcttgctctctcatgttggaataaaacccttgtcgtacctgtttgtgtagaactgttagtgtgccatccgtcgacaagttatttgttgtagtaatgtgtggtgtatttgctctgcgcctgtggggctaaatctcttgttttgcatgcttgtgaggcaccaagaattcatgaataatgataatgatagtgatgatccaatccaagatcaaatgttgttgagcgtcccgtccgcgctccaagccgcaagcgccatggcctccatcccgtgcaccatccagctcgcgaccaagcggcgtcctcctcttccgggtggaggtcgccgcgggcggtggggggagtgctgggggccccgcagctgggcggcggcacgaatacatgtctgagatgaacaacgagatctatcatctccttttgcgcagcccccataaggaggttcttcaggttcggcaacatctcaccaatccaccccgggatttacggcagccaggcgagggaggccttatgccaggtaggacgttgagcggtacttcaactacatggggatgttggcggtggagggcccttacgacatggtggaggcgctgttgaaccagggcatccacccggtggacatcctgctgattctggccgcctccgagggcgacttgcccaagatcgaggagctgctcaaggccggcgccaagtacgacgtcaaggatgccgacgggaggacggcgctggaccgggctagcggcgaggtcagggagttcatcaccggcttcgccgtggccaagaaggcatgatcactcatgcttggagattccggtttggggtgtgtagattctcctccgttttgctgcggtcggtagagtgagcttagccgggagattcacgagctgctcgggtcggcacggtgcaacgactgaccttgctttgcgaaggacctgatctccatggaaagtttgagtagttgctgaacctgacgagcaggtttcgttgcgtcatccttgaactgaggcaactgatatataatgttattcggaaaaagaaccttgcttcagcttgctagtgttatgcaactatgtaaccggctttaatttgtaggggcatatatttcctttcgtcgctcctctctttttcgtacttcaacaaaaaaaaaaa

SEQ ID NO: 13425 - DNA, 584 bp, Triticum aestivum
  Clone ID: PAT_TA_13425
ttttttttttttttttttttttttttgttgcaaaaaaaaaagaatctttaaaatagtttttattgaattttattgtagcgaagggtgcatgtgatcctacacgctaagagcaactctagcagataccgcaaaaaatgatcccataaaagcaatatacagatcacctgaaaacagatttgtggtatgaaccaggatcaagcagaatagatccgtgaaaaccaccacgtatttgaattctaattcgcgctacaaacttaagcttatacacaaccggagttcatcttacatatacgtgtagcataataaaaacatagatcgaactaaacctagggaaggccgggaatcagtcctaaacaccgaggcagaatgcgaaagccgacatccggcacgcatgggcgtacgtgagctctcccttcgccgccttgagccgttcggcggcgccatcttctccggccgccatcacggcttgggcggcgcggagcgcctcgtccacctctcggcaccttttgatgcgcgggaaaagcacctcgtcgagctcgatcaagtgatcccacgcgccccggccgccgctacggaagagccgg

SEQ ID NO: 13426 - DNA, 966 bp, Triticum aestivum
  unsure (1)..(966): unsure at all n locations
  Clone ID: PAT_TA_13426
accccaattttactcattccagtgatgttgcggtactcggtgttggtgtccctttttcaggcgtggggcagtggcgctgccacatggctgcgtgctgcagctcacagtgtggcattgtgttgcatgttgcatgaaggttggccggttatgaggtaggcccgctctgggcctacggctgcggctcttggttgttgggcaaggcaggtggtgggcacaatggaggcatgtggtcatggtggttgtgtagcggggaggtgcacaaccatggtgacggctcctcagtgggtgtagtggtcatgctggcgtggtggtgccgcgggtgccgtagtagggacttgtggttggcctcaacgtgttggcttagcagggtgccagcttcggtggtggggttttgttggcatctctttggtcattcctctatgctttggtgtggttgtgtagtccttctgctctgatcttgtttggttcttttgttatgcaaaatagaaaattctctttgttgctgtgccggaatgtaatggatagaaactacttgaattgtattttggctgatgatgatccccatttgttatgcctgaatggcagtgtagccatgttcgcctcctagtttgcttcccttgcatttgaacaaactgtatttttcaccgcacagcacataactgtccgacgtccttcattgccttcttgttggctcaggtaaatatttttttacaaacgtgctcaatcttttgccagtttggatgtccgactgtttggcaggactccatgacctcgtcctccaagtatgctagacgaagcccctcgagagactggggcagtgttggaagcgaccggacattcgggcatgaactaaccaccagttccctgagtgatgtgaggtgctccatgtttcctggtaaggcgtcncagctgcagttccaaagctttagcacatgaagatgtgggaaagactcaacaagctgagga

SEQ ID NO: 13427 - DNA, 572 bp, Triticum aestivum
  unsure (1)..(572): unsure at all n locations
  Clone ID: PAT_TA_13427
cgaattgcggccgcgtcgtcttttttttttttgttgcagacaaagtagcaatgcatgtttaatttctataagctggtacatttgttctgaaaatagcatcacatggttactccatacatgcagaatagcattgtgcaatcgtgtgtggccatcgagaaatcaatcaaaattgggttcatgcgtgtggtgacagactatgtactacactacagcaaacaaagaacatgtagtatgtcagtccattgtgatcaggcctggacctcccttcagcgagcggtgcagaggccgtgatcgcttgaagccgaatatgtcggtaatccggcaagttttgggcggatcagcctcggcgatcgccttcttgaactctgccgaatggttgccgctgaagacctgcacgcttactgtcctcctttgaggggcgtccacctttatgtactcatcaaagtattcgatgaattcttctttcttgagctctcttaggagagcaacctcggactcgaccctatcaaacttgagagttccggcttcaatctctcccctgtggaagccaggtgcctttcncaaacaaactt

SEQ ID NO: 13428 - DNA, 742 bp, Triticum aestivum
  Clone ID: PAT_TA_13428
tttttttcttgcttctcctgtattacgacggatgaatccatcatacctcggatcagttaaagtttgtgatcaatccaactagaacaatacagctaaagagcactccacacatgaagaaggttctttgtctcctttttgcttagcctcagaagcgattacagtacctatacatggtaaggattggaaatctatacaaagggacaactgtaagtttcatcatggctttctgaacctagattctctgtcccaacttctggcaatccggtgatgctccgcacgatgctgaccctcatctcatatacagaagctaacccaacaacagctcacataaccaataaatataaataacacaaactaatgcattagttgaatcaaacctatcctcgcaaatcaattgttttggacaggaactgctgcagaagtatctttcaggaggggattcttcaggccgtctggattaattttcatgctgcgcggggtttgtgcgctctctggtggcttcttacctccaagttctaaagttgtgtccatggtggactcactgtcagcggccttctctgtgctggttggaagcttctgacccgatgttgaagacactgtactgggttgctcagtgattgtcgttgctggagtgatcacagagacggggtcggcccctgatccgctgcggccccccaacggtcgtccttgattaatgaaaacatccttggcaaatgctttcgcagttgttcgtctttcataa

SEQ ID NO: 13429 - DNA, 352 bp, Triticum aestivum
  Clone ID: PAT_TA_13429
tccccccccgttcttatctacgcgtccaattagcacccaagataaattcacaactgtcccactgtgacaaaaaaccacacacactctgcacacctatacacacgcgtggcggatataacacagagatcgccacatggctgactgctggtcttggttccatcggacccaattcattggattcgttcccctttttcccccattgtactcgtaccggagagaaagcacggctccatcttcgcggtggctcaggctgcagcttggcggcggagcggctctcgctgtacctcggaggcactggggctccatctgcatcttggtggcctgacagcttggaggcacagcggctcgccgg

SEQ ID NO: 13430 - DNA, 912 bp, Triticum aestivum
  Clone ID: PAT_TA_13430
ttttttttttttttttttgtaaatctggaagagatcaaatgtataaagaaataagaccgagaggccttctcgctgctttttccatgcacacaaagccgtatcttgtataaatatacaaaatagccacaatttctgactaagatggatcataattctaataaattattcgatgcaagctttgattgcaaaacaaacaaaaatgttatatcttgctgttgtgaggtttcataattggagaagaaaaacagtctttaaccaacatacaacaccatttatcaaggaatgaaaaatatggggggttcctcttgtcatgctcgttctggctcatcttgggagatgagcgaacaccttgactgtatgaaccgtggacacacacggcagctggcctggttgtaccccgccaacctgacaacatgcctcgagtactcgctcagggtgcccctgctgctctggttccggacatggctcaggaagaagatgcccggctggtagcatggggtgtcagggatcttcaaacacaaagggccggttggcccacccctgggtcttgaacgcctgcaccaccaaaggtgagtaatcctctccgttactaaagaatgtgttgaggacagcagaaaagaaatgtccagcatatctgccactactttttcctggagatgccaccacctattgtgaagtttaatatcaatggaccaatactcatttcaaactgcaaaaatagaatgccgacagaggccaatggtatttaactatctaacaatgtcacgagttaaaaagatgaaggcaagaatatggaaacatctgcacggtttgagtaccgtctcaaacacaaacatatatatatatatatatatatatatatatatatatatatatatatacataggtagccatatggagctgtaaaccaag

SEQ ID NO: 13431 - DNA, 735 bp, Triticum aestivum
  Clone ID: PAT_TA_13431
tttttttttttttttttttcaccagaatgaatcatgccattgaactgctttcttcactgcgcccccttaatgcgggccaaacaacaacaatcttctagtttagcaaaaggaaactaggacaagaatgctgttctcaacagacgcacaacttttgcaattgaggatttaactttgaagcaaaagtcactcctatacaatatgactgcgaacggtaatatttagtctccaatccatgtatctggtgacagatatgagacgactaggagcaaaatgcagaaactaggaaaattatgcgtatgagacgtgatgtcgacgccctctgctatcgttgacctagtaaaacccctccaccgggggttgcattaccatatctatagctatgtacatgaagtccaacgaggctgaagtttcccaaacttcacggcttgctgacatctaagtctacgcctacttccccgtcgcagtcttgttcatcatcgtcacccctatgtcgcttccctaatactctttgcttttcatcctctataggaggagaagccttaacagttaaactgaatacttcatcgttgcactgctgttcagcatcatcatcccttggccgcttccctaatattgtctccttttcatcctctacagaagtagctgccttatcagtcaaacttaacacttcattattgcagtgctgatcagcatcaccctccctaggtccccttgctaataagtttgctcatcatc

SEQ ID NO: 13432 - DNA, 576 bp, Triticum aestivum
  unsure (1)..(576): unsure at all n locations
  Clone ID: PAT_TA_13432
ttttttttttttttttttctgagggtagacttgattaatattatacagagataaccatgattacatgcttcgacacgacaataacatatagcagtgggagaacaaaagacaggacattagcatgcagcttacacgtgttcgtactacttaatgtaatcacgaaattagactctccccattacaggactctacactaaaactaagtgctcatctcgcgaagattaagaacaggatagccgcaacaaggagttggnttggtgcaagccaaaagcagcaccgtgcgttggctgtccgtcgagcagcagtgcggtgcagcgcaggggggcgtccctgagcttgttggatctttgcctggcagctgtgngacgaagttgtgctcgcgcctggatctatggtgaagcacgtgggactgggacatgccatggcgagtcaactccggcaggtacgtgtgaacgtgtccngtggatctcaaaaaactggcatgacccagcatcccggctcgagagataaggttgaccaccttgtcgccaatggatcagcggcagtacccgtcggccggagaagaagataagtggt

SEQ ID NO: 13433 - DNA, 651 bp, Triticum aestivum
  unsure (1)..(651): unsure at all n locations
  Clone ID: PAT_TA_13433
ttttttttttttttttttgggtggcccccctcggtaggggtcttctccccttatgtaaatgtgttccatgcacaagactttctgttacaggtacagctgcccatatattgcaccccccgtgtctccgcctcagacaatctaatctccttcactgaccccaatatctgcacaggtcactatgcgacatctcactctacacgagcaacattccttatgtcaggcgacgcagcagcagagtctctgaatcatatgcacagcacctcgactctgactcatgtcttgcttctaagtgtatcaggtatcagaaagctgactaaatcaattgcaagaatctatgcatcatgaatgtgatctgaagaacctacagccccgcgcgggatcgcactgggcacgacgagcaagagctcagtctgcagctagtgcttggagctcccgcaggtgggctggtatcagtgttcccaggtgaggatcctgggggtcctccgcatatgcaacatggtatgctgcaacgcaagcctgtggcaccaccataccggcagtgcatgccccttacgtgcccggtccttggccggcgcccctgaattctaccaggcaatgcatgacacacatnngcaggccccatgnancaaggacaangaccgtagngatcan

SEQ ID NO: 13434 - DNA, 902 bp, Triticum aestivum
  Clone ID: PAT_TA_13434
tttttttttttttttttttacttaaaaaacagcattgcataactgattaagcatacaattacacaagtgactacacacataatatttccacacaccaaagtaagcaattacatgcatactaaactaggagaaacgaggatctaatcatctactccttgttgcgatgacgcttgccattgctctactttcggctggatccctggccgttttggggaaggtgacactttgtcatatcaacgatccgcctgtacatctcgtaactcgtgtatgccttcttggtcgtgtacacggcatgagctttgtcgagtttctccatccaggccaagggccaggcacgcttgtccttgttgcaggaatccttcatgtctctgtagtaggatcgatgatggcctcggcgaggtgaaccagtgagttcttctcatgcttcgttgctgccccagatcttgtattggctctggatgtcgacaagattctggcaggcgatgcccgaattcttgagcacatttacatcgtcggtgatgtccaccgtagcgaacatgtaatgggagttgttgaaaaacctggtgaaacgcttgcaaggccttgtggccaggcagtagtggcagacgaggacgtgattgcgcatgcacatctgggcgacgacgaccttgggacgagaccgacatgagcgcgggtgtactcaaggtcaaacccgaccaccttgtacttcttcttagcaagcaacagctccatgatgtggatggagtgctccacccataccgggttgttggtgtccaccaccgagagctcgtgaaccttctgtgggtgtccaccacggcatgcatggtgaattgttgctcatcgtcggcagccgctcaaatcgtcattggagccgcgcaagataccctctaagaatttgtcgt

SEQ ID NO: 13435 - DNA, 582 bp, Triticum aestivum
  unsure (1)..(582): unsure at all n locations
  Clone ID: PAT_TA_13435
agataatgtttcttcttggtggtctcttgcttcttacagtaacaaacacaggcatgcaggcagccaaacaaaagcggctgctccaggatctcatgacaccacaatccacaggaggttctctctctttcaactaactgcaaacaacaagggacagatatccatctaccatgccattccattccattccatccatcatccctagtaaccctagaagctcagctacagatttctgccactcaccagcaccaacctctactagaccaccactctgatcactgaccagctctggctgaatctggttatcatctggttatcaccttaccttacctctcgtctgttgaacggtctcatgggcttgttcacttgggccccttcttccacagcccgctcatcctccgcagcacgccgctgttgcgccgcttcggggactcctcgtccgagaacggcgaccccatcagcttcccgccgatggacccgttgtactccgtgtcgagcgacccggtcctctccaccatccggccgccattgttgnnnnnnngnnnnnnnnnnnnnnnnnnnnnnnnnncnnnnnnnnacnnnnnn

SEQ ID NO: 13436 - DNA, 1216 bp, Triticum aestivum
  unsure (1)..(1216): unsure at all n locations
  Clone ID: PAT_TA_13436
gccggaaacgccgcccagcggaaacgtcgcctcttctccaccgccggcccacaaaatcccaaggcctctccctccgtcctctctcctcgcttcccttctccttctccgaccgacccacctccatggccctggactccgtcccttcctaccccagcgacctgggatccagcggcagggcaaccaggacccagcaaagaatccggaaggaggagcggacgtggacggcggacacctacgcgccgtacgacgacgggcaccagtggaggaagtacggcgagaagaagctctccaactccaacttcccgaggttctactacagatgtacctacaagactgacctgaagtgccctgcgacaaaacaagtccagcagaaggacatgagcgacccaccattgttcacggtcacttacttcaaccatcacagctgcaacaccacctcgaggcccatcggcagcgccccagacaccactgagcagtcgtcctcgaggagggcggtgtccatctgcttcgggtcgcatgccaccggcgagcagccgacattcctaacgtcgccgggcacactgcagtcaccagcgagcacaaccaaccaacagaacgacagaggcgcttacggtcaccagtttcagtggacagacacatcaccgtcggcaggcgatgccccagtcaagatggagaccgacagtctcgccggaacaggcgcttcgtctggcgctgctagcggccatgctctgtcgaggacactgctgccgatcggccctgtcgagatgcatcggctggggagctccttggtccttgttgcaggtcgagtctgagtagcgacgactgctgttctgaagttctgaaggatccacatcgagagattactgccgctgctgccaccgctgttcttttgcttcctttgcattcagattcgagccagatttgtgtgcttggatgatgtaaagaactagactgaagtttatttatttatctagtagtacatcaccttgaaaaagaaaggtaatgtttcccatttggaagtagtttggctagccgatcggtcacgtttcccagttggaagtagtttggcttccccgttcggtcaataatgaagtactgcaagctttcagattccctggaaaacatccagggcatcaacgcccggcgatccggaagctgggcaaanagggcnttttaacncatctcggggctntctacaagaaaccncgggtcccaa

SEQ ID NO: 13437 - DNA, 441 bp, Triticum aestivum
  Clone ID: PAT_TA_13437
ttttttttttttttttatgcagaaacatcagttactactaagtaacaaataccatagcaggtagcaataatccttacaagaacatgagggctaaaatcatgaatagatatgatgcaagggctttagacttaaactttaacataacacaggtctgaagatgggaatgaggatttagtatcactcccacaagcatgaagtaaagtcattgaggcttgggtatcttaaggagagggcgccttcgggggctcaccccaacagacggagagatcgcagagggcgccttcgggtgctcaccccaacagacggagagatcgcagagggcgccttcgggtgctcaccccaacagacggagagatcgcagaggtcgccttcgggtgctcaccccaacagacggagagatcgcagaggtcgccttcgggtgctcaccccaacagacggaga

SEQ ID NO: 13438 - DNA, 1008 bp, Triticum aestivum
  Clone ID: PAT_TA_13438
tttttttttttttttttttttttggcttgggaagcatcgagcaaatgtatcgatttttttttctttccaattcagaaacctatcaagatagcttcatactcattttagccaagataagaaaatctttgaacatcatacaccagaaactctctcctccgtcacctgagatacggtgccggcgagaacaccgcgaccgcgctatggagccccgggttcggagcgctggccgctctggctcccccggcgacgctcgttctgtccacgaactggtggtggtggagcggcatggagctggtgtcgagcaggtgcagcacggccaccgtgagcacggagcaggcgagcatggccaccgggccgaacacccacatgagcagcgccgtggcgaagtagagcgcccggagccccagcgcccagaagttgccgcccaggatcaccgcgcgctgcacgtggctcgccggcgcgtccaacccccagcgcggacatgaggaagctggcgtgcacgtagtgccccgcggactggatgaagcaggcgaaggaggccaggaagcagacgaggagcgacgtgaacttggccgacgcccatccccgtcgtcgccggctggctggcgccgccgtcgccgccggccgtgagcggcgccgagggcgaggcgttgctgctcacccacgcgccgatcagcgagcccagcgcgatgcagagcgacgccagcgtggtggacgccgagatgctgtcggagatcacgctcagcgccagggccgcctcctccggcgccgtcgtctgcgggcaggcatgaaccgcggctatcagccagaagaaccagcaccaggcgagcttgttgtggttctcgtagccgatgaccgtggtgtgcggatggcgaaggatgcggtagaggaggaggaggtggtagccgagcatgatcgcaagcccacaagggaccagcaccaagtccaaggatcccttgtgaatcatctccatcgcctagcggtcagcatgtgtacgcctcgtgccga

SEQ ID NO: 13439 - DNA, 1309 bp, Triticum aestivum
  Clone ID: PAT_TA_13439
tcatcgcatagtgggcatcatgcgcgcgcgagacatagtgattacttggcgttcctatatcgtggcaaagggctatttgatcgctgtataaatgctcttcatagactaactgtggttgaaaaaattgaaaatcctctagggtctgtctagttatgatcgggttacaaacctgctatgattactatggctggcctgtcctcacgcacgttaaaaatatcgaagcgtcttctacattattgattgtgtgatgatcgtgcgacggggaaaatagccgccccccggcccgggccgggctcgcggcggcgtcgccccgacgcgcatgctctggtcgcttctgccctgcggccggttctccgcgtccaggtcactccgccgcgccctgcattcgcgtcctcccccgagtcctccttgctgcccctcggtgcgctctctgatgatgggagaatgggggaagatataaatgccttgagtgaataaataaatggacgattcatggggcttcactaatggatagcatcacactgtcgcctgaaattgctttagtgtatacacccagggcgcctacatgctcatgttagagttaatggaggatgaagtgtgaccgtactatctccttgtgtctacaacgacgtgtgccagtactgtctccttgaccggctccttaggctctccctgtgcggtagcggctcaatctccgcggtgccgtcgaggaggggctggggcggccgtgtctggtgcgctctcgctactcatcgaccttgctgttactacctcatccttgaagccatgggtggcctctaattttccctttggagtgttgaatgcaaactgcaaaagtagagctggttggctagctgttgatttgatcgggggatagcatatgaagtgagtaaacagaaagaaagtgagtaaacagaaagaaagtgagcatccaagcaggaactgcaaatgctctattttagtcaaagcatgggaatgtgcacaagggaaagtcacctcttcatccgagcaagaatgtcgagggaacagaaatggtcgtggtgaaagtcgatttggtgcatcaaggattggtgcacaagagaaaggcaagagtaaatgacgcaatcgtggtgcgcgtgtgaagtctagtagcgagcagtccaaagttggggaagttgtcttagcttgtctaaaggttgatgtcccgggcaagacgcagtacctcatgtttgtctctttttgggacatgctgcaacacatgggcaagttggagattggagaagtcgattgggggcttgaggcatgagaggataccatgagaagggcagtc

SEQ ID NO: 13440 - DNA, 384 bp, Triticum aestivum
  Clone ID: PAT_TA_13440
ttttttttttttttttttttcaaaccttagcccctttgaagacctttcactttgattcttcttgtctacctaggttaaaatactggttctacccacttcaagatcaaatgcacaagtcctccttacgtaaatgccaatacattatgtgcaggtgcaggcactagctagacacctccaagctgtgtaaagttctacttgggaggctatatatgcctagctatgacatatgcatggttctctacacaacacacaccaccatcctattcctgcctcgcttcctcttctcttctctccactgcccaacttttgccatagacaaggaagaacctctaggtagctttcctccagagcagcaatggccatgcactctctctcccaggggca

SEQ ID NO: 13441 - DNA, 545 bp, Triticum aestivum
  Clone ID: PAT_TA_13441
ttttttttttttgggaggaaggttcactcttggcaggtacgtccccagcaatcgctcgtttcccttccttcccgggttgccatacgttcattcggaaggaggctcccaatctggcgttccccaaatattggagtcctattatttattattacataaactttgtaaaacaaactaatccctttcaatctctagataaccgtttcatggtgagtcctcttgattcaccattttcaaagaagaaaaaaggagacaataacaggtcgaaaacaggtcctggcggtactacaacatcgttctactcttccttgatgccgggtgcccttattcttcataacgcccttattttcaacatcgctctggccaaacaactcttcatattgtccttgttcttcgtatgaaagttctcttaggacttgcaggatcattcttgagcacagggaatgtgggtggccatgtcatcataaaaggataaatccgttctaaagttcggtcatcttctgtcacctcatacactttacgcagctccctgtgtttaatatccaagt

SEQ ID NO: 13442 - DNA, 881 bp, Triticum aestivum
  Clone ID: PAT_TA_13442
ttttttttttttttttttttttgactttcataagcaagtcacatacttgcccatgattgttcaagtacattactaaataaatcattgaacatgggtagcatcttgggcatattccaaacacattcttcatcgacccttttttaaataggggagggaaactatgctggattgaatccagctttggtcagttcatttcttgtatgcagattgattgatgattcagtccgatccatatctgcattggctgagactttgacgatctgttggttttaattcatctcagctttgaaagaaatttctgagggtttgccctgcttgcacctagttatcatctgcatgcatacatgtcaataaaaatatcagaaagaccagcagcacttcattgtccctttcttttatttgactttattttgaaattatcagctagctaggcttgatcttggctcatccaaaagaaggaattaagaatttgtttcatctgttggagtatgtaacaaccaaggaaaatcacatagcttcataactggatgcatatcctgacagatttactagatgtgcatcatcagtgcatcttgtccttgcgtatcggcgtgagctgaattgggcagccattctttagcctcggaaacattgcccatttctcaaggcttgtatcgtggtctgccatttcccatctgaaatttgtgacaaggcgatgaaggaatattagcatcataatcttggcaaggttcatccccaggcatgttctgctgcctgctccaaatgccaagaagctgtatggcttcatatcatcattgaacctggaaggatcaaacactgtcggactgtcatagatggttggatcatagtgtatggatctcgcatcgacatttacgagccag

SEQ ID NO: 13443 - DNA, 705 bp, Triticum aestivum
  unsure (1)..(705): unsure at all n locations
  Clone ID: PAT_TA_13443
ttttttttttttttattttttttttttttttttaccaaccggtgtggcactggctgccccccttcttgcttttgcatttcaaaatttgtatttaccacaacagatgtaacagatttagttatcctatcaccatgatagtagtccattaacgttcacatcacacgcacgacatgtgcattctacaaccacttttggtcctaattgctaagtacaacagtacaccctggaacaacttttcccgctggcctgtcgcatggtgttcttctgatggccagtgacaccacacttgctgcagttttgctcctttcctcctgaacttttgnggaacgtctcctcccctggcggggcaagttgttccgtttggtggccttgaattttgcaagatgctacagaatctacccttactcattccttccctaaggggcctggcctcttgcgtttgtcggcccccctgctctctcccttgnanggacccccaagcaacaaaaatggtatccccggaacaaaactatcactcgcaacctggtntttcaacnaatgcctgctctgcacgaacatcccgtccaaccatctnccggcgaagngcacactcanacttatgagatccacatgtactcaacggaacncaacgtaatcaagcngaaaaancatngcaaataggggtgacaacgttcccggagtnatgccngatatccacactgnccn

SEQ ID NO: 13444 - DNA, 857 bp, Triticum aestivum
  Clone ID: PAT_TA_13444
gagaaagcgagcgtcttcctcctccgtccgtccccagactccggcggcggcccattccgcggcgtgcgggcggcgcatggcggggagcgaggacggatcggcagttgaggggctgaggaggtgaagagacaaggaaagaagaaggaagaaagaaggcgataccatggtgatagcttccggagtgattgacaggggacacctgtcctcgttcggcggcccaccgccagactcgtcgtcgtcgtccttcttctccgaagatcttgtccccacacgtccgatgggatggcccttcatgaactgacagtttccattaatggcagggagcaagccagcttttgcttctccacttgagaagatccatccgatgggggcgaatcctgaaggcggtctggaacagacaggaggccaagtcttcaagggcctagatgcccttcgcgtcagtaaagcgatggggcaaggaaatgcttcaagttcgccgtcggtatcctggggtgatatgctcacgacccctggatctagatttggcttgtctgctagagaggcgggtattgctgaaacagccagtggcaactcgagaataatggccgctggtgtttgtggccagtctgctgatacacttagcttcatctgcgagggagatgaagctctagggtccatgaaggaagttgaagctcaaactattggagatcttctaccaaccgatgatgatttgatatcgggtgttatcgatggctttgaactctctggcctgtctatcaaccaggatgacgccgatgaagatatatttggcactggcggagggttggagcttgagaatgatgattccatttccattaaaggtgcaagaaatctgggag

SEQ ID NO: 13445 - DNA, 729 bp, Triticum aestivum
  Clone ID: PAT_TA_13445
ttttttttttttttttttttgaagaatgaggccacttgataactggccatttacaatgttcacctgacctacacaagtgcagtactgctcactctgaatcagaaccaaaaggacaaaaagaaaaggttcagatatagtagatctggcctacgttgagaaggctttcatgaggaacattgaatatcacgctgtgttctctacagaccttcctgaggaacgcatacaggtgatccacaacaatcctcttgatgatccctgaatccctgcgcgcgcacacaatggtgttgccgaggatgtgcacgacgccggcgtccttgcagctgttgaggaactccagttcgtcaccgtatgtttggctggaataccttgttacgctgttgttccctgttagcggcgacttggccagcacaatggaggaatcatgtgatgagtagctcaggtcgcttccagccttttcgctcatcagcagtgcattagcgggtctctcgaccttgtgctccgtcatggtgaagtcctcagaatcagaatagccatccatcatgctctcaagtctgacaaagatcaggagcctgtcaagaagcatcttctcaaagtcgtcgtgcttcttttggatgtccttgtacccatacctcgtgacacagcggaacatgtgaaagttctttggcccgatcctcttcatgacaaaccgttcttcaactgggacagtgtacctcggccgcgaccacgcta

SEQ ID NO: 13446 - DNA, 659 bp, Triticum aestivum
  Clone ID: PAT_TA_13446
ttttttttttttttttttacatctacaggaagccatctgtagaaagcacatcattatctttaaccagcaagttcaaaaacaaaaattaaggacagcagcagcagctaaactctcaaagaaatctctctcccactctagttgaactgcagcagcagcgcactaacatcagttagacggcgaggcaggacgcaacaacagcagctagcagcttcctgcttttgtaggctaggtcatgacggcggccccaagatggaggaggtgtcgggccatggcagtcaaaaatattgaaaccacgtgatgtagctaggtgttacaagaaaagaaatagtaagcacatcaagttttagcgcctctttcaacacacagatgtgcaacaaaattggcattccttcttatatagatgaacttgaacccctgaaacttgtaagatatgaacgcatttctcggaagccatcaaccccctcagagaaagccctggaatcctctgacatcgtgcattatcaaacttggtcttcagtctcaataatattatttcagaatcctttttcaatcgccatcaacatggttgtccctttgttcttcttgaactcctcatttttctgattatgaacttgcggctgttcttttttttgcagggtgcagtgcaactgccggtgctc

SEQ ID NO: 13447 - DNA, 502 bp, Triticum aestivum
  Clone ID: PAT_TA_13447
ttttttttttttttttttttttggaagaaccgatacgtatatagtactagtatattatgggagtatacattaccgccggtaaccaatcatacgaagaacctgccactgaggcaatagcaggggagaccagagaacatcgtcgaattcatacatgcatcggcgacggcgagcaggaacggcgacggctcatcgtaggttgtgcagcgggttggacccggacggcgccatcctcttgtcgtcgccgaacccgcctacgccggcgccattccggttcctcgcggcggccagagcagcgccctccgacgtcttgacgtgcgccgagccggcgacgacgctcgctctcctggcggcggctgctggccgtgccgacgagggcggcggcgcgacgacgtggccgaggaaggagccggccctgagcgccagcgggacgagcgagagcagcgcgaggatcttgacgcagcacctgacgacgccgccgcccatgcctcctggttcactggga

SEQ ID NO: 13448 - DNA, 734 bp, Triticum aestivum
  Clone ID: PAT_TA_13448
tttttttttttttttttttttttttttgatcacaggaacttatggatgttttttcagcaagtcaactagcaacttacatagacaccaagtagctagttaacaaaattcatgcattagctattttaaaactacagcaaaaagcatggagacaaggcaacacaacaagttaaagatcatgtttttcctagttaacgtcctgtatcaactactaaaactctagaaaaaatatgaatatatttagaggttacaaaccagtgtaggcaagccctccgacacttccatgtacgtgatttctacatgatatcctccctcttctgactctatatcttcaacacactgctctttgccttttgcatttcttttgctcagggtcgcatccttcgtcatccatgtcagtgtctgtgcacttcgctcccatcatgttgttgaaacggaccctttcattgcatggcacaacccctgcgtttttgaagtgctcccatacatacatgctgaaaccgcttccctcgctctcatagttgcaatggttcaaacaaactccacaagccatctcttttgctcaatactattccagatcttctcggccaaagatcctaattaatctctaagtactccactagcagcatcgcccaggctctcactggccgttcaagagcaaaggcgatttctttcgttccaccgcagagatctttggctttttgacaaagaaagaacagagagatagacgaagaaac

SEQ ID NO: 13449 - DNA, 664 bp, Triticum aestivum
  Clone ID: PAT_TA_13449
cgtccgcggacgcgtgggcggacgcgtgggcggacgcgtgggcggacgcgtgggcggacgcgtgggcattggactgaattgttgaaaaaacctacgaaacgtggccacacattactatgcaagaagcttagtaagttgtcacttgaaaatcttgagcagctatacctcccgacactatttgacaaccattggatattggttgtcattaacttcacacaaaatacaattgaaatttatgactctaacaagaaggtaaaagaaggtgaagacccacacaaggttatcttggacaacatgtgtaccaatctgcaagaagcattgactgctattctcaatcagagtgctatcaattttatccatttcccaaggaagtattgctatgctggaaagcaaacaaacaatgatgactgcggtttctgggttattaaagtcctattgtgtcacaatggcaaagggctggtcggaaattacaagtgggaaatggatgtcttccggaaggaaatatgttacatactggtttatcaccgcttcaatgatctcaacccaagaaggcctgcgatccagaagatagcatcctccgtccagacaatagtcgaatgattcctcaacggcgtcgtttcctgtacttaccatccgcgcctggttgcaacttatttcatatgat

SEQ ID NO: 13450 - DNA, 943 bp, Triticum aestivum
  Clone ID: PAT_TA_13450
cgtccgcctagatcggcctcgcctctgcagcaaccgatctctaggtcgccgccgatgccggacctctccccgtccaagggggtgctctcatgcctgtacagcaggtgcgacagtgcctctcagtccaaaggcacgcataagcttctcttcgacctcatcctcgactactacgacaaggcggtcgatcggctgcccgttaaggagatgccgccggacgttgacctcctccgcctcgtagaaggctccggcttctgtttcggcctcctcgatcccgtctccaacattatcttcaacaccatctccgtcctaccgcacgacatcggagcaaccccaaagccatcttctccatgccgaaagaagtccaagaggactctccccaaaatcactcgaaaacctaagtgggacgagattgcatcgaaatcttacaaaggtctcattgatttcatgctgagctactttggatgcctcagcaaggaccaggccgcccgctacctcttctggtccagcgccgatgttagccttgccgtcatgcttgtcgagtatgaatttggcacagataatcctttgctcccctaccctggctccgaaaggacgcaggctgccctcaaaatggcggcgctcggagcacgtcacactgcacccgacagctttgtgcggttcgtgacgtcccagtaccccaggaacattctgctcaactcggcccgtgttctggcggatagtggccggaagctccacattgccgatgtcaaaggcattgtcgatctggtgcactctctggacacgccctgctacgatgccaaagtagccctgctgccgaacggaagaactgtctgctacgttcagaagatcacctttcatggagaagtccttgcagcagaagcagtcaccagcaagatttctgacctcggagatggctacagcagcagcagcaccaccaccacac

SEQ ID NO: 13451 - DNA, 569 bp, Triticum aestivum
  unsure (1)..(569): unsure at all n locations
  Clone ID: PAT_TA_13451
ttttttttttttaagaattagaatccgccgaatctccgccccccctcctttgattcaaagaagccctttctgtccatttcttagcaatacacacatctcatttattcctgttcccaggtatacatcggtgttgtctgcaccaacacaacaccaactctccttcacaaactacaaattcataaccggaaatcagaaatagcagtttttgcatctaaccctatggagaaataatgcttcatgtaatctctcacaagagtttccctatataatggtttgttctcttcagtcaacagctccttgattggaccatacatcctcgtcgaggctggatggaaatgcgtgctngaaggaagaacgcgatcgagagccctaggggcagcgttcttcgccaacaccctatgctccacactcctgaacccgtcattggagatcagctgtaagagatcgccgatgttcacaatgaatgctccgggtgtgggcgtgacatctacccaccggtcctcgttgaaaatctgtagaccgccgacttcatcttggaggagtatggtcaggaagccggcgtctgaatg

SEQ ID NO: 13452 - DNA, 892 bp, Triticum aestivum
  Clone ID: PAT_TA_13452
cgtccgcactcctatgctcggtcgacgtgaagcagatatcagaaataaaatggttgctcctgcgaatgcaaacctcgaaggtttgatgccaatagatgatcttgatactacaggcgggtcgaagcttgagaagtatgcgcgcgacactctggacccgtctttatcatggaaggacgtggagtggctgaaatccataaccagcctgcccattctactgaagggcatcgtgaccgccgaggacgggggggggggcaaacagccaggaaagcagtggaggccggggcagcaggcatcatcgtgtccaaccacggcgctcggcagctcgactacgcgccggccaccatatccgccctcgaagaggtagtgaaggcggtggtgggggcggtcccggtgctggtggacggcggagtccggcgggggaccgacctgctcaaggcgctggcgctgggtgcgcgggcagtcatggtggggaggccggtgctgtacgggctggcggcgaggggccaggcaggggcgaagcacgtgatcgagatgctcaacagggagctggagctggccatggcgctctgcggctgccggagcgtcgccgagatcacccgggaccgcgtccagaccgagggcgaccggttcaggtcgctgctctgatgagggatgcgcggcggcagtcgcagcacatactgcatactgtgaaggacacactgcatgtgccagcgccctcattggtcattcgagatgctggtagtaattagctaaggatctgtaaaatggaaaattggagtaatgctttgtgcagccctgagaacaaactttgcattgttttgctgagagaaggattttatccaaacacccagcatatataagttggattttatccaaagaatcgtatgaggtt

SEQ ID NO: 13453 - DNA, 614 bp, Triticum aestivum
  Clone ID: PAT_TA_13453
ttttttttttttttttttttaacaaccggctactgattcacttgattcgacattgtttcagtgtatccatcgattacagtatgtccaaagaaagtgattgctgggtttgccgtgtaggccatgctcggccagattgtggtctgtggagctgattcctcgaaagaccgcgcgcaagaccttcctacaatctgctccacacaagcatgcattgttgaccattttttttcctccaaaactgaacgtctgaatgaagaccgacagtcgtgagtcctgaactttgtctggctctggcgcacatccgatttgtagatcgataaccttttttcctcgggtaccagatgcaggattgtagatcgataacttttcattaacgcttcaggtggccatgacgaggatgatgattgaccgcaacctcccgtccgaactccgaagtcctcccctctctggagccgattgagagaggtgaggtcgggcaggcgaacggcgtcgacctgaggctgctcagcttgcataatcggcggcggtggcgggggaactcgcagatgcggcggagcgtcaagggcgacaggggcggcggcgtcaaggcccgcggcgcaggagaagagagaaggtga

SEQ ID NO: 13454 - DNA, 823 bp, Triticum aestivum
  Clone ID: PAT_TA_13454
tttttttttttttttttacagcaaaatttgtttataatgcacaataactatggagtaataaatccatccaaaggtgtctaatagcggtgatcacacataatttacaataaagataaggtattgatccaaaacgcctctgcagaggcatcacgcctatatacgataatattactcgagaaacaaaaagaacttcatctttgtatgcggttgaaacatcagtcgcattcaccacagttcaagctcacatgagcactattgttgtcctcgtgataaagcagaaggatttagcttgtctgctgagtgggtttagagcgacgaatgtgaatgatgttaagccggcccacagccccgctgccagatcactgcagttccgtcactcgacaccataaccgacggtggtgtcctctactggtttgattcaaactatcaatggtatgcctcctccttccctgcataaacatctgggaataaattcatctacagggtcaaaaatagatgatggattaacgcgtattcagaacttggaaccaaggaaatttttctacaactgtggagtaagcaggacaatggctgcaagtaaaatagaaatatataaaaaattggaagtggcattaaccttgtgggacaaaactcacgcttgagtaacaagagcatacgaaggtgagctaaaaaaataacaatcattcaacagtagccaggaggaccaaggactaactaatggacgaagagaattatgtagccgaactttactacaaataggtagctagataagctgttataaaaaacgaccataattagtagctgaaggattgtttcttgattc

SEQ ID NO: 13455 - DNA, 642 bp, Triticum aestivum
  Clone ID: PAT_TA_13455
ttttttttttttttttttaaaaaatcaactaagataatgtcatgttagatgtgaggtattatctcacactagtaaaatgcccgtgcgttgctacgagctacaagtgaatcaaacaaataattaagattgtctccaacggtgaagctcatatatccttcccatgtccgaaggtgttttgacatcaaatgggtgcccagccggcaccccaaaattaaaccagctagacagttcagccttccccaaatacatatcatatatggaggagaaatatggttgtccggactattcatcatgttatctccaacaaaaagagggcccaacacaaaaaaaatccacctcacgacacaccctttccttttcctgtcagaccattcccttcctgctcgattttcatcgtagcgtgacatttctcgatggagccctctcattttaaactggatgacgcccacctcgccttcgctagcaccctctctccttcataccgaacttctccatggaccatccaggagaccctgcaaaccgcccaactctccacccacatcccttcctctgtgttcgtgttgatccgccgaaaggaggcggggatgacggcgcgccggaaggaggcgggagtggtggcgcaccggtaggaggcagcggcga

SEQ ID NO: 13456 - DNA, 766 bp, Triticum aestivum
  Clone ID: PAT_TA_13456
cgtccgaaaaaaatgaatgtaattagaaaatgcatgcagggatcaaatatgcaaattgtacattggtgacctatggaaaatatcttaactcaaatggatgaactgattactgagatcaactcttacttaccattcaaatttcagaattaatggaaatcacttgaatttataaggattcacacacatatcatcttctaggaaaaatctacacataatacaatagcttttattacttaatgactacaaaaataatctattatgctcatttttcaacgataagagttgcatatagcatcttgtatatcataaaaattctgcaaacaatagtagttgctgttactaacacattgtataatatgtgatctgttatatcctgaattcaggacctttacgcattagtcctaaggatagcttgtatacataaatttatcctttttcaaactgtaaatctaatatgcacaatgatctgctaaaaataccattggatatacatgtctttatacattttgtcaaacacttggcaagcatgtccaaattttaactaactgttagacagtcgggggcgacgcggccgctaaatctagaaagaggatagggccatgtttcaaacaattttgttattacgccaagtaatacctgcatctgggggtcgatttggttctctttatgccacttgtaagtcacatccttggtggtcatcttactatgcttgtagaccatgctgatctatcctcttgcagacagtcctacatgccttgatcgacct

SEQ ID NO: 13457 - DNA, 559 bp, Triticum aestivum
  Clone ID: PAT_TA_13457
ttttttttttttcattttattttatttttgaaaataattgaagtatatcttgcacatcaatcttcagcccagctttggttgtctctttgttctctcttttcttgcacacatatcttttacatgttccttgtgttcagtacatatttacccactgtccgtgcatgttacatatgcattgttgctcacttcctgaagagcttctgggagacgaggaagccgatggagaaggcggcgacgccgatggcgaccacctccttgttcttcctcgccgtctccaccgcgttgtccgcccacttcatgtccgtcagccccttgagctccccggcgatgcgctccttccaggccgtgcatgtcgacgccaccgccttcttcgccttttccgcttttccttctatggccgtcgccgcggcagcagccttggccctctcttccttgccgcgccgcctcgtcgtctccaccaggctctccggatcaaccgccgccttggccttctcgccgttggcaacctctgccttcggcgctggcttctccggtgtcgccgtggctgctgctggctggg

SEQ ID NO: 13458 - DNA, 503 bp, Triticum aestivum
  Clone ID: PAT_TA_13458
ttttttttttttttttttttttttttatccccatttcaaacgttcatagctttagtattgttattactagtagggttcaaagtatggcaaaagctttcctacaaaagaaaaaaaatctttcccaaaagctagcgagaactacacctagtctggctcgggaatggctatagatcaatcgactgacacaacaaagaggtcagtcgattggtacaaatgtgatcaaaccggcaaagcagaacaaaatccactgacagaagaaagaggtcagtcagattttctttcggtttctgtttcagtttagcccaaccgaaaacaacaagctgaggcctttctgtttctgtcccgggcctgacccggtaagctaaagatcctttccctgcctgttttctgtatttaccccagaaaaagaaaacgggcctggacccggtaagctaaataagtaacacgtcactaggtcttcctcctcccgactcccacacagccgccagggaggggaaccatac

SEQ ID NO: 13459 - DNA, 925 bp, Triticum aestivum
  Clone ID: PAT_TA_13459
ttttttttttttttttttttttttaaaagctgaacgaaaaaagaagtccattctgacaaatataacttgttctgcgtacagagtagaataaacctgcgagtttcctcccggcgtcaactaaagacattttttctctatcctcaggtcacctatgaaacgcaatacccatcctagacgacaaatctacatactagactaaaatacacgtaatgcggaaaataattaacactacatgccaaaatctgaatggtgtccaagaaacgtcaggtgcacagaacagaaccggaagctggcctgcatcgtccaccgctcgctcagggctgcctgatggcggtagccaggtcgaggcagttgctgacgaggcgcatgatgtggcgctgcgcgccgcgtatcggcgacttgagctccgggcgctcgccgaagatgtcccggcagtcggtggagtaggtgctggccgccgacagctccgacatgagatcgtcgcggctgccccccttcttgagcgtcgtccgcgacttccccagcgagtccgtcagcgacgcgtagctgtccctgcacgactgcagcgacgacatcatcgggatggtgttgcccaggcctgccctcatcgcctcgtcgagccgcatctccgccatggccgacttggccgccgtcacccgcagggccgtgtccaggagctgctgcggggtcgtcaccccgggcagcgtcgccagcgtgctacacagcgtcctgtagtgcacctcttgacatatgccgaagcattcttcgcacctctggatgccgatcaggcggcggccactgtcgccgaaggggaggaagatagggtggatcgcacgggcaccgatggagctcgaggacgccgccctgtccgcggctcagatcagcgcgtggtggccgggttgcatcggcgggtgctcgttcgagc

SEQ ID NO: 13460 - DNA, 949 bp, Triticum aestivum
  unsure (1)..(949): unsure at all n locations
  Clone ID: PAT_TA_13460
ttttttttttttttttttttttttacagctgcaaactagcactacaaattagccaggcttatattgatcaaatcacatgttattgatccatattaattttcatccacgtggtcatccctaactggggaaaatacaacaattaagtactcactgatattttgttcagcttcacacgggtgatacaaaagatagttatacaacaaactgcacggggcgtcgacagattgagttaaactcggatatctgacagtcctaatatctaacattaccaatcgtaattaaggctaccggatccaactattgacatgaaatccccattttgtgtctgaaacaccttgtggatccaactattgacatgatatcccagctttgttcctcatttgctgaacttgtacgtgctgggctaaggagaagcatccaaagcgccattgttctgctcctcaacaccattgtgatcctctaatctattgttaacagcaccctcctttgcatcctcctcctcaagactcgctatctccatttgtgccttttccaaaatctctctccgcctcacctcaaggtccctttgcatatccttccgcatacgtttcaactccgccatgtgctgcctcctgctactctccactctctcataaacctcnttaagcctatgaattgcctctgtgagaatcgcaaattcctccccctgcactgcgccagcttcatatgtctgttttcccctcaattgcgcatctggcactgaattccctggtaccactttgctacatccagcgagcacaagctccccgacgtccaccccccacgaacggcgtggcactggatgcgtgtcacggcgccgcgtcacgagaggagttagtggcggcagtagtggcggcggcgtcggcgtcggcgtcggtgggcacatgacggacagcatcttgtcgaagcggacgcgtgggcggacgcgtgg

SEQ ID NO: 13461 - DNA, 908 bp, Triticum aestivum
  Clone ID: PAT_TA_13461
ttttttttttttttttttttttttgggaaatgacgacttgttattttacttgggtggcataataatttacagacatcacagcgggtggggctagctcagctcagcgcatgcatgagcatgatgccatgatcgactatgcatgtctagctgacgtttatggcagcgccggtgctgggggactcctcgtcctggggcgcccacgtccacaccttcagctcgcccgcgccatctccagtcaagagaagcctcgatggcccctgggcgagttcgatggtcttcacttctgttttggaggagagcgtgccaatatcctcgaacgatggcaggcccaacatgcggacgcagttgctcttgtggagggagcagagcagaaccggcgtctttcccggacgatgcatgccaaagagggtgcgtactcccattgcccaagaaccagagcaaagcagaaagtctatcaagggcactagcatcatgcgatacatctcaacagagcttacaaacgtacactgagaaacatgcttccaggaagggaaatattgagaaagccaacaaccggacaatatataaaaatatcaacagcgatattcaggctttcgaagaatgaattgctctggtgctgcctctagtaactgttgtatgaaggttcctaaccattctgacgttgccgatacacttttatttgatactcccatactaactcttcagtcagggaaacagattagctcaacagactgatgacgttgctgatacatgtctatttgatactcccatcgtaactcttcagggaaacagatgagctcagcagactgatagcagccattacgtgccaggcatgtaacaaaggccatactgtgcgaactataatgcttgaccgaatgcagatggagtcacaattgccagaaatggag

SEQ ID NO: 13462 - DNA, 462 bp, Triticum aestivum
  Clone ID: PAT_TA_13462
tttttttttttatttttttttttttttcttttttgttttttttcattgccaactggcaaggagaggatcattatgatagaagtctatacaaatgttgagcattgcaactttccaaaatactacaacgaaaaggtatatcataaagtttaaaagcatgatataccattctacatcggtacataagttctataaaatatagccaaatagttcatacttgcaagtgtaaaaacaggtgttacagcagctggaaacaatgctatagaaacatcaataacggtacggcctttgtctttgttagtcaatcaacaaacatgtatggtatcttgtagatgatcatcactgagaactcctacttcctctctccaagtgaaaaagggcatgttctgaggtgaagctaatgcagatagtagtggccaatacttgacaggaaaggctgatagcgtcctcaggcttccctcgtgc

SEQ ID NO: 13463 - DNA, 601 bp, Triticum aestivum
  Clone ID: PAT_TA_13463
ttttttttttttttttttgtggggttctgcctttgaaatggtgtcaactcaacagaccgagttcctcttacaatttcctcatcttcccatatatttgttcgggaaatgctagaataagttctgagactgaataagtatgaaactgaacatgtagtgcgtgagaggctgtgctagtcctcattggttctgggcttcaacaggacctgatgctgagctccctgatgaagcggacgagccgctccaactcggacgacgacggccccgcctgcgcgacatccagcctcaactgctgcgccatagcttgggccacccccctgatcttgtcggacaccatggcctccctcaccgtcctctcaacgacgcctctctcgcagacgcccttcatgtccagccccgtcctccacacggcgcccacaaagcggctgttgatctgctggtcagagaagaagggccagcacaccatcggcacgccctccaaggcgcactccagtgtcgagttccagccggcgtgtgtcaggaagcagccaccgcccggtgccgcagcacgttccgctgaggagccactcaagaatgtgcgccttgctgccctccactgccccga

SEQ ID NO: 13464 - DNA, 639 bp, Triticum aestivum
  unsure (1)..(639): unsure at all n locations
  Clone ID: PAT_TA_13464
ggtccggcggttggcatctcgccaagtctagggttagtccgagccgcagtcaagcgggcccggacggatcgcagccgccctcgaagaaggacaaggtgaggccctcgctccgtcgcttgggtgttgccgtctttctctcctagcgtactaggcagggtctgatgtgccggactgattgattggcttgattttcaggggctcgttaacctccccaactctatccaaggcagctgattttcaggatccgttgttgatagcagaacaattcgagtggaagagcgtaagtttacagggatttggaaagacggacggggtgggtgattttctgtggcgtgagatgatcctttttgcaggctgcaatcccctcctccaccagcaataacgacagagagatggggatttcccatgcggtcgaacatactctttaattatagttcctcctctccaggttggagcatctcctcaacgcggtcggggcgctcctttgttgaccattctcattaacccgagagagatgaatagagagagagcagagcccggtatacagcagcggcgctctcccggcctccctggactcggagggtcctgtcctcccggtcagatagtgcgcgcgctgtncnnnnctccctnnannncnna

SEQ ID NO: 13465 - DNA, 902 bp, Triticum aestivum
  Clone ID: PAT_TA_13465
ttttttttttttttttttttttttttgggggggggcgggttggctagcgccaaaaccaacaaggggttcccgattacaataaattgtgtgcaaaccttgatagaattgacaacaaatgttgtatacatatggcgtgtgatcgaaagataacgacgcgcaatgacgcgtcacgacttacagaaacttgttggataaagactttgggccagataactgataacacgcagcttagtgaatcatgacctattacatcaggcacactttatatcagaaaattgctatgtgctcttataggtaagaatactctaacgaaatttatgacttacttgtatcttacaaaagcatatttgtcactcacatggaacaatagttcattgtgattaaattgaagattttatgcaggcgtcatcttcgtaatagtttgtgaggagcactaggataagctcgagataacaaaacatgtacctctattacttttaattatcaggcacctattcattgttccaccacaatgtttaaactaggtaaggaacaggttatattccacaagccatatttctatgtactcacacagacttcagtagtgtgcataattcctaaaaacacgtaaaaattaaacatatgataatatgtcatacatataagagtgttgcgactatttctgctatccaattaccgctcctagttttattctacctttccaattaaacatactgataacacacaaattaaacagatgataatatatcatacatataagagtgtgactatccaataccgctcctagttctattctacctttccaattaaacatactgataacacacatataagagtgtgctgcagcctgctcctagttcaattctactactaaacccaaaaaaacatcgcacacagaaaag

SEQ ID NO: 13466 - DNA, 531 bp, Triticum aestivum
  Clone ID: PAT_TA_13466
tttttttttttttttttgcttggaaaacgatttgcttgatgatatgcctgcgctttttacttgcagcgccgaatgggctcttcacgttacccgcggtgctaacggacgggtcttctccacctgccctccggggtggcctgcccgcagcgcgcgtcttgacgccgggggtgttccccgttacaaccttgaatcatctgggcaggttcgagttgtgtgaggatcgagtcagagcctgtcggcgaggctcgggaagcgctccagaatccaggtgactcccctgatgaccacccagcgccagctccccgggtttggtcgccggctccacgcagtcccggccatacacgatctgaatctgctgcggccgctgcgggtcgggctcgcagcggtagaagctgcagcccctgctgaacgggaacggccgccccttccactcgaggtgccaggtgacgccgacggcggaggggtcgtcgccggagatgtcgtcgatgacgaagcggaggtcggggctgacggagcccatgaactcgccga

SEQ ID NO: 13467 - DNA, 499 bp, Triticum aestivum
  Clone ID: PAT_TA_13467
ttttttttttttttttttgaaggagccaaataaatgacctcaaatacaaggagattatggaatctaaaacacaaaacactgaaaggcatgatatagaatcagacagagggagagaggccacacatactcatgaagtaatgaattcagcattcaattgttacatgaagtgctacaccaaaacaataaggacacaacgactggaaatttaagggcttcaagctgaatactcaaattgtaaagtcaccacagaaatgccactcagttccatggagatctttggctaccagttcttgacatgatggattctgagacgtgccctccatgccggcgccagggagccactcctcgacggggcgccggcgccccggctccccgtctcccgcgccggagcccggctgcgtgtcgccggctcctgtcgccatgcttgcttggccccttctcccttccatgtgtccgccgcgccaatagtcacattcctctctgctggtaccatggatct

SEQ ID NO: 13468 - DNA, 883 bp, Triticum aestivum
  Clone ID: PAT_TA_13468
cgtccgcccacgcgtccgcccacgcgtccgcggacgcgtgggcggcgacggaactgtcatcacgttcggagcaaccgtccggattctggagggacggcgtgcgagctactccggagaacggccggaggtctccgactactcgtcgaggggacccaacatagagaacgcgcagatgcagctggcggacgtcctgaaaccgaacgtgatggcgccgggccatcacatctggggagcctggagcccgacgagcggcgccctgccggaggtccagggcgagagctacgccatactgtccggcacgagcatgtccaccccacacgtcgccggggtggtggcgctgatcaagcaacggcatcccaagtggagccccgccatgatcatgtcggcgatcatgacgacggccgacgtgaccgaccgctccgggaggcccctgatggcgcgccgggacgtgggcgccgtggtggcggccacgccgttcgacatgggcgcgggcgccatcaacgcggcgcgcgcgctggacccgggcctggtgttcgacgccacgtacagggagtacctgcagttcctgtgcgcggtgccgggcgtggacgaggccgcggtgcggcgcgcggtgggggcgtcctgcccgtcgtcgcgggcgcggtggtgctcggatctgaacgcgccgagcgtgacggtggcgagcctggtggggtcgaggcgggtggaccggaaggtgtggagcgtgggcgcggagaacgagacgtacatggcgtacgtgcgcgcgcccgacggcgtggcggtgcgcgtgtcgcccgacgagttcaccgtcgcacccggcgagacggtggggcttaggatcgtgctcaacaccaccgtgccggggaacgcgttcagctttggt

SEQ ID NO: 13469 - DNA, 783 bp, Triticum aestivum
  Clone ID: PAT_TA_13469
ttttttttttttttttttcagctaccaataacattgcagtatagtgggataaggtggtttacagtacgggtgaactgaacaaaaccaaagtaacagacagcttcagtcacagggtaatccgaatttcccattacttgaccaaaaaacgaaggaccaaacgccttatttctcatcatatattagttggccacatctttcctgacgtagcttccgtatggacgtcgacgtactcagtatggcgggtcggcgaagttgccgccaggggagtagctgcaaacagccacgggtgtcgttgctgccgcggcaggtgcggcaggcgcagccgagctctcgcgtggtgttccgcaccaccaacttgtaggacccgcattccttgccgggcgcgcacgcgttggcgccgttggtcgtaccaccgccgctcgtacacccacgagccggtggcggcggcgccgtcttgtttcccgctgccccagtacctgttccgcgcgtagatcggcgggatgtactttggcggctccagcttgcagcggacgacgagctgggccgcgtaccgcttggcgtcctgccccagcgtccagttccactccaggggtgccacgccgacctcgcggcgcgcgtcgttgtgcccctgcaggaactggaacgccacgggcactctaggggccgcgacggcgacgccattgttgttggtaatgctggctgatgccggtgacggcgagaccagtgcaagcaacaagatggcgaggcagatggaaggagacatggtcacctgctgcatcggtg

SEQ ID NO: 13470 - DNA, 830 bp, Triticum aestivum
  Clone ID: PAT_TA_13470
ttttttttttttttttttttttttagaaagagaaccgagaatcttaaagtggtataaaactttgcccatgcaaaagcatcgaccaccagttactagttactacacaaaccacacaccagttcacactaattgacaagccacttctctacagttacataaaccagtctagcaacgaaagcaaacataaatttaactagtcacgaggatgagatcaaatgctgaaaagagaccaggcaactgtaacttccatccagcagtcgagcgcctccacaggcatgtaatgagtggcttttccagcatcttcagctgcaatccaaatacctgctatcgctcggccttcttccccaccagcaccacgttgtaagatagacagccccagcttcccatccttttcaacacaaataacacttcttgataacttgacaaagccatcggcatcaacaggcaatttatcacaattaagttcaagcagtgagatttggatgtctcttttcttggaggtgctagcagttagtacacctcgaaaaccatgtggccatcgccctttaaagactcgaacaaaaattgtggcctccacagaactaaaagcagtgtagtattgcatctccactgtgcaaagcttgctagtgtactcaataggaaggaagcagcccaacctgtatgagtccacaaatttgtttaaatctttatcttcagattcagtagtacccttcactttgagcttaacctccaaatgtgagttatcatgcgacatgacaacaccgcggctaggacctgtcagtgttaggtatgaatcctgctcagtgatatttggcagtcgtcctttcacg

SEQ ID NO: 13471 - DNA, 791 bp, Triticum aestivum
  Clone ID: PAT_TA_13471
ttttttttttttttttttagttcgaaacaaaaataaataggtactgatacaagtcctcacgaggactggttctcaacagcagggaagtacgatacaaaccccaagggtccttggcatggcagccgcatcagtacgaactaaagagaggtgatcaaatggctcgagaggcagccgcatcactacttttcctggttataacagaggagaagctagaacgacaaagcgacgattgggctgcgcacgacgtggtgcactgacacccagctgaagcttccctcgataaacttattcccatcactgctgctggtgctcaccgtcatgctaaacgttttcttttctccagccttggagaacaccagcatctccggggtagactcgcactgtaagagagctgggaatctccatcttcagtatgtatactgaattggctggccccacatttgtcacagttctgttcactgtgaatggtcttgtcttgagtggcaccgttatggtgggatagttcaagaatgcttctggtatcttgggaagcatcttgcaggacaacctcgggtcacgcacaatgatttccaggccctgatcaccaaggagagcacatatgtcgccggcatattcagtaatgccaaggtcatacacaaggcctggatcaatggctttactagggttgacatggccagcacccatggcatatgcggttgctcatccaagatcgggccaccagtgctgtccgtgatgtcagatgtagtgaggatggctgacttgatggcagccgcagaccagtcaggatggga

SEQ ID NO: 13472 - DNA, 935 bp, Triticum aestivum
  Clone ID: PAT_TA_13472
cccagcgtccgcggccgcgtgggctttatgctgggcagaaagagagagtgtattccagcactccagctttttagcaggaggtgcgaccatagctgctggaaggtttactgcagaaaaggagttatcaagtccatctgggcatatagtggacactacaagccgagcgcggagaaccttaccaacttcatgagctttctagaagaaaatggagttgatctgaaagaagttgaggtgcgctcatccaccaaggaagactactatgaggatccagtgcctaatatcaaagagaaccctgctgctgctgctatgatggcatccaatactccacaactgattctgccttccaacatggtagaagaagacaaagcatctgggccatcttcacagactgaagctgacgaggacgataatgtccgtgtggagcaagcgagaccaacctaccaaagaaccttatcaggtggcctgcaaagtcctagagacgccgtcgtctcgcaggatgcaattcttgagagggtgaattccaagagcaagtcaaaatcctatcagctcggtcacaggctatccctgaaatggagcactggaaatggtccaagaattgggtgtgtgaaggattatccgatagagctcagaatgcaagcgctggagatggtacaactctcaccgagggcatcgactcctccggcctcgtggaggatgccatcatgcctctcccccaccttgccaatgccgccgcttgtgccattgcaggcctccctgccccagccaagttaggcaatagctgtgtagctctgctgcttcatattagctgtgggtgctgcgaaggtcagaagtttgtgcttgctgttttacctatcttccgtgaacccgtttgtagctcagaaggatctggtgagaattgtatgcgctccaatttggttgaattgatctaacaatgt

SEQ ID NO: 13473 - DNA, 2020 bp, Triticum aestivum
  Clone ID: PAT_TA_13473
cccccccctcgagaagagcacggccatccccagcccgcctccaagtcgagaaggccacgaccattggcggtagacagtatacatggaggtggagactgcggtgcctcctccggcggccgggccggaccgtgtggagaccgcctcgcgggagccgggccacacgggggcctcctcctcgccgtcggccggcggccggaggcgaagcgaatggcgcggccaccaaggtgcagaaggtctaccggagctaccggaccaaggcgcaagctcgcccgactccgccgtcgtcgtcgagcggctctggtgcccagacgtggccttctcccccatcgtggatccacagctcccctgctggcgacgaccccgcggcatcctcgggagctccggcgagtgaaactggcgaagccctcaagggcgccgtggcacacggaggtccccccctcccaatcgccgtctcccgcaggcggataggatggggcgacgcccacggttctgatggtctacctgtgctacgggtcaaggcgaaaacccgctgactatccctcgttgtcgtcgaggggctctggtggcaagcgctcgacttcgcgcggctcaaccacagcaccgtgtacttctaccagcaccaggagccggagaccgccgcgtcgcggtggaacctcgtcagcctcaaagcgtcgaaggtggggccgggtatgttcacggacgccaacgctctcaactcgcgattgccagcactggatcgagtctatttatccaagtcatagctacgggcaaaacctgctgttctgctatgatgtctggtgccagacccaggctggccagcccttcttcggctggcgtgacattggtgacggaaaagatgtaggccttccagagtgtccaagggctcggctggactagcaatggataagatatcttggtcggcaagaacgcgagttccatgaatacatctttaaagagggaaagattatacactagatatgtggaggggcgctcgatacaagccagggccctcaagggacatactggatcttagttatgagcaacgcctggaaactttatcctggccacaaagcctgagggctgcaccagccctccagctgttctggaggaggtcccgctatcccggcgacccgcttggacctcaaatgggcaggttgaaggttcatctgggcctatagtggtcaattcaatccgagtgctgagattcctcccttctcccgcaaattcctagaaaagaagggatttcatcggatgcaagttcaggtacgctcatccaccaaggaagactactatgaagatccagtgcttaatagcaaacagaaccctgctgcggctgctatcatgccatccaatcctccccaactgattctcccttccaacatggtagaagaagacaaggcatctgggccatcttctcagactgaagctgatgaggtcaacgataatctccgtgtggagaaagcaaggtcggcctaccaaagaaccttatcaggtggtctgcaaagccccagggatgtcggcgtctcccaggatgcaattcttgagagggtgaactccaagagcaagtcaaaatcctatcagctcggccacaggctgtccctgaaatggagcacaggaaatggtccgagaatcgggtgtgtgagggattacccaatagagctcagaatgcaagcgctggagatggtacaactctcaccaagagcgtcgactcctccggcctcgtggagggtgccatcatgcctgtcccccacctcgccgacgtcgcctctcgtggcaatgcaggcctccctgccccagccaagttaggaacttgagtctaggcaacagctgtgtagttctgctgcttcatatttgatgggtgctgcaaaagttagaaatttgtgcttgctgttttacctatgttccgtggacccatttgtagctcagatggatcttgtgaggattgtatgagttccaatttggtgaattgatttaacaatgtatgattgcacctttttcccgccaaatgtcactattgcag

SEQ ID NO: 13474 - DNA, 596 bp, Triticum aestivum
  unsure (1)..(596): unsure at all n locations
  Clone ID: PAT_TA_13474
ttttttttgcctacataacatgcagattaatagccgaattgctggacattaaacataaatatctgctattagatgcagaaatacaaaggcacttcgacagaccggacagataaatttagaggaaatagagatctgtagtgcctctctttagccatcatcttcacaacattcaaactcccatcccactgaccgcttctttcaattccgtcaaagtccattccattcatcatcaaatgacgcctgttccgaagcaagaagagaccaagcgacagtaatctccacttccaccttaggggcactgtcacccaaagaaacatgtctccctggacttaatattggcaagcttggggcggtaaagcaaacctcacccgtgcggtgatacaccagttcctgagtngnttggtntgacaacattcaagctccttccaatcctacagaactccaggcttggatanacgaagnnacatatgacctttagnatgttctacgcatgaagaaanacacaattcaagggangggnagatagtaaaaagatttcacagggcttatttcccnggggaaggagcantncgcgtatcaangcaggcatttgacgc

SEQ ID NO: 13475 - DNA, 604 bp, Triticum aestivum
  Clone ID: PAT_TA_13475
gttttttttttttttttttaatcttcacaacatcagtacacctcggcagttactcacacatatgcgtctcattatcgacaatcaatctgcacaatgcttactatacatgctgtaaaatctgcacaaccagtctacacaatgctgtaaaattcacacgttcaatcattatcaacaccccaacgcatgtatcctttttgggacatgcatgagcatgaccaaatcttagctatcgtgaagcaaccaaccagtccaactattttcccaacaaacaatccaaccaacgaatcctacgaagaatggccacacgcaaagcaagccagcatcttggaagcgaagccactcctcttcttcgacggcggcaacggcggcatggtggggatgtgagacccgtccttgccgcacttcttgcaccgctcgcactcgtcctggaaggccttgaaggcgccgttgcagtaccttgcggcatccgccaccgtcatgccctccaccagcttgtgcgggtacgtgtccttggcgtggtcgccgttgagcgccgcgcctagctgcaccagctccgcctggaagtccgagatcgtcgcgtgctccgccgcctccgttggcccct

SEQ ID NO: 13476 - DNA, 576 bp, Triticum aestivum
  Clone ID: PAT_TA_13476
tttttttttgtgttttttttgttggccgattagcaccatagctcaaacgaccttgtgtgggataataaagcctattgcgagcaggccttctaggcgccgcccaccccatatgaaaagcataaggagccattgggtgctgccaccatcctccattgaagtctctcatgtaatatggtgcataggagggttgtgacatccatgtcggtgcccatgacccatatggccttgcatagcgtcgaaactcttgctccggaggcaaccttgaacgctttgaatgtgatgaccgattagaacaagaaccggccgcttgacttgcatatttggatagcaacatatcaaaagttggcctgattcgcttgcgcttagcttcactcttttcccacttgccaacttctgaattcttgggcttgataaatctaacttgagtatcttcttgtacttgtggttgccccccaagtgaaggattttttatggtgatcttcaatacttctttgccatcgggttgcttatcaagcacaacctctcgtcccaagactttgtcgccctccttgcctttcctatggcacggacgcgtgg

SEQ ID NO: 13477 - DNA, 555 bp, Triticum aestivum
  unsure (1)..(555): unsure at all n locations
  Clone ID: PAT_TA_13477
tttttttttttttttttttttttttttttttttgccacgaactaatttttcattgatgcaaatcataatatacatccagaaactcgaaacagacatagcatccattgcgtacagctaagccagccagccagctagtgttcctacatccagaacgctacaggtgaaaacccggtgatatgcttcgacaacacataggagttggtggtgcgattgatggtctgcaactctccattatgagagtacttgaggccaaacttggtcataaggagcatgcaaccatcacaatcacctaaggcatcctcatactccacttcctcacgcaccacacactccacaaggcaaaatctggcattgcccatgtatgttagagtggcacacgaggccgctcgtttcctctccgggaccttgtggaacaacttccccttgacaaccttccactcgggctgttgggtgcttccgcggctgcggggggcgacttggcaggcgcagatgtanccatcctcgtgaaggccaacccatccgtccagcgtgttgtcatagtagccctggccttgg

SEQ ID NO: 13478 - DNA, 2836 bp, Triticum aestivum
  unsure (1)..(2836): unsure at all n locations
  Clone ID: PAT_TA_13478
ccgcgcccccgcccgcacttacccccctctcgcgctctgtccctggcgctccccccggtcgccgccccgcccggcccgcgctgctccggctccagctcgagccccggcccctcagctggataaggagcagaaaattcagacttgggatgagggtctcgtcaggattttgtgaaggaattcgtatcaaagaggcgaagacagaggcttttactgtgaaagatcacagaggagaattatacaagaaagattaccctcctagcggtcaggatgctgttgggagattggaaaaggcggcaaaggacggtgcattccacgggaaactaaagtcaaacggaatccaaacagttgaacattttcttccacttcttgttaaatatcaaaagatgttaagtagtatccttggcacaagcatgtcaaatcccttgagccaattctccgtagagtagtcaaagaagaagttgcgggtgctctagccaaactgggacctgcagcagcacctgctagaattgaaggaaggacctctcccaaaagaattgaaggccctaatggtagtaatctccagcttcaatttcggagtaggttagcactcccactctttaccggaggaaaagtggaaggcgagcagggagcatcaatacatgttgtgctgttggatgcaaacactggacatgttgttacttcaggacccgagtcatttgcaaaactggatgttcttgtgctcgagggtgattttaataaagagaaggacgaggattggactgaagaggaatttgagagccacattgtgaaagaacgtgaagggaagagacctcttttaaacggtgatatccatgtgacacttaaagaaggcgtagggaccataggggagcttatcttcactgacaattccagttggataaggagcagaaaattcagacttgggatgagggtctcttcaggattttgtgaaggaattcgtatcaaagaggcgaagacagaagcttttactgtgaaagatcacagaggagaattgtacaagaaacattaccctcctgcgcttaaggatgatgtttggagattggaaaagattggaaaggacggtgcattccacgggaaactaaactcaaacggaatatatacagttgaacattttcttcaacttcttgttaaagatcagcagaagttaagaagtatccttggcactggcatgtcaaataagatgtgggaaagtcttgttgaacatgcgaaaacttgcgttctgagtggcaagcattatatatattactcgaaggatacagcaagtgttggtgcaatattcaataacatatatgagttcactggtttgattgctgatgatcagtttatttcaacggaaaatcttactgaaaaccagagggtgtttgcagatacattggtgaagcaagcatacgatgattggatcaacgttgtagaatatgatggcaagggattgttgaaatttaagcagaaaaagaaatctgtcacaacaagaagtgatgctgcaaatgtctctacaagctacacttcttatgattcagcgcactctcagaaacaattggcacgaggacatgccaatgccaatattgagcgatctctcatgagcagtaccagtaaagcagaagagacaagaattgcatccaacgggaaccaggtagcaatatatgcagccaatcctcaggacatctcaccaagtattaccatgcaatatggcatgagttcattgatccctgaaggccagttcaatggctcttccatccaaactcaagcatcaagaagctccaacatgctagcatttggccctccaccacagcagcagcagaacttcgaattctcaacacttggtctgtccatgcaatccccagctcttaatccttttgatgactggcctggacggtcacaggagaaccgtggtggtgttgatgacttcctgatggaggagataagagtgagaagccatgacatactggagaatgaagaagagatgcaacatatgctgcgcattcttagcggcggggcagcagcaaacatgaatacgtacatcccttctcctataccgacctacaacttcgaggatgatcgtgctccctcatctggcaaggctgttgttgggtggcttaagattaaggctgccatgcggtggggcatcttcgtcaggaagaaagccgccgagagaagagctcagcttgttgagctggatgattaggggatacggttgttggtaagacacttgtttttctcgtcttcaacgaagctcagcttgttgagctggatgactagggcatcttcgtcaggaagaaagcttcgttgacgcttatgtgtaacagcgagcaggatctcaagctcccaaaagtatgaatggactcgcgttggttgtataggtagctgtttgatggtcattatctaagttttattagtgttcagaaaaaagaaactgttacaactgtgcaaacttatttgttggagattggacaattgaaacagactttgtttgtgggaaaaaaaaaaaaaaaatgtttttgcatcctcggggccagatggacaaactatatcccgaacaaacacggtcaaggacgttccgtggggcgatttttatgggacggctttgggagatgtccttaagttgacattaagtccaagggcatcctccaatgctttgttgccatccntggaataaatttggngctactacagatggggcctcaacaattatccatctatcagttcaagaagaggcctgctgcatcttgaatctgaatttgggtcaagcaganaggacatgtanataantttgtccgttatttttcnctcacggctgtccgattgntaaaaggataaggaa

SEQ ID NO: 13479 - DNA, 1115 bp, Triticum aestivum
  Clone ID: PAT_TA_13479
tttctttcttcttcttccgctctgcggaagttcacgccttctatctgcgtgtagtaacttacagggcataaccgccgctttagtgcgcccgcctgtttgggcacgggaccttccacgtcttctagtcgtgcacggtcggcgtgcgctttgggctccagatgcaggcatccctgccctactcagcggcccgtgatggtgtcggtgctggtctctcgggcgccccgagcagcatggggtatcgaagggctgcctggcggcacgtcagaccccatccgggccgaggcccagtatgaccaatcatcaatcttgcatattgaacagcttaaacaacagctgagacaggcctctctatattccaaactcggctactctgcttctaacctcctcaaggataggatctgaaacctgtagaaccatccatcagagtgccatccagagcccgatcctcaatcaggtatttctcagatgttgttgtatcatcacgtgcaccatgaataaaagcaagcctgggagttaaggtcctttcttgcttcaacctgtcgaccgttgatctcaacagacagtcacgtggaggaggaaagggaattgaagggctggctgtaggcaagtaatacaccaaaaggtcagtgtaggcgtcaagaaggaatattggtctctcactggtgaatacactgcgacttagagactgatgcacttctgcttctgtatcaagagaggagtacgaactcagtgtaggacatatagctcgccggccggaagccggttccagtgcactgaagaggcactgcaaatatgtctggtaatctggatgaatatgttcatcctgaacttgaagcaaggggcttactagaaatgcaaatacaagccgtgccagaggctgcaattgtgagcagtttgagaaatcaacgtcaatatcagaaactccagaatcagcaggtctgacgttcttgtatgccttgttgtattgggcaatgaaaatcgccaaccaatcatggagccatagccttgcttctaccacatcacttaaagaagccaaaataacctggtgtacaagtatcgtcaataccacatctgggtcaacaaagtcatacaggtcccagatattagcagttgtg

SEQ ID NO: 13480 - DNA, 745 bp, Triticum aestivum
  unsure (1)..(745): unsure at all n locations
  Clone ID: PAT_TA_13480
actcgggaggaacaacagcggagttcacccataagtccgacactagaaaatcctcgattatttttatactgttacaggggccccaagaagcggttaaatgcattggcacctagcggcctgatgtacgaggtgccacaatgccctgccctccaatgccacagttcttggagcttgcaggcatgcgaggctgctttgacacatcacctttgtctgggcaggtggtcttcttatgccctggcagcttgcaaatgctgcagaacctcgtccgcttactcatcgcctcgtacggcacgttctctctgctcgagcatggtcgctcaacacaacgcttcttgcttggagccgacagtccagtaagggcatcccagttgctggaagcagtcaagctgttcgcattgtcaaccatatctccctcaactttgatgatcacacatgccgatccaatgatattgcgattcgattcggcagcttgtctatcctgaaatcgtagtccatccctggatttaagccagcagcgatgcttccatgattatttccttcatccgacctagcccgagctcgtaggttgcaactgatgagtccncaatccttacgagctgcatggcctgcaggtagagagtcaagctccggcaggtgaaagatcgattagcagcaagatgctgcggcaagatgtccctgacatcttttgtccacctctcagggatgtgccgttttgctatctctttcatgccaacatagtccatca

SEQ ID NO: 13481 - DNA, 652 bp, Triticum aestivum
  Clone ID: PAT_TA_13481
ttttttgaaaaaagtgaaatccaatagcaaaattttaaaacacacgtatcctcatacaacttcggcatcaaataatgccagccaaacaacataaataataactcaaagttaccattttgaacctagcttgtttgaattccaagtgtttggcctttatatagtcccttgagccttgtaaatcatggctgttagggagactgtacaacaactccaccatgaacaattcaacatatttacaagcacctattcttatatgaaattcttatcagaagcttattgcaatgctttaggtgttgcccaaaggcccactattttagtagcattccgtttactcctttcccaacgtgaccactttctacaagttcacatagttagtgacgagaatctagtgattgcagccgatttaagcaatactatgtgtaggtcgttggcagcccaccacacctgttagagctcatggagccattgttgagctaggactgcaaaatacatgaaagtttaccaacttaattggttacccttgcgatatacatagctaagttttgaactatatagatagagtgcttaatcataattactgcaaatctgaagctgcacaattccaattaaatttgatgcatgggagatgacttaccttcttcatgaccctggt

SEQ ID NO: 13482 - DNA, 583 bp, Triticum aestivum
  Clone ID: PAT_TA_13482
ttttttttttttttttttaaagagaataattaagttttcattatctcaaaagttttcctacaaagaaacaactttgtaaagtcttaactctaacaaagggcatagtttcctacatagtagctatcgatgtgcatgtatacttgcaatataaaggctaggtacctgggtgcggttacagagtagaaatttttataaacccaaccactagatttagttgattcacacaataaaagagtcactcatgcaaaactagagagtgtccttcacattgaacctttcgctcatgtcagtgagtattttatgagtagtactatatctttttttgtagtatgtgtattaatatatatttatggtattggtggactgcaagttatctaatttgtaaccttttactatagtaccattatcacttgatgtacacaaaatcttacattcaccccatctttatcttgctcgaacattatgggacctttagaatcaggttgacccgaccaagaaaagcagagctacgaaactacatgcaaatgaggttggcttgatccctaatggtaaacaactattcttcgaggctttcctattgata

SEQ ID NO: 13483 - DNA, 478 bp, Triticum aestivum
  Clone ID: PAT_TA_13483
tttttttttttttttttttttttttttttttttttgaaaaacgacgaccaataattgttcattgcagtcagcagtagtgttaacagttatgagatacatcaactcagctggcgtttcaaacggaagaaaagaaataaagaaaacaaaaaactctcaccgggccaaaactacaggattcttaatcagattgaggaacagtccgaagaagcccgtaaatcaaaaaagccgaaaagggcgatgatggtgttttcagtttcaagagaaactgtgagcaaacatcgccgccgaacccgaaaggcaaaaccaaaagaagaagaagaagaaggaggctacgctaggatcttgccgcccaacgcaccaaaaggttttgtttgtcatcagcccaaccgtctacccaacttgatccaaaattcgggcttgattattgagggacgctcggcgcgagggcttgtgcaccggctacatcttgagctccgtg

SEQ ID NO: 13484 - DNA, 1686 bp, Triticum aestivum
  unsure (1)..(1686): unsure at all n locations
  Clone ID: PAT_TA_13484
gcacgagggccccgcccggcgcgcccatggcgcgccgcggctggcgtcgtcccctcgcctcgctgccagccctcgccctggccctccttctcctcgccgtcgctgccgccgcggccggctcccccgaccgggctgccccttcgcggccgccgctggtgctcccgctcacgctctcctaccccaacgcgagccgggtcgcgtcgtccaggtccaggcgagggctcgccgaaggaggtcacccaagcgcccgcatgcgcctccacgacgatctcctcaccaacgggtattacacgacgcggctgtacatcgggacgcccccgcaggtagttcgcgctgatcgtcgactccgggagcaccgtcacctacgtgccctgcgcctcctgcgagcagtgcggcaaccaccaggatccaaggtttcaacctgatctctccagtacatattcaccagtaaaatgtaatgttgattgcaattgtgatagtgataagagccagtgcacttatgagaggcagtatgctgaaatgagctccagcagcggggtacttggtgaggacattgtgtcgtttggcacagaaagtgaacttaagccacagcgtgctgtttttggctgtgaaaattctgaaactggagatttgttcagccagcatgctgatggcataatggggctgggccgtggtcaacttagcataatggatcagcttgttgataagggtgtcataggtgattcattctctatgtgctatggtggaatggatattggtggtggtgctatggtacttggtgcaatgcctggccctcctgacatggtatacacacattcaaacgctgtccgcagcccatattacaacattgagttgaaggaaatacatgttgctggaaagccattgcgggtagacccaaggatctttgacggcaaacatgggactgtcttggatagtgggaccacatatgcatacctcccagaacaagcttttgtagcttttaaagatgctgtgacaagcaaggtccatcccctcaagaaaatccgtggacctgacccaaattacaaggacatctgctttgcaggtgctggaaggaacgtctcccagttatcagaggtatttccaaaggttgacatggtatttggaaatggacagaagctctcactttcacctgaaaattatttattccggcactccaaagtcgaaggggcttattgcctgggtgtgttccaaaatgggaaagatccaacaactctattaggtggaatcgttgttcgtaatacccttgtaacctatgaccgccacaatgaaaagattggattttggaaaactaactgttcaagagttgtgggagagactccaaagtggtggggctccttcaccaacaccctccaatgatcaagttcaaaagcagatttatcgcctgctcctgctccaaatggtttgccagaaataatgatgttgggcccagccccggttaaaagtccgataaatgttacgttccaaacctggaaactcaactagaagaatttggtgaactgttggctaaagaacggggaaaaatccccagtcgcctccgtatnaagtacngggaaggaaancaacnaacanatgggaanttccaacgggntntcnaatcaagtcaaggaananaagggacattncggnggcaaanaagtaatnccgaaactgganttnattaccngg

SEQ ID NO: 13485 - DNA, 326 bp, Triticum aestivum
  Clone ID: PAT_TA_13485
gatcccccgggctgcaggttttttttttgacatgaaaaaaaatgcttctcccggctttttcctcttttgaagcaggcagccagcctggtatcgcaacgattgtactaccaagacatgatcccaactgggctacacctgaagcaaccacaccaaaagcagaactcgtacaaggccggcctgaagcacaggcacgcagcggctagcggcctagcaagggccgaattgctccgtaggtagcacctacatacactacagggccaacgataaagggggcctttaccattgtgctagctgcaggcctgctgggcgtggcgtcaagcatgaaa

SEQ ID NO: 13486 - DNA, 447 bp, Triticum aestivum
  Clone ID: PAT_TA_13486
tttttttttttttttttagttctaacgatcaattatccaaatttagtaacaaagaacgtgtcactccagtgttacatcgtgtaagacgcctctgatatccgaggaacaagcgtggagcaattctctctgaaacacacactagaaatcctcaaaagaactacaatacagctaatgcagagtagaaattaaacattcaaaactcatttctcagcagcactgagtggcctcgtgcaactgttctggcggcgcccttccataacgcagttttcgcactcccctggtttccgtggtttcttgggaacatcccctctttctgggctgataggtgatagtacacttgtgccccttgtgctgacagatgctgcaaaacttatgcttactcaggccctcgtatggcgccttctccctgctatttgtcagactgtcgacccgtctatgtttttccct

SEQ ID NO: 13487 - DNA, 1049 bp, Triticum aestivum
  Clone ID: PAT_TA_13487
aaggagtacatatatatgtttaccccacaaccaaactaaagtagtgccacgcaaccaaaccaccaccaaaatgagtagagcaaatgtctaggttaaaaaaaagacgcgggacattgtagatcttctaaatcttcagcagcttgaagatcctccaaaccttagtgaacttgtgcacctttgggaagcctacagcttcttccttttagtttgtcgctgactagatgggcctccaaattcttcatttatatttgaaaatgtaaggcggctaaatcattcaaaatcctcgtcgtttcttgttctaattctcgctagcctctcttccgctcgttcttgaacattgtcttagtctctttcttattccattctttttccctggataaagctcctcgctatcatcagctatgaattgtcgaaaagcatccgcatcacgcttctttttcttttagaagagggtcaatgctccctggatctacatcctcatgaattgggtcgtccccaccgccacaaatgctcttgatggggcagaggaggcagacataggatgttgatatggtagtgagttggtcatgggagaagagggacactctgctgcttggtggatcggagaggacgtcgaggaggcagtcccgctcgatccttgcttgctcaggtggaggggaagccctgcttggggaggcgttcggtggtggagtcgctcggtgatagtggtcgtctgtgggggtgctccgtgctcgttagcgctgatgtggggtggttgggggcaaaggcggcagtgatcggaccgttagggtggagggctgcctgcggtggcggggctgtgttgatgcgggctgtcggctgcagaactcaggatctagggtggcctgtggtggtggggtagctaggggaggcggcagggctgtggtggtgggggacgctggcgatgggggtgcggtggtggggacgccggcggcagggctgcggttgtgggggacgccggcggtagtgctcgggtccggctcgggcccccggcccggtcagtggtggagggggatttgggggcctcgtgc

SEQ ID NO: 13488 - DNA, 770 bp, Triticum aestivum
  Clone ID: PAT_TA_13488
ttttttttttttttttttccttgtatgagcaaatcaaattatttttttatatcaaatcataatttgaaaaaatataataaactaaagccaggtgaattaaccttgggccctaaataggaaatgctaacacacaaggcaacatcccctccagctgcttccaaaaaaccttggctcattgtctcaatgtaccagcagctaacttgaattgaaatcctaatgtgttgcataatggcctgaactcacacttacttagctccaatacgagtgtttaaaaacatgaacggtgacaaaaatgttcataatcagtccatggtttcttctctgctgaatgatggcatcatataacaatattcaggaaccaaattatcagtttcatcacacattagcaacaacaacccagcatctaagagacatacagcagcggacaagcaacacatagctatatcatagcttgttcctggctcatgtgaatctgaaattagtcggcacttccccttacaagcggcatcatagtcctcttcgaggtgtggtgcagcttccttgtgagggtatatgaatttctccctgaataccttgtcggtcagcttgacaattgtatcgtagcttgggtcacgcctgagcaatccattttccttgagaaactttacagcgtagtaccggggcctgagccggccctccaggctgtgaccgagtattaccgaccgttgagcaatgtaagccggttgcaagcccgcctcggagatgaggaactcggacctgcgctgaagcga

SEQ ID NO: 13489 - DNA, 928 bp, Triticum aestivum
  Clone ID: PAT_TA_13489
ttttttttttttttttttttaaaccttatactacatacttcagtgttttttcattaaagcaaataaacaaatatacagctgtagcttatatatagatggtctcagcttacaatgacattgggcaggagagaactagcaagtataccaaataaacataaaaacacacaaataccagtaacattcaagcaccttgtacatttgcaagtttcgactttaatctttggcttgggcaccaccgtaccccctcaatcctggtttcctctatagtggctgacaaagcattccattgctgaagtgagtagaccattttgcagagcgttataagggagtgacaactctagacagacaagcaaaggcagccacttttttttgactttggacaaagggcaacacagtctaacacacttggagaatccacatacgaatcagtcaaagggatcagccattgacaaatcttgggtatgtacttggcgagtgaatatatttctgtttacttcaattcgcgcatcttgagaggtccctattccccacttgtagcagccttaagtaacagtcgtcgttgcggtaataagagcctccaatttccattttattcagcactttcgcattcaaaaggaaagaattggcaaagtcaaaaatggcctataaccaccgcagtaattcttgagaccacttcttttagatggagttcaaggcattcaattggatcaagttgatcatactttcgcacaatattcatattctttcctgcattcaaaatgacatagagcttcgccaagcaggggaagcacacgaggaagtcaattactaaatccagattaggactagattcaagaaccaaaatcttcattgagcgcattttggttgtcatggtgacatcaatcattttctgaaagactgtggttccaaggtggagtgtagatatgcc

SEQ ID NO: 13490 - DNA, 692 bp, Triticum aestivum
  unsure (1)..(692): unsure at all n locations
  Clone ID: PAT_TA_13490
tttttttttttttttttttttttttttcaagaagaacatccatgcatattaaaatgaatttctcaacaaataattaaacgcattcccaacagcaacaaatccaataatagtgaagtgcactcgctgtgcgccgagctgcagacacacaacatgtgaaccttgtctcgtatccaaggtanatgtcgccggaggagaggactgcacgcgagccgtattttgcccaaagtagagtgttgcttcatccttgctttgcagtccacaccgaagaaaacttcagtgcactgaacatttccatccaaaaagaagaggaaagtgatatgaatgagagtagtgaacattagaaaaaaacaccaaaccacacgctgatggttttgctccccgaaaccagctcgtcatcgcgtactgcataggcccgtgggcggagctgcatgccgctgtgggggctgaacccatgctgtggactgcgcatgagagtgcctacgtgctgcgtgcccgcacgtagtccactgcatgcggccccgtaggagaggacgacgaggaggaccagagaggtagccccaccacgccaccaccatgggagaggacgacgaggaccagggaggcagctcccataggaaacgatgccccgccgaaccgcatgcactcaccgaacgcacttcacgcctcggtggctcgaactacacagcggcgtt

SEQ ID NO: 13491 - DNA, 512 bp, Triticum aestivum
  Clone ID: PAT_TA_13491
tttttttttttttttttttattatgaaaatatgatttcgttctactagagttattttcttattattacacgcgtgtgatgcgtgcgccaccactaacacattagcactgcctaggtatagtcgattttgcatcagcgccatgcttaggtcacgatagatatagataggaccagcgggccgatgagatcagccgacgttggcggggcggaacccaccgccgccgtcgtacgccatgacgggcgtgccgctctcatcgcttgtgggcatgttgtaggagcagctggcggaggcctccagctggtcctgcgccgccggcaccatggccggcaggccccccccgtcgtcagggcccaggcagtgctgcatgagagggaagggcgtgttggggatgagcgtggagagcagctcggtgtagctgtacgcctgccgccacggatccgccgtctggctgctgcccccgacgtcgccgttgccgccgtgcatcccggccacctgcgatttgccgtcgtaca

SEQ ID NO: 13492 - DNA, 1030 bp, Triticum aestivum
  unsure (1)..(1030): unsure at all n locations
  Clone ID: PAT_TA_13492
cgtccgcgtacgcgtccggcttgctaattcaccagtgacgctccattcgtcgatctcaccggccttcttctccgaccgactgacgatggccggcaatggagctagcgcctggaggcagctcactccgttcccgctctacctggccatcttcttccttctcggcgccaacggggcggaggcggcaacgtccttcagcttcaccaacgcgtgcgcgcacccggtgtgggtgggcgcgctcagcggcgcaacctcgccgcagctgccccgcaccggcttctacctcgccccgggcgcaacctccgcgctcgccgcgccctcctccggcgcctggtccggcaacttctgggcgcgcactggctgcgccgtcgacgagggcaccggccgcctcgcgtgcgccatggccgactgcggcacgggcgacgtcgcctgcgacggccgcgggcccgccccgcccgtcacgctcgccgagatcaccctcgccgcgcccggctccggcggcctcgacttctacgacgtcagcctcgtcgacggcttcaacctgcccgtcagcatcgcgccctcccacggaggctgccaggcggcggcgtgcgcgggcgacgtgaacgccgtgtgcccgtcagacctgcgcgtcgtgtccggctcaagcggtgaggtggtggcgtgcaagagcgcctgcaacgcctacggcagcgcgcgctactgctgcagcggcgactacggcacgccggcggcgtgcgggcccaccaactactcgcaggtgttcaaggccgcctgcccggcggcctacagctacgcctacgacgacgccagcagcaccttcacctgctccggcgccgccacctaccacatcaccttctgtcctgccacttaactcatcaacctcacaatccttataattaattaattaattataatcacacggtggacatgtatgcagtttacctttttcaatgaaaataatatacagagttaaaaagggattacaaatctttatgcgtncttattctttttttctttgaggggattatgc

SEQ ID NO: 13493 - DNA, 952 bp, Triticum aestivum
  Clone ID: PAT_TA_13493
cgtccgcccacgcgtccgttttttcttctttctctttggaaaaaatccgaaggagcaagccctagctggtccgaatccccccctcctcgccgaacaaatgtccgaccgccgccgcgacaaggagaggccccgcgagcgcggcggctacgaccagccgcgggagcgcgaccacgacgccgaccgccaccgcgaccgggaccgggaccgggaccgcgacgtcgaccgccaccgcgaccgggaccgcggccaggacaaggagcgggaccgcgaccgcgaccgggactaccgccgcgcccgcaagcgctcccgctccccctccccctcggccgacagggaccgctcccgccgccgccgctcccactcccactcccacccccaccggtcccgctcccccgacgccggccgccacaagcgccgccgcgaggtgtcgcccgtcgccgacccgaaggaggacgacaggaaagccggaccccccttccgcccccaaggccgccgaggagccggccccggttggtgacggggacgtggacgccgaggagctggagatgatgaagatgatggggatccccgtcgggttcgactccaccaagggtaagtacgtccccggcgccgacgtcagcggcgtgcgcgccgtcaccaagcgccagccgcggcagtacatgaaccgcaggggcgggttcaaccgtcccctgccgcccgaggtcaaccgctgaggaggatcatgtatcaatgcagtatacctcgttgccggattgcaaacttgcagtggactatttgacttcttcgccggccatagcaagggttgagcttctactgtctaccaagcatgtataaccttgatggctagttactttgccaaactttgaagactaaagacatgtagttctcgttttcatcatttgctctgtcgacaatccaggaaaagatattggtggcgtgtttttggaaatgt

SEQ ID NO: 13494 - DNA, 501 bp, Triticum aestivum
  Clone ID: PAT_TA_13494
ttttttttttttttttttttttgaaaatcaaaacaaattaatcgaccaagtcctgcgagtcagatttcatggctgaccatcacagagggccaatttctgggttgaacaagcgtacaaaatggaagaattcgttacaaagttgaccattacaagggcacaacccatttctgcatcacagccaccggaacgtaatcatagatacctgctcaacaagtacatcacagtagcatacctaaccagataatcatcttatgtgctgtgaaagatcaactccatcatgtccaccaccaatttctatttctgcagtgtagacactttcgaatggatgatagtgagaaagggttctggtctcaccaagtttcttgaactgcaaagactcaagattgaccataaagaggacaccgtgtgtccacacaaacaccacattattctcctcagcgaaccctagtatgacttggctgccatttccattcagggaaagtagcttgtccagttcaatag

SEQ ID NO: 13495 - DNA, 567 bp, Triticum aestivum
  Clone ID: PAT_TA_13495
cgtccgttctttggctcaatcgaagtaatgtacttctcagcttcccttggcaagtttcatgaaggtgcctgggtccctattaccctttccttcatatttatggtggtcatgtctgtgtggcactatggcacaataaagaagtacgagtttgatgttcaaaacaaggtttcagtaaactggctgttgaacctcggcccttcactgggaattgttcgtgttcgaggcattgggctgatacatacagagcttatgtctggaattccagccattttctcccatttcgtaacaaatctgccagcatttcaccaggtactggtctttctttgtgttaaatcagttccagtgccacatgttgaaccagaagagagatttctggtgggtcgcattggtccgaaagagtacaggctataccgtgtcatcgtcagatacgggtaccgtgacgtgcagcaggacgacctggagtttgagaaggagctaatcaacagcatcgcggagttcatccgcagtgggggcgccgaccagaacggcttcgtggaaggcagcgagaagctctcctccattagcagc

SEQ ID NO: 13496 - DNA, 609 bp, Triticum aestivum
  Clone ID: PAT_TA_13496
acgtccgcggacgcgtggggcagcatttggtgacccagaggttatggcggcccttcaagatggtacagttttctactcaaatagttctctaatccccatttactttatagtacagttgcctgttgtagttgatcttcctggtcaagtcctggtactggaaaacagctgattgaatataaattctcttaataatagcagtggtcataagtgcaacatatttctttgcatagtccctccgtccgaaaatacttgtcatcaaaatagataaaaagggctgtatctagaactaatatacatctagatacatccctttttgttcattttgttgacaagtatttccgaacggagggagtatttagtctgtttttggagtacagtgggcatatttggtgggttatgcaaggtgcggattagtttgattgaatattctgaacatgcaagcatgctagtgatgtacgctcaatcctgaaatctggtgcggcagataattttttatcactagaggccacttattgtaatgcggttgacgatatctttattcttatactactagatcagtagatatattctaataattcaggttagtactcatggtatcaacattccttg

SEQ ID NO: 13497 - DNA, 563 bp, Triticum aestivum
  Clone ID: PAT_TA_13497
tttttttttttttttttttttttttttttttaaaaaaagacagactactgtatttcatgcaccacagcgtttagaaaaaattacaaatttccagctccaagcaccttgcacagcttgaagtagtccttcgtcttcgtccaacctgaaacaaagaggtcaccttgtttctacatccacgcctctcgtttttagtttttgtcacattggcgaactagtggtggttaacctccagagaaagtgcagtactttgtttggtaaagatagtccccatatatagtttctttcattaaaaaacctgattatcggtagcaggatttgacgttgttgccaatcctcgaaatgattcatgtgctttgcttctatctcgagccactttgtaggctgatttaaccgcgaataagcctcttttgtcatagtgccaggcaggttgatcatcaaattgatcatggaccggaattttgatgatttcctgcccatcccatacatttgtcactggatcaatcagctcttgtactcttgtcaccaagtttctgtcattccttgagatcaccgttgtagagatg

SEQ ID NO: 13498 - DNA, 329 bp, Triticum aestivum
  Clone ID: PAT_TA_13498
tttttttttttttttttttccagggcaaaactcaaccagtttggttcaggacatcaagcgttatacaggccacgagcctgcctgggtcaaaagaatcctagtagagttccatagcaacacaatgttcaaagacaagccattaattacctactccattttttacataggtgtagtactagatacgtgtgtgtctccacaggcgcacatcagcttccgatcacgatgcgattagctgtgccactatccagatgttgctaaaccgtaacttgggcgcacaaaaagtcaagctatatcttcctctcgttgttttcatcgggaagccatcgacc

SEQ ID NO: 13499 - DNA, 945 bp, Triticum aestivum
  Clone ID: PAT_TA_13499
ttttttttttttttttttgtgtgacaaagttcaaagccaaaataacacttccttcatgaatcatatgatcagtcatgcacataatagccaaaatagcacttccatcacgaaatcatataataaagttctagatgacatccatatgaccagtgtcatgcacctatagcaaaatgctataaatctaactggcaaattctagaaatcgaaccgacaaagtgctagatctctaactggtatcagcaaggtaggttctagaagagtttccctgcccaagctggaccgctggctcgtcagacaaatgtagcatcattctggggcagactaacaacgacccaacttgctccagtatgctcccttctatcccaataattttcaccaatgagttcgagtggcccttgaggaaaatatccgtgatctgggtacacccaaatagcttgagagttctcagcgatgagcaactgtcaacaatcagccccaaagcttcattggacagaccacggcagaaggaaacatccagaacctccaagcgtacagagcacttgagagcaatcgcccgtgcagtaaggtttccaaccttctcaatgttgtttaggctcaactcagttaaagatcctccagattcttccaaaaactgagacagtgctacatcactgaacgtattcttttgaagctttaatttctttataagccgacagccatcacgaagatgtcttgttgctgagtcacgcaacctattcaagtttcgtatatctaaagatgataactgggggcagttcaccccaatagtcttaatggaagatgaggtcagtttcaggcaaccagcaaacgctaactcccttatattagagccatgtataggaatgagctcattcacaaacttgtcacagacagactgtatgccagacattgataaaacctccaaatgtttaattttctttagagcag

SEQ ID NO: 13500 - DNA, 606 bp, Triticum aestivum
  Clone ID: PAT_TA_13500
tttttttttttttttttttttttttttgaccaaatgcagcgaccattaacaaatccaaactcagtgttaacaacaaccacttatatatatttggacgtacatagaaattagatatttcctaattgtttgcataacaaaaaacatttgtctacaagagaacgaaagactttcgagcggccgcccgggcaggtacataccatcccatcatgatgttgccatctctcacacttgatgattacatcttgttatttctaacatgtacaccatcgggccattgctttattagaaatatatttacacaatatgatcagagcaacatcaaggagtcggaatgctggtgcacagattctcctcaaattccacatgcaacccttgtagagaagaatgacatatttttcttaggtgatttttgaccgagctcctgatgcaattgctcgtaactccagtgtgttggtagagtggagaagagaccacccagccaatgttacagcagatcgatctgtagtggatttgatgcattaaaacagccatggcccatgggcagaggagaagtgacggcagctggggatctgacgtgtcacaggcacctcggccgcgaccacgcta

SEQ ID NO: 13501 - DNA, 748 bp, Triticum aestivum
  Clone ID: PAT_TA_13501
ttttttttttttttttttttggcaaataataaatgcacagagaccgagggaagcaattaactttgtccatacatgccaccaccgtgatactaaagcacagtagtacatccttagttgctgctccaacatacttcagcttagtcagtacaccaaatttaactactgctccagtgcataaattaaacatccactacactatactagttaataagtgcatacatgccacatgataacatagatacgataatcatagtttccaacagacagttctcacagccactacaccaccagcatctaaaccaagtttagactctccagatgatcagcaatggccctcttatagctggccttgaaggtcgacagaagagaccacgcaacctccacttccatttcacatgagagaacctctacaatctcccggcttctaccctttttcttgggcagaaaatcagcctcaagcttcaccgtatgtttccttatcttctctttgactttttctttcttccctttgatacgcactgcctctatcgatactttcagattagtgacacaaagctcatccaaaggagcaacctcaacgcaaacaacgcgccgcgaaaacttcacgtgaccatcgccatcaacaggcagtttgccatcacgacaatcaagtagcatcacggacttctcaggaataccggacgtctcagccttgaatacaccgcgatagccatgcggccacgtccgtccaagagttctcggccgaatc

SEQ ID NO: 13502 - DNA, 612 bp, Triticum aestivum
  unsure (1)..(612): unsure at all n locations
  Clone ID: PAT_TA_13502
gggtatgnatcatttgggggccgtccgccccctcggtgttgggggctcatcctgcgagattcccgttgctctactgcgggctccccgcttgggattatcgtgtccaccgtactttccttctctagttctacacctgtgcagtctcccacctcctcgctggccccgcgtttcgcccaatgtccgcgcggcctctgctttaccagttccactttccataggccgagcctttgaccggggcgcggggcggcggcgtgttgcggtccccggggtcctccggagtcatcgggcctgggggtgggcttcgccgttccggcgacagcccaagggaggcagccgagcctacccaatgcgtagccattcttaggtgcagtagcagtgtagcacccacncactgccggaaccggaactgctggagcgaatcaccatcacatgggtcacctccaccgaaggatctagcaaggggtaaagtccgctcgtgcggctgcacgagcgccacctcatgtaccagcccctcccccgacgtgcacagccgctgctacagcaccattggtcgctggtacccggcccgcaggccgccgtgctgctcccgtccgcctgcgtccccccggtggg

SEQ ID NO: 13503 - DNA, 523 bp, Triticum aestivum
  unsure (1)..(523): unsure at all n locations
  Clone ID: PAT_TA_13503
ttttttttttttttttttttttttttttttttttttttttttttttttttttttccaaacgccagctttttttacggggtgcaagtccgcaacaagtaacaatccactccgatgcaattaatcatttatatgtacatcaccaatgttctagctcactctatgcaactgaacccaccgaattaaccaacgcaatcaaacatgtaaaagagggaatagagatatacagcaaatgttcattgaatcaagtagccacaaactagttcccatctagagacaacttatttctttccaccaatcataggctggccgccatttcagctacccaaactagtacccgtcttatttccaccactggggctcttcaagtcaatcaaatcactgaacaagttacaagtagtagtaaggtttgcttgccgcttctgaanaaccttcggttgatgatcccatttggacttgaggatcggtaacaatgcttgttggaaangcacanaacgtacgttgcattggctgggaagtggangac

SEQ ID NO: 13504 - DNA, 1039 bp, Triticum aestivum
  Clone ID: PAT_TA_13504
ttttttttttttttttttgagaacaacagaagatgatcccctacctgcgatgcaaacgcatacatcaagcatcaacacataagtactagtacaacctgggagcaactgataacttaagctggactacgagcatctaactactaccatagtaccatcggacacttgacattaccaaaagatgccaccgttagatagttctgatggccgcacaaaagatcaacctaatttagctagacacatcgagctactttcccatgtcgatgagcatgttaggcgcaggaccgtgcgcggccggcgcgccgcggcggcgccaggaagacgtcggtgagcacggtcttggactgcagcgacgccttgaggatcgccagaccctcctcgtagccgagctgcacggtcttctcctggagcgcgccgaggtccctgacggcgaaggtgttgagcagcgcgatgctggagatggaggacatgggcgtcaccctgaggtcgtccatcaccgtgtacgtcacgatgccctgcacgaaccccttcccgctgacgccgcccgccgccgccgcccccccgcctccggacgcgaaccgcaacgccgtggccatcgggtagctgcacgaggggcacttggtgccgctagtctccgacacgtagctgccggtgcagtagctgcacttgaagagcgccttgaactgcccgccagaggtggcctccggcaagcggaacatgttggtgccggcggcgcccggggagaacacgacggggtgaagaagggcgtccttggccgtgccgggctggacgtaggtgccgtccagcttctccacgctcccgtagaggttgccgacgcagccgaccatggagtccttcccgagcagcttgacggcggtgccgaccggcagggcgaggagggagaagagcaagtcgaccacatccttgctcgcctcggcgaacagcacgcgctgcgccttggtgtccaccagcagcttcatgctcagcgcgctgctcgtcgtggcggcggcggccatctagacgctcgatcctcgtgccgaat

SEQ ID NO: 13505 - DNA, 694 bp, Triticum aestivum
  Clone ID: PAT_TA_13505
cgtccgccgagtcatgggttcctcccctgatcccccaccgcagtcagacggcggcgacgggcaggcgcgcggcggcgcggttccggcgctccgggcattctgcggcgacccccgcaatctccgtcgagcacggaagagcgacgcgcccgctgcgaggtccgggctcgcggctgctctgacggtctcagcatccgctctctcccctgactccggctagggctctagaattttcctggccccgcctggtgtagaatggcggcggcgacactgcgttgggtgatccagatgcaccgcgacgtgccacgggcggcacgattctacgcagaggggctcgacttcagggtcaacgtctgcacactccgttttgcagagctccagtcagggccattcaagctagcgctcatgcacactaatgacagtccatctgtcttcaagagcctattcttcgatgctgtccttcaccaaaccggacataaccagcacaataagaaagctaatgtctctgggagccgagttggacgggccgatcaaatacgagatccatgggaaagttgcagccttacgatgcatcgacgggcatgtgctgggtctgtacgagccagcctgaagaacctgttgttcaaacgcactggatgagaagcgattttcatcgctcgaagattagggatacgtgtgattgtttcttgtggcaacg

SEQ ID NO: 13506 - DNA, 481 bp, Triticum aestivum
  Clone ID: PAT_TA_13506
tttttttttttttttttttttgcaccgttctgtgatccgcggccatatctccacccggggcccccccttcactccaagccccaaatgcttgtcttgtcagaatctatctgagttttgacccaaaatgaaagggttctaaatctagttaaggctacatcagcactgaaccacgagtttttcagaaaccaaaataggtgccagctttgcacctctcacttgatagggagggggagttcctattcatgtatacgccggggtagttaaagtttgtcatgtctttaaccaaaaaaacaggtaaatgagacggcatgccgcactcgacctcagaaacccattccgctcatgtccggcatgcgactggcaattctggcttttgtcgacggaagctcagcgactgcggcctctgtggttgtcatcagcagagaaacgcttgctgcatcttgaagtgcagttcggatcaccttcacggggtcgatgatac

SEQ ID NO: 13507 - DNA, 871 bp, Triticum aestivum
  Clone ID: PAT_TA_13507
tttttttttttttttttttttttttttttcagtcgtttcaggggagccgagatgccggccaaccactgcggcaccgaggcaatacccataccagcagagataagctacagtttcatccaaggaatgaaccaaagaatcgcagagaagcagcaagccagcatcgccaaccccctaagatttcagaaccaaactacaagctacatgcattccacaatgcatcaccactccttcgctccctcccttcttcccaaccgggcatcatatatgcatctagtagagaaacaaaaacccaggcacacgcggaacagagtttcaaaagagaccttgcttagaccatctcatcccctggactgtcctgcgggctcctcaccacatcaagtatactcaacacctcgcccatgtccggccggttcgacggcacctgcgatgtgcaaacgaggcccagcttgatgatcggaatggcctcctccatcgcgaactcgccgcacagtcgcggatccatgcagtcctccagcctgccttcctccagcgcgcttctcaccaagtcacatagcacgaccacgtcatcttccaagtactcaacgggcctcctgcccgtcaagatttccagtgcaagcaccccaaagccgtagacgtcgcacttctcggtgatcttcaccgtcttgcatgcgaattctggcgccatatatccaagtgcactctggatcttactgctcagcacataccggtctaacatcgggagtaggcttgcaaggccatagtcaccgaccctgggctcaccattgccggccgcctgcacattgcttgacttgagattgtaatggacgacgccatgctggtggaggtgcatcagtcccctggcaacaccgat

SEQ ID NO: 13508 - DNA, 1097 bp, Triticum aestivum
  Clone ID: PAT_TA_13508
tttttttttttttttttttcacgacaacatcctgaccatatatgtataatgcacagttttgtggttgtggttccgctacagctgtcatgttgtctgtcggcgtcggacggacattacagacttacagtcctccacagggggaggagaacacaccggagggagaaaaaactgcagaaactattggtttatatgcacgtcggcaaacaacacctcctgtgatttcacagcccacagcacctcaaaacgcttaataacaactaggtgtaacaaggctcatcggggctgtaaaaaatctggaggggaaaaaccttccacggtcgcaaagtagcaccttttccaaacttcagcgtggttgaaacgacggtaggagagcagactagagatcataccctggtgcaacaccagtaaaaaaaacatataaatgcataaggtaaggcgtcaaagtttgatcgctgaactcttgcttcaaatctttctttttgtgaggatgattttggggtttggaagatggcgaaggttgctgctgtcaactgccaagcccatttctttggttaaagctggttgaggctgcacctcgtagttgtggagaagagaggcaaccaacatagagatcccaagaattgcaaacttctgcccaacacatgctcgattcccagaaccaaatggaagaaatgagtcagacttatcacgctcggtagaaaagcttgatcccatttgagcctttatgcgctgcttaatattcctcccaagatcgatgtccttctggagaaaaccactaggattgaactggcaagcatccatttccccatatagaagcatccatctcgcacgcagatgcagaggaacaaccaatatcgctccagctggcatagtgaggcttgatttgagagtcaaatcgtgttgcatagaacatcgctggagaagaggtccagcaggcaaaaggcgagcagattcacaaacagtggcaagtacaaattgcatcttaagcacatcgtccatcaccagctcaggcgattctgggtggacggcaactacgtcggcccgcctcccccagctttaaccaaagaaagtggacttggcagcggacgcggggtcga

SEQ ID NO: 13509 - DNA, 389 bp, Triticum aestivum
  unsure (1)..(389): unsure at all n locations
  Clone ID: PAT_TA_13509
tttgnccggnntttcttttttttttggctcctttgctcttaaatcacaactcagcagtgctatattattcaagaactataccggagatataatacatagcaacacagtcattgttaccatgtggacttatcgaataaagccattgttgtgcacattgaccacaatagttctcttataacagtttgcctaagaaatgcagtagtgaagatgctgcaggtcagatatggaattaggtctggtggtactaaccatcggcagttgagcagagtcgtgcagaacccgctagctctggtcgatcggacgcccagggttacccaatcagacggtgagcttgatttcgaagccgagggaggggtggatgtggtcggctggggatgtgacgacggcgg

SEQ ID NO: 13510 - DNA, 639 bp, Triticum aestivum
  Clone ID: PAT_TA_13510
accgattcccagttcgaggcgtccgacgtcgctataatcgtcagtagctggttacgtatggatccatttcttctttccatcatcttatgctcatgcatctttgctgcagtgtcttggaaaaaactcaatggaatgaggctaaggcttccaccgggacctccaagatggccaatctttgggaaccttctccagttgagtcctcttccccacaaggactttgctcgattttgcaccaagtatggcccccttgtctatcttcgtcttggaaccattgatgccatcaccactgatgaccctgaagtcatccgtgaaatacttatccggcaagacgaggtcttcgcttcacggcctcggacattggctgctgtccaccttgcctatggctgtggcgatgtggctcttgctccactggggccaaactggaagaggatgaggagggtttgcatggagcacctgcttaccaccaggcggcttgaatctttcgctgctcaccgagctgaggaagctgagcacctctgtgagtttgtatgggctaaatcccagtcaggtaagcctgtgaatctcagagaggttctcggggcattctcgatgaacaacgtgacgagaatgttacttggaaagcagtactttgggctgcag

SEQ ID NO: 13511 - DNA, 855 bp, Triticum aestivum
  Clone ID: PAT_TA_13511
gaacatcatccatagccagcagccacaatggaagcgagcgcgcaacaaggcaactatgtccaagtctacgtcatgctccctctggacatcgtgagcgtgaacaacaggttcgagaagggtgacgagctcagggggcaactgaagaggctggtagaggccggtgtggatggtgtcatggtagacgtctggtggggcttggtggagggcaagggccccagggtgtacgactggtccgcctacaagcaattgtttgagctggtgcatgaggctggactgaagttacaagccatcatgtcattccaccagtgtggtggcaacgtcggtgacgtcgtcaacatcccgatcccgcagtgggtgcgtaatgtcggagtgagtgatccggacattttctacaccgaccagcacgggactaggaacattgagtacctcacccttggagttgatgaccagcctctcttccatggaagatctgccgtccagatgtacgccgattacatggcaagctttagggacaacatgaaagaggtcttggatgccggtcttattgtagacattgaagccggacttggcccaactggagagtgaggtacccaatccaatctcagaagcacgaatggtcattcccaggcctcggagaattcaattgctattaaaaggccctgcaagcagacttcaaagacacagcagcgaatggttggccatcccaatggggaaatttctcgcgatgcccggacgaacaatggaccttccccagaacccgattttttcgggaccagggaacaaatttccattgtgcagggaggttttcctttggagggacccccaaaccccgaaaaagatgggggacacattttt

SEQ ID NO: 13512 - DNA, 884 bp, Triticum aestivum
  unsure (1)..(884): unsure at all n locations
  Clone ID: PAT_TA_13512
taggaacattgagtacctcacccttggagttgatgaccagcctctcttccatggaagatccgccgtgcagatgtatgccgattacatggcaagcttcagggacaacatgaaagagttcttggatgccggtgttattgtagacattgaagtcggacttggcccagctggagagttgaggtacccatcgtatcctcagagccacggatggtcattcccaggcatcggagaattcatctgctatgataagtacctgcaagcagacttcaaagcagcagcagcgatggttggccatcctgagtgggaatttcctcacgattccggaacgtacaatgacactcctgagagaactcgattcttcgtggacaacggaacatacctcactgagcaggggaggtttttccttgcatgggactccaataatctgatcaagcacggggacaagatcttggatgaaacacacaagggcttttttgggacacagagtgcaactggcaatcaaaattttccgggattcactggggggacaagggttcaaaggcatgctggccgagctcacagctgggtaactaacaccttacatggacagagaacggtgacagaaccattagcaccgcatgcctcaaaagggacacatgcctagcctttaaacttacttggcggccgcagatgagaggaacttggagcaaaagcttcgaaggcttaggagcggcacccanaataaactaagttcaatcagttgtttgaggtgcttggtttggagaagaagggtccttaaatgtgtggccatggcgatnaaacgcccactttcctcgaatatggatacccacatgggttttacaaaccacccatatatcttacgaatatgccgagcggcctncaatgct

SEQ ID NO: 13513 - DNA, 967 bp, Triticum aestivum
  Clone ID: PAT_TA_13513
gaacatcatccatagccagcagccacaatggaagcgagcgcgcaacaaggcaactatgtccaagtctacgtcatgctccctctggacatcgtgagcgtgaacaacaggttcgagaagggtgacgagctcagggggcaactgaagaggctggtagaggccggtgtggatggtgtcatggtagacgtctggtggggcttggtggagggcatgggccccaaggtgtacgactggtgcggctacaagcaatggattcggctggagcatgaggctggactgacgatccaagccttcatgcactgtacccagggggggggcaagggcatgtacgccttgcacaccgtgctcgccgggaggatcatcctcgacttgagtgatctttgagggcgacactgattgtaatcgcttctcaggaacgtgctatcagggggcccatccttcccccgtcgggaatggtgccggccctacaatgccaatagggataccgtatcttagccagggtgatacggtctagcatacctgaagaccgggcgcgcataagtaataaattaaccctagttacaattctgaggattctccggagaggtaactttctctgcctctgctgcttaggaacaaatagcgctctcctattcattctgcgctccacagaggatctatagtaacttcactactttatttcaaaatatgtattcttacagcataggcaattcttacagaacgctatggtctaaacggaatcgtgcattccacgtcataatcgtggcattgctatttcagactaatctataatcgacttctgcacgcgccatttgattaaaaaattcttgcgatatgcatatatgtactcttcttactgtttatcctccgactacaaacgtcattagctccaatgcatttatatagtcacgttttgcctcaattatgtcgttggcgcctgctgtaacattgacctagacctctggatgca

SEQ ID NO: 13514 - DNA, 684 bp, Triticum aestivum
  unsure (1)..(684): unsure at all n locations
  Clone ID: PAT_TA_13514
cttcgtggacaacggaacatatctcactgagcaggggaggtttttccttgcatggtactccaataacctgatcaagcacggtgacaagatcttggacgaagcaaacaaggtcttcttgggacacagagtgcaactggcaatcaaagtaagtaccatcatcctaaatatctcagtttcttataatagtactccctccgttccgaattacttgttttggatttgtttagatacggatgtatctagactcattttagtgctaaatacctccgtatctagacaaatctaagacaagtaattcggaacggatggagtacatggaagccaccgcacacaaatagactaagagagagagagagatagagagagagagggacggagggagagagagagagtccgtcccagcaggcagtagcgattaagctcttgagcgggtctggaacccattaggtgcggcggcagatggggactgttgtgtagcggccgtgatccggccgggcggaggacggctagaacaaccttctcggcggggctgctgcttggatcttgaacgacggcagacagcaagcatgatattgcttcgatcctacacggtgaggatgtactcnnntggttgggtgggctacggaaacaggggagcatcgtgttgaagaagatcaagtggaggggcgagagaatgcctcgtgc

SEQ ID NO: 13515 - DNA, 1178 bp, Triticum aestivum
  unsure (1)..(1178): unsure at all n locations
  Clone ID: PAT_TA_13515
ggaaaagttaatctctgggaaaggctttgcacttaatcctggacaaaaatattatttggttccttcgtcgtggttgtcagaatggagagcttacattacagcgactggaaaaaatgtttcgtcgttaccagaacctcaaagtcttgaagttgctataaattcacttaaatgtgaaaagcattctagattgttgcaaaggcctttggatatagtttacaagcgtgggggcatcactcagaaaacatcgaatactgatgggttagcaatcatctcagaatccgactggcaatcattctctgaggagtggaacgtggaacatgcagatggcgcatgtgctgaaattgtttttagtaagagctcagaggataaaccgcacgagtcgtctgaagcaatggtaatttcagataaagatccggaccagtctattaatggtgcaaatgatgacttggaggactgtagaccctatgtcagaactgatcctgaggtttgtgaagaatgtattggagaaagagagagctgtgcattggtggagaaactcaattaccagaacgaagatatccatgtttatcttgtgcgtgggaaagaagcaccaaagtcaattagggaggcatctgcagctcttcctgttccagatcgccggacttcaaagcgttctcggagaacaaccacagggaactcaatcagtttgaaagtctctgggttctacaaccgtctatcagttgaaactcatgatatgggaatctttagggattgtgaaggagaatcaagaagcttcataaaggccctcttggagatcgaaagaggatttgccgaccctggctggataagtgcatttcccctgggggatgttttgtggggttaaagatcctgaatgttttgaggacctngatatagcagatgaaattcaanaccnaagntggatgcactacctgctgaagaagttttcctggnacactattgacacaatgtacaactcaactttgtcaagacatataccatgnagatttcaagtgatctanacnctgcagcatacattggcacncgcnggtacctgctaaangancngagttggcaacaantacggatcgctggactggcggaattctcanggcgtcccgncttgcnttcancgtgaccaatntcaaaattnggaaagaagtcgacacccnccgagatat

SEQ ID NO: 13516 - DNA, 661 bp, Triticum aestivum
  unsure (1)..(661): unsure at all n locations
  Clone ID: PAT_TA_13516
aattcggcacgaggcgagnaatcctcctccccacacctccctcggcgccacttcgcagcccccagccgcaaccgcgccgtcaccgaccgctccccgtccggccgtcagattttgaaggttcacagcaggagagatggcaactctaaccagccttgcctcaaacccgaatccaaacaagtcattcgaggtcctgcctaatccgggtgactccctctcaagcctcagttttagcccgaaaagcaatcttctggtggcaacttcctgggataaccaggtgaggtgttgggagataggtaatggtaacagtcagccaaaggcatccatatcacatgatcagccagtgctctgctcagcctggaaagatgatgggactactgtcttctctggagggtgtgataaacaggtcaaaatgtggcctctgctgtctggtgggcaggctcagacggttgcaatgcatgatgcacctgtcaaggaggtctcttggatttctcagatgaatcttcttgtctcaggaagctgggacaagacgctaaggtattgggacacaagacagccaaatcctgcccatgttcagcaacttcctgatcgttgctacgcacttgctgtgaattatccccttatgattgggggaacagctgatcgcaatattgtgatcttcaac

SEQ ID NO: 13517 - DNA, 978 bp, Triticum aestivum
  unsure (1)..(978): unsure at all n locations
  Clone ID: PAT_TA_13517
gctcagtgagtgagtgagcacgcaagccagtgtttgtagccagcagccacaatggccgggaacatgctagccaactatgtccaagtctacgttatgctcccgctggatgtcgtgagcgtcgacaacaagttcgagaagggcgacgagatcagggcgcagctgaagaagctgacggaggccggcgtggacggcgtcatgatagacgtctggtgggggctggtggagggcaagggccccaaggcgtacgactggagcgcctacaagcaggtcttcgacctggtgcacgaggccgggctcaagctgcaggccatcatgtcgttccaccagtgcggtggcaacgtcggcgacgtcgtcaacatccccatcccacagtgggtgcgcgacgtcggagccaccgaccctgacattttctacaccaaccgcggcgggacgaggaacatcgagtacctcacccttggagtggatgaccagcctctcttccatggaagaacagccgtccagatgtatgctgattacatgacgagcttcagggaaaacatgaaaaagttcttggatgctggtaccatcgtggacattgaagtgggacttggcccagctggagagatgaggtacccatcctatcctcagagccagggatgggtcttcccgggcatcggagaattcatctgttatgataagtacctggaagcagacttcaaagcagcagcggcaaaggctgggccatcctgagtgggaattgcctgacgatgctggagaattacaacgacactcccgaaaaaacccaaattcntcaaaggacaacgggacaanacctcaacngagaangggaaatttttcctgtccatgggancccaacaaaactggtttaagcncnggntacaananttttgggccaaaccaaanaangtcttcctttgggaagcangggngcaaacngggaaaccaaaaatccctggnaaatccacngggggggaaaag

SEQ ID NO: 13518 - DNA, 540 bp, Triticum aestivum
  Clone ID: PAT_TA_13518
agtacttaccagctgttgcaagaattgtgttgtcagcacctatggcagatccctgagcagtcgcagtgccaggccatccacaatgttgttcatgctattattctgcatcaacaacaaaaacaacaacaacaaccatcgagccaggtatccttccaacagcctgtgcaacaatatccattaggccagggctccttccggccatgtcaacaaaacccacaggcccagggctctgtccagcctcaacaactgccccagttcgaggaaataaggaacctagccctacagacgctacctgcaatgtgcaatgtctacatccctccatattgcaccatcgcgccatttggcatcttcggtactaactgagaagaaaataactttagtactagatatatgaaacgccgttttctcagtccatggtttggtcgttgtaccggtgaaaaaataatgtgacatgcactatcatgtaagaacccttttgtataatagttcaaacttgggaataaaagacaaacacaggtcttgtctacatatttatgttgc

SEQ ID NO: 13519 - DNA, 806 bp, Triticum aestivum
  Clone ID: PAT_TA_13519
gttggagagcatcatccatagccagcagccacaatggaagcgagcgtgcaacaaggcaactatgtccaagtctacgtcatgctcccactggacgcggtgagcgtgaacaacaggttcgagaagggtgacgagctcaggccgcagctgaagaggctggtagacgccggtgtggatggcgtcatggtagacgtctggtggggcttggtggaggccaagggccctagggtctacgactggtccgcctacaagcagttgttcaagctggtgcatgaggctggactgaagctacaggccatcatgtcactccaccagtgcggtggcaacgtcggcgacgtcgtcaacatcccgatcccgcagtgggtgcgggacgtcggtgcgagtgatccggacattttctacaccgaccagcacgggactaggaacattgagtacctcacccttggagttgatgaccagcctctcttccatggaagatccgccgtgcagatgtatgccgattacatggcaagcttcagggacaacatgaaagagttcttggatgccggtgttattgtagacattgaagtcggacttggcccagctggagagttgaggtacccatcgtatcctcagagccacggatggtcattcccaggcatcggagaattcatcgtgagtgtttctaaatatgtttccttctgtttcgaccaatttacttttgcgtgtaacattgatgaccaaatgctgtttagtattgtccaaagtgacgatctacattagagaagtttcttcaacaaaccaacacccaaatgaaaagtgattcttgt

SEQ ID NO: 13520 - DNA, 1445 bp, Triticum aestivum
  Clone ID: PAT_TA_13520
tgacaatgaaaaggaaggagctgccccaaagcccaatgcattccagtccttgcttcctgctgttagggagaaaattgttgacggtttcactcaggaagctcgggacatgtttgaaagagagtttgatttttttgacaaggtcacctcgatttctggtgttcttttccctctccccaaggaagagcgaagagctggtattaaaagggagctggagaagattactattccaggtgacgacctctatctacctactgcaacaaacaagttagtacggggcatacagctggacagtggtattcctctccagtctgctgcaaaagttccaataatgattacttttaacgtgattgatcgtgacgggaacccaaatgatgtaatgccacaggcttgcatttttaaggttggtgatgactgtaggcaggatgtgctggcccttcaagttattgccctattaagggacatatttgaagcagtcggattaaacctgtatctctttccctatggtgttttgcccactggccctgaacgaggcataattgaggttgtcccaaatactcggagtagaaatcaaatgggtgaaacaactgatggtggtttattagaaatatttcagcaagattatggccctgtagggtcaccttcttttgaagctgcacgtcaaatgtttattgttagtagtgctggatatgctgttgccagcctgcttcttcaaccgaaggatcggcataatggcaatcttctctttgatagccaggggagactagttcatattgatttcggatttattttggagatttcccctggaggtaacatggggtttgagagtgcacatttcaagctaagccatgagatgactcaattgcttgatccatctggaactatgaagagtgacacctggaatcagtttctcagactctgtgtcaagggatacctagcgggaaggagacacatgaatggcattgtaactacagtacagttgatggtggacagtggactcccttgctttagcaggggagagcccattgctaatcttcggaagcggtttcatccagagatgaatgagcgcgaggcggccaatttcatggtacggacatgtgtcgatgcctacaacaaatggaccaccgctgggtacgatttgattcaatacttgcagcaaggtattgagaaatagttaatttcccattttgtaaatggtatgggtcgtgtacatcaattgtatgtagcacactaactccagcatgtagagttatattgagcagttcctttgtaccgagagaactgagaatgtatgtttaacagaggtgtgatgtattttcctattgaaagacagtctagctactcctagtaagtaagcccaatagtatcatcagttcaccgggtctttttgtaacagagcagcagattcaattctttgtcttatgcagtccaaaaaaaaaaaaaaaaaa

SEQ ID NO: 13521 - DNA, 882 bp, Triticum aestivum
  Clone ID: PAT_TA_13521
cacgcatgctcacaaggcatcatgctagcatgaacttcacttgtgcagagatgagggactcggagcaaagcgaagaggcgaagagcgcaccagaagaactagtccaacaggtgctgagtgctggatggagagagggtttacatgtggcgtgcgaaaacgcactcggtcgatttgatgccactgcttacaacacaatactcaggaacgcgagaccgaaaggcatcaacaagaatggccctcctgagcacaaactgtttgggttcacctacctccggttatcgaatgagctactggagggacagaactatgccactttccaaacttttgttgagaaaatgcatgctaacctgggtcatgacccaagtgttgatccagtggcgcctttggaaagatcaaagccagaaatgccaattgaaatgatcctgaaagcagcgcagccaaaactggagccattcccctttgataagaacaccgacctgccagttaaagatcacactgatgtcggggatgaggtgctccttgcccctgtgtagaaatctttctctaccttcataaaataatgtgcatcacttatgcagtctacgagagggtcaagaggcacttgtgagaattgaggtgcgcaggaaataagccgccgaggataaataaactgtgtgctacaatgttatagccatatagtgtggcaatactattgtactggtaacatgaggttgtatgcttttccgatgagctgcagttcataggaacttccgccccactttgctgtgtgtattcgagtgaataaataaaacagtttgtgcttgtaacttaatgatcgtgaagtttttagccgtataaatggaactgccgtccaggcttctgctgttaaaaaaaaaggggggg

SEQ ID NO: 13522 - DNA, 2468 bp, Triticum aestivum
  Clone ID: PAT_TA_13522
cccacgcgtccggtagttttcaaagaggccatacctattaaaaatatttctgtggtttcaaggatacatcaaacgtacagaatagggtatctaaaggatgttatattacccagaatattagatgatgccactctggctagtcttaacacgatgatacacgaacaatgctgctgttatttccttactgaaggatgatgcttgctttatccaagacttattctctaggatgagatcaccaaatatttctatggaattgaaaagagaattggtcctgttcttgcatgagttctgcactcttagtaagagtttgccgcttgtacaacaactacgactgtttcgggatctttcaggtgaaggtgtatttgaaattgtatctgatgtgttgcagagtcaagacagaaaaattgtttcggctgggacggatatcgttattctttttcttaatcaggaccctaacctattgaggtcatatattgtccagcaagaaggaaattctcttcttggacttttggttaaaggaatggtaactgactttggtgagcaaatgcactgtcaatttctggaaatcctccgtatattaatggattctttcactatgtctggagcacatagagacgtaattattgagattttctatgaaaggtaccttgactatttggttgatgtaatagcatcctcttgtccttcgaggagtgctacccgaacatcacctaactcagctctcgttggtggaaacactgaagtgcatcgtatcaagccagaaattctgttaaatgtctgcgaactattatgcttctgtgtagtccatcatccctatagaattaagtgcaacttccttatgaacaatgcgatagagaaaatccttaccatgactcgacgaagcgagaagtttttggttgttgcagctgtcaggtttatgcgcactattatatccagaaatgatgaacatcttattcgccatgttgtcaagtttaacttgttgaaaccaataattgatgcctttgtggaaaatggggatagatataacatgctacaatccggagtactcgaactgttggaacacatacggaaggaaaatctaaaacctcttgttatttatgttaccgagtctttctcagatcaacttatgaagtttgaacacttcgggagcattcaggccttcaaactcaagtatcaacagtacttggagagtgccgatatgaaattaagtgctagtgtgcctgacatgagaaagaaggcagaaggaagaggtcttgagaaggaagaggaagattatttcaatgagagtgacgaggaagattcagtaaggcggactaaacatgcacacagtgaacataatgaagaaagcaaggatgatgtagccaatggaagcgaaactggtgacatatcctcaaggcctaaatctggtgggcttgtggactatgccgatgatgatgacgaggatttcaatccgccacccaaggagcctgataggcccgtggatgacgatgagctcttaactatatccacagtgaagcggaaattagtgaacccgggggatggcaaacatgcagatggggaagttcgcaagagacaaaagattgaaacaaggattacttgtgccaagatttctgctttgactaatctggctagcaaacacaaggatacacttgcctcaagctcgccaagttgcgaggccaatggtgttttgggggagcatgctacacattctgatgagcatcaacattccacagacactgcagaaacctcacggcaagttggcggtgattgtatcaaagcaatgggcagtttgtctagtgagaaggctgtaaataccaccaaaataaacgattcagagccctatttagtgagatgacaaattgacagctcttctccacactggcttgccccaggattcgaccgatcaatgcttgccaaccgatcaatgcttgccaacaggaaggaacaacatgtttttggctctggagaaggctgaatctattaatctcaaatccagaagcatgattcgaggtgatgtaaatcgcacttctctgtaaatcttgaatgaaattgcagctaccatcacagcctgtaaagtaattcttccagaaggaaagatatgaaaatgagaattggcatgcctttcggttcagcattaatcgagtcacctctctctttctatgtatatctctttctctctctatatagagagagcaatgaatatatgaaactgagaattggcatgcactttctcccgtattgctttctaggatcattggcggagatgttgatgttgtaaaacaagtgggcaagaatagtttcagttgagagtgatattatccatatcttacagttgtaatttgtcgattagtagttttggctggatatactttgacttggatgagtaattaatttatatgatagaataatttattcaaaaggttgaacaagagtaattttgaatgaatatatggccatgtctttcagtc

SEQ ID NO: 13523 - DNA, 726 bp, Triticum aestivum
  Clone ID: PAT_TA_13523
atttgttggagagcatcatccatagccagcagccacaatggaagcgagcgtgcaacaaggcaactatgtccaagtctacgtcatgctcccactggacgcggtgagcgtgaacaacaggttcgagaagggtgacgagctcaggccgcagctgaagaggctggtagacgccggtgtggatggcgtcatggtagacgtctggtggggcttggtggaggccaagggccctagggtctacgactggtccgcctacaagcagttgttcaagctggtgcatgaggctggactgaagctacaggccatcatgtcactccaccaagtgtggtggcaatgtcggcgacgtcgtcaacatcccgatcccgcagtggggtgcggggatgtcggtgcgagtgacccagacattttctacaccgaccagcatgggactaggaacattgagtacctcacccttggagttgatgaccagcctctcttccatggaagatccgccgtgcagatgtatgccgattacatggcaagcttcagggacaacatgaaagagttcttggatgccggtgttattgtagacattgaagtcggacttggccccactggagagttgaagtacccatcgtatcctcagagccacggatgggcattcccagccatcgggaaaatcatctgctttgaaaagaacctggaagcagactttaaaacaacaaccacgatgggtgggccttctgaatggga

SEQ ID NO: 13524 - DNA, 2317 bp, Triticum aestivum
  unsure (1)..(2317): unsure at all n locations
  Clone ID: PAT_TA_13524
ggcggtccagcggcagcgaccgtctccgcctcctcctccccccagacgccacttcgagaatcctccaccctcccctccctcggcgccacttcgcagtccccactcgcagccgcgccgtccccagcagccgccgccgaccgctccccgtccggcagattttgaaggttcaaagaaggagagatggcaactctaaccagccttgcctcaaacccgaatccaaacaagtcattcgaggtcctgcctaatcctggtgactcgctctcaagcctcagttttagcccgaaaagtaatcttctggtggcaacttcctgggataaccaggtgaggtgttgggagataggtaatggtaacagtcagccaaaggcatccatatcacatgatcagccagtgctctgctcagcctggaaagatgatgggactactgtcttctctggagggtgtgataaacaggtcaaaatgtggcctctgctatctggtgggcaggctcagacggttgcaatgcatgatgcacctgtcaaggaggtcgcatggatttctcagatgaatcttcttgtctcaggaagctgggacaagacactgaggtattgggacacaagacagccgaatcctgcccatgttcagcaacttcctgatcgttgctacgcacttgctgtgaattatccccttatgattgtgggaacagctgatcgcaatattgtgatcttcaacttgcagaatcctcagactgagtttaagcgtattcaatcacctctgaaataccagacacggtgcgttgctgcctttccagatcaacaaggattcctggtgggttccatagaaggaagagttggtgtgcatcatattgatgattcacagcaaagcaaaaacttcacattcaaatgtcacagggaaggaaatgatatcttctctgtcaattcactcaactttcaccctgttcatcacacgtttgccacagctggatctgatggtgctttcaacttttgggataaggatagcaagcagagacttaaggctttcagtcggtgtcctcaacccattccttgcagtagcttcaataatgatggctcaatatttgcttatggggtctgctatgactggagccgtggtgctgagaaccataatcctgcaaatgcaaagacatccatctatctccacagtccgcaggaagccgaggtgaaaggaaagccaagaatcgcaacagggcggaagtgatggtggcatcctgcctgccgaaaagtcgatagttgtgcaagagatgatgtatattcaagggcctagtttcgctcgggccttgccttgccgtgccctctggatgttcttacgtggttcggccacctggtagatgaaaagcctactccagcaaccagtgataggttacttagccgtaggtcgtagcacatagccgcttctgtaatgcatagttgtccgaaggaatgttttccccatgttcttctgttgtgatatagtcaggtcagtgcgtagtcttttgaaaaggagaaagtcttcagtctctttgtaagtggtgaagatctttggaaatatgggcatgacttttggtggagttattctgataccatatatataatatatactccctccgttccgaattacttgtctatacggatgtatctagactcattttagtgctagatacctctgtatctagacaaatctaagacaagtaattcggaacggagggagtacatattatgtgtcatactgtcatcacatgtttgcaatccacggacatgaaataattgttctcaaggtttgcattttacctttattatgtataaaatggggcagtgggctgtgtgtcaaactgtactatcttgtgtagtgagtcaagtatctattttaataccacttggtattttctttctaggatgaacatcttattcgccatgttgtcaagtttaacttgttgaaaccaataattgatgcctttgtggaaaatggggatagatataacatgctacaatccggagtactcgaactgttggaacacatacggaaggaaaatctaaaacctcttgttatttatgttaccgagtctttctcagatcaacttatgaagtttgaacacttcgggagcattcaggccttcaaactcaagtatcaacagtacttggagagtgccgatatgaaattaagtgctagtgtgcctgacatgagaanagaggcagaaggaagaggtcttgagaaggaagaggagattatttcaatgagagtgacgaggaagattcagtanggcggactaaacatgcacacagtgaacataatgaaggaagcagggatgatgtagccaatggaagcg

SEQ ID NO: 13525 - DNA, 877 bp, Triticum aestivum
  Clone ID: PAT_TA_13525
gctccaccgcggtggcggccgctctagaactagtggatcccccgggctgcaggaattcggcaccaggaacatcatccatagccagcagccacaatggaagcgagcgcgcaacaaggcaactatgtccaagtctacgtcatgctccctctggacatcgtgagcgtgaacaacaggttcgagaagggtgacgagctcagggggcaactgaagaggctggtagaggccggtgtggatggtgtcatggtagacgtctggtggggcttggtggagggcaagggccccagggtgtacgactggtccgcctacaagcaattgtttgagctggtgcatgaggctggactgaagttacaagccatcatgtcattccaccaagtgtggtggcaacgtcggtgacgtcgtcaacatcccgatcccgcagtgggtgcgtaatgtcggagtgagtgatccggacattttctacaccgaccagcacgggactaggaacattgagtacctcacccttggagttgatgaccagcctctcttccatggaagatctgccgtccagatgtacgccgattacatggcaagcttcatggacaacatgaaagagttcttgggatgccggtcttattgtagacattgaagtcggacttggcccagctggagagttgaggtacccatcctatcctcagagccacggatggtcattcccaggcatcggaaaattcatctgctatgataagtacctgcaagcagactttaaaacagcaacagcgattgttggccctcctgagtggggatttccctccgatgccgggacgtacaatgaccttccccaaaaaactcgattctttgtggacaacggaacatattttactttaaccggggaggtttt

SEQ ID NO: 13526 - DNA, 1870 bp, Triticum aestivum
  Clone ID: PAT_TA_13526
ccacgcgtccgaaccaagctcggtgagtgagtgagcacgcaaaccagtgtttgtagccagcagccgcaatggctgggaacatgctagccaactatgtccaagtctacgttatgctgccgctggacgtcgtgagcgtcgacaacaagttcgagaagggcgatgagaccagggcgcagctgaagaagctgacggaggccggcgtggacggcgtcatgatagacgtctggtgggggctggtggagggcaagggccccaaggcgtacgactggagcgcctacaagcaggtcttcgacctggtgcacgaggccgggctcaagctgcaggccatcatgtcgttccaccagtgcggtggcaacgtcggcgacatcgtcaacatccccatcccacagtgggtgcgcgacgtcggcgccaccgacccggacattttctacaccaaccgcggcgggacgaggaacatcgagtacctcacccttggagtggatgaccagcctctcttccatggaagaacagccgtccagatgtatgctgattacatgacgagcttcagggaaaacatgaaaaagttcttggatgccggtaccatcgtggacattgaagtgggacttggcccggctggagagatgaggtacccatcctatcctcagagccagggatgggtcttcccgggcgtcggagaattcatctgttatgacaagtacctggaagcagacttcaaagcagcagcggcaaaggctggccatcctgagtgggaattgccagacgatgctggagagtacaacgacactcccgagaaaacccaattcttcaaggacaacggaacatacctcaccgagaaggggaagtttttcctgtcatggtactccaacaaactgatcaagcacggtgacaagatcttggacgaagcaaacaaggtcttcttgggatgcagggtgcagctggcaatcaaaatctctggcattcactggtggtacagggttccaaaccatgcagccgagctcacagccgggtactacaacttagatgacagagacggctacagaaccatagcacgcatgctcacaaggcatcatgctagcatgaacttcacttgtgcagagatgagggactcagagcaaagcgaagaggcgaagagcgcaccagaagaactagtccaacaggtgctgagtgctggatggagagagggtttacatgtggcgtgcgaaaacgcactcggtcgatatgatgccactgcttacaacacaatactcaggaatgcgaggccgaaaggcatcaacaagaatggccctcctgagcacaaactgtttggattcacctacctccggttatcgaatgagctactggagggacagaactatgccactttccaaacttttgttgagaaaatgcatgctaacctgggtcatgacccaagtgttgatccagtggcgcctttggaaagatcaaagccagaaatgccaattgaaatgatcctgaaagcagcgcagccaaaactggagccattcccctttgataagaacaccgacctgccagttaaagatcacactgatgtcggggatgaggtgctcgttgcccctgtgtagaaatctttctctatcttcataaaataatgtgcatcactgatgcagtctacgagagggtcaagacttgctttgtgagaattgaggtgcacaggaaataagccgccgaggataaataaactgtgtactacaatgttatagccatatagtctggcaatactattgtactggtaatcatgaggttgtatgctttttcgatgagctgcagttcatcggaactccgtcccactttgctgtgtgtatttgattgaacaaataaaacagtttgtgcttacaaaaaaaaaaaaaaaaaa

SEQ ID NO: 13527 - DNA, 1040 bp, Triticum aestivum
  Clone ID: PAT_TA_13527
tcgaacttaaccctactaaagggaacaaaagctggagctccaccgcggtggcggcccgctctagaactagtggatcccccgggctgcaggaattcggaacgagggatcatccacacagccagcagccacaatggaagcgagcgtgcaacaaggcaactatgtccaagtctacgtcatgctcccttctggacgccgtgagcgtgaacaacaggttcgagaagggtgacgagctcagggagcaactgaagaggctggtagaggccggtgtggatggtgtcatggtagacgtctggtggggcttggtggagggcaagggccccagggcgtacgactggtccgcctacaagcagttgctccagctggtgcatgaggctggactgaagctaaaggccatcatgtcattccaccagtgtggtggcaacgtcggtgatgtcgtcaacatcccgatcccgcagtgggtgcgggacgtcggtgcgagtgatccggacattttctacaccgaccagcacgggactaggaacattgagtacctcacccttgggagttgatgaccagcctctcttcatggaagatctgccgtccagatgtatgccgattacatggcaagcttcagggacaacatgaaagagttcttggatgccggtgttattgtagacattgaagtccggaccttggcccggctggagagttgaggtaccccatcctatcctcagagccatggatggtcattcccaggcatcggagaattcatctgctatgataagtacctgcaagcagacttcaaagcagcagcagcgatggttggccatcctgagtgggaatttcctcgcgatgccggacagtacaatgacactccccagagaactcgattcttcgtggacaacggaacatatctcactgagcaggggaggtttttccttgcatggtactccaataacctgatcaagcacggtgacaagatcttggacgaagcaaacaaggtcttcttgggacacagagtgcaactggcaatcaaaatctctggcattcactggtggtac

SEQ ID NO: 13528 - DNA, 1897 bp, Triticum aestivum
  Clone ID: PAT_TA_13528
ggcacgagagtgagtgagcacgcaagccagtgtttgtagccagcagccacaatggccgggaacatgctagccaactatgtccaagtctacgtcatgctcccgctggacgtcgtgagcgtcgacaacaaattcgagaagggcgacgagatcagggcgcagctgaagaagctgacggaggccggcgtggacggcgtcatgatagacgtctggtgggggctggtggagggcaagggccccaaggcgtacgactggagcgcctacaagcaggtcttcgacctggtgcacgaggccgggctcaagctgcaggccatcatgtcattccaccagtgcggtggcaacgtcggcgacgtcgtcaacatccccatcccacagtgggttcgcgacgtcggcgccaccgaccccgacattttctacaccaaccgcggcgggacgaggaacatcgagtacctcacccttggagtggacgaccagcctctcttccatggaagaactgccgtccagatgtatgctgattacatggcgagcttcagggaaaacatgaagaagttcttggatgccggtaccatcgtggacattgaagtgggacttggcccagctggagagatgaggtacccatcgtatcctcagagccaaggatgggtcttcccaggcatcggagaattcatctgttatgataagtacctggaagcagacttcaaagcagcagcggcgaaggctggccaccctgagtgggaattgcctgacgatgctggagagtacaacgacactcccgagaaaacccaattcttcaaggacaacggaacatacctcacagagaaggggaagtttttcctgtcatggtactccaacaaactgatcaagcacggtgacaagatcttggacgaagcaaacaaggtcttcttgggatgcagggtgcagctggcaatcaaaatctctggcattcactggtggtacagggttccaaaccatgcagccgagctcacagctgggtactacaacttagatgacagagacggctacagaaccatagcacgcatgctcacaaggcatcatgctagcatgaacttcacttgtgcagagatgagggactccgagcaaagcgaagaggcgaagagcgcaccagaagaactagtccaacaggtgctgagtgctggatggagagagggtttacatgtggcgtgcgaaaacgcactcggtcgatatgatgccactgcttacaacacaatactcaggaatgcgaggccgaaaggcatcaacaagaatggccctcctgagcacaaactgtttggattcacctacctccggttatcgaatgagctactggagggacagaactatgccactttccaaacttttgttgagaaaatgcatgctaacctgggtcatgacccaagtgttgatccagtggcgcctttggaaagatcaaagccagaaatgccaattgaaatgatcctgaaagcagcgcagccaaaactggagccattcccctttgataagaataccgacctgccagttaaagatcacactgatgtcggggatgaggtgctcgttgcccctgtgtagaaatctttctctatcttcataaaataatgtgcatcactgatgcagtctacaagagggtcaagacgtgctttctgagaattgaggtgcacaggaaataagccgccgaggataaataaactgtgtactacaatgttatagccatatagtctggcaatactattgtactggtaatcatgaggttgtatgcttttccgatgagctgcagttcatcggaactccgtcccactttgctgtgtgtatttgagtgaacaaataaaacagtttgtgcttataacttaatgattgtgaaggtttttagcagtataaatggagctgccgtccaggcttctgctgc

SEQ ID NO: 13529 - DNA, 1984 bp, Triticum aestivum
  Clone ID: PAT_TA_13529
aaccctcactaaagggaacaaaagctggagctccacccgcggtggcggcccgctctagaactagtggatcccccgggctgcaggaattcggcaccagaagtctacgtcatgctccctctggacgccgtgagcgtgaacaacaggttcgagaagggtgacgagctcagggagcaactgaagaggctggtagaggccggtgtggatggtgtcatggtagacgtctggtggggcttggtggagggcaagggccccagggcgtacgactggtccgcctacaagcagttgctccagctggtgcatgaggctggactgaagctaaaggccatcatgtcattccaccagtgtggtggcaacgtcggtgatgtcgtcaacatcccgatcccgcagtgggtgcggaatgtcggtgcgagtgatccggacattttctacaccgaccagcatgggactaggaacattgagtacctcacccttggagttgatgaccagcctctcttccatggaagatctgccgtccagatgtatactgattacatggcaagcttcagggacaacatgaaagagttcttggatgccggtgttattgtagacattgaagtcggacttggcccggctggagagttgaggtacccatcctatcctcagagccatggatggtcattcccaggcatcggagaattcatctgctatgataagtacctgcaagcagacttcaaagcagcagcagcgatggttggccatcctgagtgggaattccctcgcgatgccggacagtacaatgacgctccccagagaactcgattcttcgtggacaacggaacatatctcactgagcaggggaggtttttccttgcatggtactccaataacctgatcaagcacggtgacaagatcttggacgaagcaaacaaggtcttcttgggacacagagtgcaactggcaatcaaaatctctggcattcactggtggtacaaggttccaagccatgcagccgagatcacagctgggtactacaacttacatgatagagatggctacagacccatagcacgcatgctcaaaaggcaccgtgctagtcttaacttcacttgcgccgagatgagggactcggagcaaagctcacaggccatgagcgcaccggaagaactagtccaacaggtgttgagtgctggatggagagagggcctaaatatggcatgcgaaaatgcacttcctcgatatgatccaactgcttacaacaccatactcaggaatgcaaggcctcatggcatcaacaagagcggccctcctgagcacaagctgtttggattcacctacctccggctgtcgaatcagttggtggagggacaaaactatgtcaatttcaagacctttgttgacagaatgcatgccaacctgcctcatgacccatgtgttgatccagtggcgcctttgcaaagatcagggccagaactgacgattgaaatgatcctacaagcagcgcagccaaaactggatccattcccctttgaagagcacaccgacctgccagttcaaggcctcggtggcatcggtggggatgttgaaggccccactggtggcatgggtggggaggttcaagaccccactggtagcatgggtggggagctccctgccaccgtgtaatgaaacctttatgatctacagtaccttttatgttgtgtgtgacagagaaacctttctctgccttattaataacaataaataaagcacatcacttgtgcgtgttctggaagaaaaatctcagtgctggaagggttaatcttctctttgtgagaattaaccgtgccctagaaataagccgatgaggataaataagatgtggtgctacagtacatcatgaggattactcatcaatattggattagtcatcaagaggatgcttttcctatgagctgtagtacatcagaccttacatacctccattatgtgcatatgagtgaatgaacaaactattttgtgctcattt

SEQ ID NO: 13530 - DNA, 2075 bp, Triticum aestivum
  Clone ID: PAT_TA_13530
tcggcacgaggatttgttgtagaacatcatccatagccagcagccacaatggaagcgagcgcgcaacaaggcaactatgtccaagtctacgtcatgctccctctgggacatcgtgagcgtgaacaacaggttcgagaagggtgacgagctcagggggcaactgaagaggctggtagaggccggtgtggatggtgtcatggtagacgtctggtggggcttggtggagggcaagggccccagggtgtacgactggtccgcctacaagcaattgtttgagctggtgcatgaggctggactgaagttacaagccatcatgtcattccaccagtgtggtggcaacgtcggtgacgtcgtcaacatcccgatcccgcagtgggtgcgtaatgtcggagtgagtgatccggacattttctacaccgaccagcacgggactaggaacattgagtacctcacccttggagttgatgaccagcctctcttccatggaagatctgccgtccagatgtacgccgattacatggcaagcttcagggacaacatgaaagagttcttggatgccggtcttattgtagacattgaagtcggacttggcccagctggagagttgaggtacccatcctatcctcagagccacggatggtcattcccaggcatcggagaattcatctgctatgataagtacctgcaagcagacttcaaagcagcagcagcgatggttggccatcctgagtgggaatttcctcgcgatgccgggacgtacaatgacactccccagagaactcgattcttcgtggacaacggaacatatctcactgagcaggggaggtttttccttgcatggtactccaataacctgatcaagcatggtgacaagatcttggacgaagcaaacaaggtcttcttgggacacacagtgcaactggcaatcaaaatctctggcattcactggtggtacaaggttccaagccatgcagcccgaggtcacagctgggtactacaacttacatgatagcagacggctacagacccatagcacgcatgctcaaaaggcaccatgctagtcttaacttcacttgcgccgagatgagggactcggagcaaagctcacaggcgatgagcgcaccggaagaactagtccaacaggtgttgagcgctggatggagagagggcctaaatatggcatgcgaaaatgcacttcctcgatatgatccaactgcttacaacaccatactcaggaatgcgaggcctcatggcatcaacaagagcggccctcctgagcacaagctgtttggattcacctaccttcggctgtcgaatcagttggtggagggacaaaactatgtcaatttcaagacctttgttgacagaatgcatgccaacctgcctcatgacccatgtgttgatccagtggcgcctttgcaaagatcagggccagaactgacgattgaaatgatggctacaagcagcgcagccaaaactggagccattcccctttgaagagcacaccgacctgccagttcaaggcctcggtggcatcggtggtggggaggttgaagaccccactggtggcatgggtggggaggttcaacaagaccccactggtggcatgggtggggaggttcaacaagaccccactgggtggcatgggtggggaggttgaagaccctaccggtggcatgggtggggagctccctcccaccgtgtagtggaaacctttactatctacaataccttttatgttgtgtgtcacagagaaacctttctctgccttattaacaataaataaagcacattacttgtgcgtgttctggaagaaaaatctcagcgttgtagtctacgagaagggttaatcgtctctttgtgagaattgacgcgccctaaaagtaagccgatgaggataaataagatgtggtgctacggtacatcatgaggattactcatcaatattggattagtcatcagaaggatgcttttccgacgagctgtagtacatcagaccttacatacctccattatgtgcatatgagtgaatgaataaagtatattgtgctcatttagtgattgtaaaaaaaaaa

SEQ ID NO: 13531 - DNA, 2010 bp, Triticum aestivum
  Clone ID: PAT_TA_13531
tgattacgccaagctcgaaattaaccctcactaaagggaacaaaagctggagctccaccgcggtggcggccgctctagaactagtggatcccccgggctgcaggaattcggcaccagatttgttggagagcatcatccatagccagcagccacaatggaagcgagcgtgcaacaaggcaactatgtccaagtctacgtcatgctcccactggacgcggtgagcgtgaacaacaggttcgagaagggtgacgagctcaggccgcagctgaagaggctggtagacgccggtgtggatggcgtcatggtagacgtctggtggggcttggtggaggccaagggccctagggtctacgactggtccgcctacaagcagttgttcaagctggtgcatgaggctggactgaagctacaggccatcatgtcactccaccagtgcggtggcaacgtcggcgacgtcgtcaacatcccgatcccgcagtgggtgcgggacgtcggtgcgagtgatccggacattttctacaccgaccagcacgggactaggaacattgagtacctcacccttggagttgatgaccagcctctcttccatggaagatccgccgtgcagatgtatgccgattacatggcaagcttcagggacaacatgaaagagttcttggatgccggtgttattgtagacattgaagtcggacttggcccagctggagagttgaggtacccatcgtatcctcagagccacggatggtcattcccaggcatcggagaattcatctgctatgataagtacctgcaagcagacttcaaagcagcagcagcgatggttggccatcctgagtgggaatttcctcacgattccggaacgtacaatgacactcctgagagaactcgattcttcgtggacaacggaacatacctcactgagcaggggaggtttttccttgcatggtactccaataatctgatcaagcacggtgacaagatcttggatgaagcaaacaaggtcttcttgggacacagagtgcaactggcaatcaaaatctccggcattcactggtggtacaaggctccaagccatgcggccgagctcacagctgggtactacaacttacatgacagagacggctacagacccatagcacgcatgctcaaaaggcaccatgctagccttaacttcacttgcgccgagatgagggactcggagcaaagctcgcaggcgaggagcgcaccagaagaactagtccaacaggtgttgagtgctggttggagagagggcctaaatgtggcatgcgaaaacgcacttcctcgatatgatccaactgcttacaacaccatactcaggaatgcgaggcctcatggcatcaacaagagcggccctcctgagcacaagctgtttggattcacctaccttcggttatcgaatcagctggtagagggacaaaactatgtcaatttcaagacctttgtcgacagaatgcatgccaacctgcctcatgacccatgtgttgatccagtggcgcctttgcaaagatcagggccagaactgacgattgaaatgatcctacaagcagctcagccaaaactagagccattcccctttgaagagcacaccgacctgccggttcaaggcctcggtggcatcggtggtggggaggttgaaggccccactggtggcatgggtggggaggttcaagaccccactggtggcatgggtggggaggttcaagaccccactggtggcatgggtggggagctcccggccaccatgtagtgaaacctttattatctacagtaccttctatgttgtgtgggacagagaaacctttctctgccttattaatagtaataaataaagcacatcacttgtgcgtgttctggaaaaaagatcttcagtgttgtagttttcgaaaaatgtttaaggcctcattggtatcatgggtggggagttccttgcccccgtgtaatggaatatttatgatctaccttatattttgtgaaaaaaaaaaaaaaaaa

SEQ ID NO: 13532 - DNA, 914 bp, Triticum aestivum
  Clone ID: PAT_TA_13532
aacttaaaaataatgaataaattcgataccgccattagcttgcagcaacaacggggggaattttctccctggaattttgaatacagctactacattcagagatctctgaacgagggcaacacgacgggatcagctaaaattagcactaccccacttttttatttaactcacatgcaatgcaacactttttacagggcgcaagccacaggcaggctagcggttcaagaacaaaaaatggggaaccggagcaaaatagttaatcaaaagatggggtctactggcagctttttcttgggcggggacctctcaattatctgcttctgcatgtccatgaagcttaaccccttgtgtgcaaacatcctccgtccgcggatcgtgggcggccgcgtgggcggccgcgtgggcgggcgcgtgggtttgtgaacgtcacaatacaatcactgatgaggattacccctttgagaaatttctttctcatacctgaaaattatcagcatagcaaatccccactggttcatcggtttggagaactaactcgcaagatttggcatgctaggaacttcaagggccaagttagtccacatgagtttcttcaagcagttatgaaggctagtgagaagaagtttcagattggtgtacaatctgacccagtggaatttatgtcatggctcttgaacacactgcatgcaaaactaagaagttcaaagaagaaaaatagaagcatcatatatgattgctttcagggagaacttgaagttgtgaaggaaattcacaggaagcatttagtggatgatgagcagaatggcgaggcaggttcacaggttgaaacaacaagtgacggtatggtcactcaaacatctcgggtcccattcttgatgctcggtcttgacctgccaccaccaacacttttcaaa

SEQ ID NO: 13533 - DNA, 1725 bp, Triticum aestivum
  Clone ID: PAT_TA_13533
gtttttcgagttccacataaggaatgtcgagctgcgcggggactaccttgcactaggcactgttaatctacatgtcccttctaaatgatgaataaagtcgataccgccattagcttccagcagcaacggcgctggttgtaacggcggcaattttcttcctagtaatttcaaatacagctactacattcagagatatctgaacgagtgtaacacgacgggatcacctaagatcagcactacgccactatcttatctaactcacatgcaatgcaacactatatacagatgcgcaagccacaggctgctggctagcggttcaacgaccagaagatggggtaaccggcagcaaaatagttagccagaagatgggtgtcctagctgtcagcttcctcctttggggtgggggacctctcagattatctgcttcgtgcatgtccattgaagcttaaccccttgctgtgcaaacatccttccgaggttgatcaccgagagctcactgtatctcgcgacagcaaggtccgcttgttccagctcatacgcaggatgagcaccaatcaaggaaactgccatcatagtgcagtggtgagcagctgtaacgcctcttgggtcatcctcaaacactatgcagttcgagggcttccgatccaacttaacagcagctgagagaaacctatgtgctattgactccatatcatcctcatcggtcacaattgccttgaagtatttgcttaaggacatcctgtccaaagcttcaaccatgcatctcctatccagggatgatgccacagcgcagggtatacctgctgtccgaactgcatccaaccattctctcaatccttctactggggtatcaagtttgaagaggctttcatagtaaagctcgataaggcgtgccttcaatctttccatttgatcatcctcttttgcccaatacaaaacctttctaaggacatggtcagcagcaccatgaagaatactcttttggatatgagcagcagtagggatgtccttcccttcctccaaagcaagctgtctccaagcatccaactttagcgagtctgtgtcagcaataacattgtcccatgagaaaattagaccaaatgcttcatccggcttcatagcatgccttatcctttgaaggaagcattcttgcaatttttcgttaagataatccacatcgatattgagtggtccgtccatcctgaaagtctcaaatccttccccatattcagctccaattgtctcctcgacgaagactttgcctgggaggggcgggaaggcatcaaaacccgacgccatcctccgcatccgcatctgcctcccatttcttgctctggcgaaccggagactggggcacggcgcgcgaggggacgaggaggaggacggagccgaggggaacggcgaaggagaggtggcggtgcggaagctgcacgactccatggaaatgggaaggggaaagaggcgaggatggtttacaagctaatttatatgcctgaggcaaatttttgagggcttgagtgttgtatgtccgaatttaattccttgagaagtagaagaatctgaggaactcggatgcactgttagtttcttgacgccgccatggagagattccaggagccagcagctgtaagatgtaaaaaacgtacccgcactcttcgagagctcgttgaattctccgagcattggtttttaccaggaatgcgctgttccatcataaaaaaaaaa

SEQ ID NO: 13534 - DNA, 1020 bp, Triticum aestivum
  Clone ID: PAT_TA_13534
agagccggccgcgcgccttccccgaacggaaatgccagtggcattccagtgaacccacccccgacctaggtccggacaccgccgctgcaatggctacggccatctccgcctccgcgctcctctcctccgcattcgccggcgataggcgccaccgccgcgcggcgaggcccgcgccccgccgcgccgtcccggctggcctcacggtgcggtgcgagcagagcgacaagcagaagcggcagcctctttccgcactcgttccccgcgagcagcgcttcatgttcgagggcgacgagctctgcggacccgacatatggaacacaacatggtaccctaaggctgcagatcacgtaactaccgagaagacgtggtatgttgttgatgcagaggacaagattcttggcaggctagcatctgctatcgcagtgcatatgagagggaaaaatgagcccacatacactccaagtgtggacatgggggcttttgttattgtggttaatgcagagaaggttgctgtttctggtaaaaagcggtcacagaagctctataaaaggcactctggacggcccggtggaatgaaagaagaaacttttgatcagcttcagaaaaggattccggagagaattatcgaacatgctgtgcgtggcatgcttcctaagggcaggctgggaagaagactatttacccacctcaaggtgtacaaaggatcagagcacccgcatgtggctcaaaaacctgttccactgcccatcagagacaaaagaataatgaagtctggctagagaacccctggatattgaaaaaagatacagcaaccgtgcttccctgcccagtgttaggagcgtgacccgaacattcatgtcatctgtccacaagagtggtgtgtaatttttttgtaatttaattatgtttctgcaaaagctttcgattcctttcggtcataattatgtcgtatggtacgatttgatggaatccaaaatctgagttttggaaggtgtaaaaaaaaaaaaaaaaaaactcgag

SEQ ID NO: 13535 - DNA, 323 bp, Triticum aestivum
  Clone ID: PAT_TA_13535
tttttttttttttttttttttttttgcaaacgtgtacagttctgttcttttacaactgtccacaaatgtaatacatgataacttgggaggaacatatacaactttcggttactctatacatgacaggcagagccaactattacaatcatcctttggttaattaccgaaccggtccacaacagtaagtgcaatggttgtagtcaaaaacaatgggcgaactgggccaagcatctaaaggtcctttggttagagcaggtctaccctttcacccacagcaagtacctcggccgccaccacgcctccatattcacccaaaaggatac

SEQ ID NO: 13536 - DNA, 805 bp, Triticum aestivum
  Clone ID: PAT_TA_13536
tttttttttttttttttttttttttttccacaggaggaaaaatcatattttggataaaactgttggattacaattgtggatattacaggaggaacatcatccagatttgatgcaaaatctaaacatttttcttgacagaaaaacttaaacaaaaaggcttccatcaacatccctacaacttgaactaaaacttaatcgaggaacaacatccaacaggaacaacatccctacaacttaactaatcctgaaagcatccaccgtcatcatcatcattgcagtatacttgccacccacccatataatcatccatatatcttttgaatcggctatggtcgttttcatgtctccgctccacaccctctgttttcacatgtgccacattgacatgcactgttatgattatcaaaagacaccggcattcaagggcaatgtgagtgacagtaccacttctcttctcttctctctagttagttaacaaacaaccatggcatcgtccatgacatgctccacttactcgacttgctccatggcgtccccctgcatagagttggtgtgtgtggctataaacatcaaagtgaaatggctggctggggcagcagtgcagccctaatgtttggaactttgattatgtggtgctgctggaggcgattggagctgcagaccaccccaacaagatgcattcacagccttgttgttgctcgggacaaagcagtcatggagctttcctcctcccccttcaggcagtgaatggggaggagctttcctcctccggacgcgtgggtcgacccgggaattccggaccggt

SEQ ID NO: 13537 - DNA, 926 bp, Triticum aestivum
  Clone ID: PAT_TA_13537
attcggcacgaggcgatcccctttccccttcgtcgtcacccacacgtccggcggacccggggcgggcgcgcggctcccgtcgcacaacccggcaagcgggcccatccgggttggagaccgtggaaggcccgcgcccctcccggccggttgttccccgctgcgagccgccgcgcgcgaggtcccatgagagaaccacaccgcctcgccctcctggtggccggcgagatggcctcagcagcgtacctcgagacggacgagaacctggaggccctcatcagccgcatcgagcagaagtcccgcaagatcgagaccctcctcaagcagtccaagccggtggaggccctgaagacggcgctcgaggggtcgcccctcaagacccgcgacgagcgatgcaagtcggcgaactggatcgtggtgcaccgcgccatgatggcgatcagggacatcgacggcatgttcaactcactggacaccgagtactacgacatcctcatgaagtacctgtacagaggtttgtccactggcgaccggccgacgtgcgaccagtgcctcaaaatccatgagaagctgacggagagagctggcttaggatgcatactgcggtcactcgccgacactgtaaacaccgtgtgaacctccttcgtcttcattaagttcctatgctgtgaagatcccgtcaggtcgaattagttctatggactttataaatgcagaaggtgattgttgacctcttctctttgctgtttggcagcttcatggatactctctctataaactaatataagagcgtttagatcattaaaatacgaagggagtagataagagcattgttgtattgtgccatatttgctgctagtttgcttagttgcatcttgattacaagatagggattttagatccttctttctggcatgaaactcgatcag

SEQ ID NO: 13538 - DNA, 574 bp, Triticum aestivum
  Clone ID: PAT_TA_13538
cgtccgcggacgcgtgggcggacgcgtccggccggaggtcgatcgatacatcgtgaagaagtagacatacagagtgctcgatcgagatgccggagtactgcgtgaccggcgggacggggttcatcgcgtcgcacctgatccgggcgctgctggccgccgggcacacggtgcgggccacggtgagggaccccagcgacgaggccaaggtcgggttcctgtgggacctggagggggccgacgagcggctgcagctgctgcgcgccgacctgctcgtggagggctccttcgacgcggccgtgagcggcgtggacggcgtcttccacgccgcctcccccgtcgtcgtcagctacgaggacggcaaggacgcgcaggagaagctggtggacccgatcgtgaacggcgcgggcaacgtgctccgctcctgcgcccgggccgcggtcccgccgcgccgcgtggtgttcacctcctcctgctcctgcgtgcggtaccggcaccaccacgtgcacgggggcgccccgccgacgctgaacgagtcccactggagcgaccccgactactgccggacgtacgggct

SEQ ID NO: 13539 - DNA, 508 bp, Triticum aestivum
  Clone ID: PAT_TA_13539
tttttttttttttttttttttttttttttttttgacaaaccctgccccgatagtgctggtaattaatgtgtgaaaaatggcaaatatgcggtgttagcatccacacatcagcagctttataagagttgccactggtatgccactttgcatgttcacggacatacaactcacaaaataaagatgtaggatctaaatgacacccaagcaggtttagttgcccgctggtatatttactcgcaacaacagccgctaaggtactgtaaacaaagccaagctaaattacgatgacataacctgagcaacggcacatggtacatttgcagaacataaatatctttacagtgtatctatatgaataactctctccagcaaagcttgcccccaggtttcaaggcacagcaatctaactccataacaccttcaatcaagcaaacccactttctcgatcacaagtattccgcatcttgcacctcaagtttgctcaacggggtcgcgtttgctttcttga

SEQ ID NO: 13540 - DNA, 850 bp, Triticum aestivum
  unsure (1)..(850): unsure at all n locations
  Clone ID: PAT_TA_13540
cgtccgcccacgcgtccgctctcttcttcatctggggtacgtagtgcgccgtgcccgtgcgccagcggttcttgggcgagatggcggacaaggaaggggaaagccgacgcccgctataagccatggcagcggcggcgtcagggtgcagcgaggacggagactgaagccgtcgacgacactgccggtacttcgtcgcggacttcagggcggacggagactgccggcgacggcgggactcagcaggagcttccacccggcgtctcttaccagttcagtggagctcccggtggcgggggcgggtcggggctgagcaatcaagcccgtgggagtgcgcccttcggcggccagaaccagatcgccaacccacagttcggtggctgcgggggcgggtcaggagcagggtacaggggattctctcagtttgctgacgggcacgggggattctctcagttccattcgagtccaccggcagcgatggtccagccgactctaggcagtcaagttgcagccactatttgcgaagtggccacgccccggctttggactatggaaggtacccagctgcctttgtgcgaggattgcgagagaacaatcttcttccacgccaggcctctacagcatctagagcaatatcttgcctctacagctgtcggtggcggcgccgggtcgatacccgtgtttcttgcagctcatggtcgcgtcggctggttctctcagtgggcgggcgacaatccaagtttttttcttatgaaaacacacagttaactgaagtttaactgatgtaagcttcagttaatactttttttttgctgcacagttaacactttttaatgncttgttgncggtaagt

SEQ ID NO: 13541 - DNA, 593 bp, Triticum aestivum
  unsure (1)..(593): unsure at all n locations
  Clone ID: PAT_TA_13541
cnactccactnataggggcgaantgggnaccgggcccccccctcggtgtttttttctttttttttttttctcgaaatttttacggtgaacttcaatatattaataatatggttaagatacagattacacgcgggactaagtttctacatattgtttcagagtaaacaagtcctacttgcgatgatctttatcccaaaaatcattacaagctagattattcttctgtttactctttgtgaaattaaagaaggaaaaaagaaaagaaagagaaacgtaaatatgcccaccacaagtcgtgcaagtcatcttattcgatgctctttgttgggcgccatgattaagccgatttctcaatcagttcgcggaatccgatagcagtcgaaggcgtgggcggtcgggaggaaggagatacggacgccgcacctggcggacagcgtggcggcgcggcgggtgaccaccttgccggcggcgagcatctccttgtggatgcacgcgcagagggcgcgccgccggtcaaaggtcggcgccatgtccctgatgtcggcgagccccctgcagcagcgcggcgagagcttgtcctccacgccggcgat

SEQ ID NO: 13542 - DNA, 614 bp, Triticum aestivum
  Clone ID: PAT_TA_13542
cccacgcgtgcgacgacgcgtacgcgcgcgcgttgagggctggaaaacaatgtagccacggtgtgatcaccaagggagcctcttggcaaagcttgtgtgttcttccttggtgcatgtgtgcgtgtgtgtgtgtggagtttctccttgagtgaggcaagaggtagaagaagggcgttgcggcgaggaggcggcgccaacatttggtattcagagccacaaggttcgaggggcggccgtggtgcgcggtggcgtccgcggcggacggggcgtgcgcggccgacatggaggcatcggctgcggcgcatggcgagcgcgtggtgacggcgacgcgtggcgggtccgcggcggtgcggtgtgatgtcgtgcgcgcgaagagcacggtggtcgcggagaccgaggaggtcgcggaggacctgcgtggtggcgcagaggtcgcggcggcttggcgcgacaaccctggaggcgcgtggcacgaagccgcggcggacctgcgtggtggcacctggggtggggtggcgcggcgaggcgggacggcgatccgggcgcgacctgtgcgcgtcatgggtgcgcattggatgggcgcacgtacgagcgtacgtttgacgttgggtgga

SEQ ID NO: 13543 - DNA, 799 bp, Triticum aestivum
  unsure (1)..(799): unsure at all n locations
  Clone ID: PAT_TA_13543
ttttttttttttttttatttttttttttttgatgcaaatttgcatgctcgccactggtatcgggtgcagaatttatgatctgcaaacgtatctcatctgctctaattggaggttttgtgagcttacatcaacttgaattcttcaaatacatgaatgaaaacagatccacacagatcccaccgctggtgaatctcccagccacatgttgcatcctttacgaagacctacacagatgcctagatcggcgacgatgctgcagctaggtagggatgtgatcaaatacatattagctagaacatccttattttccggatggcaaagttgggcagtgatcctggaaatctcctctggaactaaaagggatgtgatcaattacatctcagcgaacatccttattttccgggtggcaaaggtgggcagtgatcctggcaatctcccctggaactaaaacaaggtgctccctgcgcattgaggcagcaaaaccagggatgggcatttggttcacctttggtgttacaatnccttgcgaaaaccatttatggnnaagttgcttttattaagganaggccncataactnnttncatggcatnttttnngggcttttggggacgaacncatnttcaaccttntnggcccccanaaaaaanagaccctacctggtncctttttttttaagaattagcancctggggtnntnttggggnggaagnaaatttttannnnnnnntnnaaanannggggtggggcntttntttcccaaaaaannaagggnncnntttnnnnnnnnnggnanttttn

SEQ ID NO: 13544 - DNA, 2667 bp, Triticum aestivum
  Clone ID: PAT_TA_13544
cgtccgcccgtccgtcggcgcatgggcgggcaagtggggaaagcctagtgattgaagcaataacattcttaaggcatcttaagaccttgataatgggcaagggacaactgggagaaacattttttcaggctttggctgaatgcccattgttaaatactttaacagtcagtgatgcatcccttggtagtggcattcaagaggtaactgttaatcatgatggattgcatgaacttcaaattgtgaagtgtcgtgcactcagagtatctatcagatgccaccaacttcgaatactgtctctgaggagaactggcatggctcatgtatcactcaattgtcctcagttgcttgaattggattttcagtcctgccataagctttctgacactgcaattcgtcaagcagcgacagcctgtccactattagcgtcactagatatgtcatcctgctcgtgtgttactgatgagacattgcgtgagatagctaatgcatgtcaaaatctttctgttcttgatgcatctaactgccccaacatttctttcgagtcggtaaagcttccaatggtggtagacttgagactatcaagttgtgagggaatcacatctgcttcaatgggtgcagtatgttttagtcgtatacttgaggcgttgcaacttgataattgtagcctgttgacatctgtgtctttggatctgccacatctcaagaatattagtcttgtacacctccgcaagtttgctgatttaaatctgcgaagccctgtgctttcttacataaaagtttccagatgctcagcacttcgttgtgttaccataacatcaaatgctcttaagaaactggtgcttcaaaaacaagagagcctatgtaatttatcattgcaatgccacaatttaattgatgttgatcttagtgattgcgagtcattgacaaatgagatctgcaaagttttcagtgacggagggggttgccccatgctcaggtcattaattcttgataattgtgagagtttgagtgtcgtggaactgaataatagttctttggttaatctctcacttgctggttgccgttccatgacattcctgaaacttgcatgcccaaagcttcaagtggtgattcttgatggttgtgatcatcttgaaagagcatcattttgcccggttggtcttgaatccctaaaccttggaatttgtccaaagttgagtgttctacgcatagaggccccaaatatgtctatattggagctgaagggctgtggtgtcctttctgaggcttcaattaattgtccttgcttgatatctttagatgcctctttctgcagacagcttatggatgattcgctgtcccaaacagcagaagcatgccctcttattgaacatcttatattgtcttcatgtttatccattgacgtccgtggattgtcttctctgcattgccttcagaagctggccttgcttgacctatcatatacatttttgatgaacttgaagccggtttttgacagttgtctgcagttgaaggtcttgaaactttcagcttgcaagtatctcagtgattcatctttggaaccactctacagagagggtgctctaccgatgctcgttgagctagatctgtcctactcgtccattgggcagactgcaatagaagagcttcttgcgtgccgttcactctaggttaatgtgaacttaaacggatgtacgaacttgcatgaattggtatgtggatcagactattgccggtctggtgacatgccagttgatgctttcccccctgattctgcaccagacaagaccaaagagatcagggagagttcgaattgtcagcttgaagttctcagttgtactggctgtccaaatattaagaaagttgttattccttcaacggccaactatctgaatttgtctaagatcaaccttaatttgtctgcaaacttgaaggaagtagatttgaagtgctccaatctttacaatttaaatttgagcaattgtaactcactggagattctgaagcttgattgcccaagattggctaacctccaacttttggcatgcacaatgttgcaagaggatgaactgaaatctgcactatccttttgcggtgcattggagatcctcaatgtgcactcttgtccacaaataaacacgctggattttggcaggctacaggctgtttgcccaactctcaagcgcatccagagcagccccatcgcatagtatgaaggattctggtcttcttaatggactcgagtaaatagtccagatttgaaacagaaaaggccatgtcgtactcttgtacatatgcagcaccgccaatatattgtatggctgcatgtattagggagccagggctgacatgaaacctgttcttccaatcgatttcttgtgttgaatctagttgaaacatggaaaccgcacttcctagtttgtatttgcttttgaggtgcagtgatggagtaagcagatctgtatttatatgaatgaataaccatcttgtttggatcgtcgatgttgtatgcttcattgatgacacgggctacgtgggttgactgaaattacaccaggttctatggttctctcactaaggtgcagtgattctgcggtctttattaatctgtctcaactgtgacgatgcaactgagacgtttccaaaaaaaaaaaaaaaaaaaaaaaa

SEQ ID NO: 13545 - DNA, 638 bp, Triticum aestivum
  Clone ID: PAT_TA_13545
ttttttttttttttttttaggtataggtatagatttgggaaaataaacatagtacatatcgtaatgtgcccgtacgtagggttccctatatctggattattacaagtgattgatcatgcgaaacaaactcgccaatagaaataggcaggcatgacaatgaaaataagaaacaaatcgagtatatgggtgaacgaggtgccaattacggagctgggcgagaagcctcggtaaagcctgtgtccatgaccgagaacttctgagcgggcggcgcggcaaggacttgctcaccagccttcttgtaggccgacatgcatgcttctaatttggccttgtctcctttggccgtgtccaccttggccatagcgaggagttgctgcttctccccagccgcttttacttccggtattttcgatggtgggctggcggcgatgacgtcgtcaatggccacatccatgagcccggcaagggccatcttgaacagctcctcgccggacttcgtgacggtggcccttgacgccggtaacaatgcagttgccaccatgacgatgacaaggattcgtgccgccgcattcttcttggctggggccattactctagttgacatgtggtagagggatgattcaacgagatgttgctgc

SEQ ID NO: 13546 - DNA, 630 bp, Triticum aestivum
  Clone ID: PAT_TA_13546
tttttttttttttttttttttttttttttgcgcactaatagcaattgatgcagatacatatagtccaacatgatgatacatttgtaattttataccactggaagaacatctagtagtagaacctttctcagttataataggtggagatcaaagtagaaattatttatactgtatataggtaatcgacatggtagaaactgaagcatgtatcttcattgtagcatagcatgcccttgatggagtttttgtttcttggggcattactctacctgtcctgacatgtttcctgcgttcttcttgtttgtagtgctagcaggatgttgatttgttgattttctgtcagtaatggtggttcgtacgtattcattgttatcagcaattgacctcggtcgaattttgctcgggctcgcccggggccactcctcgtgctggtgttggtcatctgggattgtccgtcctgcatgtagtactccacaggggtatatctctcctctctctacttgtctattctgatggcccctcgaagggacaacatgtccttgttttgagatgcctgaaaatgttcgtagtttaacttggtacacatgctggagatgggattcataatacaaacattgactcgccgtgaac

SEQ ID NO: 13547 - DNA, 511 bp, Triticum aestivum
  Clone ID: PAT_TA_13547
tttttttttttttttttagaagtttgcacgatgtatatataacaaaaaagcagagatgcacacggcacaaacacaactagtttggtcagttttgcttgctgcttaaaggaagcaacatactctgattgcaaattatgacaacatggcaactagtttgagaccaaaaacgtacgtcctcgtatccaaggcgattagggagtactgatgcgtcacagaaaacattaagaaggaaaaaaatgaagctagagggtgagtatcagggggtactgatgaatcgtctcttgctggctcccatgacgctgctcaaaatcagtggcgagcccagcggtctccatggcgtgcaccaccccgcagcccccgcctagccagcaagctcgcggccatgtcaagctcgacgcgcaccgagtgggagtgggagggggcatcccgtccccgacgcggccgacaacgcgctcgccgcctccgccctcatctgctctcaatggacaagcgacaacctcgcctcctgcgc

SEQ ID NO: 13548 - DNA, 1270 bp, Triticum aestivum
  unsure (1)..(1270): unsure at all n locations
  Clone ID: PAT_TA_13548
tgccgcaccgcctatataacattcgctgatcgcnaggacgaggaacacgcagtcggcacgtcccccaaacctgccaatccgtgagcccactgtccctgccgtccgccgtcgcgttcaaactcccaactcgtgatcatactacgagctgcaagtagtattgccatggctgcgccggccaccttcgtcgtggtggtcgccttggtggcggctgctctctgcggcggcgtctgccgggcgcaggacatggacaacgagtgggcacggtaccgcgggttcttcggcggcggcggcacgctgctgccacaatcggacgtggacctgctggagttcccgctgaacctcgagtacctggaggcggagttcttctgctggtcggcgctgggctacggcctcgatggcatcgacgtcaacctcaccggcggcggcccgcatcccatcggtggccagaccgccgccctcacccccttcgtccgagacgtcgccacacagttctgctaccaagaagttggccacctcagggcgatcaagcagaacgtgaggggattcccgcggccgcagctggacatcagcgcgaccaacatcggcaagatcgtggagcaggcgatgaacacgacgctggacccgcccttcaacccctacgagaacagcctcaacttcctcatcgcctcctacatcatcccgtacgtcggtcttaccggctacgtcggcgccaaccccaagctcctcactccccaggccagaaggctggtggcgggactgctgggcgtggaatccgcacaggacgcggtgatccgggccctgctgtacgagcgcggactgtcgcgggtggcgagctatggtgttggtgtggcggaggtgaccgcgcacatctccgagctgcggaacgagcttgggaggaggggggtgaaggacgaggggctagtggtggcgccgggtgaggggcccgaggggcagaccgtggggaacatcatcgccggcgaccgctactcgctcgcttacgatcgcacgcccgaggagatcctcggcatcgtgtacggcaccggaagccccgcccaggccggcggcttctttccccagggcgctgacggccgcatagccagggggctcctcatgtagacgatcaatcgacggacatatatacaactggagtgttgttctcgatcgcaagttgtagactatatgcatcatacatgtgtgtgtgtgtgtgtgtgtcttgtccttatggatgctaataatcaataaaaggacctatgcaataggcaaaatgttt

SEQ ID NO: 13549 - DNA, 566 bp, Triticum aestivum
  Clone ID: PAT_TA_13549
ttttttttttttttttttttttttttttttttacaaaaacacatctatttagaaatagatgaaatgcatactgcttgttctgttggtcacacaccccaagaatcaatacatcaggtcaccaaaacattagaaaatggtctattaaacatgccgacaggtgaaaatgcaacaatacattgatcttctaaattctgcaataaactctgaaattgattgtttttcttttcattctgaatctgtagagaaaacaggaagctcgggctactcaccaaaacctgacattgaagtccatacctgtgccaagcttatatacaccatcagcatgaagcaccttctccccccgagtctgaatacagaaagatagatatggaaacaaatcaattatctccatagctttctaccccattggctttttaacattcagaagacgttttcagcaccgattcttctaacttgcagcccacaacccgtcgcaagtaaccgaagctagcagctagctcagccagcaatggtagctgacgcttcttcttgctcctactggtcaatgctattcaccggacgcgtgg

SEQ ID NO: 13550 - DNA, 1126 bp, Triticum aestivum
  Clone ID: PAT_TA_13550
gcggccgcgtcgactccgaatatcaacattgatcaattgggggtgccatggagtatagctttgaatctgacatacccagaaactgtcactccatataacattgagaggttgaaagagctagtagaatatgggcctcacccacccccaggtaagacaggtgcaaagtacatcatcagggaagatggtcagaggctggatcttcgctatgtgaagaaaagtagtgatcagcatttggagtgggttacaaggtggaaagacacctcaatgatggagattttgttcttttcaaccggcaaccaagtcttcataaaatgtctattatggggcatcttttaaaattatgccgtactcaactttccgcctgaacctgtctgtcacatcaccatacaatgcagattttgatggggatgaaatgaatatgcatgttcctcagtcatttgagataagagccgaagttttagagttgatgatggtgccaaaatgtattgtctcgcctcaagcgaatagaccgtccgtgggtattgtccaggacacacttcttgggtgtcgaaaaataaccaaaagggacactcttattgaaaaggatgtatttatgaacatcctaatgtggtgggaagattttgatgggaaggttcctgcacctgccattttgagaccaaggccgatttggactggcaaacaagttttcaacttgattattccgaagctaatcaatttaataagattttcagcctggcatgctgaaacagaaagtggatttattactccaggagatactatggtcaggatagagaagggagagcttctgtctggtacactttgcaaaaaaacacttggaacgtcaactggaagtcttattcatgttatttgggaagaggtagggccagatgctgcacggaagttcttgggtcatacacagtggctggtcaactactggcttctgcaaaacggtttcagtattggtattggagatacaattgcagatgctgctactatggagaagattaacgagacaattggaacagctaagaatgaggtgaaggagcttattaagcaagcacaagagaagaacttggaacctgagccaggacgcaccatgatggaatcattcgaaaaccgagtaaat

SEQ ID NO: 13551 - DNA, 843 bp, Triticum aestivum
  Clone ID: PAT_TA_13551
tttttttttttttttttttttaaaacacagttggtaccaaactggggaataaagacacagtaaacgggttttgggttttgaccctctcaagtctcaactctcacgaaagaaacgaaaccaatgaccatttgttttctacccactttagtctttaagacctgtatttcatttttcctgtacacgggaaaacattcatatcagatgagctctttgagcatcaagccacaactgactggcttgcccgttaccctgacacaagcattgagaacgagaatggtgtgcaattcgcatgagtttctgcgcagaacggatggctaggtctaagcgagcgactgaaggatcgatcactcaaggtgatgagtgtctcagcacatcaaaacgggcgcgcatgcagaaacgcatgccaggtagctgtcagcagactcagaaaatcttcttcacctcttggacatcctggggcctctgggacgaattggagccatcagattgatcttcatcctcctcttcctctgcttcatcctcatcactatcaatctccaacagactcagcctgcactggtttgaaactcttctcatgaggaaaacattgaggtagtaccgcaccaagtccaccctggtcttcggggcaaaatgttttgccgctaccgcccaaaaactcttatcttcaaacacaggaaccaactgctcaagtgcggcaaactttagttgctcctcaatactccacatcttagaaacctgctcacccatcaaatcaaatttccattccgtgaaaacttgaccaatttcagaccttagccgatccctggcggtgttgatgtgatgtaatctgcaatagaagtttcc

SEQ ID NO: 13552 - DNA, 1097 bp, Triticum aestivum
  unsure (1)..(1097): unsure at all n locations
  Clone ID: PAT_TA_13552
cctcagccctcccctccggagcctcccatgtacgccttcgaccgcggttcgacgccacccgcctgccccgtcttctcccctcctacagtccaccactctactgcatcgtcgacgcgctcccgccgcatggaccgcgcggcggtgagcaactccccgaacgccaccgcggcggtcgtgctgccgctccccggcctcaccagcttcttcccggtgctcgtcatgggtaggcaggagctggcggccctggagtcccccggacccgtcaccgacggcaccctctgtgacccgggcgccgtccactcccacgtccttcttgggggactgcgggcgcgcggtctgggcccggcgtccccgcccgcgtggccgttgttgggcctgaccaccggggacccggagaaggtggtgagggacgcgggggcgtgcctgctgatcggggatttccgggacccgaagctgatggccatgcttcaggagctagaccctgcagctgcagatgagcaaggctaaggatcgcgcggctgcttgcaacttggaacacgggtcgatggccgcgacctgaagagggccaatgtgacgaccgccccgaggatgaatgctgagctcattctgccgctcatcggcctttccagcttcttcccggtgctcgtcatcggtgagcgagtgcgagcgggccaagccgtccccggacccgtacctcaaggccctcgatctcatcggcgcgtcgcccgatcacacgttcatcttcgaggactccgcgtccgggatccgggccggcgtcgccgccggcgtggccgtggtgggcctgaccaccgggaacccggagaaggtgctgagggacgcgggggcgagcctactgatcgaggatttccgggacccgaagctgatggccgtgcttcaggagctggaccctgcacctgcagataagcaaggctgatgttcgcggacatgcttgctaactggacacgggggactagtcggtgatccccattttttttaatttcaatatttcatcgtgcacgagcatgaataattctgcaactatttaacttcccccgatgcgcgaatgcgncatcagaagagttgagcgcacactcctg

SEQ ID NO: 13553 - DNA, 547 bp, Triticum aestivum
  unsure (1)..(547): unsure at all n locations
  Clone ID: PAT_TA_13553
ttttttttttttgaanaaggttacacngtgaaatcatttngtaggngggcatncattttggccccacatcaatacaattaggacangagtacatgcgtcgactactggcttgcggtttccttgtttccgtgttttcccggccgccactctccgctttagcaagcgtcgtatacatacgtgtgagccaacaaggcgggagaagatgatggcacgcaacaaatcagtgttagcattgacgaaaatctacagtgcgacgaggtgagctgaggcgtgtgctgctacaacgacagggcgagctccgcccacgccagggaggactccttgaggatgccggccgccgagaggtcgatgccggtctccagcgcccccgcgatgatctgcatcgacggccgcttcgacgggtcggggtcgacgcaccggctcaccacgctgcagatcaccgccaggtcctccgtccgcacgttcgtcagctccgggtcgaccagcttcccgatctcctccggctgctggaggtacttgatggcccagtccaccaagtagcctttgt

SEQ ID NO: 13554 - DNA, 534 bp, Triticum aestivum
  unsure (1)..(534): unsure at all n locations
  Clone ID: PAT_TA_13554
tttttttttttttttttttgcagcaaactggcgattctaccagaattacacactcacacggtgctttgagatatactaggtacataacatccatagcaggactttcaatccccaaggtgcatgaaattcacccctacctagccnaagtccttacctcctcctaaaatgaattagggaatccccacaaattaagttaagttcctcctccaaactacaggaaatataactgaagttgcatggtcggaattctttgtctgacaaaccatcagtaaatgtagcttcttggttcatctgaaagaaggaaactctcctccaggaagctcccagttgtcacgcccatcatcgtcggtggttcgctccttcgacccctgttcatcgtcaaatggatatggacccttgaaacgcctgcggctgaacctccatgcggcgtcgcgggactttcgcttgcgcttgtcccgcgcgttctcgtgccaccgccgccgcctgacctcgtgcatgacgccggctcgccccaactcccgcgtgaactgccgc

SEQ ID NO: 13555 - DNA, 2251 bp, Triticum aestivum
  unsure (1)..(2251): unsure at all n locations
  Clone ID: PAT_TA_13555
gccgaattgggactgctcaattggttctggacaatacaacaaaagaaatgtgcatattgtccacatctgcaggttgttagttcatcaaaggcggctactaagtatacataccgtgttcatctcgcctgccttcttaggaaatagcctggtcgcggccggcgcaccgaactgccgagtctgcctcagcttccagccctgtgctgcctcctgcccttcccggcctcggctttttccttcttgtttatgtgtccaccgcgccttttcccccatccccggtatcatctgaaggggcgacatacccaattctcggattcctcaagcaacagatgtagtgttgtcaatctctgaagatgcgaatccgtctgctcctaggcaacgacagagggatgattgggatactaaaagccacaatgtatcgaggcttagtggagtcagtcaccagcctctccgttgtttgaacaactgaacaacaacatcaagcggcgccaaaacatattgctgatctgagagacatccgagacatgaatgaggaaaaaatgagaaggtcggccattgttggctcaagctcaggaggtggtcgaaagcctggctccacatggtcctagcactactgtcacacatggtgttcgggccacttccaccagtgctctgcgggttgtcgttccgcgagagcaatgacggggagaacaagatgatgcggtgctttgctcgcctgcattgcgctgcttgcgctcgggacgtgcatttctacagaagagccatgacatacttcaagactctaatttactacctgaccatcgccgcgagcttgtccgggatatcgtacgttgccgatgtgctgatcacgaggcttctcaaacactttggcaccatcgatctaggtggtgcattggctcctcatgcttctctaggcctgttattctctcatttaggtaatgcacatacgtctgcctaggcctcactctgaatgcttaagaggctgtttggtttgtgactaactttgccaaatattgccacacctaaggttaggcaagtttgactaacttaggtgagtgtttggttcaagccacaccttaggcaagccacacttgggccccacatggcatacacacaaaaaatgtggcaagattcccttaggcttgccaacttgtggctctcattttgatgaactaaccttaggcaagtttggcaagaatatgtggcaaagtttggcaatgctaggcttagaaccaaacagcccctaagttattgttggtcatgtgtggtgttgtggcttatttaggtttgttcttttgagatgcacaggggcgttgttaggatttgtccgtgctttctagaaccgttgctggggaaaattcttgtcactattgtttggtgccgttgttaaggcttgctgcttctttggactgcctttgttgcagccttactaaaattggagatgtaatgttttggctactaattagtaagaatggcaagataagatttagcctatgaatgcacgacccatttgctgctccctcccctatgggcgattcaacctcatgccccgcctccgctcaacccaagccccgttcatccaggccgtacggtgttgtttgatcgctcagctaaagggtctccaaccaggatgcatcaaggcatatgctagcaccatggggaaacaaatcgtgaacatgcttggtgaactcgccacaaaggaggtcgcccggctgtggaggtttaaagactatgttgatgccatgatggacaagatgcaagatctggaagccgtttacacgatgcggatgataggccgcgccaaggagggagagacggggaagttgttgggaggtggctcgccaaattcaagtctgtcacctaagacggaggacgtgctgaacgacctggacgctgcagatcaacatggacatggacttttcactttctagagtaacacactgacatggcatagtagtaggcgacggttctttcattataacggcttataattatcatcagactcatactattatgcaaatgcttcctatgatttcattggttaaattgtataattgtgacaggttcatatatcaatgtcaagaaagagctgagcaacgggacgacctgacaaagctatcaaatattaggttacatggcagctacttaggctctttatattgcacaggccttatggatccctttgtctataattactgaactaccatatttaatttgtganactcatcgtgtggtttactttggaatcaaaatg

SEQ ID NO: 13556 - DNA, 1187 bp, Triticum aestivum
  Clone ID: PAT_TA_13556
cgtccgcccacgcgtccgcggacgcgtgggtgcagaattcagaagcaagtccaatatctcctcagtttcagctggtgcatccagcaacctcacctcccaccatgaccagtgctatgggtgatgaacccaagataacagcagcagctatggcagataagcttgcatctttgtcatctggccagcaagtgctgtcctccattttctcatcccttgccgctgaacaagctgcttccataaatggtggttcgtcttctggagaactctctgcagggcctcccggctttgacagaccaaagaggcctagacttgagcagcaggctggtgatacaggggctccccctttctttgcccaagtaccacaagtgcaacaacagattggagcagcacctacttctcttggaagcacacagtcaccagcgcaggctaaccaagtaccaggttcatttgcgccacctccattacaacctatggtaccgcaacttatgcagcagtttagtcaaaatactggaggtcctggaggaatgttcggaatgataccctttgggatgatggctggctctttgccacctccacttccattgttgccggcaggttttgcaatgccaaatggaccaccccctccacctcctctgccacccattcagcagcagcagcagcagtctccacaggcaccacagcaatctccaacatcaactggattcttcccaacttcaagcactgggttcttccctccagttcaggtgcagcaatctccatccgtccaacggcaatgatgttatattacaaatgtcggggtataaaggcagcaccttgtgctatctttgtacattaacaataatccccgagtattatccggttaggttacaggtcctgtaggagaaacaggatcactgcctacgaaaataggcgtacggcttgtgtgatgtataactgttccttttggtctgagaagtttgctcgatacttcttgaccatatgaagtagttagacttttctttgcatagcacgttaattagctcagagacaaacaaatgggtgatactattgcttaaattgttgttgcccaatgatattaacattttagggctcagtcgtagaacttaccggtagatgggatctgaactgtaactatttttcatatactcatattgctcttcacgtttatttattattattttataaaaaaa

SEQ ID NO: 13557 - DNA, 403 bp, Triticum aestivum
  Clone ID: PAT_TA_13557
tttttttttttttttttttttttcaaccctgttaataagcttttttttttgcaatgtaaggagagatacatcgattggtaggagtcagagagcatatttgcgtgcacaaattaaactgagagcaaaaataatgataatggaggaattcgatgattgatggcagctgcagcaatgtcattgtcaggtgccccgctctacgccgcaatgtggtcgctcagcttccgcccgctcgtctccagggggaagtaggacacggcgacggccgacacgagcatcactgtgatgaacaccgcgatggccgcggtctggtggcacgcgtgctccagccccccggccgcgacagggcacaggatcccgccgaagcgggcgatggagctcgcgaaccccacgcccgtagccctca

SEQ ID NO: 13558 - DNA, 926 bp, Triticum aestivum
  unsure (1)..(926): unsure at all n locations
  Clone ID: PAT_TA_13558
ttcgctcgtcctccggcgacctatgtctgcggctgtgatgcagggcacagcgcccgtagagcgccgcgactcctccagcggcgccgcggactttccgtccccgccccccggcggcgcgcggccccccccgcccgtggtctcccgcggggacgcgggcctcagcgccccctgcgcccagcggcggagcggagattgcgtacgttagctacggcggtgagcagcacctccctctggtgcatgtcgcgggtggtgcgcggggcccgtcgtttcctactccggcgtgcacagacgcgccttcggcggcttctgcgccctgctcgtcgtcctcacgccctgccgccgacgaggattcgcacctgggctcgttgctttacccgttcggggaacgacggaatcgcgttgtggggatgtgtcgcctggcgcagaggttacaaacaagggtgccctcgctctgtatggccgcctagggtttatccgagcaaagaggctgtagagatactatctaaatggcgtggatgcttttcgtctcaaattactgtttccacgccccgatcttggtctagatccaatgatgatgcttcgtgatgagagggatggccaacacatggattctccgtacttgtgataataccctgatcaaaagtggaagatggaaatcaagctgttatttttgttgtgttcgtttgcctgtttgatactttcatgtcttcatgacatgcagtagctattttcctttttgagaaacaagtggttttcggcactgctgctcctggtaattttgaaaccctgaggagggcattagaagttccaaaaatatctgaatatcttttcacgtgtaacaatattgtcatggatatttttgtaacacagtgcaaatgtaaatcgccacccaatcaggggggccctccgatagctnatatcgatta

SEQ ID NO: 13559 - DNA, 894 bp, Triticum aestivum
  Clone ID: PAT_TA_13559
cccgcttgccccgcccccggggccgcgcccgccgtgtccgccggcaacgggccgccgccggccagcttgggcccttccaaaaagatgaagccctttttttgggcggccgccttgcttttcgatacggcgagcctttttttttcgtcaacgacagcgacgacggttcttcatcgacccactcccggccggtcgctcgatcatcggagcatggcggacgacggcgctgaggcgtacgaggacctgctgccggtgatggcggggcggctgggcacggcggggctgctgtcggagctgcgggccgggttccggctgctggccgacccggcgcggggcgccatcacggccgagagcctgcggcggagcgcgggggccgtgctgggcgtggaggggatgacggcggaggaggcgcaggtgatggtgggcgagggcgaccacgacggcgacggcgcgctcagcgagcaggagttctgcgtgctcatggtgcgggctcagccccggcatcatggccgacgccgagggctggctcgaggaggccatcgccgacgagctgctcccgccgccgccgccgcccgcgccggccgcctgaggggtcccccgcatagctccccatctcgattgttatgtactactacttgcatcgatactgacttgtacgtatgtttgttgtatctgcgccgctactgactgtatgtttgagtgttcgtacgtacatgagtctcctttgttgtttgagatgttcgcactattgtataatttaaaaactctttgaggccttgagctttgctttattgattaatttagctcgtgcatggactttttagttcagcccgcgctcctggctcgatcgtggtcacatttttctaccttcgaccttcgtttctgaaaaaaaaaaaa

SEQ ID NO: 13560 - DNA, 713 bp, Triticum aestivum
  Clone ID: PAT_TA_13560
cgtccggtcggcagtgggccgagacccacccgccgccatggccaagtacaacgtggtgcagaaagagcaagcagcgagtccagccatgaccgcaagcgccgcgccccatggggatcccaactccggcaagctcaagcaccacaacgcgcccatcgccatatctggcaagcgcaagcgcaagctcctgcgccgcctcaaccgggatcaggaaggaggctgtgatggttaaggcgctggagaacaacatgggcgacgtcgacatggtgtctgctgaagcatcttcggaaactgcaaaggacaagtctcagatgaagtttaatgtgaagaaaaactcaagaatacagatcaaaagattgaaaggcaaaggtagaaagaaagccaaaaatgtgaagccgccaacgaaggaaaaagctgatgccatggtagagtgactgttaagagtgaagcagtatcgtaatatgaaagtttatggggcacaagcaagggctagcggtactagagcttgtgcattaacttgtatggaattcagacatcttttgaagtagatttatgcacggttttcttcctgataccattttgtcaagatcttgttttggtttggtttgaattgggctcagctaaattgcccgcctcgttgtgtctgctgggtttgtcgaatccaactgaattggagatcaatgttgcatactctactctatatgtcaaaaaaaaaa

SEQ ID NO: 13561 - DNA, 676 bp, Triticum aestivum
  Clone ID: PAT_TA_13561
ttttttttttttttttttttttttttttggagatttgtgttctttccgagaacggggcaagtgtgcaagcatcatgcatactaagaggagttgtttcatagatacaaacaggtctatttaacagagaacattgtgaagcataacatgaattgtaaaacggcaagacatttcaattcccacattcaattgacagcgaccgaccaactacccattgcagtttagtgacttgaggggaaatcagatgtattttagccacagagagaaatttccttggaagttccgacacattcgatgatcacccattgactgcttcccaaccactgcccaatcccacacctccaaaaaggcacccaaattagcatgacgggcagaagtgtgatatgtgtcgtcttagatccacgcagtccgcacgccgccttgagcacgcagctgcggcggccctacgcgcagtcgcagtccgcaccggcctgagcgcacgggcacagacaggcgcgccgcgcgcgggccattagccacgctattatctagtgtcggggatagagatggcgccgctggttgccggcccgtcgcacacctgtttgctgtgaaaccaaaaaactcgatgacgatggcggcggagccatgagcgtgatgatgccctcggatgtcgtcctcgacgccatctctcctcagcatc

SEQ ID NO: 13562 - DNA, 696 bp, Triticum aestivum
  unsure (1)..(696): unsure at all n locations
  Clone ID: PAT_TA_13562
tttttttttttttacatgaaacttcagcagataaccacgcacaggtaacatgtgtaacccagaccaatttcagaacaggttcgtcaccacaaaaaatgtaacagcagtaacatagagtttaaacatggtacaggagggtctattgccggttgcaatgtacacaaggtccaaagtaacgcaggatttccacacatgtattgtcaccaaagaatttcatctcaagttcttcacagttgccgagttcccagataacaagttgctgtccatcgttacaatgttgtaacagtagcctggtcatccctcccctaagtttcttgcctgctagctggtccgcccgcttgctgctcggttatgtcttcaagcattttgctttcccttttggctgccccacggtgagctccataccgatttggagtcccaggtcctgggccctagcccatgggtgttccgtaccctggattgcgtggaccttgccttcgcatgggcatagaagacagganatatcaaaggcaacaaagactaattgncaacaagacaagtgtgccccgcntttcncacaaatttaantcatgggcacaaggaaaattgnttgcaanataacaatcagntcantgttatggaaccancctttagncccaccatcacagcaaaatttatctcaattgnagattcagatgganctgcancantggacgt

SEQ ID NO: 13563 - DNA, 667 bp, Triticum aestivum
  unsure (1)..(667): unsure at all n locations
  Clone ID: PAT_TA_13563
ttattntttttttttcatcatggatagatacttgattacatataaaacacatgaccacaaagggatgtttagcacatagatgattacaaaaatctgaagtctattgatgtcttattgttcagagcaggaacaaaagggttagggcatcattggaactaaacatggagtatactgcagacgaaacaaaaagtggcttctccaggggtcacacatgcattgtaggtaagacagatccaacaaagataattagaaacggcctttcatagtttccaggcgttgttctaacttcatacctatgaagcgtaatctctttgccaattcctcaatgcctataagggctgctaccatagctcctgcgccgtcgtcctgcccctgctcggccccctctggtctcgggtttctggcttccgactctacctgtggcttcctccgctcctcgtcttgctcccctccggtggggccccccggcacctcctcccctgtccgacgcccatctctcttggccccccccacgtcccccccccgcgtcctcgcccgcgacgcctcctccccccccaccgccgcccggcctccccctccgtgctgcccgcccccctgcctcataggggaggagttcacaccccttctttcttgtagagatcaagccgccactggccgcgaggtctgc

SEQ ID NO: 13564 - DNA, 395 bp, Triticum aestivum
  Clone ID: PAT_TA_13564
ccacgcgtccggcaactagtcggtactccaataggcaaagatttaacgacttgtaaaccttcccatcaaatagagcccctgaagcaaatgcatcagggcttacctattgtgatctgtttattcgatggcccgaaagtgcccgaaaaacttgatgaagttgacaagaagtgtcatttctacacttatgatcttatcccttcacagaatagcttttgctttgaaaggagggattggatgactgtgcagccagacgaactgcctggcggaaggcaactgataatggggcttaatcctccttttggagtcaaagcagctctggcgaacagatttatcgacaaagcattgtcttttaagcccaagcttgttatactaattgtcccaaaagaaactaaaag

SEQ ID NO: 13565 - DNA, 425 bp, Triticum aestivum
  Clone ID: PAT_TA_13565
ttttttttttttttttttaaatagacaataccatgatccacaatcacaaaacagtagtagtgactacaagtagggaatgtggtgtttttgtagggtatcctttcttccggacaggcaaaccattaaaaacatgaaggtgaagttacccgaggaaactggtagtggaacagtagtctgcagttgagcggcttacatactcatttcgaggccagcagggtcaatgtcacctgagagtatgccgccactgcaccccttgagttctaggacattgtcgcagcgaagtcaaaaactcgctggtgatttcccggaacgaaatatgctttacatgcgcgaggaactctatgccaggtgggacctccaccatgccttcaaggttgactagtgttaatatttcgaggctcaccacggcaccttccttcatctct

SEQ ID NO: 13566 - DNA, 490 bp, Triticum aestivum
  Clone ID: PAT_TA_13566
tgtccgcggacgcgtgggctggctcttccgtcatggtcttggaccctgttcccacctccgcgctcttccctgcccagcctgaccatcccgattggtttgccatggactgccgccacggccgcgccctcttctcccgcatgggggacacctccgtcctcatggtcttggaccctgtgtccgccgctaccgcaagcgtgtcctccccctatattcacccggtcagcttcaacgcggcgccgggcagcttcagtagggctcccctctgcgccccacaaggctgcgactgccacgccggccaaggagggtgcttcggtgtgctgcgccggaccactaataggctgcaagagccaaggttgggctggcgggcccttccgtctggccgtctgtgccaccaactctgtccaagaggtcacatcgggctggctctaaccaatttggcctcgcgtgtggagccagctcacctctcttcatcaccccaatgtcagattta

SEQ ID NO: 13567 - DNA, 720 bp, Triticum aestivum
  Clone ID: PAT_TA_13567
cgtccggtgacgctttggtatagagctcctgaagtactgcttggagcaacacattactcaaccagtgttgatatttggtccatcggatgcatctttgccgagatggtcagaaaacaggctcttttccctggtgactctgagttacagcaactgcttcacattttcaagctgttgggaactcctaccgaggaggattggcctggagtaactgctctgagggactggcatgagtttcctcagtggaaagcacaaagattgacacgtgcagtccctacactggaaccagaaggaattgacctgctatcgaaaatgctccagttcgacccggcgaacaggatctcagccaaagccacgctagagcatccctatttcaacagcctcgacaagtctcagttctagctgttctagctaccgtgtgatttttctcaacttggtgtgtgcgctctgctcaccaacttgttctgccatgagatcgatgctgaaaacgcacgaaaccatgtttcatctacctacaatcagcaacggcgtgttgctggtagttggctcccatgagcgcccgtctcctaaacctccagcacttgatttgccctgagaattatcgactgaagatactgtaggagttttatttgctctgtacggaattgtttgatgagatgggtttgtggacaacagacatttgtgtagcataataaggcagtactagtatttgttaagaaaatg

SEQ ID NO: 13568 - DNA, 773 bp, Triticum aestivum
  Clone ID: PAT_TA_13568
tcgtgtttttttttttttgttttgtttagaagaaatcattccccccctttcatttcctttcatgcgcacgcacaaactttcttgacatttcgtttcatgaaaaacaatgatgaatcaccaaacattgcagccttaccagcttactgcatttgctggtcgagcttgcgtcgcttcctttgtccagcggtgactccccgccatggaggatcgatgtcctcctcaagctgcttcatttcctcctctgcgtggtccggatctccggatggatcgacgtcctcggcctgggcgagaggggatagtggtcccctctacggcgatctggtcgcgttttggagaagtgttgctggtcttggtgtggctcggccctcctggtggcgtcgttgcccattgcttgccgtgtcttcttgcagtgctctgttcctatggctactgtctgcggcctgctcctcatgtgcgagttgcaatttgtggcttcgggtgtgcttgagtggttggccctgttggcgcaatcccatctagctccggtaaggtccaagttgtactctttttatcctatggtcgtagaatttagcctcatcggtgccttgtatctgctgcctggggttgcatcctcattttcctttttatcttcggttgtaatggtgtgctcttgtaatcctggccggttgatggctttgttaattcaaagtcgggtgaagatcgagccctactcgggctcggttcgatcctttcatctaaaaaaaaaaaaaaaaaacgcgagactagttctctct

SEQ ID NO: 13569 - DNA, 560 bp, Triticum aestivum
  Clone ID: PAT_TA_13569
ccgtgccgaattcggcacgagctttctcgatattatttatagatagcgaaggagtttcagaaacaaacttttgttttctcgcgtgcgtttccctgatagacagcatatagtagtactaaccatagacgtaggaaatcatgaacaagtgtccaacgaaccaacaaaataacagcaattaaattcccatatgatgaaagccctactcctcggaagtggaagcggcaagagccaaagtaggcgccgacgaatcccccggttccaccatggccccccttgcggccgctcgggatttgaagaacccgaggagccaatcgcaagcctccttcaagtacattttgtagacggcgaaacgctccttgcgggaggccaaggtcacgccggaggcgtactcggagatggcaagcgaaggcctcggcctcaatggctgcggcagcgcgcttggcctcgggctccgggacggcgccgtagtgctggcagtagaggctgggccctaccagcttctcaggagtccgcgcaccaaggagtcgcgcgagctctgcgtcggtggccacgtacacgta

SEQ ID NO: 13570 - DNA, 795 bp, Triticum aestivum
  Clone ID: PAT_TA_13570
tttttttttttttttttttttttttttttttttgaaagagaaccaaaaaataaaataaaataaataacgtgctcttactattacacgggcggcgtatacagaggaaacatgtatatattgatgacatggacaaacaagcctagtttgcatgcaagaggtatttttatagccatgcaggagctacagcagaaaattgggaaggccaatcttcttccccgtcttcttgacatcttcctgcacccttctccgatactccccgaaggtggaggtcctgtaaggtgaaggctcttcgcatgcgccgatgggcgagtcgtacgacgggcaaaggaagtatgccacggagtacctctccgtcgtcgcgttggtcaccactttgtgctccacgctcttgtatctgttgttgctccatgcctggaagaggtctccaatgttgacgatgagagcgccgggaatgggcttgacggccacccaccgggagcccttcatcagctgcaggccgccgacttggtcctggcagagcacggtgaggaagtcgctgtccgtgtgcggcaccaggccgaaggcgtccggcgagaacgggcacggcgggtacctgttcagccggaggaagcacgtcctctcgtcgcaccctttcgggaagcgttggccggcggtgtgtcccaggctctcggccaggacgcgcgccagcgtgttggccagctttgacatcgcgttcgccacctcctgcgtcacatccctgatgctggcgagctcgccgtagctgcaaggggtaccggagatgccggcgagcgggac

SEQ ID NO: 13571 - DNA, 862 bp, Triticum aestivum
  Clone ID: PAT_TA_13571
ttttttttttttttttttttttagaatactgaagttccacaacagcattgataaaaactagtcgcacaaccaccttaacatctcacacaaccattgttcactctttttaacaacaggcagcaaactacagaagtaacaactaacaacaacgcctgggagacatctcacatacagaaatgggcacaacaaaccacaaggcaaattcaagttcacacaaactaaaaggtgtgtttggatgggggtatttgtctcaagagagttctggtacccctcgcccaaacaatcctaatctcgagacaaagtgtgaccagcacactacaaaaggaacgacgcccaccagatgagctgacaacatccccagccagaactgcttataatatacaggaacaacttctcccgaaaccctattaggtctgaaatttatgttcttttcaatatctgtagccaagctcggaaagtgtgttgaacatcttcagacaatgagggtgacggcgattgacattttgaagggaaaggatagcagtggccaatcgatcccgaagaggaaccttgcaggttgtaagggctctagagatgacataattagcaaactcatctgacactaaatctctgaagggatgataccgaatcaattcatgaacaatgttagatcgatctctgtcattaaaaacttgtaggcacgtttcaaccacattgctgctatatctttgtcttgagagtgtcacataattagacctgaagtgggatgcgataattgccaagtacgatgggtttctttgtttcagtacgtactgaacaatgtagtttccataaacgattttgagcaagatcggtgctgcaacaagagactttgacaaaacat

SEQ ID NO: 13572 - DNA, 588 bp, Triticum aestivum
  unsure (1)..(588): unsure at all n locations
  Clone ID: PAT_TA_13572
ttttttttttttaaggacacgaggatnnnnatcatatctctagtccaccaaaattcacacccctatttccaacggtgtttgtgaataaaggacgctgtgtccttctctctctcgctcagtgcgttgcccttcttcttggggtgaggaatgcctaactcgtgagtcgtggcagcaaccagagttccacaacaaagtccaccgcaacagcgcggataacgcaccaaacaacgagagagaaaagagcactgctacgaagccaacgaaacactcgaacactgatcatgtcagatcatatggtgccgccgttgcagcgcaggacctgggcgttgacccacccgccggcgtcgctggcgaggaagcccacgagcggcgcgatgtcctcgggcatccccagcctccccagcggcgcctccgcgatgtaccgctcggcctcctcgtccgtcttgccgccgtagaacatgggcgtggccgtggaccccggggccacggcgttggcggtgatcccggtgccccgcagctcccgcgccaggatcctcgtcatggtctccacggccgccttgctggccgcgtacgccgcgtagcccgggc

SEQ ID NO: 13573 - DNA, 462 bp, Triticum aestivum
  Clone ID: PAT_TA_13573
ctcttctcctctctctttttgtttgcagggaggttctatgtgtatacacacacacacacacaccccacagttgggggtggggtcctccgccggaacccggagggaccaaacccaaaactgggcctcccgaaccgggggcccggttcccaaccggaaccgggggccccccccgccgggggccgcctcctggattgttatcccggggggggttggtaaaggaaaggaaagtggggaccggtggttgggccggcggtccgagccgcacgtgggcgtgggcctggcggtcggcgcgggcgcgccccgggcgctggtggttgtgcgccaccccgccccggtccccgggggatggccccctcccgccgcggctcccctgcgggtgcccccgtcctgctccggctcgccggcggctgcggcccccgcggccgggcctcctggcgccgccggccccggctccggtgccgc

SEQ ID NO: 13574 - DNA, 735 bp, Triticum aestivum
  Clone ID: PAT_TA_13574
ccccgcgtccgacttgagcttgcactgagctctcttgcctggcttccggcggctggctctgctccgcgctcctggctttgctggtcgtcctggccgcgcggccggcggcggtgtcgggggcgtcggcgcacctgcacttctacatgcacgacgtgctgaccggcccggcgccgacggcagtgcaggtgctggacggcccgcgcggccacttcggcgacactatcgtcatcgacgacgcgctcacggccacctcgtccgcggcgtcgccggccgtggggcgcgcgcaggggcggtacatctgggcgtccaaggggaacccggagctgctggtcaccatggaggtgctcctcacgtccggcccctacgcggggtcctccgtcacggtggtcggccgggacgacatcggcgcggcggtgcgggagctgtcggtggtcggcggcacgggccagttcaggatggccacaggctacgtgctgtggaagaccgtccggctcgaccaccccaacgccgtcctcgagctcgacgtcttcgtcaacccgtgaaatacgtgacggaccgcgagctcgtctcgttcgtctcacatgagcatgttcatctgttccacttctcacctatgcatttgccctgtcttctactatatgtctactctgctgctcctccatgcatacgagtgcaataataatgttgaatatgtgcaaatgttgttcatcaaataatatgttgcccggctttggt

SEQ ID NO: 13575 - DNA, 1426 bp, Triticum aestivum
  Clone ID: PAT_TA_13575
cgtccgcggacgcgtggggatccatcagccatcaggggggggtggtgggaaggccacagagactccgccacaggcaagagtggaaggtgaactctcgagcgcgaccctcccggggcctcctttccgccgccctcctgcttcccctctccatcctggctgctcctcccgcgcaggtattgcggctcgaggtgcgcgccaagagcggccagccgctcatgcgctgcggccgcgccccggcggacgcgctcctccgggtcggaccggtccgcgacctcgggcgcgcgaccggcatcctggacacgcccgccgccacgacttgcgccccagcaacaggcttctcccccgcggaggccctctttgtcggctccccggtggatgatttgactgcggatctcatcatcagggatctcctcctgttcgccccaaacgacgactcctaggttattgtggtgggcgggtgacgacctggaggccgcggtgctgcagcgatgggtggtcatcgtgccaggctaatttatgatggctatgctctggctgggcgggttccacgggcggatccaccccacccactccgacaaagggccacgacatcttccacgccaaatggccggcaatagggaccatccgccgcccgtgtcacctggtcggacttctctgcacctcttattgcagataacagaaatgctccatgagaagataaagaactacaagattctgtcaaggatcactggaaagcctgaagagcagattgacgaagatgtgctaattcacatagtttgatcgtttcatgagtccttgggaggccaaggattatggaataattgacagcattatagatgaggggaaacttggattggtagctcctgtatcgggagctgtgccacccccaaaatcacgtgtgtggtacttgtggaacgcttcaggaccaactagaaaaataatgaaaaatctaccttcagaggaaaagctcattcgaaatggcaatggcagtgtaagtggagctgatggaatgctgaaggaggcctcatcaacttgagatatgtcttacagcatcaccatgggtttaggatcaaagatgtggcttgctatacaggccagagcatacaatgtgcaattttcagggtgcaggtctgtatgccttgccggtactcgaagattggctgtagtgctgtttgtatgctgtattgtattatttttcctgtatacggttgatttattgatcttgcagtgcaaccatcatttcgcaggagaatataggggatggagggagtattatttttcctgtataccggttgatttattgatcttgcagtgcaaccatcatttcgcaggagaatatagcatcgccttgtttgtttgggcttttgctaaaaaaaaaaaaaaaaaaaaaaaaaaaaaaaagagagagaagaagaggagggggagg

SEQ ID NO: 13576 - DNA, 661 bp, Triticum aestivum
  Clone ID: PAT_TA_13576
cgagcgaaaacagggggaggcaggcggccctaacgtccttttaacttgcatgggccacatgcccgaagcttttctgctgctgtttacactaaatcgttattattctaaacaaagaatacactaaagcaattctatagcacgactaaaaaaaatctatagtacggtaacacaaatgagaaagaaaattccctttacaacttcaagactgcatcagatcacatcatgtttgcgaatggtattataatgttatcgggcttagaaggtagtgccctggtgccagccttggaatgttctgcagattccagggcgcgggatgtctggagcaccatctctgaatggagccgcaggcagttcatggccatcgatgtgcactctgtatcaggatcagcttcagcaatacgcaaggcccatgtacgtatccattctaaaccagtagaaatgtcctggttgccttctataagaactgatgcaacatatgacgggtgcaaggctatcaatacacaagaagctgcaaacaacacagaccttcgcacatatgcttcagcatgttgcgagacctccctggcgcttatcatttcctgtcaagccgcgccattggctggcccttccggatgccttgccatgctcttcctgcagacaccaagcatgtatatcaatttac

SEQ ID NO: 13577 - DNA, 561 bp, Triticum aestivum
  Clone ID: PAT_TA_13577
tttttttttttttttttttttttttttttttaaaagcagtatatatcccacgcactaaaatattaggaatatcccccacccggttcctttggttccaatgcctccattattttgttccggcggcctttcactcagtcatagggttgctggggccctcccggtgcgttgctcccatcgtcggacctcctcttccccgtaccttctttatgctccggctgtccggttgcaatcgcaagggggacctcctcctcccggttggctgctcgatcatttttcaaatgcagtatcagtgtgccccaacccaaataaattgttattaagctctgcaaagacacctcttctgtaacactcaagagaataaagtaagtcaaaaataatagataaaaaacatgatgcgataaaaataaagcaattcttggagaagaaatgcacttaatgttgtgatgccactcaaattgtattcctggaccccagacccctcaggggcttgcttcttgcatagagtaacaagccctggatccctcctcacaagcatatatggcaggagaccttggcgagcat

SEQ ID NO: 13578 - DNA, 450 bp, Triticum aestivum
  Clone ID: PAT_TA_13578
tttttttttttttttttttttttttgctctgaaaaaaaattatattcacaaaaactcattctttcacaagttgacgctcgccgtcacgtctcgcctaaccccgtcaagttggttaggaacgggttgacgtaatcaccgaaatgcccttgcctaacgccggtacccgcatcgtcgtcgaacaccatccactctttcgtggccaccgtcgtcgacgccacgccggcgccctccatggggaccaccagcgccttcgcttcgttgtcctgctccaccgtgcagccgccgtcttcgacgtcggccatgatgagcttctcgaggtccctgatgtcgtggtccgggacgcgctccacggccgggaactcggcggcgctgagcacgccgagggtccggcagagctcgaagtatgacgacaccagtgcgctctgctccgcctccttccgcagcacccgc

SEQ ID NO: 13579 - DNA, 722 bp, Triticum aestivum
  unsure (1)..(722): unsure at all n locations
  Clone ID: PAT_TA_13579
ccaaggggnccgncgngacgcgatcaanaaatgcncgaacggcaaggnccatgcgnccgncnncaagacaacaacatcgagaagcaaanccccgagcccganatgcttccggaccttgcccggnggcttcgagccggccaanacgtgcattctcatccttctatttttttttttctttttcgatcgaaatctcacatctaaaaataattagatacacagtgttgacgaatacacggcgcacggcacggatcacgaacagaagaagcgatggatcacggcaggtggtacagctcggacggcttgatcccggcggtgacgttgaagtagcggagcgtggtcgcccaccggcggttgtccttgagcatgtgcacggcgacgctgtccggccgcaggttgtccatgtcccagctgaggtcgtacatccgcggcttgaggtcgtaccggttccggcccttgccggcgaggttgagccacttgccgagcatcaggtcctcgggccccagcgtgtcgttccgcgccaggatctcctccgccgtcgacacccagctcgccaggtccccgctcatgttgtagccgtagccgaggtagacgtgcgccgggtccccgctcatgttgtagccgtagccgaggtacacgtcgtcgcgccgccgccgccgcagctcccccaccagcgccgccacccgcaggtacgtgtcgtcgtcggtcttcatcacgtagtcgta

SEQ ID NO: 13580 - DNA, 793 bp, Triticum aestivum
  unsure (1)..(793): unsure at all n locations
  Clone ID: PAT_TA_13580
gccggccggttcgggagaggccgccaacagccccacccaacaccgagataccccaaaggacagattcgcgagagctcgagagagtgcgaccaaaatggcgatgagatgcgcgctgacctccctccccgcgcgcctccggtccccggcggtggtggccagcgggacccggcgccttctgagtgacgggaaggggcgcgtgctcagcgaggaggagcgcgccaaggagaacgtctacatccagaagatggagagggagaggcgggagaagctcaagaaaaagctcgaacaggagaaggatgcggccgacaaggctaagtccggcgccgacggcaagaaggccgagggaactaactaggagcgatcttcgcctgcctgaaggtgaccccatcttggatgcatctgggggacatttgtgtttatagatgtccagagatggaagaataaattctgtaaaacgttgatagcgctagctttgctttgttttcggtttgccgcgcttgttcaggatataatccagggaccataaacattgataactgggaacttgtatcgttgctggaccaaatatttgtcgcccttttgcgcatttggttgtatggtatgggtcacaaccacatcgttctcgttttcaaaaaagaagccggcccttccccccagctgagcgtataccgcgctcacggcgtcnttcaactcngacnggaaacctgggtaccaatatcgctgnanaancccttccactgntatncaaagcccacntngctccaagtncaccnangcatgacccctncngata

SEQ ID NO: 13581 - DNA, 485 bp, Triticum aestivum
  Clone ID: PAT_TA_13581
ttttttttttttgaatcgttgcaagatttgtattcactcctgaggagattcgaaatatagtgttgttttggttctttctagagcaaatcattggtgcctgctttatgagacaagatagaaagagtcaacgccatggatgcagccgttcctcaggaaattcaaaatatagaaaacaataggctcgaatatcatatcatctccgggccagggcggccgcatgtttcgagccggagcaacgacgctagctccggcagccgccgcccccccacccgccgccgtggagagaggcgctccgtcccgcgtccgcgccctcgaggtgaaggcaaggagcttcgcagagtatcggggtcgccgcagagtattggggtcgccgccgctggtgccggctggcagctgcttcaagagatatgcttacaacagcgtggtcgtcactgacgagtgcctcaagacggaccgccttaggcaccgccgggacccgccgtcgc

SEQ ID NO: 13582 - DNA, 622 bp, Triticum aestivum
  unsure (1)..(622): unsure at all n locations
  Clone ID: PAT_TA_13582
gtgatcaagttaagtagggttttctttactttgcttgccggggcttccaataattcgtttttttacttgatcttccatatcattaaccaacctctcaacctgtttgtctttgtcttatttttcagatttgttttggtggttgcaacatcactactcattcaccaaaactggagcctgcttcctggaacatcgcattgttctcatcttctccttgacgatgttgtgcagctgcctgcttggatctagccaattaatctcaaaagttgattctttctcttcattaggcccagcagagttaggaaggaacccgactacactctatatcccgtgctcgacaaatcagcagggatctcacctagtgatgccaacctgagcctctgaatctcccgctccttctcgtcacacatagaaggcaagtaaataagcacgataagagaagcatcgtcttggcgagtagggccccgcggtgatctctcttgtacgctgctgagcaggcacttgcccgtanatcatggcatgtggcggtggcggcgatggctgcttttactgcggcatcacgggtgggatcgctccctagtgtctgatgatcggcatgcctagcatgcacctctgtgtccgtcgt

SEQ ID NO: 13583 - DNA, 742 bp, Triticum aestivum
  Clone ID: PAT_TA_13583
aaagatctaaccaaatataacatggagtccaccgccgaatgttcaattcaagacagcctactattcatttatctgccggttgcgtgtgcgctgctactctctggtgagagtttggagaactacggtgcggtagagaacatacttgttgagatgggaacttacttccaagttcaggatgattatctggactgttatggtgatcctgaattcattggcaagataggcaccgacattgaagattacaagtgctcctggctagttgtccaagctcttgagcgtgctgatgagagccaaaagagcattctatttgaaaactatggaaagaaagatccagcatgcgtggcaaaagtgaaggatctctacaaagaacttaaccttgaggcagtatttcatgagtacgagagcgagagctacaagaagctgattgctgatatcgaagcccagccgagcgacgctgttcagaaggttctgaagtccttcttgcacaagatctacaagaggcagaagtagggtgtctcttgggcaggaaatctgctccattgtcgcatgtttgatagatgactagtggtgttgattttatggtttagtgcttcatgttgtatgttgcgccttgctgctcccagtagtaataatgatgcaaggcgctatttcgggtttaatggaccgccttggtgtagacgactgatggttctgtaatttgcaccttgccctttcgtttggtcttatcttatattggggattt

SEQ ID NO: 13584 - DNA, 1059 bp, Triticum aestivum
  unsure (1)..(1059): unsure at all n locations
  Clone ID: PAT_TA_13584
cgcacgcatcgtctcgtctccctccctcccttccccctctcctctctctactagtactactctactgctactcgtagcagtatatattaatactggcagccgctgccagtgctccgagctcgacgcactcgcgatctccctccagtctcccctccgcccatcacccgtcgccgtcgcagccccgcccctaaaatactcccgcgcccctcctagccgccacccgccatccgtcccccgaaaatctcccagcgcagccgtactgaggtcacccgccctccccctcggccgatttactcctcggcttccctcccctgtttgaggcaatggcggcggcggcgaacggcgggggcggggagagcaaggcggcgttcgcgcggatctacgacgcgctcaaggcggagctgctccgggaccccgccttcgagtacacggagtcgtcgcaccagtggatcgaccgcatgctggactacaatgtactgggaggaaagtgcaaccgtgggctctctgtggtcgatagctataagctgttgaaaggcgtcgatgttcttactgaggaggagatgtttcttgcctccactctcggttggtgcattgaatggcttcaagccttctttcttgtgctcgatgatatcatggacgactcccacactcgacgtgggcagccttgttggtttagggtgtctcaggttggcttgattgctgtaaatgatgggattctccttcgcaaccatatttcgagaatgcttcggctccactttaagaagaagccttactatgccgatctccttgatttattcaacgaggttgagttcaagacagcttctggtcaaatgctggaccttattacaacccacgagggagaaaaagatctaacgaaatataacattggagtccaccgccgaattgttcaattcaagacagcctactattcatatctgcggttgcatgtgcgctgctactctccggcgagagttggagaactacagtgcttgctcccttgacccttccctcccctcctnctctgcttccgctttcctccgcggtgcgtcccgccccgct

SEQ ID NO: 13585 - DNA, 1640 bp, Triticum aestivum
  Clone ID: PAT_TA_13585
cgtgcggtcgggagctccccgcttctcctcatcctcctccccaactccaatactctccacagaaatctccgctccttctcgtcccttctcgctcgcgtgcgcgtgaggtgcgcaatggcggcggcggcggtggcgttgtcgaacggctccggtggcgactccaaggccgagttcgcggaaatatacagcaggctcaaggaggagatgctcgaggaccccgccttcgagttcaccgacgagtcgctccagtggatcgaccgcatgctggattacaatgtcctaggaggaaagtgcaaccgtgggctctctgtcatcgatagctacaagacattgaaaggtgtagatgttttgagtggaaggaggagacgtttcttgcctgcacccttggttggttgtattgaatggcttcaagcatattttcttgtgcttgatgatatcatggacaactcccagacacgacggggccagccttgctggtttagggtgcctcaagttggccttattgctgtaaacgatgggattatccttcgcaaccatatttcacggatccttcaacgccacttcagcggtaaaccgtagtatgttgatctgattcatttgttcgatgaggtttattttacgtctgcttgaggttggttgttagaacgtctcactacttacttgggagaaaaggatctcacaaaagacaacttgaagtcttcaccggcgcattgtgcaatacaagacagcgtactattcattttatcttcctggttgcatgtgcattgctgctgtcggggtgtagaatttggactacttttcgtctttgttaaagaacattcttgttgagatgggctacatactttcatagttcaggatgattatctagattgttttggagatcctgaatctattggcaagattggaactgacattgaagactacaagtgttcctggttagttgtgcaagctcttgagcctgcagatgagagccaaaagggcattctacttgaaaattatgggaagtcagatccagagtctgttgcaaaagtgaaggatctgtataaagaacttgatctggagacggcatttcacaagtacgagcgggagagctacaataagctgatcgccgacatcgaggcccagccaagcaaagctgttcagaaagttttgatgtcttttctggagaagatctacaagaggcagaagtagagctaagctcttggagaggttgttgtgtcgttccgtgctttggtaacttgttccatgttctgtgtgtgttggtcttattaccataatgtacagcgtgttattccttccaacaataaactacggtgctatttttttatggtgcgttgatttgtgttgtcagaaccgcgttgctgctcccactctaaaataattcatgcaaaggcgctattttaggggtttaagtggaccgctttgggtgttagacgactggcgggtaagttattcccttcttgcatgtttgatagatgactagcggtgttgattttatggtttagtgcttcatgttgtatgttgtgccttgctgctcccagtaataatgatgcaaggtgctatttcgggtttgatggaccgctttggtgtagacgactgatggttctgtaatttgcaccctgccctttcgttaaaaaacc

SEQ ID NO: 13586 - DNA, 674 bp, Triticum aestivum
  Clone ID: PAT_TA_13586
aaaccgacagaagctggaaataattttcaggcgcctgacctacaggctcaacaaataatcattagttacaacacatctttttggcaggcacatttatggcgctgctatgcactcgaaggcacatccaaccattcaaaagaagaaaaatgaactgtcacatgacaaattctctctcctaaagactcgaatgaaaataacaccaaaatgtttgcagtggtcctctatttattggcaccatatctgtctagctgatagcagcgtccttcttgcctcatctgcgatgcttgcagcagaaaaattggcaggtatgttagcttcagattcaacggacgcctttgctacagcaatcccaactgcaacactttgcataatatccaatcccccacatagagatgaacggacccctccgtccacccggtcacccccgcccgggaggctgaccactgaggcagatgttgcaggtaaatggaaaacacaagttctggaagaaccttctctagacaaattaacaggcatgctggatagagaacatccctccaatttttcaagtagctgagttgagaaaggtgtcactttacaccttttcggatccttcatgaagttgacgtgctctctgcaacatatgaaaacaccattcgagccaagtgtcaccaggagaagcttgatgccctttt

SEQ ID NO: 13587 - DNA, 640 bp, Triticum aestivum
  Clone ID: PAT_TA_13587
ttttttttttttgggttcaaatcaattcacaacatcaccactcttctaagctcgacagccaacagcttatgccatcgctgattacacaaccctatcgagcaattacaactactacatatataggagaacgggaaacaactggatatcttgccatacatgttttttccaactgataaatctacgcctagtcctagagcattcagagggttagaagatatctcccggaccgttccttgtcctatacaagcacacgcacacgcgcacgcgcatgcacatacagatccgcgttatccgccacagcagcagcagcacttgaagcagctgcagcaggctgggcacttgaatgcaccaaatgcgaagcatttcctcagggcgtcgcagcagctgcagctgagattgcagctcggtctgcgaactcgaatacggcagcaacagttggcggtgaaggtggtggtcgttgctgtgttcactcgatatgctgtctttgtcggctcaagggactgccgaatcttcttcagcctcgttttcgttgtcacactctccatttcacggatgaacttggagaggtggcggatgaagtcagggtacagctccaggttgcaaatgaccgcctcctttgatccatagtggatcatacggc

SEQ ID NO: 13588 - DNA, 1099 bp, Triticum aestivum
  Clone ID: PAT_TA_13588
aaaaataataaacaggtctagaacagactaaatactgctagaactactgttatacaactaagttgctgataagctgaactagtactggattactagtgtagagatcaagcaaatagcaaataaacaaacagccacggtactgttggtgccatgattccctgccgatgcacatggccttgtaaaggcggtcatactagtcaatctaaaggataaggagagagaccagggaaagaaatcccatgcaactcatcccccgtccgcgcgaagacacaaccaggcggagaacaccaggtcggccggccgcatcatcggcggcgagcaaaactcccgccgcgctcgtcctcacatgaagaaccaccggggagatgggagcccgagcgccgcgggctccgcgtgccggagtggccgttcgacggcaagcacgccagtgggacgccgagggccaagaggcggcggcgaacttccacgcgcggcaagggcgggtgggtggccggagtcggggacagcaggcacagcggcgtggcagcgtcgcccgggacgcgcgcaaccgtcggcaacctctgaagcggtgcgtcgccgacagcctcaacaaccgctggagtctgatgctgcagcggcgcggccccgacggttccaacctcctgaggcgctgctaccaccaggtcaaactacccatccatgcgctgagcaccaaaacggcggcggcggagccaccagtgccggatcgatgcccccatcggcctcgagccttggtgcagccggaccggcgaaaagccgggcgggcacatcgggctgcacgggctggttcgagggccccgcgccgtgccggtggttgcgacggaggttctgacggcgctggttccaacctccacgccggaagcggcggaggtcgcgcacatgacgctggaagtggcggtgtcggccaacaccatggcggcggtggcgagcgacgaagcggtggccacggccattgacgcgaaggaggcgaagaaacagggacattggaactcgaggcatggttccatttctcacttttctctgtttttcttggttctcgtcggaatcgctctcgccggagagcatgccgataactgttgga

SEQ ID NO: 13589 - DNA, 686 bp, Triticum aestivum
  unsure (1)..(686): unsure at all n locations
  Clone ID: PAT_TA_13589
ttttttttttttttttttccgagtaacctttgtagtacagtgacacactgagccatgctgagatgttcttcctgttcccaaggttacttaagtagatcaaacataaatgaggctaccacggttcaattagaaactaccggtgcttggatttttgtactgcctgccattgcccatttgccacactcactcaagtctagacgagaggggagaagaaactaaaacttacaggagaacggaacaaagaaaacaatagcaagaactacaagaacacatttctagcaaggtcaatcagatcaccacgggttgcaccgcgctcgatacggcggcgatcatgcgaagcgcttgcggccgtcaacgatggcgaggaggcgcgccacgcccttggtccacatgtcgtgctccctctggctcgcgcactcgaactcgatcacccggtgctccgccgtgcgcaggccgaagtagcgccggtgctcgccgccctccagcaggtgccgccccggccacgccgccaggtccctgcacacgtccaccaccacgctcttcttcttcttggttatggtcccggcgacatgcctgctcttcatcttcagcatcaccacgcccgtccggttgatgtacactgatacgaccttcaatgcaacgatcctttgcgggtgcgcttgangagctcgatgccgcgggggggg

SEQ ID NO: 13590 - DNA, 1291 bp, Triticum aestivum
  Clone ID: PAT_TA_13590
cgtccgcggacgcgtgggcgcatacgccgcgaaccctagccacacccccaccgccgctaccgcgccctccaccacaccaccgctgccccgcctgccccaaccactccccgctgctgctgcagactccgccctccacaccccaccgctgcagactgctgccgcggtcgaccccacatcacagcgccgtcgaggacacggacgacaccaccagcgccggccttccacgtcgcggagccactccactggcgaccaccccccttctccgcgagcttggtccacaccgagcaggccttctccaaagcattgagcggggctgcctcctctacgtcatctcccccgagcagcggagcgtcctccctcccgcgagcggctctgtctcctcagtacccttcccctaggcagccacgtcatgtatttcctttcaccagtgtcctcttcaatagccaattgggacacaatatcacaggagtgcagaaattttcggatggtgctgcaagataaacacaacagggcacgcgccagggcgatgtatctcatagccatacacaaccatttggaagtggagaagtccatggcaaaagcagtaatgcgaccacaagcaagctgaggagcatgcctcctattcgtcctccgcagcaggcagtgtggtgtcgactacgtctggatagcaactcatctccatcctcgccccaagcagtgtcgcctcacctctacttcctcgcctaagcggtaccgcctatggtctccgcttcaccgccaatggagcatggtagcccagtggcaaaagcttctatgtatgcagttggaagtggataagtgtcaggctcttcctacaggatgtctactagttcagttctagtcataaacaaagccaccagccatctatgatcaaaggccacatattctgctttaaattgtttatcaagttttgagttgctaaccacatatgccacgtggttacatgctctgtctttaggcttcccaagggtacataagttgatggagttgtggaagatctgcaagctgctggaggtttggaagacctacagttaatttggtcaagtgatatatgcctcgtttgctgaacccagagacattggcaagttttcctatgcttatttggtggttgttttggtacacaagccattatgtgctcattttggttgtgtgacgcatataaaaacatatgtactgaaccttttgtagcacgagctccttgtatatggtcgtttcatacatgtatctagaaacatgtgtatttggtctggcatgtgtaattgaatgaagttta

SEQ ID NO: 13591 - DNA, 658 bp, Triticum aestivum
  unsure (1)..(658): unsure at all n locations
  Clone ID: PAT_TA_13591
ttttttttttttnctccccgatnttgttttttgtttttctcgtttctttttcggcccccccctcttcttcgccgctgtcgcccctcttggcctcagtgcctccgtcggctgctttgctgtgccccacccccctacttcctcaccaaatcagcactagcacctggcagagttgcaattgaggatcagcagaactgtttttggggacgaaccaagctgcactgaatcagctacaaatgtagccaaacatgacactggcgcaccagcacccaaaatgcaattgaggaatatctggtaagaaaacgggggttcctgagggtgatatgattgctattctcacaggagtcaacgtcgtcgtcctgtcctctcacgtccgtgcatactgcaccgacgacccaactgagctgtaacaaagagcaacctgcactgctcgctctggagccgctaaactggaaggcgtcggcgtcctggacaaactgcagaaaaacaaaatgtgaagcgcacaaaaaaacctattgcacagcgagcaccatctcgaatcccagccaaactacacgcgagcaacaaccgaacctcatctgagtgcgtcgtatgtaccaatggcaaacgaactgtacaagaacatgcaccaagcagcaagggccctaccactgtattgctc

SEQ ID NO: 13592 - DNA, 843 bp, Triticum aestivum
  Clone ID: PAT_TA_13592
gtcgagtttttttttttttttttttgtcaagcacaatttttttaatacatttccaagtggatctcatcataggcagacaaatttcggtgtgtgttatccatcctaacttgagtacccaatacacatacatgtatatcttggtacatataatgacatgatcattttctacttcaaatcatcacaaccattctgttcctaataaatccaaaagatggacccagacaaatatgggaatatatgtccaagtatgatcttttgaatacatgtctaagtggatcatcctaggcaagaactttttagtgcatgtcatccatcctaatttgagtgcacaagacacatacatatattacttggtacaaaacatgacatccttttccacgacatgaacagcgaaccccaagtgtgaaggactgaagtgacccccactgaataaagcatccgctacctgagctgccaaccccgtgtgcgatcccgttaagctcatgcacctttaggcactccgttgcttctctggtcttgccttcgggcctctatcctcctttggttcctaactggcggcctgcagcctaccggggggcatggcctgtcctctgcccctcccgtggcatggttggaatatttgtccggcccggttaaactaccattgggcataagcgcagtaagctatctcaaaacctatcaagaaaaagaagatgtgtttgaactgtgatgtgatggtgtaaccttgcactgctcagcattgttcttcaaccataatcatgtatcagtgagttggcatgacaatatatagattaattaactggctgcactacagtctaaggagcacaactgctttatctcatc

SEQ ID NO: 13593 - DNA, 694 bp, Triticum aestivum
  Clone ID: PAT_TA_13593
ctttcctttggttttctctttcgacgcagcttggccttcctttcggtcccggatctcgtactttcttcatatgtgctcctctgttgtattcctcggtgtggcaagttttgtgccaccggctggcgtcatatgaaaagttcatcctaatttatcaggatgtactttgtagcctttcaggtcaatacaatattaagttaaaaaaaaacttgtatggtctttcggaacaggtgaagcaaatgatttcacttaggtgacttgtccagccttgtagcaacgttgcccaacctcttgctcatcatgcaaatgtagttgtctacgagaatggaatactcgcagcagtcgacatgcccgttgtcttcccgctatgaccattcgcccgtcaacctgctgcaggactgtagctgcacggtgctgcaatttccatatctcctagacacaacggtcgcccgtgcttcatccagtctcgacgtagcactgcgcatgactgccaccacacaaaggacgccggggcgcacggtcgtccttctccaccacctacacgatgcagccgtgtccgccaccctcgaagtgaagccctgctcaagccacaacggcgccgccccgtgctcccttcccctgctccacaaccaagccgtttcccgtgctcctccaccaatcctcaattcgtggcggccagcctcgtgccgattcctgc

SEQ ID NO: 13594 - DNA, 1168 bp, Triticum aestivum
  Clone ID: PAT_TA_13594
cgtccgcaaaatttccgcatctttaatcggccaaaagcttgcaccgacccgaggagctcaaccactccaatcactaccagtgagccgaggcacgtctcacgccgtcaacgcctcggaagagcgcatatatgcggcgtatcccgcagactggactcccacagtattaaccccaggcacgcctcccgctgcaaccaacccgagtccttccaccctgcacagaatctcagcccaacccacaggtctcgactcaagccatgggcgccggcgacaagacggccgcgggcatgccgcgcatcggcatgggcacggcggtgcaggggcccaagccggaccccatccgccgcgccgtcctccgcgccatcgaggtagggtaccgccacttcgacacggccgcgcactacgagaccgaggcccccatcggcgaggccgccgccgaggccgtgcgctccggcgccgtcgcctcccgggacgacctcttcatcacctccaagctctggtgcagcgatgcgcaccgcgacagggtcgtccccgccctcaggcagacgctccggaatctccagatggagtacctggtcctgtaccttggccactggccggtgtccatgaagcccgggcggttcaaggcccccttcaccgctgaggactccgtgccgttcgacatgcgggccgtgtgggagggcatggaggagtggcacaggctgggcctcgccaaggccttcccggtcaccaacttcccctgaaagaagcaggagaccctcctctccttcgcctccatccctccaaccgtcgataacgtgggggtgaacccggtgtggccgcagagaaagctgagggagttctgcaggggcaagggcatccagctgtgcgcctactcgccgctgggggccaagggcacgcactggggcagcgacgccgtgatggacgccggcgtcctgcaggagatcgccgcgtccaggggcaagagcgtggcgcaggtgtgcctgaggtgggtgtacgagcagggggactgcctcatcgtcaagagcttcgacgaggcccggatgcgggagaacctggacgtggacggctgggagctcacggaggaggagcgccgccggatcgccgagatcccgcagcgcaagatcaacctcggcaagcgctacgtgtccgagcacgggccctacaagtc

SEQ ID NO: 13595 - DNA, 586 bp, Triticum aestivum
  Clone ID: PAT_TA_13595
gctcgtgggtcgttttccccccccgcgtacattcgcccagaggctgccggtgacgctcccctgcccctgccttccgcccacgtcaggccccaggcccactcgcccctacccacccagcctcctgtttgccctcgcccccccgctcttccacactcagcttccagcctggactcgcctccgctctcatcctagcccaggtacctgcctggacttgcctcctgtcacaccctagccgatgtacccgcctgtgcattcgctctggccccctgtgctgctgccgcggtcagccgccgccgccgccggagcccggccccccctgccccggcgtcgacggggtgcccgcgccccccgcccccgcctccgccttctcctcctcgacctcggccggccgccggcccggctctcgccccctgcgccgtgcgcccgggcgccgggccctgcgccccgcccccctcccccctgtcctctgcgctgcgccctgcggccccgggtcccgggccgcccccggccccgctctgccctgcgccgcgcggggcccccagccgccaatgtccatgttctccgggaacgagggatcaccgctgtc

SEQ ID NO: 13596 - DNA, 539 bp, Triticum aestivum
  Clone ID: PAT_TA_13596
ttttttttttttgcgactaaacacgaaaaatgtttttgtgctcgctttggttttgcccttcttggcggtggcaaccaataggcatcaaaatgctttctcgaggacttgatatacagactgcctgctttactgcactagggcatatgctcatacagagctacaaaatgcacactcaacatactagctcaagcatgccaaccaaaaaacatactctactctgctgggaaagaaatggttactctagattacactactgttacatgagcgcggcttgttgggcatcaaacctgacagttcgttgcctgctacaaacctgaactccggttaaaggaaatgctcccaacaaacttttactgcattcgagggccagaaaggaaaacagctggtccccttccagtctaatgtcattgccaacagcactgcatcagcaggacatcctatgaacctgcaaagttaggttgcctctcaccgccagaagaatcatcttcttggctctcatcaaccatggggttgctgctggaattagacaaagggggagc

SEQ ID NO: 13597 - DNA, 886 bp, Triticum aestivum
  Clone ID: PAT_TA_13597
ttttttttttttttttttaagggagaaacggagatttcatgttttcattaaacgggtcagtctccgacagccttccactaaacagtgcctttgttaacgcccactactacatggtgaatctacagcagaaaagtagctccagtaaacagtgcctctgtatctaccacgagttagcaccctggccatcggagagagaaaatttggggtaaaaacaaccctacaccatgtattgcattgcgacctgcatcagccttgtgtgcggtatgctcaacgttgctatgcctctccggcagttcttcctcaggaacgcgtagaaatagttgatcactagcttcttgacaaagaatgactccttccgagctcggatgtcgccatgtccaagaaggtaaaccacgccacactccttggccttgtgaatgaaagacagctcattgtccaggcttcgccttccatccattgtcccgtccagagatccatcaaatgatgtgcttgatccaaagtttggatttgaaacaccagcagactccgcaaggagtggaacaccaagagagtagatgctaccatttggaccaacaagaactcttgatgagcttgacgcaacctcctcttcagagtccgtgttaccattctcgtcactctccagggagcgctcttgagcttctcgccgtataaatttctctagactttctatcagaagctgttcaaatgtttgggggttctccttgcgtacatctttgtacccatacctgcagacatgtatgattagcacaggtagcaaataaactctcctcaccatcaagttattctatatatatgacacagctttgctatgtccatatcaagctatgcataggttaagaaaataccaccaagggccctcgtgccg

SEQ ID NO: 13598 - DNA, 528 bp, Triticum aestivum
  Clone ID: PAT_TA_13598
cgtccgatttttttcaggtagaatattgatcccttggcatctcctactcttgaaattaggtgcagcagcaatatttcgtggtgagtacaacatgaactacactttcatatggttcatcgccttcttcgagagcatattgatcaagaagtggactataaggtgattgttttctgcacagcagccatggtgactgaatttatgtatataatgcttcgagatctgaaactaaacgtcatagagataaatttaggaaagcctcagctttataggacacgtgtatctgaagagttacgggattccaatcgcctgattctggtaacatcagatgtttcaacacgtggagtgaattatccagatgttaccccgcccattggggagaaacaaagttgtatatatgaaggggatttgtctgattaccttggaagaaaggatttaacatcaaaatcatagcagaagaggacaacatcagccgtcatgacctacagacgagggcccaaaccaaattccttgtgctgcccgcgctggaca

SEQ ID NO: 13599 - DNA, 1414 bp, Triticum aestivum
  Clone ID: PAT_TA_13599
ttcaaaaaaaaaaaaaaaaaaaaggaaaacgggacagggctcgaatacctgcagcacgagaatttcatggaatgagcagtcagttagtcaaggcaatgccgagtcttatttttacaaaagtccaggaagacaattgtacttcgtcaacatgtgccatttgcttggaagactacagtgttggtgaaaagataagggtgctgccttgtcgtcacaagttccatgctgcttgcgtggacctgtggctcacatcatggaggacattctgccctgtatgcaagcgagatgcaaatgctggaatgtcaaatttccctccatcagagtctacccctttgctttcttctgctattcccttgccagctgaatcgacagctttgtcttcttttcgttcaatggtagcagcatctcctccaaggacaataagccggcatccttcatggcagtctatgtcccgcactaactccaattccagtatcctccacacccgtaacccatgcagatgtttttccaactcacctgctatcagtacaagtaggagcagtgtagaccttgcaaacatgtcatcgccatggtcgagagcactccgcaccttgcatccgcgcactccctgggtggagggcatttttctccgccgatcagcatcggatacacatcaccacatgtctcccctttcggctacagattctctggacagtttataggttcaccccacatcccccgttctgagaacgggtctccaagttattatcctggctcttcagggcagcagtacccttacctgaggcatcgcacagagtcagggccaagcttatttaccatggtgccccagtcgccacaacagatcctgctgcaggatggtggcgactcggcaacgagtctatcagcttcagcatcgacccagtcgctccgtcaggcctacctgcagcattgcccctgattctgatgtgagcttatctgctgcaacatcggctcagtcgctgccagggtgctgattgcccttacaggttcaccattgaactccagttagacctgttaccatagaataagctctccatgaagtgttcagcggccgccaccttcgagtgaagcggatttgaatgagcaaaagggagctgcctggcagaacataccagacagatccggtggcctttaatctgaccaacttgctcggcaccttggaagactgggaaatgactcttgctgaccacacttgagtttgcaaggattgtcttgaggcgtgtgtgctactgatgatgccaagagtgtatattattacagtttaatagggatctgttagttgcagtcagaaatgccttgtgctagtaagatgacgtatatatattctgttcatgaatgcttcagagaaatatatcaatcttgttcgttctcactcacaaaaaaaaaaaaaaaaaaaacc

SEQ ID NO: 13600 - DNA, 592 bp, Triticum aestivum
  Clone ID: PAT_TA_13600
tttttttttttttttttaatttaaattgtgctgaaggcacatcgagcggccgcccgggcaggtacatcttggcataatcaaatagaatgcagagtttcccaaacgaacttccacatgtttttgtgaattgaaccttattcattttacacatagagtaaactgcagtagcattttttgtgcggatgcaatctgctatagagagaaatggcaaccaaaactactgtcactgcaatcttctttttatccacacatttttttcctagcaaaacttttatggcgatgttaggagaagcagcaaggaacaagagaactgatgggcgaccaggaggagacgtgcttggagcgtagggtgttactgatacactcggcatcagggaatttcccgcttgcgcaagatcaaactgcaccagttcgtggtgcaaaggccgactgcctggcttgtcggcgtggtacctcggccgcgaccacgctaagcagcaacatcaacacatgcatagtgggtaaacagaacatgcaaagtagcaagcaatcaggcaagctccgcaccttccccgatctagaaaatcactataatttagattgtcagtccaca

SEQ ID NO: 13601 - DNA, 721 bp, Triticum aestivum
  Clone ID: PAT_TA_13601
tttggcgggggtcggcggccgaggtcgagtttttttttttttttttagtgagcaactgatttatgatttctcgcattggttgttttagggatgacatatcagtgcatccgaaattgccaaagcagaaacattattacactgcacacagtgtggagtagcattacatgtcttcattaggtatgctgatcttcgtgatggtcctcagcgggcagcacagccagtgctactacctgttggtacggtggcggtgccgcacttgcccggccgcccccgttgctgtccctggcggcgcccttgaccatgttccccggaagggaggacgacggcgtgacggccttgcgtatcttgaagatgttccacgccgtcccgacggtgtgcccgaccgtcgcgaacgcgtctccggtcgcctcccctgcgctctctccatacctcttggacactgcaccggaaacaacgttggaggttgcagcaagcgacctcctctcggcagcctctaccgcgtccataactttattgatggcgtcgagagaggcgataacgacctctccggggacggtggagaggagggctttcccttggttggaacggagcagcggtgcggccatggaccctgtcaccgagatgaccgtgtccagcatcgtcttgctcatcttctccgtcatctccgacagcttcctcaccctcttgaggctcttgttgactcctccacgcttcgccggac

SEQ ID NO: 13602 - DNA, 1721 bp, Triticum aestivum
  Clone ID: PAT_TA_13602
aaattattagttacttggccatcgctttgatataggtttttgcccctgcccttcctatggttgcagattgttctttagcccaggcctagctccccatggttgttatctgtactcttgatccctgtgctctctaggtcttctggactgagtgtgggtattggcaagatataatagttaggagtttgggcccaaaccgctctgtacatggagtgaggtcagattcttgtagacagtctgtttgtttaatttgttatggtctgtacaatttagctttcagtactggatctcgatctggtttggaaatgaagcttcatatggtgtgtgaacatatggtgaagggtacttgaggcaggtcagtttcccatttttggtcgcattgatttgctgtattcctcatctgtgcttggtgaagtcagatttcagtggctgtaccttagttccttgatttttgtttgttatgatgcctggatgggaagcttagctctggcatgtgaggattcttccttcagacaaccgaaataatggcttaaatcctggactcgattcttgtttcaaactgtttccaacagtttgttttagtggtcttcttgtgccgtccgggaggttgtaacttttcctttagcctgggccgtgcgcatattggcttaattggtatttttgttacctgttcgtttgatcccgtagtcagctagcgcttgggattaggatggtggccaactgattctcctaatggttttgacccctcatttctggtcctcaaactgagtgatatgtcctttttggcgttcttctgtttgggcatgtgttcactgccttctctccaattcagccagctgggaggggtcactgtccgcatctcgaaattctgttcactgtcctgtatgaacttaccgggaaggttacctgaggcaagtcagtttcccatctttggttacactgatttattgtattcctcatatatgctttgtgccgtcagttgtgtgtagcaatagcttgaattcctcgataatgtttgcccgaggactgtttgggagctcctttctggatagaggagtttacctagaccacaaaaacttatacctggactccatgcttgtttctactgagaacttaggttttggtatttggctgcttgtatctttcaacttgcaaatttatcacccaataggaagtaaagatcgtacattgtccagttctaattatggtctgactttccttgaagaaacttttaagtatgccgattacatttgggctgttcattattgataggcactgttggaggttttattggaagattgtagagttggaaatcctagcaaaacgtcagttggtgggggtacttggtgaagcaaatggatcgtctgcttcccggacggtttggacttctgattaatcctgatcatgaagcatattgcttgatttggtctttgtggcagctttcagtttgaacttgaattcagtggtagtttggagttaatagtgtgcacatctgattcttccaatcgtcctgaagcatcttacttggtttctgttaattgccatcagtatctgcttcaacttgcatgtggaatatgatctatcttttgctccgaatcaacaaaatgctagaagtgtctcaaacaagggtccaacaatggaaatatcagttcatactcaaagtttgtataggggattatcaagttttgatttggctattaattactacttggttgcctgtttcc

SEQ ID NO: 13603 - DNA, 1172 bp, Triticum aestivum
  unsure (1)..(1172): unsure at all n locations
  Clone ID: PAT_TA_13603
ctgcttatacaaggcaaacaatcgtgttttacaggcaagggtacacagtaggctgggttcaacactaagcaacaaggcatacacgctngccagaagaacaaagttcttttttttttgcagaagccagaagaacaaaggcaaaaaccaaaagactacccaataccgccacggcaacagcttgcgtttttaatgcatatccatctatcacagcgttgcttacaaaataggagctcactacagcaacctattcaccgccttgatatcagtattcaggacaatcacagcccctatttttaatgcatatcctgatatcactccagagaatgtgccaatcgccaaattttctggggttgatattataatagacgttaacaattggcatgagaaggaaattaggtgagccagcttatgtttgtagttcactgaggccatttgattgtgacattgcaagagcatatatgttcctaccatcacttccgcaataataggtatcactgtcttcagattattccagatgattataagaagctttataggaaccaaaagtaccacatttcactgtcttcagattattgtctcgaagtgtgttccaactttcttttcacaccatgctttcccgttgttgatccaaattcagatattttctcattgaataatgtcagaagtcttgcaagtccagtctccggcttgtattcggtgccaactaactctgccagcatgtttctgaactcttccatcttcactgcataattaatttgcgatgtctgacgtgtgcgagcaacattgatcccaacctcctcgccacctcgattaagaactggggctccaattaacccatctccaatctgacatgtgtggacaagtgtcgatagttttcttccttccacccactttttacagacattaacaccaatcaatccagaaactataataatatccttgtagaaaccctgacacccaacagcaaacaccggcccagaactcaaagtttctccatcatagaaacgtggagcgaggcatggtttagccttaagatcagaacccaatatgatcaaaccatacagtggtccacttctcattacaactttggcgtccaaatcattttggtcaccaaatcttgcagcgacagtatatccttccgccggatcacagccaatagttgtaattactcc

SEQ ID NO: 13604 - DNA, 1136 bp, Triticum aestivum
  Clone ID: PAT_TA_13604
gggtgaatgcagcagctgaagtgatatatgatctcgtcgatcctggtgcaaatctaatatttgggtctgtcatagacccatcatatactggtcaggtgagcataaccttgattgcaactggattcaagcgccaggaggaaagtgaagtccgacccgcgcactctggagacaacagcaaccgccggcgttgatcagcaatgttgatacactgatcgtaatcccaaatgatactgcactgactgctgtttctacagctacacctgcgttcggggttttccagaggctgaaatgatattcaagtagtctaggtcctctttccagtcagatatcatcactgtgccaaggcttggttaaatgttgactttgctgatgtacgatcaggttatggtcagatgcaggttcatccttgatgggaattgggactagcaacaaattagacacgagcaagagatgctgcactcaatgccatacagtctcctctacttgatattgttgtattgaaagggcaacaggaattgtgtggaatatcaccggagggagtgacctaacattgacagaggtgaatgcagcagctgaagtgatatatgatctcgtcgatcctggtgcaaatctaatatttgggtctgtcatagacccatcatatactggtcaggtgagcataactttgattgcaactggattcaagcgccaggaggaaagtgaagtccgacccgcgcaggctggaggcgatgttaaccgcggccgcagctccaggttctcttcatcttcccaggacgaaggcccgaagctgcaggttcccgagttcctacagcggaaagggcgtccagggttttccagaggctaaagcattttttccagtgtcatgagcttctcagttcctctagcagtaggctctttgttttgtttcgttgcaagctttaggcgatagactgtgtgtgtgatagcattagactgcatatgaaaacctatctttgtcagcgtgtaaccatccatggcggtctcttctaagccatcgcatggccctgtttggaacttctttgttcctgcgggaaataagccgattcttgtgaaattctcgtgttcgaaacgcgcccggatggctgggttacatcgagcctcgatctcctgttgtgttc

SEQ ID NO: 13605 - DNA, 922 bp, Triticum aestivum
  unsure (1)..(922): unsure at all n locations
  Clone ID: PAT_TA_13605
cgtccgttctcaaactgaggtatcatcttcactgcctcttggagttgcaaaagtggaagtagaaccagtggaggtgattgagcatgaagcttgcacgccccaggcgggcccagtgttggcagccatggatattgcaaaggagaacattccagccatggataccgcaaaagagaacgtccagcctggtggttattcgagtccactaaaggagaacattctggctccgcatcaaaatatccagcctgaagagcatatgactcctgtaaagggaagcattctggcctcacatacaaatgcgcaggctataggggagatgactccaatgacactcttgagccagaagctgtcctccatttctctaggacaagctaatggggaggcgactccattggcccagaagctgtcctccatttctcaaggacaagctaatggggaggcgactccattgacccagaaggcgccctccatttctcaaggacaatctaatggggaggcgactccattgaaccagaagctgtcctccatttctcaaggacaatctaatggggacgcgactccattgacccagaagctgtcctccatttctcaaggacaatctaatggggacgcgactccattgaccctgttggcgcagaagctctcctccatttctcttggggatgccaccgactaggtgccttgttctgccagaggaactgagcttccgaatcgtatgctgctggttgttttatgattacatccttgttatccagaaggcaaccacagctgaagttagtacaaaaggctgtcctacagtttgttttatttcttttagctgttcaaagaatgagagtgctacgagtgtagtaaacgcagggcatggttgaaaactgtgatattnctgttgtgtaccaaagcacttgatncctgtgtatgtcaattg

SEQ ID NO: 13606 - DNA, 561 bp, Triticum aestivum
  unsure (1)..(561): unsure at all n locations
  Clone ID: PAT_TA_13606
ttttttttttttaggtctcnttggtgaacacacaaccacgtaatatccagcacgcacgtttgatgtgctggcccagcgcgatcgatgccttggtacantcgttaaaagcgagacatagatcgtctttcggcccgtgagcttaattttgtaagactattgactattgaagccgttgcttcaagcaaacatgctgcttctacccccaaagaatatgcaaatgaaacttgcttcctctccgctcaaaaaggaaacttgtttacgctaacaataggagaagatctcatattttttgcgaatatttgccagaacttaagtttttgtttcccgaacatcgaaaggaggagatgtttatggtttgtcttttctagtcaaagcatcctgagagactgttacagaccattaataacttcgtccgcaccagatccgtcgagatgggaacaacaactttaaatcagaaaaacagtcagttttgaaggtgtttggaaccaatcagaatctccccccccagccttccatcaggcaccctggtgagtgttgttcgcgttcgtcgccgcggctgca

SEQ ID NO: 13607 - DNA, 666 bp, Triticum aestivum
  Clone ID: PAT_TA_13607
ggagcaagtttcatatatgataatggatattacaaagagaccgcctcattaaaaaacctcacgccctgtgaagggttccccgtgtgaggaaaaagagtgcagctaagttggcatatggcaacttgtacgtccacgtacaatacaatgggtatctttattccggtcatatgatcatatataggataccagatacatcctcgtgcaatataatggatgtctttattccggttatccccttaaagctcatcatgtacgtggtcttggtcagcttgttcttggttgtggtgaccatggtcatcaactccaagatttttgcgagccagtattcgacgaagacatggccagttgggagcgattggcttcacaccaccaatgatatagtcgtcggttgcaccatgggcaacgttgataagtgcatattggtctcctttgaaaatgtaagcttcctcactcagatgagaagcgaaagctgcttcaactccactttcaaagatggtgtttctcaaactataaactccttctgtgatcttgcggatggcaatgcaagtcttggaagaatagtttatgtttgcataggagtcacctttgaataagtaagcttcgtgcatcacgcttgatgtaaatgcagcgtcaatagagtccgcaaactccgtaccgttgaagaag

SEQ ID NO: 13608 - DNA, 695 bp, Triticum aestivum
  Clone ID: PAT_TA_13608
acacgcagctgctgcgttgtcattagttaccaaatggcagaggagagtagaggtagcagcaataatctggactctaaaatactctagccacaacactgcccccgcaccttgctcatcttattactcattacaaccatctggattcatttgtcctaacaactaagcaagcattggaatcggatcagatgtaatggaaaacgaaatgcttaaccatgcattagattcagtcataaaaacttgttctttctgtctttcttaatatatgggcgtgtaggtctcctgggactcaatagtttcttcacaaaagtacccatcaaaccaagatttaatataccatcaagaatgcctgccataatttcctctatcatcaagaattcctgccaatgccctgttataccatcaagagatttaatagagctatcttgagatcaggggatggattttggagccactgctcgctgaaggtttatggtattatcggacattcagtcatctcaagcacataacctacttgtgcggggcagtccgcgcctccggtccataatgtgatgcagcagacatcaccaaacgatctccagggatgatggagtgatggtagcttgcctagttcagtagccccctgtttgtcggtctccgaccaccctcattcctttacagatgtcgtcatccggcccctcgtgccgaattcctgcagc

SEQ ID NO: 13609 - DNA, 462 bp, Triticum aestivum
  unsure (1)..(462): unsure at all n locations
  Clone ID: PAT_TA_13609
aataggagcatcaaaccaaatcaatgggcctctaaacattcttatgaaaaccatagatagcatctcagataaagtaaatgttgctaccccacaatctacagccccagtaacaccaacaatacttagatagctttaacctttcccatccttgaatatagtacaacagtctcctgacattagattggctgtacagtcatgtaagcaccaagttccaggagcaatttgtcgcggtcaacaatgtttcggtttacatcaaaggatatgttctgtaaccccgcacggatacacatgactgcttgttggatcttgtgtatccgtgcggggctgcagaacaagcagaggcaggcatcacgaaaaggttcatgaatgaaattaggccctccctgctgccattccctctgggngtaaaaatactatgaggataagaacacaagcaaaagcaacaatgtcaaagatgcnaag

SEQ ID NO: 13610 - DNA, 1397 bp, Triticum aestivum
  Clone ID: PAT_TA_13610
tttttttttttttttttttttttttttggaatatgaccagagtctggaagtacattgctaatacgacatgagcaggacagcaaatagccgggttcaaggttaaaagttaaaaccagcagagacacctgtaggccaagaggattacaaatctgttcttccctgagatgtacatgattttcagggggtaaaaacgacaccatcgatctcccggcctatgggcttacattacagtgaagcagataatatacacccggttgcgccaaaaccgaatctctgtgtgttaattcacacagatacaacgctctggcagcctcctgccattttgacacaaacaagtctggaaaaaaaaaaaggcaagggacaaattgccaatccatctgttctactaaaatggaatctgtagcctatatgttcaggagggaacggttgtcacggcttatacctcgcctgacagtcgccactacatggagcgatgctggaggaaatgccttcattgaattgatagtttgcggctgtttgttaagctagtagaataccctgacctactgttaacgagcatccagcacctccaaaagattctcggtttcatgctccttgaaaaccttaacaggaagagtattgttgaaccccttttgattaagaaaatcaccagcaacttgctgccaatcaatactgtcaacgcctttgctgcactcatattcacctcctacccatacgcataccgttttaacttcttctgcacttctgctggctttaggagcaacaaaaataaaaactgtttttgggtcaagatccttgcgagcgaatgcagtcagcttctccatgcagggccatcggtagactagtagttgaacataattacaggcctctgagttagtatgctcaattaatatggtctcaccgtggacagtagcctctgagttgctgtcagttgctgttgaactagttccggtgcatttctctgggcaagaaacaccagtaagctgtttcacaccattggtattagtcttatccgtgacttcctctgctttgtgaatagatggcgcccttggtggcaatactagctcctttgggagtgatggtagcttcagacctgaaaatccccctcttctttctgctatagatgagaccttggacggagagcgtattgatcccaggacaggctttgaatgttccgcattagatgactggcgaagagcccacgcgtccgcggacgccaaagcgtgtggcaaattagatgaagcaggtgaaagaccaagtgacggtggggagctagttgaaggtgacagggagggtgagtctgaactgtactttgagctaatggttgaatctgatgatagagagctcggagaaaggaaaggcggtgatattgatgcctgtacagtcaagcctcgtgc

SEQ ID NO: 13611 - DNA, 1010 bp, Triticum aestivum
  Clone ID: PAT_TA_13611
caaataggtttgatataattttacacagtagcagcgaaacgggctagctgaagcagcacagcaacagagatattcaaacgaaacgagcttgcaatcatttctactactccctctgttccgaattgtacctccagtcctccattcagggctaaggccagactacctccagcaatggctaaggacagatatctaactctggagtctaaaaaattcatgttgtatcttctgattcaatgtttccccggcatgtatcctcggtccaatcgatgctaccgccgattgtacgatcatccctctgcagtctccagcgatgaagtcagcttttgcacaggcatcgatagcagtacgagccgccatcagttgtctgtgccgaagtagcgatcaccatactctcccaaacctgggatgactctgaattcctcgctcagcccggtatctatctctgacgtcacaagcttcaacttcggaaatcgcgtacacacacattgaatcccttcgggtgccgagatgagagtgaggaatatgatcctctcctcagcaacgcctttccttcgaaagaagatctatagcttgatttgctgagttccctgtgccaagcaccggatccaaaagcagaacatgccgttcatctatgtccattggcaggttgtggtatatgagttgctgtccattatctccaacacgatgtatcaaaattttgccaatttttattcctttacagcaagcacgcaaagcattctccatactttcaccacttcggacaatagacactccgcagagcttcttgcagaaatcaactcccgtataaacagatcctgttggagtaataatctgcttttctgtaaatggcaaatggcccaaaccatgctcaactacctaacatgacattattcaaacaaacaggagaccagttaaatcaattttaaactcaatgcaattaactcaacataaagttgataataataagataaaggcttggaaacgaggtacctgcccgggcggccgctcga

SEQ ID NO: 13612 - DNA, 881 bp, Triticum aestivum
  Clone ID: PAT_TA_13612
aattggctggtaaataggagtggaagtcagccccctgacttcggctcaagcaagttaagaatctgcggcccctcaccagggtgctaaatgacacaatcaagatgtacgcttgcagaatgcttcctgccgataacaaaaacaacaaattgtagagctagactgctagagctagaccaacaaattgacaaaagcagcactagttggcagatcaaaagcctatgcatccggaaacaggcagtttcagcacttgcagaggtagcgtcgtatcgggtgcctcacgttccctgtccccggccgctgcgccagctcggagcgggcgcccctcccgccactgcttccctcgaatcgcagagcactggcgcagcgacggcaagaagtccccgctgatctcgtggaagcccagatactggagggacgcgaggaactcgatgccagctggcacctccgtcatgctgctgaggttggctagggataatctttccaggcccgccatggcgccttgctgtatctctagccggttcagattaggcaggtctcttagggagagaatctttagcttgggaaaccaccccgtgagaaatgtcagctgctctcccttgtatgctctggtgaagtgtagaagtgtcaagttcgacaacaaagaaagcgatggcagtgggtcttttctcagttgtgaccaagacagagccaatgcacacacgttttgtcctccatcagattggaagggaggagactcctccaacgacccttgctctaatcgtcctctcaacgatagcgtttgcagatttggcgggaggacgttcaacaagagaacctcgttctcatcacttgcattcacagatagcttggacaaatattgcatctgaactagagactcacgg

SEQ ID NO: 13613 - DNA, 437 bp, Triticum aestivum
  Clone ID: PAT_TA_13613
gtccgagttcgcgcccggcgacgccgtccggccgctcaccgtctgccgccacgccttccacgccgcgtgcatcgactcgtggctcggcgcgcacaccacgtgtctggtctgccgcaccgacctcgacgcgccgcccaacgaggagatcgccttcgccgaagaacacggacacagtggcctcactgcagcggcggtccacgaggccactggacaccggacaacgtcatcacctccggcaactgaccaccggtaaccaacggtcgccggccacgcaacactgagtggcgatccggtgtgtcgcgttctccaaattttgttgaatcctttttaagtactagtagttggtaggaattggtagcttaggtacgttcatgcatgggacgtgtgtatataccgaaatatttccaaataaatgtaagcgtggatattttcactaa

SEQ ID NO: 13614 - DNA, 601 bp, Triticum aestivum
  Clone ID: PAT_TA_13614
caacacagggtacatcaacaactagacggaacaccttcacatcactaatcagacgaacactacacagcacacatcctaaacgacagagagcgcatctctcttaagctttcttcggggtggcggccttcttgggcgacttggcggccttcttgggggacttgggcgcctggccctccttctccgccgtcttcttggggagcagcacggggttgatcttggggatgacgccgccgtgcgcgatggtgacgccggccagcagcttgccgagctcctcgtcgttccggacggcgagcagcaggtggcgcgggatgatgcggctcttcttgttgtccttggcggcgttgccgtcaaccgccacatcccggctcgggaaatcttaacccgattccctttcgggggatgcgcgtgatcgcgctatctgccggggttaccccgtcccttaggatcggcttacccatgtgcaagtgccgttcacatggaacctttctcctcttcggccttcaaaggtctcatttgaatatttgctactaccaccaagatctgcaccgacggccgctccgcccgggctcgcgccccgggttttgcagcgggcctcgtgccg

SEQ ID NO: 13615 - DNA, 530 bp, Triticum aestivum
  Clone ID: PAT_TA_13615
ggttttccggccccgaacccgtcggctgtcggcggattgctcgagctgctcacgcggcgagagcgggtcgccgcgtgccggccgggggacggaccgggaatcgcccctttgggggctttccccgagcatgaaacagtcgactcagaactggtggaccatacagtacggatgatgcaataattgaagatatgaagaaggattacatggtcgcgcaagagatcaaggagaataacaaataagctttatgcaatggataatttgcaaggcaaggttctccatgcttgtatgtacgttgctgcttttggaatttggcagttgcttactggtcatgtttggtgattgatgctgaattcctagatacattttgtaaacatttggatttgtccaggcgcatgcctgtatgtactagatgtgtacttgttttcacttatctgcagaagtggtacgttccctgtgagattaaattaactaggtcctaataatgtattatgtaaaaatgtatattttaatggaggtgtattttctggtca

SEQ ID NO: 13616 - DNA, 568 bp, Triticum aestivum
  Clone ID: PAT_TA_13616
tttaggtgacactatagaatactcaagctatgcatccaacgcsttgggagctctcccatatggtcgacctgcaggcggccgcgaattcactagtgattagcgtggtcgcgggccgaggtacccgaagrgbataccggatgcctacgagaggctgttgctcgacgcgatagaaggagagcgaagactcttcatccggtcggacgaactggacgccgcgtgggagctcttcacgccccttctgaaggaactggagcagaagcggatggcccctgagctttacccctacgggagccgtgggcctgtgggcgctcactacctgggcagccaagtataacgtgagatggggcgacctgggtggctcggaacactaggaagagagcgtggtttcacacgggaggtgatgatttctgtttttggcggcgattgattctgctgccgtcgcaatttgtgcaaaaggccttgcattgcatgcccagctagtgggagtggtgcaaggaacagatctgaataagtgtgagcggttggcgatgcttgtgttcatcgatcgaccgkgaatatatttgttggt

SEQ ID NO: 13617 - DNA, 446 bp, Triticum aestivum
  Clone ID: PAT_TA_13617
cgggtctgccaccgcggtcccagtcggcccatgctggtgaaggagcggtgttgccgggagctggcggccgtcccggattactgccggtgcgaggcgctgcgcgtcctcatggatggggtgcgcgtggaggagggccacgtggtggagggccgccttggtgacagtcgtgactgcccgagggaggcgcagagggcgttcgccgccacgctggtcacggcggcggaatgcaacctgccgaccgtctcgggagtcggtagtacatttggtgctaccggcagattgatgaagattgaattgcccaagtactgaagcgaagtactctactggcagatggaatactgtatatagaataaaagtactcaagtgaaaacaaagcttgtgagctgtatgcgtatgattctatggtgtggactgttaaattgttgtcggttgatgaataaaaaggg

SEQ ID NO: 13618 - DNA, 446 bp, Triticum aestivum
  Clone ID: PAT_TA_13618
gttaggatccatactgcaagccaatcctccccaacacaggcgtatacccaagcagtcaatgatctagacaaggagcttgagaacctgaagcaagcttttgaggatgagaagacccgattcgaaaggatgaagcagggctactaggccgccggtgttggctgctaattaacgtgaaaccttccttgctactgtagttcatatctgatgtctgaactgcggtagaaaaaataacactcaaggatttttcgacatgtgcgaccgggattgcgtatgattgtatggttgttaaacatgcgttggcacttgatatgcctgctagttgaattgttcgctcctgtggggttggatagagggtacggaccgagcttgaagcgagtccttggatcattttgtgctgcatgaattttatgccaatgtattgtagccaacttaaacagacgaaaaat

SEQ ID NO: 13619 - DNA, 568 bp, Triticum aestivum
  Clone ID: PAT_TA_13619
gtcccggattactgccggtgcgaggcgctgcgcgtcctcatagatggggtgcgcgtggaggagggccacgtggtggagggccgccttggtgacagtcgtgactgcccgagggaggcgcagagggcgttcgccgccacgctggtcacggcggcggaatgcaacctgccgaccgtctcgggagtcggtagtacatttggtgctaccggcagattgatgaagattgaattgcccaagtactgaagcaaagaacctgcctgagttcagaaaagactgaccataaggccatcgatgctgagttgatcaaagctattgaggctgtccctgaccttaagaactatcttggtgcccggttctctctcagggatggtgacaagccccatgagatgaccttctaagttgctacaagttcctgagttttggatgtgttttgcctagattgttgctgaaatttgtaccctgttagttgacttcctatgtcagttgaagtgaccataagatattatgagaagatcaagagaatccttaaaaaaaaaaaaaaaagtaaaaaaaaaaaaaaaaaaggccccta

SEQ ID NO: 13620 - DNA, 592 bp, Triticum aestivum
  Clone ID: PAT_TA_13620
gacccacgcgtccgctcgtctcgagcgaggaggtgtattttattttagcatatatatattttcctctggggttgccgcctggctggtccggctcgcgccgcttattttgccctgccccccccctcataaactttcgaaaggcgagaggcggcggcggcggaaggaggaggacgactaggcgctgccgcgggctagggtttcctccgaccaggcgaggcggagaggcgccacccacctccccggcgggtcacaggacctcgatggcgcgagcaaggcagaatctacggtgaccgcccccttctgattccggcagccacgaccccatgccgaccatcacgcactacgtcttggaccccttcctggagaccggctcccttcccaacctccagaagcttgttcccaaggcgcctccagcggggctgctaccccctgagaagtcctccgagaagcccatccctgtgccggtggctcctgccaggaccagcaccttgccagcgctctactccacgcccgagagcacgccgctgccagactcgccgtcgtcgtttcccgggacctggtcgccgtatgtcatcaaccataaacgtcgggg

SEQ ID NO: 13621 - DNA, 708 bp, Triticum aestivum
  unsure (1)..(708): unsure at all n locations
  Clone ID: PAT_TA_13621
aattggtcaactagaaggccacagatggatttccctgtgcagtctgctatcctgtacactggaagatgtagatgttatcaaggaaggaaaggctaggattgctggatatgcactttcaggtggtggccgtggcattgagagagtggatatatctgttgatgggggtaaaacatggattgaggctcgtcgatatcagaaagacaatgtggcgtacgtatcagatggacctcaaagtgataagtgggcttgggttctctttgaggctacattagacataccagcaaatgctgagatcgtagctaaggcggtggactcggctgcaaatgttcaaccggaaaaggtagaagacatatggaatctgagaggaatcctcaacacgtcttggcatcggatcaaaatacagaactcttcaggaagatctaagctgtgaaattaagtacgctgctgacaacttggagcaagcatggtgctgacccttgcgagtcttaccattgtactaaaataataagtcatttcaactttctgtatttctcgtttcttgtcaaaaaaaaaaaaactttctgtgtttctcgagtcaggctgtaccancgaatgttggagtggtgttctatgggatttgagctcacttgatttctacgtaatgtcagctgctgctgtttttttttaactgctgttatcggttggtctgatatcaacaattgcattctg

SEQ ID NO: 13622 - DNA, 746 bp, Triticum aestivum
  unsure (1)..(746): unsure at all n locations
  Clone ID: PAT_TA_13622
cgcccgcacgcctcgacccaagggatcccaatggcgccgacctccaagatggcgctgggcatcaagcgcgcgtcgcggtcgcacacctaccaccgccgcgggctgtgggccatcaaggccaagcacggcggagccttccccaaggccgagaagccagccgccgtcgccgagcccaagttctaccccgccgacgacgtcaagccccgcaccgttagcacccgcaagcctaagcccaccaagctcaggtcgaccatcacacccggcacggtgctgatcctgctcgctgggaggtacatggggaagcgcgtgccagttcgccgggtgaaccaggcttatgtgattgccacatccacaaaggttgacatctctggtgttaaggtggagaagttcgatgacaagtacttcgccagggacaagaagaccagggcaaagaagactgaaggggagctgttcgagactgagaaggagaccaccaagaatctgccatccttcaaaaaggatgaccagaaggccatcgatgctgagctgatcaaggctatcgaggctgtccctgaccttaagaactaccttggtgcccggttctctctcagggacggtgacaagccccatgagatgaccttctaagttgctacaagttcctgagttttggatgtgttttgcctagcttgttgctgaaatttgaaccctgttagttgacttcctatgtcagttgaagtgaccgtaaaatattatagaagnatcaagag

SEQ ID NO: 13623 - DNA, 593 bp, Triticum aestivum
  unsure (1)..(593): unsure at all n locations
  Clone ID: PAT_TA_13623
ccacgcgtccgcggacgcgtgggcggacgcgtgggcggctgcggcgacgaggaaaatacactgcagataagagagagggaggggcgagcgagcgagacagggagaggcggcgcgccgagccagccagcccacaccgcccgcggccatggccggcgccgaccccaaccggagcttcatgaaggacgtgaagcgcatcatcatcaaggtgggcactgcagttatcaccagaaatgatggaagactggctttgggcaggattggagccctgtgcgagcaggtcaaggatcttaatgctcaaggatatgaggtgattatggtcacctcgggcgctgtcggtgtggggcgacagcggctcaggtaccggaagcttgtcaatagcagctttgctgatctgcaaaagccacagatggagctggatggaaaggcgtgcgctgctgttggtcagagtgggctgatggcactctatgacatgttgtttacccaacttgatgtgtcatcatcacaacttcttgtgacagatagtgacttcgacaattcaaatntccgggagcgactccgcgaaactgtcgagtcattattagagcttagagtta

SEQ ID NO: 13624 - DNA, 774 bp, Triticum aestivum
  Clone ID: PAT_TA_13624
gaccgctgcccaggctgcaagggtgagaaggttcttcaggagaagaaagttctggaggttcatgttgagaaggggatgcaacacaacccagaagatcaccttccctggtgaagctgatgaggcgcctgacactgttactggagacattgtatttgtcgtccagcagaaggaacacccaaagttcaagcgaaagggcgatgatctcttctatgagcataccatatctctcactgaagctctttgtgggttccaactcgtcctgacccatctggacaacaggcagctgctcattaaatcaaaccctggtgaaattgtcaagcctgattcattcaaggcaatcagcgacgaggggatgccgatgtaccagaggccgttcatgaagggcaagctctacattcatttcacggtggagttccccgactcgctggcaccggatcagtgcaaggctcaggaggcgtacgatgaggacgacgagatgcccggaggcggtgcccaaagagtgcagtgcgcacaacagtaagctaggttgggcagcaagcatttttgggacccaagaacaagatgcctgcccgctctcttctggtgctttggtggtgttatcgatgaagctgatttttgcccgtatggcgccgggactgtatccatccatgtcttttgaaaattgctacgtggctacttctgatgtagtgtgacactcgtataaaagcaaagtctgtccgtgaaaactaacgcacgctctttgtctgtctctcgaatacgtgtctaagcaggacc

SEQ ID NO: 13625 - DNA, 1107 bp, Triticum aestivum
  Clone ID: PAT_TA_13625
tacaggcatggttctgacgcatgttcagagcgacgaggcggccgcgtcggccgccgtgttcgcgtcgaggtacgtgcaggagccggtcccgagctacgagctcggggcgaggtcgatctccaaggacgcggcgtaccagatcatccacgacgagctgctgctggacggcagcccgcggctgaacctggcgtccttcgtcaccacctggatggagcccgagtgcgaccggctcatcctcgagggcatgaacaagaactacgccgacatggacgagtaccccgtcaccaccgagctccagaaccggtgcgtgaacatcatagcgcggctgttcaacgcgccggtaggcgccggcgagactgccgtcggggtcggcacggtcgggtcctcggaggcaataatgctcgccggcctggcgttcaagcggcgctggcagaaccggcggaaggcggaggggaagccatacgacaagcccaacattgtcacgggagccaatgttcaggtgtgctgggagaagttcgcgcgctacttcgaggtggagctcaaggaggtgaagctgagcgaagggtgctacgtgatggacccggacaaggccgtggagatggtggacgagaacaccatcttcgtcgccgccatcctcggctccaccctcaccggcgagttcgaggacgtcaagcgcctcaacgacctcctcgccgccaagaacaagcgaacaaggtgggacaccccgatccacgtggacgcggcgagcggcgggttcatcgcgccgttcctgtaccccgagctggagtgggacttccggctgccgctggtgaagagcatcaacgtcagcggccacaagtacggcctcgtctaccccggcgtcggatgggtgatatggcgcaacaaggaggatctccccgacgagctcatcttccacatcaactacctcggcgccgaccagccaaccttcacgctcaacttctccaaagggtccagccaaatcatcgcacaatattaccaatttcttcggctaggtttcgaggggtacaagaatgtgatggagaactgcatggagagcgccagaacgctccgggaggggctcctgcgcacggggcgtttcgacgtcat

SEQ ID NO: 13626 - DNA, 768 bp, Triticum aestivum
  unsure (1)..(768): unsure at all n locations
  Clone ID: PAT_TA_13626
ttgctcgacttaaccctactaaagggaacaaaagctggagctccaccgcggtggcggccgctctagaactagtggatcccccgggctgcaggaattcggcacgagtcaaggtggtgcgcacctcgattgcgagggtgctcacggtgatctcgcagaagcagaagtcggcgctgagggaggcgtacaagaacaagcgtctcccgctcgacctccgccccaagaagacccgcgccatccgcaggcgtctcaccaagcaccagctctctttgaagacggagagggagaagaagcgcgagaagtacttccccatgaggaagtatgctatcaaggcctaggttaggagcacatgttttaccggccgagttttgctcagaagttgcatgaattttatgttctgtgtggacaccgctgctatctaagtactatgtattcgatatcctgcatgaaattcgaacttatgcttatttgcactatgatctacaactgcttggttgcaaaaacaccctccgctcacangaaatccggagactncactttctnacgctgttccccgccgtatcccgcatgggccgaccggcttcgtcctgnttggttttcttcggtggncggccggattccttaaccgttccttcccantcngcggncgggcgttccttggaanaaccttttttatttttcttcccacttngggccaacgcttaacccaagaancgaancccgancaccggnttcccccttnaccacgaaagggnggtcanccggttttcc

SEQ ID NO: 13627 - DNA, 765 bp, Triticum aestivum
  unsure (1)..(765): unsure at all n locations
  Clone ID: PAT_TA_13627
gcacgagggcgccgccgctcactcactccaaccaacgcccctcccctccacaccctcacatcacagaaaaaaaaaagtcaaatccattcatcactccgctgcgctaaccccgctcctcccctccctcccccatggaccccggcgccgccccccctcctccccccggatccgcctccgccgacgccgactgcgacgccacgctcccggtggacctgctcctcgagatcgcggcgcgctccgacgccgtctccgtggtccgctgcgcggcggccgccaagccgctgcgccgcgccatcctcgaccggggcttccgccgcctgctggcgcagcgcgccaccgccacctccggctacgacccctccctcctccgcggcgtctcctacaaggtcgaggacagcgacgccgaccgccccgcgcgcgtcgtgcagcccgtgccccccgacgagccctccgtgctccgcttcaacgagagcctcgccttcgagcccgtcgcctcccgcgacnnnctcgtcgtgctccgccgcctccgcccgcgcccgctcttcgggcagtccatcgaggaggggcgagtccagggcagtcggtcttcagcgtgccggggggatgcaaggcgtggcggtggcggtgcnnnagcagaacgaggcannaggggagcgcgagtggtnnngggcggaggggcggctcnnncagagngcgcgaggagcggcgggcggggctcgcacgtggcnnncgggccgagcggcagtgacgcnnggcgcgggcggc

SEQ ID NO: 13628 - DNA, 416 bp, Triticum aestivum
  Clone ID: PAT_TA_13628
ttttttttttatttgggaattcagagagattactgaatttcttccatgaacatgaacacaacacagggtacatcaacaactagacggaacaccttcacatcactaatcagacgaacactacacagcacacatcctaaacgacagagagcgcatctctcttaagctttcttcggggtggcggccttcttgggcgacttggcggccttcttgggggacttgggcgcctggccctccttctccgccgtcttcttggggagcagcacggggttgatcttgttgagctcatcttaggacacctgcgttatcttttaacagatgtgccgccccagccaaactccccacctgacaatgtcttccgcccggatcggcccggtaagaccgggccttggagccaaaaggaggggacatgcccctcg

SEQ ID NO: 13629 - DNA, 516 bp, Triticum aestivum
  Clone ID: PAT_TA_13629
ggctgagtggaattgattgcaaatccggctaaaattatcttgtctctcatcttgggagcggaactggttgctgcttgtatctaaatttgtaatttactcactgtactggtgtattatgggtcaaattgtaagggtgcattaagacctttaatatgttgcattttaataattatgtttatgaacagagggagcattttaataaaaaaacccacgcgtccgcccacgcgtccgcaaaatacagaatacatcatgcgtatctagatccaaaatgtgaaggaagtatgttgatgtgcctagaacaagcagcacgctggtccagctgagtccatgatatctccaaataataaagctactgcagcttaatttctgtgattttcgtatagactttgtcatggaactgtgttggtttgttaccagcgttacgaataactgcttttgttggctgatatgatatgaggaaatcgctatgacttgtgctttacgaatgcatgtttgaagtgctttaaaaaaaaaaaa

SEQ ID NO: 13630 - DNA, 649 bp, Triticum aestivum
  unsure (1)..(649): unsure at all n locations
  Clone ID: PAT_TA_13630
gagggtggcaattaggaccgtgtaacactcatcaaggactaccgtggcaagattgagactgagctcaccaagatctgcgatggcatcctcaagctgctcgagtcccaccttgtgccctcttcaactgctcccgagtccaaggtcttctatctcaagatgaagggtgactactacagataccttgctgagttcaagactggagctgagagaaaggacgctgctgagaacaccatggtggcatacaaggctgcccaggacattgctttggctgagcttgctccaactcaccctattaggcttggactggcactcaacttctcaagtgttctactatgagattctcaactcacccgatcgcgcctgcagtcttgcaaagcaggcttttgacgaggccatctcggaactggacaccctgagcgaggagtcctacaaggacagcactttgatcatgcagctccttcgtgataacttgaccctatgggacttctgacatctcggaggaccctgcgggaagagattcagggaggcgcccaagcacgactcgaagcgagggggcantnanagccggctttacgttgcctnagaagctagtacccagtgtttgctgctgtctaatnacnactaatgcaantgttgatctgngcnccct

SEQ ID NO: 13631 - DNA, 539 bp, Triticum aestivum
  Clone ID: PAT_TA_13631
cgacctgcctgtgctgtgacacccactgctcaccctctcttctcgtagcacgacacaacaacggcgagctgatccagccagccaccggccgccgtggcaaatggcgttgtccagggcgcagacgaactccggcgagtcgctcatctcctccaccttcgcgtcgcgctacgtgcgcaccgcgctcccgaggttcaggataccggagcagtccatccccaaggacgcggcgtaccagatcatcaacgacgagctgatgctggacgggaacccgcgtctgaacctcgcctccttcgtcaccacctggatggagcccgagtgcgacaagctcatccagaattccgtcaacaagaactacgtcgacatggacgagtaccccgtcaccaccgagttccagaaccggtgcgtcaacatgatcgcgcatctcttcaacgcgcccatcggggaggacgagacggccgtcggggtgggcaccgtcggctcctcggaggccatcatgctggccgggctggccttcaagaggaagtggcagaacaagatga

SEQ ID NO: 13632 - DNA, 593 bp, Triticum aestivum
  Clone ID: PAT_TA_13632
gtcgagtcatcgcatcctattgcgcctgataatcaacagcttagctagagccgagagcgagttgcagcagccatggtgctctccagggcctcctccgacaccgatgtgtcggtgcactccaccttcgcctcccgctatgtccggtcgtctctcccgaggtaccgcatgccggagaactcgatccccaaggaggcggcgtaccagatcatcaacgacgagctgatgctggacggcaacccgcggctgaacctggcgtcgttcgtcaccacgtggatggagcccgagtgcgacaagctcatcatggcctccatcaacaagaactacgtcgacatggacgagtacccggtcaccaccgacttgcagaaccggtgcgtgaacatgatcgcgcatctcttccacgcgccgctgggcgagtcggagacggccgtgggcgtgggcacggtggggtcgtcagaggccatcatgctggccgggctggccttcaagcggaggtggcagaacaagcgcaaggccgagggcaagcccttcgacaagcccaacatcatcaccggcgccaacgtccaggtgtgctgggagaagttcgctcggtactt

SEQ ID NO: 13633 - DNA, 1207 bp, Triticum aestivum
  unsure (1)..(1207): unsure at all n locations
  Clone ID: PAT_TA_13633
cagcagatgcagcaggcctgcaatgattgcaagggcaccggggagagtattaacgacaaggaccgctgcccaggctgcaagggtgagaaggttcttcaggagaagaaagttctggaggttcatgttgagaaggggatgcaacacaaccagaagatcaccttccctggtgaagctgatgaggcgcctgacactgttactggagacattgtatttgtcgtccagcagaaggaacacccaaagttcaagcgaaagggcgatgatctcttctatgagcataccatatctctcactgaagctctttgtgggttccaactcgtcctgacccatctggacaacaggcagctgctcattaaatcaaaccctggtgaaattgtcaagcctgattcattcaaggcaatcagcgacgaggggatgccgatgtaccagaggccgttcatgaagggcaagctctacattcatttcacggtggagttccccgactcgctggcaccggatcagtgcaaggctctcgaggctgtgcttccaccaaagcctgcatccaagctgaccgacatggagctcgacgaatgcgagaaggcaaaggaggggagaggatgttgtccatccactaaaagcttctctagaagatctttacaatggtacctcgaagaagctntctctttcccgcagcgtcctctgctccaagtgcaagggcaagggatccaagtctggtgcttccatgaggtgcccaggttgccaggggtcaggcatgaaagtcactattcgtcagctggggccttccatgatacagcagatgcagcaggcctgcaatgattgcaagggcaccggggagagtattaacgacaaggatcgctgcccaggctgcaagggtgagaaggttcttcaggagaagaaagttctggaggttcacgttgagaaggggatgcaacacaaccagaagatcaccttccctggtgaagctgatgaggcgcctgacactgttactggagacattgtatttgtcgtccagcagaaggaatacccgaagttcaagagaaagggcgatgatctcttctatgagcataccatatctctcactgaagctctttgtgggttccaactcgtcctgactcatttggacggcaggcagctgctcatcaagtccaaccctggcgaagtcgtcaagcctgattcgttcaaggcgatcaacgacgagggcatgcccatg

SEQ ID NO: 13634 - DNA, 647 bp, Triticum aestivum
  Clone ID: PAT_TA_13634
cccgtgcggctgagcttctgccagtactgtagcatttataacttaattttgatcgagaatgtggagagagtttggttccaggtcagctttcatatggcctgtgagccatcaacttttgttcataaagaggaaattctcatgctctgttatttgttcccaagttgcagaggtcaaatctaataccacctttctctgttttgaaacttttgcggacagatgagctcggttgatgcagcgttcgatcgaagaatatcagatattacattttctagacaatccacataaacaagctgcgcccggtgttcagtaaacagcttgatgcgattcaccaacgggctcacccgtgcatccgtaggagggacgccgtgcaatcggtgatcctggatcccccctgttgttgatctacttacttagtgactggagctactgcagttgaaagattgtattggtctgacttggagattttggctcaacatcatttgtgtcctgtctattcgtgtcgtgagtggaaacctgtgagacctagaagtcatttgttccgttgtcgattgactgatgatatgagagtatcgtcagctctgtaaacccgaggatgaaattagcagtgtcttttcacccaaaaaaaaaataaaaaaaaaaaaaaaaaa

SEQ ID NO: 13635 - DNA, 896 bp, Triticum aestivum
  Clone ID: PAT_TA_13635
ggaattcggacgaggcctctccgtctctgtctctctccctaaacccgacggcggcactggtttctctccggcgagcatctccctgccccttggccctacccatgtaccccgtggtcgtgggaaattcttcgccacacgccggctcttccgttgggtctcttttccccaacctcgacggcgccagggtttgctctccgacgagatgtgctcctttgatcttgagatgccacgggtgcatcttctcttcttatggcccggaggtcatggccgtgtttagattcgcatcttattctttggatttgagttcatttgcctcaccacgaacctttctgcaggatccatgtttcagacgttagagccgatccctgatgcatttcccgtggagtcgcgggatttcatgagcatcgccgatacccagctgggccgcggcggcgagggcaccctctgtgcggggacgccggcttaggttttctcagaagccaccagcggctgaaccatgagcggctgtcctccatggatgagtttgccgaagcgcggcaaggtggaccatacagtacggatgatgcaataattgaagatatgaagaaggattacatggtcgcgcaagagatcaaggagaataacaaataagctttatgcaatggataatttgcaaggcaaggttctccatgcttgtatgtacgttgctgcttttggaatttggcagttgcttactggtcatgtttggtgattgatgctgaattcctagatacattttgtaaacatttggatttgtccaggcgcatgcctgtatgtactagatgtttacttgttttcacttatctgcagaagtggtacgttccctgtgagattaaattaactaggtcctaataatgtattatgtaaaaatgtatatt

SEQ ID NO: 13636 - DNA, 707 bp, Triticum aestivum
  unsure (1)..(707): unsure at all n locations
  Clone ID: PAT_TA_13636
cttttggaaccgatcttgacagggctactaatgagcttgtgatacgcgtgcaaccggatgaaggaatttacctaaagattaacaacaagattcctggtcttggcatgaggctagatagaagtaatttgaatcttcactatgcagcaaggtacccaaaggagataccggatgcctatgagaggctgttgctcgacgcgatagaaggagagcgaaggctcttcatccggtcggacgagctggacgctgcgtgggaagctcttcacgcccctcctcaaggaactggagcagaagcggatggcccctgagctgtacccctatggaagccgcgggcccgtgggcgcccactacctgggcggcgaagtacaacgtgagatggggcgacctgggtggctcggaacactaggaagagagcgtggtttcacacgggaggtgatgatttctgtttttggcggcgattgattctgctgccgtcgcaatttgtgcaaaaggccttgcattgcatgcccagctagtgggagtggtgcaaggaacagatctgaataagtgtgagcggttggcgatgcttgtgttcatcgatcgaccgtgaatatatttgttggtaccactggcttacatattctgtgattcttaagaggcgaagccgagagcagaaagctcattcatcttggctgttcatcggctcattnggttgtcggctgggctgctgt

SEQ ID NO: 13637 - DNA, 839 bp, Triticum aestivum
  Clone ID: PAT_TA_13637
agagcagcagtccgtggtcagcgtgaacttgttgaacttctgtttcctaagacaaacccaattccatctgtgccagattggagtgttgatgggataattacaactatgaaatctccacagaccagggttcaggatagagcttctgcggaagaacggaaagctgatttgaagtcacaagggaaggaagcatttgccaagaaggactactttacagcaatgtactactatggattggtgatggagatagacccacttgatgcgaccctgtttgctaaccggagcctctgctggctgcgcatgcgagaaggggacagagcactggcagacgctcaacggtgcaaaatgctgcgtccttggttggtccaaggcatggtaccgagagggctcggctctcagtttcatggaggattaccaaggggcagttgatgcgttccaggaggcgctgagacttgaccctgagagcagtgagatcaagaagatgttaagtgaggcccaaaagcaaggctactcgctaagagtaggacctgcgatggagctgacatataagcaagtgcctatgtcctacaaaactgtgatcatcttgtcttttcaccggctactaatctactaccaggcctgctcgtattgcagcccgttgacaagctagctacttttgagctgtgctcgaggcagctgcggagtttcatcaggaataagaggaatcaaacatattgtgatatgtattagccgtgaagaaaaatgaagttgttagatgtaccaacaaatatatagttcatgaagatctttcacctgagatagacgaggccagcatggaaatcccttgcaaatcaaaaaaaaaa

SEQ ID NO: 13638 - DNA, 676 bp, Triticum aestivum
  Clone ID: PAT_TA_13638
ggaaaaaactcactgcagataagagagggaggggcgagcgagagagaagggagaggcggcgcgccgagccagcccacttccgcccgcggccatggccggcgccgaccccaaccggagcttcatgaaggacgtgaagcgcatcatcatcaaggtgggcactgcagttatcaccagaaatgatggaagactggctttgggcaggattggagccctgtgcgagcaggtcaaggatcttaatgctcaaggatatgaggtgattatggtcacctcgggcgctgttggtgtggggcgacagcggctcaggtaccgcaagctcgtcaatagcagctttgctgatctgcagaagccacagatggagctggacgggaaggcctgcgctgctgttggtcagagtgggctgatggcactctatgacatgttgtttacccaacttgatgtgtcatcatcacaacttctcgtgacagatagtgacttcgacaattcaaatttccgggagcgactccgcgaaactgtcgagtcattattagagcttagagttattccaatatttaatgaaaatgatgccatcagtacgaggaaggctccatacgaggattcatctggtatattctgggataatgacagtttggcaggtctactggcattggaactgaaagctgatctccttgttctgctt

SEQ ID NO: 13639 - DNA, 393 bp, Triticum aestivum
  Clone ID: PAT_TA_13639
tcgagcggccgcccgggcaggtgcgaagacgagggaagagagatgccggggctcacggcgccgtcggactacgcggaggagccgccgcgccacccggccctcaggatcaactccaaggagccatttaatgctgagcctcatcgatctgcgttagtttcatcttatatcaccccagtggatttcttctacaagaggaatcatggaccaattcccaaagttgatgatatctcaagatacagtgtttccatcagtggcctcgtgaataagcatatccagctgtccatggatgacattaggatgcttccgaagtaccagtaatcatgttcttgatgaagtcacggtgaccaggggcatcaatgacggtgcagtagtacctcggccgcgaccacgcta

SEQ ID NO: 13640 - DNA, 1040 bp, Triticum aestivum
  unsure (1)..(1040): unsure at all n locations
  Clone ID: PAT_TA_13640
aaaggggaagaacttgatagatgagactctttattttagtcttggttcaaaagaaaaccctatacaaggctgttgtcaaaagggaaaagaaaggctacatccccaaattttggtcactggtgaacacccttgtagaagtactccatagctgctgatgcaggacctccaagtcagacatgctttgttgcaatatatccatttgtcttcaatgccagcggcgtcgacgataacccccacaaatcgaaattaatgttaggaaagaagggcaaatgcccttcaaagggtctcctccctccaggtatctgagtcgatgttacatgatgctgcaacacttcaacaccaggatgcttggaggaacaggtttgaatcatttacggcactgtcaagctgtaatctttttcttattccatatttctatgtaaccatcaatcaagttatcctaccatgttgggagtgacaaaattgtacaattggtgaaccatcaatataagctatactgaaatattggggcctattgatgactgaaagacatcatacagtgcaacttgaacctctctagagctatgctcgcagcgaacgagattagctaataaagggaaaaggaggggcaaattcctcctaaagcactccctctctagaccaccaagtaaccgcattacatgaaggaccaacggggttctcgcagacagttcctctttcttagcagcggataaaggcagcgtccagtgtacaactggatctttacaagaagcatccttcgattgttcctgacctgcacagttcagatacttccgtagtattttcacagaaacaagcataatttgtgactcaatgttcatttctcgtgacaaagatgggttgtcgtgaagcaaagcttgcagaagtttgaggtagctctggtaagactcattctcgaaatggctcgtgccgaattcctgcagcccgggggatccactagttctagagcggccgccaccgcggtggagctccagcttttgttccctttagtgagggttaatttcgagctnggagcaacaacc

SEQ ID NO: 13641 - DNA, 887 bp, Triticum aestivum
  Clone ID: PAT_TA_13641
accgagtaccgttcacgcccggtcgtactcataaccgcatcaggtctccaaggtgaacagcctctggccaatggaacaatgtaggcaagggaagtcggcaaaacggatccgcaactaccatatccgcagccgcaactaccatatccgcagccgcaaccatttcgaccacaacaatcatatccacagccgcaaccacagtattcgcaaccacaacaaccaatttcgcagcagcagcagcagcagcagcaacaacaacaacaacaacagatccttcaacaaattttgcaacaacaactgattccatgcagggatgttgtattgcaacaacacagcatagcgcatgaaagctcacaagtattgcagcaaagtagttaccaagtgttgcaacaattatgttgtcagcagctgcggcagatccccgagcagtcgcggtgccaagccatcaacaatgtcgttcatgctattattctgcatcaacaacaacaacaacaaggacaacatcaacagtcgagccaggtctcctaccagcagcctcagcaacaggttctacacaccgacggtcaacgtcgagaggctctggtccatggttccgtccgacaaggcggcggaggccggcggcgacaaggcccccgtggtcgacgtctcgcagttcggctacttcaaggtgctcggcaaggggatgctgccggagaagcccatcgtcgtcaaggccaagctcatctccaagatcgccgaaaagaagatcaaggccgccggcggcgcagtcgtgctcgttgcctagggttctgttcccgaccgtgccccgagatctatatctgaactattagttgtttcccgtaccagcaatttgtgttgaagaagacatcgttagtttgttatccggttcc

SEQ ID NO: 13642 - DNA, 643 bp, Triticum aestivum
  unsure (1)..(643): unsure at all n locations
  Clone ID: PAT_TA_13642
ccgtggacgggaggctcaaggttgtggtctcggagacccaggttatatcaatgtggaccatgttaccacccgtcgagggcgagccgagctcgccgccgagatgganccggcaggtgctgatagacaagcaggactggggcgtgcacagctcagttcagtttgaggggttcgggctcaggagtggcactgtcatcctatatgtcggcagagttgggctcattcggctcaaccttgccacaaaagaggcggtcatcgtctaccaccgcagcgatacggcctacatctcgcaggtttgcctgcacgagatggatttgtcctctctgctgcagaccatgaagcctctgagctagctgcttgttatggatcagttttgggaatgttcttcagtccacttcttgttctactgctttgtttgcttagagcagctgttttagctctaagcagtcgtgctccttggccaatactagttgtaaaaggaatcgagtcactcctaagtttgttaagtcttgtcatttctctcgttatgctgttagtgtttgccggcaatctgtcgttcatcctgtaaaataacggattgtatggttcattatgtactttagccagttgtcaaaggtgaaataaaaatctgtttgccttaaaaaaa

SEQ ID NO: 13643 - DNA, 653 bp, Triticum aestivum
  Clone ID: PAT_TA_13643
aatccgaccagctccgatacaatctcgtaatacagtgctcgactaagattacatagcgtggagaagagggttcgaccggcgtcaatggcgatgttcaagggttcgctcctcgtgttcgctctcctgcttgctgctgctttcctcgtcgcctcggccgaagaaactcaggccaaggaggagccgacggccgacgtgcaggactactaccgtggcggcggcggctacccgggccgtggttatcctgggcgcggaggagggtactacccgtaccctggccgcggaagaggcgggtacccaggccgcggcggcggcgggtactgccggtggggctgctgcggccgcgggtactacggcggctgccggtgctgttcgcgcgccgacgaggtcccggagcccatgtaccgcgctgaggcggaggtgcaccactgagccgagcatgcatccaccggatgcagcgtgtacgcctgcacgtgcctagttaatctgcttatactgtgtgttcttgaggaacgcacctagccctgtgttcttgcaagctacgtatgtgttgatgtgtgtgcttgttcgtaagacgtactggtcagtgtacggatgtattgttactgcacccgtgttgtgtttatggaataaaaagacaggcgaatttgctcttt

SEQ ID NO: 13644 - DNA, 954 bp, Triticum aestivum
  Clone ID: PAT_TA_13644
aatcgggttaagatttcccgagccgggatgtggcggttgacggcgacgttaggaagtccggagacgccggcgggggcctcgggaagagttatcttttctgcttaacggcctgccaaccctggaaacggttcagccggaggtagggtccagtggccggaagagcaccgcacgtcgcgcggtgtccggtgcgcccccggcggcccatgaaaatccggaggaccgagtaccgttcacgcccggtcgtactcataaccgcatcaggtctccaaggtgaacagcctctggccaatggaacaatgtaggcaagggaagtcggcaaaacggatccggtcggacgagctggacgctgcgtgggagctcttcacgcccctcctcaaggaactggagcagaagcggatggcccctgagctgtacccctatggaagccgcgggcccgtgggcgcccactacctggcggcgaagtacaacgtgagatggggcgacctgggtggctcggaacactaggaagagagcgtggtttcacacgggaggtgatgatttctgtttttggcggcgattgattctgctgccgtcgcaatttgtgcaaaaggccttgcattgcatgcccagctagtgggagtggtgcaaggaacagatctgaataagtgtgagcggttggcgatgcttgtgttcatcgatcgaccgtgaatatatttgttggtaccactggcttacatattctgtgattcttaagaggcgaagccgagagcagaaagctcattcatcttggctgttcatcggctcatttggttgtctggctgggctgctgtattggaactgctgattgtgtaactgcagaagctgttgcttctttaccgatgccggtgttctgttggacatactcggtggtacagtaagacttattattgaaatcatcttttttttactgaaatctggataagtactaccttctgt

SEQ ID NO: 13645 - DNA, 535 bp, Triticum aestivum
  Clone ID: PAT_TA_13645
gcagacatcgaccaagatcgaaagagccaactggtcgaccttggcgaggtctggtgctcggcggatcgttgcggcggcgatagtgctgctgctgctgctgctgctgctgctgctgctgaccacggtgtcaccagcatcagcatcaggagcagcaggtgtcgattcagcaacgacagcaccggccaaggtgtggcggctccctccaagattccctacagagtcctccccggtgccaaggcccccttcttcgtcgtcgtggaaggcggtgaaatcatctcttcctcctcaccaccgcctccccacggagccgccgtcggaaaagcgtacgtaagatgatatacctaattagtaatgcatgtagcagcaaagcatgcggcggcacaagaatgtggatgcatggtgctgcccttgatctatctgtctgtgtgagtgtgggttgacgtacgtcgtcgttctgttgcatttaatatgtaccaaggagtcgcttcgtgtaccaagatgaataaaatgataatgattgtgtggaaaaaaaaaa

SEQ ID NO: 13646 - DNA, 688 bp, Triticum aestivum
  Clone ID: PAT_TA_13646
ctcggaacgccgccgccgaagtgcgcctcgagtaatttcagaggaaggaggagccaagtgttgatcggagatgaatgcccctgaccgctatgagcgcttcgtcgtgcctgagggcacgaagaaggtatcatttgagaaggatacaaagatcatgaatgctgcatctttcactattgaacgtgaggaccacaccatcgggaacatcctccgcatgcagctgcacagggacccaaatgttcactttgctggctataagctccctcacccccttcagtacaagatcattgttaggatccatactgcaagccaatcctccccaactcaggcatatacccaggcaatcaatgatctagacaaggagcttgagaacctgaagcaagcttttgaggatgagaagacccgattcgaggaaaggatgaagcagggctactaggccaagggtgttctggatgctgacgtgaaaccttccttgctagtaattatatctgatgtctgaactgcggtagaaaaaaaattactcaaggattgtcgatgatcctctgaactcgtagaacctcttcatgtgcggattgcgtatgattgcacggttgttaaacatgtgttggcacttgataagcctgctagttaattgctcgccttgacaggttccgtagaaggcacggaccagacctggatcatttcataccga

SEQ ID NO: 13647 - DNA, 786 bp, Triticum aestivum
  Clone ID: PAT_TA_13647
gtgatacgcgtgcaaccagacgaaggaatttacctaaagattaacaacaagattcctggtcttggcatgagactagatagaagtaatttgaatctgcactatgcagcaaggtacccgaaggagataccggatgcctacgagaggctgttgctcgacgcgatagaaggagagcgaaggctcttcatccggtcggacgaactggacgccgcgtgggagctcttcacgccccttctgaaggaactggagcagaagcggatggcccctgagctttacccctacgggagccgtgggcctgtgggcgctcactacctggcagccaagtataacgtgagatggggcgacctgggcggctcggaacactaggaagagagtgtagtttcacgcgggtggtgatgatttctgtttttggcggtgattgattccgccgtcacaatttccgcaaaaggcctgcacgcccccagatagtgggagatgcagggaacaggtctgaataagggtgagcggtcggtgatgcttgtgttcgtcgatcgaccgtgaatatatttgttggtaccactggcttacatattctgtgattcttaagaggcgaagctgagggcagaaagctcattcatcttggctgttcatcggctcatttggttgtctggcctgggctgggctgggctgttgtattggaactgctgattgtgtaactgcaaaaggtgttgcttctttactgatgccggtgttcggttggacatactcggtggtacactatataagacttattactgcaaaaaaaaaaaa

SEQ ID NO: 13648 - DNA, 1158 bp, Triticum aestivum
  Clone ID: PAT_TA_13648
catcccgatcttttattccatccatctcccccgtcgcgtgcactgcgctacacactatccaccagcggagagcagtagcattgagcgccggcgaccatggtgatctcgcacgcgagctccagcgcgggggaggcggtctactccaccttctcctcgcgctacgtgcgcgaggagctcccgcggtaccggatgccggaggggtcgatccccaaggaggcggcgtaccagatcatcagcgacgagctgatgctggacgggaacccgcggctgaacctggcgtccttcgtcaccacctggatggagcccgagtgcggcaagctcatgatggactccgtcaacaagaactacgtcgacatggacgagtacccagtcaccaccgagctccagaaccgttgcgtaaacatgatagctcacttgttcaatgcaccgatcggtgaggatgagactgctatcggagtctcaacggtggggtcctcggaagcaatcatgcttgcgggcctggcgttccagaagaaattgggcaaacaaaatgaaggagcaggggaagccatgcgacaaacctaacattgttactggtgcaaatgtttcaggtttgctgggagaaatttgctagatatttcgaggtggaactgaaggaggtcaagttaactgaagggtactatgtcatggatcctaagaaggctgttgaaatggtggatgagaacactatatgtgttgcagccatcctgggatctactctcaccggagagtatgaagatgtcaagctgttgaatgaccttcttgtggagaagaacaagaaaacagggtggaatgtgcctatccatgttgatgctgccagtggaggattcatcgctccttttcttcagccggagcttgaatgggacttcaggctgccattggtgaagagcatcaacgttagtgggcacaagtatggccttgtgtaccctggtgttggatgggtcatctggcggagcaaagacgatctgcccgacgaactcattttccacataaactatctgggaacagatccagcccacattcacactgaacttctccaaaggtgctagccagatcattgcgcaatactatcaactgatccgcctcggcttcgaggggtacaagcacatcatggagaactgcaagctgaacgcggcggtg

SEQ ID NO: 13649 - DNA, 884 bp, Triticum aestivum
  Clone ID: PAT_TA_13649
gccgagccgcgtcgagtccggcacccaaccggagattgacctggcgaccatcacggaccggatggaggtgaagaaggcggttcagtcggggaacgtccaggaggctatcgagaagatcaacgatctcgaccccacgattctggatacgaatcccgaaatatacttccatctgcagcaacaaaagctgatagagttgattcgtgtggggaaaatacatgaagctttggagtttgctcaagaagaacttgcaccaagaggcgaagaaaatctagcctttctcgaggaaatagagaaaacagtagcacttttggtttttgaagatgtaaagaactgcccatacggggaactattggatgtttctcaacgtttgaagacagcaagtgaagttaacgccgccatccttacaagccaaagccatgagaaagatccaaaactccctagcctgttgaagatgttgatttgggctcaaaaccagctgagcgaaaaggcagcgtatccacgaatcaataacctgtccactgccgacctagaagatccagctatatgatgagctgctgctgccgaggtgttttctgtttactagggacaggagctcagtaggcaccaagtacaaactgtctgagctgaggtctgttagttgttcgttacctgcgggtgcagtacttgaatacactgcttgttttatcagcgttggcaaaaagctgacatgggaatttttcgctctctcctgttgttcatatgatgattcagaggatggtctcgttacagtttactaggtggtaagtgtttcgtttgattttcatagaaccgccatgtgtggtgcttatgttacacaaaagaatgatcgggccaaaattttgacgttcaattccatgttctttctc

SEQ ID NO: 13650 - DNA, 1181 bp, Triticum aestivum
  unsure (1)..(1181): unsure at all n locations
  Clone ID: PAT_TA_13650
cgcgcatcccccgaagggaatcgggttaagatttcccgagccgggatgtggcggttgacggcgacgttaggaagtccggagacgccggcgggggcctcgggaagagttatcttttctgcttaacggcctgccaacccggtccccgccgccgcgagcgcctcctcgccgtcgtgggtcctctcgccccccacttgccaagggagtgtgaaggcaaggtaccagcaggtagcattcagtggcaagatagtgtactgccggacggcaattgaagtggagaaagctacgcgggagattgtacgcaaaatcgaaagcatgaaggcctctggcccggtctcccttggtttcgatctcgagtggaaaccctttcccagaagaggagaaccaccatgtaaagtcgcgttgatgcaattatgcatggacaaaactcattgttatctcatgcatatcattcactctggcgtgcctcccatcttgaaatctcttttggaggacagttcatccgttaaagttggagtatgtatagacaatgatgcaaggaaaatgttcaatgattatgatgtccgtgtacaaccattgatggatttatcaactgttgcaaacgtcaagttagctgggccctataaaagatggagtcttgctgcattaactgaaatggttacatgtaaagagttgccaaagcctggcaacataagaatgggaaactgggagtcttttgttctctcaaaaaagcaacttgagtatgctgctaccgatgcctacatctcgtggtacttgtatgaggtactacggagtcttccagattatactcctgatattgaaacagaggttgtttagggaacatatttgcaggtatacaagaaatcggaaagtgtactgttaagctatttgatgactccctagtgttctctgttctgtaacttcacttctcaaccagggttgagtaggaggatctctggaaccaaaggattgcgaggatccgtgaacatttgcctaaatctgttgtagtaatttgtgcctgttgtgatataaaactgtgaaggttagcaccttccaccatgaatctgttgctcatttatcttgatcatatgaattgttgccatgtaacattttgctcaagtttccggatcaagaataaataaaccgaaaaaaaaatttttaaaaaaaattnnaaaaaaaaaaaa

SEQ ID NO: 13651 - DNA, 967 bp, Triticum aestivum
  Clone ID: PAT_TA_13651
aggtacaagaacaagcggctcccgctcgacctccgccccaagaagacccgcgccatccgcaggcgtcccacaaagcaccagctctccttgaagaccgagagggagaagaagcgtgagaagtacgaagagatggtcgagttcatggagaaggtgaccaagacagttgactccgaggagctcaccgtcgaggagcgcaaccttctgtcagttgcttacaagaatgttattggtgcccgccgtgcctcgtggcgcatcatttcctccatcgagcagaaggaagagagccgtggcaacgaggaccgtgtcacactcatcaaggactaccgtggaaagattgaggttgagctcactaagatctgtgatggtatcctcaagcttcttgattcccaccttgtcccctcatccactgctccagagtccaaggtcttctacctaaagatgaagggtgattactacaggtaccttgcggagttcaagagtggaactgagatcctcaactctccagaccgtgcttgtgacctcgccaagcaggcttttgatgaggccatctcggaactggactctctgagcgaggagtcctacaaggacagcactttgatcatgcagcttctgcgtgataacctgacgctgtggacttctgacatctcggaggacgctgctgaagaaatgaaggatgctcccaagggtgaatctggagatggacagtaaacactgtctatgtgcccagaaacttgtctttctcgcttgttcagtgtagattgtaatgtcatcgtggttgctggtaattggaggctccaatttgtgttgtgatagggaagcttgtagctgccttgcttgctcgacggcctgatcatcgggctgcactggttattgcctcttgttgaacctttgtgttactttggtggttttagaaattttctgctgctcttgtttgtggccccttgcctttgtattcaaaaaaaaaaaa

SEQ ID NO: 13652 - DNA, 748 bp, Triticum aestivum
  Clone ID: PAT_TA_13652
ggcccccgcttagtaccactctctaaccttacgcaggccgccttcatcgtcttcctcggaacgccgccgccgaagtgcgcctcgagtaattccagagggaggaggagccaagtgttgatcggagatgaatgcccctgaccgctatgagcgcttcgtcgtgccagagggcacgaagaaggtatcatttgaaaaggatacaaagatcatgaatgctgcatctttcactattgaacgtgaggaccacaccatcggcaacatcctccgcatgcagctgcacagggacccaaatgttcactttgctggctataagctccctcatccccttcagtacaagatcattgttaggatccatactgcaagccaatcctccccaactcaggcatatacccaggcaatcaatgatctagacaaggagcttgagaacctgaagcaagcttttgaggatgagaagacccgattcgaggaaaggatgaagcagggctactaggccaagggtgttctggatgctgacgtgaaaaccttccatgctactccctccgttccaaaatagatgacgcaactttatactaactttagtacaaagttaatacaaagttgagtcatctattttggaacggagggagtggtagttatatcgaactgcggtagaaaaaaaattactcaaggattttagatggtcctctgaactcgtagaacctcttcatgtgcggattgcgtatgattgcacggtatgttaaacatgtgttgg

SEQ ID NO: 13653 - DNA, 736 bp, Triticum aestivum
  Clone ID: PAT_TA_13653
attcggcacgaggccatcgactatcaataggaaacgttcccgctttccttggtaacggcttggccccgaccccgcgttgatcaagcacaaaccagcggcagcactagcaccaccaccaccgccggcccccgtacgtctcccgatcggatcggccgtcgtccccgccggcgagcgagcgagcgagcgatcaagatggtgctctcccacgccgcgtcggctggatcctccgatgactccgtgcactccaccttcgcctcccggctacgtccgcgcctccctgcccaggttccggatgcccggagaactcgatcccgaaggaggcggcgtaccagatcatcaacgacgagctgatgcctggacgggaacccgcggctgaacctggcgtccttcgtcaccacgtggatggagcccgagtgcaacaagctcatgatggactccatcaacaagaactacgtcgacatggacgagtaccccgtaaccacagagctccagaaccgatgtgtgaacatgatcgcgcatctgttcaatgctcctctcggggagaccgagacggccgtgggagtgggcaccgtcggctcttcggaggccatcatgctcgccgggctggccttcaagaggcgttggcagaacaagatgaaggccgccggcaagccctgcgacaagcccaacatcgtcaccggcgccaacgtgcaggtttgcctgggagaagttcgcgcgctacttcgaggtggagctc

SEQ ID NO: 13654 - DNA, 873 bp, Triticum aestivum
  Clone ID: PAT_TA_13654
tcgcggccgcgtcgactgcacatgggtaagccgatcctaagggacggggtaaccccggcagatatcgcgatcacgcgcatcccccgaaagggaatcgggttaatatttcccgagccgggatgtggcggttgacggcgacgttaggaagtccggagacgccggcgggggcctcgggaagagttatcttttctgcttaacggccaatctcatgatacagtgttcgactaagacacatagcgtggagaagagggttcgaccggcgtcaatggcgacgttcaagggtttcctcctcgtgtttgctctcctgcttgctgccgctttcctcgtcgcctcggccgaagaaactcaggccaagaaggaggagccgacggccgacgtgcaggactactaccgtggcggcggcggctacccgggccgtggttatcccgggcgtggtcgcggaggagggtactacccgtaccctggccgcggaggaggcgggtacccaggccgcggcggcggcgggtactgccggtggggctgctgcggccgcgggtactacggcggctgccggtgctgctcgcgcgccgacgaggtcccggagcccatgtaccgcgctgaggcggaggtgcaccactgagccgaccatgcatccaccggatgcagcagcgtgtacgcctgcacgtgcctagttaatctgcttatagtgtgtgttcttgaggaacgcagctagccctgtgttcttgcaagctacgtatgtgttgatgtgtgtttatggtgtgcttgttccaaagacgtactggtcagtgtacggatgtattgtactgcacccgcgttgtgtttatggaataaaaagacaggcgaatttactctccaaaaaaaaaaaaaaaaaac

SEQ ID NO: 13655 - DNA, 1134 bp, Triticum aestivum
  Clone ID: PAT_TA_13655
aatccatacatgtagctgcttagcagcagatcatggacactatccttgcccattaggccaagagagtgaatcaacgaccaacaaactttcaatggcatccaaccatcgccgcttcctcctctccggcgccgtcttgctctcggtcctcgccgccgtggccgccctggagagcgttgaggacgagtgccggccaggggtggccttcccgcacaacgcgttagccacctgccacacctacgtgatcaaacgggtctgcggccgcggtcccagcctgcccatgctgggtgaaggagcggtgctgccgggagctggcggccgtccccggattactgccggtgcgaggcgctgcgcgtcctcatggatggggtgcgcgtggagggtggccacgtgttggagggccgccttggtgacaggcgtgactgcccgagggaggcacagagggagttcgccgccacgctggtcacggcggcggagtgcaacctgccgaccgtctcgggggtcgggagtacacttggtgctaccggcagatggatgacgatcgaattgcccaagtaatgaagcggagtactctactggcagatggagtactgtacatagaataaaagtactcaagtgagaacaaataaataaagcttgtgacttgtgagctgtaaaaaaaaaaaaaaaaaaaaaaaaaaagccgccgccagcagctgcgcaaaggctcgacaaaccctaaccctagtccatagctagcttagcttccttcctctcgatctagctagagccatggcgccgaccaagggcgaggggccggccatcggcatcgacctcggcaccacctactcgtgcgtcggcgtgtggcagcacgaccgcgtcgagatcatcgccaacgaccagggcaaccgcaccacgccctcgtacgtcgccttcaccgactcggagcgcctcatcggcgatgccgccaagaaccaggtcgccatgaaccccatcaacaccgtcttcgatgcgaagcgtcttattggcagaaagtttgctgatgcccctgtccagagtgatattaaaatgtgggcgtacaaggtttattcctggcccccgaaacaagcctatgattggagtgccgtacaagggtggaggaccaagcagttcttacct

SEQ ID NO: 13656 - DNA, 878 bp, Triticum aestivum
  Clone ID: PAT_TA_13656
ctcccggtcacggggaatacaagcataagctttatatgtacataagtttctctgtcaagagccaaatattacagcattcatcaagccccctttgtcccatgtaaattatgttacaggaaccaaaaccaaacagaagcaaacttccagcaaaaattgcataccccactgagcgcagaagttccacgataggccgactatctacaggtaacttactccgcatactttcatgatatgcgtagcgagctcatgcggagctctccgcttgcatgaacctccttgaccctcttgtcgtactcatcctcctcttcctcctccaccacttctggtctctcttcctcttccttctcttcctcgtcgtctgaaccctcatcgccccaaccatagcttggcctggatgactttggcatggtccttgcctcctggacaatcttcatgatctcttctgaagtctgctctgaaaaagaaggcacggcattatccctcctgaagtacatggcctgcgccgtctctgtgagctcccttggcaggttcttcaggaaccatgggtggctctttatctccctcatcgtgattctcttcgatgggacgttaacaaagatacgggccataagctgtcggcattccatggatatgtggacatgatcaggtatagtatattgcacggacattattcgctgaatggtcttgcgtatattctttgggtcatcctggtcttcaaatggatagcctcccacaagcatgacgtaaagagtcaccccacaagaccacacatctgcaagctttccatcatactcccggcgggatagcacctctggtgcaatatatgctggcgtccccactgctgatttgggccttgaatgcagtactgatgactggag

SEQ ID NO: 13657 - DNA, 1145 bp, Triticum aestivum
  Clone ID: PAT_TA_13657
attgataacaagaagccatgccccatccccatgtaccgtccaatagaatgcccactggcatccgattgttcatcttacagcagacaagcgtttccagaaaactaacagagtgcccaatgccccaatctagcatgtttccgagtctatattactacatgcgatgtgttagttcatgcccacagccaaaccatggagtgactgacagtcttccacaccatccagaatctctacaggtgaaaaacaatatccaggaatgactgacatcaacttcatgtgcactgcttaaacttgtcgtcaccctcgtaatccgaaccctcgtcatcgtctgaggactcctccacccggttaggtactctgctattgggttcttcctcgccaccaccgtttggtttggcccgcttttctttcttacgctgcttctttttttttggcgtttcaggcgcttcttggctgtacgctcctcggctgctcttagtctctcctccctccgcagattgaactcagccacctgtttcctcttttcgtaatcacgctccatcctcgttattcggtcctgctcccttctcctcatttgccgatactggtggaagtcgccagagccagaaccagcggaggacccagaggtgttgctgacacggacggggacattctccatgatgcgccttagcttcacctctaggtcctcctcatcctcccgtagcttgacccctccggagctctttcctccaccctccaccagcaccagctgctttccactgtcaccaacggaagccttcgccactagttcaccaccagaaacccttgccggtggtgccattgggactagctgctgcatattgctatccttaccaggaactgacattgttgataccagctccaactgtggatttgccagtccagcgtcgggggagaagcacgccggcgacggcgtcgttgctgtcgccactcctggtcaccgccgagctcacgctgctgtggttggatgcggtgccgccggttggatagtgggagggggaataggatgaggagggacgccgctaccgtctactccggttgcgccgtccctctccccgccggcgtcagtgtcgtcgtcgccgccgccgccaccttcgtcggtgtcgtgacagtcctttttacgacggccc

SEQ ID NO: 13658 - DNA, 1319 bp, Triticum aestivum
  Clone ID: PAT_TA_13658
cgcgcaccaaccctcccgcccccgcctccattcattcgtggagaaccgattcgattcccggccgactcgccgtcactttcccggtggtgcccgcgacagcgaggaggaggaggacgatggtcgtaactgtggcagcgacggggtcggacacggccgagccgctgcactccaccaccttcgcctcccgctacgtccgcgaccagctcccccggtaccggatgccttcggggtcgatcccccaaggaggcggcgtaccagatcatcagcgacgagctgatgctggacgggaacccgcggctgaacctggcgtccttcgtcaccacctggatggagcccgagtgcggcaagctcatgatggactccgtcaacaagaactacgtcgacatggacgagtacccagtcaccaccgagctccagaaccgttgtgtaaacatgatagctcacttgttcaatgcaccgatcggtgaggatgagactgctatcggagtctcaacggtagggtcctcggaagcaatcatgcttgcgggccttgcgttcaagaggaaatggcaaaacaagaggaaggaacaggggaaaccatgtgacaaacccaacattgtcactggtgctaatgttcaggtttgctgggagaaatttgcaaggtattttgaagtagaactgaaggaggttaagttatcagaaggatattatgtcatggaccctgtcaaggctgttgagatggtggacgagaacactatttgtgttgcggcaatcttgggatcaactctcactggagagtttgaagatgtcaaactattgaacgaccttcttgtggaaaagaacaaggaaacggggtggaatgtgccaatccatgttgatgctgctagtggaggatttatcgctcctttcctacatcctgagcttgagtgggacttcaggctaccattggtgaagagcataaatgttagtggacacaagtatggccttgtctaccctggtgttggatgggtcgtttggcggagcaaagacgatttgcccgaagaactcattttccatataaactatctagggacagatcagcccacatttacactgaacttctccaaaggtgcaagccagataattgcacaatactatcaactgatacgccttggcttcgagggatacaagcacatcatggagaattgccaggcgaatgcagccgtgctgagggagggcatggaggccactggccgattcagcatcgtgtccaaggaggacggcgtgccattagtcgccgcctcgctcaaggacagcaccaaattcagcgtgttcgacgtctctgagaacctgcggaaatt

SEQ ID NO: 13659 - DNA, 973 bp, Triticum aestivum
  Clone ID: PAT_TA_13659
atcagtgtgaataaggcgtaattcgtgcatatatgctacagattccaacagttgtcgtccaaactcccgcacaagttccacagggaaaggttggtatctatttctctttagaaaatcatacaagcttggcccaagcttctcaaatacctgacaaaaccattgatatccattgaataaaattatctttattttatttccataccaggcaaccttcatgaggaaagagcgaagaaaagcaactgttttataagcatgcaaatcttattacgactacattatcatgttatgtgtaccagcatgaacatctcactttgcacgagtaagaggtactgagagggctagtaaaattaactgttaacaaacaaggcatataaacaggaattcaatgcgctataggagatggaagtgaatgtaataactgacacttggaatcaacatgtagaacttgcataactgaacagaagaaaatcaaacttacaatgcatatatggttgcgatagtcaaaccatctttgaatttggacacagagggatctgtatctctcattttctgcaaggcgattgagcacatcgatctcaatcattgcagcatcccggtacttccggatgcttcggacaacttttattgcaacatattcacgtgtttcacggtcccagcattccaaaactcggccaaaagtaccttcacccattttgctcaagattttataccgacgggtcaagttctcgccgagatcaaacacgtaatggccgtcgcggtcgtcatcccgccaaggcggcgacgcgccaccccttgctaccacctcccgctccggcggcgggtcgccggtgctgtccaactcttgacgcgtgcgcttccgcgacctcgacgactccatggattccgattcgattgggaggagagaaacgggggagagagagagagagagagacggagaaaccctagggcgaggccgtgcgggtgggctcgtgcc

SEQ ID NO: 13660 - DNA, 1020 bp, Triticum aestivum
  Clone ID: PAT_TA_13660
ctcgagcggacgaccagagtcccttccccgagcgcgagatctagggttcatagccgccgccggcccaccgccgcggctcgcccagtcggccgaagcctccgctgcccggccgcaggtacaggatcccagcagcgcctccctccgtcgggcagccgttcctaccagcagcgccttcctccctggagcaggcgctcccggccagcaacgccgccgcccggagcaacgccggcgaccagtccataggcagttggaacagggcatcaacattgtcaattggagggacttggagctgctccagcatcgacagtagagcaaacaagaaggagccaggtgttgattggagatgaatgcccctgaccgctatgagcgcttcgtcgtgcctgagggcacaaagaaggtatcctttgagaaggatacaaagatcatgaatgctgcatctttcacaattgaacgtgaggaccacaccattggcaacatcctccgcatgcagctgcacagggacccaaatgttctctttgctggctataagctgcctcacccccttcagtacaagatcattgttaggatccatactgcaagccaatcctccccaacgcaggcgtatacccaagcaatcaatgatctagacaaggagctcgagaacctgaagcaagcttttgaggacgagaagacgcgattcgaaaggatgaagcagggctactaggccgctggtgttggatgctaattaacgtgaaatccttgctagtttatatctgatgtctgaactgcggtagaaagaaaagaactcaaggattgtcgatgagtctgaactcgtagagtatctgcatgtgcgaccgggattgcgtatgattgtacacttgatgcgcctgctagctgaattgctcgcccttgtgaggttggatagagggtacggaccgagtttgaagcagtccttggatcattttgtactgtactacatgaattttacgccaatgtaatgtaaccaacttaaacgggtcggactttatttgcctagcgaaa

SEQ ID NO: 13661 - DNA, 1063 bp, Triticum aestivum
  Clone ID: PAT_TA_13661
gctgcgtcgacctgtctatgctgtgacaccccctgctcaccctctcttctcgcacgccacgacggcgaagtgatccagccagccaccggccgccgcggcaaatggcgttgtccagggcgcagacgaattccggcgagtccctcatctcctccaccttcgcgtcgcgctacgtgcgcaccgcgctcccgaggttcaggataccggagcagtccatccccaaggacgcggcgtaccagatcatcaacgacgagctgatgctggacgggaacccgcgcctgaacctcgcctccttcgtcaccacctggatggagcccgagtgcgacaagctcatccagaactccgtcaacaagaactacgtcgacatggacgagtaccccgtcaccaccgagttccagaaccggtgcgtcaacatgatcgcgcatctcttcaacgcgcccatcggcgaggacgagacggccgtcggggtgggcaccgtcggctcctcggaggccatcatgctggccgggctggccttcaagaggaagtggcagaacaagatgaaggccgagggcaagccccacgacaaacccaacatcgtcaccggcgcaaatgtccaggtgtgttgggagaaattcgcgcgctacttcgaggttgagctcaaggaggtgaagctcagggaagggtactacgtcatggaccccgcgaaggccgtagagttggtcgacgagaacaccatctgcgtcgccgccatcctcggctccacactcaacggcgagttcgaggacgtcaagatgctcaacgacctcctcgtcgccaagaatgcagagacagggtgggacacgccgattcacgtggacgcggccagcggcgggttcatcgcgcccttcatctacccggagctggagtgggacttccggctgccgctggtgaagagcatcaacgtcagcggccacaagtacggcctcgtctatgccggcgtcgggtggatcatttggaggaacaaggaggacctgcccgacgagctcatcttccacatcaactacctcggcgccgaccaaccaaccttcacgctcaacttctccaa

SEQ ID NO: 13662 - DNA, 690 bp, Triticum aestivum
  Clone ID: PAT_TA_13662
gccggccgggtcactcaccaaaccagctccgatacaatctcataatacagtggccgactaagacacacagcgaggagaagagggttcgaccggcgtcaatggcgacgttcaagggtttcctcctcgtgtttgctctcctgcttgctgctgctttcctcgtcgcctcggccgaagaaactcaggccaagaaggaggagcccacggccgacgtgcaggactactaccgtggcggcggcggctacccgggccgtggttatcccgggcgcggtcgcggaggagggtactacccgtaccctggccgcggaggaggcgggtacccgggccgcggcggcggcgggtactgccggtggggctgctgcggccgcgggtactacggcggctgccggtgctgctcgcgcgccgacgaggtcccggagcccatgtaccgcgctgaggcggaggtgcaccactgagccgagcatgcatccaccggatgcagcagcgtgtacgcctgcacgtgcctagttaatctgcttatactgtgtgttcttgaggaacgcagctagccctgtgttcttgcaagctatgtgttcatgtgtgtttatggtgtgcttgttcgaaagacgtactggtcagtgtacggacgtattgtactactgtgcccgtgttgtgttcatcatggaataaaatgacaggcgaatttgctcttct

SEQ ID NO: 13663 - DNA, 885 bp, Triticum aestivum
  unsure (1)..(885): unsure at all n locations
  Clone ID: PAT_TA_13663
aggatagagcttctgcggaagaacggaaagctgatttgaagtcacaagggaaggaagcatttgcaaaggaggactactttacagcaatgtactactatggactggtgatggagatagacccacttgatgcgaccctgtttgctaaccggagcctctgctggctgcgcatgcgagaaggggacagagcactggcagacgctcaacggtgcaaaatgttgcgtcctggttggtccaaggcatggtaccgagagggctcagctctcagtttcatggaggattaccaaggggcagttgatgcgttccaggaggcgctgagacttgaccctgagagcagtgagatcaagaagatgttaagtgaggccaaaagcaaggctactcgctaaagagtagaacccgtgatggagctgacatataagcaagtgcctatgtcctacatacctgtgatcatcctgtcttttcacgggctactaatccactaccaggcctgctcgtattgcagccgttgacaagctagctacttttgaactgtgctcgagggcagctgcggagcttcatcaggaataagaggaatcaaacatattgtactactccctccgttctaaaatagatgacccaactttgtattaattttgtactaaagctagtataaaattgagtcatctattttggaacggagggagtatgtattagccgtgaagaagaatgagttgttagatgcaccaacaaatatatagttcatgaagatctttcctggtgccgaattcctgcagcccgggggatccactagttctagagcggccgccaccgcggtggagctccagcttttgttccctttagtgagggttgtttcgagcaagggtattagattcgagnaggggaataaac

SEQ ID NO: 13664 - DNA, 1256 bp, Triticum aestivum
  Clone ID: PAT_TA_13664
ccagcacggcgcacgccatccactatacaataggaaacgctcccgctttccttggtaacggcttggccccgaccccgggttgatcaagcacaaaccagcggcagctctagcaccaccaccaccgccgtcccccgatcggatcggccgtcgtccccgccggcgagcgagcgatcaggatggtgctctcccacgccgcgtcggcagggtcgtccgatgactcggtgcactccaccttcgcctcccgctacgtccgcgcctccctgcccaagttccggatgccggagaactcgattccgaaggaggcggcgtaccagatcatcaacgacgagctgatgctggacgggaacccgcggctgaacctggcgtccttcgtcaccacgtggatggagcccgagtgcaacaagctcatgatggactccatcaacaagaactacgtcgacatggacgagtaccccgtcaccaccgagctccagaaccgatatgtgaacatgatcgcgcatctgttcaatgctcctcttggggagacggagacagccgtgggggtgggcaccgtcggctcttcggaggccatcatgctcgccgggctggccttcaagaggaggtggcagaacaagatgaaggccgccggcaagccctgcgacaagcccaacatcgtcaccggcgcaaacgtccaagtttgctgggagaagttcgcgcgctacttcgaggtggagctcaaggaagtgaagctgagcgaggggtactacgtgatggaccccgagaaggccgttgagatggtcgacgagaacaccatctgcgtcgccgccatcctcggctccaccctcaacggggagttcgaggacgtcaagatgctcaacgacctcctcgtcaagaagaacgaggagacaggctgggacacgccgatccacgtggacgcggcgagcggcggcttcatcgcgccgttcctgtaccctgagctggagtgggacttccggctgcccctggtgaagagcatcaacgtgagcgggcacaagtacggcctcgtgtacgccgggatcgggtggtgcatctggaggagcaaggaggacctgccggacgagctcatcttccacatcaactacctcggcgccgaccagcccaccttcaccctcaacttctccaagggttccagccaggttatcgcacagtactaccagctgatccgccttggttttgaggggtacaggaacatcatgggacactgccaggagaacgcgatggtgctcaaggagggctgg

SEQ ID NO: 13665 - DNA, 579 bp, Triticum aestivum
  Clone ID: PAT_TA_13665
gagttcatccatcatccatcccctgacgcagacatcgatcaagatcgagagagccgaccggtcgaccatggcgaggtctgctggtcggtgggccgttgcgccggcgatagtgctgctgctgctgaccacggcgtcatcagcatcggcagcagcaggtgtcgattcagcaacgacggcaccggccaaggtgtggcagctccctccaagattccctacagagcccttcccggtgccaaagcccccttcttcgtcgtcgtggaaggcggtgaaatcgtctcttcctcctcgccaccgcctccccacggaaccgccgtcggaaaagcatacgtaagatgataatacctactccaactagtatgcggctgcacaagaatctgcatccatggtgccgcccttgatcagttgatctatccgtgtgagtgtgggttcacgtagtcgttctgttgcaagctatgtgttgatgtgtgcttatggtgtgcttgttcgaaagacgtactggtcagtgtacggatgtattgtactgcacccgtgttgtgcttattattatggaataaaaagacaggcgaatctgctctcctg

SEQ ID NO: 13666 - DNA, 1636 bp, Triticum aestivum
  unsure (1)..(1636): unsure at all n locations
  Clone ID: PAT_TA_13666
gcacgaggaaaaaaaggtcaattcattcactcactgcgctaaccccgctcctcctcctcctcctcctccccgatccaccccccatggaccccgacgccgctccccctccccccttcccccccggatccgcctccgccgacgccgactgcgacgccaccctcccggtcgacctcctcctcgagatcgcggcgcgctccgacgccgtctccgtcgtgcgctgcgcggcggccgccaagccgctgcgccgcgccatcctcgaccggggcttccgccgcctcctcgcgcagcgcgccaccgccacctccggctacgacccgtccctgctccgcggcgtctcctacaagatcgaggacagcgacgccgaccgcccggcacgcgtcctgcaggccgtgccccccgacgagccctccgtgctccgcttcaacgagagcctcgccttcgagcccgtcgcctcccgcgacggcctcgtcgtggctccgccgcctccgcccccggcccctcttcgggcagtccatcgaagaggggccccccggcagcgtcctccgcgtctgccacagcttcaccggcgccgtctccgtcctcccctccgtctccatccgcgactaccgcaagcacgcgctgctctccgtcgacgacaacggccgcgccttcgagctgctcgtcgccgacgagcgcctgcgcatccagatttactcctcgcgcgagggccgctggggccccgtncgcgccgcgctcccccgccgccagtccaggccgttccatgactcctaccccctcgtcatcggccgcaccgtccactggctctgcaacccggagccgctgccgcccgggcgccacctgtctggcccggagccgtacatcgtcgccgtggacgtcgacaccatggaggccaccgtgattgatctgccgcggggctgcaccagcagaatgacggcctctatgagccaccggggcctcctcctggccgcttccgtggacgggaggctcaaggttgtggtctcggagacccaggttatatcaatgtggaccatgttaccccccgtcgagggggagccgagctcgccgccgagatggatccggcaggtgctcatagacaagcaggactggggcgtgcacagctcagttcagttcgagggattcgggctcaggagtggcactgtcatcttatacgtaggcagagttgggctcattcggctcaaccttgccacaaaagaggcggtcgtccgtctaccaccgcagcgatacggcatacatctcgcaggtttgcctgcacgagattgatttgtcctctctgctccagaccatgaagcctctgagctagctgcttagtatggatcagttttggaaatgttcttcagtcaagttcttgttctactgctttatttgcttagagcagctgttttagctctaagcagtcctgctccttggccaatactagttgtaaaaggaatcgagtcactcctaagttaagtttgttaagtcttgtcgtttcctgttatgctgttagtgtttgccggcaatctgtcgttcatcctgtaaaataacggattgtatggttcattatgtactttagccagttgtcaaaggtgaaataagatctgtttgccttactgattcaaaaaaaaaaaaaaaaaaa

SEQ ID NO: 13667 - DNA, 684 bp, Triticum aestivum
  Clone ID: PAT_TA_13667
ttttttttttaaatacaatgccgagacattccaaaatattttagggacagggcatttggaaatgtatacggcatctgccatcatcatcagataaattttaacaacaaaacagaaacagaaacataatgttcagcccaggtcccatcaatatcagattggtacatcacaagttcacaaccaacccttattggaagcaaaacagaacagaagcaacctaggtttcgaggaagacctggggcgcccgcgcgcggatcactctgacagggcgtcggcggaggcggacgcggcggcgagctcctgctgctggaggcgctcgagcgccttgtggtgcgcccaggtctcgagggtgaggtcgggcttggcgttgagcccgacgccgaggatgacgacggtgaggaaggaggtgacgtagcaggggagctcccagtcctcccacttgcgcgactcgcccggcggcggcggcgtgcggttcatcgggtaccccttgggccgcacctcgtggccgggcgtcgtccagcggccaccgccgtcgccgtgcccgccgcggaggcgcgccgccgcgctcagccgcgcccgcagcatccctcccgccgccgacgagatcgcccgcatcgtgcccggttggtgcgtgtgtgcgaggtggaggattggagatcggagagaggggtcgccgattgggggctg

SEQ ID NO: 13668 - DNA, 1084 bp, Triticum aestivum
  Clone ID: PAT_TA_13668
gcaaggaggacatgaaccgcctcgtcatgaacttcctcgtcaccgagggcttcgtcgacgccgccgacaagttccgcgtcgagtccggcacccagccggacatcgacctggccaccatcacggatcggatggaggtgaaaaaagcggttcagtcagggaatgttcaggaggcaatcgagaagatcaacgatctcaaccccacgattctggatacaaatcctgaattatacttccatctccagcagcaaaaactaatagagttgattcgtgcggggaagataaatgaagctttggagtttgctcaagaagaacttgcaccaagaggcgaagaaaatcaagcctttctggaggaaatagagaaaactgtagcactgttggtctttgaagatgtaaaaaattgcccatatggtgaactgttggacgtttctcaacgcttaaagacggcaagtgaagttaatgctgccattctcacaagccaaagtcacgagaaagatccaaagctccccagtctgttgaagatgttgatttggactcaaaaccagctgaacgaaaaggcagcatatccccgaatcaataacttgtccaccgccgcactgggaagatccagctatatgagctgcgcccaaagtgtccgagtgctgactacgttaggcaccagcagccatgtctgcatgtacactctgtcgtaggtctgttgttcgtttcatcagtgttctagcttaatgcaaaaaaagaacatcagatagataatcctgctctctcctgttgtataggttgttcttgtcaatttctttttgaaaacagagataaacgttgcatttgattgttgtttacaaactatgtgttgttgaactgttggcgaaaaaaaaaaaaaaaaaaaaaaaaaaaacatggggaagcgcgtggtgttcctcaagcagctcaagtctggcctgctcctcatctctgggcctttcaagatcaatggtgtgccagttcgccgggtgaaccaggcttatgtcattgccacatccacaaaggttgacatctctggtgttaacgtggagaagtttgatgacaagtacctgcccgggcggccgctcga

SEQ ID NO: 13669 - DNA, 853 bp, Triticum aestivum
  Clone ID: PAT_TA_13669
cggccgcgtgggcgcccccagtcccgatccgaagctgtgcctcgtaccatttcgatccaatggcgccgacgtcgaagctgtcgacgggcatcaagcgcgcttcgcggtcgcacgcgtaccatcgccgtgggctgtgggccatcaaggccaagaacggcggcgccttccccaaggccgacaaggccgccgccgccgtggaacccaagttctaccctgccgacgacgtcaagccccgcgttcccagcacccgcaagcctaagcctaccaagctcaggtcgagcatcacgcctgggacggtgctgatcctcctcgcagggcgcttcatggggaagagagtggtgtttctcaagcagctcaagtccggcctgctccttatctctgggcctttcaagatcaatggagtaccgatccgccgtgtgaaccagacctatgtcattgctacatcaaccaaagttgacatctcaggtgttgatgtcgccaagtttgatgacaagtactttgccagggagaagaagcagaaggtgaagaagaccgagggcgagctttttgagacagaaaaggaggcatccaagtcactgcctgacttcaagaaggatgatcagaaggctgtggattctgctctgatcaaggctatcgaggctgtcccggagctgaaaacctatcttggcgcccggttctctctcagggatggtgacaagccccatgagatggtcttctaagctcttagttttggagttcggaggaagctgttttgtctgtgttcttgcacttctgagttttgccccagtagcgaatgtctcattgtggttgaaatcctcctcccaaatattataagatctaagaaagttccatc

SEQ ID NO: 13670 - DNA, 775 bp, Triticum aestivum
  Clone ID: PAT_TA_13670
tcctcactccactcgccccgcccagccagatcttcctagaaccttcagcaaccctagggccccagcgagaggcctctgccgctgccgccgccatggcccccaaccccgccgcaatcgccctcctggctgccctcgacggcaatctccgcctcctcaagaaaatgtccaaaaagatggatttgcgggaaacaaaggaccccaaagggctcaacgcactccatttcgctgcaaataaggggtccctggagatttgcaagttcctgttggaggacgtgtggggtcgatgtcaactcggtatcaagcgtaggtgcgacaccgatgttttatgctgcactcaagggaaatcttcaggttgccagatatcttctcgatcatggtagcgatccggcgaaacctagtgagaggggcttaacgccgctgcacaatgcagcagagcatgggcattgtgagattgtaagactgttgctgtccaaaggagttgacgtggatgttatcaattaccgagggacaccattacatatgactgctgcaaagggtcagcatcaggccatgaaaattctgctggagcatggtgctgatcccaacagagtagtcaatcatatcttctcaccactaatgatggcatgctgtgggaactccttggaatgcatgaagctactgattgaggctggtgctgatgtgaatggtaatagtagctctggaccaactcctttaacgggggcagttgatgatggctcaactgaattcgccaagttcttgctggaggctggagctg

SEQ ID NO: 13671 - DNA, 1377 bp, Triticum aestivum
  Clone ID: PAT_TA_13671
ctcgtgccgaattcggcacgaggcgcacgccatctactatacatacaataggaaacgttcccgctgttcctggtaacggcttaaccccgaccccgcgttgatcaagcacaaaccagcggcagcactagcagtctagcaccaccaccgcccccgccggcccccgtctcctgatcggatcggccgtcgtccccgccggcgagcaggatggtgctctcccacgccgcgtcggcagggtcgtccgatgagtcggtgcactccaccttcgcctcccgctacgtccgcgcctccctgcccaggttccggatgccggagaactcgatcccgaaggaggcggcgtaccagatcatcaacgacgagctgatgctggacgggaacccgcggctgaacctggcgtccttcgtcaccacctggatggagcccgagtgcaacaagctcatgatggactccatcaacaagaactacgtcgacatggacgagtaccccgtcaccaccgagctccagaaccgatgcgtgaacatgatcgcgcatctcttcaatgctcctctcggggagaccgagacggccgtgggagtgggcaccgtcggctcttcggaggccatcatgctcgccgggctggccttcaagaggcgttggcagaacaagatgaaggccgccggcaagccctgcgacaagcccaacatcgtcaccggcgccaacgtccaagtttgctgggagaagttcgcgcgctacttcgaggtggagctcaaggaagtgaagctgagcgaggggtactacgtgatggaccccgagaaggccgttgagatggtcgacgagaacaccatctgcgtcgccgccatcctcggctccaccctcaacggcgagttcgaggacgtcaagatgctcaacgacctcctcgtcaagaagaacgaggagacaggctgggacacgccgatccacgtggatgcggcgagcggcgggttcatcgcgccgttcctgtacccggagctggagtgggacttccggctgccgctggtgaagagcatcaacgtgagcgggcacaagtacggcctcgtgtacgccgggatcgggtggtgcatctggaggagcaaggaggacctgccggacgagctcatcttccacatcaactacctcggcgccgaccagcccaccttcaccctcaacttctccaaaggttccagccaggttatcgcgcagtattaccagctgatccgccttggtttcgaggggtacaggaacatcatggacaactgccaggagaacgcgatggtgctcaaggaggggctggagcgcacgggccggttcaacatcgtgtccaaggaccagggcgtcccgctggtggccttctccctcaggacagcagccggcacgacgagttcg

SEQ ID NO: 13672 - DNA, 2061 bp, Triticum aestivum
  Clone ID: PAT_TA_13672
gaggaattcggcacgaggcgcatcccgccgtcgccgggaaaggagtgaaagctcccatggatgctgtggagaacgctgtcgcccccgccgccccgtcaacggtggcaaatggcacttcttcatcaatcaccgtagaggaatttgaagatttagcctccctagtgaaggatgacgaggcgtcggttagcatcactgtagttggagcgtccggtgaccttgcgaagaagaagatatttcctgccctttttgctctttactatgaaggctgtcttcccaagcatttctccatctttggctatgcgcggagtaaaatgacagatgctgaactgagagacatggtcagcaaaacactgacttgcaggattgataaaagggagaactgtagtgagaaaatggaagagtttctgaaacgatgcttctaccactcaggtcaatatgattttagaggaagatttcagggagctaggcaagaagatcaaacaacatgagggtcccagagtatctaaccatcttttctacttgtcgatacctccaaatatattcctggatgttgtaaaatgtgcaagcaaatcagcatcatctgtgagtggctggacaagggtaattgttgaaaaaccctttggccgggactcagagtcttctgctgccctaacgaaaggtctgaagcagtacctgacagaggaccaaatcttcaggattgaccattacttgggaaaggaactggtggagaacttgtctgtccttcgcttctcgaatcttgtttttgagcctctgtggtcaaggcaatatattaggaatgtgcaactgatattctcggaagactttggcactgaagggcgaggagggtactttgatagctatggtattatccgagacataatgcagaatcatcttcttcagatactagctctatttgcaatggaaactcctattagcttggaagcagaggacatacgaaatgagaaggttaaagttttgcgctccatgaagccattgcgactagaagatgtggtaataggacagtataaaagtcatacaaagggtggtattacataccctggatacactgaagataagacggtgcccaagggtagtctgactccaacatttgctgcagctgcgctttttataaataacgctagatgggatggagttccctttctcatgaaggctggaaaagctttgcatactaaacaggctgagattagagtacagtttcgacatgttcctggaaatctctacaaggggtcttttggaaccgatcttgacagggctactaatgaacttgtgatacgcgtgcaaccagatgaaggaatttacctaaagattaacaacaagattcctggtcttggtatgagactagataggagtaatctgaatcttcactatgcagcaaggtaccccaaggagataccagatgcgtacgagaggctcctgctcgacgcgatagaaggagagcgaaggctcttcatccggtcggacgagctggacgcggcgtgggagctcttcacgcccctcctgaaggagctggagcagaagcggatggcccccgagctatacccctacgggagccgcgggcccgtgggcgcccactacctgggcagccaagtacaaggtgagatggggcgacctgggtggctccggaacactaggaagagagcgtggtttcacacgggaggtgatgatttctgtttttggcgtcgcaatttctgcaaaaggccttgcagcgcacgcccagctagtgggggtggtgcgaggaacagatctgaataagggtgagcggttggcgatgcttgtgttcatcgatcgatcgaccgtgagtgagtatatttgttggtaccactggcttacatactctatgattcttaagaggaagcccagagcagaaagctcattcatcctggctgttcgtcggctcatttggttgtctggctgggccgggctgttgtattgggactgctgattgtgtaactgcaaaagctgttacttctttactgatgccggtgttcttgtcgtgttttttagttcaatataagcaagtactgggaagtaaaaaaaaaa

SEQ ID NO: 13673 - DNA, 541 bp, Triticum aestivum
  Clone ID: PAT_TA_13673
cagccaagcaaagaaccagcccgatccttgcagggcatgaggccccaggcgctgctcgccgcgctagtcgtcgtcgccgtcctcgcagcagctctgcccctcgcccacagccaagatgcaggggcgacgccgagcgcgtggccgtgttgcgacaagtgcggctcgtgcaccaggtccatcccgccgctttgcacgtgcatggacatgtcaccgaccgggtgcaacaaggcctgtaagacctgtgccaagcccaactccaccctcgccggcggtgacggcttccggtgtgcggaccgcatcgccaacttctgcaagcgccgctgcacgccggttgcatgactaattggacggtggatcatgtcgcctgaataatgaacttgtgcctttaagtttctctcggtcttctttcagagttccctctgcatcttggtctgcatagatgtagaggagaaatgaacggtcgatgcttgctcatggtttctttctatgtctcaaataaattaagagcatattatatgctcaaactcttttctgttaaaaa

SEQ ID NO: 13674 - DNA, 496 bp, Triticum aestivum
  Clone ID: PAT_TA_13674
gccgacgcagacatcgaccaagatcgagagagccgtccggtcgaccatggcgaggtctgctggtcggtgggccgttgcggcggcgatagtgctgctgctgctgaccacggcgtcatcagcatcggcagcagcaggtgtcgattcagcaacgacggcaccggccaaggtgtggcagctccctccaagattccctacagagcccttcccggtgccaaggcccccttcttcgtcgtcgtggaaggcggtgaaatcgtctcttcctcctcgccaccgcctccccacggagccgccgtcggaaaagcgtacgtaagatgatgtatacctaactagtaatgcatgtagcagcaaagcatgcggcggcgcaagaatctgcgtgcatggtgctgcccttgatcagttgatctatctgtgtgagtgtgggttcacgtcgtcgttctgttgcatgtactcctaccaagaatgaataaaatgataatgattgtgtggaaaaaaaaaa

SEQ ID NO: 13675 - DNA, 1278 bp, Triticum aestivum
  Clone ID: PAT_TA_13675
ccacagccttcgcaaggcaacaaaattgcaagcgattgctgacaaacaggtcgatttcgaccgatctcctccgcatatgtggttctctgctgcccttgccgcttctcctcccatcctccttgtcctcgggcgcacggggaaacgacgccggcgggatggctcctccccgcgcggtgatctgcgtgggtgacgtccacgggtacatttccaagctggagagcctctgggcgaacctccggtccgcgctccccgccgacgccttcgccaccgcgctcgtcatcttcctcggggactacaacgaccgcggcccgcacacccgccgcgtcctcgacttcctcctcgcgctcccggcccgccacccggctcagcgccacgtcttcctctgcggcaaccacgacctcgccttcgccgccttcgtcggagcgctgccgccgccccccgacggttcccctttcgccgccacctgggcccaatacatcgacaacgaggcccacgagggatggttccgccgggccgggccacgaggacatgcacgtgcaagggaggagatggggcggcgtcatcaaggagaggtggaaccccaagaagggcctcccgtacaagggctctatctacgatgcgcagcccaccttcgagtcctacggcgtcgcccatggatcaccagatctcatgaaagctgtgcctgaggagcacaagaagtttctgcatgacttggtttgggtccatgaagaggaagacgttcgtattgatacagatggaggccagattctatgcaaactgatcgcggttcatgccggcctggaaaagtccttggatttgcaatgagcagcttagagttttgagaactagagacacaagggtgccaaaagttcaaatgcttagcgggaggcaggatgtttggaacataccacaggatctggccggcaagcagaccatcgttgtaagtgggcatcatgggaagctccacgtggacggtctcaggttcatcatcgacgaaggtggcgggtacgcagataaacctatagcggccgttgttttcccttcaaaggaagtgatcaggagcacagagggaacggcctcccagaattaatctagacaccatcggacgccacggatgcaagctaatgttttttgttactgtcgtaacatgagcaattggacgactggtatgtacatctgccaaaatggagtataatatttcaaaaaacacagaattggggttttaatgtataatgtcgaggaaataagtcaataatgtgtgatcttctaaaaaaaaaa

SEQ ID NO: 13676 - DNA, 1198 bp, Triticum aestivum
  Clone ID: PAT_TA_13676
gcttccccaggtcttccaatccaccagcctctccgccgcgaaaccctagcccccctgagccaccccccgtcgaggccgctggcggatggcgaaggcgtgaccggcgcggacagcaccccgttcccgccctcagccccgcatctgatgttcctctcccgcatcgtcctgcgcgacctggactccatcgactcccccgcctccatggcgacctccaagaaggtggtgacgcgcgacgagtgggagcgcaagctccgcgacgttaagatccgcaaggaggacatgaaccgcctcgtcatgaacttcctcgtcaccgagggcttcgtcgacgccgccgacaagttccgcgtcgagtccggcacccaaccggacatcgacctggccaccatcacggatcggatggaggtcaaaaaaagcggttcagtcagggaatgttcaggaggcaatcgagaagatcaacgatctcaaccccacgattctggatacaaatcctgaattatacttccatctacagcagcaaaagttaatagagttgattcgtatggggaaaataaacgaagctttggagtttgctcaagaagaacttgcaccaagaggcgaagaaaatcaagcatttctcgaggaaatagagaaaactgtggcactgttggtttttgaagatgtaaaaaactgcccatatggtgaactgttggacgtttctcaacgcttaaagacggcaagtgaagttaatgctgccattctcacaagccaaagtcacgagaaagatccaaagctccccagtctgttgaagatgttgatttggactcaaaaccagctgaacgaaaaggcagcatatccccgaatcaataacctgtccaccgccgcactggaagatcccagctatatgagctgctgcgcccaaagtgttcgagtgttgagtacggagcttaggcaccagcagccctgtctgcatgtacactctgtcgtaggtctgttgtttgtttcatcagtgttctagcttaatgcaaaaaaaaaaacatcagatagataatcctgctctctcctgttgtataggttgttcttgttttttttttcaaacagagataaatgttgcatttgattattgtttacaaactatgtgttgaactattggcgataatgtgttgcacaccactcatttgttctgctggaatgatgcaaagcaaggcatagttcagcttgc

SEQ ID NO: 13677 - DNA, 1669 bp, Triticum aestivum
  Clone ID: PAT_TA_13677
gcacgaggatcaaatcctcactccactcgccccgcccagccagatctttctagaaccttcagcaaccctagggccccagcgagaggcatctgccgccgccatggcccccaaccccgccgcaatcgccctcctggccgccctcgacggcaatctgcgtctcctcaagaaaatgtccaaaaagatggatttgcgggtaacaaaggaccccaaagggctcaacgcactccatttcgctgcaaataaggggtccctggagatctgcaagttcctggtggaggacgtgggggtcgatgtcaactcggtatcaagcgtaggtgcgacacctatgttttatgctgcactcaagggaaatcttcaggttgccaggtatcttctcgatcatggcagcgatccggcgaaacctagtgagaggggcttaacgccgctgcacaatgcagcagagcatgggcattgtgagattgtaagactgttgctgtccaaaggagttgacgtggatgttatcaattaccgagggacaccattgcacatgactgctgcaaagggtcagcatcaggccatgaaaattctgctggagcatggtgctgatcccaacagagtagtcaatcatatcttctcaccactaatgatggcatgctgtgggaactccttgggatgcatgaagctactgattgaggctggtgctgatgtgaatggtaatactagctctgggccatgctcctttaacgggggcagttgatgatggctcaactgaattcgccaagttcttgctggaggctggagctgaccctaacattcctaaccagcacggggatattccaatcaagagagcagcagtccgtggtcaacgtgaacttgttgagcttctgtttcctaagacaaacccaattccatctgtgcctgattggagtgttgatgggataattacaactatgaaatctccacagaccagggttcaggatagagcttctgcagaagaacggaaagctgatttgaagtcacaagggaaggaagcatttgcaaagaaggactactttacagcaatgtactactatggactggtgatggagatagacccacttgatgcgaccctgtttgctaaccggagcctctgctggctgcgcatgcgagaaggggacagagcactggcagacgctcaacggtgcataatgctgcgtcctggttggtccaaggcatggtaccgagagggctcagctctcattttcatggaggatcaccaaagggcagttgatgcgttccaggaggcgctgagactcgaccctgacagcagtgagatcaagaagatgtttagcgaggccaaaagtaaggctactcgctaagagtaggacctgcgatggagctgacatataagcaagtgcctatgtcctacatacctgtgatcatcctgtcttttcgccggctactaatccactaccaggcttgctcgtattgcagccgttgacaagctagctactttcgaactgtgctcgagggcagctgcggagcttcaacaggaataagagcaataaaacgtattgtactactatgtattagctgtgaaggaaaatgagttgttagatgcaccaacaaataatagttcatgaagttcttttacctgagatagacgaggccagcatgaaaatcccttgcaagttaaaatcccctcagccac

SEQ ID NO: 13678 - DNA, 1837 bp, Triticum aestivum
  Clone ID: PAT_TA_13678
caccaccaccactgccagcccaccccatcttttctcccatccattcccggactcccccaccacactgcagtagtcgccggcggccatcatggtgatctcgaacgcgagctccagcgccggggaggccgtctactccaccttctcctcgcgctacgtgcgggaggagctgccgcggtaccggatgccttcggggtcgatccccaaggaggcggcgtaccagatcatcagcgacgagctgatgctggacgggaacccgcggctgaacctggcgtccttcgtcaccacctggatggagcccgagtgcggcaagctcatgatggactccgtcaacaagaactacgtcgacatggacgagtacccagtcaccaccgagctccagaaccgttgtgtaaacatgatagctcacttgttcaatgcaccgatcggtgaggatgagactgctatcggagtctcaacagtgggctcctcggaagcaataatgcttgcgggcctggctttcaagcggaagtgggcaaacaaaatgaaggagcaggggaagccatgcgacaaacctaacattgttactggtgcaaatgttcaggtttgctgggagaaatttgctagatattttgaagtggaactgaaggaggtcaagttaactgaagggtactatgtcatggatcctaagaaggctgttgaaatggtggatgagaacactatatgtgttgcagccatcctgggatctactctcaccggagagtacgaagatgtgaagctgttgaatgaccttcttgtggcaaagaacaaggaaacagggtgggatgtgccgatccatgttgatgctgccagtggaggattcatcgctccttttctccagcctgagcttgaatgggacttcaggctgccattggtgaagagcatcaacgttagtgggcacaagtatggccttgtgtaccctggtgttggatgggtcatctggcggagcaaagccgatctgcccgacgaactcatcttccacataaactatctgggaacagatcagcccacattcacactgaacttctccaaaggtgctagccagatcattgcacaatactatcagctgatccgcctcggtttcgaggggtacaagcacatcatggagaactgcaagctgaacgcggcggtgctcaaggagggcatcgacgcgacggggcggttcgacgtgctgtccaaggcggacggcgtgccgctggtggccatcaggctcaaggacagcaccaacttcagcgtgttcgacatctcggagaacctgaggcggttcgggtggatcgtgccggcctacaccatgccggcggacgcggagcacgtggccgtcctccgcatcgtcatccgggaggacttcaaccggagcctcgcgcagcggctcctcaccgacatcaacaagatcgtgggcgagctggacgcgcacgccgtccacgccatcaagctgtccaccgccgccgccgccgagggcgcgtccaagagcaccgtggacgccgtcaccgaggccttcaagggcctggccgggaacaagaaggccggagtctgctgaaggccggccgggggcgtgcttgcttgctgagacgcctggtgcattctttcatcacgtgtctatgttgtattatcttgcattgtgtaattattgtggaggggtgcatatgtgaactgtcaggacctgcctcctccgtattttgtactgcgtacgtacgcggattgcactctccctttcggccctgctggcgattggttctgcacaggacacctctccaccgaggtcactatgtatctgtcgtttgctttagctgtttgtcggaacgttaaaaaaaaaaaaaaaaaa

SEQ ID NO: 13679 - DNA, 1969 bp, Triticum aestivum
  Clone ID: PAT_TA_13679
cgtccgcccacgcgtccgcccctgtccctctcgagcgaggaagtgtattttagtatattttcctctggggttgccgcctggctggtccgtctcgcgccgcttattttgccctgccctcataactttcgaaaggcgagaggcggcggcggcggcggcggaaggaggaggaggacggcgaggcgctgccgcgggctagggtttcctccgaccaggcgaggcgcggaggcgccacccccctccccggcgggtcgcaggacctcgttggtgcgagcaacgcagaatctacggtgaccgtcccttctgattccggcagccacgtccccatgccgaccatcacgcactacgtcttggaccccttcctggagaccggctcccttcccaacctccagaagcttgttcccaagccgcctccagcggcgccgctaccccctgagaagtcctccgagaagcccatacctgtgccggtggctcctgccaggaccaccaccttgccagcgctctactccacgcccgagagcacaccgctgccagactcgccgtcatcgttccctggaacctggtcgccgtatctcatcaaccataaacgtcgtggacctggcctgatcaagacatcttcccagggtgatgtcggaagtgagggtagcctgccgaagtttcccgaggggctacctgctttgccgaaaaggtctgaagcctttcaagtgcaggagtctgagtttaggttcacacaagagagtgatggtgtggttaacaatggtgtggaggagaccttggatgagcagaatgaaggggtgcagaaaggcaaggtgaccctttttggccaagatgagcaggatcagcccgagttcgagtttcggcatgaaagtccagatgcgttggtgaggcctgtcaatgttggaaggcttgtcaacaatggaatgccaagagatggcgaaaatgatgccttccttgaacctcaggattcacagagtgtgactagtaactctgaggctgaggatgctggtgggcaggggtggtggaagcccagttctccttatgggacgtctgctggcacacctggtgcagaattttatgacgcattcgaagaaatatcaagcgatggtgcaactcgatcttctcgatgtattgatgacgaataccgtgaaatgaggttaagcatgttgacagaaattgagggtaggaaacaagctgaggaggtagctgagacctggcagaaggaatggaagaagctgagtcatcacctatcgctgatcgccttgtcacttccatctccaactgtagctgagaacgatgatgatacaagtgcggatcctggagctgagttgtgccagcaaataactgtttcacaactggtagccgctgctattgcccggggaattgctcgtgtagaagttgaatcagagatggaaagtgtgatttcagcaaagaactttgagatcgcaaggctatcagatagggtccagtactatgaagcagcaaacagggagatgtctcaaagaaaccaagaagctatcgagatgtcgaggcaacagcggaacaagcccaagatgaggcagaagtggttctggggttcagttggcatagcagttaccctcggcacagcagccattgcctggtcctacatgccggcgagccagtcccaggcaggggactcgaatagcaccaacaccaacagcgattagagctagctgaagatgcatcttctccatgcagaggtcctaacaaaagctctaactatacttcctagagagaaaagaagcttgtataagttttctcttttggtgatcggctgtgatcactacaatcctcatttcccgcttcctctgtaaaaaaaatgtggaatgggccatctccgtccaggattggctcgactcccccttaccgtaagtccctcgttgcatagttggctgagcaaaataatacgaggaatgtggatatgagtagtaatcgtccatggtgaaaaaaaaaa

SEQ ID NO: 13680 - DNA, 892 bp, Triticum aestivum
  Clone ID: PAT_TA_13680
gagtattcaaactcccaaactacaagagcaagaacaaattaacaagccagcttcaatttcaacaatgtcgacacttgttgacttctcctacacaagggtaatgtggtggaggagcatagaaagttctatcagatacagatcagtcagaaggtgccccagggtgaagggaaccaaccaacgcgggtgtacaaccaaccaaatagctcgagcactagtcattcagatactcccttccagcgcaaacatctccagtttgttcttaccaacaaaatggcacttgattgctggctaaagtatgatgggttattacatcaagagcggcgtgggggttgtcacgcaccactggcatacagacgagtccactccttcgctgtttcaacagcttctgcctcgttggatttccagtgcttagcaatgttttcagacagagggtcatctggatttggtgcacttaggagtgcctggatactcaaaagaactgttcgaatctgaagagccggactccatttatccttgagaatgtcaaggcatatcctaccaagcttgtcaatgttgggatggtatattttggtcagaaacctaacctttggggcagccatcggatattcctcgggtaaaaagagttccagcttaaaaactcccccttcgtagggcgactgcgccggaccaaggatcatgacgttgaagtaccgcatgttctcctccgagggcgaagcgctgatccccggcgctggctcgctgaggagtctctgcgtctccttgatgattcgtcgaggaaggttgctgttggccatcggatcgagccggggcgggagcttcctcctctccgatgagtgcggcgccggtgtgtcgtgcggaggaggcgtcagtggggatgggggcctcgtgccga

SEQ ID NO: 13681 - DNA, 1658 bp, Triticum aestivum
  Clone ID: PAT_TA_13681
cgaggcccaatcgaccgagaacccgcgtgctctcgccgcctcctcctccctccccccgcggcgtcgccgaacgaaaccctagctcggtcgcgcccgcccgcgccgtcgtctcgccggagagcggagagggcggagagggagagggagagggagcgggaggcggggatggggaagaagaagaagcgggtggagaaggtgttctgctactactgcgaccgggagttcgacgacgagaagatcctggtgcagcaccagaaggccaagcacttcaagtgccacgtctgccacaagaagctctcgaccgccggcggcatggccatccacgtcctccaggtccacaaggagtccgtcaccaaggttccgaatgccaagcccgagagggattccaccgagatcgagatcttcggcatgcaggggatcccctccgacgtgctcgccgcccactatggggaagaggaagatccttcatcaaaggtggccaaagtagaagtgccgacaataagacctcctattatgcctaattatccgctaggcatgccttttcctcctcggccttatggtgcagcccgccctatgtataatcctgcaatgatggtccgacctccgatttggcctcttcagcagccgcaaccttggtttgctcaacaaccaccggtttcagttcccccaatgatggctgggcaagcaccacagcaaccactattccccattcaaaacatgcccaatcctatgatgacatcagcacctgctaatttacttcagacatcatacgctatgcccaccacaggggttccttcacctgttgcccctcaggcttcccagcctttgtttcccgttaacaccagtggcaatggagcagcaaattcgtcattcagctcgtcaatttcacctgcaactattgcagcaaattctccagcatcagttggtactgcaggatatggctatgtagctaataaccatggtacaggagggccagcaattggacagccacctgcacctgccactaatagtaaaacgtctgctactcaaccagctacgagtgaggtctatctggtgtgggatgatgaagcaatgtcaatggaggaaagaaggttggcgctgcccatgtaccaggtgcatgacgaaactagccagatgagctcggttgatgcagcgttcgatcgaagaatatcagatattacattttctagacaattgacataaacaagctgcgcctggtgttcagtaaacagcttgatgcgattcaccaacgggctcacccgtgcatccatgggagggacgccgtgcaatcggtggtcctggatcccccctgttgttgatctacttagttagtgactggagctaccgcagtggaaagattgtgttggtctgacttggagattttgattcaacatcgtttgtcctgtcttttcgtaccgagagtggaaacctgttagacctagaagtcattttgtccgttgtcgattgactgacgatatgagtatcttcagctctgtaaacctgacgatgagattagcagtgtcttttcagcggctgtgctgctgttgagtaccatatgttgttggcaccgtcattttgccttccgcagcgtgatcatgtatccatggctagcaaaagcaaaagaggtgttgcttgtttcagcaaatttctcataggga

SEQ ID NO: 13682 - DNA, 835 bp, Triticum aestivum
  Clone ID: PAT_TA_13682
ctgcaacaagtcatttcaggcaaagagagacaggtacaatcggtcctaattacgctcgcaaaagcatgtagcaaatcatgcccaaggaaataaataagggatacacaagacaatacaatgcagaggcatttcaaaatgtttgggacaccacagggcatttcgaaatgcatacggcatctgccatcatcatcagataaatttcaacaacaaaacagaaacagaaatatagtgttcagcccaggtcccatcaatatcagattggtacatcacaagttcacaaccatccttattggaagcaaaacagaacagaggcaacctaggtttggaggaagacctggggcgcgcgcgcgcggatcactcggacagggcttcggcggaggcggaggcggcggagagctcctgctgctggaggcgctcgagcgccttgtggtgcgcccaggtctcgagggtgaggtcgggcttggcgttgagcccgacgccgaggatgacgacggtgaggaaggaggtgacgtagcaggggagctcccagtcctcccacttgcgcgactcgcccggcggcggcggcgtgcggttcatcgggtaccccttgggccgcacctcgtggccgggcgtcgtccagcggcccccgccgtcgccgtgcccgccgcggaggcgcaccgccgcgcgcagccgcgcccgcagcatccctcccgccgccgacgagatcgcccgcatcgtgcccggttggtgcgcgtgtgcgaggtggaggattggagatcggagagagagcgaggggtcgccgatttgggggctgctgatctgcggagacgaggaggctggctggggtgtgcggacg

SEQ ID NO: 13683 - DNA, 893 bp, Triticum aestivum
  Clone ID: PAT_TA_13683
gccggccgggttccggatcactgaaaaagaagagagctccccgctagtacctcactcggaaaaaaaagagagccccccactagtaccttacgcagaccgacttcatcgtcttcctcggaacgccgccgccgaagtgcgcctcgaggaatttcagaggaaggaggagccaagtgttgatcggagatgaatgcccctgaccgctatgaacgcttcgtcgtgcctgagggcacaaagaaggtgtcatttgagaaggatacaaagatcatgaatgctgcatctttcactattgaacgtgaggaccacaccatcggcaacatcctccgcatgcagctgcacagggacccaaatgttcacttcgctggctataagctccctcacccccttcagtacaagatcattgtcaggatccatactgcaagccagtcctccccaacgcaggcatatacccaggcaatcaatgatctagacaaggagcttgagaacctgaagcaagcttttgaggatgagaagacccgattcgaggaaaggatgaagcagggctactaggtcaagggtgttggatgctgatgtgaaatctcccttgctactagttatatctgatgtctgaactgcggtagaaaaaaaaatagacaaggcctgtcgatgatcctctgaactcgtcgaacctcttcatgtgcggattgcgtatgattacacggctgttaacccccaaaaaaaaaaaaaaaaaaaaaaaaaaaaaaaaaaaaaaaaaaaaaaagcttgtacaccttcacccattttgctcaagattttataccgacgggtcaagttctcgccgagatcaaacacgtaatggccgtcgcggtcgtcatcccgccaaggcggcgacgcgacctgcccgggcggccgctcga

SEQ ID NO: 13684 - DNA, 1648 bp, Triticum aestivum
  Clone ID: PAT_TA_13684
cgaggatcgaccgaggactcgcgtgctctcgccgcctcctcccctccctccttccttccgccgcggcgtcgccgaacgaaaccctagctacctcgccggagggcggagagggccggggagagggagcgggggcgcggggatggggaagaagaagaagcgggtggagaaggtgttctgctactactgcgaccgggagttcgacgacgagaagatcctggtgcagcaccagaaggccaagcacttcaagtgccacgtctgccacaagaagctctccaccgccggcggcatggccatccacgtcctccaggtccacaaggagtccgtcaccaaggttccgaatgccaagcccgagagggattccaccgagatcgagatcttcggcatgcaggggatcccctcagacgtgctcgccgcccactatggggaagaggaagaaccttcaaaggtggccaaagtagaagtgccgacaataagacctcctattatgcctaattatccgctaggcatgccttttcctcctcggccttatggtgcagccccgccctatgtataatcctgcaatgatggtccgacctccgatttggcctcttcagcagccgcaaccttggtttgctcaacaaccaccggtttcagttcccccaatgattggctggggcaagcaccacagcaaccactatttcccattcaaaacatgcccaatcctatgatgacatcagcacctgctaatttacttcagacatcataccctatggccaccacaggggttccttcacctgttgcccctcaggcttcccagcctttgtttcctgttaacaccactggcaatggagcagcaaattcctcattcagctcgtcaatttcacctgcaactattgcagcaaattctccagcatcagttggtactgcaggatatggctatgttgctaataaccatggtacaggagggccagcagttggacatccacctgcacctgccactaatagtaaaacgtctgctactcaaccagctacgagcgaggtctatctggtgtgggatgatgaagcaatgtcaatggaggaaagaaggttggctctgcccatgtaccaggtgcatgatgaaactagccagatgagctcggttgatgcagcgttcgatcgaagaatatcagatattacattttctagacaatcgacataaacaagctgcgcccggcgttcagtaaacagcttgatgcgattcaccaacgggctcacccgtgcatccataggagggacgccgtgcaatcggtgatcctggatccccctgttattgatttacttagttagtgacttgagctactgcagttgaaagattgtgttggtctgacttgggagattttgattcgacatcatttgtcctgtcttttcgtatcgagagtggaaattagacctagaagtcatttgttctgttgtcgaatgactgacgatatgagtatcttcagctctgtaaacctgaggatgaaattagcagtgtctttccaccagctgtactgctggtagtaccatatgttgttagcaccattattttgccttacagcagggtgatcgtgtatccattgttagcaaagcaaaagaggtgttgtttgttttagcaaatgcatttttttttccggcccttaaaaaaaaaaaa

SEQ ID NO: 13685 - DNA, 893 bp, Triticum aestivum
  Clone ID: PAT_TA_13685
ctcgtgccgaattcggcacgagggtctccagccatggccaccgccacctcaccgctcctctccctctcttccctctcggcctccctcccctccccttcccgggcacccgcctccctctccctgcgcgccatcgccccacaggcccgcctgtcgacctcctacgccgccttccccatcggtgggttcggagcctcggcgtcgacggggaggctgaggaggagggggctgcaggtggtgtgtgccgcccgagccgcccaagactggaagacagccggactcggtccaagaagagggagcgtcagaatgacagacaccgcatccgcaaccatgctcgcaaggccgagatgcgcacccggatgaagaaggttttcaagagcccttgaaaagcttagaaagaaagctgatgcccaacctgaaagaaatcattgaaatagagaaaatgatctccgaggcatacaaagccatcgacaagacagtgaaggttggtgcccatgccacaggaatactggagaccatcgcaagtccaggcttgcaaggaggaagaaggccattgagataatccgtggttggtatgttcctaatgccgaacctgctgcaactgcctagtttctgggggagtcgtcattgtgaatttgcagcagcttttccttcatcacatcttgccaattttggacagcatatgttattgaacgaactcaatagactgccaggtcttccccatggcaagtgttctggtactggttactgtgtttatgtgctcgctatgcagtagaagctcttgaaacaatattgggccattgcttgtcttacattccctctgttgtaaaacttcaaacttgaaatatacctgttgtatggtgtatgcagatatcttcagctagagataatatgtt

SEQ ID NO: 13686 - DNA, 1846 bp, Triticum aestivum
  Clone ID: PAT_TA_13686
cgtccgatcatcctttattccatccaccccccgtcgtctgcactgcgctacacactatccaccagcggagagcagcagcggtgagcgccggcggccatggtgatctcgcacgcgagctccagcgcgggggaggccgtctactccaccttctcctcgcgctacgtgcgcgaggagctcccgcggtaccggatgccggagggatcgatcccgaaggaggcggcgtaccagatcatcagcgacgagctgatgctggacgggaacccgcggctgaacctggcgtccttcgtcaccacctggatggagcccgagtgcggcaagctcatgatggactccgttaacaagaactacgtcgacatggacgagtaccccgtcaccaccgagctccagaaccgttgtgtaaacatgatagctcacttgttcaatgcaccgatcggtgaggatgagactgctatcggagtctcaacagtggggtcctcggaagcgataatgcttgcgggcctggcgttcaagaggaagtgggcaaacaaaatgaaggagcaggggaagccatgcgacaaacctaacattgttactggtgcaaatgttcaggtttgctgggagaaatttgctagatatttcgaggtggaactgaaggaggtcaagttaactgaagggtactatgtcatggatcccaagaaggctgttgaaatggtggatgagaacactatatgtgttgcagccatcttgggatctactctcactggagagtacgaagatgtgaaactgttgaatgaccttcttgtggcgaagaacaaggaaacagggtgggatgtgccgatccatgttgatgctgccagtggaggattcatcgctccttttctccagcctgagcttgaatgggacttcaggctgccgttggtgaagagcatcaacgttagtgggcacaagtatggccttgtgtaccctggtgttggatgggtcatcctggcggagcaaagccgatctgcccgacgaactcatcttccacataaactatctaggaacagatcagcccacgttcacactgaacttctccaagggcgctagccagatcattgcgcaatactatcagctgatccgcctcggcttcgaggggtacaagcacatcatggagaactgcaagctgaacgcggcggtgctgaaggagggcatcgacgcgacggggcggttcgacgtgctgtccaaggcggacggcgtgccgctggtggccatcaggctcaaggacagcaccaacttcagcgtgttcgacatctcggagaacctgaggcggttcgggtggatcgtgccggcctacacgatgccggcggacgcggagcacgtggccgtcctccgcatcgtcatccgggaggacttcaaccggagcctcgcgcagcggctcctcgcggacatcaacaagatcgtgggcgagctggacgcgcacgccatccacgccatcaagctgtccaccgccgccgccgccgagggcgcctccaagagcaccgtggacgccgtcaccgaggccttcaagggcctggccgggaacaagaaggccggcgtctgctgaaggccggggtggtgcttgcttggtgagacgcctggcgccttctttctttcatcacgtatgtctatgttgtatcttgtgtaattattattgtggaggggtgcaaatgtgaactgtcaggacctgcctcctccttattttgtacgtacatttcgtctgtggttctgtacaggaaggacacctctccatcgaggtcgctatgtatctgttgtttgcttagctctgtgtcggaatgttacgtgtttgttgtatcctttgaatgtattgcattatatagtgctgctggac

SEQ ID NO: 13687 - DNA, 904 bp, Triticum aestivum
  Clone ID: PAT_TA_13687
aactcccaaactacaagagcaagaacaaattagcaagccagcttcaatttcaacaatgtggacacttgttaacttctcctacacaagggtattgtagtggaggagcatagaaagttctatcagatacagatcagtcagaaggtgccccagggtgaagggaaccaaccaacacaggtgttacaaccaaccaaatagctcgagcactagtcattcagatactcccttccagcgcaaacatctccagtttgttcttatcaacaaaatggcacttgattgctggctaaagtatgatggattattacatcgagagcggcatggggttgtcatgcaccactggcatacagacgagtccactccttcgctgtttcaacagcttctgcctcattggacttccagtgcttagcaatgttttcagagagagggtcatctggatttggtgcacttaggagtgcctggatactcaaaagaactgttcgaatctgaagagccggactccatttatccttgagaatgtcaaggcatatcctaccaagcttgtcaatgttgggatggtatattttggtcagaaacctaacctttggggcagccatcggatattcctcgggtaaaaagagttccagcttaaaaactcccccttcgtagggtgactgcgccggaccaaggatcatgacgttgaagtaccgcatgttctcctccgagggcgaagcgctgatccccggtgctggctcgctgagaagtctctgcgtctccttgatgattcgtcgaggaaggttgctgttggccatcggatcgagccggggcgggagcttcctcctctccgatgagtgcggcgccggtgtttcgtgcggaggaggcgtcagtggggatgggggaacacgagggaggcggtgcgggtggatgctcg

SEQ ID NO: 13688 - DNA, 698 bp, Triticum aestivum
  Clone ID: PAT_TA_13688
cagagagattactgaatttcttccatgaacatgaacacaacacagggtacatcaacaactagacggaacaccttcacatcactaatcagacgaacactacacagcacacatcctaaacgacagagagcgcatctctcttaagctttcttcggggtggcggccttcttgggcgacttggcggccttcttgggggacttgggcgcctggccctccttctccgccgtcttcttggggagcagcacggggttgatcttggggatgacgccgccgtgcgcgatggtgacgccggccagcagcttgccgagctcctcgtcgttccggacggcgagcagcaggtggcgcgggatgatgcggctcttcttgttgtccttggcggcgttgccggcgagctccagcagctcggcggcgaggtactcgaggacggcggcgaggtagacgggggcgccggtgccgacgcgctgggcgtagcggcccttcttgaggtaccgcccgatgcgaccgacggggaactggagcccggccttcacggaccgggtcaccgacttcttcctgggcccgccggccttgcgcccggcggcgcccttcttccccttggcgccggtggccgtggcgtccatggcttgcgggagcgggcggtaggtcgggattgggatggagagagccagactgccggagagccgtggtccagcccggccggc

SEQ ID NO: 13689 - DNA, 1527 bp, Triticum aestivum
  Clone ID: PAT_TA_13689
aaatactcccgtgcgtgcctgtcaaaaaaaccagaacccggccagtgaccaagcgaagacgagggaagagagatgccggggctcacggcgccgtcggactacgcggaggagccgccgcgccacccggccctcaggatcaactccaaggagccatttaatgctgagcctcatcgatctgcgttagtttcatcttatatcaccccagtggatttcttctacaagaggaatcatggaccaattcccaaagttgatgatatctcaagatacagtgtttccatcagtggcctcgtgaataagcatatccagctgtccatggatgacattaggatgcttccgaagtacaatgtcactgcaacattacagtgtgcaggcaataagagaactgcaatgagtaaggtgcggaaagtgagaggtgttggatgggacgtatctgctcttggaaatgcaacttggggtggagcaaaactatctgatgtccttgaactagttggaatacataaactcagttcagtcacatctttaggaggcaaacatgttgagtttgtcagtgttgacaggtgtaaagaggagaaaggtggcccctataaggcatcaattccactaaagcaggcaacagatcctgatgctgatgtgttactcgcatatgaaatgaacggagagaccatcaatcgtgaccatggatatccactccgtgtggtcgtacctggtgttataggtgcacgctccgtaaaatggcttgacagcatcaacataatcaaggaagaatgccagggtttttttatgcaaaaagattacaagatgttcccacctaccgtagattgggacaatattaattggtcaactagaagaccacaaatggattttcctgtgcagtctgctatttgcaccctggaagatgtggatgttatcaaggaaggaaaggctagaattgctggatatgcagtctcaggtggcggccgtggcattgagagagtagatatatctgttgtatgggggtaaaacatgggttgaagctcatagatatcagaaaagcaatgtgccatatgtctctgatggagctcaaagcgacaagtgggcatgggttctatttgaggccacattggacataccagcaaatgccgagatagtagctaaggcggtggattcggccgcaaacattcaacccgaaaaagtggaggacatatggaatctgagaggaatcctcaacacatcttggcatcggatcaaaatacagaatacttcgtgcgtatctagatcaaaaatgtgaaggaagtatgttgatgtgcctagaacaagcagcacgccggtccagctgagtccatgatatctccaaataataaagctactgcagcttaatttctgtgattttcgtatagactttgtcatggaactatgttgttttgttaccagcgttacaaataactgcttgtgttggctgatatgatacgaggaaatcgctatgacttgtgctttacgaatgcatgtttgaagtgctttaagaatgtgtcagcattgagcaaaaaaaaa

SEQ ID NO: 13690 - DNA, 1725 bp, Triticum aestivum
  Clone ID: PAT_TA_13690
ctagaccactccagcggagcggagaggagagcagtagcattgagcgccggcggccatggtgatctcgcacgcgagctccagcgccggggaggcggtctactcaaccttctcctcgcgctacgtgcgcgaggagctcccgcggtaccggatgccggaggggtcgatccccaaggaggcggcgtaccagatcatcagcgacgagctgatgctggacgggaaccccgcggctgaacctggcgtccttcgtcaccacctggatggagccagagtgcggcaagctcatcatggactccgtcaacaagaactacgtcgacatggacgagtaccccgtcaccaccgagtctccagaaccgttgtgtaaacatgatagctcacttgttcaatgcgccaatcggcgaggatgagactgctatcggagtctcaacggtggggtcctcggaagcgatattgcttgcaggcctggcgttcaagaggaagtgggcaaacaaaatgaaggagcaggggaagccatgcgacaaacctaacattgttactggtgcaaatgttcaggtttgctgggagaaatttgctagatattttgaagtggaactgaaggaggtcaagttaactgaagggtactatgtcatggatcctaagaaggccattgaaatggtggatgagaacactatatgtgttgcagccatcttgggttctactctcactggagagtacgaagatgtgaagctgttgaatgaccttcttgtggagaagaacaagaaaacagggtggaatgtgccgatccatgtcgatgccgccagtggaggatttatcgctccttttcttcagccggagcttgaatgggacttcaggctgccattggtgaagagcatcaacgttagtgggcacaagtatggccttgtgtaccctggtgttggatgggtcatctggcggagcaaagacgatctgcccgacgaactcattttccacataaactatctgggaacagatcagcccacattcacactgaacttctccaaaggtgctagccagatcattgcacaatactatcaactgatccgcctcggcttcgaggggtacaagcacatcatggagaactgcaagctgaacgcggcggtgctcaaggagggcatcgacgcgacggggcggttcgacgtgctctccaaggcggacggcgtgccgctggtggccatcaggctcaaggacagcaccaacttcagcgtgtttgacatctcggagaacctgaggaggttcgggtggatcgtgccggcctacaccatgcccgcggacgcggagcacgtcgcggtcctccgcatcgtcatccgggaggacttcaaccggagcctcgcgcagcggctcctcgccgacatcaacaagatcgtgcgcgagctggacgcgcacgccgtccacgccatcaagctgtccaacgccgccgccgccgagggcgcctccaagagcaccgtggacgccgtcaccgaggccttcaagggcctggccgggaacaagaaggccggagtctgctgatggccgtgctttgttttaacacgtctgtctatgttgtatcttgattcttgtataattattgtggaggggtgcgtatgtgaactgtcaagagctgcctcctccgtattttgtacgtacgcacgcggattgcactgtcacttgtataattctatctgtttctttttaataaaggggttttccccggctccagttttaaaaaaaaaa

SEQ ID NO: 13691 - DNA, 1528 bp, Triticum aestivum
  Clone ID: PAT_TA_13691
agattttatttacctttgacaactggctaaagtacataatgaaccatacaatccgttattttacaggatcggatcaacgacagattgccagcaaacactaatggcataacgagaaacgacaagacttgacaaacttaggagtgactcgattccttttacaactagtaagtattggccaaggagcatgagagcttatagctaaaacagctgctctaagcaaacaaagtactacagcaagaactggactgaagaacattcccttgcctacattgttccattggccagaggctgttcaccttggagacctgatgcggttatgagtacgaccgggcgtgaacggtactcggtcctccggattttcatgggccgccgggggcgcaccggacaccgcgcgacgtgcggtgctcttccggccactggaccctacctccggctgaaccgtttccagggttggcaggccgttaagcagaaaagataactcttcccgaggcccccgcccggcgtctccggacttcctaacgtcgccgtcaaccgccacatcccggctcgggaaatcttaacccgattccctttcgggggatgcgcgtgatcgcgctatctgccggggttaccccgtcccttaggatcggcttacccatgtgcaagtgccgttcacatggaacctttccctctcttccctctcggcctccctcccctccccttcccgggcacccgcctccctctccctccgcgccgtcgccccacaggcccgcctgtcgacctcctacgccgccttccccatcggtgggtttggagcctcgccgtcgacgggaaggttgaggaggagggggctccaggtggtgtgcgccgccgagccgcccaagactggaagacagccagactcggtgaagaagagggagcgtcagaatgacagacaccgcatccgcaaccatgcccgcaaggccgagatgcgcacccggatgaagaaggttttcagagcccttgaaaagcttaggaagaaagccgatgcccaacctgaagaaatcattgaaatagagaaaatgatctccgaggcatacaaagccatcgacaagacagtgaaggttggcgccatgcacaggaatactggagatcatcgcaagtccaggcttgcaaggaggaagaaggccattgagataatccgtggttggtatgttccgaatgctgaacctgctgcagctgcctagtttctgggggagtcatcatcgtaaattgcagcagtttttctttcatcacatcttgccaattttgggcagcatatgttattgaacgagctcaatagactgccaggtcttccccatggcaagtgttctggtactggctactgtgtttatgtgcttgctatgctctggcacagaattgggccattgcttgtcttacattccctctgttgtaaaacttcaaactgaatatacctcttgtatggtgtatgcagatatcttcggctagagatagtatgttcagtatatatactttctctcattaccttcttccattgtgaaaaaaaaaa

SEQ ID NO: 13692 - DNA, 949 bp, Triticum aestivum
  Clone ID: PAT_TA_13692
gcagctcgaactcctcccatcctggtctccagccatggccaccgccacctccccgctcctctccctctcttccctctcggcctccctcccctccccttcccgggcacccgcctccctctccctccgcgccctcgccccacaggcccgcctgtcgacctcctacgccgccttccccatcggtgggttcggagcctcggcgtcgaccggaaggtttaggaggagggggctgcaggtggtgtgcgccgccgagccgcccaagactggaaggcaggcggactcggtcaagaagagggagcgtcagaatgacagacaccgcattcgcaaccatgcacgcaaggccgagatgcgcacccggatgaagaaggttttcagagcccttgaaaagcttaggaagaaagccgatgcccaacctgaagaaatcattgaaatagagaaaatgatctccgaggcatacaaagccatcgacaagacagtgaaggttggcgccatgcacaggaatactggagatcatcgcaagtccaggcttgcaaggaggaagaaggccattgagataatccgtggttggtatgttccgaatgctgaacctgctgcagctgcctagtttctgggggagtcatcatcgtaaattgcagcagtttttctttcatcacatcttgccaattttgggcagcatatgttattgaacgagctcaatagactgccaggtcttccccatggcaagtgttctggactggctactgtgtttatgtgcttgctatgctctggcacagaattgggccattgcttgtcttacattccctctgttgtaaaacttcaaactgaatatacctcttgtatggtgtatgcagatatcttcggctagagataatatgttcagtataaatactttctctcattccttcttccattgtgaaatggatatgcatctctcaaaaaaaaaaaaaaaaaa

SEQ ID NO: 13693 - DNA, 705 bp, Triticum aestivum
  unsure (1)..(705): unsure at all n locations
  Clone ID: PAT_TA_13693
ggaaagcaaatccgcctgtccttttattccataataataacnacaacacggggcagtacaaatcatccatcccctgacgcagacatcgatcaagaattcaagatcgagagagcagaccggtcgaccatggcgaggtctggtggccggtgggtcgttgcggcggcgatagtggtgctgctgctgaccacggtgtcatcagcatcagcagcagcaggtgtcgattcagcaacgacggcaccggccaaggtgtggcagctccctccaaggatccctacagagcccttcccggtgccaaagcccccttcttcgtcgtcgtggaaggcggtgaagtcgtctcttcctcctcgccaccgcctccctacggaaccgccgtcggaaaagcgtacgtaagatgataatacctactccaactagtaatacatggagggaagtagcaaagtatgcagctgcacaagaatctgcatgcatggtgctgcccttgatatgttgatctatccgtgtgagtgtgggttcacgtggtcgttctgttgcaagctatgtgctgatgtgtgcttatggtgtgcttgttcgaaagacgtactggtcagtgtaaggatgtactgtactgcgccgtgttgtgcttattattatggaataaaaggacaggcggatctgctttcctacgctgggctttgttaatcaataaaaaaaaaaaaaaaaaaaaaa

SEQ ID NO: 13694 - DNA, 1834 bp, Triticum aestivum
  Clone ID: PAT_TA_13694
cccctccctcctcctgaccgcccacccacctaccagccaccgaggcggccgatcccccctccccagccgcgccgcgccaccgccaccgccgccgccaccgccgccgccggcagccgttcgtctcgagattgacctttggtgactgttagaaaccacaggcggtgaagatggcgcagcccgctaagctttcccgtgaggagaatgtgtacatggctaagcttgcagagcaggctgagaggtacgaagagatggtcgagttcatggagaaggtggccaagacagttgactccgaggagctcaccgtcgaggagcgcaaccttctgtcagttgcttacaagcaatgttattggtgcccgccgtgcctcgtggcgcatcatttcctccatcgagcagaaggaagagagccgtggcaacgaggaccgtgtcacactcatcaaggactaccgtggaaaagattgagggttgagctcactaagatctgtgatggtatcctcaagcttcttgattcccaccttggtcccctcatccaccgctccagagtccaaggtcttctacctgaagatgaagggtgattactataggtaccttgcagagttcaagagtggaactgagaggaaggatgctgctgagaacaccatggtgggcatacaaagctgctcaggagattgcactgaaagagctgcccccgactcatcctattaggcttggggctggcactcaacttctcggtgttctattatgagatcctcaactctccagaccgtgcttgtgacctcgccaagcaggcttttgatgaggctatctcagaactggactctctgagcgaggagtcgtacaaggacagcacttttatcatgcagcttctgcgtgataacctgacgctgtggacttcggacatctcggaggacgctgctgaagaaatgaaggatgctcccaagggtgaatctggagatggacagtaaacactgtctatgtgcccagaaacttgtctttctcgcttgttcagtgtagattgtaatgtcgtcgtggttgctggtaattggaggctccaatttgtgttgtgatagggaagcttgtagctgccttgcttgctcggcggcctgattatcgggctgcactggttattgcctcttgttgaacctttgtgttacttttggtggttttagaaattttctgctgctcttgtttgtgaccccctgcctttgtattcactagatgaccagttgcgccaatggcgcaaaggccgagagcaagccatgtattgaaagagtgtacattaatattattcgggcgtgaacaaactacagaattatatgtatgtatacaatcaggacaacaccatatctgtagcaataaaatggcaacaccatatctgtagccatatatgtatgtagtcttataggaccttgttcaaccaaccggactgatgacaaccaactatgagctgggacaaccggtgtaatatatgtatgtagtcttataggaccttgttcaaccaactacaacctatcataggtgtagtcctgtaggaccttgttgtaaaaggctctcaagtatttaagagcttcatgtgccagtcgagccttcttcaagttttccatagacagatggatattgatttctttggaagtaccgaaggaatttgatgagcttgcttgcgctttcaatctttcaacaatttatacgtcgactagccctatcctggaaagatgattccgccttcgacggcaaggatgtcatagtctgacacgcaaatcctgagatacgcaaccacctgtactttttaatctcatgcggcaactccgccagtagcacattatcagaatcaggcagc

SEQ ID NO: 13695 - DNA, 908 bp, Triticum aestivum
  Clone ID: PAT_TA_13695
cgcctcctcccttcttcagccgaagcgcccgcacgcctcgacccaagggatctcaatggcgccgacctccaagatggcgctgggcatcaagcgcgcgtcgcggtcgcacacctaccaccgccgcgggctgtgggccatcaaggccaagcacggcggagccttccccaaggccgagaagccagccgccgtcgccgagcccaagttctaccccgccgacgacgtcaagccccgcaccgccagcacccgcaagcctaagcccaccaagctcaggtcgaccatcacgcccggtacggtgctgatcctgctcgctgggaggtacatggggaagcgcgtggtgttcctcaagcagctcaagtctggcctgctcctcatctctgggcctttcaagatcaatggtgtgccagttcgccgggtgaaccaggcttatgtcattgccacatccacaaaggttgacatctctggtgttaacgtggagaagtttgatgacaagtacttcgccagggacaagaagaccagggcaaagaagactgaaggggagctgtttgagactgagaaggagaccaccaagaatctgccagaatttaaaaaagatgatcagaaggccatcgatgctgagttgatcaaagctattgaggctgtccctgaccttaagaactatcttggtgctcggttctctctcagggatggtgacaagccccatgagatgaccttctaagttgctacaagttcctgagttttggatgtgttttgcctagattgttgctgaaatttgtaccctgttagttgacttcctatgtcagttgaagtgaccgtaagatattatgagaagatcaagagaatccttatctgctttggtggttctttttttacttatgcttaatggaacagtttgtcgtgtgttatttgtg

SEQ ID NO: 13696 - DNA, 969 bp, Triticum aestivum
  Clone ID: PAT_TA_13696
tttttttgggcgtatcaagatgcaaccttgagtattcaaactcccaaactacaagagcaagaacaaattaacaagtcagcttcaatttcaacaatgtggacacttgttaacttctcctacacaagggtaatgtggtggaggagcatagaaagttctatcagatacagatcagtcagaaggtgccccagggcgaagggaaccaaccaacgcgggtgtacaaccaaccaaatagctcgagcactagtcattcagatactcccttccagcgcaaacatctccagtttgttcttaccaacaaaatggcacttgattgctgggctaaagtatgatgggttattacatcaagagcggcatggggttgtcatgcaccactggcatacagacgagtccactccttcgctgtttcaacagcttctgcctcattggacttccagtgcttagcaatgttttcagagagagggtcatctggatttggtgcacttaggagtgcctggatactcaaaagaactgttcgaatctgaagagccggactccatttatccttgagaatgtcaaggcatatcctaccaagcttgtcaatgttgggatggtatattttggtcagaaacctaacctttggggcagccatcggatactcctccaggtaaaaagagttccagcttaaaaactccccccttcgtagggcggactgcgccggaccaaggatcatgacgttgaagtagcgcatgttctcctccgagggcgacgcgcttgatccccggtgctggctcgctgaggagtctctgcgtctccttgatgattcgtcgcggaaggttgctgttggccatcggatcgagccggggcgggagcttcctcctctccgatgagtgcggcgccggcgatgccttgaggccttgagggcttgaggctggtgcgggggagggggagcagtcggtcggggtggggaacgggaaagcggtgcggcacgag

SEQ ID NO: 13697 - DNA, 1543 bp, Triticum aestivum
  Clone ID: PAT_TA_13697
cgaattcggcacgaggctccctcctcctgaccacccacccacctaccagccaccaaggcggccgatctcccctccccagccgcgccaccgccgacgccgcagctccggcagccgttcgtctcgagattgatctttggtgactgttagaagccacagacactgaagatggcgcagcctgctgagctttcccgcgaggagaatgtgtacatggccaagcttgcagagcaggctgagaggtacgaggagatggttgagttcatggagaaggtggccaagacagttgactccgaggagctcacagtcgaggagcgcaaccttctatcagttgcttacaagaatgttattggtgcccgccgtgcctcgtggcgcatcatttcctccattgagcagaaggaagagagccgtggcaatgaggaccgtgtcacactcatcaaggactaccgtggaaagattgaggttgagctcaccaagatctgtgatggtatcctcaagcttcttgattcccaccttgtcccctcatctactgctccagagtccaaggtcttctacctgaagatgaagggtgattactacaggtaccttgcggagttcaagagtggaactgagaggaaggatgctgctgagaacaccatggtcgcatacaaagctgctcaggagattgcacttgcagagctgcccccgactcatcctattaggcttgggctggcactcaacttctcagtgttctattatgagatcctcaactcgcctgaccgtgcttgcgaccttgccaagcaggcttttgatgaggccatctcggaactggactctctgagcgaggagtcgtacaaggacagcactttgatcatgcagcttctgcgtgataacctgacgctgtggacttctgacatctcggaggacgccgctgaagaaatgaaggatgctcccaagggtgaatctggagatggacagtaaacactgtctatgtgttcagaaacttgtctttctcgcttgttcagtgtagattgtaatgtcatcgtggttgctggtaattggaggctccaatttgtgttgtgatagggaagcttgtagctgccttgcttgctcgacagcctgattatcgggctgcactggttattgcctcttgttgaacctttgtgttactttggtggttttaaaatttttctgctgctcttgtttgtggccccttgtcttcgtattcatctgtgtttcttctttccggacgggtgtctctgaacccttccactttgccaagtcttattcccatgttatgggagtttcgacattcacggtgctcctaaagcacatttgggagtattatttacctggttatatgactggaccgaaggcatctgagatggagacgaaagcaacaaatttgcaactagcttgcgttatgttaaccatatgggtttctacaggtggtatgcagaaatcttatgatgcggcgaacatcatgagttgtaaaaaggcttccatagcgacgacagtgccggttcacaagtatttctgcttgtactcacatgtatgctgctgttttctc

SEQ ID NO: 13698 - DNA, 1534 bp, Triticum aestivum
  Clone ID: PAT_TA_13698
gccggccgggttcggacaaccgatcccgaccggcgacctcgcttccaccggatcaaccagctagggtttcgtcttcgtcgtcttctccgcggagcttggagttttcggcgagatgttcgggcgcgggccgccgaagaagagcgacagcacgcgctactacgagatcctgggcgtgcccaaggacgcgtcccaggacgacctcaagaaggcctaccgcaaggccgccatcaagaaccaccccgacaagggaggcgacccagagaagttcaaggagctagctcaggcttatgaggttctgagtgatcctgagaagcgagagatctatgaccagtatggtgaggatgccctcaaggagggaatgggaggtggaggaatgcatgatccttttgacatcttccagtcattctttggtggtggcggcaaccccttcggaggtggcgggagcagtaggggcaggcggcagcgcaggggtgaggatgtggttcatcctctgaaggttagccttgaggaactgtacaacggaacatcaaagaagctctctcttgcccgcaatgtgctctgctcgaagtgcaatggcaaggggtcaaagtccggggcttcgatgaagtgtgccggctgccaaggtgctggttacaaggtgcagataaggcagctgggaccaggaatgattcagcaaatgcagcagccttgcaatgagtgcaggggaagtggggagaccatcagcgacaaggatcgctgtgggcagtgcaaaggcgagaaggtggtgcacgagaagaaagtcctggaggtggtggtcgagaagggaatgcagcatgggcagaagatcaccttccccggcgaggcggatgaagcgcctgatactgttactggagacataatcttcgtcctccagcagaaggagcaccccaaattcaagcggaagggcgatgacctcttctacgagcacaccctgaccctgaccgaggcactgtgtggcttccagtatgtcctggctcatttggacggcaggcagctgctcatcaagtccaaccctggcgaagtcgtcaagcctgattcgttcaaggcgatcaacgacgagggcatgcccatgtaccagaggccgttcatgaagggcaagctgtacatccacttcacggttgattttcccgactcgctgagcctggaccagtgcaaggcgctcgagactgtcctgccgcccaagccggcgtcgcagtacacggacatggagctggacgagtgcgaggagacgatggcctacgacattgacatcgaggaggagatgcggaggcgacagcagcagcaggcacaggaggcctacgacgaggacgaggacatgcccggtggcggcggccagcgggtgcagtgcgcccagcagtaggcaggcaggatgttgtgatcgtcagtcagcagatgaattcgtttctgttgttctcaagttttccatgttatggttcttacccttttggtgctagtatatgatgtaactacttcactgaacaataccgggtcgtccaggaaaattaaaaaaaaaaaa

SEQ ID NO: 13699 - DNA, 2558 bp, Triticum aestivum
  Clone ID: PAT_TA_13699
cggacgcgtgggcacatcgcggctgcggcgacgaggaaaaatacactgcagataagagagggaggggcgagcgagagaggcagggagaggcggcgcgccgagcaggccagcccacaccccgcccgcggccatggccggcgccgacctcaaccggagcttcattaaggacgtgaagcgcatcatcatcaaggtgggcactgcagttatcaccagaaatgatggaagactggctttgggcaggattggagccctgtgcgagcaggtgaaagatcttaatgctcaaggatatgaggtgattatggtcacctcaggcgctgttggtgtggggcgacagcggctcaggtaccggaagcttgtcaatagcagctttgctgatctgcaaaagccgcagatggagctggatgggaaggcatgcgctgctgttggtcagagtggtctgatggcactctatgacatgttgtttacccaacttgatgtgtcatcatcacaacttcctcgtgacagatagtgacttcgacaattcaaatttccgggagcgacttcgcgaaactgtcgagtcattattagagcttagagttattccaatatttaatgaaaatgatgccatcagtacgaggaaggctccatacgaggattcatctggtatattctgggataatgacagtttggcaggtctactggcattggaactgaaagctgatctccttgttctgcttagtgatgtggatggcctctacagcggtccaccaagtgaaccttcatcgaagttaatacatacttatatcaaggaaaaacattatcatgaaattacttttggagacaagtcccgtgttgggtagaggtggcatgacagctaaagtccaagctgctgtgtgggcttcaacgggtggtgtacctgttgttattacaagtggatgtgcatctcatagccttgttaaagttctccgtggggaaaaaattggtactctttttcataaaaatgcaagtttgcagggaaccatccaaggacaccagtgtccgtgaaatggctgttgctgcacgggattgttcaaggcgtctacagaatttgtcatcagaggagcgcaagaaaatattgttagatgttgcggatgctttagaggcaaatgaggatttaattagatccgagaatgaagcagatttagcagcagcacatgaggctgggtatgagagtgctttggtttctagattgactctgaaaccaggaagatagctagccttgccaaatctgttcggactcttgcgaatatggaagaccctattaacgagcatactgtaaaaggacagaggttgctgatggtttagttcttgagaaaacatcttgccctttgggtgttctattgattatttttgagtcccgacctgatgccttagtccagattgcgtctttagccattcgaagtggtaatggtcttctcctaaaaggtggaaaagaagcaatgagatcaaacgcaatattgcataaggttataaccaatgctattcctaacaatgttggcgaaaaattgattggccttattacaactagagatgaaattgcggatttgctaaagcatgatgatgtcattgatcttgtcattccaagagggagtaataagcttgttgctcaaatcaaatcatcaacaaagattcctgttcttggccatgctgatggtgtttgtcatgtatatattgacaaatcagcagacatggatatggcaaaacgtattgtgatggatgcaaaaattgattacccagctgcctgcaacgcaatggagacgttgcttgttcataaagatcttatgaagactccagaactcaatgacatactagtagcactcaagacagcaggagttaatctttattgtgggcctgttgcgcataaagtattgggctacccaaaagcagattcattacatctggagtacagttctatggcttgcacagttgagatagttgatgatgtacaatcagcaattgaccatatacatcgctatggaagtgcacatacagactgtgtggtcactacagatgataaagtagcagagacctttctacgtcaagttgatagtgctgccgtattatacaacgcgagtacaagattctccgatggtgctcgttttggactcggtgctgaggttggcataagtacaggccgtatacatgcacgtggacctgtgggtgttgaaggtcttttaactacacgatggctcttacgagggaaagggcaagtggtgaatggtgacaaggatgttgagtacacccataagagccttcctttgcaatgagaaaatggcgtggtaaggattccgcgaaaaccctctgaagtatgagtctcatcagactaaggaaagaaacccggtggatcaattaaattgtgtacaaaccatcttattgtggcggatcggtggatcaatttgtatgagcttggaggcttcggctctccggtgttataataaaaacaaatcagcaattctaggagtgagagtactagtgtgccgatactataagcagtatgtttcttgggcccggtaatccagcagcattggcaattgctcgtt

SEQ ID NO: 13700 - DNA, 1207 bp, Triticum aestivum
  Clone ID: PAT_TA_13700
gaccacacacacaccattattttcctctccctcctcctgaccacccacccacctaccagccaccaaggcggccgatctgccctcaccgccaccgctaccgccgacgccgcagctccggcagccgttcgtctcgagattgacctttggtgactgttagaagcaacagacactgaagatggcgcagcctgctgagctttcccgcgaggagaatgtgtacatggccaagcttgcagagcaggctgagaggtacgaagagatggttgagttcatggagaaggtggccaagacagtcgactccgaggagctcaccgtcgaggagcgcaaccttctatcggttgcttacaagaatgttattggtgcccgccgtgcctcgtggcgcatcatttcctccatcgagcagaaggaagagagccgtggcaatgaggaccgtgtcacactcatcaaggactaccgtggaaagattgaggttgagctcactaagatctgtgatggtatcctcaagcttcttgattcccaccttgtcccctcatccactgctccagagtccaaggtcttctacctaaagatgaagggtgattactacaggtaccttgcggagttcaagagtggaactgagaggaaggatgctgctgagaacaccatggtggcatacaaagctgctcaggagattgcactgaaagagctgcccccgactcatcctattaggcttgggctggcactcaacttctcggtgttctattatgagatcctcaactctccagaccgtgcttgtgacctcgccaagcaggcttttgatgaggccatctcggaactggactctctgagcgaggagtcctacaaggacagcactttgatcatgcagcttctgcgtgataacctgacgctgtggacttctgacatctcggaggacgctgctgaagaaatgaaggatgctcccaagggtgaatctggagatggacagtaaacactgtctatgtgcccagaaacttgtctttctcgcttgttcagtgtagattgtaatgtcatcgtggttgctggtaattggaggctccaatttgtgttgtgatagggaagcttgtagctgccttgcttgctcgacggcctgatcatcgggctgcactggttattgcctcttgttgaacctttgtgttactttggtggttttagaaattttctgctgctcttgtttgtgaccaaaaaaaaaaaa

SEQ ID NO: 13701 - DNA, 1642 bp, Triticum aestivum
  unsure (1)..(1642): unsure at all n locations
  Clone ID: PAT_TA_13701
cccacgcgtccgcgaccggcgacatcgcttccaccggatcaagcagctagggtttcgtcttctccgcggagcttggaattttcggcgagatgttcgggcgcgggccgccgaagaagagcgacagcacgcgctactacgagatcctgggcgtgcccaaggacgcgtcccaggacgacctcaagaaggcctaccgcaaggccgccatcaagaaccaccccgacaagggcggcgacccagagaagttcaaggagctagctcaggcttatgaggtcctgagtgatcctgagaagcgggagatctatgatcaatatggtgaggatgccctcaaggagggaatgggaggtggagggatgcatgatccgttcgacatcttccagtcattctttggtggtggtggcaacccctttggaggtggagggagcagcaggggcaggcggcagcgcaggggtggaggatgtggtccatcctctgaaggttagccttgaggagttgtacaatggaacatcaaagaagctatctcttgcccgcaacgtgctctgctcgaagtgcaatggcaagggttcaaagtctggggcttccatgaagtgtgccggctgccaaggtgctggttacaaggtgcagataaggcagctgggaccaggaatgattcagcaaatgcagcagccttgcaacgagtgcaggggaagtggggagaccatcagcgataaggatcgctgcgggcagtgcaaaggtgagaaggtggtgcacgagaagaaagtcctggaggtggttgtcgagaagggaatgcagcatggacagaagatcaccttcccgggcgaggcggatgaagcgcctgataccgttactggagacataatcttcgtcctccagcagaaggagcaccccaaattcaagcggaagggcgatgacctcttctacgagcacaccctgaccctgaccgaggccctgtgtggcttccaatatgtcctggctcatttggacggcaggcagctgctcatcaagtccaaccctggcgaagtggtcaagcctgattcattcaaggcgatcaacgacgagggcatgcccatgtaccagaggcccttcatgaagggcaagctgtacatccacttcacggtggatttccccgactcgctgagcctggaccagtgcaaggcgctcgagactgtcctcccgcccaagccggcgtcgcagtacacggacatggagctggacgagtgcgaggagacgatggcctatgacattgacatcgaggaggagatgcggaggcggcagcagcagcaggcacaggaggcctacgacgaggacgaggacatgcccggtggcggcggccagcgggtgcagtgcgcccagcagtaggcaggcaggatgttgtgtttgtcagtcaagcagatgaattcgtttctgttctcaagttttccatgttagggttcttacccttttggtgctaagtatatgatataactacttcactgaacaataccgggtcgtccaggaaaattatttgccttcttgttttgcttgctgtggcatgtttacccggagtggttggctgctngatgagccagagttgcccatggcatgttttgttggctgctgatgagcagagctgacagcatgtttgtttcaaaaaaaaaaaaaaaaa

SEQ ID NO: 13702 - DNA, 753 bp, Triticum aestivum
  Clone ID: PAT_TA_13702
gccggccggtccgggaaaactcagcgtctcattttcaccctcccgcccgccgccgccgccgctcccgccgctagaccagctcgccagcagcaatggcccggatcaaggtgcacgagctgagggggaagaacaaggcggatctgcagggccagctcaaggacctcaaggcggagctctccctcctccgcgtcgccaaggtcaccggcggcgcccccaacaagctgtcgaagatcaaggtggtgcgcacctcgattgcgagggtgctcacggtgatctcgcagaagcagaagtcggcgctgagggaggcgtacaagaacaagcagctcccgctcgacctccgccccaagaagacccgcgccatccgcaggcgtctcacaaagcaccagctctccttgaagaccgagagggagaagaagcgtgagaagtacttccccatcaggaagtatgctatcaaggcctaggttaggagtgaatgatttgccggccgagttttgcccagaagttgcatgaattttatgttctgtgtggacaccgctgctatctaagtacaatgtattcgatatcctgcatgaaattcgaacttttgcttgttaacactattatctatagctgcttgttggtgctgcagtgtgatggttattgtactttgttagtttccagttcatctgattgtgctagtggctgctagttgatgttctagtgtgatggttatcgtgccttgttagtttgcagttccaaaaaaaaaaaaaaaaa

SEQ ID NO: 13703 - DNA, 1027 bp, Triticum aestivum
  Clone ID: PAT_TA_13703
tagaactagtggatcccccgggctgcaggaattcggcaccagcccctctcgccgaattgccgctccgcgtccaccgaaggatcaccaatggctccgacgtcgaagatggcgctcggcataaagcgggcgtcgagatcgcacacctaccaccgccgcgggctttgggccatcaaggccaagcacggcggcgccttccccaaggccgagaagccggccgccgtcgccgagcccaagttctatcccgctgatgatgtcaagccacgcaccgtcagcacacgcaagccccatcccaccaagctcagatcgaccatcacaccgggcacggtgctgatcctgctcgcggggaggtacattggaaagcgcgtgctgttcctcaagcagctcaagtccggccttctcctcatcactggacctttcaagatcaatggcgtgccaatccgcagagtgagccaggcttacgtcattgccacatccacaaaggtcgacatctctaaggttaatgtgcagaagtttgatgacaagtactttgctagggagaagaagactagggcaaagaagactgagggcgagctatttgagtcggagaaggaggcaaccaagaatttgcccgacttcaagaaggatgatcagaaggccattgatgccgagttgatgaaggctatcgatgctgtcccagaccttaaaaattatcttggtgcccggttctccctcagggatggtgacaagccgcatgagatgaccttctaagttacctggtacaagtttcaagatctgtggaagtcttttttgtctagtgtgtgtgctggttctgtacttctgatttcttttgcccggttggtgaatctttgatttccactgaagtctgcctgtcaaatattttgagaagattactagaagtaccatcccctttattggcccgttgcgacattttcttgatccgtcattgtattattcaggctgcaattctgagtaaatgttttatcttcaaaaaaaaaaaaaaaaaaactcgagactagtgctctctctc

SEQ ID NO: 13704 - DNA, 1546 bp, Triticum aestivum
  unsure (1)..(1546): unsure at all n locations
  Clone ID: PAT_TA_13704
gccacgcgtccgccgaccggcgacctcgcttccaccggatcaaccagctagggtttcgtcttcgtcctctccgcggagcttgggattttcggcgcgatgttcgggcgcgggccgccgaagaagagcgacagcacgcgctattacgagatcctgggcgtgcccaaggacgcctcccaggacgacctcaagaaggcctaccgcaaggccgccatcaagaaccaccccgacaagggcggcgaccccgagaagttcaaggagctagctcaggcttatgaggtcctgagtgatcctgagaagagagaaatttatgaccagtatggtgaggatgccctcaaggagggaatgggaggtggaggaatgcatgatcctttcgacatcttccagtcattctttggtggtggcggcaacccctttggaggtggcgggagcagtaggggcaggaggcagcgcaggggtgaggatgtggttcatcctctcaaggttagccttgaggagttgtacaatggaacatcaaagaagctctctcttgcccgcaatgtgctctgctccaagtgcaatggcaagggttcaaagtctggggcttccatgaagtgtgccggctgccaaggtgctggttacaaggtgcagataaggcagctgggaccaggaatgattcagcaaatgcagcagccttgcaacgagtgcaggggaagtggggagaccatcagcgataaggatcgctgtgggcagtgcaaaggtgagaaggtggtgcacgagaagaaagtcctggaggtggtggttgagaagggaatgcagcatggacagaagatcaccttccccggcgaggcggatgaagcgcctgataccgttactggagacataatcttcgtcctccagcagaaggagcaccccaaattcaagcggaagggtgatgacctcttctacgagcacaccctgaccctgactgaggccctgtgtggcttccagtatgtcctggctcatttggacggcaggcagctgctcatcaagtccaaccctggcgaagtggtcaagcctgattcattcaaggcgatcaacgatgagggcatgcccatgtaccagaggccgttcatgaagggcaagctgtacatccacttcacggtggatttccccgactcgctgaacctggaccagtgcaaggcgctcgagactgtcctcccgcccaagccggcgtcgcagtacacggacatggagctggacgagtgcgaggagacgatggcctatgacatcgacattgaggaggagatgcggaggcggcaacagcagcaggcacaggaggcctacgacgaggatgaggacatgcccggcggcggcggccagcgggtgcagtgcgcacagcagtaggcaggcatgatgtttgtgattgtcagtcagcagaagaattcgtttctggttgttctcaagttttccatgttagggttcttacccttttggtgctagtatatgatataactactttactgaacgataccgggtcgtccagggaaaaaaaaaaaaaaaaaaaaaaancctcggccgcgaccacgct

SEQ ID NO: 13705 - DNA, 676 bp, Triticum aestivum
  Clone ID: PAT_TA_13705
gccggccgggtcgggctcagcgtctcattttcatccccccgcccgccgccgccgccgccgctagaccagctcgccagcagcaatggcccggatcaaggtgcacgagctgagggggaagaacaaggcggatctgcagggccagctcaaggacctcaaggcggagctgtccctcctccgcgtcgccaaggtcaccggcggcgcccccaataagctctccaagatcaaggtggtgcgcacctcaattgcgagggtgctcacggtgatctcgcagaagcagaaggcggcgttgagggaggcgtacaagaacaagcgtctcccgctcgacctgcgccccaagaagacccgcgccatccgcaggcgtctcaccaagcaccagctctctttgaagacggagagggagaagaagcgcgagaagtacttccccatgaggaagtatgctatcaaggcctaggttaggaggacatgttttaccggccgagttttgctcagaagttgcatgaattttatgttctgtgtggacaccgctgctatctaagtactatgtattcgatatcctgcatgaaattcgaacttatggttattgacactatgatctatagctgcttgtttgtgttgcaatgtgttggttattgtatgttgttaagtttccagttaacttgtttgtggaaaaaaaaaa

SEQ ID NO: 13706 - DNA, 1092 bp, Triticum aestivum
  Clone ID: PAT_TA_13706
cggacgcgtgggcggacgcgtgggcggacgcgtgggtgccccctctcgccggattgccgctccgcgtccaccgaagaatcaccaatggctccgacgtcgaagatggcgctcggcataaagcgggcgtcgagatcgcacacctaccaccgccgcgggctttgggccatcaaggccaagcacggcggcgccttgcccaaggccgagaagccggccgccgtcgccgagcccaagttctatcccgctgatgatgtcaagccacgcaccgtgagcacacgcaagccccatcccaccaagctcagatcgaccatcacaccgggcacggtgctgatcctgctcgcggggaggtacatgggaaagcgcgtggtgttcctcaagcagctccagtccggccttctcctcatcactggacctttcaagatcaatggcgtgccaatccgcaagagtgaaccaagacttacgtcattgccacatccacaaaggtcgacatctctaaggttaatgtgcagaagtttgatgacaagtactttgctagggagaagaagactagggcaaagaagactgagggcgagctatttgagtcggagaaggaggcaaccaagaatttgccagacttcaagaaggatgaccagaaggtcattgatgccgagttgatcaaggctatcgttgctgtcccagaccttaaaaattatcttgggtgcccggttctctctcagggatggcgacaagccgcatgagatgaccttctaagttacctggtgttgtggtatgtatttgcaactaggtcaacattactacggtggtccttatttgccagagcttggacagtgttgtgatttcgttggggcatgtcagtagtcttcaacaatccgttcccctaaaagtgctccagcagatcttgtaaacgtgggtaatttctggtttagggaaagttgggccaaaaaagagctccaacagatcttgtaatcttggtactagtatcaacagccacacttattctggcagagtgcgtacaatctgatactccctcttatgtgaaatatgttttgtggtttaagttcttctttgaactaaaaccgcaacacttatgttggc

SEQ ID NO: 13707 - DNA, 937 bp, Triticum aestivum
  Clone ID: PAT_TA_13707
gtcgacccacgcgtccgctcccttcttcagccgaagcgcccgcacgccccaacccaagggatcccaatggcgccgacctccaagatggccctgggcatcaagcgcgcgtcgcggtcgcacacctaccaccgccgcgggctgtgggccatcaaggccaagcacggcggagccttccccaaggccgagaagccagccgccgtcgccgagcccaagttctaccccgccgacgacgtcaagccccgcaccgccagcacccgcaagcctaagcccaccaagctcaggtcgaccatcacgcccggtacggtgctgatcctgctcgctgggaggtacatggggaagcgcgtggtgttcctcaagcagctcaagtctggcctgctcctcatctctggacctttcaagatcaatggtgtgccagttcgccgggtgaaccaggcttatgtcattgccacatccacaaaggttgacatctctggtgttaatgtggagaagttcgatgacaagtacttcgccagggacaagaagactagggcaaagaagactgaaggggagctgttcgagactgagaaggagactaccaagaatctgccagagttcaaaaaagacgaccagaaggccatcgatgctgagttgatcaaagctattgaggctgtccctgaccttaagaactatcttggtgcccggttctctctcagggatggtgacaagccccatgagatgaccttctaagttgctacaagttcctgagttttggatgtgttttgcctagattgttgctgaaatttgtaccctgttagttgacttcctatgtcagttgaagtgaccataagatattatgagaagatcaagagaatccttatctgctttggtggttctttttttacttatgcttaatggaacagtttgtcttgcgtcaaaaaaaaagtcgacgcggccgcga

SEQ ID NO: 13708 - DNA, 885 bp, Triticum aestivum
  unsure (1)..(885): unsure at all n locations
  Clone ID: PAT_TA_13708
gccggccgggttgggctcctcagcgtctcattttcatcccctcgcccgccgccgccgccgctcccgccgctagaccagctcgccagcagcaatggcccggatcaaggtgcacgagctgagggggaagaacaaggcggagctgcagggccagctcaaggacctcaaggcggagctctccctcctccgcgtcgccaaggtcaccggcggcgcccccaacaagctctccaagatcaaggtggtgcgcacctcgattgcgagggtgctcacggtgatctcgcagaagcagaagtcggcgctgagggaggcgtacaagaacaagcgtctcccgctcgacctccgccccaagaagacccgcgccatccgcaggcgtctcaccaagcaccagctctctttgaagacggagagggagaagaagcgcgagaagtacttccccatgaggaagtatgctatcaaggcctaggttaggagcacatgttttaccggccgagttttgctcagaagttgcatgaattttatgttctgtgtggacaccgctgctatctaagtactatgtattcgatatcctgcatgaaattcgaacttatgcttattgacactatgatctacagctgcttgtttgcaagagcaccctncgctcacaggaaatccggagactccactttctcacgctgctcccccgccgtagccgncatggccgacccgctcgtactgctcgttctcgtcggtggcggcgcatccttcaccgtatccttcccagtcggcgggcgggcgtnccttgcaacaccctcttcnatnttctncccactcggccaacgcttatccccagaaacgaccccggaccaacgggttccccctttaacacgaacggtcggtacccgttttccg

SEQ ID NO: 13709 - DNA, 1711 bp, Triticum aestivum
  Clone ID: PAT_TA_13709
gcacgaggctctctctctcactcgctccgcccggccgcccgactttgaccgcctcctcgtctccgctcccacgcccgcgggagagaggcgaccggcggcggcgcgcgaggaggggcctacccacccatcccaccaccccgccggcgaagatgttcggccgcgcccccaagaagagcgacaacaccaagtactacgaggtgctcggggtgcccaagaacgccgcccaggacgacctcaagaaggcctaccgcaaggccgccatcaagaaccaccccgacaagggcggagaccccgagaagttcaaggagctggcacaagcctatgaggttttgagtgaccctgagaagcgtgagatctatgatcagtatggcgaagatgctctcaaggaaggaatgggtggaggaggaggtggtggagttgatccatttgacatcttctcatcatttttcgggccctcttttggaggtggtggtggcggcagcagcaggggcagaaggcaaaggaggggagaggatgttgtccatccacttaaagcttctctagaagatctttacaatggtacctcgaagaagctctctctttcccgtagtgtcctctgctccaagtgcaagggcaagggatccaagtctggtgcttccatgaggtgcccaggttgccaggggtcaggcatgaaagtcactattcgtcagctggggccttccatgatacagcagatgcagcaggcctgcaatgattgcaagggcaccggggagagtattaacgacaaggatcgctgcccaggctgcaagggtgagaaggttcttcaggagaagaaagttctggaggttcacgttgagaaggggatgcaacacaaccagaagatcaccttccctggtgaagctgatgaggcgcctgacactgttactggagacattgtatttgtcgtccagcagaaggaacacccgaagttcaagagaaagggcgatgatctcttctatgagcataccatatctctcactgaagctctttgtgggttccaactcgtcctgacccatctggacaacaggcagctgctcattaaatcaaaccctggtgaagttgtcaagcctgattcattcaaggcaatcagcgacgaggggatgccgatgtaccagaggcctttcatgaagggcaagctctacattcatttcacggtggagtttcccgactcgctggcaccggatcagtgcaaggctctcgaggctgtgcttccaccaaagcctgcatccaagctgaccgacatggagctcgatgaatgcgaggagacgacaatgcatgacgtcaacatggaggaggagatgcgtcggaaagcccatgctgctgctcaggaggcgtacgatgaggacgacgagatgcctggaggcggtgcccaaagagtgcagtgcgcacaacagtaagataggttgggcagcaagcttttttgggacccaagatcaagatgcctgcccgctctttggggttttggcggtgttatcgatgaagctgatttttgcccgtatggcgccggggctgtatccatgtcttttgaaaaatgctacgtggctactcttaatgtagtgtgatactcgtataaaagcaatctgtttgtgaaaactaacgcacgctgtctgtctgtctctctgaatacgttgtctaagcagtaccgtggacaattttgcaaacgagttactgaaccaaggtgacaaaaagcagt

SEQ ID NO: 13710 - DNA, 771 bp, Triticum aestivum
  Clone ID: PAT_TA_13710
gccggccgggccgggaccacctccgcctccaccccatcctccccgacccctctccccccaggtaagcccgcggcggcggcgagcgagcggcggctatgacgacccgcctcaagaagaaccgcaagaagcgcggccacgtgtccgccgggcacgggcgtgtgggcaagcaccgcaagcatcctggaggccgcggtaacgccggaggcatgcaccaccaccgcatcctcttcgacaagtaccatcccggctacttcggcaaggtcggtatgcgctacttccacaagctcagcaacaggttctacactccgacgatcaacgtcgagaggctctggtccatggtaccggccgagaaggcggcagaggccggtggtgacaaggcccccgtggtcgacgtctcgcagttcggctacttcaaggtgctcggcaaggggatgctgccggagaagcccatcgtcgtcaaggccaagctcatctccaagatcgccgagaagaagatcaaggccgccggcggcgctgtcgtgctcgttgcctagggttctgttcgcgactgtgccttgagatctattatatctttactattagttgtttcccgtaccagcaatttgtgttgaacaagacatcgttagtttgttatccttgttcctgtgtggtaaaccaacatcttatgagaattttgcgatatgttatgccagtttatatcagacgagttatccataatttgagtgcagcatcaacatgtttcaacatcacttttgtgcatcctgatgtcct

SEQ ID NO: 13711 - DNA, 1250 bp, Triticum aestivum
  Clone ID: PAT_TA_13711
cgtccccgaacgcgtgggcggacacgtgggcggacgcgtgggtctttgaattgcgatcaaagatggcagaaagattgggaaaaaggaagaacttgatagatgagactctttattttagtcttggttcaaaagaaaaccctatacaaggctgttgtcaaaagggaaaagaaaggctacatccccaaattttggtcactggtgaacacccttgtagaagtactccatagctgctgatgcaggacctccaagtcagacatgctttgttgcaatatatgcatttgtcttcaatgccagcggcgttgacgataacccccacaaatcgaaattaatgttaggaaagaacgcctcctcccttcttcagccgaagcgcccgcacgcctcgacccaagggatcccaatggcgccgacctccaagatggcgctgggcatcaagcgcgcgtcgcggtcgcacacctaccaccgccgcgggctgtgggccatcaaggccaagcacggcggagccttccccaaggccgagaagccagccgccgtcgccgagcccaagttctaccccgccgacgacgtcaagccccgcaccgttagcacccgcaagcctaagcccaccaagctcaggtcgaccatcacacccggcacggtgctgatcctgctcgctgggaggtacatggggaagcgcgtggtgttcctgaagcagctcaagtctggcctgctcctcatctctggacctttcaagatcaatggcgtgccagttcgccgggtgaaccaggcttatgtgattgccacatccacaaaggttgacatctctggtgttaaggtggagaagttcgatgacaagtacttcgccagggacaagaagaccagggcaaagaagactgaaggggagctgttcgagactgagaaggagaccaccaagaatctgccatccttcaaaaaggatgaccagaaggccatcgatgctgagctgatcaaggctatcgaggctgtccctgaccttaagaactaccttggtgcccggttctctctcagggacggtgacaagccccatgagatgaccttctaagttgctacaagttcctgagttttggatgtgttttgcctagcttgttgctgaaatttgaaccctgttagttgacttcctatgtcagttgaagtgaccgtaaaatattatgagaagatcaagagtatccttatctgcttcggtggttcttttttacttgtgcttaatggagcgctttgccatgcgttaaaaaaaa

SEQ ID NO: 13712 - DNA, 1272 bp, Triticum aestivum
  unsure (1)..(1272): unsure at all n locations
  Clone ID: PAT_TA_13712
cttatagggcgaattgggtaccgggccccccctcgagtttttttttttttttttttgaacattactaaaaaaatccaaaagaaaaccaaatcatcagaggtgtttaggggagaaatacaaacagagagccactattatcatttggagagcttacatactcggatcacaacagatacttttaattggagaaacaattgaagatgaacgagaaacaaagcgtgttctataagcagcaagttatgaagcgtgccagaacacgcaccacaaatacaaccaccaactagaaatgatgccgctctggatacattcgtccatcgcaaatcatttcaagtgtgtttttatcaagcaaatggttttcgattaggcccaactatgacacggtgttattacatccataacagcgttagcttgtcatgcgccactggcatacatacgagtccattccttcgctgtctcaacagcttcagcttcattggatttccagtgttttgcgacgttttctgagagaggatcatctgggtttggggcgctcagcagtgcctgaatgctcaaaagaacagtgcgtatctgaagagctggactccacttgtcctttaggatgtcgaggcatattctaccaagcttgtcaatgttgggatggtatatttttgtgagaaacctaactttaggagcagccatcggatattcctcgggtaagaaaagttcaagcttgaagactccaccttcgtagggcgactgcgcggggccaaggaccatgacattgaagtagcgcatgttctcctccgacggcgaggcgctgatccccggtattgttatttattgtcactacctccccgtgtcaggattgggtaatttgcgcgcctgctgccttccttggatgtggtagccgtttctcaggctccctctccggaatcgaaccctaattctccgtcacccgtcaccaccatggtaggcccctatcctaccatcgaaagttgatagggcagaaatttgaatgatgcgtcgccggcacgaaggccgtgcgatccgtcgagttatcatgaatcatcggatcagcgagcagagccccgcgtcagccttttatctaataaatgcgcccctcccagaagtcggggtttgttgcacgtattagctctagaattactacggttatccgagtagcacgtaccatcaaacaaactataactgatttaatgagccattcgcagtttcacagttcaaattggttcatacttgcacatgcaggcttaatctttgagacaagcatanacc

SEQ ID NO: 13713 - DNA, 1773 bp, Triticum aestivum
  unsure (1)..(1773): unsure at all n locations
  Clone ID: PAT_TA_13713
ctctctctctcactcgctccgcccggccgcccgactttgaccgcctcctcgtctccgctcccacgcccgcgggagagaggcgaccggcggcggcgcgcgaggagggcctacccatcccacccaccaccccgccggccaagatgttcggccgcgcccccaagaagagcgacaacaccaagtactacgaggtgctcggggtgcccaagaacgccgcccaggacgacctcaagaaggcctaccgcaaggccgccatcaagaaccaccccgacaagggcggagaccccgagaagttcaaggagctggcacaagcctatgaggttttgagtgaccctgagaagcgtgagatctatgatcagtatggcgaagatgctctcaaggagggaatgggtggaggaggaggtggtggagttgatccatttgacatcttctcatcatttttcgggccctcttttggaggtggtggtggtggcagcagcaggggcagaaggcaaaggaggggagaggatgttgtccatccacttaaagcttctctagaagatctttacaatggtacttcgaagaagctctctctttcccgcagcgtcctctgctccaagtgcaagggcaagggctccaagtctggtgcttccatgaggtgcccaggttgccagggttcaggcatgaaagtgactattcgtcagctggggccttccatgatacagcagatgcagcaggcctgcaatgattgcaagggcaccggggagagtattaatgacaaggatcgctgcccaggctgcaagggtgagaaggttcttcaggagaagaaagttctggaggttcacgttgagaaggggatgcaacacaaccagaagatcaccttccctggtgaagctgatgaggcgcctgacactgttactggagacattgtatttgtcgtccagcagaaggaacacccgaagttcaagcgaaagggcgatgatctcttctatgagcataccatatctctcactgaagctctttgtgggttccaactcgtcctgacccatctggacaacaggcagctgctcattaaatcaaaccctggtgaaattgtcaagcctgattcattcaaggcaatcagcgacgagggaatgccgatgtaccagaggccgttcatgaagggcaagctctacattcatttcacagtggaattccccgactcgctggcaccggatcagtgcaaggctctcgaggcggtgcttccaccaaagcctgcatccaagctgaccgacatggagcttgacgaatgcgaggagacgacgatgcatgatgtcaacatggaggaggagatgcgcaggaaagcccatgctgctgctcaggaggcgtacgacgaggacgacgagatgcctggaggcggtgcccaaagagtgcagtgcgcacaacagtaagctagggttgggcaagctttttggggaccctagatcaagatgcctgcctgctctctggggttttggtggtgttatcgatgaagctgatttttgcccgtttggcgccggggctgtatccatccatgtcttttgaaaaatgctacgtggctactcttaatgtagtgtgatactcgtataaaagcaatctgtttgtgaaaactaacgaacgctgtctgaatacgttgtctaagcagaaccgtggacaattttgcaaagcatgtttgtggtttttgatcaggtttttaatcaggctggcatcatgatcaaaaaaaaaaaaaaaaaaaaaaaanaaanaaaaaaaaaaaaanaaaaaaaaaaaaaaaaaaaa

SEQ ID NO: 13714 - DNA, 780 bp, Triticum aestivum
  Clone ID: PAT_TA_13714
ctccccacacctccgcctccaccccacccgccccgacccctctcctccaaggtaagcccgcggcggcggcgagcgagcggcggcgatgacgacccgcttcaagaagaaccggaagaagcgcggccacgtgtccgccgggcacgggcgtgtgggcaagcaccgcaagcatcccggaggccgcggtaacgccggaggcatgcaccaccaccgcatcctcttcgacaagtaccatcccggctacttcggcaaggtcggtatgcgctacttccacaagctcagcaacaggttctacaccccgacggtcaacgtcgagaggctctggtccatggtgccgtccgagaaggcggccgaggccggcggcgacaaggcccccgtggtcgacgtctcgcagttcggctacttcaaggtgctcggcaaggggatgctgccggagaagcccatcgtcgtcaaggccaagctcatctccaagatcgcagagaagaagatcaaggccgccggcggcgctgtcgtgctcgttgcctagggttctgttcgcgaccgtgccttgagatctattatatctgaactattagttgtttcccgtaccagcaatttgtgttgaacaagacatcgttagtttgttatcctggttcctgtgtggtaaaccaacatcttatgagaattttgcgctatgttatgccagtttatatcagacgagttatccatatctgtgctcctatttatgtttcgtttgatctgtgttaatccctaatgttatcaatccctaatgcaaaaaaaaaa

SEQ ID NO: 13715 - DNA, 790 bp, Triticum aestivum
  unsure (1)..(790): unsure at all n locations
  Clone ID: PAT_TA_13715
tccctcccaccacctccgcctccaccccacccgtcccgacccctctcctccaaggtaagcccgcggcggcggcgagcgagcgagcggcggcgatgacgacccgcttcaagaagaaccggaagaagcgcggccacgtgtccgccgggcacgggcgtgtgggcaagcaccgcaagcatcccggaggccgcggtaacgccggaggcatgcaccaccaccgcatcctcttcgacaagtaccatcccggctacttcggcaaggtcggtatgcgctacttccacaagctcagcaacaggttctacacaccgacggtcaacgtcgagaggctctggtccatggttccgtccgacaaggcggcggaggccggcggcgacaaggcccccgtggtcgacgtctcgcagttcggctacttcaaggtgctcggcaaggggatgctgccggagaagcccatcgtcgtcaaggccaagctcatctccaagatcgccgaaaagaagatcaaggccgccggcggcgcagtcgtgctcgttgcctagggttctgttcccgaccgtgccccgagatctatatctgaactattagttgtttcccgtaccagcaatttgtgttgaagaagacatcgttagtttgttatcctggttcctgtgtggtaaaccaacatcttatgagaattttgcgctatgttatgccagtttatatcagacgagttatccatatctgtgctcctatttatgcttcgtttgatctgtgttanatanaaaaaaaaaaaaaaaaggcccctagggccgcggccgct

SEQ ID NO: 13716 - DNA, 1712 bp, Triticum aestivum
  Clone ID: PAT_TA_13716
attcggcacgaggcccgactttgaccgcctcctcgtctccgctcccacgcccgcgggagagaggcgaccggcggcgcgcgaggagggcctacccatcccaccaccccgccggcgaagatgttcggccgcgcccccaagaagagcgacaacaccaagtactacgaggtgctcggggtgcccaagaacgccgcccaggacgacctcaagaaggcctaccgcaaggccgccatcaagaaccaccccgacaagggcggagaccccgagaagttcaaggagctggcacaagcctatgaggttttgagtgaccctgagaagcgtgagatatatgatcagtatggcgaagatgctctcaaggaaggaatgggtggaggaggtggtggtggagttgatccatttgacatattttcatcatttttcgggccctcttttggaggtggtggtggtggcagcagcaggggcagaaggcaaaggaggggagaggatgttgtccatccactaaaagcttctctagaagatctttacaatggtacctcgaagaagctctctctttcccgcagcgtcctctgctccaagtgcaagggcaagggctccaagtctggtgcttccatgaggtgcccaggttgccaggggtcaggcatgaaagtgactattcgtcagctggggccttccatgatacagcagatgcagcaggcctgcaatgattgcaagggcaccggggagagtattaacgacaaggaccgctgcccaggctgcaagggtgagaaggttcttcaggagaagaaagttctggaggttcatgttgagaaggggatgcaacacaaccagaagatcaccttccctggtgaagctgatgaggcgcctgacactgttactggagacattgtatttgtcgtccagcagaaggaacacccaaagttcaagcgaaagggcgatgatctcttctatgagcataccatatctctcactgaagctctttgtgggttccaactcgtcctgacccatctggacaacaggcagctgctcattaaatcaaaccctggtgaaattgtcaagcctgattcattcaaggcaatcagcgacgaggggatgccgatgtaccagaggccgttcatgaagggcaagctctacattcatttcacggtggagttccccgactcgctggcaccggatcagtgcaaggctctcgaggctgtgcttccaccaaagcctgcatccaagctgaccgacatggagctcgacgaatgcgaggagacgacgatgcatgatgtcaacatggaggaggagatgcgtcggaaagcccatgctgctgctcaggaggcgtacgatgaggacgacgagatgcccggaggcggtgcccaaagagtgcagtgcgcacaacagtaagctaggttgggcagcaagcatttttgggacccaagaacaagatgcctgcccgctctcttctggtgctttggtggtgttatcgatgaagctgatttttgcccgtatggcgccgggactgtatccatccatgtcttttgaaaattgctacgtggctacttctgatgtagtgtgacactcgtataaaagcaaaatctgtccgtgaaaactaacgcacgctctttgtctgtctctctgaatacgttgtctaagcaggaccgtggacagttttgcagagcatgtttgggcttttaatcaggttttcggcggcatcgtaatcattatcatcatca

SEQ ID NO: 13717 - DNA, 1850 bp, Triticum aestivum
  Clone ID: PAT_TA_13717
gatcgaacctctagtagctggttccctccgaagtttccctcaggatagctggagcccattacgagttctatcaggtaaagccaatgattagaggcattggggacgcaacgtcctcgacctattctcaaactttaaataggtaggatggcgcggctgcttcggtgagccgtgccatggaatcgggtgctccaagtgggccatttttggtaagcagaactggcgatgcgggatgaaccggaagccgggttacggtgcccaactgcgcgctaacctagaacccacaaagggtgttggtcgattaagacagcaggacggtggtcatggaagtcgaaatccgctaaggagtgtgtaacaactcacctgccgaatcaactagccccgaaaatggatggcgctgaagcgcgcgacccacacccggccatctgggcgagcgccatgccccgatgagtaggagggcgcggcggccgctgcaaaacccggggcgcgagcccgggcggagcggccgtcggtgcagatcttggtggtagtagcaaatattcaaatgagaactttgaaggccgaagaggagaaagttccatgtgaacggcacttgcacatgggtaagccgatcctaagggacggggtaaccccggcagatagcgcgatcacgcgcatcccccgaaagggaatcgggttaagatttcccgagccgggatgtggcggttgacggcgacgttaggaagtccggagacgccggcgggggcctcgggaagagttatcttttctgcttaacggcctgccaaccctggaaacggttcagccggaggtagggtccagtggccggaagagcaccgcacgtcgcgcggtgtccggtgcgcccccggcggcccatgaaaatccggaggaccgagtaccgttcacgcccggtcgtactcataaccgcatcaggtctccaaggtgaacagcctctgggccaatggaacaatgtaggcaagggaagtcggcaaaacggatccgtaacttcgggaaaaggattggctctgaggactgggctcgggggtcccggccccgaacccgtcggctgtcggcggattgctcgagctgctcacgcggcgagagcgggtcgccgcgtgcccggccgggggacggaccgggaatcgccccttcgggggctttccccgagcatgaaacagtcgactcagaactggtacggacaaggggaatccgactgtttaattaaaacaaagcattgcgatggtcctcgcggatgctgacgcaatgtgatttctgcccagtgctctgaatgtcaaagtgaagaaattcaaccaagcgcgggtaaacggcgggagtaactatgactctcttaaggtagccaaatgcctcgtcatctaattagtgacgcgcatgaatggattaacgagattcccactgtccctgtctactatccagcgaaaccacagccaagggaacgggcttggcggaatcagcggggaaagaagaccctgttgagcttgactctagtccgactttgtgaaatgacttgagaacctgaagcaagcttttgaggatgagaagacccgattcgaggaaaggatgaagcagggctactaggccaagggtgttctggatgctgacgtgaaaccttccttgctagtaattatatctgatgtctgaactgcggtagaaaaaaaattactcaaggattgtcgatgatcctctgaactcgtagaacctcttcatgtgcggattgcgtatgattgcacggttgttaaacatgtgttggcacttgataagcctgctagttgaattgctcgcctttgacaggttccgtagaaggcacggaccagaccttggatcatttcataccgagt

SEQ ID NO: 13718 - DNA, 550 bp, Triticum aestivum
  Clone ID: PAT_TA_13718
cgttcgcccacgcgttcgcgtccgcgtcgtcgtagtcaacattacacataccagaagtacgtacacacaaaccctcacactagaagaccgatccatggcgccatccccggccgccgccgtgaagacgacgagagcgacgtgcgtgctgttgatcctgctcctgttggccgacgggcggtcgaggcccgtggctgggcaggcgccaccggcgcccgaggaggccgtggcaatcgaggcggatgccgacggccgtggaaacggcacccgcggcggcggcaggagcgccgggacgccgaaggagttgagcgccatcgactgccaggtctgcgagtcgacgtgtcgggtcaagtgcctcgtcaacaacctcttgcagtggggcagctgctaccagcactgcaaggccgacaactgcaacgagtggtgtaggtagccgtccgtcgaggtaacgcgccgacggatgcatgacacgcgcatggatcctctacaagaggatgtccgttttctgcgattcatggtgttgctttgaatgcagcaaatcagctgctctatg

SEQ ID NO: 13719 - DNA, 516 bp, Triticum aestivum
  Clone ID: PAT_TA_13719
ttttttttttttttttttttttagccaactattcatttttccggttttttttttttttttttttttttttgaacagaagtaatgtcagtccgttcttcactggctcgagtccaaactcaaaatacaatctgagctaccggctagccttatccacatccatcactgcacctggatgctcacgactttgcccccggacggcgacaccttggggatgcttgaggtagagcacgccgtccctcacctccgcggcgatcctctccacctccacgttctccggcagctccacccgcgtcctgtaccgcccgtagctcgccgccggccacgcctcctcctcctccccatcctcctcgttatccttatccttctccccgtccgcctcccctggcttcgccgccttctcggcgaccaccaccagcgtccgggcctgcacgctcacgcgcacgtcctcccgcgtcatgcccggcatgtcgaaccgcaccaggtagtcccccgccgctccttgatctccacggtgtc

SEQ ID NO: 13720 - DNA, 809 bp, Triticum aestivum
  Clone ID: PAT_TA_13720
tctctcttctcgttcgttttctgctcccgcgcagctgcgggattcgtcggcgttccccggggtccggttggccctcccgacgccgtgagctccgcatgcctgcgttttaccgcttttcccctttcacctggaagtcgggaatcgtgtaccctgcaccgccgggttccactgcgcttgtctctctcttctaaacaccattcgttctgctgacaattgtactacttatctaacaactgtgtacacacatctcgttcgattccagatcccaagcagcagcgggaaacgtcaccaatacccgagttccggacggcacacacgacccactcaaccccacatcaactgtcccttaatataaataagaagacgtatagctggatcactgcgccggtcgctctggtcatacgccgccgtgcctcggcgacgcgcgcgcgcctcattcgtcaccgtggccgccgtggcgggcctccgtctctgcgcactccttggcggcggcgtggccccgcacggcgcgctgcttctcctcctcggcggcgtgaatccgctgctgcttcttcacctcggccgcctccttgttcaccaccgccgcctccctgtgccctgtcgtgtacgccgcggccttgtccacctgcccctgcacggcggccctcgtcttctccatgccggcgcgcgccgacgcgccggcgttcaccgcggcctccttgcccgactccatgccgcccgacctcccttgcttcagtttggactagccgacgatcctgctgaaatctctagacaagctgccgtgctttcgcaagcagggtcgaggcgac

SEQ ID NO: 13721 - DNA, 444 bp, Triticum aestivum
  Clone ID: PAT_TA_13721
ttttttttttttttttttgacatataatcatatatacatacactgagtagtagcaaaatgaacatgaagaactccccgttgattgattgattgattcatggcagaagaaagagttggatacttgctagatcgactggctgcagcaactatattacgtactgaaaaatgatgcagctttggctaaggctaattggtggtggtcgtcttggcgcgggcggggacggcgccggagccgtcgcaggcggtgcaggagcgggtggaggagcagcggttgcagtaggtccacttggtgggggaggccggcggtgtagcgggtggccatgttcttggcggcccgccgcgcccggccggccgcctcctcgccgacctccttgaacacgaacccctcccccttgcaccgcgggcagaggccgctcccgccgcaggcggagcactcctccaccg

SEQ ID NO: 13722 - DNA, 770 bp, Triticum aestivum
  Clone ID: PAT_TA_13722
attttttttttttttttttttttttttttgatgcaaatgatgtggtgtatcactttccattgagctatgtaactgccgttatgtgttgggtatgtttaggatcccttgatgctttcagggcgaggaatcttaaaatgcatcagattaacaaaaactggtatcattgaaacaaggttacttcaaatgtgccatgaatatcgtcacagggcaataagatgactggcacaccatgtcatcataagttttaagcagtgagactacagattccatcagcaaaaatccaatggtatagtccacaaggcatgtagctagtgttattggaatctgccaggggaaggctaaactgaagactcttgtatggtgactggagcaccattcttgttatagaggcgttgcaaaaccttcggagagccagccccaagacccgggcttaagcccgagcatggaggtgagcagcgccgatgctgtcgcgctgtgcagcggtatcagcccctgcgcgccgcccagcgccgccaccggcaccctcgagatcgcgaggcgccggcgcggagcgcgcggcagagcggaggccgccagctccggggactgggcaactgccggcctggaaaacgttctggacagagtagatggggaagcggagcgcagccccgcgagggctcgccgcgcgccgccagccgccgtcgccatggctggtgtggatgggctctaaaaccctcggccgtccccgccgcgggcttctttcaccgtttgtcgacgcggccgcgaattcg

SEQ ID NO: 13723 - DNA, 723 bp, Triticum aestivum
  Clone ID: PAT_TA_13723
taggggccttttttttttttttttttattttttttttttttttttttttttttgatcaaaaatagacgataatatttcttaagccaaatatccagccttggaaggaaagcatataattatcctcatattacacgggatgcaaacatcaaacctcacaggaacccagataaataaggtcctgtaacacgggtgagcacccccgacacatcaggtcaaaccagatttatctggatccacaagaccctgccatcccaactgactcgtgtagtgatacaaggttaagctttctcctcgttgttcgcctacttggatcgctgcatcacctatcgagatgataatatagcttaagctgaatatccgcctcgatggaaagcatataattatcctcatgttacaagggttggcatcacccaaatatcacaacaacccagacatatcaggaaccagaacaccctatcatcccaacatactggtgcaatgatacaaggttcagctttctcctcgttgttcacctacttggatcgctgcctcatctttcggcgcttcctcttgagcctcctcatcctcttcttcttccacttggccctcatcgcggaggtggcggcgcagcaggcggactgggtatcgaactctcggtgtctgcttgctgcggcggcggccggaccgaacggccggcagaaaaaaaaaaaaaaaaaaaaaaaaataaagaaagactgcataggt

SEQ ID NO: 13724 - DNA, 1065 bp, Triticum aestivum
  unsure (1)..(1065): unsure at all n locations
  Clone ID: PAT_TA_13724
ttttttttttttttttttttgcagcggctaccatttcttctctgttcagctactttgcccaaagacagcagcggcagcccaatgcaataattttcacatcctacacctaaaagacagaaataaattccgcacgccggacgcctgcccaaaccaaccttttcctacaaggtgcccctaaaaactctgtccgcccccatagcacgcaacctaacgtaacaccctgcacgctctcccgccttgtccggaccccatcccgctcgccacccgccggctgcgcttgcctccgcttccccggtttgctgtcgctacgcgtgccaaacaggagggcccgaaacgagacaaacaattgctagtgatgatctcgcttcaggcctatactgcggcgcatatttgctagaccagcagcgggcgatcgagccatgccgatgccatgcatgctctccggtcagtcctcgaagccggtcctcttccagacggcgtcccggacgcggctgaggtcgcgccccttgagcgtcccgccccccccctcgtgcgccgccggcgccccggcgcggccgcgccacgcncagctcgtgcggcggcgccgccgacccgctccggcggcccgcccccccctcgccgcggcccccctcgccgtcgccgttgtccccccgctccccggcgcgggggtccctcctctcgtcccccccggtcttctgccagtccgggatgctcatcggcagcgacccgggcacggcgccgggcgcccggcggtggcatggtccagcggcttcttccgcccgctggcgcgggcggacgacgggatcgtgcgagcgcgcgcgaggtccgcggggccggagtccgccgcaccgaacgacccccagacgtccgactcgtcgaactcgtccgccgcgctgccggggctgccccgcgacgccgcgctccgggacggcgtgaacatccggtacgcgtgcttcgcggccgccgacctcgcgctcccggccatggcgctctcgtttgtgcctcgcgcttaccgtgacgcctcaaccaccggtctttggcggagggaaggggtgcgggttgtga

SEQ ID NO: 13725 - DNA, 721 bp, Triticum aestivum
  unsure (1)..(721): unsure at all n locations
  Clone ID: PAT_TA_13725
nnctgctccgacataccaccacgcannctcaagttacagtgccgcacgnnnnnnccacnnatagnctaggttgcgaagggtaaccgttcgcagaccatgactattgcattgactcgtctctggaagcaggccatcgccccgacataccaccgctcactaccacctccagnnnatgcttcacggagcaaccgtatgcaatatgcatactaaagcagtcgcaccagctcatcgccgccccgacgtaatgtctttccgctccttctttgcacgtcaactggtataaaaaactgacggcttaagatttgtacagcactagcacggtagtcgactctctccccaaaaagagacgaaaaacccgtacacgacgggcaaacgatatttacatacaatgtcgacggtggctagctatttggctagttgccagctacttccccttttgattccgtgatcctagctagcagctaatcacctctgccaggagcttgtacctcctcaccttgaccctacccggccgcgccagcttccccgcctgcatcggcttcttgtcgccgctgctccccttcgccgccgtgcccggcgacgggggcagcgccgtccactcgtcgaccttaggcttcttgtcgccgttgttccccttcgccgccgtgcccggcgacggaggcagcgctggcctcttgtcgaccttgggcttcttgtcaccgctgttccccttcgccgccac

SEQ ID NO: 13726 - DNA, 696 bp, Triticum aestivum
  unsure (1)..(696): unsure at all n locations
  Clone ID: PAT_TA_13726
tttttttttttttttttttttttttttttttttttttttttttttaaccaacatgtagcaattaaaaattgcatccatacacatgttgacatttcataaacagatattacatagttcatatgtacaaaaactgaaaaagctagaaagctaatcagaaaagaaaacgaaaaataatggcaataggccaaaaactggatgacctactaccgtggctagtgccacctttttattttcgttcttgtttctttttttttctttgctgcacgtacgcatgggccagtggctaacgtggtgggctggtggctgtccaactcacgcgaggggatggataagggggccgagggaatatcattcccgtccacaaatcgtcccagatccaactcaagcggtgggcgtctcagccagcatcaccaacctccgccaccggtggctgcctcaccggcgcgtagaaggccccggcgcagcgtgttcctcctctgaagaacaagatcctccaggaatgtgcgcccctgacgcgacgccgttgtagtggccattggccagcccaagattcaccgggctccatcgtcccggccgacgaccggcgcgctgcangacagcgcgcggcgctatgtgccagcggcggggcgccgatggaccggaggagctgccggctccgttgtcgaagacgtcccggcgcgcaaacagccggcgtgg

SEQ ID NO: 13727 - DNA, 566 bp, Triticum aestivum
  Clone ID: PAT_TA_13727
gtcgtccctgcgtgtttgggtcgtggtctgcttgcgacccggttcccctctctgccatgacgcctgtttgtgggtggccgggggtgtacaagtgctgcgacccccgtggcctgccctccatcgtcgtccggcatccggagcggagctccagctgcgaattgggcacactggggctggcttaccggacactctttgtacccttctgcccggtctggtgcgggggtcctggagctttgcgcgtgatgatggcgccccttgagctgtgcttccatcggccacctcccacttacaagtatgcgccattttacctccccggctctcattcgttccatctgggtatgccggcgggcactcgttcctccgttgggagtagaggtgcacatgtacatcagttggggaaggaattgcccctttcatgctgtgtgaacatcatattctctgcataatgccagcttcttttcctggagcgatctggtaatgcagccgtgaaccttcgggggttcccaaaggcgcgcccgtgcaggagcagttgtcaaccatataaagctcccatttcttgataccac

SEQ ID NO: 13728 - DNA, 931 bp, Triticum aestivum
  Clone ID: PAT_TA_13728
tttctctttttttttttaatcatttcgcaaaaaatatattaaaaacttccattgtaatgagtgatcacactacacaagtacacaacgatcaaattagaacaaatctcatctcacgcatgcagacagactgatcccccaccgaaccacgcgttccttggatcacggcatcttcctcaccgggcggtggatttcaccggcgccaccctgttgctctccacgaaagccttcatctcctggaaaaccttgccggcgtcagcgaccgccgggaagccgtagaacccgtggaagccgtccgggtactccgccacctggaccttcacccccttccgccgcagcacgtcggcgtaccgccgctgccagtcctgcagcgggtcgaacccgccgaccaccaccagcgccggcgggaacgcctcggccagctcggcgttctcgtcggtcacgtgcgccgccgggtggtcgcggctggcgccctccggcagggacgccctccaccagaaagtccgcccgccggatggtcacgatcggcaccacgccgtccagcctcagctccgactccgtccgctcctcgccgccgaagtacggctgcacggacaggaggccggcgaggcgcacggagtttggggtgggcgcggccgcagcccagcggttggccgcgtggtggattatgttgccgccggcgctctccccggcgaggaagcagctggagaggtccacgcggacgccctcgtccagccccgggacgccgttggcgtcgatgaagcggagcgcgtccacggcgtcgtcgtaggcggccgggtaggggtgctcgggcgcgaggcggtactcgacggagaccacgacggcgccgacgccccggcagaggcggcggcagaggcggtcgaagtagcactggcgcgcggagaacatcgcgaagccgccgcctcgtccgaat

SEQ ID NO: 13729 - DNA, 583 bp, Triticum aestivum
  Clone ID: PAT_TA_13729
tttttttttttttttttttttttttttttggcctccctttggggccttgatgagctcctctattcctccaaatctttcacttccaaaaagcttggattacatgacaacttgtaattgagatagatgggttgaatatgacagtgcctacatcccaaccacaaaaataatgcgcgaggcattctgcccaccacccaagagttgccgccattttttttttttgacgaaaaggcagggccactgcttttcattgccgccattgttgacctccaatcctcaagctgcttcgacgcagctgccgctgaccagctcaactcactggccccaatgatcctgttccatagcgatctcgaccccacagatacccttcgcgttgctgccccagcgcccctccagggtccagtgttacaggtgatcgtgccaatggtgcgtcccctctggattattcctctgagctcttcgcctcgccgcccagcgctcagaatcctgtcgatgcggtggcagcggcagtgagctaccggagacggaagagcggcggcctgccagaggagcgcggggacgaccggaatccatcagaagtggggat

SEQ ID NO: 13730 - DNA, 723 bp, Triticum aestivum
  unsure (1)..(723): unsure at all n locations
  Clone ID: PAT_TA_13730
ttttttttttttngacttattggggatcatcaatttatctacaggatgtngacgtattcaatcaccattgaagggaattagttcgttgagttagaagcacacccgggaaaccttttagttacgttcgttggaacataacttagggacgaaaaaccgggctctcctcctttttgccttattacacgctggtgattaaccagctggttcaccaacgaaagtaacagtacaggcaaaagcacacagaagttcatctcgcttacacataaggaacatgaaatgaacatagtgaccgggagggtggagaattgcacgatagagagttgatgccgccaacgaaatcacctcctgctagcttcaggacgcaagattttgttcatcgctcggcttgactcaactcggcgtctttcatcagcgatgcctcatccactcgcagaccctgaccaaatactctcgtccagtggctctggactgggcttggccttgttgcgccgctgggcttcggagtccacttgggcctcacgttgtcgctgcctttcatctgttctcttctgaatcttgatggcttctggcagacacgaggtcgtgacaataccccctcctggagagacagcttgtccccaagctggtgccgtaggataagcagcgacgatggagaacacctcctcccaggtggtgtgatcttcttgcaaaccttcccactgtacctcggccgcgaccacgcta

SEQ ID NO: 13731 - DNA, 841 bp, Triticum aestivum
  Clone ID: PAT_TA_13731
gccgctcgagccggccgggcggggggataagaggaggaagagccgttgaaggaaagaagagatgacgatgtcgtcgccggcctccacccacctcctccgctccgcgcccgcggcgcccctgctccctcgccgcgcctccctgcagctctcctgcgtcgccagcggagccgcgccaaggagtaggagacggagcggccgcctggaggtagtccgcgcggccaccgcggaggtggccgaggccgccggcgcccccgcctacaccaccgagtccctcatcctctacttcaaggcggagggcaccatggaggagaggtctatccccaagatcacccaggctctcgaggggatggacggcgtcagtgacctggaggtgctcatcgaagaaggcatcggaagtgttgtgttaacgaaggcgacaacagtccaagctactggggtcgcctcaaacctggtggaagccatccagggagttggtttcaagctgcaaactctgagcctcagcttcgaggactttgacaaggaggatgctgctgctgtttcgggagaaggagcagacgtccaagccagcgagtgagcttcacagcgtcgtgcctgcgctgagtgcacacgatgtgctctggtcgttggggttcaatatttcttcggacgtttttctttagttgtcatacactcgctcttagcaatttttcaagctgcacgttttaccttctggcatgactacgtaccctatgtgggcttttagaaatgctgcatcttcccattaaaaatagagaagaaaaagaaattctgcgtctactaaaaaaaaaaaaaaaaaaatttccttaaaaaaaaaaaaaaaaaa

SEQ ID NO: 13732 - DNA, 516 bp, Triticum aestivum
  unsure (1)..(516): unsure at all n locations
  Clone ID: PAT_TA_13732
tttttttttttttttttttttttttgaaactaataggattttattcaatgaatgttcacaacttacaccctagttcaccctacatatacatatacacacaaattagacatgcatctacaatcagttctagctatctagtgacataattgtgttcttctactccggcctataatatgttacactaactttacacaatatactgtgctaatttaggctgatctacaaattatgcatgagtaatattatccccctcgatccattgatcgatcggcatcaataagtgaataatcaactagtgtggccatagttaaagtcgctaagcttgctttctcctagccctaattaacacggtagcacggatcatatcctatcctgctgggaaggctggtctggtccaaaatatggagaagccgccgttcatcatccgtcgtcatggngccaacgctacccaaccaactccttgggagcgggnaacgaacgacntttcaacaatccttgttgcngtccgcccgtcnc

SEQ ID NO: 13733 - DNA, 890 bp, Triticum aestivum
  Clone ID: PAT_TA_13733
gaaggctcggcccaaccctgatatagggggacccgagatccagaccgccaaacaaaatccaagtagcaaacatcgctcgatcgatttcacctaaaagagaaaagaaaggcaaatcgcagattcaaggcgatggcggcggcgatccgacttgcggccagtcggctcatcggcggccagcgaccccaggcggttttcaagtccgtcgtcttgccgctggtcgaggtggggcgtcgccggctgattccaagtctcatcaacggcggccgacctgcctctttttctctcagatctatgtcctccggcggcgcaggttgcaaagagtttttttccggcgccgccgccgctgcccacccacccaacggcaaccgcgccctgaagcaaccctttggagaacctgtaccaaagctcgacccagagagagcatgggcctatcggcagtactgcgagattgagaccaagaagcacgagctcttctacctgatcgctgagttggagaagaggcacccatatcgtaggtacacgggaaaaaacatggagctcctcttccaacttttcggacacgttgatcctaatcccagcgatcccctctggtgccgagctcatgcaagagaaagactcaacaattgtctgctatatggaatgcctcccccgatggccccttggatgtacatggattgggagagttggagaaatatgtttgcctttgcccttggaattggtccctagactagatttccctatgtcatgagtcccagatattgaaactcgagtaaatttcattaaagtacccttttttgttggctaaatgtcaaggaattgcgcttcttcttttttgtggtctcttgtttcaacaggctgcactttctaaaccgcacttcttttagcagctt

SEQ ID NO: 13734 - DNA, 552 bp, Triticum aestivum
  unsure (1)..(552): unsure at all n locations
  Clone ID: PAT_TA_13734
tttttttttttttttttgtttgaaatgacttgcaaatcgttcggtggcagtccttccgtgacacctgggctcgtctgttcggtgcgcggatgtcttgtgcccacctccgtcgttgccctccttgacacgacgacgtagttggtctttgtttcgccgggattcgtgtcggggctggggtggcctgccttccgttattcctacccaaaccaagcatcagctgctgcggcttccagacagccatttgcgacggcgtcttccgggccgtgcactgccctgcgcgcggccgatgccgcggccctccgccgcggaacacagaacatggcagcatcactgcaagtatttgctcttcttccctgcatagatggccaggaggtatatggcggcgcagccggcaacggtggcccaggtgggtctcccagaactttcctgtttttgatcctcgccatctcgggggtctccgggatctaacgtcaactcnatgtggatgttcatgccgaaacaagctcaacgaaccaacnaatgncaancggtgatnaacaacgggcccccgtn

SEQ ID NO: 13735 - DNA, 471 bp, Triticum aestivum
  Clone ID: PAT_TA_13735
agtgcattttatttattatgtacatcatctgttgggctactgtgaacaagaatcttgcacatgctaactataattgtcaatcaccaatctcactcgcctcgtaaacaacaaaaatattttttctatacagtatcatgcatcttctctctggaagggaaaaaaaagaacaaagaaaaacgtatggagtatgaacaccgcccatgctacaacggttggctctgctggcgccgccgctgcgccgcccagtgatcgtaggcctcgcgcagccgtcgccggaaccgcgccatgtccagccgcacgtgcttgcccgtcgaggtacaccttcttggtgacctgccatcccttggcgttgacggcgaccgggtcggtgagcacggggtcgtccctggcgtagcgccggaacagcgagctctcggacggcaggatcttgtaggggacgtagtgcaggccgagccgccgcgccggctcgcc

SEQ ID NO: 13736 - DNA, 624 bp, Triticum aestivum
  unsure (1)..(624): unsure at all n locations
  Clone ID: PAT_TA_13736
tgcantntgcaacttggacgggagcaaatcatnttnttaccactgattaaccgccttcaatccacccccctgggatgaaattacaaactgtccagtataggggtacaactcaaaatcaaaaatgcagtacgttatagggtaggagtgtacattagctgaaagcttggaagacgtggtattttcgtttcgtttcgtttcgtttcaaggaaggaagcggaggggaggttcgcctcaaagtccccgagcgaacgaattcctcagccttcccgccgacattctccaagtcggagccagttttgtaatccgtacggcacccaaaagaaaccaagagagagaaggtcgcggatgccccaaaagcagaggcgagcagagagagcggcagcggcatcagaatccatccggtttaggggcagtttggagattacactgcatgcgcgtcgccggccggctcgctggggctgcggcgccggaggccggagcttgtcccgccgttggaacgcgctgtttactaggtaactagtatgctcccgtcagccaccgcacgaacccgtagaacgcgctgccgtcctcggactcggcccgccgcgacgctggggccaccccgccatccatggtcccaccacc

SEQ ID NO: 13737 - DNA, 713 bp, Triticum aestivum
  unsure (1)..(713): unsure at all n locations
  Clone ID: PAT_TA_13737
actacatggaaattttaaatctgatgacaattgacaaggcaccatttacaaggtagctagacactactgcacttcagggctgcgcaatttaaaaaggggtttgttctttttttttctcttctttcgaatccaatgacatttgtttgcgttatcgctgaggaagcatcgtccttactcgttataaacactcaatcatacaggctctcacagaattaaatcaaccagagattgctacctcttgcacttcgcttttgccattttcttcctcctcttcttatcggctttcggctccttcgtcttccgagcttctctcttctcgtcttgtcactttcttctcctcctccgtccgagcagccttcctctcctcaggtcccatcgtgggatcagcctcatacctccgaatcttcaccagaactagagcaagatncactacttaagcaatgagcactattaagtggcaacngttttcctgctttcnagcatacctgttttttcaagcccgcacaaacctaacaatggctggtataaaagctatccgctggnggntcgtaaanaggaaggtcncttgcaacatgaatgttgacanacaagccaanngctcaatatccaaagcgnacagangtggggaagcacacatgcaatgnccatcncaaactcgcgacttcaataacacaatnnatcnaagttgtaacaaataatnntcatacgcagng

SEQ ID NO: 13738 - DNA, 1514 bp, Triticum aestivum
  Clone ID: PAT_TA_13738
ggccaccaccgcatccaatacccccaacactacgacgacgatgaggatgacgacgatgaattcgaggacgacgacgacgatgacgagccctcccggcgggctcggcgtattcgccaacacggagactagatcatgctcagttgaaggttcactgaggttcaagaatctatttggatactgtgagacctggcgtccgcggacgcgtgggggtttagatcagacaatggagctcaatgttggagccataataccgagaattggaccaatacccactccactgatggctcgagtgtcatttctctctgaggactggttgaagtcctcactcagagaacacctgatgggggtttctgttgggttgctctccacgatgaactataaccttgcttacaatctctcatggaaaactataattgacccggcgcggttgtcctccagttccataagggatcagttagagcatagcctactatcctctatcaaatatacatacaaaattgaccagagagattcaagcataagacctacatgtggatatgcttttctttcgtcttctcaagtcggaggtcttgccccagacagcaagaacacacgttttgttagacaggaatttgatcttcgggtagctatgccactgggtgtgtggaatggtgctctgaatgccggagtggctgcaggggtcatccatccattggccacaggatcaacaggctctatctcatcacttccagaacgcttttacttgggcggcaataggtctcttgtttgccgcttgggtggaccgtcatcactattgggcttcaagtcaagggggctaggaccaacagactcacaagcctgtgcccccaagaattctgaaaatgctgctcccatttctcctgagctagatgcactgggaggtgacatagcagtcacagcctttgctgatctttcatttgatctacctctgaagccactcagggagcttgggattcatggccatgcatttgtctcagctgggaaccatgccaagttcacagagcgtgacataagaggattttccgttaccgagttcctaaaaacgttcaggagttctgcaggatttggtgtggttgtgccaaccagattgtttcgcatagagatgaactactgccacatcctaaaacagtttgataatgacagggcgaagacaggcatacagttcaacttctcttcgccctaatttattttgctacacctttctatgaagatgaatatttgtattaatttttcttaatatgaccccacttgtcattctttttttcccaagaacttgcgagcctctccagaaattcacaaactgtaggtgacgatgaattcttgtcctggcttgttgattaattgttgtggcctgtaaagtctcgaatctgaatgaaaataagagatagagggattcagttttcaatgcttatcaacatgcttcttgaagtgatagaaatagtgatgtgatgtgtacggagaaagattgtacagtgcattgtgtaaatattttcctg

SEQ ID NO: 13739 - DNA, 648 bp, Triticum aestivum
  Clone ID: PAT_TA_13739
tttttttttttttttttttttttggtaaacagatggtcaagatctcagtacataacataaaattaattcactggatcggtgttctaagatgaacatccaagtatgaggatcagagaagtttgaggaccccaaattaatcgacaacgtatctctggcagtcacctgacaaggcagtctagcagtcacacagttgaccaaggcacatagaaggcacaaatatgcgagaattcagtcacatatgacataccaatgcaagtgtaaatcaaatcaggggtacatggaccacggcgtgcagatacaagtcgttctttcgccggacggtgagacccatctcctcggtcatgtctagcccatctggcttaaccccatttgggagctcccagtcaaagtggtagagaagtgaggcgagcacaatctccatgctgccccgcgcaaatgtcattccagggcacattctcctgccctgccccgaacggtatgtactcgaagtttgtgccctttgaggtcgaccattccggacttgaatctctccggcttgaactcctcaggatcctcccaatgcttaggatccctgccgatcgcccatgcattcaccaacaccgtggtgcccttgggtatgtcgtacccgagaattttgcaaggctccat

SEQ ID NO: 13740 - DNA, 563 bp, Triticum aestivum
  Clone ID: PAT_TA_13740
ttttttttttttttttttagagtttcagactggttttcaacacataatcacaatattacaccaaaccaacaagcgcaatgtcatcataaacgcaaagccttaaatatacaagttgtgatggatacacatagactgagtgtagctccttgcagcctcgccttcagaccttggtctaggggattattgtagtactgggacgctccagaataccggcatgcatgagcaaagcccagacgtgagtcacaaactcgcctccttccgcaagaagttctatgtgaccagctacattgttagatggggcgatatacaccatcatctcggcccagaaatcctgccactaggtcccaccggttcgcatgatggtccatgctctccagcgctttccccagcacagcaccataggtgaacaattttcttccaccacctacgacataccctagttcactaagcttttcatacttttcccttggggagacgaggtcatgtagcatttcttttgcttcttttaccatctcatcgagagcaactttgtttctggtgcactgcctggaagcacgttggtg

SEQ ID NO: 13741 - DNA, 650 bp, Triticum aestivum
  unsure (1)..(650): unsure at all n locations
  Clone ID: PAT_TA_13741
ttttttttgttggtttttttttctgcatccttctattctgatattcctgtattgggcactattacttcagtccttaactgggcattgcctgtctgccataacttgaatgtcggccgtgtctacacctaccaacactgccacaaccacttgtgtctgcagcgcagcctcctgctgcccgtgccacatttgctgaacggtctggcgcagcctgctggtgcccctggcaacttccctggtccctctcttcttggatatcgttccacggcctgcgtcccccggtagttccccgtagttgcccgcctggctcgtccgctgctctcctcggctctctcctccatcctctgccgctccgcctatgtgctcgcttccccgtccatggtcattctctcgctggaaagctctccctgttagcgctcatactcttgctgggatcctcgcgccgctagctccgtgagcatcaattttaacagtgtctggtctcaagcacattggcatatattccagggaacgacaagcacccttcttcatagactgacaatcgcnnngagaacttgtaaactactgggttgacaaggacaatttcctctccttcccctttcaccccagcnnnnttgaataccatgagctgcacgttcactccaacttgtgnn

SEQ ID NO: 13742 - DNA, 642 bp, Triticum aestivum
  Clone ID: PAT_TA_13742
tttttttttttttttttaggtttatgcttccaagcacagagagttggtcttgttctgctttggcaaaagccaatatttactacatagtaagtaacctgatatagttaaactgtacactgagatgtagaaacttaactctacagtctccggtgcaggctacaaaaaacttaaaatccctatgttctcttggtgatgaggctctacttcggttgcaatttcttttctgaactcctgctcgccttcagtgagtcacaaaagttccgtttgcgtcccgctgctccacttcccacagatctctttactaattgaccactatatccttgtctcggcccattattgttttctccttctcaatcaatgccctttgtcccttcgtaaccttgaatcaagttgtttagttccctacttccacctttcttcgaattttcagctttctggtattttgtccctttcttctgtagcttttgttaatcaagtcaggagcacaacttaattatctctactctcatatgtaactccagctccagcttatcattttagaaacaacaagtcagcacaactcaattatatgcactttcatatgtaattgtcaggaacgattcaactttgtaaagtaataaatcttacatattcatttcgtaa

SEQ ID NO: 13743 - DNA, 1946 bp, Triticum aestivum
  unsure (1)..(1946): unsure at all n locations
  Clone ID: PAT_TA_13743
gctcccgcccgatgcccccccacaccccaatcaacccgaccgtcccccctccccctcccccgccgcttccaccaccccaagccgggctccgatcgcagccacctcgccgccaccccggcacacgcgcacccggccgtgagccgccacctgcagctgcgcgcgccagccgtcacgcaaggaacttgttagcttccgatggaacgctaatcgaagcttgagatccgatggacttggatatttataataaaccggtcgagagctaggtgaactgaggtagacatgatagatcactaattggtgtccttgttaaggtggggggcgctagtagtattccaatcgaccgataatctatccgaagacggggtaagtgagtaacttacgtttggtctttcaaccattcaaaattctcggccaagcatggaaaccgtggtgggaatttaccttaatacccccaaatctgaaaagttacatcaatggtggggataatgaacgactcaaaattgtattgttttttttgttggggtggcgtgcgggtatggaagatgctctgtcagccttgttagatatcgatgaggacacataatgcttcggtgtttttgattgacatgggggaaaagtgtttgacaaattctgtgcaaaatatctacacagggcaagttctcaaaagtgaagtttatttagctggtgacctgggagctgctgtccatggagctttcttcagaatggatgagatgatgcggggtcaaagaggctggcgagaactacaggcacttggagataaaataaaccagtttactggcatgatagaagggctgatctggtctccgagaggcagtgattcaaatgatcgacatgatgattgggcttttgaggagggacctcactctgattttagcgggccaacctgcgggagtacagcctgtgttgcaatgataaggaatagtcaacttgttgtggcaaacgccggagattacccgctgtgttatctcaatgaaaggcctggcacggaatttatcaagagatcacaaaccgaagcttgattgggagatatggaatttaagcaaagcaggggctttgcctccatgaggaagcaaatatgggacttcaaatcctgacatcaatgttgtggatctttgcaatgaaggataaattctttgctcctgataagcaaatgttgacagcaaaccttgatgtaaacactgtcagagctttgtgatgatgatgactttcttgttttagcatgtgatggcatttgggactgcatgtcgagccgaacagctggtcgatttcatccataggagcacctaaaagaccgagagaagcctttcatgcagtgtgtgaaaaggtgctcgcatagatgcctggctcccatcaacattaggtggagaaggatgcgacaacatgacgtatgatcctagtgcagttccaagaagccaattgaccatggcaagaatgccagtgctggtgaacaatcagctgttggggataagaatgtaagtgctggtgaacaatcaacggccgaggataagaatgctagtgctagcgatcaatcagctgtcgaggacaagaatgctagtgctggtggacaatcagctgtcggggacaagaatgctagtgctggaggacaatcgcctggtgacatagaacagtccgcgaacgaggagaagaactcgtgatgtcatgtcgtagcctggtaaaccctgtgtactaaacaatgacttctgaatcctggtgtgatgtactgatgttgtagtgggttgagcatgcatggtgaagaaattcatgtgtaaatatcaaccgtgtgttgaattgttgatacaaccagtggatacccccatcagtgaggggggcacgctggttttttgtgctgtttctctgtaactaatcaaaaaagtcttgtctccgggcgaatcgnacagganaccagggacgtggnttcctggaaa

SEQ ID NO: 13744 - DNA, 724 bp, Triticum aestivum
  Clone ID: PAT_TA_13744
tttttttttttttttttatctgcaaagtaggtatataatataactaaaactgcccctctagacactgtattacaagcaaaagacatttgcattcaaatacatgaacatcgttcaaatggtcacatttcaagtgtattcgagttataatgcatccgacacacacacaaacacacacgccatcgtttatttgatcaccaaacccaaacatatataggtgcttagtagcacaacgtacaccgccctcatccacatctctggacacatactatagtagcttgagagagacaacgagacaatattttagaggtccgtccatggaagagccgagctgcttcttttctgatgaaaagaaagcgcagccaggcggcatccttaccagtttttgttccggcaatacggataatttgagcagcggcaatgactttggaagcaggcgccagtgtagcatgtctcccagccgcaaccggggtctcctcccccattaggcagtatgatgtgctccattggtatgtttggctttgctgtccatgcccccttctccggttcctcgagtaagcgggccatggccatcggagctgctgccatgagcacctgcagaaccaccaatgcagccaccacactgatgagtgctttcttcttggcaccctccatgctgtgcaagtgcaagcacaaccctctttctctttccctccccctctgtgtatgtctatgtgtgggtgtgttc

SEQ ID NO: 13745 - DNA, 708 bp, Triticum aestivum
  Clone ID: PAT_TA_13745
ttttttttttttttttttcttcgatccaaacaaatcctaaaagaccgatttccccaatgacgaagtcgaggtatacattggatcaatcttaattcgtccaggttaattagttctacagtctacatatatagtatgtgttttccatgtacatataaatagcattgtccaatctgcatgcaggaaccatctaatcatctatcgatgccaccgtttgtcgccgccggcaatgtttcgctgcttcctccccactcccttatcctcccttcggccaacatagcctgtttcttccacttggttctgaagcaaattatgagaagtacaacagtctgcagcagcgtgccaatggacatgcccgcccaaattcccagtgcgccaagtttaagcttgaagccaaagaggaatcccagtgggatgccaaccaagtagtagcatccaatgtttatgaaggcaacaagcgtctgccaccctgctcctatcaccacacctgtgagcacaggctggatgctgttgaggaagatggttgctgcaagaaggtagccgagcttggcagcctcgctcaccacctcctcgttgtcgctgaagaaccgcggcagctcagtcctccaggcgaggaacacggccaggaagactgcaccgatggcggcggacgttgacaccgcaatgatcaccgagaacctggccgctttggcttgttcgcacccagctcat

SEQ ID NO: 13746 - DNA, 453 bp, Triticum aestivum
  unsure (1)..(453): unsure at all n locations
  Clone ID: PAT_TA_13746
tttttttttttttttttgaaagtacgcaatcgcgtaccttagctttatagaaggcaaaaccgatgtacaagatagttattacagccgggccttagctgcacaccggagagccaacggacctggcaagctccactcctaaaatcataccctactactcacaaaatatttcgactccattcgctcctgcactcacccaagatctcaaaacgtcgaagacctgacttgtgaatgcacccaccgtcaagctagttctggctggtccgaataccaaaccgttacgatgcttccaaagatgccagcaaatgagcatgacaaccggagtccatccctctcctgttaaccttcgcggatgcacgcacgancttctanccaccaatcttcaatcntgtcngtanccccatggcttttttcaaaacaatttccaagtccaattggtttcctgggtacaacccc

SEQ ID NO: 13747 - DNA, 486 bp, Triticum aestivum
  Clone ID: PAT_TA_13747
ttttttttttttttttttggctagccaaatgaatgcagtgacatggtgcactcataacaatttattctattttcgaagtttggcacttgaataaagtaaggtggccgtcaggtatgtcccagaactcgaacctagacgggcaggagaagcgcggcattagcgcctcttcaggaatacccggttccactcacacatatcattattcataatagataggtgtaggtatgctgcggtaatctggtgtggtgtacttcagttaccaggctaatatcttctcttcagcagaaatatggcacgctgatgcggcttgtcgctgcctacttgtgccacacggcatatctgtctccacatgccgccagcttccactctgggtcgcttgggcaccaggggccctctccgatcttcatgcacaacttatcatcgattattgccgagtacagatttgagcttgcctccaaaattttgacagctgaacgactatgtatg

SEQ ID NO: 13748 - DNA, 1431 bp, Triticum aestivum
  Clone ID: PAT_TA_13748
aaacctatgctggaaatggtgcaagcagtaggacagatcagcttgctgcaagtccatatatggtgcagccagtgtttggaagctcaacaggaccattgcagaaatcatcctctaggtggaaccatcaagaggcttcgccacagggtgttgaacctgataggcatctagtcaaatcatatgccagtttgccatatccaaaagatgaaacactatccagacattcaatactaggaccgaatgggcttcatggccaatggacaaggcctgttagtggtgtcaaggtccagtatccaagttaccccgaactgacgtccggcaatatccctagtttaattccagcaatcttgaaccaaaatgactcacatggtcctaatacaacatcactggatggattgacaaataacaatggtgatatgcagtctgttctctcacttgatgatggtcaatggtctttaccagtaaaagagccagcctctgtgtctcctgctagtttcgaggaagaattctcgcagctgaatatcagacagcctaaccccccaccagtcctggcacaagtacatcctgagcgtagaccgatttctccatcaagagtagctgatccaagaccaggacttgctccctgtgacacagggcgttttcaaaatttgcatgtgccggtggcattaatggagtcttttctgagacttgctgaggcaaatactgcaaaaaatctggaaacatgtggcattcttgctggtaacctgaaaaagagaactttttatgtgacgacactgataattcctaagcaggaatcaacgtctgattcatgtcaagctacgaatgaagaggaaatatttgaagttcaggacaaaggctcacttttcacccttggttggattcatacacatccgacacagacctgctttctatcttccattgatcttcataatcattattcgtatcaggtcatgcttcctgaagcaattgcaattgtcatggcgcctaccgatacaacaaggaagcacggcatatttcacctcacggatccaggtggcatgggggtgatccacgattgccaggagactggtttccatcctcacgaggagcctcttgatggcacttcaatctacgagcattgctctcatgtgtacatgaaccccactgtgaagtttgatatggtcgacctccgtcgcgtgtgagcccgattctgattgaattaggcgtttatacatggtagataagaaacttgtaccttgctgcggaacataacaatgtacagtacatattggaattgattgctttacgagctcacgcgtcaagcgccctccctatttgcctctttggtaaccactacgcagagtgagttctcatgtcatttatttgtgcggggaacaaagagacattcacagttgatgatgctgcaaaaagagagaagcaaattaaactacagct

SEQ ID NO: 13749 - DNA, 401 bp, Triticum aestivum
  Clone ID: PAT_TA_13749
tttttttttttttttttttttttttttttttgtatcatgtttggaaataaaattaagtagattatcataggtgtgaaataaaattaagtggattatccaatcaaacatggagtggagatctttgtgcttcaagctaactcatgatcaacaacattagcttcatgtggacaatttcaaatgatacattcataaactctcttggcagcattcctcgtagatggtagcaaacataatctggatcaccttcatgaagtcatagtttacaatcggatagttgactttagggacccactaaaccttgtacatgtctgtggggcatctcattatacttgtggtgcaacaaatataatgccaagtgttcacggagtccttcggcgtcagaatcgttaaagaagatatgt

SEQ ID NO: 13750 - DNA, 1137 bp, Triticum aestivum
  Clone ID: PAT_TA_13750
ttttttttttttttttttttttttttttttttttaaaccaagattttactctttaccattgtagtatgtgataaatgagatatgtacatatactatacatactgcactagcgaaaatgttagggacaatgtacatctgcatacaacaaacaacaaacaacaacaacaacaaagcctttagtcccaaacaagttggggtaggctaaaggtacatctgcatacaacctgaaactaaaaacgtatttgttaatcttggacatcaggaggcactatcaaccccctcaacctctagtgctacttcattgcgccttgcgaacggaagtgtgaaagggggattatactgtgcaatttccaccactgaatcctctttcacccgatactgtgtatctttctggagagctttccgcaatctggattccctctggcttatgtcatcatctgtaaccaaacctggaaaggccgcaactgctacaattttgctgggcacctccttgatagtcacagacgggtcttttgcctgaggcaagtctggaccatattttgatggcatcacaaaagacatcttccacttgtttccatcagctgacttctttgttataactggggtggtcatgtccatcgtttcaccgcgaacttcctccttccgagtaaaaacaggggttgtcatttccatttgctcggagctcgtgttcttaccgaataagtaagacgccagcacgttgaacgactgagacgacccgctgaaatcaaacccagttcttccaggcatcgtcgtctcagcgacatagtacgactccacttgtctgatctcgtagtcctcctcacgcttcaggatgcggaacgggacggtctccaggtcgggaacggacatgagggcctcctcgaggttccgtggctcgaagcggccggaagggagggcgtacttggcggcctcggtgacgaggtcgacggcgcggcgctgcgaggcggcgagggcctgcgagacgagcgccagcaccagcgacccccgggcctcggcgccgctggttcgggttccggcggccacgaccgtcagcgcgggccgccggccgcggggacgctcagctcgggctcggacggcgcgcggcggtggccgcacggagggcaagcaggggaacgc

SEQ ID NO: 13751 - DNA, 774 bp, Triticum aestivum
  unsure (1)..(774): unsure at all n locations
  Clone ID: PAT_TA_13751
ttttttttttttttattttttttttttttttttttttgaaaaaaacatattccctntagtctcataatgtaagacgttttttacagacgttttttaacactgatgtagtgtcaaaaagtattttatattatgagacggagggagtacctgagaataatagatcctttaaaaagaaaagaaaaactccttgggagtagattttttttctccccttggaatagatggctggcacctacgagcgctcatatatgcattttcccggtgggccacaacgtataccggtgcaagtggcagtgggacacaacgttcacggggggctgtgggccacaatggttcagcgtgagcaagtggtagtctcccaccggataagccaccatgccacgtgtgtctggtgtgtgtgggtttggctgtgcgcgtgtcctctcatgggggcatccactcagtccagctttggacagaggagactggcgatttggatccgccgtagtgttgttctggccgtcttgggcgaggaggttccggccatcggtgctgctttccccggctgcttcttgggcagaggaggttccgcccgtcggtgctgcttttcccggctgcttcttgggcggaggaggttccggccgtcggcgctgctttccccggttgcttcttgggcggaggagggagctcggtccatctgttcacccagccgcctggatccataggggacatgtccacgattcaacgcccacccgacgttgtcaccaaggtaataaataatccattctaatccat

SEQ ID NO: 13752 - DNA, 600 bp, Triticum aestivum
  unsure (1)..(600): unsure at all n locations
  Clone ID: PAT_TA_13752
aatttntttttttgtacaattttttttttttttttttcctgatgatataaagtgtataactgtacaactgcacactgtaaattcaatacggtttatcaggcatgtatgtacacatgataaagattggtcttgtgctggtagcactgacactgaatatgcttgtgataatgcaactccggtgccctgcctggttgaaggtcaagggcaccaggttcgaaggcttctgatggagcaagttgggcatggcgatcgggtatcagacttgacgttgaggccctgcaggttccaggcgtccatgtactccatcctccactcttcccgtagctccgcagaatcgcggcaccactgcctgcagacgagggagcagctgaggaggtcgacgcagtccagctgcgagaagacccgggagatcacgtccgccggcgcccgcagcgcggccggcgtggcgaggtccccttcgttcggtggcggcggcggcggcgccatggccgatccgttgtcccaagaaagcccagttcttggattggctctagaaatcctggagctgttcgtctcgtcttctccgcgtttgattggtttgttcccttgcctttggatgct

SEQ ID NO: 13753 - DNA, 380 bp, Triticum aestivum
  Clone ID: PAT_TA_13753
ttttttttccttctgaacttaaatgcaaccgtcattataccccaaaattacaaatcactgttttctgcagcgataacaatctgaagaggcaccatttctgtttattcaaaaacaattttacagaaatggggaaaagccgacccttcgtttccaacaatggtagacatctacgtgagaactgcaagcacatttactaatctaagaggcaaatatggttctgggtctcaccatgaaatatgtgtgtgttcgatagcgatttcagttagattattgtggcggtggggcatttgcagctaaatgttctaaccgctgtggtgggagcggcggcggccactgtcgatcctgaggttgctgtgcctgctgcggtggtggccactgtg

SEQ ID NO: 13754 - DNA, 812 bp, Triticum aestivum
  Clone ID: PAT_TA_13754
ccactcgcggggaacgagcagcgaggccggagcttcactatggatttgaggatgcaactcgctggccaccatcaccgtccgcaatctgggctgcccatttgcgtctcgccatcttccttcccaatacttaacttagttctttgacagtctaatttcaattttgtcaatttatggtccgccgacgcgtgggcggacgcgtgggaagaagaggaagacgttggtgaaggagagggcagcacaaatgtacaccgctgtggccaggttattccatacgacacagccacaggtgatgtacatgaatgacggcagatggttgaggattgagggaatgtagatgcgactagcgagcacttactctgaggtgctttcagatgatggtttaataagactgtttggacaaaattctgatttttcaacacttgttccatgtgcgaatattctgggagcaccaactccaactgctgacaaggtgaagcttatgatcagtacaactttgtttgacatttggctgggctaaaaaaaatatcaatgggagctttggacggcccgattgcattagtgcctgtggttgtgaacgtgtaagcctgcatcctgtgatcttctctttgacggttcgactttgcttccatatctcctccttcggtcctccacagcctccatgaccattgtccgtgcacagccgccgtctgccgcagctttgtcaatcgtccttctcaggtgtcagcgatcttagccgtgaggagcgagcgacacaccgttcccgtcgacgccgtcgtccgtcggcatccggtattgctgtatgctatacatgt

SEQ ID NO: 13755 - DNA, 767 bp, Triticum aestivum
  unsure (1)..(767): unsure at all n locations
  Clone ID: PAT_TA_13755
gttgacttgtccttctcttgtgtcatgcccccggcctactcctccccgcgacaggggtgtctgttctcattaccccctgttcacgattttgtctcaactatagtcaagttgaagagcaatatttagataactaaaaacaacatgtgttgtcatgatgattgcaatgtatgattcaacaactatttccatcacaaaagcatggtcttcatgacccttctagtttgaactaggactgttgagttgcttggcgacgtgcttgagcccttaatagaaaaccaatgagggtatccatctcatgttgcttcttttgccatgcttcattcttctcttgctcgctcttcttcacagcttccatttcttcttgttgcttactctgcgtctcttcgcatgctctcgcttggtggcattattttagtaccgagtcacagcgccccttgcagtggcgacatgaggagggcacgatgagtaaatcactgagagacatcgcccattgcaggggagaagagagccgggtgctcgagtcggcttgatgcagtggcatccaagatcggcggtgcaatggcctcccttcaatctgaaaattgaatttcaagtccaaatcagaagtacgacttaattaaactacaaaagatccttttggtanatacctgaaccttacaaaaacacaatttangactggtatgccancaatgtgtgaagcctaacaattggactgtacatccaaataaaataacattgtactaaatataagccatcctgtgttccat

SEQ ID NO: 13756 - DNA, 931 bp, Triticum aestivum
  Clone ID: PAT_TA_13756
tttttttttttttttttttaatataatgaatagattacttatattttcagaaataatgtacaagccttcatcttgcgcatcacatgacaagataattagctaactgaccagattagtaaattcaaccaagacgagtttatctggtaaaatgaaatcaaatttacatttgcatattacataaattttgctctatataagctcagggatgaacttgatgaaattgaagacatattccatccatgaatagtaacatgtctgtttcattcgacattcttgtattatgttcctgagatggtcttgttaataactggtttgaaagtagacctcaagaaatgtttcataatagctgggcagaggatgaccgactcgttggggaaggccacacagcgggttcttactgtccttggtgacgtcgcagatgagctgctgctacctgttgccgaactgtccaggatgaatcgtgtggggagttcgccggcaccgcagaacgcggcatctccgtctgctgagcggcagcgatggtgcagggagggaatggagggggaagtgtatcttaagtgcttaacgcaaaactgaacattatactgtgaaaaccatgttagctttagagaggattttcctatgttacttttacatatataagcatcaagcactgcatgtttggtgctcccaaaatgatcgtgtgcatgatagaggtgtgctcctccttgccctcctgcttgctcctccccgcatatctagggacagacatggatagtctgtatgtagggcagaagcgtggaggctgtcttggacaatagcatccgaagacactggttgaacaggtctgcagccgacaacctgaccagaagtggtgaacagcgttgttcctccaggacgagatcgggagagccctatcgcctgtagagaatggacggaaccctcgtgcccg

SEQ ID NO: 13757 - DNA, 596 bp, Triticum aestivum
  Clone ID: PAT_TA_13757
tttttttttttttttttgaattgaaaggatgatagcgtcgtttattaatagaaataccaaaatgccgacatacaattctgaaattacaatatcatttaagaaattgagtcaaaagcactccttatatgaacaatgtacttgctcatatctaactggaaaacaggaaactagaaaagataataattattaatcttcaatcgaggcacatcatcgttatttgaatggatatcattcctcatcggcaattacaaagaaccttgatgcttctatatagcatgtagaaccatcagtcttgatcactagttttcacaagaactatcacttagagatcaaccagacagaagacacttaatttcggacacttcttgcaccacgccattgaacttttcttcgagtacttgtttcgcttgctcaaaagcttgaagtttagaaaccaattcagccttacttaatgctagtcctgacagatctcttgctttaattccaccgccaaagcgaagtggcatgtcccaaaatatttgttacttccaggtcattcttcctcaccaactacaatgccttctgatacttctatcacggtggaccatccgttcatg

SEQ ID NO: 13758 - DNA, 608 bp, Triticum aestivum
  unsure (1)..(608): unsure at all n locations
  Clone ID: PAT_TA_13758
cgtccgaaaagaaggaagccaaaaatcgcgagcacgaagaacggagatccgaatcgccgcgaaaggaggccccgatcgcttcgtccgcaagagccccgcccggaggatcgagagcgaacatagcggaggcctgaggaatggagtcgactcatagaatctgaagaaaataactcgaaagagccgtctccggtagaaatcccagaaacttatgtggattcaccaactctggaagtcagtagcaacggtggtcatgaaaatataaatgcaaacatggaaaactcagctcaagcagacacatcggatatctctaatggcctgccagtttcacactaaggttcagaaaatccagatatttctgatgaatcagagcctctggtggaatcaaatgccaatcacaaaaatatagatgcacagctctcaaattcagtaccagctgagaaatccaaactctcggtgaagggtcaggcagatcattcttattcagtacatcccgtccaggtgcaccatgttgaagacaaggcacgttttcaggcagagattgctgtaaaaccaaaagtgatggaagagtcagaagcaaaacctgaaagtccatataaaggtcttannnn

SEQ ID NO: 13759 - DNA, 788 bp, Triticum aestivum
  unsure (1)..(788): unsure at all n locations
  Clone ID: PAT_TA_13759
ttttttttttttttttttttttttttcgaaaaaactgcaatgttcttttttatagttacacaaatttattgtccaagtttacataaaaactcctcaaacaaaaatggaatcaaattcctaggttctgggtccagttccattgacccagccaaagccaaacgagctgcgaggtaaagcctattgagctgcacgcccgcccgcccactcgaaccacatttttctgcaaatcctggaatcccaacgccacccaagtgtactgcatgtgagatccccgtccgagtgacaaatgtcactctctgttggataggggagtacgccggtgaacagcataaccggaaccagtgtaccacacgtgccacgccggcaaactgcacgcccgcacggatgcgccggcccccatccagcgtcgtcccacacactggcggntaggagaggcgggtaggaggatgggtgaactgcaaaacaaaattagtgagcttcaaaaaattcaaaatgagctgcaactgttctgcacatccaaaatccaaaaggaaaagcaaaaaagcaaaacgcactgcacacggaaaccgcacgccgcactgatctgcactgcacgagctgcagcctcaccggcgatgcgcactacagttggaccgcacgaggcatcagatctccatccaaaatccaacaaaaaaacaacttatccctttctgaactgcatgggcgtcctagccgccgttgaacatcatcgcgcgctcctgggatcgctggttcttgcgtttttgtggaggttgagccctcgtgccgaa

SEQ ID NO: 13760 - DNA, 720 bp, Triticum aestivum
  Clone ID: PAT_TA_13760
ttttttttttttttttttaatacaagccatttcaacacaagatctggaactaaataaacttagtgcatatatccagttaaagaggtgtgaaacagactaaaggaaaagcatacggaaattctagagctagggctgtcactttagacaaggagaaaagggtggattcagatagcaactaatagccctccattggtgcaaccaaaatgaggtgccggtaaaccaagatcccaacagcactttcaggctatttggtgcgatgacgccatatgatccttgcgcgccaacattcgcaatgacctgcctcctatggctggccacccggtggtgattgctgcgggttaaatcattttacacttcactaatgttaaacaaaatgctgggaaagtaaaggtttagaacatggggattaacataatttgtattcatatagcatgagctcttctagcacgatgcgacgaggacaggtcacctggtcaactcttctacgtggttttacaagtaatgagtaaatgatttcctgcatagcaggctcactactacaaaaaggcatagctttgcatgctcaagttctcaactacgaccatgcctacagtcagacctaagtcatttcctatccttgaacaaatgaccgacccctgattatgaggatagtgcctctattaccatggacgtatatgaccggtagttctatcgcacaggcgatatctgttttctcgcatt

SEQ ID NO: 13761 - DNA, 297 bp, Triticum aestivum
  unsure (1)..(297): unsure at all n locations
  Clone ID: PAT_TA_13761
tttttttttttttttttttacagaaattctctattacagaaattctctattcatgaactaacaatatttattcgtgtggactagagaaacgagaacaaaagtacacacgggaactaatgatagaatacacactngaagagaaaagaatttcttctctgtcaactgacgatagaatacacaaatatttgtattctatcatcaggttttttcatggncaaacagtacaagaatgactaggaaaaaaagaaaaatggggaatttagtggccaaaatcactgtaataaccctcgtgccgaa

SEQ ID NO: 13762 - DNA, 642 bp, Triticum aestivum
  unsure (1)..(642): unsure at all n locations
  Clone ID: PAT_TA_13762
aatccaagcgtcgacccctcccgccggcacacaccaggagcatggcgggggcgcgaggaaccaaccgtcgccggcgccgccctgcagctcctctctccctctgaccctctccgtacccatcccccagctccctccgtgcgccgccctcctcctccctgggctcgtggctgggcagcccgacgccctcactcccgctcgtcgacgcctagctggccgcccgacgcctcggctccggcgccaacaagcccaacggcgcagcaccggtcagagggatccgccccagctcgtcccggatcagttcgtcggcctccccttctcacctagctcgtccatctgctcgagttcgtcccggatcagcctgacggcggcgctccattgcttggcaccgaccggaccagctcgcggcctcccctgcaacctcgccttcgagtggctcctctgcctccaaccctccagtacatctccggcggcaaaattccccttcccggtccaaggagagcaacttcgagaaggaggcggcgagggcgagcagggagcggaagagatggagaacggcggcagcaaaggcaacccgcggagcacacaccccccccctgacccatcgccaattcggaggangggggaaagccnatcctnccccgg

SEQ ID NO: 13763 - DNA, 942 bp, Triticum aestivum
  Clone ID: PAT_TA_13763
ttttttttgattaaattgagtgtttcattcacatctttacctgtctttttttctctgtccttatctacaaactgaacaaaaccattaacattaatcagtataacagcgataggttctgtaacatggcatggaacacaggttaagctcgcacaaaatcaaacttagggtctcagccatttgaggcgctcatttgcaagaaacaaggttggttgtatacaatttccaaaattatggggataggactgttgagcaaagtagcctccattgtctttcccatcaagagtaaaagtggcactttccaggcccggcacataccgtacactcatcgactccacctgcagcgtgcctcaggcagtatttgatgcgatcgctcataatatccaccataagctcatgtaatccaagaggagccgtgatgatgtagggtacgcttgagtgctctttagaggcttctgatgctaaagaagggatatcttgcttccagtgttgcccaggggaaaggaaatatggactgacaataacgcgagatgctccctgctgcacacattttccctccgcttccttaatagtaggctcagccagctccatgtgagcaggctcaacaatcttgtagcaagtcctggccttgaacatgctaacaaaatcatgtagcatgagattagattcttgtcgacgtgacccgtgatcaactatgatcacaccatcattctctcccactacacaatcatgtcctacagaagtttcaggcctagacacagaatttggtctgaaatttgtggcccaatgtccactacttcttccaattggcaccaactttataaaaccacggtcataattcgcactagtgctccttaaagaatatttgtttattgaatttgcagtgaagggttgtaaggagagcgacatagggtgcatagacatattggagccctcgtgccgaat

SEQ ID NO: 13764 - DNA, 556 bp, Triticum aestivum
  unsure (1)..(556): unsure at all n locations
  Clone ID: PAT_TA_13764
ggnaaggtcaaggatcaagaaaatggaagcttgaccagagtgatgggttctttgtacaatttgaatcaccaattttacggaagatatggtttgttgctagcacaacagagaagggacgagcattgtgcaggagccctgagcccttggacattaccatccacgagatccttcctcgtatattcaaagagaacgaagctactgcttgatatctttccaaagcagatgcacagtcgacgacgtcttcttgattctactacccctgactgcgtgatccgtattggcggtttatggtcgacacaaactacacaggaagaactgaaatgccatatatcttgtaaaccgacgaccctgtgttggtgtcgtgtacacccaggcactccaattttgttgctgtgtggtttttcgctgtatgcggtgtatacaagctttggtggggttatgctggttgcatttctttgatttgtagaaggaaaagatatgttggagtataacactagatgcttgtgctcagattttattttgtggttttggctggccccggtctggtatgatgttg

SEQ ID NO: 13765 - DNA, 1372 bp, Triticum aestivum
  Clone ID: PAT_TA_13765
acggacacgatggcggcgcccacctcctccgcggcatccaccctcgcccccgtccgcccacgcgtccgcctaacccctgtaaccctcggcggcggcggcggtggcgatggcggacggaggcggtggacgggcggcggagctgaaggaccaggggaacgagcacttcaagtcggggaactacctcaaggccgccgcgctctacacgcaggccatcaagctcgactccgacaaccccaccctctacagcaaccgagctgctgcatttctgcagctggttaagcttaataaggcacttgctgatgctgagacgacaataaaactgaaaccagaatgggagaagggttatttcaggaaaggatgtgttttggaggccatggagcagtatgaggaggcaatatctgcttttcaaatagctttgcagcacaatccacaaaatacagaagtcgcgagaaagatcaagaggcttactcagttagcaagggaacagaagcgagctgttgatgtggagaacctgcgttccaatattgacatcgggaagaacttgcagtcattgaaaaaggagctggttacaaagtatggagatgcagaaatgggacaaaatatattctcatttgttatcagtgtgattgaatcagcgataaaggtttggcatgacacaggaaaggtggatgctaaggtcaattttcttcttgatgatcagaagactgacactgaaaaatatgccccagtggttaacattgagaaggcctttgagtcaccccatacccatggcagttgcttcgcatatttgcggcaatactctgaggagtctttttcaaaggctgcctgtatggtagcacctaagagcatcatctcctatccacaggtctggaaaggtcaaggatcaagaaaatggaagcttgaccagagtgatgggttctttgtacaatttgaatcaccaattttacggaagatatggtttgttgctagcacagcagagaagggacgagcattgtgcaggagccctgagcccttggacattaccatccacgagatccttcctcgtatattcaaagagaacgaaaccagtgcttgaacgacaggtgcaccgtcgacgagatcttgattccaccacccctgactgcgtgatctgtattgctcacggtggtttacggttgagaagggggcaggtattttctcacacaggaagaagtgaatgccatatatcttgtaaaccgacgatccctgtgtcggtgttttgtacacccaggcactccaattttgttgctgtgtggtttttgctgtatgcagtgtatacaggatatgctggggttatatgctagtagttgcctctctttcgttcgtgaaaagatttatattccaggatgcattg

SEQ ID NO: 13766 - DNA, 656 bp, Triticum aestivum
  Clone ID: PAT_TA_13766
aggttggattcagcatcatgtatttctctggctgagagaggactgcgcacacttctggacagcgtgaagaagaacagcttcagtgatccaggcagcccagtgatctctagaaaatcacaaatcatcgaccagtttcttctcgtccgcccacgcgtccggcggtgtttgtcatacttacttgatgaacgcaccgttaggattgtgtctggatctagttttatctttagtgctcccaaggagcagtggatgaaggtgtttgaaccattaacagtttctgcagattcttgtcagagtggcctcgttgaagtcatggagatatgcttgctgggtttggtttcaaggcgatgggacacattgatagagagctttgtgtcgcatatttttagttcccttcctatatccaagcagtatgctgatctgcaccagttgcttcagggaacttatcggggtgaatgcccagacaagattcgtaatttgaaggaaaatgacattcttgagtatgcaaggcaatcattggaaagtgaaccgcacatattatggcttctgcctccagttcttactgctgcagcaattccgccacggtcgagcttgtttgaaatataccttgctgaaatagattagcaatttgatgaagctgttttcacagaaccgaaatg

SEQ ID NO: 13767 - DNA, 801 bp, Triticum aestivum
  Clone ID: PAT_TA_13767
ttttttttttgttttgaaccaaacatattgaaaattacaacagatttggattgactcggcctacatcaggtgattgatgacagaaatgaaacatgcttaatcccaagctatagggactacaactactccctctataaattaatataggatcgtttaaatccctatttaaacgatcttatatattagtttaagaagggagtttttgttattatcaaccaaagatgcatacactagcaaattacattaagatcatgatgcttagctacgtggtgctgatatatatgcttaattatgcatgattgtgggggtaactaaacatgcggttaattacatgcacttatcgtacatgcagcacggcataataactcttaatgcgggtttcgtggatcatggcggccgttggccccggaccccgggtagtcctctgtctgcaggtccaccctcctggccaacatctcctcgtcgtccctcagcagtagatgcatctctcctccgaccgccacctcctccgccgtcgtcggcgtcgcctgcccaccatcgtcggacacggcggcggctgccgctccctccctcggcaggaacatcttgcggttgccgccggccccggccaccgccgcgtgggcgaggaaggagcaggagaggaaggccagcagcaccaggaggagaggaaccgagcagttcgccctccccatcttcaccagacgcaggtcgaccaattaatggaccgagaagcttatcacttgtcagcaagcagcttggcggtttttggcaagcactggtattgcggctcgtgccgtcgag

SEQ ID NO: 13768 - DNA, 791 bp, Triticum aestivum
  unsure (1)..(791): unsure at all n locations
  Clone ID: PAT_TA_13768
ttnattttttgggaagaactcgcccccctagtcacgacgggccccgtgggttcttcttcacaacacctttcaaactgattccaaacggttcacctaccgagcacggctcatccggctggcagcgcggtctaaaaaccatccgttcggacccccgatgggcgatcagttatcccgagtcaactgccctccccgcccccataagcatgccttgaaggccaccacttgaaagatcaagtgcaacgtccatgtccattggtcttctggccgcaagctgaatcttgtgaccaactacacaacttccccagctaaagcgacctgccagccaaattcaacaaagtcccatgctgcacacatccttcttatgtgcagggcgtccatgagataataatgccgcaatcgatcgaggatattgcttgtgcttggaggaagctcctgatgtgctcgggccctactctggatctctgacggtctcatacttttgtgataccatgagcaacgacgagaactcggtaccacaaattatgtcatgactgagtggatgggctgcacaggaaagcaccctttcggataagggaataaacttgttttctgcaggttgattttcctcggagccttttgtttcctcattgtagtccacatggcatgtggagcttgtatctggatgaaaatccagtgcatatattccattattggaggaagatccgactgcataaattgaagatgtcgacagccaggtggctttccgcttatgcaacacagagtccacgccctccaaccaagcaggaggaggg

SEQ ID NO: 13769 - DNA, 854 bp, Triticum aestivum
  Clone ID: PAT_TA_13769
gcacgaggcgtccgcctacctcgacgaccgccgccgcgcgcggctccgggatcggagacctttcgcccggcagcctcgcggcgaccgcggggtggggcggacgcggtcatggaggactacccggaggagctgcggacgccgccggtgtcgctggtgtccatcgtggggtgcccggagatgcactccacgatctcggcggcgctcagctcccagcagccgcccatgaacacgctggccctcccggacttcgccaaggccaacatcctctcccgcaccgccaagagccgcgacccgctcgcgccgccgcaggccgccacggggatcctcaagaaggactggctcctcaagccgtccgcgcgggtgcccgccgccgtcgccgccatgttccgggccgatcaggtcaccggcgaccccgcccagtggctccaggcctgctccgatctcgagaacctcaagtctataatccagggaagacatactaaattggtggtgatccttgtacagactcaagctggtgatgagctgggtgaggaagttatggttgccctgagaaaacgtgcggagattgattctaagcacctgattgtgttggttgagagtgatgaagcagaacggaacgcatctctcctcaaattgaggactatttttgcggagctgtgttccacatactataagggggaagggcgaaggataaaagcccgcattgagaagaggaacttctcttctgtggagctgagtgtccgctactgcttcaaggttgctgtttatgcggagtttaggcgggattggccagaagcattgaagttctacgaggaaggagttcgtgttttgcgtgagatgattgggacttcaac

SEQ ID NO: 13770 - DNA, 719 bp, Triticum aestivum
  unsure (1)..(719): unsure at all n locations
  Clone ID: PAT_TA_13770
tttttttttttttttttaacaacaagggctagccatcttcccatttttgcacttggaactaaatatacaacaacagcgcaacctatcaacataaacacaaaaattcaccacanagaaattcaacacacaaacacggatcaatcatccagctggtcattcgtggtcgagatcgaccacagactcttgaacattgctgccgactggagggagaagtccgacacgatgcggaacagctccggcaggtttgtccgtaggaggctcagggatttctccctcaccaccttgcattgcttcgtgtatgcctcctccagttctttcagtgaattctccagcttctccatggccgccttccgctccgcgagcgggtcggcgcgcgtcccgtcgggattgccggcctcaggaggaattcctgctctcttctccatgtacttccgcgcccagtcctcgaactgtctgctcttcctctcatgctccttcctcgtgtcctgaatcctttgcctcagctttatttcctcgtcctggtgcaccaggattatgtgtaccaccctccgaaaatgtgtgtatggccttcctagcatcctcgtcggggagcttcccgaggatatcgtgccaagcatggagaagcctcttgatgggaggcgtcgtctcgactggctgcgacgagttggacttcaggttggtatcaatggggatcacattcagcttgatccagctgtaga

SEQ ID NO: 13771 - DNA, 574 bp, Triticum aestivum
  Clone ID: PAT_TA_13771
ttttttttttttttttaaacgtaaagatcatctttatgaatttagtattattgcaaatgttcaaaccaaattgaggcttaactaataaaagtagattagatgggttaaaaaaataccaaacattatctggaattatcatcactatcacaaagtggaggtttgcctcaggatcactgactcatgtagcaagagttatttaaaggattcctccatacagcaacatactatttcttcacaagcttccaacatggtcggttacgaggtcctccatctctgagatatctttatcatcaaccagccgtgtatgaggtacattgctaaaccacacctctagttcacataactacattacagagattctcgtacatggatgttgagttggcccttcctctcggaggggattgcgatttgatgcatcttaataataaaggaaagtcagagtggttagatatactatgcagataatcaaagatcgaacctgtattcaagaaaacacatccagatatttaaacatttagatcagcatcaaagaaaactgaaaagtgtctagcatctcgaaagcagagagaagaaa

SEQ ID NO: 13772 - DNA, 603 bp, Triticum aestivum
  Clone ID: PAT_TA_13772
tttttttttttttttttttggtagcatcaagtcagcaaccgtccaggctcaagctccggttaaccggtgcagagtcaaataaagcgtttgcaaacatgaaacatatctatagtggtggtagcaatcaatccaccaattgtgttgtttcttcacgtaaagaactaccatacatgtggtcaatgttgtaacaaaagaataacggaagtggttgttgttacagtgtcgcgtggacggctaagcttacaacaaagcctaccaaggcaccgaccgtgacctgcgcttccgtgtgggccgacggactccgctcagccggttatactcctctgtcaactcagttagctctggctctgagctttggagggagttccatctcggcgatctggtcgcatccgtgcgcgcccaggaaggcgcggcgtttgaacactgcgacatagatgcgtcccgaggaacggagacaagctccgtggccatctcgcggtttgcagggaggggttcagaggtggaattcacctggccaccaccgtcctcctgaacttgagtcgtcgtatgctcccgtagggtccatagcttgttcaaaagcccttgcgtgcttgcccacctctc

SEQ ID NO: 13773 - DNA, 1210 bp, Triticum aestivum
  Clone ID: PAT_TA_13773
tagcgtggtcgcggccgaggtggagatatcagttgatcagcatactaaagccgattcctcggttcctcaactatcacgtccgcaagaaccttccactagcactcctagtgtccgtgaggtcttacctgccactggaccttccaaagatgccgataacatatctaactgcagtgagagaaggaatgttgtcaaaattagggttaggcgtagtgcatcatccagtaaagcagatggtgctgatcaccaagatcattcacatggtggaagaaatgaaaacgaagcgggtccttgtagttctatgtctgtggatgcccctatggttggagcgccaaatgagccaccgaccacaagtaatcataatattgaggagcagaactcatgtcatgaccgtgaatcaaggatgtccgcaagcgtgagcaacgccaaagtaatggacacgtatgaaatctccaaggaactgcagtgtacagccgattcaaggatagatgctgctgattcaaggctagatgtggttcccaaggatgagttctctcctgtcgtcaatgtgcgggaagatgtggataagcctggcagtcagcttgaaagagtatccaccagctacgttggaacccaagctccagactccgtcaatgggctgcactctaaagagaagaagagaaaggacaagaaagataagaagcgcaaccgagatgaaaaacgagacaagaaagatgaccctgagtacctggcaaagaagcgcctcaagaaagagaagaaaaagatggagaaagagttggctcgaaagcagaaggaaggtgacagagcttctcagcaagacatagtagtgaaaccctccgactcgcaaggaactgtggcagcaacgccaccggctccagagcaaagtgccgagccccaggtttcgaacaaggatgctgcagtagacacggcacggacgctgacgccgccgccgaccaagaaaataaagataaaattcaagcccttgaagaagataggctaataagcggagttgtaagttatcctacctagatggtcctcactccactatttgtgaggattgaattgctgtgcagtagaaaagaaacaggcgagcggtagattgtacgatgagcggccagattttttttttttgtgaatggctaatgtatcttgtaaaacaacaactgccccagtaattctggggagtaattcagatgaagctgtaggggtgggc

SEQ ID NO: 13774 - DNA, 487 bp, Triticum aestivum
  Clone ID: PAT_TA_13774
ctcaatcaaagggctgccttacaaaattatggaacaatactaaaaatggttgcatgcatacatcgacgcaaaggccaaatgcatttttggctcttatcgaagaaaaaacaatgatggtatcattcatggcaaggactgctagaccctctcagtgtgtggttgatgtctctgcttgtcagttcaatcctattactactagctagctagttactcagaacggtcgaaccttttttaccttggcgctaactccgtcaaggtgtgcgaagcaacgaccatggatgtggagtggctgtccttgttgtccctgaggacgtagcccggcgccgtgagctctttctccctcaaccggacatcctccctctccagcatctccagcacccgcggcatcgacggccgccgcagcggcgtcgcctgagtgcacagcagcgccaccttcatgtacttcacagcctcttcctcgctgcacccgtcttccatcgccgggtcg

SEQ ID NO: 13775 - DNA, 211 bp, Triticum aestivum
  Clone ID: PAT_TA_13775
gacatcatccaaattttgtaattcctcgcaaaaaaagtttgtaattattttctctactgaaataagtagatttactgaagattaaaaaacaccagtacggagtacaacaagtggatttacaggtacttccttcgttcggaattacttgtttcggaaatggatgtatctaaaactaaaatgtgtctatatacattcatttctgcgacagcct

SEQ ID NO: 13776 - DNA, 591 bp, Triticum aestivum
  Clone ID: PAT_TA_13776
gactgaaaatgaacgcttccatggagaaggcacgattaactcctcgatggtaatgtcgatgtacatgtagaaagtacaaggaacctggtaaacggcctcctcttcatgatctcagagtttctaactgaaccaagtggtcagaaagaaggcagacctatcatctatgtaccttattgtccgattttctgtagggaaacaacttatagaatgcacctaaccgctctggaatgaaaagagtacagagccgtaccacatgaactctcaagcaggggttcttccaacattcagattacaagaagtgttcaagggctatttactaatcatatcgtatcgttggtgtccgtccatcatcacgtgcccgcaaccgccaaagcataggtgtcaaacaatgacttgtactcttcgttctcagcacaccctctacttctgagtaaactcattaacctgtcgacactctccgtgtcgttcttctccttgaaatatgccaggagactctcaacattggttggtcttggtctccatttactagcacttttaactgcagtggctttctccaaacatgacagagattcagcaaactgattgtccttc

SEQ ID NO: 13777 - DNA, 891 bp, Triticum aestivum
  Clone ID: PAT_TA_13777
cgtccgcggcgccgccccctctccgttaaccgtcccatcgagcgccgccgctctggttcctcgccgtcgcgcaccgccctcctatccacctccaccatacgctgccggccccgttacccctgctcacaaccgtatccagaggactccttcgcgggcgccgcggtctgtcctccgggagcggatcgaaggcggcgaacgagcggggaagcggcggccggaggagatgctcaagttcctgtcgagggtggtggtggagtacaaccctttggacccgcgcaaggcggcggccgtggagctcctcgcgcagtgcaacggccgcaaggccaaggactccaaccccacctgctccgtcgagctgcggcgcctgccctccccggccgcggccgacgaccccaaggcccagccgcccccgcgcgtcctcgtcacctacctcaacggcgccgaggaggccttcgtcgccgccgacggcgccaccgcgcagggcatgcgcgaccagatcctcgcccgcggccgcctcctcgagaccgagcagctcttccgcgaggccggggagaagtggcccgtcgtcatccccgaggaggagctcggcatgtcattccccggtatcaagccaaagaaagccgaggagaagccccaggcttcgtgatcaaggcagagctctttcagtctggtgtggttaactagcagtacatctgttctctcgcatttgggagcttgtcttcattgactagttcaggttcagggcatgtcccttgttcgtttctcttttctcggaacatgctatgctgagtagcccatttggtgttgattttacaaccctgttctagaacgatcaactgtgaaccaatttattcagaataatttgctcgggccccaaaaaaaaaaaaaaaa

SEQ ID NO: 13778 - DNA, 705 bp, Triticum aestivum
  unsure (1)..(705): unsure at all n locations
  Clone ID: PAT_TA_13778
acacattattcagttntcattcataatcgcgtccattagaaatacacaacaaactaaaattttccatcaaaaggaactgcataacattgcagacgatgggctttgacgctgtataattcaatttgcttccttattatgatacagatcaccaaaatatacacactgggactcttctaagatatcatagctacacagatgaccaaaattaaaagatatcatgcatacacataattcagtcctcatccataatctctccaatccatgcatcctccaagtaatgagaaggaaccaagtagcttatgacacaggttgagtttaaaaagaatctctccaatcttgcagctacacatctgtccgtctctcggggcccccaaagcgtctgagagccttcctttacagcccgaaggtttagcattctcgttgctgtggacctgcctgccggagcgggagagcttacggatgtatactgcagtgcttgttagatccatctcggtcccgcgccccgccccgttgataggttcataggaaagttgaagttagttggtgtgtataaggaaagtgcatcatgacataggaaaatatgtaaattagctcgcaccactctttgccctggagtagcacatgtgttgtttatttgactgacatacttaagaagatagacctgatgtggagacggtgtcaaattcaattgcataacactactga

SEQ ID NO: 13779 - DNA, 478 bp, Triticum aestivum
  Clone ID: PAT_TA_13779
tttttttttttctctcttctaatgcaagcgaacttccatacaagtcattgtacatggttacaaatatatcagttctctatgatcacagacctctagaactctgtggtacgaaaaaggcaaagcctcgtaaccaaatcttctgttgttagcacacgagaaaaggtggaacaaaatcaaaggctacagataaactagatgaaagagggagcagcaacgcatgcaaaattctgaatagtatcttggaccagttactcctgttggaattagacctctttttttcagggttgctgctagtatacggatattctgagacagcaacagccatcagatgcaaatagatttcgactgtatcatggaaaccgacgcgatgttctgattcgggtaatcattcatttgtaccatccagtaagcatgtatctcagccaaaagcagaataggcatgacacagcctgaaatataagaagccttatgcaaaggg

SEQ ID NO: 13780 - DNA, 632 bp, Triticum aestivum
  Clone ID: PAT_TA_13780
cgtccgctcctccccccaccccgcgtccaaaaccctagaaacctcagggaaaggagggcgcgtgtctgggtgggcggcaatggagaagctggatgagagcaagttcgagcagcagctgcagctctgggcgctccgcatcccccgggagctcgcctccgccgtcactcgtctgcttcgctccgggcccctactggacatgccgcgggtcaagcctgtagttgaggaccctgggagtgacaagaacagactcgtggtgctgtcggagaagattcagaaccaagatttgtccgacattccggagcaggtttacaattccttgaagcaactgtgcagtgttgatgttgtaccttacatgttgactcttggttattcttactggagtgctgatcatattctgaagcaaatattgcctgaaggagtagaggtgccctcttcttttgaaacaattggtcatgttgctcacttaaacatacctgatgacttgctagcatacaaagatgtcatagcaaaggttatctatgataaaaatcatccaaggattcaaacagtggtgaataaagttggggcaatttcaaatgaatttagagttccaaagtttgagattctagcagggaaaaaggatatggtgactg

SEQ ID NO: 13781 - DNA, 563 bp, Triticum aestivum
  Clone ID: PAT_TA_13781
ttttttttttttttttttgaagagatgcggcataatctatatatcatcagggggtaatttgatgtcatgttacatagaatcttatcaccggggatcagaagaagcaaaaaacaaccccatccaaaccgtgttaatttacatgcagctacagaacagtaactgactagtgattttcaagctatgatctagactcactcacaggctcatggcacaacacaatagatatgagccgaatgttacaacacagtgaaaactacggcagccaaaagctgcaggatggatcaccaaaacaccaaaatcttggctgtaaaacaggagaaaaagaaacacagccggggaggaaagaataaccgctgatcatctcccgcatttagctgctatgaatccaaatatattcacaaccaggaaggagaggaatcaagcattgatttccgcattgcactgctgctccctctgacagcttctgcgactccagaacatgcctgagcaggtggtccggtcaacgtcctgctctcccctcttatccagctctgtgcttgtgctgtgcggtcgacgcggccgcg

SEQ ID NO: 13782 - DNA, 944 bp, Triticum aestivum
  Clone ID: PAT_TA_13782
tttttttttttttttttttttggcaaaggaacaaacataacattcttattgagcttatatagtttcgcctattctttccatcaccattgccgggaaaccttattacataagcatactactagaactatccatttcggtcccgggctttcggcgttatgggggcaggactctctaggcaccgccaaccatgacccttcggcggtggtgctcccgctgcttcccctttgaacggagatcacgatgacggaaacgtcatcattggtacctccctcctttcgtcatgggatatgttgagcagttcatggtagtccaggaccggccttcccttgcagcccgaagtaacacttctcggacgagatgctcagcaggattgcccttgggatacgcagctgtgaacatctctacctcatcaaccacctctttgttggtgaaatacttgatagagcccgtcggacgacaacaccaggaacttgtcgtttggaccgatacggtggtggtgcagtgatgggatgcaattgatgtaggggcccttgcctgatgtaatcaatcttgaagcaccctaacaacatactgttccactttggctccttcaggtagccagccccgaatgctctggtgacgttgagtttccccttcactcttgccgtggatgatggcgttgcgatcattatgttcggccttgatcctctttacctcctcctcaacggaggtactgtgttcagcgttgagctgcacggactgtaggccatccatgatctcggccttcaactgctgcagatccttctctgtcgccttgccgaggatgttatcaagattgggctccggccttctcgccaacacggcacgactgttcccgacattcatcacatacacgttctcgcccttcatcagcatcactagtacgcatgaccccatcagcccaatctccgggttgtcggccgcac

SEQ ID NO: 13783 - DNA, 458 bp, Triticum aestivum
  Clone ID: PAT_TA_13783
ttttttttttttttttttccggcgagcatttgatagctccggtggttcttcttccggacgcctcggcttgccgatgcacgtccgaatcgagaggaacggcgcgcccttgcggcggcgtgattactttgcccttttgcccctcttgttcttttagggttagggttcatgggagagggaaaactttttgtgatttctgtgtatttgcttttaatttgatctctacccgaaaaccgatgccttctcctcccccccgataccattgttgtaatctatagatcgtgtaggctagggatacgggatagatcgatctgtacatacacttctccttggctcgaggaggccgccgtgtcggtcatggtggcgagtgggcggcggcggcggtgaggaggcagtggcggcggcggagcttcccatcgcttcagtgcctcctctggatcggatagagttaggagtgggga

SEQ ID NO: 13784 - DNA, 560 bp, Triticum aestivum
  Clone ID: PAT_TA_13784
tttttttttttttttttacgtgtacatagtacattaattgtagatactgttttgtttttttttacacaaaaagatagcagtattttgcgacgagatacaagaaactacgcgcgcgtgtacagtgtactgtacatacacaaactcgccacccgacgtggtcaccacgcgacaactcgcaaagcctctctgactgtctctcctcccttctacagcatcttgtagttcatcacggcgaggagcacggcccaggcgacgcacggcttggcgaggtcgccggcgacggggttcacgccgccgaacccgcggacgcacgcggcggcgccggcggccatggcggcgcagcacgccatcccggcccacccggccccgagcctgagcgccagcgccggccacgccgcggccgccaggagctgcgccgcgaacggcgccagcgtcgcgccgggccgcccgtgaagcccgccctccgcccacaccatccacgccgccagcgccatcacggcctccgccgccaccgaccctgcccgcgcgatcgccaccatcgcggacgacggcgccttggc

SEQ ID NO: 13785 - DNA, 713 bp, Triticum aestivum
  Clone ID: PAT_TA_13785
ttttttttttttttatttttttttttttttttgaccgtaaaattcataaactctaaattatgtggaatcattaggaaatatcatgaattcctaagctccagaaagctcagaatcgtacattgcagggacaagattgtaacacaatgggtcaactcatctgcctggcctggctgcggcccgtctgcctttgtaccttccgccacctagtaatattgtacactgattgatacacgtcagttcatccattctcagcgaagaggtgcacgtttctgcgaggatcgtccgctccctgtgatcgtcaaggtgctccgatgaaccctccactaacagttcttttcagggcatcaacatagggtaaaatcctctcaacatcaggtccataataaagcgagaatatcgcctctgcctgggcgaatgtagctgctgcgcttgccctgtcccccagagacagctcgatggaaacaagcttgatcagctcatgtgcaatggctatgtgtttggggtggtacagcttcttgaggatcataattgatgcttcgcagtgctttcttgcttgttcttgatctcctatctttgcaaaggcttctgcaatcgcatcttctgcctgggcaagagccttgctatatgggtgcctcaacttctttatctgttgtagggattgtaatgcatctgtgatgggaatttcggagattccgtctataactgcaagttcc

SEQ ID NO: 13786 - DNA, 490 bp, Triticum aestivum
  Clone ID: PAT_TA_13786
tttttttgttttttttttttttttgtggtgaacacgggaaaatattgattattaagtagatccatcagaacaaaatgcaccgagggcattggcagaacacccaagggcaaccctccgatacgatatgtaccactaccaacagaaaaatgcatccaaagatgcagctgagtaagttgtgctaaaaggaaaagcacgaaaactaaaactgcattggctaactagtaatctcacatttgcaaacagggcacagtttctttcttctcagccattcgtcgatgcactctttgtggaacttgtgaaagcatggcaaagtgcggatggtatctccgaaagatggattttcaaggcagactgtgcaaggctcttcggtgctagttgactgaaatactgactgaggcaagttattgatctgactttccgacgcaccagtatgctggtggttattttcatctaacgcaagtagcgcatcataatcatttaaatcaatatt

SEQ ID NO: 13787 - DNA, 983 bp, Triticum aestivum
  Clone ID: PAT_TA_13787
tttttttttctgggcctctttgttgcgggttatatcactagtacgtaatactggtctttaggcaacaggttaaataacactggtcttttcagtactgcactaaaatgtactcaaggacaaggtaggtgaaagctgaaacattcatgtatgctaatggtagttgaaaacttgaaatgtgccctatctcaagaaaatgcatacctacaaacatgtgtttcccaaaaggctcggatcaatcatgtgaacatatagcgaactaaaccgtgcgttcagcaacgaagaaaagggtcgtcgatggtaaggtccagtgctttctgcaagttccaagcaccgtccactttgggcgacaccagcaacactttagaggcccatgcttgaaactgaggacacctgcatctgtctataatctcattcacctccaccgctgaagtaaatttttcgtcgaacggcacaagcagcaaagactcaagctcttgcgcatccctggcgatgaacttgaggaattcaaattctttttgattccctcggaacttgtggaaaaccatcctcttgacacgtgatttccagcatctaactgcactgatctcctcccagaacttggcatggtgctcccaagtgggttgataggcagttgtggacggagcatgtagggcagactcaatgtgtgggattgagatgttggggaagcatccgaggaagctggctagcatcttgaccttgctgaagatacggaaattcactttcaaggccaatatcctgacgcttggaaccacagcgcatctgctcgtcattgtgtcaggctgaaatgtcatgcactcgatgacattgtcaccaatctgcagcttgtgaactcttggctccaggtacccgagcactcgcaggttgggtgcacaagcaatgttgatcctcacacaatcgcacccagcaataggcggctccaaaatgatgaggcgctccaagagtggcgcgtcccggacgcgtgg

SEQ ID NO: 13788 - DNA, 2531 bp, Triticum aestivum
  unsure (1)..(2531): unsure at all n locations
  Clone ID: PAT_TA_13788
ggcatcctgtcatgcaccctcacgtcccggaagttgacattgcacctaatccagcaagcaccaaagacgaagctgacaatggcagatgtgatctccctgatgtcaggggatctgatgtggaagatgatatagaagggaatacttctgagcattcttcagaaagaaacattgttgaagatgaggaggccaagggtgatatttctctcatggtatgcgatttgaacaatgatgttgctgagcagtcttctcccgtggtatgtgatttgaacaatgatgttgctgagcattctccctcaacaattgctgttgaatctgaggacttgccccctgaagcttctctgaagcgttcattgatccggaagttaatccaggagctagtgacagaaccttctcaaacatttccggaactaacctgtggtagcgagcagtttgatgaaagttatctaggaagagaaaatgctgagcatgaagcaactagagagttccttgctcagggttgctctgctggtgaatctgagtcagtttgccaaattcctggagcacagcaacaatccacatccatctgctttaatgattctggaaatgttcctgtttctggatgcattttagagactgaaggggttacaacatttgctgtacaggacacacaggtttgtccacccgacaatgattttgctgtctgcatgccaagccaggctgtggaaaatgagccacctcctgcggattatgataataaacctgacctgagatcatatgccccagaacatgctgaagcgttgaaggatgatggttgtgtggtaaaaggtcaggacacttttggggaatccatgctggattgttcgcataataaccagacaatttctagccacgcagaagttatgatgcatgatattatggattccaagtgtggctcattctctattaactccgcggcaatggcctacaaagaacagagcttagaaacaaacataaatgaagttctgtatgattgctgtgatgaggatatggatcctgtcatgatgtctgatgccagggaagttgacattgcacctgatccagcaagcaccaaagacgaagctgacaatggcagatgtgatctcccggatgtcatgggatctgttgcggctggtgatatagaagggaatacttctgagcattcttcagaaagaaacattattgaagatgaggaggccaagggtgatatttctctcatagtatgtgatttgaacaatgatgttgctgagcagtcttcacccgtggtatgtgatttgaacaatgatgttgctgattctcccgcaacaattgctgtcgaatctgaggacgcgaaacatgaagagacttctgtggatctcaaggtagaagatgatatcgaagttggcatggaggaaacttgcgccgctgcggataagatcagtgatggtatgcggcatatttcacccgagtccaaagagggaaacattgacagcgctgttccccatgagccgaaagagggagagactagcagcatcgtgtcaggtgacagtaaaaattggagtgatgaagctcatgtggatagtgtggatgcacacggtaacgtaggatcaggagcaggcgagacagttccttgtgaagttgacactaaccataccgatgctgagatgcctgacattgatagcaccttgtgcgtgaagaatgaaacagtttgcgaggacacacctgtgatgctaaaaggctcttcctgatggatctccgaagatcagaagatggaagtttgcgaggacaaaccgaatgaagcagtttgggaggacaaaccccgtgatgctaaaagggctcttcttgccagcacctctgaagatcagaagatggtagcttcagaggacaaaccgaatgaagcagtttctgaggacaaaccctgcgatgctaaaaggcctcgtcttgccagcacctctgaagaccagaagatgcaagtttccgaggacaggtgctcggaggacgtcgagtctaccgccgagaagacagagcggcgcaataagcgtcgcaagggcaccgtgccgacgccgacgccggcaacagataagcgacgaacgaggagctcctcaatgccacggtttctgggttagaatccgggtttcctttggcagtgttgacgattacttgtctgtaataggtgacttctctagggttcctagaacctctctccctcttgatctgtatgatagttagctgcctgcctgactgaacctgctaccttttggcgtatgcctgaatttagctgtgaagtgccctgcaacgcaacgttctagcatgttattattatactactcagtttagttgtgggcgtcgctggcttgcaccgcctcaacggctcctttacaactcntgacgggaaacctggcgttaccaactnacccctngaacaatccccttgcaactggcgtatacgaaaaggcccacgatgccttccacaatnccacctatgcatggaccnccttacgccataacccgcggtntgngtacccactacgtaattcangccaagcngnctttttttn

SEQ ID NO: 13789 - DNA, 508 bp, Triticum aestivum
  Clone ID: PAT_TA_13789
ttgtcctagaaaccagagcggcggcggacgcgtgggccctgctgcccgtgtccctcgctccacgacgggccggcggatctgggactgggagacgcggctgcgctggcggcggtccgttggttggtggcggaccggcagagcctcagcgaccatcgattggaggcgaggggattgggggcgagcaatcgacggcgaaagaaaacggagggacgatcggagcggcggagatcgatcgggggccagcagcagcacctcagatcagaagctgcgatccacaaaactaagaaaggcctgttgtgtttgtgcctccgccatgtctgaacatcaaggttgggcagatctaccaaatgtcctgcttcattccgttattgctatggcaggctccttctccgacctccttgcctttgcttgcacctgccgctcttggcgtgaggccttcttctcttttccatcaaaggctgccttctcgacgatcttcccgcctgtgctcctgcaacctgaggtcccc

SEQ ID NO: 13790 - DNA, 393 bp, Triticum aestivum
  Clone ID: PAT_TA_13790
tttttttttttttttttgtgttactctgattttattcttgacaaatgactgcagctgtctcaacagaaaaaatgaacatgatctctatttgaaaattacagcttgtttatgcagttgtgcacgatccgaccggcgcagacatgaggggcgaaaatcctctcgcttccgttcggcggcagcggcttcatgcgctacggtaagcgctatcgctcgatggccttgtagaggacggtggtgacgtacttggaccggaaccggtgggtgtggccgagcgccaccagcggctgcgcgccccaccccttctccgatgtagaggtggttcagcaccacatgcctcggcacgcgcgcactcccgctgctccgcgctccgcgaatttgagcacccaaagtaga

SEQ ID NO: 13791 - DNA, 413 bp, Triticum aestivum
  Clone ID: PAT_TA_13791
ttttacgacaaatagaagaaataatttcttttcacagggccaacaaacctcatgttgctacatatggacgtgtcaggcccgttgcacgccagtgctaccacatgtcgactacgagctgctaccaccaccactagtaggtacattatctgcagtggagagaaagcaaatccgaacgaactggaggacgacgtcgtgcaagctagcctctccacatgtttttctctctttatttacaccgtctgtctacaaccggagccactgctcgccgttgatgtagtcccggccgaggaaggggcgcgcctcctcgtaggtgagcgcccgcgaccacggcacccgctgccgcgagctcgccccgggccccttgcacttgtactccccgaacatcaccgtcttggtcctggcgcggtcgcccc

SEQ ID NO: 13792 - DNA, 909 bp, Triticum aestivum
  Clone ID: PAT_TA_13792
ttttttttttttttttttttagagcagcgaagcgcgcttatgcttctatttacatacggtatatagacagtgcgacctactactacagataggacccctgcaagcttacaggagaactattcggaaaggtacttacagacaaaaactatacaaaaatatgtccaagaaaaaaagggatagcatgagattcagacccactgaactactccacggcgctatcgtctagccgtggtttatgtgcagaacctaatttaatcacgaccaaatccacatggcatagtaggcaaggatggcgttcttcagccgccacagcatcatcaggaagtactgcatctgggcgtagcatagggccaaattcagagccatgcctaagagctgacctgccgagtgggccttcttgccgggaaaggtccagaacatagagccccatgaccaactgaggccgcaggacacgacgcaggtgagcaagaacatggcagcggtgtaccctctcggcattcggcttgcgccgccaaacccgatgtggaactcgacgatcaatggaatcgccatctggcaaaataccattagaacaatgctgacggttaacgttgccgcacgaccgtggtgttttgtcgtgaaagcggatccaagaatgctgcacgagttcaccaatattatcaccatcttgctgaaaaccgcagctttgctcctggaacttattgtttgaatcagcattggcagcagtgaagtggtagtgttcactctgttcatctgtagaaagatctgcagagtcaccaacgctccaataaaagtcagataatgtccatttcttgccacgatgctccgaagtgcactgaaatcatagttcctttctatgctcctctccttgaagctggtcacctttggcaccgtatacgccttaaaaac

SEQ ID NO: 13793 - DNA, 705 bp, Triticum aestivum
  Clone ID: PAT_TA_13793
tttttttttttttttttttttttattttttttgagcgagaagaaacggatagttcacaccacatacagactgtatcttacaacaagtaaccatgaaaaataagttatcaggctaattaccaaaatggcatgtacatcatcatgtaatcatctcaacagatgtctggactcgacgaccatgccgggctccaacggtgctgatccaaaactagaattaatttcaacaaaaaccatgtcgtttgcagtgagtgttacccagctttaccgctaatcgacttcctctgaaatacagcgtcccaattttattttttttgaggaattccaaatctgacttgatacattcacttctccactgctttggagatgaacagagctcctttggcatgaacatggcaattttgaacatcaattatacccctcgcgtaaaaattaaccttcgaaattaacccacccaaagagtgctttgaagctgagccctgacttcagtaattagcaacccctgactgatggacaaattccatgcctccgggcattgttagtgatggttaaactctgcagaaaatccaaaacaaactatgcagcatactcgctctcgatcaccggttttgttcgtgtccacagcgctacaggtgcttgcgcccgcccaacctgcgccatgcgcaatgtctccccaacctctgaattccgctccatcacctccaacttc

SEQ ID NO: 13794 - DNA, 563 bp, Triticum aestivum
  Clone ID: PAT_TA_13794
ttttttttttttttttttttttttttttaagcactattactgttttccttccttatatatgtgtggtgaaaaatgttacagtacatcagctacacatatgcattggtactgtttttttgatattctcaaaatatcactagcatatgacctcttccgagaatgccactaagttctctaatatacagcttctatcactcaagagttaagtttgcttgccaacattgatcaaaacatgggcaaccaaaacatggcatcaaatcgagttatgtttcatgatgtaaaagggtgaggaaaataaaagggcaatgatatgcgccggtgcgcccggcccaaatttgggcccctccctgcccatattgtctgatttgccctgttacaaccgtcagatccgggtccttctccttcctcccttctgtcaacgcgcgtgatttaaaaacaaaaggaaatcctccgtgttcgctggccgccgcgttcgtcccccttgccagccacgcttgccggcgaccccaagccacccatgcccgccgttttgctgctcctactcgccagccgcccgtgtcgac

SEQ ID NO: 13795 - DNA, 1148 bp, Triticum aestivum
  unsure (1)..(1148): unsure at all n locations
  Clone ID: PAT_TA_13795
cgtccgcccacgcgtccgcggacgcgtgggtttctctctctctctctctctctcccacgcgatccccaaatcgctgcccctgccgctggcctcccttgccaactccggcgagctctggcgccgtccagcatacccacggctccccctcactgagttctacctgatccaccttttcgatctgctttcccctgcctcgtgtggtcgctcgcttcggtcaaaccttgctagggtttcggtgcttgcggggctaggtcgccggcgtggttccggcgccttgctcttgtgtgactcgcctcctggctgtgcccaggtgttgcacgcgtcactaatgcggcccagtggtcgctggcgatgcggcggtcgcctgcctctccacggcttcgcgtacctcccctcctgccgtcatgtgacgacggtgaggtggccacaccgcaaccgcggcggtggcgatgcacggcctcggctataaccccttcatgcccatgatgctggtctgaggctccttgaccttaacgacttggctctccaagcaacaaaatcagttcagcggcgctcttggatcctctttcttgcttattggcagttttcttcgatagttttgtgttgccattgctaccagtcatcagattttggctcctgactcggcagttccattgttccgagcagctcttaacagtggtgaacaattgagagtgcattgaaggatatggctactatattgaaacaagcaaaccgggctgaagaagccatcgatgcgataagatccttccgtgaccgttgtccaaatgaagctcgggagtctcttgacaatattcttcttgacctatacaagggaacacatggacatgaagccacggcggcgacgaatacgatatcgacattgggcntgcggcgacgatgatgacgacgacatcggcatcgacacagggctacagcgacgacgaagacgacgacatcgtcatggtgctgctgcggcagtgacgacgacgacatcaacacggccttgtggaggcgccgacgcgcgacgacatagaccgcgtggcatatattgtgtgtgtgtttgtgcgcgtgcgtgtgtgtgcgtgtgcgtgtgttaattatctacatcagatatgtatgattgatgattgactgtatgcataacatgt

SEQ ID NO: 13796 - DNA, 496 bp, Triticum aestivum
  Clone ID: PAT_TA_13796
ttttttttttttttttttaacaataaaagtaagaaggactggctatgtagaagaataggttcaaccgaaagtagtaacagctacgctactctaatgcaagaagtagagggaaagagtaggagctctctggtgatcaagggggtttgcttggctggaagctctacggagaaggaggggtcgtcaacaccatagacggtcggggcgacagcggcgtcaatcttgtagtcatgaggtggaaggcgttatcggggatgccggcaacgggctagagaggcggtggtgatggcgagatgcgccgcccggaggaagaagacgaagaccgcgttggctacgcagctccccgggctgatgagacgcccagaacagatgaagacgagggcgttggagctccaggacgaactcccacacgctggaggggccgttggacacatcaacgatggagacgcagcagtgaccgtgagtgatttcgagatgaaattcgcgaagaagaggaggg

SEQ ID NO: 13797 - DNA, 733 bp, Triticum aestivum
  unsure (1)..(733): unsure at all n locations
  Clone ID: PAT_TA_13797
ttttttttttttttttttttttttacagtggcaaacagagctatattacgaaggctcttnggagccccctattcaggttatgaatatgatcatgttacatggcatttcatatatactaatatttcacaatattgtagatgctagcctgcaaagtacacttatctagttaaggacttgaggtggtactcttacttgtcaaagatgacctcatggtaacaattgcagactcatttgcgcctaatcgcctggcctgcttgcttgcctgcagaaaacctttgatggctcgtctcacgtatgcgtcggcctgcttcacggtcatctttttctgcgtctcctgagcggaacttgtcaacatgtagtcgccgttcaagaagcttgctaattcgatgagctcacgctggaaatccgagagaattccgtgctctttcgctggtgttgctctctcaaatggcacttctggcaaagtctctgggcaatctgtccttggttggtcgagttgggtgaagatgtgctcaaatgtgcctgcccattcgtctctcttggtgaggaaatcagatctgaggttgaagatcttcttgatggtcgccgggatggaggagtgctcgtactcggatgtcgccgtcggcccgttcggcggccgccccgcccccgtccccttcttgatccacggcgataccatcattgtgggcaccctgaccccgagccggtcgaacttgaagaagaatggcacggg

SEQ ID NO: 13798 - DNA, 1250 bp, Triticum aestivum
  unsure (1)..(1250): unsure at all n locations
  Clone ID: PAT_TA_13798
ngatagtagtactgcaaggtcacgcctccgagacgtctttccggccacccggcgtgagccaaaggaggcaggatcccggcgatggcggttcccggaggggagggagaggggcgggggcggccggtggtgctggtgacaggttgctcggaggggggcatcgggcacgcgatggcgcgcgcgttcgcggcggaggggtgcgcggtcgtggccacggcgcggtcgcgcgcgtccatgcgcgggctcgagggcgacccgcggtacctgcttctggagctcgacgtgcgctccgaagagagcgtgcgccgcgccgtggaggacgccctgcgggagctaggccgcgtcgacgtgctcgtcaacaacgcggggatccacctcgtcgcgccggtcgccgaggtgcccatggagtcgttccaccaggtttttgacaccaatgtctatggaacaatgaggatgattcaagcagttattccccatatgatggaaagaaaagaaggtacaattgtgaatgttggaagcattacagccttggctccaggaccatgggctggtgcgtattcggcatcaaaagctgctcttcatgcattgagcgatacattaagggtggaactaagaaattttggcataaatgtcatgatagttgccccaggaggcacaaagtcaaatataggaagcaattctgcggacaaatatgatcaaataaacgactggaagtactacaaaaaatacgagaaatcacttcgagccaggacggatatatcccagggtgccgggtgtgttgcagcagaagaccttgcaaagagagttgtcaaattggttcttaagaagaatcctcccgcttggttcgcttatggccaattcactgctattctgacgatcctgtattatgccccattgtggttcagagattacttctacaggctggtcatgaaaatgtaatctctggaagatagctcttgcgtgaaccagagagattgccccctcgtgtcccattttcatttcatgagtactacttggtctctcggactctgactacagatatatttcacaatacatgagtacacacacttccagtccatatccatttgtaacgatcagtccaagtgtaaagtcctcccggttattatgtaataatggttttagtaatgtaatattattccgaaatttgtggttaaaagtgttactgtcataggtgagaatctgtggaacatattcttcaatcttgtgcagcaccctcatttgtgcctggcagg

SEQ ID NO: 13799 - DNA, 748 bp, Triticum aestivum
  unsure (1)..(748): unsure at all n locations
  Clone ID: PAT_TA_13799
tttttttttttttttttttttgtaggtaacacctcttatgtagaccatatgaaagtcatgatcgattatacagagtgcatgattgtggcctaataatgatccatagcgcccgagacgattgcttcttagcctaaacctcgtcaattatctggatatgtcatgtgatgcttggtgttaaaaaaatctcttggtacgagatgcagtaagaacgcaacaaatcaacgataacacatggatcatctactaagatgtgcatatgtatagccctttattcgcttcatcattaccggttgttctttttatatagagttacaaagcaggatctgtggtggtctgtcgaatcgtgtccaccctttgcttcttggtaactacggatgatgtttcgggtggtgtcacggtgacttttgttttccccacggcgatgaatgccactctcttcctcgtatcaggcttgacgacatctctgcgtggagccggcgcanagcaggcgtgccaagaagagaacgcagagtgttttcatcatttggtagttgcctcccactctgagaatctccggcatcgcgcaatgggtggtttantggttggcagcagagagatgctgttgcttgctgggtgtttgctcataagtttcgtctctnacaacagtcaagggctcatactggatnataactgagtgacgactcagatccacttgcgttctactgtactttggctttcatnaaacaattanttcaccatcaacncagan

SEQ ID NO: 13800 - DNA, 390 bp, Triticum aestivum
  Clone ID: PAT_TA_13800
tttttttttttttttttctgttccacgcactaatggagcttaacaacagctgcaactcaagttgtaacctgatattgataacgacatagttaattaataaacaagtcgatggtgactgacccccacctgctaccatgtacagacacagatacttggtactctactactactactactactaccgagtttgaatgaacaagaatcttaagacaacacaaagccaggactggaaactcttcgtcgtcatcgtcgtcatcatcagcggcagtccccggcagccacgggggccgtcggtgcagcttgcctccactccatatcacgccgcgcatctccaagccaccatgctgcggcttcggctggaagcaagaggagcgccaggcccaggtcccg

SEQ ID NO: 13801 - DNA, 949 bp, Triticum aestivum
  Clone ID: PAT_TA_13801
ggtccgctctagtccacggaatgagcacgagcagagcgaggaagtagccggagcctctccatctcccttgccgcggctggtgtgtcgacctcggtgctagccatggccgcgctgaggagaggttcggccgtggcgttggcggcggtggcgatggtggtggggatggcgtcggcggccgtgtacgaggtcgaggtcggggtcaggttcacgagcatcggcaaccccagctccggcgccggcgccgcgtccaacaacttcaagcgcagcctagaccccaccgttcacctacaatccaacaagttccaccacgtcgtcaccgctgagcacggcgggctacaaaagaactgcaacggtgaccaaccccgacggcccacctggggccacgggcaagggactccgtcgtcctcaacaccaccggccaccactacttcctctgcggcttcccggggcactgcgccatcgggcagaaggtcgacgtccgcgtgctctcctctgctgccccttccaccgcgcccgcaatgacgcccgccccggcagccgcgggtggcggctcagccggccgcgccggcgccgcgccctcgccgcacgccaacgccgcgccggccgtcagcagctccttcgccgtgacggtcgccgctgccgtgctgtccgtggccgctgccggattaaacctgctgtagtccggaagtttgccggccgaggatggatggatggatggatggatggcgccctgtgagttgtgagcttgcgtttgtcgccgtatgagtgcgagcagtcgtggagacatctctggtcatctggatcctgtgttgtttattacagtactgttttgctctcttttttgtgtgccatactcttctccgtggatcttggtctggtttggggatttgtgccggttctcaccggcttagtttaatcgatcaattgagcactcgcttatggtttttac

SEQ ID NO: 13802 - DNA, 672 bp, Triticum aestivum
  Clone ID: PAT_TA_13802
ttttttttttttttttttatggtcctgattacagaaaaccacctcactccagctgacaaacaactgcatttttctccgtaaaagtagtaaatggctactgtaaatcacaaaggaatgttccgtgttctcggacatatggaggtattaccattggtcacaacactagcgtgccattcagcaaaaaaagtgatcgcagtaggaataaacctctaaattatcatctggcgaacatcaaagctcatcagcgaaccctacgcgacataaaaatttgcgttgcttctcttctgtggcaagaactctatttggcagcgcgtataacagtcccaagccaatcgtccgagcttgtgttcacatcccccttcaaggctctcagggagtgctcagtgtcaacctttgtgatgtacacatcaactccaagcctagctatcgcggcagcttccagtattttggtctccattcctccagtggtgtcgtgtgcggctactgatatctccacttcttttctgttgccttgtaatgcaggttttacaatcgaccagcctccggtggcatccacccctccctctttgagatgcactgcgtctgggtcagttggaggacggtcatatactccatgaacatctgtctaaatatcaattgtcagagtaaagaaaaacttggcaaaacaatgaa

SEQ ID NO: 13803 - DNA, 475 bp, Triticum aestivum
  unsure (1)..(475): unsure at all n locations
  Clone ID: PAT_TA_13803
ttttttttttttttttttttttttagtagttgctcgagcttgtcttctctcgtctgcttcggattctgcaggttgaagcacacttgcatggcgaattactacaatccattcataattaactaagcgcacgcgtcgatgcatgtcatgttgtcttctcggtcatcttcttgatcccccaactccagctcctccgtcggcggcggcggggttggcgaaccgggagcctgagccggccgccctcgcgggacgcctgcagcagctccttcccggggatcaccacctgcgtcaagcacgaaccgcccatcccgcgccggaacgtcccggaagcacacgcacggcttcccgccgcgcccgatctgaccgttatcggcggcggggaacgacggcggcgaacccaccagccctgaccccgccgcggcgggggcgtccctcagcgtcgcctcctccctctccctcccgcggaggccgcngcgct

SEQ ID NO: 13804 - DNA, 746 bp, Triticum aestivum
  Clone ID: PAT_TA_13804
ttttttttttttttttttacaacaaatacaacagtgtcatgattaagtatgccaagcaagaagtgtaatcacaaaaaacggatctgtgtaccaactgaatcacagccacatgttcctatgaaatgtgagatgtccaaaaactcactgttggcacaatgtagcatctccagtcaaggcttgtggctacaagagacatggcatcaggcacaagaaaataaattagaaagcattccaagtccgtcagagaccagatggacacttacagcggcagagaagcagctgctgtttacagtgtcatacggcacttcctggtctagagatcttcaccaagacgatacaaaatcagacagaaaaatactgaaaacaactccatgaggtcacataaacctcaagcacaggttatctatctatctcgcaaacaaagaacttgcctcaaaacaggaaaagctttgggacagagtgactaactgaacaaaaaatctatcgcatatgccgacggaaagggcccggaaaatcatcgagtaatcagatccaggtgagttgaaagccgactgggttttgaatctagcaagatggcaggatgatttgccgattgactggactgatagttacgacatccagacaagaagctgatcttgcaaaaaacattgcactaacattcaaatagatagatgcatcaggtttttctgctatatgggtacgcttgcccaacagaagcacaaccacctgtttgggcgatgaatcaa

SEQ ID NO: 13805 - DNA, 674 bp, Triticum aestivum
  unsure (1)..(674): unsure at all n locations
  Clone ID: PAT_TA_13805
ttttttttttttttttttttttttttttgttgttgaatctaatgcatcagtgctctttcatataagtgtaactctattaaatcttccttttactttgacgctaagatgactaaatattctgttctccatgtggactttttggtatctaatctttaattcatcttaagctgtaccactataggaatctgttatgtccaaggccctgaattatttggtggcctgctccaaattgccttttgttcttcaaaagctccgcaaacgttggcagactgtttcttgttccgttaaagaatttgccaatccgattggtaatatatttcaaacattggaatcacttaacacctgcaccagcttggtactctgctggctgatcacaatctgcccatctgtgctttcctttgggtccggcaaggacgcttatttgcttcagctttactggggatttcaagtcagatccttggaccatgttaaccgcaccaagaacttctcccaaaaatatacccactggggaacattcncttgcccgaattcctcaataacgcgaataccccggcaaattggccaggattgcgggttgctcaagggtcaagacagccaaatgaacacttcgtnncgtagggatatgtnnatcaatggttcagacngtttnacanggttanaaagtaaccgctcgt

SEQ ID NO: 13806 - DNA, 557 bp, Triticum aestivum
  Clone ID: PAT_TA_13806
ttttttttttttttttttttgacaagttgacaactcaagcagtatcatagttgtgttctggtcttaaaatcttattacatcacaaccaaagctgtaagatcttattaatcacaaccgaagttgcataaataaaggacgtaacatatttcaaaattctaatgcacttccaacagtacatgcactagtaattggagacccggccacatgtccacatgagcacacttggctccaaattagtcttccgtaatgatgggctcattttcatccagcgcttcttcctccgcctcatgacctgtgtcacccgcgcagagtgcctgccatcccctttcatgtccccgcctgacctcgcccccttcctctgatgtgcgcctccttcccgtggcggcagccggctgcgccgcgccctaccgtacctcccgcggggtcgactggccgcccccggcgccaccgcgcctgcggggccgcggtatgtatcacgtgccggctcctgcatgctaggggtcgtcgcgaccctgttgccacggtgcatggaacccgtgcggtgcgacaccaacccc

SEQ ID NO: 13807 - DNA, 447 bp, Triticum aestivum
  Clone ID: PAT_TA_13807
ttttttttttttttttttttttttttttttttgaagcagttacttctacaataaattgcaatttgcagcacaaacatagtaaaacatgtctagagttctctcccaaaaaaagttatcttcttgctcaacaggtagatttagcattataggagctatgcacaacgggatcatgtcatgtcatgatatacaagaggataagttgaaagtttgcttgctctattggtcgggtcgggatcacagccccagggcgggggaggttgcggcgcatgcaagcgccccagggcaacaaaagagaacgcaaattcctttatgtagctgaagaaacacaggtcagctgtacagttgcagcggaatgttccgtcagatactggagcttcagatcttgtccgccacttcggctggcatgcccgcgtactctgcgttgttaccatgcttcctgcagcccgg

SEQ ID NO: 13808 - DNA, 629 bp, Triticum aestivum
  unsure (1)..(629): unsure at all n locations
  Clone ID: PAT_TA_13808
tttttttttttttttttttttttttttttcaaacatgtgtgacttttttgaaacttcaaaatgagattttcaaaaaattaaaaataatgatgtccatggagctcggcctccaaaatgccccactccatacattagtgttttttcttgcggcggacctccaaattagttatagcgacacatttgtacatgagaccatttaccagcacggtatcatgctgaaaaggctacagcaagcctaaagcaaggccatttagcggcacggcatacatacataaatcccccctaatcgcccacacacacgcccctgaatttcgatgtgaagcctgcgatcataaccaaccaaaagatgccacgtcacatcatagagtgggcagcgataggaagtcctatcctgtcccgaaaatgctctgttcttctagtttcagctcgaattttgttcactctgtagcgagttttacagtccggtgttggtcatcgtcgtcggctgatctctcagctagtatcttcttgaccttggcatcatcaaggtagtgctggtagatgtaaggacaagaaagccccagacggcaacgagcatggncaagcaccttcacccccntccatccggtccgccgaagganagatgacgg

SEQ ID NO: 13809 - DNA, 703 bp, Triticum aestivum
  unsure (1)..(703): unsure at all n locations
  Clone ID: PAT_TA_13809
ttttttttttttttttttataaaatgtactgcacacatcaacacagcngagaatgcaaatgctttgcgttgccgaaccgcacgcagtcgccggacgtacttcactcagcaagcgagctgcaaaacaaacttttgtgagctgcaaaaacaaacttcgctgagccgcggagagggctccctcggccggggcaaccaccgaatttgttctgctttttttttctcaaatcaataacagtatgacttctttcattcgtcaagcaggtggcggaaatcagaagcgcactgcattgggcaaccgcacatccaaaatctgcgcacaagatgaagtgcacatccaaaatctgcaaaaacaaagagaaaaaaggccttttgcaaactgcatcggcggcaacttgtgttcccaggatgccatcgccgttgttgaccgtcttcgcgcactctaggcggctgcaggtgaggtggagctcctccggccttggaccacgggtccacggctaccacaggcggcagccaaccgtccgggcgtgaggttggacgctcgcagatgcgcgaagaggcaccgatgcggggcagcccattcgatcccgacgacctgagggtcacgagaaaccgtggataaacggaccaggggccatcggcgagggagcatgcgtgggtcaacgacggttgctgctcgatcccgtctgctaatgacgcagcagggc

SEQ ID NO: 13810 - DNA, 462 bp, Triticum aestivum
  Clone ID: PAT_TA_13810
tttttttttttttttttttttgtacggtcaactgcaacaagagcacacaatggcaaatgtttcactgtatcctggccgatcctagctttcggatcacaattttctattgaaaactgtaaccatttcgtcgtactactatataatctaggtagtaactaactctatacacgcattctgcaacaatgtggataaatcatctattacagcagcagccagtgacatttcatttcttgacaaaactatgcacagcgcagcggtttctgcggtacgtatcatcgcttccttccggagacggtcttcttgactgcgccgacggagaccaggaagtcgtcgagcgacgagagggtcttcatgtcgtccggcgggaagtagctggccgccttgcccatgagcgaggcgaagatgaggggcaggccgggcgacgcggcggggcggtccgggaggaactcggcgaggaaggcg

SEQ ID NO: 13811 - DNA, 667 bp, Triticum aestivum
  unsure (1)..(667): unsure at all n locations
  Clone ID: PAT_TA_13811
cccggttatgccggnaagggggtccattgcatttggtgcgttttttggttggcgtcccggcctcccggtgtagcccgttgcgcaacgggttccgccgacggcggtacgttggtaagcagctttccccgtcaggtggggtctgcgtcccccgtgacgcccccatccgtccggataggccggtcccgcacgggcccccccctttgcgagtcggccttctctcctccgtccgtgggtgtatttcgcccccgggttgaaatggacgattagtaagtgatcccaaggaggatccctgtatttggcttgctaactaacccctcttttcgttgctctcccagtggaaaacggaacgaaataacacacttttaagccgtggaacccgagccacgcatttacaacatcacccaaacctcaaggaataagtgaactatgtacatttgtttatacattaagtcagctcttgtaaatcattttccttcctgtgctgaactgaagctttcggggcaggagcattgtgctctatatagtcatccaaagcttcctcctcatcgtctgaagatagaagcgatgaccccatccatgttttgaagccatcgtttacacgcctctgcgcctctgaggtcacctcaattgtggtctcgagcatcacctgcccgggcggccgctcgaa

SEQ ID NO: 13812 - DNA, 471 bp, Triticum aestivum
  unsure (1)..(471): unsure at all n locations
  Clone ID: PAT_TA_13812
gtttttttttttttttttttttttttttttttttttaggaagaaacattttccattcctctgttaaattacaatctgatctgtgactgtgaggggccatggagccatcagccatggacagtgacggtttgattcgtgccccttggctgctgctgatagagagcaaacaagagcaagagcatcagctacactgaaaaggcataccagagatggactggatcctaccctatcaaatgcacagaaacccatttccagattaacaaaacgcacaatcaactgttaacaaaatgggtatttggattctacatggctctcagcctcccacaaaaaggccccaaaaccagccgcctccaaggacaaggggcgtgagctctgtaaacgtaagcgtcacggttttaccacctttaccgttaacagagccatcatccagcactttgatatccggccgcccaaaaaaaanctgngttgctcc

SEQ ID NO: 13813 - DNA, 580 bp, Triticum aestivum
  Clone ID: PAT_TA_13813
caaaaaaagttaaagggctttgtttcccgtgtttttgtagtagtcgcgttgcacttcccctctttctattcttaagctgggatagagttcgttcgacatgcctcggcacggcatctccaccggccgtcgacgtcgatgcacgcatgcaggtgcaggcagtagtccagtagtccagtaccacacgatccaggcaacacgcacccgtaaggcgtaacacacggcgcggatgtgctagccggtcacaacgccgccgacgagcatccgggaggatcaagttacacctacgacccgcagctatctagcactccgggatggcgatcgagtgctgcatccgtagctgctcgtaaaacctcttgatgaagtcgtcggcctcggcgtccacgcgctcgctgctgccgctgttgccgtcctccggcacgaccgggaacggcgagtcggtgacgcgcagccgccggacaccagcggggctgcggcccaggatccatgccaccatcggtgatggcgtcgccgtcgccatccctgccacgccggcgtggctcttccggactccacgtcggcgctcatcatctcgaacgcccgc

SEQ ID NO: 13814 - DNA, 1117 bp, Triticum aestivum
  Clone ID: PAT_TA_13814
cgtccgcggacgcgtgggcggacgcgtgggcggacgcgtggggccgcagtggacgtggctgtccgacgagctggcccgcgtcgaccgcaaggccacgccgtggctcatcgtgctcatgcactcgccctggtacaacagcaacaactaccactacatggagggggagacgatgcgggtgcagttcgagagctggctcgtcgccgccaaggtggacatcgtcctcgccggccacgtccactcctacgagcgcagccgccgcttctccaacgtcgcctacaacatcgtcaacggcaaggccacgcccgtgcgcgacttggacgcgcccgtctacgtcaccatcggcgacggcggccacgcgtccgatcgagggcatcgccaacaacttcacggagccgcagccgtcctactcggcgttcagggaggcgagcttcgggcacgcgacgctggagatcaagaaccggacgcacgcctactacgcgtggcaccggaaccacgacggcgccaaggccacagccgactccgtctggctcaccaacagacaccacctccccaccgacgactccaagtgaagtcggacggatcatcttcagctgcattatggctccttcgggacacatgactgccttttccctcgtgagttgcgggtgccctgccgacgtcgggcttcggctccgccacgctggagagcaagaaccggacgcacgcctactacgcgtggcaccggaaccacgacggcgccaaggccactgccgactccgtctggctcaccaacagacaccattccccaccgagactccaagtgatctgatcatctccgaagcaatgtcgcggggggcccctttacttacgagcaacgtggggtttttcttacatgtcgatccatccggctgcgatgggacagaaaagaagacatcttgggcagctgcaaatggttgctacacggctgcttctttcatctcatttgtgaatctcttgagctcgagccgtagttagtgcaattagtcatgtaaccttaagggtaaagctcttgcgcgtagtctcgtttgaaataaaataacaaaagagatttgggaggttcttcaaaaaaaaaaaaaaaaaaaaaaaaactcgagactag

SEQ ID NO: 13815 - DNA, 658 bp, Triticum aestivum
  unsure (1)..(658): unsure at all n locations
  Clone ID: PAT_TA_13815
ttttttttttttttttttataaatatgctcggttctacgagaaatctatttatatatatgcataacgtgtacaatatgtagtatcgtaaaataccagcaaacgaataagaattaaatggaaaacacaaaattaaaggaaaaataaaaaataaaaccaaaacccccaaacatttagtaccggttggtgttaccaaccggtactaatggtctacccgcacctgggcctggctcgtgccacgtggtggcactttagcgccggttcgtgacgaaccggtagtaaagggggggctttagtccccactctttagtgccagttgtagaaccggcactaaaggcccttacgaaccggcgctaaaacccggttctgcactagtgtgtggtaggtagccgccgggtgcctttgccggtgatcctctggatgaccacgcatctctgtgtctctcctctagtgctgcactgggcctcagttggctcactctggcccttgactcgagcgttggggcattagtcagtagaatgncaggactaatctgtaaaagaattcttcacaaccaagcccctggctggaaaacagacatgtctatttcacagagcctctctccgagcaggccagtcgttacgctttcgtgcgggtggaacttaccgcaagaattttcgc

SEQ ID NO: 13816 - DNA, 706 bp, Triticum aestivum
  Clone ID: PAT_TA_13816
acattgaatagagaaattagctcactacagtttcaaggccatataaatgggaaactatcgactagtataaggatgacatgtggtatctgaggacatgtcattagttatatattggatatatggattgtattttccaactcagtgatccctgtgatggtactgagctataatgtccaattaagtaactgcattgccacgtccggcagaccaccatcacctcattcaatgatccgtgtgactcttctcagagggggaagggaggaagcggttgcgtgttcgcggagaagcagagaccaaaccctctcctcccagcgcgggcaccgggcggagagggaggaggggcgcgcggaggacgaaggccgccagcagccagccgcgtcgactcgagccgccggccaagattaagcaaacatctgatcagactgtacatgagtcatggctgggcatcattatcacaattcccagatttcaagaatggatcgtacgaaccagccacgtaatgaacctccgccttttggtcaaaagttatttatgcatcctagaggtgatgcacctaatggagcgggaccatcaggttatggggttacaactgtgagatctaatgaacttccatcctcaagctacgccggtcagtcttatggtcagcagatgggagccctggaacctgcatgcttcccatgctgggtatccttctgctgggaagctt

SEQ ID NO: 13817 - DNA, 1941 bp, Triticum aestivum
  Clone ID: PAT_TA_13817
cgtccgcccacgcgtccgcccacgcgtccgcccaaaccctgcccctccagaccccctcgacgcgagatggccgacgacaacggcggcggcggcgacgactacgtcagcgaggccgtccgccccgagggtgatacacatacgcgtgaagagggattgtcaaaatccagggatcgagacagagaaaaagacaaggataaggagcgccatagggaccgtgacagagatagaggaagagacagagatcggggtcgggacagggatctagacaaggatcgggacagggacaaggatcgggatcgtcaccaaaggcatcaccgtgacaaaagggagcaccgagaccgtcctgatgatcacgatcgtcacagaagccgtgattctgaaaggagaagggaccgcgagagagatggacatcgcaggcatcgctctcgttcacggtctcgttcaaggggcagggatgatcacagatctcgatctcattcaaaaagcatacagcgagtcagtggattcgacctgggaccaacagcacaatgccgtacttcctcacttcccttccattccaaccccacgtcagttaccgggctcctctattcctggagtgttcccgaacatgctcccttttggtgatggactctgctggcccattgttgggcggacacaaggcattactcagcaggctactcggcatgctcggcgtgtttatgttggtggccttcccccatctgctaatgaacagtctgttgcaatatactttaatcaagtcatggctgctattggaggaaacactgctggtccaggtgatgctgttcttaatgtgtacataaaccatgacaagaaattcgcttttgtggagatgaggtctgtggaggaagcaagcaatgcaatggcactggatggcattttatttgaaggtgcaccagtgaaggttagaagaccaacagactataacccttctctggcagctgccctgggcccaagccagccaagctccaatttgaatcttgctgcggttggcctaacaccaggttcagccggagggttagaaggcccggaccgtatttttgtgggtggtctcccctattacttcacagaggctcaagttcgggagctgcttgaatcatttgggcctcttcgaggatttgatcttgtgaaagatagggaaactggtaactcaaagggctatgcgttctgtgtctaccaggacctcaatgtcactgacatagcctgcgctgctctaaatggtatcaagatgggagacaaaactcttacggtcagacgagcaaaccagggctcagcccaacctagaccagagcaggaaaatatcctgttgcaggcacagcagcaggtgcagttacagaaacttgtgtatcaagttggagcgctccctacaaaggttgtatgcctgacccaggtagttactgctgatgaattaaaagatgatgaagaatatgaggacattatggaggacatgaggttggaagctgggaaatatggtaacttggtgaaagttgtcatcccgcgccctcatccgagtggagagccagtttctggagttggaaaggtgttcttagagtatgcagatgttgatggttccaccaaagcaaagacggcgatgcacggaaggaaattcggtggaaacccagttgttgcggtcttctaccccgagaacaagtttgctgatgaggactatgacgcggcagcataaattatctctcttttccaatgacaatagtgctttgtgtagtttgttcgatttacagcaacgttttcccttctagtcgagctttcttgtagccctggatttatgcagaaccgccagttattaatattggaagatagattgcctaaagatgatctattggtcttgtcccttaatcttgactggcgttagaggtgccagggtatgccattctcttcgtttagcgcccttgaaagattattagc

SEQ ID NO: 13818 - DNA, 815 bp, Triticum aestivum
  unsure (1)..(815): unsure at all n locations
  Clone ID: PAT_TA_13818
tgcaggnaattcggcacgaggctttctctgccgctgctccgccctcccgcctccaccgacggcgacctcgcttctctacggccggctgccaacccaaccgccgtctctaccagataggccaccaccgcatcctcctagccatccctcttaagcatcagcagatctacggcgaccggtcgaaccagcgtagcggccctccctagccatggccactgtaccagttaacccgaagcctttcctgaacaacctgacagggaagtctgttattgtcaaactgaagtggggtatggagtacaaagggtaccttgtttctgtggactcttacatgaatctgcagcttgctgatacagaggagtatattgatggacaattctctggaaaccttggagatatactgataaggtgcaacaatgttatgtatatgcgtggcgttccagaggataccgagatagaggatgcagcgtgagaagacatggaccgctgtcacgcgtagatatctgacatgaacgtgccaatctagtcccgtttcagatgttgtctctccattgatgcaggatgtacgatttacctgctcccatgctatctacatgtttggttgtagtggtgaccagatttttcagttttcaatcgtctggatggtgctatcgtccttgctgagtgttagaagtactgaatttcttcagcaattctatttcggcctgcctggttttggaaactatatgccgaattgaccctccgttcctacctcactggtttggtttgaggtatatcatttcttcatcaatagccccgtcggtattatagacaaacgatct

SEQ ID NO: 13819 - DNA, 652 bp, Triticum aestivum
  unsure (1)..(652): unsure at all n locations
  Clone ID: PAT_TA_13819
tacagcacattaacattacacacgttgccgctttgttcttctccttttaatcctggcttcaaaaaatcaccatataatccattcacaacaaataaatcaatcgcatacgcttggatgaaaattcagttgcccatatttacaccatcccatctgaatctgatacagttcacagctattgcctggcgctaccaatagttcccgcagctgcaggtgccacgccggaaccggtggaaacggttccggtccctgacgacgacctccctcccgaagatctccgatatcagcgcgctgtaggcgtggcactccttgctcatccggaggttggtgacgaccctcaccggagtcccttccggcgtgctgagcagcccgaacgccatggccagcttctggctgtgggcggcgacggcgctccgcttctcctcgtcgtccgcgtccagcgccacctccgacgtgtctggcttgtagccctcgaaccggagctgcccccccctcgtggagcatctcctagattcgggcgtccggcgtgcnacggtctgcnanttaacggtgattcgcntgnactcangggctgnacccgggctgcctaggccntcacgctcgtcggnccggcnctctccatttcggccggngtnaatccanntagttccccgnt

SEQ ID NO: 13820 - DNA, 337 bp, Triticum aestivum
  Clone ID: PAT_TA_13820
ttttttttttttgatgatcatgaaacaaacatttgccttggctctctcggctgtgtgtgtttggttttctccccaccaggcgcgtcgggggcccccccacctatgcggctctcccctcaagcggcgccgcgtgcctgccacacgcgtgccgtacggcatggcctgtcccttcagttgaacctggagcacctcctcctgatctcgccctgccggccggtcttgacggcgaccccgcccaggctgaccatggccttggggaactcgtaggtgaagcgcagcccgaagagcccccggatgttgccggcgtacttctgcaccaccccctgggtcgcgccgt

SEQ ID NO: 13821 - DNA, 596 bp, Triticum aestivum
  unsure (1)..(596): unsure at all n locations
  Clone ID: PAT_TA_13821
cgtcccgcgagctctcaccagtacggcacgacaggcgctccgtcctccctggccatggctcgcgcgcacggcgcattcctgctgcagctgctggccgccggcctgcaggtcgtcgcgctcgctgcgaccgtcacagtcacgcagacggacgacccgcggtgccggccgagcctcccgcggcggggcgccgtcgcggtgtacccgagcgacatggagcagctgcagttcctgctcaaccccaagttcgtggaggcggagtggttcctccacgccgcgctgggccgcggcatcgactacctcgaccgcaacctctcggcgggtggcccggcccccgtcggcgcgcgcaaggccagcctcgacttccgcaccaccgagatcgccgccgagctcgggtaccaggaggtgggccacatcagggccatcacgcaggccaacggcgggttcccgcgcccggccatcgacctcagcgccgaccgcttcgccgccatcatggacgacgccctgggggcgcgcctcgacccgcccttcgacgcctaccaacgcctaanaaacgggaaccgtttaaattcctcctngnctcctaaaatccttgcccc

SEQ ID NO: 13822 - DNA, 725 bp, Triticum aestivum
  unsure (1)..(725): unsure at all n locations
  Clone ID: PAT_TA_13822
ttttttttttttttttttagagccccccctctgtgggttatatcacggtagaataactgagagacagtcttcgataactcgggcagagttttgttcatctgttgcagagagaggactacaaactaagcagccatttcagacatggcctgatgcatacatattcccatcgaaaatggcaagtactacagacgtaccataatttacagatccagttccatgccctacatacactaccaccaactggcctaacataattccgctgccaccgggacccaggaaaatttcgtttccaggagcttacagagctgttggctttgaaccagcactgttccgtcgtaattgattcaaaactggatcagcaaaactggttcttaggaacgagacctgcccgcctgctcgcaccttcttgaaattcagcattgctgttttctgaagagcaattcttcaagaaagatgacaagtcgtttgccaaccagacatgtaagagctcgaaggatggtcctctctggatcggctctccctcccctcagctcggcctcttcggtctcggcattactnttaagtgctanatccgttgtgcncattcaaaatancctaangtacttcacccgttcatgcganaatgaggacatttcagatgagtctaagtttgctccccctgaacattagtggtaaattggacaagtctcaagcgaattcacacantttaaccaatctagtntgat

SEQ ID NO: 13823 - DNA, 517 bp, Triticum aestivum
  unsure (1)..(517): unsure at all n locations
  Clone ID: PAT_TA_13823
cctcacctcacctcacctcgcttcgagcgcgccgcgggaaaaccctcgaccgagcttccggctgccagaagtttccagaagagggcgccgccccgacgaggccccgggctccgcctccgcctccgcctccgtggcccctcccgtcggcccgcgctgcgccgtctgccgcggcgtcgacatctccgtcccccaccaggccaactgctcccactggtttctgcggacattgcatcgtgggggtgtggctacaaggatctgtccttcggccaatccaattgccctgtttgtcgtcgtcccataacgctgccggtaccttctgaagatgttgccctgctgcctgatgagatgaaactagaaactcgcttgatctgatgaaagccgtacagtgcagttactaatggagtacctcacagtatgagtcacctcagtatgaaccagtcctttgacatgctaagaatgctggcagttaaattagacacggggattgctggcaactaattanaanganacaaccgcc

SEQ ID NO: 13824 - DNA, 651 bp, Triticum aestivum
  Clone ID: PAT_TA_13824
tttttttttttttttttttgtttttttgaaaataaggtagtcttaatttcctttgagctcgagatgtctaaccgtacaatctgaactgccaaagcaaatactttatgaaaatggataaattttacagagaaaaggtttacacagggccttaatacgtggtttgacgtccctactatgacatgatgcacgtctgtgcctttgctctttaggggaggaagaactgctcggaaagtatcataggtataagaagatcaccagagctgatcaggtttcagggagccaggaagagcgtgttcctgagctcggctcggagggcctggacgtcgtcattggggagcaccaccatgatgacgcggccacgcccgctggcgtcggactgcaccagcacggcacccccctgaccgacgccgtccatgccgtactccacgtgtgcgggcctctgccccatgatctccagcccgtacaggtcgacctgctccatgtccacgaacgttagattggcgccgtagatgaccacgtcccccgggaagcggaccaccgtggcggtctcgtcgaccagatccttggccagcagcgcagccagctcggacacgtccgtgttggccggcgcagagcccgcctccacgtacacgacattttgcctcgtgccga

SEQ ID NO: 13825 - DNA, 594 bp, Triticum aestivum
  unsure (1)..(594): unsure at all n locations
  Clone ID: PAT_TA_13825
cgtgttttttttgtttctgcttcgggcccgatgcagcttccagccctctgttcgttcatcctgccgaacaggctacaatgcccgctgcccggaccggtacaagccccattgatttcaccgcatcccagaggaacaaagctaaataaacaaccttattatttccacctaccggactgagactgaaacagcacaccgctaactgtcgtaaacacaacaacaaacatctttcagcagaacaaacagatggagggttaagccttaacacttctactacacttcacattgctagagacggaaagaccgcgctctcgcacgagctcagtccttcttgaggagatcctccggctcgcggagggtgccaaacagccagtccatccacacggtgtagtggccgtagttgtgccggtacctcggccgcgaccacgctataccngggcccacacggcattctnccgtgggatgcatcatggangtggcctcanaccgcctctatgatacanagaatntgcgtcctgaagtcatangagaggacangcatcattcgatatggttgaggtccgtcaatgatggancagccacaaangganaggatcc

SEQ ID NO: 13826 - DNA, 934 bp, Triticum aestivum
  unsure (1)..(934): unsure at all n locations
  Clone ID: PAT_TA_13826
cctccacccatccgcgccacagccaggtttcgtctagaacctaggtagaggtttgagcgagatggggttgagggacaagaagaggaaccagaggcgcgtgctctcgcggcgctcggccggcccccggactggcgagggcaaggatttcctgccgctggaggggaaggagccgagcgtccggcagcggcagcccgaggagccggagagcacggccactgtcctctacatcggccacatcccccacggtttctacgaggaccagatgcaaggtttctttcagcagtttggggctgttaagagggtcagggttgcccggaaccgcaagacagggaagtctaagcattatggattcattgagtttgagaaccctgaggtggcgaagattgtagctgatgagatgaataactacctgttgtttgagcacactctgcaaattgcgcctgtcccgccggagaaagttcatgccaaattatggaaaggtgtgcggaagggatttataccagttgaccgggtagcaattgaacggaagcggcttagtaaggataaaacagtggaagagcacaagaagatgctcgaaggaattgtaaagcgggatgagaagcgccgcaaaagaatcaaggctgctggtatcgattacgagtgtccagcccttatcggaagcgttcagccttcagctaagaagatcaagtttgatgaggattagctatagagaaggcagatggatctttctttatccggtaggagtgacgggactctgctgagttaacctggctggtccattttagctggggatgagatggcggtttcgtactttggttttgtatctgtgtttggtcgatgttatgtaagttgaatgactggtttatgttggtgaagaagcataaagctgtggtgggaaatgaacctgctccctgatttacttnnnnnaaaanna

SEQ ID NO: 13827 - DNA, 1060 bp, Triticum aestivum
  Clone ID: PAT_TA_13827
ccgccgtcccgccgccgcctcccccctcctatcggcacgctccgcctcctttcctctcccccgcaactccgccgtcctccgcgccgccgcctcgccggacctccgccgcccgacctcgcctcctcctcatccttacagggagctgcatagaggtttgattgagcgagcaagatggggttgagggacaagaagaggaaccagaggcgggtgctctcgcgccgctcggccggccccaagaccggcgagggcaaggatttcctgccgctggaggggaaggagcagagggtccgggagaagaagcagcctgaggagccggagagcacggccaccgtcctctacatcggccacatcccccacggtttctacgaggaccagatgcaaggtttctttcagcagtttggggctgtcaagagggtcagggttgcccggaaccgcaagacagggaagtctaagcattatggattcattgagtttgagaaccctgaggtggcgaagattgtggctgatgagatgaataactacctgttgtttgagcacactctgcaaattgcgcctgtcccgccggagaaagttcatgccaaattatggaaaggtgtgcgtaagggatttataccagttgaccgagtagcaattgaacagaggcggcttagcaagaataaaagagtggaagagcacaagaagatgctcaaaggaattgtaaaagagggatgagtaagcgccgcaaaagaatcaaggctgctggtatcgattacgagtgtccagcccttattggaagcgttcagccttcagctaagatgaagaagtttgatgaggatttgctatagagaaggcagatggacctttatccggtgggagcgacgggtctgtgctgagggctattttagtctgggatgagatggcggtttcgtacttctggttttgaattctttgtttggtcgtatgttatgtaagttaaatgtatgactggtttatgttggtgaaaaagcataaaaactcgctttctttcctgctccctgatttacatcccaaagctgtcactgcagatccaccctcgtccgaa

SEQ ID NO: 13828 - DNA, 554 bp, Triticum aestivum
  unsure (1)..(554): unsure at all n locations
  Clone ID: PAT_TA_13828
tttttttttttgtgcaacaattctttgcgatccgaattttcatgtacagtaaagctccttatttgtgatacaagctacaacacgcccttattaccgatattcacactggaaaagggaaattggacgattggcatggatgatgaactagagtttgtttcactccctcaaattttacaagacacccatttctgtttcctaaccacataaataaataaataaattgaacccatatctacgctatggacaactaagaattgaacgggagacaacacttctcaagatatcgagaaagcaactgaagcaggtctagccgctcttcttcctgcaggcgcgggcggtggagtaagtgggagtcctgaaggcaggtgccggtgaaacgagcctacggcggctgcaacaccgtcctcattccctattgctattgccagttccaatgatccgtgattttacctcaaggatcaagcataaatctgattgcatttgaaagtgcctccggtagtaagctctgttacacggataagtgcaagaccacacaccgcatgaacntctcancc

SEQ ID NO: 13829 - DNA, 1626 bp, Triticum aestivum
  Clone ID: PAT_TA_13829
cccgccgtcccccacccctctgcccccacgcacgcagccgcgcccccaaccaacccaacgcgccgctcacgcgaggccgcctctcgctccccccaccgccccctccccagccccccgaatcgccgtacccgcggcagcgcatgagcgacggccaggacaccctcgacctctccgccctcggcgccggcgcccccaacgccgcagagctcagcgccgaggacaaggccaacctcgtggagtcgattcagaacacgctgcagggattggcggcgcggcacacggacgtgctcgagagcctggagcccaaggtcaggaagcgcgtcgaggcgctcagagagatccagagccaacatgatgaatctgaggcaaagttttttgaggagggagctgcacttgaagctaaatatcagaagatgtatgaaccactgtactcaaagcgtcatgatgttgtcaatggtgtggttgaggcagaaggcgtaaccaaagattcaggtgaagctgctccagatgagaaagaggaaaagggtgtgccagatttctggttgaatgcaatgaagaaccatgaaatccttgctgaggagattcaagagagggatgaggaagctctcaagtacctcaaggatatcaagtggtacagaattactgagccaaagggtttcaagcttgaattccacttcaatactaatccattcttcaagaatgaagtgctttcgaaaacgtaccacatgatcgatgaagatgaaccaatcctagagaaggctattggaactgaaattgaatggtatcctggaaagagcttgacacaaaaggtgctaaagaagaagccaaagaaggggtcgaagaacactaaacctatcacgaaaatcgaaaattgcgagagcttctttaatttcttcagtccacctcaagttcctgatgatgatgaggaaattgatgaggatacagctgagcagttgcagaaccagatggagcaagattatgatatcggatctaccatcagagacaagattattccacatgctgtttcttcactggagaggccgctcaagatgaggactttgatggcatcatggatgatgatgaagatgacgacgaagatgacgaggaggatgaagatgatgaggaggacgacgaggaagatgaagacgatgatgatggtgataagaagaagggcgggcgagttcctgcaggggaagggcagggggagcgacccgcggagtgcaagcaacagtgaggtgcttcacacatgaagactattttccttggctgaagaatgtttggttctgcttgatgctatgtcgttgagtttggttctgtggagccagtgggggattgattgcgttggttttgtggaagaaccggtggggggtttctttgtcagggacatggtattatatactggtagcatttcaattgttgtattgggttgaaatactttgtccgctgctgcgagtgatcatcgatgttgcaagtttggtagtcctacttgttttgcctggtgccggggaaattttaattacttgggtgttgtgtgccctacattcattgtttcaaaatgcatatctgcattgcctggctaaaaaaaaaaaaaaaactgaaactaaacttgtgtcgaaaggcctgagc

SEQ ID NO: 13830 - DNA, 550 bp, Triticum aestivum
  Clone ID: PAT_TA_13830
cgtgctgctgcatgtaggtcccgcagtcgatgtccagtccggccttgagcgcgagtgcaaccgcgtcctccggcgtgggcgcgtaccgctgcgcgtcacgcatgatggccacggcgtcgcagtcggaggcgacgtacccgtcgaggccccagtcgcctctgacggtcttggtgagcaggtcggagttggcgcaggcggggacgccgttgatgccggtgtaggcgcacatgacgcagctggccttgccgtccaccacgcagctccggaacggcgggttgtacgtgtcctccaggtcttgcgccgtcaccctggcgtcgaagttgtagcgggccacgccgttccagtcctccaggtcgtacgccgtggcgtgcttacagcaggccgacgtctgcagcagcgacgccgacgagttcccctgcaggcccttgacgaacgccacgccgtagcggctcgccgtcgtcgggtcctcccccggggtctcctgcccgcggccccaccgtgggtcccggtagatgttcacgttcggggaccacatcgtcaggccctccgc

SEQ ID NO: 13831 - DNA, 462 bp, Triticum aestivum
  unsure (1)..(462): unsure at all n locations
  Clone ID: PAT_TA_13831
ttccttcgaaacgtttgttgcagcaccaccgttgcataacatattcacaagggagntgggcaaaacccatatattagtaatacaaaattcccactcaagatcagcccgccattttcctccacgaggaggcgtcccaaaggtctcactcaggccgggtgagagcatcagagtatacattcagcgccgattcagtccagcccaaaactgcgcattattcaggcgagaaatcaaaggaagcgtcaggccatgcgcccttcccagccgttctcaagcagcagggggcacacgacgacagcgcccaccacggggaggagcgccgtggcgacgtacttccagctgagcgccgccgacggctttatggtccgcagcgtgccctcgtaaggcgaatcctcctcctcctttcaagggcttccctccgtttccaccttgccgtcaataagggccggggttttctccaccaaa

SEQ ID NO: 13832 - DNA, 917 bp, Triticum aestivum
  unsure (1)..(917): unsure at all n locations
  Clone ID: PAT_TA_13832
cgtccgcggacgcgtggggcagactcctaccgttccagttccagaggctcccaagcaggaggcggccaaggctcctccactccagcagattcccctcactccagaggctgtcaagcagcagccaggttcggaggaggcggcgacggcgccccggcgggagtggaagccgctgtgcgacctgacgtcgaaccggcgcatcgactggtgtgagctggacggcgacgtgcgcgtccacggcgccaaggccaccgtcaccctggtcggcgcgccgcaggccgaggagtggcgcatcaggccatacccgcgcaaggtcgaccccaacgccatgcgccacgtcaccaacatcaccgtgcgctccaccaagactctccccggcgccggcgaggacgccgagtgcgcgatcaggcactcggtgccggcgctgctcttctcggaccgcgggtacacgggcaactacttccacgcctacaccgacgtcatcctgccgctcttcctcacggccaagcagtacggcggggaggtgcagttcctcgtctccgacctgcagatgtggtgggtcggcaagttcctccccgtcttcaagagcctctccaactacgacctcgtcgacctcgccgccgacaaccgcacccgctgcttccgccacgtccaggtggggctcacctgccacgccgacttcagcatcgacccgctccgcggcccccaacggctactccatggtccgacttcaccaagcacatgcgcggcgtctaacggcctccccgcgccgcctcgccgtgcccgccgccggcgccaggccacgccgtctgctcttccccccccccaaaaacggggttnctgnacnccgaacanatctncnggngggcaaaaggngggttcaaggtgnngggctccnangganccacaagggggccttt

SEQ ID NO: 13833 - DNA, 1014 bp, Triticum aestivum
  Clone ID: PAT_TA_13833
cgtccgcggacgcgtggggtctgccctaaccttgttccatccccacccaacctccacacccatcgaccgccggcggcggcggcggcgcccgcaactcttctcgcaatatttgggcccaaacctcttctgcccttaaatctggcggccgtagatgaaggaatctcaagttcgttctgtgctcggattggaacaagtaaggaacaggtgccagtctcgttgtgtaatcggattcgtcgtagaagaaagagaccgatttcggtttgtattagaaaaaggtgctgtttttatatgtccgccccttgcgagacaatagtaaatccgtcgatttacgaattgtatgccagcctgaatcggatcaggacgaggctataataagcgctgggccggagcgtcgtttcaagaatataattatttctttgcgttttgtttgtcgctgtaagttgtctgttttgttccatttgagatcggatcgccatgaagttcaacaggtgtcgccgccgcagccgtgattcgaaaaaagcagcttattatggggaggaaaggctaagcgagctgcccagtgatgttgtggtcaacgtcctcgagacggtgaaaacacggttgaagaaagcagctggtaatggggaggacaggctaagcgagttgcccaatgacgtgctgctcaacatcctcgagagggtgggtacccttgatgccgtaagaacctgcatcctgtcgaagcaaatgcagaagctgcccgctatgctctcgcagatcgtaattgatctcagccctcgtgatttggttcaaatggatggtgttgtggctgacgtgacggacaagatccttagtacgaggtctccacagatcaccgttcgcaagctgaagctcaaatttttcttggttccctctcgctgtctctccatcggcaaatcggtcggcctcgccatggcgacccagaagttggatgcagctgagtttgagatcatgccactgatggataacagatgttgcactgatgcccatcgcctgctc

SEQ ID NO: 13834 - DNA, 607 bp, Triticum aestivum
  unsure (1)..(607): unsure at all n locations
  Clone ID: PAT_TA_13834
accacaactacatactgtacatttcccacacattcctgttctgtccagtccgactctcccttcatctccctcgcctgcccggtccgtacactctcactctcccggctgtgtcctgcgctgtactgcacctatgcaggcccgtacataacaatccagtaagcccctgtatccccccgccatcgtggcccgtcgacggccaaccgctgccgccgccgctaagccccccgtctcgtgccgtggaaggggcaaacaaccgcgaccgccgccgcgggggctccgctggcctggccggggacaggctggcccccgccagcggccgcgcggcgcccgcccaacggccccgcggtggacagcaccaccgccttccccccctgaaacctgtacaaattgtacctgttccgcaccgccaccgccaccgttttcccgccgtcctggtccgcctccacccgccccgcaccgccaccgccaccgtctcgccggcgtccaggtccgcctccaccctcccgtacagcttcctgaaccgcggcatcgccgccgtccgcatccacaccatcagctcctcctgctcgctcnnnggnnnttctcgggtcgagccgcccgccgncnn

SEQ ID NO: 13835 - DNA, 739 bp, Triticum aestivum
  Clone ID: PAT_TA_13835
atctacacactatatgttgaaaagaaggaattcctcaaaatcatgcgtggaacacaaggtatcgcaaggcattcaggttctctttatagctttcctacacaggaacatattgcaaaattaagatacataacattgttcctgacttatgaaagacggtcgttctacctacaggtctgccttatatctacaggtatatccatgcattccgtccgctttttttgcagtgacctactgatcttcgtgatttagtttagtgctagagttagcaaaatctactgatcttatgtctttgtcatgttccccttgtttgggtggtctacctttggctatgaatgtacgtatattattgtcatgttccccttatccctgcatcactgaacaatgctggcaaactaatgtccctttgccctatgtaatggtgttacagactgccatttgttttgtcgagcttactaactgattttttttacattatcatgaatatgctttaggcatgcctcttctctgtttcggtgaaacaaggtttagggaactctttttaaagacatgtgtatacactatacagaacacatgtttcatcgtcttcgctttttttcatgagttgttgaaaagatcttatgaagcttgattgataatgtttcaactcagatgaagtggtctgtatgataagcttttgtagatcctggggatcggtataccttctgtacaattctctgttctggattcaaatagtttggga

SEQ ID NO: 13836 - DNA, 630 bp, Triticum aestivum
  Clone ID: PAT_TA_13836
ttggaccaaaatttaactaaaatttgaccaaaattggccaagtttgatcagtttcggcgaaagatagatttcgccccaggccgagagggccgaaattcggccgaaatccgtttttctcggccgaaattcaaaacacaggccctaacccatggataggggagtgtaagggaaacatgatgatacattttatttcaaaatggttcttccacacccatcgaccgatcgggcattgtacagttcgtcgaacaaattcagatccgatagatgcgaggggggagaaagaagagctagctaaagttcaagccttcaaggagaggctgctccgggtgccagagccaagggggcactccttcttgcaaatcttcatcgttgcatagcaatatgcatcacctgccaagcagcagtagcactgcggtatgtcgagtttgcagaatgaccagtttttcttgtaggcgcacagcccattgggcaaatgaatcctgttgtcgcccccgccgtcgatgatccggcatcgtgcattggtggcaaggaggaggcagacggtgagaaggagcccaaccacatggctgcgggtcatgtggttgttcatcgtgtgttgtgaatgctgatgttagtgaagcggacgcgtgg

SEQ ID NO: 13837 - DNA, 573 bp, Triticum aestivum
  Clone ID: PAT_TA_13837
ggttttttttccagaagcacatatttattcacacggaactacgcatagcccataaacagccatagcaacaccaagaacaaaacctttcttcagaaaagacataaaccccaagccagaagaagcaattagtagctaagcacctctcagccatgctctcatatacccatgtggtataaactatcgtactgacgaatgtcagccagcaaggcagcttgaaccccatgtaccctccgccggtgtactgcgtccagacatctagggctccgaagcaggtgacgatcacggtgctgagcgccatgatggcggggaccaggaacacgatcatcgacacccgcccggacttcctgacgacccgctcgatcaggaccaccccggcgatcgaggcgaagaagcatatccccgcgtagaccgaggcctccccgatcccgtccatgcccagcaggatgaactggaccatcgacatggacgcgcagaacagcaccatgaacgaagacgtcgccgccgcagtctgcgggggtatcccgatctgaaggagaacggggttgagaagcagccctccgccgatgccgaaga

SEQ ID NO: 13838 - DNA, 1006 bp, Triticum aestivum
  Clone ID: PAT_TA_13838
gctacaaatggggaggcgatattatatatatatgggaatcatccaaaatgaagtacaacactacagcacatattatttttcttacaagatacataacagaacaccaggtacatggtgaagcaaacttaagttatctaaaaactggaaagatgtttttcttggatggggccagagctattcaccagctagctagctgctaaggcctagggtacttctgtctgaaattcagttccaatggtacaacatgtcaacgatgataatttagggtgatacgactctcttgacgatgctttctggctgttccttgattttgtgattgcttctaggtgttctgtaacaagtcaacatgcaccacatgcatcattgtgatggtgctgagctgaagatggcatctatcttcttttcttggcgtgcaggttcctggtgaacccgcattgtttgttgtaaatgcggcctgcctccttgcattccggacaaattaaggtagcgcactgcccaggcaccttctccccacggacaagatatttgctcggactcgaggcttttggagacgatgaaggcgccttgtgtctctagattatggttctttgaaaattctcccgtactttccaagacatacatcctgctcttgttgttaggccagtacctgaacttaaagttccatgtaacaggaagcctcatgtcctccatcttgagtatcaggccatccctttcaagcaaagctggaaggttagcctcggcatccctctttggcactacaattcttccaacatttccaacatcactggtgcgcacccccggccacacaatcatatggtagtctttacagttgaacctagtagtgaaaaatttgctgggcccggttgctgaaattgtgattctcatctagcatcatggcggtttcacttcccatctcaggcggggcctctgaattcttccttctttgggggcgccttttggccctttcggcgtatctgggcctcttcaaggattgtggaggagaagc

SEQ ID NO: 13839 - DNA, 982 bp, Triticum aestivum
  unsure (1)..(982): unsure at all n locations
  Clone ID: PAT_TA_13839
cgtccgtataatgcagcagatgctgacataaatgtgccatattatggatcatacaggacatgggagagaatctccgatccgccagcatatggtaatgaggaaagtgaggatgaaggtgtagatccacccgttaatttttcactagcccaaacttatgttgaagattacctgcgatctgcaagttatgatcaaagggaagacatttactcgtctgttagcctttgccctacaaggaaaactgttccaattgggccaaattatcaggctgagttgccagagtgtgcatctggtaattgtaggagctcagttgatggtaatgctgatgtgtcatcatcttctcacatacgtgatataaaggaagccgagagtgacaagtggattaggaactctgtcattccaatgcctggttctgttgagttatcttcagtgctgaaacctgtttgctgtaagacggattgcagttgtgttgatgaaggttcgattgcgtgcgtgaggaagcatgtgaaggaagcaagagaaagactaatgagtgcccttgggtctgaacaccttcaaagagttaaggatcctttgacatggggaagaggaggtggccttgaaatggactgaagatgaagagcatttgttccaaggatgtggtatcattaaaccctgcctctcttgggaaggaacttctggggacgaacttccgcttgccttcccattgaagactaacaaagagttagtgagctactatttcaatgtcttcagattgaaggaagagggctgagcagaataggttggatccaatgaatgttgacagtgataatgatgaatgggagggaagagatgatgatgaatttgctgtgacagaaagggctggtgaggatttgctgctcnagtctcttactgatcaagatgatggtgcatgcaatcaagttcccctccagggaaatatgcatgaagagtctggtgaggaggatgagtttgactgttgtggtca

SEQ ID NO: 13840 - DNA, 1075 bp, Triticum aestivum
  unsure (1)..(1075): unsure at all n locations
  Clone ID: PAT_TA_13840
cccacgcgtccgcccacgcgtccgcccaccaccgcctcgcaaataaaacccacgtgtctgtcctaaccataccggccaccgtaccatcagatcagagcaacgctctgcactcgctacaatggcgacacgggcacgccgagctctcatctccctcctcgtcctgctgctcgtctcagccaccggtgtggcgtccaagtcgttcgccatcaccaacaactgcgagtacacggtgtggccggggatcctctccagcgcgggctccccggagatggacagcaccggcttcgcgctggccccgggggagtcgaggacgatgccagtgcccgcggggtggtcggggcggctctggggccggacgctctgctccacggaccccgccggcaagttcgcgtgcgtgaccggcgactgcggctccgggcggcaggactgcgccggcggcggggccgcgccgcccgccacgctggcggagttcacgatggacggctacgactccgtggacttctacggcgtgagccgcggggccgcgccgcccgccacgatgctggagttcaccatggacggcaacgacggcatggacttctacgacgtgagcctggtggacgggtacaacctgccgatgctggtggccccgaacgacggcgcacccgccgacgcgggtgcgacgggcggcaactgcgcgccgacggggtgcgtggtggacctgaacggcgcgtgcccgggcgacctgcgcgtgtcttcgacgacggcgggggcgggcggcgtggcgtgcaagagcgcgtgcgaggcgttcgggacggcgcagtactgctgcagcggcgagtacggcagccccggcacgtgccggccgtcggcctactcgcagttcttcaagaacgcgtgcccgcgcgcctacagntacgcntangangacgccacctcccacctcacctgcgccggcggcgtctccgcctacgccatcgccttctgccccagcaccaccagcgtgaagtcggccgggtcgaacccgcaggcgccggcgggcctgccgctgatcaacggcacgatggtgtaccaggggggcgaccagttcgccgga

SEQ ID NO: 13841 - DNA, 2386 bp, Triticum aestivum
  Clone ID: PAT_TA_13841
gcccgtcggccgcccctcctcctcctctccgccgcgtgccgcgcactgatttcagaaattacagtccaatatggcgacaccctacacacctaagagcatcctcattacaggagctgctggtttcatcgcttcccatgtcacaaaccgcattgtacggaactaccctgattacaagattgtcgtccttgacaagcttgattactgctccaatctgaagaaccttctccctgccagctcgtcaccaaacttcaagtttgtcaagggcgatattgccagtgctgatcttgtcaacttcctcctggtcacagagaacattgatacaataatgcactttgcagcccagacacatgttgacaattcttttggcaactcctttgaattcaccaagaacaacatttacggtactcatgttcttcttgaagcttgcaaggtcactggccagatcaggaggttcatccacgttagcactgatgaggtctatggcgagactgatgaggatgcagtggttggtaaccatgaggcctcacagctgctcccaacaaatccttattcagccaccaaagctggagcagagatgcttgtcatggcttatgggagatcctatggtctgccggtcatcactacccggggaaataatgtgtatggtcctaaccagtttcctgaaaagcttattccgaagttcattcttttggctatgagaggaaagcccctcccaattcatggtgatggatccaatgtccgaagctacctctactgtgaggacgttgctgaggcttttgaagtcattcttcatcgtggagaagttggacatgtttacaacctcggggcaaagagagagaggacagtcactgatgtggcaaaggatgtctgcaggcttttcaatcttgaagctgataaagtaatccagttggtcgataatagacctttcaatgatcagaggtatttcttggatgatgcgcggcgcaagagtcttgggtggtctgagcgcactagatgggaggagggcctgaggaagacaatggaatggtatgtagctaattctgactattggggtgatgtttctggtgcactgttgcctcatccgaggacactgatgatgcctgggtatgagggctctgaggaaattaaaggaatgctaaatctgtttactaacaatcaaacaaagatggtggctccaacatcagaaagttcttcccaaacgcgtttgctcaagttcttgatatatggccggacaggatggattggtggactgcttggcaaaatatgtgagaagcaaggaattccatacgagtatggaaaaggtcgcttggaagagcgcttttccattgtccttgatatccaaactgttaagccaacacatgtcttcaatgctgctggtgttactggcagacccaatgttgattggtgtgagtctcacaagccagacaccatacgtacaaatgttgtgggcaccttgactctagctgatgtttgtcgggagcatgggttattggtgataaactatgccactgggtgcatatttgaatatgatgcaaatcatcctgaagggtcaggcatcggcttcaaagaagaggataaaccaaacttcactggttcattctactcaaagactaaggcaatggttgaggaactgttgaacgagtacgagaatgtctgcactctgcgagtccggatgccaatatcgtctgacctcaacaacccccgaaacttcatcacaaagattagccgttacgacaaggtggtaaacatcccaaacagcatgactgtgttggatgagcttttgccgatttcagttgagatggcaaaaaggaacttgcggggcatctggaacttcaccaatcctggcgtggtcagccacaatgagattctggagatgtataagaagtacatggatcccagctacaagtggacgaacttcacgctagaagaacaggctaaggtcatagttgcacctcggagcaacaacgagatggacgcgacaaagctgaagagagagttccccgagctgctatcgatcaaagactcattgatcaagtatgtctttgaacccaacaggaaggtcccagcaacttgaaagccagaacaggtaataatataggaaatatacaccaagcaccgaaagattttaggaaccattcgtcacagcgattcgttagaaatgttttacgatacttcgcagcatatgtctgttatagattcacagaatcgtttgaactatacatttggcagtctgctggtggcagcgagatatcttgtaccttcggtcgagaaacgaactaatatcgagtacacttgtataccttttaatctggttgcctttttttggtgattgatcgagcaacctgtgctctgacaaaaaaaaaaaaaaaaaaaaaaaaaaaaaaaa

SEQ ID NO: 13842 - DNA, 1354 bp, Triticum aestivum
  Clone ID: PAT_TA_13842
agagttatagtaattcagtgaaaatataaacataggaggtgactcatgacagacacaatttagcattttacatccaaaatgccaccggatcttgaaggaacggcttagtggcttctttaggcactttgtagtactgcagccgacggttattgcccgttgtcagttctttatccttgttgaagctgagagaggatgtggtcagacaatagaagcgacgaccgggtagctgcacaccatgagcaacgtcctcctcatccattcggtcctgatcagggctgacacactgtacgaggcagaattcgctcttgcctcccatgtagacaagggtagcaccaacatgcatatcaattgggcactcacttaacagattctccttgcagagcttcactacagggcaagggcacagaccatcatcagtgtcatagatgggcacttcgcagctgtaaagttggccaagggtgtccggttctttggagagcccgacaaagcagttgaggcccaggtcaaagtgaccgcagccagcaaagggcagcttccaatagccaaggagtttccatgaacgtttctcggtgtcaaaggtgtaggtggcctcagtggcgccagtcttggtgctgaagaggaaggtccgttctttgaggatgcaaagagtaggaggtgacgttatcaacatagaatggcggtttctcagagagctgtttccatgaccaacccatgccgcaagactgatcctgcaaccggggggagagctcctccgagcagagcatctcgaaggagcagaagctcagactgaataactcgttgccgacaggtaggtagtagatgggaggaataggacatccctgcccaggggcaaaggtgacgcaccgcgagcgaacgtccaacattgggaagtagctctcagagtcagcttcgggatctctggaaaacaccgccaaaatcttagagccaaaggctgacgtgaagtacgacacgagaggcgccattatgcggcagaaaggctcggaaaaatgcaccggggctggatggcctgagccagcagtatgctgcaacaagtttaccatgcggatgctgtatccatggcaccagtcatcaaagacaaggtaaagtcgctcacggccacgctttggcatcctttttcccctttgctcgtcgcattcttgtaaccgggcggacatggtctgactttttcctggattaatcgtagatctgattccttagattcggcgttgccgttggcccttgatccctacaagtcgatgatggtgcagcgtcaaaacttggcgactcaccaacggagcggtttcggcaattgattgtgttgccagacaatggtaggacgcgggcggacgcgtgg

SEQ ID NO: 13843 - DNA, 594 bp, Triticum aestivum
  unsure (1)..(594): unsure at all n locations
  Clone ID: PAT_TA_13843
cgtccgttttaggtggcggaggttcggagttaggtacacagatcggaagggtctagaagcttccgttccgttggtggtgacgatggcggccctcgctaggtcggccgccgcggtggccgcgctcgcgctgctcgcgtcggccgtcgccggcgaggtcttcttccaggagaagttcgacggcggatgggaggaccggtgggtcaagtcggagtggaagaaggaggacaacacggccggcgagtggaaccacacctccggcaagtggaacggagacgccgacgacaaaggcatccagacgtcggaggattacagattctacgccatctcggcgcagtacccggagttcagcaacaaggacaagaccctggtgctgcagttctcggtcaagcacgagcaggacctcgactgcggcggcggctacgtcaagctgctccccgccgacgtcgaccagaagaagttcggcggcgagaccccatacagcatcatgttcgggccggacatctgcgggtacgccaccaagggtatgcacgcgatcctcaccaagaacggcaagaaccatctgatcaaacggggaatgccctgcgattnttttaa

SEQ ID NO: 13844 - DNA, 729 bp, Triticum aestivum
  Clone ID: PAT_TA_13844
cgacccagcgtccgaatctttgacaatacgccgtcaccatgggcgcgggcacctcctcttctatgctcggcggggctttccttctcctcgtcctctcctcggccactgaagttcagggcgggccaagctcgagcgccgcgccatgttccccgctggactacctctgcaacaacctcggaccttggtacgtcggggcgaacgactgcgtgtccacactctgcatcgacccctcctgccgctctgcgcccggcttgccggagctcgcagtgatcgccaccaggctgacggtgtccaacgccacggtggccaaggcgagcatcgagcatgcgctcgcccacgtcaaggacggcaaggccaggaaggtaatgcggtcgtgcctccagctctacaccggcgccatcccaaggctgcagtgggcggcgcggtcggctgctgctgggcgatacagcggtgtaccggaggtgatactggctgctaggtacgtctcatctaagtgcaccaatttggccggcgagggggcacttcccaaggagaacgttgagttcttcatgatggcctacgtcgccgaggccgtcgtcgaaggggtgcagctttttatcagctgaccaatggatgaataacccgctcttcccctccgtaataataagataaagacgctgtcaaaactgtaagaactatgcaatggtgtatttgtggccggccaatcaagtcaccgttgcttggtccctt

SEQ ID NO: 13845 - DNA, 1497 bp, Triticum aestivum
  Clone ID: PAT_TA_13845
cgtcacgccaccatgatggcagtcggccctgcctctccgctgctctgcgcccctccccctctattcgccgccgccgcagccccgccagtcatctccgcttcgcggccctgctcctcgcgcgccggtctgccgcagaggcgcggcggcgccccccgctgtgcggcttgcctctggccccatcgtccttccccgcttcgccccgcctcgccgtcacggcaggccggcgccacccgcctagccgtattgcccgcggctcgacctatctcccgcaactcgccagcgggcgctcggagcggatggccacaggtccccaagggcagcagcgcgcgggtgccgcccagcacccgggacgtcctggtccgtcacgccgcgggtcggtctgggcatgtctgacgcgccgggggcccaggcccgcggctagccggcgctgccacacccggggggccggaaggcgggggttgtggtggtgggctggacctcggggtacagcagcgccaagtgccaactgggcaccgccgagcggagcgctgcctctgggaccgatgactgtcccaccaagagctgcccgaagagccctatactcccccccctgctgctgagagccgcccgccttggaagcgcaccccctccaccgacatgacctacggcgatagccagcccgacattaccaacgaggccgcgaaggggaggcatcgtggatgcaacccggccgaatcctccgtccccgattccccctcaccgcaggcagagcagggcggccgcagggccatcatataataaattcgaggctcgatctttctgccgaaactcttcaaggacgcttgattggtgaacacagaggcagagctgcagcaggaggaggattagatagattactctgttattactattaggtcttctgtcaaatcgcagtggggatgtctaataagcgccggggatatgccggcgacggcggtgaaaagaggtcgcggcggatcaagcatctgtacctcgtgttggatgactggaccaaggggtacagcatccacaagatccaagccgacagcttcgactctgacatggtctgtggcttcggcatcaccgtggtcgttgatgagatgctctatgcattatcttaccacttccgcgtgaaacaacactcctttggggtcatgtcatgggggtccaccgcgccggatgcgctgcaacaaccaaccgagggctggtcctggaagactctgccgccaccaccgccaacgttccaccgccgagtcaactcctatgcactacacccggatggatgcaccatctttatgtccacagctaacttcatgacggcacctagcaaaggttgcatgggcacctactcattcaacaccaaggattctgtgtggagatggcatggggagtgggccttgccattcagcggccaagcacacttggacagggagctcaacgcttgggttggccttgggtgggatggctacctctttgcttgccaaggtgcctcccccagct

SEQ ID NO: 13846 - DNA, 1118 bp, Triticum aestivum
  Clone ID: PAT_TA_13846
ggtttctttttttttaaagtgcaccgttccaaattgttcttattagaatacgctgagacatacgctgcaatataagcagcagtagatgcacgtaacatacggcgcaatatacgctagacatacgtgacgtaaagcacgcaacgatcgcccatgagcgacttgtttagatatacaccacacggtatatagcggtggcggtgcttcacttggtatagccgatgctgacgccgccgatcggtgaccagctcgccgccgcacctgcccgcaggccccccgacaaccctccggcatcccgctgccccccttgttgtccgtccggtccctgtcccccgtcccccccccccggccggcgcggtgccccgtcgccgcgtcccccccgccctcgggcgccgtcaccgccacgccggccggcgcggtcccccgacgcggcgccgcccgccgccccccggcgcgctcccccgccccccgaacttgacgaacttgaactggtcggcgacctggatcccctcgacgatcagccacctcctccgcctcctcccttcctccgttgtcgctcctcgacagcctggggccttgtcaccgtcacccgtcaccgtctcacctcagcgtcgccgggagcgcgcccgccgcgggcgccggcgtcctgcgggatctcttgcccggcggggccgtcggccacgccaggccgacgtcctggtacgcgtaccccatggcggccgggtcgaggcagtcgcggacgcggacgcgcacggggcgggcctcctcgtcgtagaagaggaaggcggtgtcaagccagtcggcgtcggtgaagtcggcgttgccggggcggaggccgcgccagacgtgccagaggcggtcgatgttgccgtggtgcgcgaagaagatggggtcgcgcgccgccgagtagaagttgcccatgtcctcgctgttgggctgcgccgggtcgcccgtccagatgtgcaccgtgttgtgcggcaggttctccagggagcccgctcccgggtccggctggtcgccggcgcggtatggctgccccatgaacagccgagtcttcttggcactcgacaccatctggcggtacatgatgttgaggttctggtcgatctgcggacgcgtgg

SEQ ID NO: 13847 - DNA, 950 bp, Triticum aestivum
  Clone ID: PAT_TA_13847
gaaaacaactatttccatatcaaattatcaatgtcgattacacaaagacacacacatgtgcccatagctaggtattcgatctgacaaaccgatcaatcactcggtcactagtagtttacgacggatcggtaggtccttccagcctgccatccggagggaatgacattgctggcgatgagctgcttgccggagccgaaggtgaggccgatagatatgggggcctgtagggtggacctggacttgtacttccacactgcacccgacaactcctgcatcgacgcccatccaccgccgcgctgctgaaggtcgaccgctgacaggtcgccgtcaccggcctcgtactctatgagcactgcgaggtagttcggattggagcgggcatccaccttgaaaacgatgttcagcccatgccagttgcacggaacccggttgtactggactctaatgttgccagctttgcggaggttgtcggcctggccgggctttgccatggcgccgaacgctttcccgctaaggtcgaagtgggcagcctcggccaggcacggcccgccacggcacttcatctgtgacgaccacggtcaccggaaacccgaagcaagcggcattgccggtgcatctcacctggtagcaagcgccgcagcccttgccgttcttgaagatggaggggccgcccgccgtgatcatggcggagaacggaggcttctccacgtcgtgctggtatccgcatgcaccaccgtcggtgcctgcgccttcggggggaacgtaccacgtcgcgccgccgtcggaccaaccggagacgctgcacggatggaggatgaggaggcagctgatggctagagccgctaaagcggcgaaggaagaagccatgcgcgcacttgaacaatatacgattgctccgcgtacgcgagaggaaggagagaacgaactggagacagatcgcggacgcgtgg

SEQ ID NO: 13848 - DNA, 687 bp, Triticum aestivum
  Clone ID: PAT_TA_13848
aaagagacaaaggggtaccttgagcattgaattataagatagtagcgggtatactcgccccgccttcattctagttttttcttgcggctttccacaatgatttgctataagctgctataataggcaataaacaatcaatctacttaatttcttgttcaaaatggatgaaacatgcttacactcaacctggtatacattgaacaagatgaacatactcatgtataactaatttgcctagaaccaaacagatgtgacagagaactcaacaagacagtcagaacacaactacagaccccacgaaactaacctttatatccaaacatcagccacccttcatatccaagttgggccaacaacttcatcaagaattatcgcagattgctgtgattctcaaacggggtggttgctccggttccgcactccttttccagaatgctcgccgccaccatacctcgaaccctctctgaatgtttgggcagtcctccccagagttgaggaaccgattaaaccacgcaagaaagatctcctgctgagttgcaagtggcagcgtcaggatcgtgtttgccagcccttcctcaatcaaatgtcggtcaagccccttgcatgctcgccgcatccacccaaagtcctcatagaacggctcaagccaggtactcaggagctgggagcgggcctccttggacacta

SEQ ID NO: 13849 - DNA, 1134 bp, Triticum aestivum
  Clone ID: PAT_TA_13849
tagcgtggtcgcggccgaggtacaaatcttgtggcaaaggttcctctgttccgacttcttctggttccgttcctggcggccatctgccccgtggtgtcgctggggtgtgcacgaattgtcggtcggaaagaaacgccaatgtatttttttcctaggatgacgcattttctcgcacttttttcccttttcaatgcaaattgtggtgaacatcttgaagcgcaaattccttcatacttgacgttaattaatggcattcgaatacgtaaaagtttagttcttaatgcagtaatccgtgctgaatgtctcagctttgggttcagtagcttctccatgtcatcaatgctaactatatgttctactaaatcgctttttggtcgcaggccgttacgttctcggttgagctggtctttagtccttagttttgaaaaacagtcaacaacccgaggatttatctaaccaccagccttgagtgatagtttcatggttttctggtcaacccgagttcgttcaatcttgaagattctttggctgtaggttaactttgaaagatgtccaaccaattattggtagaaggcattctcttgacccgttggataaaggcccggcgttgttcccctctgctcttcttggtctactacattcccagccgcggtagtaggggttctgcgttgctgccaagttggccctgctggttgcgaggacttactgcaatgggttgtccttgtgcttgaattaacaaaggatcttcaatgggtgtgccaatattgcttgggtagacttttggtgacaggaagtccattatccttattgggctctcacttggaagaacaatggtttttgcataattatgatgcttgttgttatattcacttggtgggaggctgaactgagaagacggagtaggtgcaaaagttttagattgttctgaacctgcccgggcggccgctcgacccgaggatttatctaaccaccagccttgagtgatagttttatggttttctggtcaacccaaattcgttcaatcttgaagatcctttggctgtaggttaactttgaaagatgtccaaccaattattggtagaaggcattctctattccagttggaaaaatgacctgcttatttccctcgtgccg

SEQ ID NO: 13850 - DNA, 678 bp, Triticum aestivum
  Clone ID: PAT_TA_13850
cttggcgcctagcgtgcacggcctgcagcttgttttgcacgcacacgcaattgaaactggaaaaataatgaatatagtaacatactgccgcttatatccgacgaggcacgaaatggaagaccacacgatcgaaactggaccgatgcacccgttgtgaggctacatgcgtcgtcgcgtttgattccattccacttccaccacacaaacaaaagcagagagcacaagtccaaggattgaattgaccgatggtgagatgtgctaccagtagctattggtcctactaagcctgctgcgttgaattgtgccgtaccgacgacgacagaccgatcaaggaatgccaccggtaagaaacaatgggagtattccttgtttgcacttgctcaaccacaccgtgctgcacaaaacacaaaacaaaaatgggcctagcataactcgacgacaagaataaatactgcttttcttgacaagaatgcagaaaaaaaaatcagcttatcttcttaaagatgctccgaccccatctggacggatggcctactctacggatatccacgttgttcagttcaactgaggggtcacaatagtctgctgagggacttgatcagcagcttgatgttccgccgtgtcgcctcgtcgccggtgaaaccagagatgtccgagctaatactctcaatgttcttc

SEQ ID NO: 13851 - DNA, 573 bp, Triticum aestivum
  Clone ID: PAT_TA_13851
tattgttgttttttttttttaccaagaacccattagggctttcaacatcgcagggatttatataagactacaacattttacaagcgcttcacccggcgtttttgttcattccatgaattgctctcagcactacataacacaagtaatcaactgctgactaacaagtaacaacaaagggggagaggtcagttcgacttggacaccgctagccaatttgcatcccattcctaaaggaccaaaagaacccagaggacaaggctctcgttattattcacccctcttaaatgccaacactcattcttcatcatcatggataaaaagatgacaagtagcggcaaatttcccactagatgtactaaaagctagtaagcatcgacttccctaacgaattgtgaagctaacgcccttccttcatcagcaaaatgatgcgaggcccacggcttctttttccttcatactttcaacaatatacagggacctttcctcattctacggggacctacacctcccgcacgggagttgttacaacagcccgcactgagttgatcggccggacacatcccttgggcgcct

SEQ ID NO: 13852 - DNA, 662 bp, Triticum aestivum
  unsure (1)..(662): unsure at all n locations
  Clone ID: PAT_TA_13852
ttttttttttttttttnnnncagaaacaaactaaaacgaagttcatcacttccattcaaggaataaaatcatgccaacatggggttcatcggttacattcaaagaaccaaccgtgtcacacaggttcagtacagcagaggcccccagccccaagttcagaaataattaaaacaaaactgaaagcaacacatgagttttaatacagcaaaggactccagcctgaattcagaaataaataaaacgaaatttgataagagtatttcctgggcacctgcccaaagaaaaacacgatacttaattcaccagcttgcttgtggcaccaaacgaaatgagatgagagtatttttatggcagatggtgcagctagtaagtagtttctgtagtttgcttgttcttcttcagttaagtgcagagaacagagctctgccccttatccttcacgcttctcctcccacagatagctccttgaggcatctaactgctagatagtgtagcctcccgcgtcttcgccatgaagtcgccggtgctcctcttgaagcccaggcacccagcgggaagtgacctcttgcatatcctcgtccagccacagctgttgcagactgtccagccccactacatggcttaagttcggacaaccaaatacacgcagctcagtcacttga

SEQ ID NO: 13853 - DNA, 1054 bp, Triticum aestivum
  Clone ID: PAT_TA_13853
tgaaagatgaagaaatctctgttgaaaataataataacaataataacctgatggctaaatctctgttgcaaacaagcctcaactgtcggtaggtcaagtgtcactggcactggaatttgctggctggtatccaaatatgagtgaaacgtactgtagttacataaacatatattggtgatctaacaactttagatgagaactgcaccacaactgcacaaagccactaggaggacaaaaagaaaactatgaaagccgctgcttcttgacaagaatgtacaagcacaagggcagaaccaaaaaactatttctgctacaaaatattctgttgaggggaaggcctgactgataaaggcggctgccgcttcataccctaatctggtgctccaatatatgtcctgctaagcattattcatgacggggttgcatccatgaattcttttgacccctctctgtctgcacctttattaaactccctgctggtgaattgcacggggagtgccatattgtgcttcttttctggggctcttgatgaattcccatcagctgtcccccttgctgctgctgcatctactgaaggtctggagctaccaatatctggccttgcatcagctgtcccccttgctgctgcatctactgaaggtctcaagctaccaatatctggccttgcatcagctgtcccccttgctgctgcatctactgaaggtctcaagctaccaatatctggccttgcatcagtaggaacaagcttgctggtttctttgtcatttgttgatgatggaacaacatcaagctcaaggtcaccttccagcccgctgttagatggatcctgaacgccatccttgtcttctcctgacgctgtagggtctgcatcagctttcttttgtttttttgcgttaggggtgccatcatcctcaggatcatcgtttcctgcaccagggtctgcgggatctgaatctttccttggtctcttccactttttcgtagatgatgtgccatcatcctcaaaatcttcctcctctctaccccggtgcagatccgcccgcaatttttgtcc

SEQ ID NO: 13854 - DNA, 1114 bp, Triticum aestivum
  Clone ID: PAT_TA_13854
ttccgcacgaagtgaatgcgccgtgtcatgtgctccattatcgggtccagcagaaccttgtccaggaacgtcagcgtcgtgccggagtcgatgatgacgttggacaggtgctcaaacctcgcgttcccgatcctgacggactcgagcacgacggtgtagagcggcttgcgcgggtcggggcggagcagcgccgtcgtcgccgcgcccggctccgtcacggcggcacgggcgccgaagttgagcggggaggaggcgttgacgtagtagggcgcgaggcagtaggagaacctccggccgagcgaggtgccggcgccgatctgtgtgatgagggagaagtcgccgctgccgagaccgacgacgccgtccgcgcggaacgtgccggccgtagccgtggagcagccgaagctgaaattgggcacgagcagctgccgacgctggcggcacccgacgcagccgccggggccatcgtcgaagatcaaactctcggtggagaggaggccggttgtcttcgagccgtcgacgtaggattgggcgtacttgcatctggagctggcatcgcaggaggtgccggggagcttgtggcacgtgccggactggcagtacacgcggccgaacgtcgacgaggacgacgggttgaacacaaggctcgcgccaccggcgattgctgctggagtcgtcgtcgctgcggtacggacgttggtgcacttaaaccagacgaggttgctgccggtgtcgacgatggcgagcaccctggtggccggcgtgcccacgttgacgtgcatcaggtactcgaactgcccgtggacgacctccgacacggcgccgtgaggggagccgccggcgtaggagcgcgcgagagctgaggcgcgcgccgcggaacgccgcacggcggcaagtaggcggccgtgcgaggtgagcgacgggtcgtggaacggcgactggacggagtcccggtggatgaactccacggtaaacccatcgcggccgacgtacgccgtgcatccgcatagctgggccgtcaggacaatggcaacgacaaggagagcgtagcatctcgcacctgccatggcgtatcacgtccgatctcgatgcggacgcgtgggcggacgcgtgg

SEQ ID NO: 13855 - DNA, 952 bp, Triticum aestivum
  Clone ID: PAT_TA_13855
gatcaaggtctaattagctcgcggatgcaacaatatattttacatagacagcagaaatatttgctaaaacatctcatcaccccgttaaaagctactaaaaaaaacgagacagtggcaactggcaagcaagatccatggaacctgatgtatcagcagcagcaatctgtcaatcagtgagtgaaagtgtaaaagacggtgctgatgtacacgacgagggcggtggagacgagcccgacgagccccgcggcggccttggcagcggcccggttgctggcgcatcccagggtgccgagccggatctgcacgaccatcaccatggacgccatcaagaagacgcagccgacgacggagcccacggcggaggccagcatccccagccggagcaggcgggcgtcgatgtgggcgtgcgtgtcgtcggggtccttggagttgatgaggttgatcgcgagcttgaggccctgcgcgacgaggctggagaagaggaaggaggagaaggcgaccacctcgaggaccagcagggaccgcgccacgtcgggcccggcgtcgcaggacgggtcgccggcgaggctgcgcagctcgccgggggtcgcgagggagaggcccacgaagacggccaccgtgaagagcgagttcacgttgaccaccccgtccagcgccgtcacgtgcacgctcgtcgtgttcgccgacagcgccgccgggcagcttccactcgtagccgtggtgctgcccgccgccgttgccgcgctcgtcagattcatccatggggcgccgggaggaggctggatcggatgctttgcttcctcagatgctgctgtcttgcagatcgagttgcttttgcttgttgggaatgtggggatcaatcagaagaatgaagcggagagcgtttggggaactgaggggccaatcgcaaaacgaccgtggcgaccgaccgaccgtccgggggacatgggcc

SEQ ID NO: 13856 - DNA, 646 bp, Triticum aestivum
  Clone ID: PAT_TA_13856
ttcggcacgaggcgaaactggaagccccgtccgcccacgcgtccgcggacgcgtgggcgccgtctgggcgcttccgaccgaccggcgggcgagatcgtcggccatggactctccacctccgttcatctactgccccccagccggcgacgccgacgacgccggcgagaaggccctcatcaaggcggccatcgacggcaacctcggccgcctcaaacgtattgtaaagcggctcaccaaaggaaatggcgaccggtcggcgattttttctttcaacaacgatggactctctgtgttgcatatcgcggcaagctttggccatctggatatttgcaagtatttggtggaggagctcaagggagatgtaaatgctcctggacatggagtagctctaggtgcgactccatttatggtgtctgctcagtctggtgatgttgctaccgtcaagtattttcttgatcatggcggtgatgtaatgaaagcagatgacaaagggcgcacagttctccaccatgctgcggctataggatgctgcaaggtacagagttcctcctgtcaaaaggagtgcctgttgacatagactgtggccgtggaacaccactatttctggctgctaataatgagcaggataagacattgagattttggt

SEQ ID NO: 13857 - DNA, 1874 bp, Triticum aestivum
  unsure (1)..(1874): unsure at all n locations
  Clone ID: PAT_TA_13857
ccccgtccgccccagccccgaccaaccccatccaccacgcacgcaagctagccggcccactgtgctacgtacgtacgccaccatgagcgccgccgcccaagaaaccacggccggcggcggcggcgatggcaagcgtcagggaccttgccgcccgggacacctcaagcttggctaccacatcgtggtgtccaacgcggtctacgtactgctggccccgttcgccgcggcgttggcgctccgctgcgtcccgtctcaccccgtccgacctggcggcagcgcgcgcctacctcctcgccaacctccaccccgctgtctccctcgtgtccgtcgccacggccctcgcgacggtctacctcgcgcggcggccgcgcgcggtgtacctgctagacttcgcgtgctacaagcccgggcccgaccacgtggtcacccgggagaccttcatgaagcagtccagcaaggccggggtgttcaccgacgacaacctggcgttccagcggaagatcctggagcggtcggggctcgggcaggggacctacttcccggcggcggtgctcaactcgccccctaacccgtgcatggcggaggcgcggcgggaggcggaggctgttatgttcggcgccatcgacagcctgctcgccaagacaggggtgagggccagggacatcggcgtcgtggtcgtcaactgcagcctcttcagcccgacgccgtcgctctccgccatggtcgtcacccactataagctccgcggtaacgtcgccagctacgtcctcggcggcgtccgatgcagcgccgggctcatctccatcgacctggccaagcagctgctccaggtccaccggaactcgtacgcgctggtggtgagcatggagaacatcacgcttaaattggtactggggcaacgaccgctccatgctcatgtccaactgcctcttccgcatgggcggcgcggcgatcctcctcagcaaccgcgccgccgacaagcgccgctcaaagtaccagctcgtgcacaccgtgcggacgcaccacggcgccgacgaccgcgcctaccgctgcgtgttccaggaggaggacaaggctggccgggtcggcgtcgcgctctccaaggacctcatggccgtcgccggcgaggccctcaagaccaacatcaccacgctcgggcccctcgttctccccatgtccgagcagatccttttcctcacctctctcatcggcaagaagatctttggcctcaagatgaagccctacattccggacttcaagatggcgttcgagcacttctgcatccatgccggcggcagggcggtgctggacaccatcgagaagaacctggagctcagtgactggcacatggagccttcaaggatgacgttgaaccggtgggggaacacgtccagcagctcgctctggtacgagcttgcgtacacggaggccaagggacgcgtccggcgcgggcaccgtgcgtggcagatcgccttcgggtcagggttcaagtgtaacagcgcggtgtggcgcgcgctcaaggacattcacccgtcaaaggaagccggcagcaacccgtggattgaggagatccaccggttccccggtcgaggtgcccaaggtggagagcgtcgtttcatcgccatgatagactcgtcaaggtcgagtacccatggttttctagaaaagaatctttctttccaagttgaaaggtatctcctgaattatttgtatcattgtgatgtagcatcaagttaattgatggtttgtagctccattgatatggaacttcaattggtgtatttttgttggtttggctgggtgcctcagtttgttataatataagggagtgactacgtgcaaaaaaaaaaaacacggcctctttaaaantcctg

SEQ ID NO: 13858 - DNA, 1255 bp, Triticum aestivum
  Clone ID: PAT_TA_13858
caacccgtccgcccacccgtgcgcgcacgtgtccggccgccgccgcccgcctctgtctgcgtggccgtgggcgtggtcgacggtcggcgtctgccgccctcgagatgacgacggctgaagccccggcaccgcagccacccccggcaggctgccgccgccggccgcaccaccagcggccgccactcccaccgccctcgcagttggacctctccttcgccatgcgcggccgcctgcgtgaccgtgccccgccctccccatgcatccccgcccccgcacgcgccgccgccgcgagcttcatgaccgcccacggggcccgagcagggttagaccagcagggcggacggggagaggccgggcccaagcaccttgaccaccccctcgcctccactgtcctaccgcagggcctggccctcaacttcttcgtcttccaagccagttcgtgtggtcccacgacccatgggggcccgtggtctcgtcctgtcgccagcgcccgcccctcccacgacaccaagctggtgctttcgcacgtggacccgctgacggagcagcagatcgtggcggtgtacgggctgcagcagtcggcggtgcagacggaggaggcgctgagccagggcctggacaccctctaccaggcgctctccgacaccgtcgtctccgacgcgctcacctgctgctccacccccaacgtctccaactacatgggccagatgggcctcgccgtccacaagctcaccaccctcgaaggcttcgtcagacaggcggagaagctgaggcagcagatgctccaccggctgcaccaggtgctgacggcgcggcagatggcgcggtcgctgctcgccgtctccgactacttccaccgcctccgcgtgctcagctccttctgggtcaaccgcaacaggatggcgccccaggaccagcagctggaggccggccctcacacctagctctcaatcttatcgatccaccaccatgcgtgcctgcgtgcgtgcgtgcatctcgctcatcctatgcatatgcatgcatgcatgcgccggcatgcatgtctctgagaaagttgaaggcagcgcgcggtgaccgtgcaagcttatattagcagtgcagagggggagacaagggaccgtatctgaatgataaccctctaacaaagaatgtcctaccgttgtgtcttggatttggatttattagtagtagcagctagatagtatggtccatcgactcatgtactcctggctgatcgacctgaactgattagctt

SEQ ID NO: 13859 - DNA, 472 bp, Triticum aestivum
  Clone ID: PAT_TA_13859
catacaacaatttctttctttccgtgcggccgccccgccaggtactgttaaggtttaagctgcagccgctttgtaaaacaacaaaggacttttatacaacagcatttttctctctctccctctcttttcaagctaaagctaaagcccagagcagaggaatgataagatgggtcctgccctccgacgtgtcctctcactgacctttgcctcctcaacgaggagcttcttcaacctagagcagctcgagacgaccgtcgccactccggtgctggtcactcgcttgcagtaccccggccgccaccacgccagctgtaagcaccccctgaccaggtgtcccagaccaacatcggtgacccctgggcagtgcaagagtgcaatgtctttaatctgggggcagccttggccaatctctgccagccccatgtcccctgtcatcggcaaaacacttatgtccagaaagacaagatcacca

SEQ ID NO: 13860 - DNA, 687 bp, Triticum aestivum
  unsure (1)..(687): unsure at all n locations
  Clone ID: PAT_TA_13860
gttgngacacccatattggcttaatatttaggggttacgaatgctagattactggtaccagaacacctctttacatgtaatctagcccgacaatatgccgataattggctaaaagtgtcggtttgccgcagtggaagggtgattactgagcacccatgttttaaaacaggccatcaaaagatgcaaaacagatgacctggcaggagagcgcatcggtaatacggcaacatacttgcccgaagtacctatatttcagggtctgatggaaccaataagagaactaccgtcgcccacggagctttcttcttttagctccttttagaggctcagggctggaagggggttcagaaacaggtgaatccgtctggtcaggaacttcctgggctgaatcactgtccacatcagcattattatcattaggctcggcctcttttccatcttcgatagctttaaaaatgtaaatcttaaatctgtcaggctcagccaattcgaagaccaatgaatccccatcctccaagtcgtggtgcatcgagaagcctctccatccaccactcagacctgttcgatttccgatgtatacggcatcaaattcaacaccctcttcatcctccaacaccatcttatgttctctgggaggcagatgatctttgcagaaactagaagggagacccttgtgtaaaggaaaat

SEQ ID NO: 13861 - DNA, 729 bp, Triticum aestivum
  unsure (1)..(729): unsure at all n locations
  Clone ID: PAT_TA_13861
agaaccctttatgtctgggtcgacgattntttacccctggccagttgtggtacttaccngtggttttgaacggttacctttaccgntgactgncaaacagcctnggaacgttgntacagatgnttgcattcttgacacgcttcgcggcctggtttctttacaaggtggtgctacgagtacagcctataaaaatcaggtcagaagaaacctgtcgccctaaacgccccacagctcatgcagtgaaattacaaggataacaacagccgctatacatgtctacaaaggaacggtgctagctgagcaatctgaggaggagctattcaactttgccgagacgtagttttttaggctatgcacgggttgtcggatgtcatctgccccaagaccatgtcggagggttcagacctcgtatttgagttcaagcaaacggagaagggttcctccttcatggagaagaaccgtcaacccaaagaggaagaaatcctaagacagaaggaagtgcagcaaaaacaatacaggttaaggcaagagctacgctttgcttcaccaatgaagttgtttgacgagctttagcgatacaaaatggcaccacacataaattatcctgcaacaacagaacatctgcaacagctaccgctgttgcactggcgcgttgtgctagaacaataccgactgttgcagctgcaagagctggtgcattatttataccatcaccaaccatttattaaa

SEQ ID NO: 13862 - DNA, 466 bp, Triticum aestivum
  Clone ID: PAT_TA_13862
cgtccgcccaaatcaagccggccgcccgccttccctccctcctcatggcgcccaagcatcttcctccggagtccctcccgcggcgcatccccaccggcggcttccacccgatcacgatccacgtccgcgtcaacagggacggcacgtacctccccaggtacctccccgtgacgggcgggccgttccgggacttcgcggatctcgaagacgccgtccgcgcgcgctacgcctccatctacctcaactggcatcgccggaggaagcccaacgacccgccgccgccttcaacgttaatgcaccaaggcggggtttcttcactggaaatggccatagaagcagctctttactggcctgatggcgcaaggaagcgttcaaaatcagatcacgctgagagagcccgtaatggaaggcgcccattacttcaagctttggtggacagcataacgaggatcacaatcttttgggg

SEQ ID NO: 13863 - DNA, 1327 bp, Triticum aestivum
  Clone ID: PAT_TA_13863
cggctccacccctccgcccccgcccctcccccgctccgccccagctgtccccccgcccccgccctcgccaacccccctcctccccggcccccccatactcgtccccccgccgtccccgcccagccccgccctccccactcctcccccccgcgccgcgccatctttcccgctcccccagcgcagggcaactaatctttccgaacgcccgggcggtcggaatgggccccgggggcagccagttcggcgacgacggccgccccccctgccccgtgccccccgtcgaccgcgatgacaccctcaacccggtgggatcaggcatcggcctccagctcagtaacgacaacccagtaatcattgtccaggagctccggatcgacaagaggcacaggcccagcctctgccttctgctggacaaagagtaccgaaccaacaatgatgggttcccgggctttgggtaacgaatggccctccgatgatttcctcgggtttgtccatgtaagttgggctaagggaaacttaaagcctgaccctgtactcagggacatccgtctggagctagccaacccgcaacccgggctacaaaaagggtgacggtcgcgatcttcttggggcgggtacagggcttggagtcagggatgccttgaagggggtcttcgttcttagacaaataaaacgcgatctcccacacccccgcgcccccgaacaatccagagctttgcgataaaatgacacctccgccactcccagaccctggggttgaggcgccaatgtcgcataccctgcaaaccgcgtatatagatgctccgctgaatcccttcaaccttgccgacatcaatcctcagactactatatttttcgatgatagtgtcagggacctcctgggagggaagcaaatcggaaaacgcactgtcctggccttggagtctcttcgcaacaaggaggctgcctttccgttgctgtgcgtgcacgccgtgaaggaagcggatgtcaggaactcggtcgaagctgggatcgatgcatcagtcagcgagtaaagcaacgcgggaaccgactcatcgctgactgcggtgaatcgtcacgtaatgactcaaggttttgtgtgagtgggaacataagtcggccagaggcattcttaattatgtagtatttgtttttctgacagtagatgtactgataagaacaagagaaaattgctgtaatcgttaagggaactgatgccacgttcgttatgtttgtcccctataataagaaataaatgttgtgaacctcgctgtggccccgttcacggggctgctgaccttctaaaattaccactataaaatagcga

SEQ ID NO: 13864 - DNA, 899 bp, Triticum aestivum
  Clone ID: PAT_TA_13864
tcgcggccgcgccgactgcctggctcccgccgccccggcggggggggccggcgcgcgggctccggggtccgttgaaggaatcaatgcggggttgtatgcgagagagttaatggatacttcccttcagagtcgtacggcgctgctaggggcgcctcgcttgcggtcccaggacgtgcttgcgctgccggtagtggaagcacggccccctggttcttcgtccaccctggtggcgcacttgcttgggccggtccttccgacggctggtttggggtagccgggggtgctggggctgtggatcggtcgagggtatacacaaacaaagccgatgacgtacggtttcaatttcccgttgcaaattgaaaatggtgttgatccttcaagacttgtacagaattactcgatcgatttacaagaaggtgataccatcataacagcgtcagatggtctgttcgacaacgtctacgaccatgaggcagcagcgattgtctcgaaatctctagaagccgaccgcaagcctacggagatcgcggagctcctggctgcgagagcaaaggaggtgggcaggtccgggtccgggaggagcccgttctcggacgcggcgctcgcagaaggctacctgggttactccgggggcaagttggatgatgtaacagttgtcgtgtccattgttcggaaatctgaactatagactgttgataagttgtatttctatatctgatggccatggccgcagcaagttgcgagccatattgggatagagttcaaatgattgcatcttgggcctgaagaatgacccaattctttaaaaaaaaaacaaaaaaaaaaaaaaaaagcccgccgcggcccggcggtcgccgccggcctcctcgccgcgagcgcgaaggaggtgggcaggtccg

SEQ ID NO: 13865 - DNA, 691 bp, Triticum aestivum
  Clone ID: PAT_TA_13865
gttttttttgcatggaattactaaattgtagctagtatttatttgtcccagctcatgcttttttctttatttatttaatttgagggtatcgatttaggacaatgcagttgcccatgcatctatcctacataactgggttcaggcgagcaggagtgaaatgccacatacttattctatataccttcatgacatgagagtattagcaagaagagctcctcctagggcatggacacacgaggcactcataggctctcatagcgcaggtgtctcttcttctttagcctcctgcggcgagtgccactctcccagtattggttgtggaacaccactttgtccgccagcacatgcttcccatcatcgttcctatgccactgatagacggcgtgcgtcctgttcttcagctgcagggtcgagtgcccataactggcctccctgaacgcggagtagtccgtttgcgggtcgttgaacctcgaagcgagtccttctgtgttgcctccatcgccaactgttatgtacacgggagcggattcatctggcaccgggtatcgactccccgatgtcaccttgtagtccacattggatacacggtgcgatctctcgtaagcatggacatggcccgcgaataccaggtccacatcgtacttgatgaaccattcctccaaagcaaccctcatgctctccggacgcgtgg

SEQ ID NO: 13866 - DNA, 440 bp, Triticum aestivum
  Clone ID: PAT_TA_13866
gtctaaattcccgggtgcaaactttcctgcttgtgaacacaactaaataatgttgcaagtatgtaacagcaagacatgaactagcctccacgctggtgtatgattagcatcaccatacaacaaaaggaagaacaacccatccatctatcattgtacaaataaatacagaaacaaaaatatttttgggggcccgcccggccgcgtactgcagcacgcgggagcagcaaacattgctcatcgaggccgccaatacgcaggagagcatggtgagggcaacaatagaggggaagcaccgcgggggttgagccacaactgtggttgatggcaagccggcatgacacgacgagcagcttgaggacaagtgggcggcgcacgacatgtcactttacatgcgcctgttggactgatttccttcttccatgatgaggaagtagatgtac

SEQ ID NO: 13867 - DNA, 483 bp, Triticum aestivum
  unsure (1)..(483): unsure at all n locations
  Clone ID: PAT_TA_13867
cgtccgcggacgcgtgggcgaccacgcacccacgactcctcacaaggcaaggcaacgaccaacgcaacgggcgggcatggaaagctctctcttcctcctcatcctgtagactcgactgtgggcagcccagcctccctccctctctcatcctagattcgattcctttcctccgcttcgtccaaccccagccccaaccccaccgcgaaagagagaaagaaaggctgcggccgtcgcagtccaatcgattgccccaccgcccgccccgccgcgccgcgctttcccgccctcccaagccgaatccgatggttccacccgttgaccggctccgccatcgggggggcgngccgngccancccagggnccatccccctttcccgccggctataaataccggncccgnccgatngctccggggcaatgggtgtccgggggggaanaacaanatggagaggggacnttncccgnccangggtttgccctcgc

SEQ ID NO: 13868 - DNA, 1143 bp, Triticum aestivum
  Clone ID: PAT_TA_13868
gatgcattgccgggctttaacgaacttttatcaggccaataacgatcgccgtacaaccaaggaactatataaactagcatattttcttacaatcttttattcatgcattgcattacataggtcctcggatccacctcactaagatttccctcccggtcctccataaaagaattgcgctcttcctatgggtgaagcagagtagagcttgccatctgtaactttagtgcgtgcatcattgccaattggggtgcttctacgatccttgtggatgagccagatatcatggatagatgcagcttgaccagggttagaggcaaaggctccacttcccataggaggagctatagtatttttagtacttcgagcatggcctccaattgagatttgagtggctttcgtagataagctatcaaatagtgatgctgggaagtaacctactcgaattgggacaccgttgatgccatagtacaaccaccagtccccacttgaactttccttggacactctaatagtaatcgtttggcgtttcctactgataccagagatagggcttatgatatcaccgggagatatgggggaccccttcacgactttaaagccaggacaatcaaggttgacacaccctgtacttcgatgattatcttttgtccaaaccgtaaaaaggtgagtacgcgagtcattaaaccgatatggccaaaccacccaaccaacaataattgtattgagttttttgttaacatcaccttcccagttatgaatccaaattgcacccgctgacagttgcccgacattaagattgtgtccatacacatccatgttagcagatattccatagtatcccttgtcattatcacccgtcaaatgtacggcaaaataatattttgtgtcatcatcattttttgatggtaaagcttgtgcatatgatatctgcgcctgccgtattcctgccgcccggcggatcctccagtccttgtgcggccgcctccgcgggggtgcccccgctcttgtgcccttcggtgaggcttcctttcgtgccgccggggcatttaggctggcgggtcctgccaggtcttgatgcacaaaaaatatggtgcataacacaaagatttccaatactagatgaatatgagaccggacgcgtgg

SEQ ID NO: 13869 - DNA, 1248 bp, Triticum aestivum
  Clone ID: PAT_TA_13869
cacaaatcctgttcagcaagtaatgtataagacacgtgaaataaaaacaaaggttgagcaaagtgaaacaatggttcaagaaatctgccgagacattaaaaagttggattgcgccaagaggcatataacgtccgcaataacggctcttcaccgccttactatgcttgtttctgctgtcgagcaacttcaggtcatggcctcaaagcgtcagtacaaagaagcagctgcacaactcgaggcagtgaaccagttgtgcagtcattttgaagcctatcgggatgtgccaaaaatatcagagctcagagagaaactcaagaacatcaagaaaatcctcaaatctcatgtatattcagattttacaagcttagggactgggaaggaaacagaagatgaggatctattgcagcagctatctgatgcttgtttggtggttgatgctctggaaccgtccgtgagggaagaactagtaaagaatttttgcagcaaggagcttatctcgtataagcagatctttgacggagcagaattggccaagttagacaagactgaaaggagatatgcatggattaagcgtcgattgcccgcaaatgaagatacctggaaaatatttccaccttcctggcatgttgattatctgttgtgtatccagttctgcaagattacaaggacccagcttgtcgatatcctgaataatctcaaagaaaagccagatgttgcaactttattattggcgttgcaaagaacccttgaatttgaggaagaactggctgagaaattcagtggaggaaccacgactgctcggaatagagagctggaaagtgatgatgaaaatgagggtacggaacacaataaaattgtttcagatatacggaagaaatacgagaagaaactgggagtgcccaatgatgaagctgaacaagacaaagagaagcagaaagatttgtcagttcctggtgctgggttcaactttcatgggattatatcatcttgttttgagccatacatggctgtgtacatagaactagaggagaaatctttggtcgaacaattagataaacttatccaggaagaaaaatgggaaattgaggaagggagtcaaacaaacattctatcaagcagcatgcaggtgttcttggtaattagaagaagcttaaagaggtgcagtgcattgacaaagaaccaaacattattcaacttgtttcaggtattttcaagaatacttaaggcctatgcagcaaaattatatgc

SEQ ID NO: 13870 - DNA, 620 bp, Triticum aestivum
  Clone ID: PAT_TA_13870
aatcatttccatctacatactcagcctgtaaaattaatctcttacacagcgtctaccaccaaagtactgacggggcaaataacacagccttcaccaataaaccccggccgaactccttcactccacagtgccgagtagcataaaccttgggtcaagtccttcactcccagttctgagtagcagctggtgctgctgcgggtgccggagcgctgccctgttcccagccagtaggggcaggtgctggaactgcatcccatccatcggccgcaggagctggagcaccagtccactcagccccagccggggcttcggcggcagcagctggagctgcagctcctggccattcagcaccccaggtatctcctgctggggcagtgtactctgcaactgcagcgtactcaggagcacccaaagcctcatcttcctcaagctccttagcttcctctgggtccctgtagaagaacagatcaaccatgatttcccacttgtgtcctgggagaatggtaccacgcatctgcagaaccatcctggcgagcagccaaaataggcaaccaatgctctgcttccccggactgttagcaggaatgccaatatcaacgtaacgcataggagagtcagtg

SEQ ID NO: 13871 - DNA, 1394 bp, Triticum aestivum
  Clone ID: PAT_TA_13871
atgagcaatagcctcataaataaagtagacatatttttagagtatcacatgatccgggcttttataacatttcaagagaatctgaccatacacttgctggcaaaatggaacttcaaataaagctattcgatgagaggcagcagaaggctggggtgataactcccagcccctgcagagccaagaagacaaaaatcgatttccatctaacataactcagcactgtaaaaattaaatctacttaaccagcgtctaccaacagagtactgacggggcaaataacacagccttcaccaataaaccacggccgaactccttcactccacagtgccgagtagcataaaccttgggtcaagtccttcactcccagttcggagtagcagctggtgctgctgcaggtgccggagcactgccctgttcccagccagtaggggcaggtgctgcaacggcatcccatccatcggccgcaggagctggagcaccagtccactcagcaccagccggggcttcgacggcagcagctggagctgcagctcctggccattcagcaccccaggtatctcccgctggggcagtgtactctgcaactgcagcgtactcaggagcacccaaagcctcatcttcctcaagctccttagcttcctctgggtccctgtagaagaacagatcaaccatgatttcccactgtgtctgggagaactgggtccctgtagaagaacagatcaaccatgatttcccacttgtgtcctggagaatggtaccacgcatctgcagaaccatcctggcgagcagccaaaataggcaaccaatgctctgcttccccttgttgttagcaggaatgccaatatcaacgtaacgcataggagagtcagtgtcacagaaggcaatggtggggatgtttccaagtgcagactccttgataggctggtgatcagtcctggggtcggtcaggataagaaggcgtggctcactgaatgaagtctgcatctggttggtgaatgtaccaggagtgtgcctgccagcaatggcgttagcaccagtgtactgggcaaacttgaggacagccctctgtccatagggcctagcagattgcacaatgatgtcctgagggttttcaatcgcaacaatgacccttgcggccatctgaagcttctcccaggtcttgccaaggttgatgatgtaaatgccgtcagtgcggcgcttgtagacgtagcgctccatctggaagtcgcagttcttggtgccgaggtggacgtcggcggcgagcatcatctggatgtcctgctcgcgctgggacagcgcccggacgccaccgccttcagccgccatggtgggaggttagggtttcggacgcgagccccgtgcgcgagagagcgaggaggaagaggaggcacggg

SEQ ID NO: 13872 - DNA, 2676 bp, Triticum aestivum
  unsure (1)..(2676): unsure at all n locations
  Clone ID: PAT_TA_13872
cggagaattagggccaggcagatgatgtctggtgatgaacttatgatgtctgcggaaggtcggagctttgtggatggtggcatgaaggagatagaagctggaggtggaggatacagaagaggggcaaatgatgacttcatggtttatggacaggacaactcaatggacaggaggagctccttggacccccttgccgaggcgcattacaagagacccactcctctagaggaaaagaagaatgtgcacagtatgggcgatgagtccttcatgatacctgttacctccaactcacaggataatcttggagcagccggccgtactgccattgacatagatgccgagcttggctcaagtgttcagaaaacatcagatgctaaggctggagctgaacttttctatgagccagatgagttgattccagagcgtggatttgaagatgtttcatttggatatgacccatcaatggactatgacagccacatgcagattcagcatgacgtcagcgttgaagatgcaaatgcagaggatttatccgtttgtgttgagggtgaagaaaagatgccggggaaagataagaagcttagaggttcacaggagggcttggataaaagaaggaaggatgcctcagcaaggagattgtcagctcccaaaggaccactaaccgatgcacagaaacgcgcgcaaaacctacgggcgtacaaagcgagccttcaaaaggaaaagaaggagctggaagcggagcagatgaaacggctggaaaggcttaagcaagagagggaaaagaggattgctgccagaagcggcgcatcgaatccccagaaaaacagcagctaaagcaagcgcagntgagcaagtcaacctcatccttggctgagatgaaagagggagaaatgcaacgattataagaccgcttgcaagttatgagcaatagcctcataaataaagtagacatatcgattagggtatcacatgcatacggggccgggcttttataacatttcaagaataatctgaccatacacttgctggcaaaatggaacttcaaataaatactatttgatgagaggcaacagaacgctggggtgataaccccaaacccccgcaaagcaaagaagacaaaaatcgatttccatataacataactctgtactgtaaaaattaaatctacttcacgagcgtataaaaagaatgcactgacggggaaaataacacagccttcacccataaaaccgcggccgaactccttcacacctccacagtgcggagcagcaaaaaccttgggtcaagtccttcccatcccagttctcagtagcagctggtgctgcgtgcgggagcgggagggccaccttgtccctacccagtaggggcaggtgctgggaacggcatgccttccatcggcagtgcgcagtagctggaccaccagtccacgcagccagccgcggcttcggcggcagccggcaagctggagctgcagaacccattgcacactcgggaacccccgcggtggcgcagggtcgggagcgactgctcctggctctgcagcaccccaaggtatcccccgctgcggccgtcttctctgcaactgcatcgctctcagaagcaaccaaagccttaacttccctcaagcgtcttggcagccttgggaccacgcgtctacggaaccatccagccgggcatgccaaaataggcaagcgaaattgctctcgcttcccctgttgttgttagcaggaacatgccaatatcaacgtaacgcataggagagtcagtgtcgcagaaggcaatggtggggatgtttccaagtgcagactccttgataggctggtgatcagtcctggggtcggtcaggataagaaggcgtggctcactgaatgaagtctgcatctggttggtgaatgtaccaggagtgtgcctgccagcaatggcgttagcaccagtgtactgggcaaacttgaggacagccctctgtccatagggcctagcagattgcacaatgatgtcctgagggttttcaatcgcaacaatgacccttgcggccatctgaagcttctcccaggtcttgccaaggttgatgatgtaaatgccgtcagtgcggcgcttgtagacgtagcgctccatctggaagtcgcagttcttggtgccgaggtggacgtcggcggcgagcatcatctggatgtcctgctcgcgctgggacagcgcccggacgccaccgccttcagccgccatggtgggaggttagggtttcggacgcgagccccgtgcgcgagagagcgaggaggaagaggaggcacgggtggcgaggggaggacctaagtggcggcacaaccgaatccttgattgagcgattgaaaaagcttgctcaacctaaaaccaatgcttcaactttgaaccccaagccagcgaccgcggaccacccacggagaagaagcttgccgcaataaggtccctgtgctttggggggtatttatctagttttgttgactgattgatgagggcaacaattcggtttgtattgattaaattttttggtctgttgatttctagtacataatctacacattgttgtattatgacggaattgtttgtaagcagtttgtttgtataatctgtcctttacattgtcttacaatctacacattgactctagtatatatttgtggatggcacaaaaaaaaaaaa

SEQ ID NO: 13873 - DNA, 1381 bp, Triticum aestivum
  unsure (1)..(1381): unsure at all n locations
  Clone ID: PAT_TA_13873
cgtccgcggacgcgtgggtccccctcctcccctgcctcagagggacacgacaaccagaatccaagaacgggagagccaccctctcagtcggattgccgctccattgttgaataacatacactcctagtggtagttttttattggcttgggggggtgtgagggcccgtattattttagccgggaggggataaagatgtcgtcgctggtgtccgcgccgttcgccacggccaccggggcgcggaagaaggcgcgcgcgcccgcgccgctgcactcgttcctgctcgccggccggcgggggcggcgcgcggcggcggcgacgatacggtgcgccgtggccgggaacgggctgttcacgcagaccaacccggacgtgcgccgcgtggtgccggcggagcgcggcctgccgcgggtcagggtggtctacgtcgtgctggaggcgcagtaccagtcctcggtcaccgcggcggtgatgcagctcaacgccgacccgcgccgcgccgccgagttcgaggtggtggggtacctggtggaggagctgcgggacgtggacacgtacgccgccttctgcgacgacgtggccgtcgccaacgtcttcatcggctcgctcatcttcgtggaggagctggcgctcaaggtgcgggacgccgtggcggcgcaccgggaccggatggacgccgtgctcgtcttcccgtccatgccggaggtgatgcggctcaacaagctcggctccttcagcatggcgcagctgggccagtccaagagccccttcttccagctcttcaagcgcaacaagaaggactcgagcggcttcgccgacagcatgctcaagctggtgcgcacgctgcccaaggtgctcaagtacctgccctccgacaaggcgcaggacgcgcgcctctacatcctcagcctccagttctggctcggcgggctcgccgggacaaccctccagaacttcctcaagatgatcgccgtctcctacgtgcccgcgctcaagggcgccgacatcacgtacagcgaccccgtgctcttcctcgacaccggcatctggcacccgctcgcgcccgccatgtacgacgacgtcaaggagtacctcaactggtacggcacccgccgcgacgccaacgacaggctcacgaacccggaggcccccgtcgtcggccccctccgccgcccgtgccaccgggtcaccgcggtcgtccgccacttcgtccccgtgcccggcgcgcgcgagcccaggggcgccggggtcatccccgtcctcgcccgcgcgcgcgacctctccggccccgtcgggcgcggcctcgtccgccccatctccggggccccggtcgtgaccangcnnnnnntgtaaatnnngctaatnnnnngnntnnnnaannng

SEQ ID NO: 13874 - DNA, 624 bp, Triticum aestivum
  Clone ID: PAT_TA_13874
atcattccctgcacaattgtctttgttccgtacctgtggactctgggatcacataggttacaagtgtaagtttcagctgtacagacacacatggaaatttttctcatatttacatacacgcatgaatcagcagggcttccaccccgagaattgccctgaactgaaagacaccaacaaagaaaccgcgccacaggctagttcagcaaatactgcagccaaaagggcaagaccctctacgcctcaaggaaacagaacgtttcatgccacatggaactctcagaaaaccactcttttttttacgagttttcaaaagaaggcttcacaaaaggagtaccgaaacctcatccttataacgtgagcaaatcacccctgaagcagaagaaaggagtggctggcaccagattagtactcggatgaaagccacggatgctctaacgcttcgctggctgttggtctcttcctggggtttatttgcagcagataagatagaaaatccacaaactgcggatcagggcatcgcaagtgatgtcgcaaagaggacttctctgggagcaaatgctctaattgacccgtctcctcattcttggtgaaaaggccataatcatcggtgaaatatttatgtgt

SEQ ID NO: 13875 - DNA, 501 bp, Triticum aestivum
  Clone ID: PAT_TA_13875
cgtccgcccacgcgtccgcccacgcgtccgcggacgcgtgggtagcgttacagaagagaggcaggggctacctagctaggattgcacgctctcgatctttggatcatcaccaatggggtctgcactgttgtcgatggtgcggatgatgaagccgaagaaggacggcgcgccgcccgctttcgtgcacgacctgccgcaccacgggacgacggcgactccttgccgccagcgcactgaagaggagcgcgacgcgtccatcatctgccatgtccaccacgccctccgccactacaacgccagcaacccgggctcggagttcgtccccgtaaagcctctcatggccgcgtacgtgggcttccaaagccacatctgggtccacgtcagcttcgtcgctcgcaggaagaagatcgccagcagcaaacggaggcgcaatcaggccaacgacgcggacaagaccttcttcgccgagctgcgctacagccaccaccactccggcgcgcc

SEQ ID NO: 13876 - DNA, 899 bp, Triticum aestivum
  unsure (1)..(899): unsure at all n locations
  Clone ID: PAT_TA_13876
ggactaagatgggcaatacaaatctttcatgagatcgtgtgctgctcaaacaaatgtacagacatcagacaacaacattgggtactcatacaggcatacaccatgtgtaactattaacaaatgggagtgtagtgctccaattccgtaagaagcgaaggctgtaagttacagaaagttggcagtgatttagtccaatcatccataaatgaactaaatcattattaggtacatattttgtgttgttctttaaaaattgtaacagttaagtattagcacgagggtacaaaaatccaagaactaacagctctcttgggccattgccagattattagtttgttctagagtatttccagatttgtcggcacgaccttgggccattatcatatcctgaccttgttgtgtttaatgcctacatttaggttatcgtctgaaatctgtcaccagcaacaaggctacaaaaggctctgcattggggtatcatcaattttcacaagaaaacctagaaaaaatagagtttgtaaacagagcagtctgtcgatcaatgttcgacagtgatcaagaatgcatagttaggagagttccaagaggaaacagagtcctggaaatttgcaaggctctctgtagtttgggacagcaaaaacaaaacatatgcctctcatataatttgttttgtcaatttaaaaatgtctctcaacatggnaatagtaaattgccataggataccccaaacatgtgtgcccacagaagaggcccacaagagcaaacatatgacaacatgaccgacatcgcagatttaangaagnacagatagaagaaacncgattactgcanatatnccacattataaattacgantaaacacaggaaanantcttaaggtgacaaaatgggtgnccaaa

SEQ ID NO: 13877 - DNA, 1071 bp, Triticum aestivum
  unsure (1)..(1071): unsure at all n locations
  Clone ID: PAT_TA_13877
gacccagcgtccgcacacgtacacacacatacctcgncggacctcggcgggtccttccgcaggagatcggcatgggagctgagcagcagcagcagcagaccgccgggggcagcaggttcgccgcggcgtttggcctgctgcgccagtacatgaaggaccagcctgggggcggcgtggtcaccgtgggcctcatgccgggggggggcgacggcgtcgaggcggtcgcgccggaggagaggatccggaccatggagctcttcccccagcaggccggcatggtcagggactcgcgcgaaaggacggggccggagagggcgccgctgaccatcttctacgccgggaggacggtggtgttcgacgacttccccgccgagaaggccaaggagctcatgcagctcgccggctccttcggcgcgctgccggccgcctccgacgccggcgccgagcccgtctgccagaacgcgccggggcagccttgctttgcaggtacggatcgcgcgacactttgtgacctgccgatcgcgaggaaggcgtcgctccataggttcctggagaagaggaagagcaggctggccgcggcagatccgtaccctgcgccggtggcggcgccaggggctgggacggccggcaagcctgtgccggaggacggcggcgcgccgtggctcggcgtcaactccgcgctccagctcaactgaaggatttgacgagccggggagaggaacaaatcactgccttgctgcttctccacgtagtagtatatacagtactactctactactacgtggatccttgattgttgccgtttttatcttactaccacgcccgttaattggctgcgtcagggtaattaactgcgtggcgccggctaaatatatatcctgggttaagtagtataagtatgttcttcatctgtttgagaactcctcggtgtcgaataaaagaattctttcatgctgatgggatgaatttgttactgtatgcgagtattactaattacctagcttagcttcctaagctgtattaaatgtagcgatgacccgcaataatgctattttttactggtattttttt

SEQ ID NO: 13878 - DNA, 1299 bp, Triticum aestivum
  Clone ID: PAT_TA_13878
ccccgaccgcatggcgcacgcggccgtgccgtgctgggcgcgggccccggcgcggcccgcggcgtcgcgggcggggcggcgagcgggaccgcctgcaggtccccgcggcgcctttcacgcgcgcctttcctctcctgcccgcgaaacagaaattaggcctcgcccagctgtacacgcccacaaaaggagagagccggccaggacttaaccccgcgagtcgcccgcctcccggccggacggacaggcagaagacgcacacacgcgcacacatacctcgccggacctcgtcgtttctttccgctggggatcgacatgggagccgagcagcagcagcagcagcaggccgccgggggcagcaggttcgccgcggcgttcggcctgctgcgccagtacatgagggagcagcctggcgccggcggcggtggcatggtgaccgtgggcctcatgccgggcggcggcgtcgacggcgtcgacgcggtggcgcccgagcagaggatccggaccatggagctcttcccccagcaggccggcacggtcaggggctcgcacgagaggacggggcctgagagagcgccgctgaccatcttcttcggcgggaggacgttcgtgttcgacgacttccccgccgaaaaggccagggagatcatgcagctcgccggctccttctgcgcgccgccgcccgtgtccgacgccggcgccggcgccgagcccgcctgccagaacgcgccggggcagccttgcttgtcagacctgccgatcgcgaggaaggcgtcgctgcacaggttcctggcgaagaggaagagcaggctcgccgcggcagatccgtacccggcgccgttagcggcgccgggggctggggcggccaaggagacggccggcaaggctgtgccggaagacggcggcgcgccgtggctcggcgtcaactccgcgctccagctcaactgaaggatttgatgagccgggagaggaataaatcaatcactgcctcactgcttctccacgtagtactgctcgtatactactacgtggatccttaatcgttgccgtttttatcttacgcccgttaattggctgcgtcagggtaattaaccgcatggcgctcgctaaatatatatatagtatgttcttcatctgtttgagaattctttggtgtcgaataaaagaattctttcatgctggatttgttactgtatgcgagtatactactgctaattacgtagcttaagattgtataactgtattaaatgtagttatgacgcgcaatattgttatttttactgcttaattaaaaaaaaaaaa

SEQ ID NO: 13879 - DNA, 604 bp, Triticum aestivum
  Clone ID: PAT_TA_13879
cgtccggcgtctctacctcccgcccgaaacgggcgccggcgccggcaagaagctccccgtcctcgtgtacttccacggcggggggttcgtgatcgggtcggccgcgtcggccgcttaccaccgctgcctcaacgacctcaccgcggcctgcgccgccgtcgccgtctccgtcgactaccgcctcgccccggagcacccgctccccgccgcgtacgaggactccctggcggccctcaagtgggtgctctccgccgccgatccgtggctcgccgagagagccgacctgtcccgcattttcctcgcgggagacagcgccggcggcaacatctgccaccacctcgccatgcaccacgacttgaggggcgccgcgggaaggctcaagggcatcgtcctgatccacccgtggttctggggcaaggagcccatcggcgaagagccccggccggggcgcgcggagggcgtggagcaaaagggcctgtgggagttcgtgtgccccgacgcagcggacggcgcggacgacgcccggatgaacccgaccgcggagggcgcgcccgggcttgagaacctggcgtgcggaaagctaatggtgtgcgtcgccaggggg

SEQ ID NO: 13880 - DNA, 502 bp, Triticum aestivum
  unsure (1)..(502): unsure at all n locations
  Clone ID: PAT_TA_13880
cgtccgcccgcggacgcccatcccgctcctcccacacatcataagccgcggactcccctcccatggccctcaagaaagcaagaaaagtggtagcatccaagaaaccaacatccgccgccatgggcgtggcggagacgcccgatccgctcgggcgcggcggcgcgcacaacctcaacccgccgcggctgccccccggcgtctacttcagcccgacgcgggaggagagcgtggcgctcctcgaccgctggatcgccggcggcggcaaggaggtgcccgccgacgcgcgggggttcgtctcccacgccgacatctacggcgacagcccagacgcgctgcggcggttgcacccgccggggagcgcccgcgcgggccagcacacctgggtggttcctctgcgagaccaggttccagagccccggcgcggcggccaagcgcgccggccgaaagtcgacaccgggggtactggcgggtngagcggagcaaggccgagggggccgcggca

SEQ ID NO: 13881 - DNA, 601 bp, Triticum aestivum
  unsure (1)..(601): unsure at all n locations
  Clone ID: PAT_TA_13881
gaccagtttgcattgcgngaatgttctttgctttgtagctcagacccctatcgcacactaacataatcttgtcacaggcgatgacgcattaaaaacaatgactgttgcaactgttgcatttaacagaccaaggctacatatcttgaaccgaaaaactgacggtcaacacgacataacaaagagacctataccagcatcaacaaatggtgataatcatcacttcaacagaatccttctccttctacgacgaccaaaaagacactacaggtaataacaggttaacagaacaaacaacatccttcttctgccagtacatatttacaaacacacagacacgcatctttttcggcgcggcctaaggctgaccgaggtggccctaacatgctttgctttgctgtatttaccaggtatatcatctatccagcgcccagctgattattagtattattcttgtcactgtcgaagcaaagagcaaggcggtcgcgaccccggcagcatctcctgatttggatacaatgtcaatgttttttttgcctatggccctcttaaggcttggatagaaataaatgaaagcgctgcacttttgcatcatattttttgg

SEQ ID NO: 13882 - DNA, 730 bp, Triticum aestivum
  unsure (1)..(730): unsure at all n locations
  Clone ID: PAT_TA_13882
gttnnnntttttttttttttttttttttttttaccactgcataagccatgtattattgcgtttccaccgaattattatcgacacaaaatccacatttccacatccacgcatactaccattttggaaaagaaagccctcccaggatgaaagcgagcaagatcctttccctgtccgccgagaccgtgcgctgcagcacgtcgccgtccacgagccgcagcttccccgcgcagtgatccaccgagacgagggcgccctcccagaagcgccggaagtccgcgagcgagcaggacttgagcgcgccttccatggcggcgacgtccgcctgcgcgaagccgtacatgtcaacgcaggtttggtacatcacccgcacgtcctccgagatcttcgggtcctgcgccagcttcttgccggcgctctcggtgcccttgcacgactcgagggcggccctcacggcgatgatgccgtaggcgctggccgtgaggccgtcccgtgcgccgcgcagcgtctgccggcagagctccagctcgcgctggccctgccaggcgctcgtcttgtggcacgcgtcggcgacggacatggacggggtcgccggcgcatgtggggcgtcggtgctgccggaaagcagggcgattgccccgagagagacggcgagggcgaagatggtgggtgtgttcttcatgtttgctcgatctctgccggcgcgtgggcggacgcgtgggcggacgcgtgg

SEQ ID NO: 13883 - DNA, 770 bp, Triticum aestivum
  Clone ID: PAT_TA_13883
gcacgaggcgtccgcccattccttcgttcttcatatcatcatcacatataccatcaccccgatcttgtcatctggtgccagtaacgcctaggcgtagcccccctccgaccgaccgatcgatcgatccatcgagctcctctatatatcctctgccaagctgatcagctccctcgactagccgcccgtctccctcccaagccacgtgctccctcgcacgcgcgatcaccatccagttcaccgatcccagcgtgacgatctgacctacacactcgctctagagctaggattccatggccgccgccgcggcgggcaagcggcccagctgcgccgtcgtgctgggcttgctgctggcggccgtgtcggccgccggcgccgagttcatcacgtgggaggacctgaccatgccggccgtggcgaggctcatccgcggcgcgccggtggacgtcaagtcggcggcggcgggccgcgggggcgtgggcgtgagcacgatcgtggtgtcgcaggacgggacggggcactcgcggaccgtgcagggcgccgtcgacatggtgcccgccggtaacacgcggcgggtcaagatcctcgtcaggcccggggtgtacagggagaaggtgacggtgccgatcacgaagccgttcgtgtcgctgatcggcttggtgtcctgtcgcacggtgatcacatggaacgcgcggtcgttagacatctactcgtcggggcatcaggtcgtcaccttatactccgacttctttgccgtcttggccgacttattt

SEQ ID NO: 13884 - DNA, 1484 bp, Triticum aestivum
  Clone ID: PAT_TA_13884
gctgccgtcgcctcctcgctcggggcgcagcggaagatcgaatcagccgaggttcggcccattctccgtcctcagatcagcgcagcggaggatcaaaccaatccatctaggtttggcgagcgccgagccgaggggaggggacggaggaggatggtgaaggccatggcggggtgcccggccaagatgggcttccggatgcccgccgagtgggagccgcacgagcagtgctggatgggctggccggagcgtccagacaactggcgggagcatgctgagccagctcgaaaaacatttgagagaactgcaattgccatttcaaagtttgagcctgtcacaatttgtgcaagtgccaaacagtatcctcgtgtccacgagctgatggaacaccaaccgaacatcagggtggtcgagatgagcatgaacgattcctggttccgtgatactggtcccacttttattacccgtgaaggcggatcagatataggactagcagagcaaacaatagcagggattgactgggaatttaacgcatggggaggactcggtggtggttgctttgatgattggagtcttgacagaagcattgccaagaagatagtcgagattgagaggatcccttgcttcgcacgcacgctggttctagccggtcggggcaccctcgcaggtcgagacgggacatgcagtacgaccggagggtgcttcttggagtcacgaagatcatttggatacctctgggactacacggtgacgaggatacaaatgggcatgttgacaatttatgctgtttcatcaaacccggcgtgattctcttgtcatggacggatgacgagaacgacccgcagtacgagatatctgtgaaggcactatcagctctcactcaggccgtcgatgcgaaagggcggcagatagaggtggtgaagatccacgtgccagggcctctgtacatcacgaaggaagagggggaaggtgttcttgcaacggggcatgctgtaccgagggtaccaggcaagagattggccgcctcatatgtgaacttctacccggcgaatggcgggatcatagcgccagcctttggcgataagaagcgggacgaggaagcgtgcgaggttctccagaaggcatttcctgatcgtgaggttgtgatggtggaaggcgcaagggagatcgtgctgggaggtgggaacatacactgcatcacgcagcagcagccggtgcgcccgtcatagatgagcggcgaggaaaggcgaccaagccctgcattggggtgatgattcaaccatattggttacgcccgcagcatatcggttgcactttgaaaccgtgtcgcgggccaatagatgcatctcatttggagattactgaataatattgtaggtgtattcagcgtctcgggctaatagttgcatccgatttggaatttactcaataattgtgtaggcccatccgacggattctttcttccatccatccgcataaaaaaaaaa

SEQ ID NO: 13885 - DNA, 1109 bp, Triticum aestivum
  Clone ID: PAT_TA_13885
cgtccgcggacgcgtgggcggacgcgtgggccagtaatgaataaagcatattagtgttcttctcctttctattgttattagtctggtatatctctatatttttatatcgtctttactccctggcgtagttgcaaactaataattaacgatgtgcagaacttgtctaagttagatgtactcagtggcggagctacaacaaataagttgggcgggccaatttttttctctaaaccatacagttaagtaggcatgagttagtgaaatttcaggttgcctgtatagggaaactggtaacaggatgatgttgtcaagtaaaatttggacaaataaatgaaatttcttgtgcgctagctgcctgctggttctatggtcttgtgctcgtcgcctgggtagttcatcagtggctagccgctggcagccgccatatggccatgcccgtcgtggcagagggatgggtcaccgtaggggttgctacatgcggcgcctgtctgcctggctattggaccgctccatctctgagtggcttgctcagtgctgaatcggggcagagagctcatagctggatgcgagggagacatgctattggattaagctgttacatgtacaaaagagttttatttgtctgtggagctgggtgggtcatggccttgtttttccctcacgaagctccgccagtggatctactcatctttgttgttgttaggatcaaatatcaatgctagttgagtcatactacgtccatcttgaaatataagtcatttttataggctaaactggcctacaaaaatgtcttatattttgagacggagttagtacttgttagttctgaccatgcctagcttaaggactcattggtattcttgataagaaaatcctgcatatgttcgtacatgttcctatctgaattaatattggatgtttcttggtgtgtgcatgtgacagtcaaggcacattttcacaatatatgttggtaattatggtggttgtgaaacttctatgattgaacataccacggcaagattcagaagtaactttcttccatctacaaaagttgagaggcagagggagaggcacacagttttaccactgaataagctactccctgagct

SEQ ID NO: 13886 - DNA, 581 bp, Triticum aestivum
  Clone ID: PAT_TA_13886
ctgggtcggctccgcttcttcccatatcatctaccttgttctcttgtcaatctagttcgttgttccgttgcatctctcgccgttccacaactttgccccgcccgcccctaccctaccctagctggccgcccccaaagccttgcctcccctgccatgggtcgaggccttttcccccaaggtgtcctacgctccgatcgcgggcgggcccactgtcttcctcctgcctcctgcgtgcaccatctccgccgccggccaacgcaaccgccccagcaagcaacccagcgagctggactcgtggtctcgcggcggcgcggcccctcctcccggccgtccccccgcgccctcgcggccccgcggcccggctggccgcgccgcctctgcccccccccccccctccccggcaccgcgccacgcggcccctgcgtgctccactccccactgggagctgccatttgcccccctccccccgcccggtcgacctcccggtgtctgtccgggtttcctccctggtcccggtcgcgaggcctgtccccgggctgcccttgcctaaactccgtcatgaaaaaggatatcaaacttaa

SEQ ID NO: 13887 - DNA, 812 bp, Triticum aestivum
  Clone ID: PAT_TA_13887
ctcggcacgtccgcccccgccccctgtccgttcaggtccgccgccgccccctgctccttcacctcctcctccgccgccccccgcacctcctcctcctcggccctacgccccttccccccctcctcctccccgtccttctcttcccgatcccccgccaccctggccctctcttccctatcctgctcctcctccccctcctcctctgctagattcaccacctggtcccctccccgtctttccggcaccacccggacggggtctatcgcggcctgggcgtcggcgccggctgggaggcggaccacgggctcgaccatcgcgctgtctatggagaccaagatcaaggagcagctgcgaggcggccactgcctccgtcggggacgcctgaggtgaagggggacacgtctgcttaaacagggtttcgaaggggttcgagaggaaatccgcggtgaacaggcagagaatggtttacaaggttatatgggaggagcttcagagcaccgtgcatgctgtggaccaaatgaccaccaagactccaggtgaggcggctggcaactagtaatcgagatctgcatggcaaaaattaaactgttgtacaccaaggccactgccaggaccgacatgaagacattcttttgtaggatacacttttgcatgtacacgccaactgatggatcaataatttggggtgtgattggcattacctccataagaaatatattttttggctataattagaattttgaagagttagaatctcgggttcgatctttatatgcttttcatgtgactgatccaaaaaaaaaaaaaaaaaa

SEQ ID NO: 13888 - DNA, 543 bp, Triticum aestivum
  Clone ID: PAT_TA_13888
cgtccggcgccccgcactgcgggcgcgcgatccgtgtggtggacgccagcgagcggtactgcgaggtggagtgcccctgcgggctgcggcgtgagcttctgcttcaactgtgcggcgccggcgcactcgccatgcccgtgccccatgtgggacaagtgggacgccaagttccgcggtgagtcggagaacctcaagtggatcgccgtcaacaccaagagctgccccaagtgcctccggcccatcgagaagaatggcggctgcaaccatgtcagctgcccatgcggccagcacctctgttatgcgtgcggcgggcggctggatacgctgcacaactgcaaccggtacgacgaggccgggcacgccaactacgacagcatcaggcggcagatgctgcggtacacgcactactgcgaccggttcaacgtgcacgtcaactcgcgcaaggtggagcagacgcatctctggccggccatccagaagagggccgtgctgctggagtcggccaccgccatccggccgctcatcagggaggcgagctggatg

SEQ ID NO: 13889 - DNA, 727 bp, Triticum aestivum
  Clone ID: PAT_TA_13889
cgtccggttcgttcttcttcttcgagttgggtagtttagctctacccaccagccatgggtaaggagaagactcacatcaacatcgtggtcattggccacgtcgactctggcaagtcgacgaccactggccacctgatctacaagcttggaggcattgacaagcgtgtcatcgagaggttcgagaaggaagccgctgagatgaacaagaggtctttcaagtacgcgtgggtgcttgacaagctcaaggccgagcgtgagagaggtatcaccatcgatattgctctctggaagtttgagaccaccaagtactactgcaccgtcattgatgcccctggtcaccgtgacttcatcaagaacatgatcaccggtacctcccaggctgactgtgctgttctcatcatcgactccaccactggtggttttgaggctggtatctccaaggacggccagacacgtgagcatgccctccttgctttcactcttggagtgaagcagatgatctgctgctgcaacaagatggacgccaccactcccaagtactcgaaggcgcgttatgaagaaattgtcaaggaggtctcttcctacctgaagaaggtcggctacaaccctgacaaggttcccttcgtccccatctctgggtttgagggtgacaacatgattgagaggtccaccaaccttgactggtacaagggcccaaccctccttgaggcgcttgaccagatcaacg

SEQ ID NO: 13890 - DNA, 459 bp, Triticum aestivum
  Clone ID: PAT_TA_13890
cggtggagccgggctggcgatccggcgccagtgtgttaagaaccaactctcactactcaatcacagtagccgattacaagaggtagctaatctgggatacaagttgcagcaggaaatggggattgagaagagagccaaaggaggaagaggaaagagccgccgccggttcgtgccgtgatccactggataggttgttcgttgcttttgcccaagtatttgtagctgcagcggccagaggattcccagccgggccaggcccatgtgatgtccaaaggcaagcccatatgatgtccagaggcaagcccatatgggctaggggagggccctgacatccccccttcttgagattcggcttgcccccaagccgacgcccccaagaccctcccggatcccattgcactcgatcgtccttgccccttgaacgacgccattgagaaaccgccggatcccatggcactg

SEQ ID NO: 13891 - DNA, 795 bp, Triticum aestivum
  Clone ID: PAT_TA_13891
gcacgaggcagtaactcgatcggtcttgaataccgcagatgagatccacactgaccggtacacgcgtccctctccccccctcccccggcctctgcctttagaaccaccctcacccacactcacgctcgcacccacaccaccggccggccgcccgcgtctgtcaaccgaaagcagcacagcgcccccacggtcggtctacatctactccccaccgcctgcttctcctccgaaaccacgcccgtacccacgtgccggcccgcccgagccagcgcggccgcgcaagatgccccgcccgccggccgcgccgctggctcccgctgtggcgtgggcgccgctgctgctggtgctgctgtcggcgccggcggcgcggtgcgcggggcaggcgctggtgccgggcgtgatgatcttcggggactcggtggtggacgccggcaacaacaaccggctggccacgctggtgcgcgccgacttcccgccctacggccgcgacttcccggccacccacgcgcccaccggccgcttctgcaacggcaagctcgccaccgactacaccgtggagagcctggggctgagctcgtacccgccggcgtacctcagcgacgaggcgcagagcgacaacaggaccctcctccacggcgccaacttcgcctccggcgccgtcggctacctacacgccaccgccgcgctctacggcgccatctcgctggggcggcagctggactacttcaaggagtaccagtccaaggtggcggcggtggccggcgagaagcgcgcggcggctcttacttccgggtt

SEQ ID NO: 13892 - DNA, 456 bp, Triticum aestivum
  Clone ID: PAT_TA_13892
gagctgcaatatgaaaatcattcattctgaaaaatgaaaatcaacacaaacaatgaagagttgatggatttccacaaaaaggcaatgtggccgcaaaactaagaccagatggtggacccctctttttggatgactggattccccccataatgcacaacagttcattttccagtcgtgccatccagggctgtccccaaaccttgatagatgccccatacagctcaaagggaaagaccgagtattcaacagaactaccatgatatagcaacgagagtcatataactgggaacaatagctatcctatggcacccacaaccaaatattcagatcagagagcatattttcaacggaaacatttcctttttttcaaccataacattggcttatttgactatccattactcattcgatgagcaaagctgctgggggtctgttctccccaccatcagaaataag

SEQ ID NO: 13893 - DNA, 611 bp, Triticum aestivum
  Clone ID: PAT_TA_13893
gatacacactttctatctattgtttttactaaaagattcaacgaccattgaatctcaattgaatacaatgatttcgattgtactaaaataaagtatcgtcttgatatggctttgcaatatttaataagaacccaccataccgactcgaatctcctattgcctctactcctaagggacctgttgggactctcgcttccacgttctttttagtcccacctcccacggtttattttggtacggtttattttggtacctcctcccacgtctaattaagcaatcacaaaccaaaaaaacctgctcgtgagtcccaaacccgcacgaacctcaatagacgtccgaaggaatacgacggttaaccaccgataggaaaatcgctacgacggttaaccagcgatcttgaaacctacatactcgtggtcctcgatcctggtcgacctccccgccccgcatcgagctaggtctcccttcgtggccgcccaacatcccagcgccgcctcgcttgagtcgcacccctacgtcctcgccgccctacatcctcgccgccctccatcctggtcgacgtccccgccccgcatcactcgccgctgccctccatcaattcgccgccgagt

SEQ ID NO: 13894 - DNA, 131 bp, Triticum aestivum
  Clone ID: PAT_TA_13894
ctcaaacattgtagatacttaggtacacatgtttgtatgttctattacatggtagcatgatagctcaaaaaaaaatatgagatcacttgatgatagcttacattggctttatcaagcaagcggacgcgtgg

SEQ ID NO: 13895 - DNA, 621 bp, Triticum aestivum
  Clone ID: PAT_TA_13895
gggcctgaattgtcaggtgtgcatgtcctgttctagcattctttcctcatttgtacaagaggagtagcgagatgtcgtgctaaacacacgacaaatctatttgaacattaacaagaaaagagcggcggagagatattaggatttaggagtagccgctagctgcgcgctgagtccgtcgacggcagccaatttgctctgcgtggcgcggatctccgcaaactccttcagcatactttcttgaaacgcctccatctcgtccgcgatgaagcgcggctgcggattcggcttgaatgtcgtcgtggtcgccgatttcccccgaaacagcccacctcaggtcggggattacgcagatcgaaccctagggtgatctgctaccatcgccttggatttgctgggcacgagtcggggaaaagaaattctcaggcgattcgcagcggagaggagcgacggccctgataccagactgtcacgacctagggtcggccagaattcgacggcggcgagccggagcagcaggtggaggagcaaggggatcggagacgagagagagagagagagatgcagagcaggagaggataagaacagaacgggaggctagagtattttcattcggacgcgtgg

SEQ ID NO: 13896 - DNA, 271 bp, Triticum aestivum
  Clone ID: PAT_TA_13896
gctagcacgaactgggctcaagtttttattgatttggggcgactgcaacaagagtacaagacccagaccctccaacgcacataaactcaaaactgacaactgaaacatcttatcttacacacagaaaagtaaagcgaggagaaagaagcaaagcaacaagaacgggacgccctctcgtcagatgcatccatgatttccttcctagctaggatcatcgacctctctatccagcgacgtccgcgcatcgccgctgacacggacggacgcgtgg

SEQ ID NO: 13897 - DNA, 640 bp, Triticum aestivum
  unsure (1)..(640): unsure at all n locations
  Clone ID: PAT_TA_13897
aatatttcacatttcggatgcagttttnaaggttgccntgcttttaatttttnctacacaaaagagccgccctcctaattcactaatttgtgggaaggtactgaacttttggatttgaaaaaagtttcagaagatatatctaatgtagatggtgattgatagagcaattcttgctcataagttcctgtatgagtactgcgcctaacataaagcttgtgactggtagtaaaacatctatttttattttgagatagagttcgatcctcaactatttctcgcgatatcttcttacgaagttttgttagggcatctataactgcctccggtttaggtgggcagcccggcaagtagacatccacaggaattaacttatcaactccccgaacagtactataggaatccgtactgaacattccccctgtaatagtacaggctcccatagcaatgacgtattttggttcaggcatttgctcgtataatctcactaaagagggagccattttcattgttaccgtaccggctgttaaaattaggtctgcttgcctaggacttgatcttggtaccaatccataacgatcaaagtcgaatcgtgagcctattaatgaagcaaattcaatgaaacaacaactggtaccgtata

SEQ ID NO: 13898 - DNA, 877 bp, Triticum aestivum
  Clone ID: PAT_TA_13898
cgtccggcagaagtctgatcctcagaaagccgcagatacatggagcaagttgggaatggctaattcagtgctggaaaaccaattgagaagcttaagcaaactttctgaagatcattgggaggcctatgaatctgtagtgcggtcctgtagtcgtctcacattcatgaagtggacagaggtggctactaatcagcatcaagaattggttgtcaaatcatttattggctgcgagagatgctttcccttgaaataaggcttcatatgcgagagatgggtgtggcagccggtgttccaattgagccggagtcacaaacgcaacttctggatgccactatgaatatggaaggcgttctactagctggtgttcctggagccggtggctttgacgcagttttctcagtgaccttgggtgaagcaagtggtgctgtagcaaatgcttggagctccgtcggtgtcctcccactacttgttcgagaagactctcggggtgtttcactggaagctggtgatccaagaacagaggaggtgtcaacagctgtgtcgtccatacagattaggtgatactatttgttgataaatcctgtaattcttctacggtgtatctttggtatctcattcatttaggagtagcacaaccagacaaaatttgaaaactctcatggttagaataagtgctgagcacggagcaaagatggtacgatgtagttgaggacaatgcaagagtggaaaatgggaagctcttgtaacccccatggaatggaagcatttgcctgtggcccatgaaaatggacgtgtcgagatgtgtagcttgtttcaataaactcgggacctgaattttggtaaaaaagaagatgatgctaaaaacagtaattgttag

SEQ ID NO: 13899 - DNA, 676 bp, Triticum aestivum
  Clone ID: PAT_TA_13899
agattataatcacatgagataaaactagaattagaaaaataacggctctgtgtcgctgcagaggcgcaatcaacaaaaccttctttttttcaaacaaaaaagttgccatattgattgtctataattacatcattataaatataattacattactttcttttaccatcagacactatttgctctcagaatgttctgatattacaaagaacaaggcccccatattctatccggttcttaaaggccaccatgtctgttagtctgttctcgctcactttctggacagcatagtcatcggcacaataatttgacgtctctttgctgattactctgctgaaactccttagatattgacgaatatcacaattgtcgacagctttcactggctcatgtgtgaaagagaaacaagaacttttgcttcgtggtgtgtcaaaatcatcactagaattgtttctagttcccaaaccaggggacttggcatgactaaagataacactgtcagacacatcagatccagtgatgctcattgagcactgggtttggttgtcaggttcctcattataattctgtcgatcagttggaaagggggatcctaaagagcttgatccccctttgaggagaaatctactgttgctctttcgtgggacaggtccacctgaattctgatgaggttcctcga

SEQ ID NO: 13900 - DNA, 785 bp, Triticum aestivum
  Clone ID: PAT_TA_13900
accaaagttaaaatattcatgttttcaattgaataatggtcaatacagaagtagcatttcataatgaaaacatgacagtaaacacattaaactacctacaaaaattagacaagcacattattgattccaacatgtaaatattacacattcttgcaatttctacgcttacttagtagtcatactattactagggctgctcaccttgccaagcccaaataatgtctttcaaagccggtctcatatcatgtttaaccggccccccctcgagagtatcaccactggtcttcctgatttccaccagatgaaaattcggtgcaatctgaaatatctcggtatctatggacattacgcctttccttcccggttgcaagctctgcatcttcaacaacccaccgtctctcttcatgagtcttagccgcaagcgctttgcaatatcttcaagctttgtgatgattgttgcagctgtgttggtagatgtgaatttggactctttcttggacttatcctcaaacatgccagagagatcaaacccagaagaaagagaaatgatgtcaaaagcattcaagttagtgagctctgttgcttcttgtattgtctcggttgtacagctactgaatggatcacaagtcggatccatgtcaacagcaacaatgccctccgttggtgtgttatagctaatcagtcccttgtcaaggcctgtccggaaccaagaattgtccaagatctctgaaaaggagatccgtgtaccggggttcggatcaagaatacgcctcagaagcctccgg

SEQ ID NO: 13901 - DNA, 1077 bp, Triticum aestivum
  unsure (1)..(1077): unsure at all n locations
  Clone ID: PAT_TA_13901
gcacgccgcggccgcgccccgccccccgctgccccgggcccgctcgcggatccccccgtaggtgccggaggtggcggcctggaactgcccggagaaccggtacatggcggagcggctgccggtgaacctcccggagatggcggaccagcgcccggtccgccgcccggagcaccgtctccacgacctccctgccgattaccactttcggcgacctggccaggcgcaggggcggaccttcggcgacctgggccgtgtcaggggcgttgaagattgggttgctcacctcctgaaagactccttgccaggggccacccttgatctgccccaagaaaacccttcaacatctctcgaccgagaagggcctgacctgcattttcaccgttgatggctcctcaagaccgacaaggcccccggcgcgcgctgcccggtcgccggtctcccgtgcgcagctctccgccgggtgctcgctgcccgaccccccggctgccgtgcgcagcgctgtgggggaggcaggggggctccacccctggcgccgggcgctgtgttccgatgccggcccgggggctcaaggcgttgctctggttggcgtatgccggctcctgcctggtgccgccgacaggtatggcatggagcggctgaagagtatttgcgaggaaaagctatgcaagttcctcaacgcagccgcaatagcgaccatcctgacgctagctgagcagcaccactgtgatggcctaaagaaggcgtgctcaaggtttcttggctccccggccaatcttagggctttgttggacagtgacggcttcgatcatctcagcaggagctgccctttcgttgctcaaaatctgcttccctcgtccccccttgggcgggcctgtggctgctgcaattcttgttccccgcgtcggcccgggtttcgtgggcctgctgcggtgcctagctccgttcctcggtctcaagtcgttttctcggccctgcatcgggccttcgctccctagtctggctgcctgcctttccttctggtatttatcgtggattcttattgtanactatcagactacctatctaacatttaagaaa

SEQ ID NO: 13902 - DNA, 746 bp, Triticum aestivum
  Clone ID: PAT_TA_13902
gaaacccgggtcgatccacgcgtccgtagcacccgaaccacggatctcccgacccccgcgtcgtctccttggcgactcggggagagaaaccctaaccggccatccctccctccaccctcctccttccctcgccgccgcctgaggggctcgccggcgaagctcggccgactccagggatggtggcggcggggcattctctgtggccactctcggaggcgcggcctcgcttggcggctggcaggcggatctgagttgctccatccgaggccggcggcggcggtgatttggccgaggtggggtgctgcagatcgaggtcacgccgcctctgcctccctccggtgggcgcacggctgcggctgcaggcggggcgggcccgatctgggctcacccgggcctgccgcgggcttgtgaggctggggcggcggatctgcgccgtccggactgtgcggtggagtcccaggcgggggctgctgccaggtctccggcgtgcgtacaggggcagctgcgggcatgcccgatctggacatgcccaagcgctgcggtgggctggatgcagtgcacctcgtggtggtgccctggtgcggctcttgagcaggccagtggtgctgcaggctatgctccggccaggatgggaggagctaggctccagatctgaaggtggggtgcgcgcggggcaacgtcccggcgtaggtgtgcagtatctccggacgaaagtcctgctcatggccggtgatgacaatgcttgt

SEQ ID NO: 13903 - DNA, 665 bp, Triticum aestivum
  unsure (1)..(665): unsure at all n locations
  Clone ID: PAT_TA_13903
ccggccatctcgcaaaagggcaaantgtttcaggaaagaaatctctgtttggctggactgcttctgttcggtcctcggttgctgcgttttctggcgccgtgctgctacattcctgcccgaaccgtcctccccgccctccacgccccgcctctacgccgcgtaagcgtgtcactgtcgcgcggcggcggccgggttctctcctagctaattaagacaggggaaattcaacaatactctgccgatcaatgtaacggagaaaattgctaggattctccaccgatcagggtactgatataagaagagacgtgttccattggaaaaacaggattattctccacgtaaatttacaacatgagatatttgatgtggttggttctgcaagcgaaaggctggagctccaccttaagtccgtcttggtattgcaaatagcacattgttgctgtggccctgaacctcaggaactttcaggactctgagcgacctgctggcttagcagggacagaaagttcgtccttcaacataaaggagagatcatgcatctgagacagcaatttctccacatttgcattgccaccttctgattttggtctggggttactgtcatgacttgttgcgggcaatgcatcaacatcacccatctgctgcattacgcccatcctttcgtg

SEQ ID NO: 13904 - DNA, 595 bp, Triticum aestivum
  Clone ID: PAT_TA_13904
atagtcgcgggagcaaatataagcagtaatgaacaaagttccatagcgtatagtcccgggacaaagtgccatagcatacaagattgaatggtgattgtcacgttttagcacgagaacaaataacatgctggaaatcatcaatatgccaaacagacaaaagaaccaccaaccatacttgatctcatacattcggagaaccaccaaggttgttgtcgcttgggcctcgtgcatgtgaagatccatcagtattagatccatggcctgattgatgaggcatcgtcatagcgggcataccattctgggtacaataagccgcaaacattgcaaagcattgactagtttgtgccaacaccgcctgctgcaccgcctgctgcatcgcttgctgcgtcctctcatcagccagtcgcctctcctccgccctctcctccgacgacactcgcctcaactccgccagtcgggcctccatctcaaccatagctggagtcgagcgtttacatgtagaagattttgagatacctaaccaagctttgtattcagggagagagctacgggaggaactagggaacatgcctcctgcaattgcttccttgccatg

SEQ ID NO: 13905 - DNA, 472 bp, Triticum aestivum
  Clone ID: PAT_TA_13905
gagtggctggtggagctgctgaccggcggcgggcccgcgctggaggtagagtaggagtagggtagggcgcagcactcgggtaggcaagccaaggcgtaagcgtacgcgcgtttcctttttcggacggttgtacagcgggcaagggaaaagccaggaaaaaaaagggcggtggttcgttttggcgcggcccggatcggtcgcatcgctttcttccgcggcatgggcgggcagcgatgggtccgttcatcaatgcggtcggtcttgtgtggtgcgttgaggggtgaggttgcgaggaaatggaaatggtgcttgctggcggcacgatccggctggctggcccttgtcgccttgcctgcttttgcgtccggtttctactatggatcagttgtcctgttccataaaacctttttgctcgccttgactggccgatagcgagcggcgtttgaattcgatttcgatcgtaaaaaaaaaa

SEQ ID NO: 13906 - DNA, 403 bp, Triticum aestivum
  Clone ID: PAT_TA_13906
tgccttacacatacatatatatcgcaaaatgtaaatgcaagtatatcacaaaaggtttgtccctgattcgcaacaccaatcacacctctaatagaactaaagaaaaatcacacctctaatgggttgaaattcacgtcttccaaacaaatatatttacacggctgattattagccttttaatcaaagcttttaacaaccaaaaaaaacagccactttagtcgctgctccctacaaaccatttcaacacctagctagattcacattgcctgaaaatctatcagcaacatcgattgccttatacacactggtatacatcgcaaaatataaatgcaagtatgcgagcaacctgtttttttttttttcccaaccaagtagaggctcatgcgtcttcgtcaccatgaac

SEQ ID NO: 13907 - DNA, 585 bp, Triticum aestivum
  unsure (1)..(585): unsure at all n locations
  Clone ID: PAT_TA_13907
cgtccggtgagacacacatcacacacactacaccggccgggatcatcgaaatggcgaccggcatcagcaacggcagaggcccatcgacgaacgacgcgctccagtcgatcctcgccgccgcgcgcccgttcctccggggcgacctcgcggccgtcgaccccgagctcccctcgctcgtctccgtcctcgtgtccgccggcgccggcgagtgctaccacaagcacggcaccttcctcgcccacctgctcgacgtctaccggatcctccgcctctggggcgcgcccgacgccgtggcccgctgcggcctcttccactcctcctactccaactcctacgtcaacctcgccatcttcgagcccgacgtcagccgcgcccgcgtccgcggcatcgtcggcgccgccgccgagcggctcgtgcacctcttctgcgtcgtcccgcgccacgcgctcatgcacgacgacctccacctccgctacaccgacgccgagctccgggaccacctcgccgncgncgaggcgtccctccaggccgcgcgctccggngggggcaggccggaggacaaggcggagccggggcgcgcgaagc

SEQ ID NO: 13908 - DNA, 1699 bp, Triticum aestivum
  Clone ID: PAT_TA_13908
aagccctgccccgcccccgatctctccccaccgccggcgacgaccgacgaccccgacacccatggcatcacgcaccaccttcgccgacgcgctggcggccgcgcgcccgtacctgcggggcgaggaggaccagtgcggcgacccggccctgcccgccctcaccgccgtgctgcgcgccgcgggcgccggcgagtgctggcacaagcacggcaccttcctcgcccacctgctcgaggtctaccggatcctgcgcctctggggcgcgcccgacgccgtggcccgctgcggcctctaccactccgcctactccaactcctacgtcaacctcgccatcttcgagcccgacgtcggccggggccgcgtcgccgccgtcgtcggggacgaggccgagcggctcgtccacctcttctgcgtcgtcccgcgccagcagctcgtgcacgacgacctgctcttccactatgacgatggtgagctcgtcgccgacctcgcccggtccgaggagtccctccgggatgcccgccgcggcgtgttcgacgaggatgagccctggcgccgcaagatccagcgcctcctcccggccgacggcatcaccgtcaagcacatcaggactggtgaggatgtggctctctctaggcgggtagcggcgacattccttatgatgacaatggcagacttcagtgaccagctcttcgactggcaggaccgtctcttcaacaacgccaacggccgccttgagttccgaggcaacacctggacgtcactgtggcctggcacaggcaagcccggcctttggaccacctctatctcccgcatgggtgtgctctacagcctaattgttcgcgaagaggagatatacatagctcaccgagcacacactagccaagaaggcaacaactctgctgccacacgcgacgaggacatcgcacttgtgataccgccggtgttcgatggctgcacgaaggtgctggacgctgaagaccagaaggcggcgcgagacctctactgggaggccgtgtgcagcgacgaggaggcgacagaccggtccaaagtggaggagctgctccggcaaagcatcaccaagaacccatttgtgggggagccacggttggtgctcgcccacatgtgcctgaacacggacatgatgaggaggtgcaggagcaggcggagcaagggctgaagctgctgctggagtgggggagcagctgggacaacaggatgccatgggaggggtgggtgtcctggggcagagccatgctgactaaggccaaggagaaagactggccccatacctccttcggcatcctcagcctaggccttgtcaagtaaccgctgtctgtccatgttacggtcccggcaacatatgatacgattagtaccaaaggtatgaaatgatattcctgcagtaatcaaataagtgacttcacagaaactagtacacgacgatggatcatcgttttccctgtgaaaaaaagacacaattctgattaccctatagatattgtgttcacgtctgtacagtagtctcagggaagttctttagatattctgaacaccagtattgtgcctgcaatttaaagggatcaaaacatcattgttgactctgtcttatggtcttcgcggcatagggttagcacgaaaggtgtgaaatgatatacctgcatcagttgaataaatgatataccattaagatggatttgct

SEQ ID NO: 13909 - DNA, 1696 bp, Triticum aestivum
  unsure (1)..(1696): unsure at all n locations
  Clone ID: PAT_TA_13909
ccactcggggggtttgttgtactgggcccctgagaactcaaaaaaaatttcacaccctcctaactgggattgaaattcaccctctccccaaacgaaatatatttacacatcattgttgtacggtcggtacaaaccacttctgaaccacctacctagaatcagttcgcctaaaagccctatcagcgacatcgtattgtcttatacaaaaccagcatacatcgcaacaggtaaatgcaagtatgcgagcaacctgcttttctaaaagtcccaaccaagtagaggctcatgcgccttcgccatcgccatcaacaccctatagacgaacccggcgagggggccaccaaccagccggccgacccagtagactcaatggttggtccacactccagcggccaacgcgggcccgaaggaccgggcggggttcatggaagcgccggagaagttgccgccggcaatggtgttggcaccgacaatgagaccggtgagcatcggaccgtagccgggcaccgtggtccgcgggtcgaggatggtcgcgtacaccacaaagaggagggagaaggtgaggatgatctccatgaccagcccttgcatggggcctatgcctgtgcccagggtgtgcaccggaaccggagtggcctggccgccggagaggtagcggaggaggatgcaggcgagggaggaggccagcagctgggccgccacgtacagcaccgccctgaacgccgtgatgtgcccgcgcgccagcagcgccaccgtcaccgccgggttgaggtgcccgcccgacacatggaaccccgccgtcaccagcacccccgccgccagcgcctgcgcgagggcaaccccggccagcgtcgccatcggcatagccgcgccctgcagctccggcaccccggcggccatggcggcggcgactccggtgaagacgaagaggaaggtgaggaccagctcccccagcacggcgcggacgcagccggcgtcgacgacgacgacgtcacgctcgtcgaacgaatccgcatgcttggtgtccatgctcgagccgagctccacgaggcttgccgctctggttcgtgggatgtggcgagagtctgtgcggctccgagctccacgaacgcatccgcgtgcgtggtgtccatgctgcccgcgctcgtggccctgctcatggcgatggtgcgagggggggccggggcgcgccgagggcaaaagctctgctggggtgggggagcagcccgggcgcggggccgccctggctggggccggggtcctgggccggccccatgccgccttcggcctccgcggccgacgccccccctacctcccgcggcctccccagcctacgcccccgccagcatccgctgcctgtccttcctacggtcccggctgcttttcctgcggttagcacctaagcgactgcaccacaatccctgaaggcgagtcagacatttcttcactagtttactcgccgtcaccctctcccgcttgccctgatcgacggtctgcctccccccgtctgtgtctcctgggagttctgtgcgtgccctgttcacactcgtgtgcccccgttgcatcgttagtttcgcatggtgctccctcttaagtctcccggataggtnacacaaagntgaaatgtatactcanagtgataatgtatncattagaaaaaaagtgcacggaaaagcatctttcggacccggccggc

SEQ ID NO: 13910 - DNA, 641 bp, Triticum aestivum
  unsure (1)..(641): unsure at all n locations
  Clone ID: PAT_TA_13910
aagcaaaattgggggggtggcaaatagttaatgaggagagaggcatatagagttacataatatgttaccatcacatagcggtttccaatgcataatgagtctacaaagtaataaatgaaggcaactatgttaccacacctatgacactacccactatgaaggtagtaacatagactagtaacatatgtatgttactagtctaaggttactctccactatgaccagccttagctccagccgagtactccttcctcccgctcctccctgtggcctgcgtctggccccggccgcgccgccgaccaacagactgacccgcgtacccctcacgcttccgctcccttccacttccccttccatcgcccgtttcctgcgccggtgcggagttcggtctcccccgcgcccccgcaagttgaacagtctgacacaatcactcctatgttctatgctataccttacttaataagcatctgtgcttagattaggcacacaatgaaagttgaacagtctcacacaagcactcctctctgttctgtgccacaagtacttaaacaagtagcatagcatagcacaccaacacttgcgccttatgctttggttccccatgactgacggacatcctcctcaattgtttgtgcaagntt

SEQ ID NO: 13911 - DNA, 529 bp, Triticum aestivum
  Clone ID: PAT_TA_13911
cgtccgctcctgccacgctttccccgagctccccaagctctcgccatggcaaagaacacatgcaagctctgcttccgccgcttcgctagcccccgcgccctggcaggccacatgcgctcccactccgtccgcaacctggccgcgaagcagcagatctcatcggcgtcctccgcgtccacctcgttcaccgccgccgccgatgacgacgtcagcttcaagaagccccttccaatctacgcgctccgggagaatcccaagcgcagcctgcgtgtcaccgatgtcgccttctcggatcgcgagagtgaggccgagtccaccccgtcgtaccccaagcgcgcgcacgccgtcggtgcaggggccgagaccgagccgctgagctcggtgtctgacgctgccacgccggaggaggacgtggcgctgtccctcatgatgctctcccgcgactcctgggcatctatggggcgcggcgacagcgacggcgactactttgacgacaggagcgactggggttacaccgctcccgcttccg

SEQ ID NO: 13912 - DNA, 509 bp, Triticum aestivum
  Clone ID: PAT_TA_13912
gcaaaaaggatcattgagaagatgaaggagaaattcccggacagagatgaagggtggaaagaggtagaggaggcattacctcaatagaataaccactcgcagatgaaagactgcactggtcagtgattcaaattgaagtttgtcgctgaccatcccttcttaaaatgtttgttcttgcgtgctgaaaacgtggttagcagttgggaactgcaacaacatttgttggactgttctaagcacatggagctttgtttaagatgtaattttgctattagaatatgctagtcccagttgctgttataaattacctcctgtcaaagaattattgaggcggttgtcaaaaccatgatctttgaggtgtgattcaaattgaagtttgtcgctgaccatcccttcttaaaatgtttgttcttgcgtgctgaaaacgtggttagcagttgggaactgcaacaacatttgttggactgttctaatagcaaaattacatcttaaacaaagctccatgtgct

SEQ ID NO: 13913 - DNA, 578 bp, Triticum aestivum
  unsure (1)..(578): unsure at all n locations
  Clone ID: PAT_TA_13913
tgattaantgttgtcttgagtgtcagatgagcacttggtttctgtgtatgcaagcacaggtttgtaacatcacacagcttgtcctggtttttttgtcgagaacctgtttggagtctgagattaagatctcataaatcatgtctacaccattttattgcggaattgtagcaaaactaacaatggctaccaggattataagaagactaatttttcgagagctctcggcatcttgttgtggcagcaacgacggcatttatcagtgtgccgcgaaacgaacccttctcgagctcatgaacaccagctatggtagttcctgcaggggaagtgacctgatccttcagctgcccgggatgtttacccgtctcgctaaccatggttgcagcacctagcactgtctgagctgcaagaccaagagcaagatcccgaggaagcccagcagcaactccaccatcagccatggcctctattgccaagaaaatgtaggccggaccactaccactcaagccagtaaccgcatcaaaatatttttcttcagctgtccaaacttttccaatggcactaaataagcttttgacacg

SEQ ID NO: 13914 - DNA, 399 bp, Triticum aestivum
  Clone ID: PAT_TA_13914
ggcggcaatagtggcactaacaatagttctccggccaggacaagtcaggcctttcaagattccagcactagacatcaacatttggagcatgcattgggatttgggaaaccagacaagtcacctacagctacaggctaggaagttcaattagtgtcacctacttccatcagcagtggcatctgagcagcgattacatcccatgtcacgccatgaataaacgacgaaaaatacctacttgcatcaatcagcaatggaccgtgtcacatcctgtcaatgcgaacgtcgaggcacacctccttgtacgccccacagtcgaccaggttcgcatgcggctccaccaggatagggggtagctcctccaccttcaccttgccgggcctggggcaactcgacaccgtg

SEQ ID NO: 13915 - DNA, 489 bp, Triticum aestivum
  unsure (1)..(489): unsure at all n locations
  Clone ID: PAT_TA_13915
gcggcgaggcggcggcggtgcccaaggggtacttcgcggtgtacgtgggcgcggaggcgcggcgggacgcgtgggcgatgggctaccttcaccagccggcgttccgggcgctcatggagctggcggccgaggagttcggcttcggccaggccggcgggctccgcatcccctgccgcgaggaggacttcgtcgccatcgtcgccgcgctcgaggccacggccgagtcgcgccagcgccggcggagcgcggccggcaggaagagcaggagcaacgccacaccatggtgattgatcaagctcatgcatggtgacgtagaagaagattttttgtcccggtcatgtggaaggacgccttgtctttcttagggcaagcatggctgtcccgatgatcgtcgattcttccacgttggttgcattcgaaatatttccaccgttctggacctgaatacatatnttaagggccctcttttgtttanaaanaaaaaaagta

SEQ ID NO: 13916 - DNA, 891 bp, Triticum aestivum
  Clone ID: PAT_TA_13916
gcacgaacagttgtgttttattagaacgaaggcttcagaagagcccggctttgaattaacaaagccatcaaccggccaggattacaaactcgaaaccaacacaagaaagcgaaaaagcgacaagatacagaggcgctggacaacagcacacaagcctcacacacacccagctaaaggatcgaacaaggaagcacgcagcacggggatatgtaggtcctcaatcgcatacaaatcaccagggagaaggagaatgtcagcacaggagcagcattacgaacggcgaggaagggcacgccgtcgccaaatcaccagcggccccggattgccatgtcctcccagctccactgtcaaagaagacccctgtctcctcgcctggctcgaaggcgccgaaccgttgacagtgtagcagttcaccctagaacctgggaggaaagacaccggcaggctgcatttggaaaggaacctagctcacccgactagccacgcaatgatctcaaggagcagagcaccacccaacacccacggactggacacggatgaggaagaactgccgggacggacggaggagcagtagcacagtgtccctgtaggcgttgagccgctgacgaactcgccgccgacaaagaagaccagctactgccgccgctgcacacccaccacttcgccgaggagcccactgcccacctagctcccaaaaacggcgccttcaggaaggacgcgacgccgagggcgccgccgccgcccaacagagttgaggttttcacccaggagactagagggatgggggcgacggatctgacctgaacggcgcctccagggaggggaacggcgccacgagcgtcgccgccgccaagacccccgaggccggcctggaattcggacgcgtgggta

SEQ ID NO: 13917 - DNA, 946 bp, Triticum aestivum
  Clone ID: PAT_TA_13917
gggacgttactttcctctgcctcccttgatagtcgcacaggcaaagctccacccggctcctttgccctcctcctccggcggtgctgccgccgcgagcgagcttgggaaaggatgccaggtctcagttctgtatagtaggtctaggattaagtgtagggctaggtctagacttccctccatggggtatggcatgatgccgagtagaagcactacatcagcgcttacgagcggcgcccgacgccgttcagcttcgcttaccggctgctctccgtggtggagagaaggtgcgggaggcggatctgactccagcttctccaataagctcgatctcgtccctgatttggaggatggccatcgcttagtcctattttctcgttgctgtcatggtgatgggaacggaaataggacgaggtgcagagcaagattcccccgattgggctggtgcatattctcgtcggtgcctggggtggagctacgacacgcactgttgctgtcggtctctgccgcctctccgacgacctttctggccgaatggcggccccgtgaagccatggtgtctgcgctggcttcgtttcttcctcccggcttgatgcctttagggaggcagctattcagcttcggtatggagtcttcctcttccgtcttctaccggagatggagtggtggctgtccggtgatcccaagtggttttgtccccggtgatggcaggactggatctgtgctagagttgatatttggacttgattgtaatcttgattctctggatagggtcctccttgtaagtttcagggactatgctgtagttttattttcctttgagtcctggtctgagctttgtactataactgctgggaattaatgaaagctctgggtccttctggacccgatcactgtcccctgctggacccgaccactgttcaaaaaaaaaaaaaaaaaaaaaaaaaaa

SEQ ID NO: 13918 - DNA, 635 bp, Triticum aestivum
  Clone ID: PAT_TA_13918
ctgcaaactgcctcgttctctccgcgctccggtctccccagtccacgccgcgcaggctggaagagctcgaatttcctcactcccgcgtcgcctcgcctcgcctctgctcgctccggagaaggctagctgccccgcgagccgagcgcggcgcccatggcgttcgacaagatccaggtcgccaaccccatcgtcgagatggacggtgacgagatgacacgaattatatggaaatggatcaaagataagcttatatttcctttcctggacttggatataaaatactttgacttaggtctacctaaccgtgatgctactggggataaagtaacgatagaaagtgcagaagctaccctaaagtataacgtggccatcaaatgcgcaactgtcaccccagatgaaggacgcgtaaaagagtttaatttaaaagctatgtggaggagtccaaatgggacaataaggaacatcttaaatggaactgttttccgagaaccaatcatctgcaagaatgttcctcggcttgtgcctggatggacaaaacccatatgcattggcagacatgcttttggtgatcaataccgagcaacagatacaatcatcagagggccagggaaactcaagttgatatttgatggcat

SEQ ID NO: 13919 - DNA, 602 bp, Triticum aestivum
  Clone ID: PAT_TA_13919
ccacgcgtccgcatgtgtcagagacgctgtatgtcgatgcatttgctcagtggctacggaataacccatgactatagaaacatttgccaaagtgggatttcccgcttcccctgcatagccctgtttctctatgtcacatctacttctccactccggcctccttaaaaaattgaacccttatataaccaaaatttatgaaactcacagtatttatctttcaacaagcatctgacttatttttcacggttgtgccattccttctccatctgatttctcaattttttttctatctatgtaacaaagcatcaatcatcatgagagaaatcaacacagaactgacccactataaattatcaaccaggggttccgagcattaaagtgaaggtaatagttagcatttgatgaattataagagtagaagagtttaataaaaaagtaagagaagaaaacatactatatttagattctttcatgatggggaaatttgaagggttgattggctataataactttctacaattaggaccatccaaagggtgtacctaacaagtcaaaattatcccaattagtaatgcaatggatgtctttgccttgctgcttct

SEQ ID NO: 13920 - DNA, 687 bp, Triticum aestivum
  Clone ID: PAT_TA_13920
aacattttataagaagcttataaattattggtatataaaaagaacaacacttaaatcattaacttccagccatttccataacacacacctaaaaactctcttgagacggtggagattcgggaagattaggaacagcgatgatggggctcctcacaacatgtcgcgtggacacccagctcaagcttccctccacatgtttttgtccatgaacgcccttgccactcactgacgcgctgaatgtcttcttctccccggccttcgagaacaccagcttgtgcggggtgacgcgtgctgtaagtgacttgggcatgtccagcttcgcaacgtatgtcgatgatggcggcccgacgttcgtcaccgtccgattcaccatcaaggcagtcggcttcagtggcacagttatagttgggtagttgagctcaacatctctgacctttggtagctttgcgcaggtcaagctcttgttacgcacgatggttgccaggcctctatcaccgaggagccagcagatgtagccagcatagtcgatgacacccaggtcgtacaccaagccagggtcagcggctcttgttggattcacatggcccacgcccatcgcgtacgcgtccgctttcccgtgcttctcgtccaagaccgagccgccggtgctattaacaacgtacgccgtcgtcatcatggccgacttga

SEQ ID NO: 13921 - DNA, 1367 bp, Triticum aestivum
  unsure (1)..(1367): unsure at all n locations
  Clone ID: PAT_TA_13921
tcttctcttcgtccttgnaccgaggcgactctctgtctctctctctccgcctccgccgagggcttccgagnaatccaccagcggntgcggcgcgacggcgccccctccgccgccgccgacgccgcccgaccctccgccgcctccaccgcctccaccgcacccctccgccgtcaccaacaccgccctactcgccgccgcctcaccgcctccaccgccatcttctacgtcctcccgtccccgtaccggagatccggcggttctcgtgaccggaagatatttggctttgcacgaacaagatctcacatggagccatcctcgcagcctgagcctgtcgtgggtgtggccactgctgggtcacaagcatatcctcctcctgctgcctatccagctccagccatgcctgccgccattcctcctggctcgcagccagcagtgccattcccagctaatccagctcaactcagtgctcaacaccaactggtttaccaacaagcccagcaatttcaccaacaactgcagcaacagcagcagcagcaacttcgtgagttctgggctactcaaatggaagagattgagcaggcaactgacttcaagaaccacaccttaccactggcaaggataaaaaagataatgaaggctgacgaggatgtccggatgatctccgcagaagctcctgttgtctttgcaaaggcatgcgaggtgtttatcttagagttgacacttaggtcatggatgcacactgaggagaacaagcgccggaccttgcagaagaatgacattgcggctgccattaccaggactgacatctacgacttcttggtggacatcattcccagggatgacatgaaggaggaaggccttgggcttccgagggtgggcttgccacctgctgctctaggggcaccggctgatgcctatcctccttattactatgtgccagcacagcaggtacccggagtaggaatgatgtatggtggtcagcagggtcacccagtggcatatgcgtggcagcagcctcaagggcaacaggccgaggaggctcctgaagagcagcagcagtctccctcaaactagccaagagattgatgcaatgaagccatgccatgatcctgaacttgatgcctataaactcaggcttgtgttaatttatttccgtcatcgttggccggaacagttactcatggttaggtcttagggggggttcctaatggtagcttcgacgctggtatgctaccggcggtaggaaaaaaaagattgtgatttgttaggtgatttgaaactgatttagtaaacagtaccttcgttttcgccctagtttctatctaatccaatcttctaaaaaaaaaaaaaaaaaactcgagaaaaaa

SEQ ID NO: 13922 - DNA, 565 bp, Triticum aestivum
  Clone ID: PAT_TA_13922
tttttttgccaaacacagccatgggataaaagatacggagtacaacagaatctgtcttgaacttccttcgagtagatattaaaaagcatcttgttacattacaaacttagtggaaaaggctacgacacaagcacagtaagttcttccacataacatatatatacactgccgaccagattgatgcaacacgacaaacttgtgaagaacagcagcagcccttaattacttcacctggagaaaacaaaattgttaatccattagtagatactagaaatatagacaagacctaatggtagcacctatgcagcagcatacatggttaaaaacagtcaatgagcaagttgtgcgtgcgtcgtaaaatgaaatggatatcatactcctccagtcctatgtctcctaggaccgccaatgacagccgaagtaaatcagtgcagccctttgacattgtaatttacttgggtgggatagttgaatgctactaatgtctactctcagtttgctggttctgaaatagctaaaccaagggtgagctctacgcatgaccaaatgcctaccggacgcgtgg

SEQ ID NO: 13923 - DNA, 1472 bp, Triticum aestivum
  Clone ID: PAT_TA_13923
gctgcagttcccttggctggactttcgcttctcattttcttttataaggccatttacagtgggctttgaagggatgcatcacttagcacagaaatgcatacagcttaagccgtctttcgacactaatggattaacaggcctgcttaacggcatcctttcagaaaatccagaggttgtcttggcggaatgcacaaaaaaattggggccttggatggctacacactgtatggagctggtggcagctgataatgactatgcggatattatgttgcatgaagaacgacctaactttggtggcataagcatagaagaactgcaccggctagtctacgctcaagttttgtgttctcattcttcaacttggcagatcgcaccgacttatctgtcctcgtgtctgaaccaaggcctagggctgctggagattctacttctcaagcaacccatacaagataaccgtctagtgctgaagactttggaactttgtcgtttgtatgaactggagaatgttggtacagacatcatgaagattgcaggctgttaccattggaagcatggtagaaaaggaactggggtttactggtttcagcaagctcatgataaagtacgacttgatagaattgctcaacaattgtttgaacgcattgggaagtcagtcgcagatgataattttaagcaatgggaagggttgctcgagttactaggttcagacattggtagtgcaggtggtcttgagttccttcacaggtaccgggatttcaagagatcccttcaacaggcactagaaggaaggactggcgaggctgctcggcagaccgtggagtttcttatacagctaatgagaaatccttctacaccacaacgtttctggctgccccttctacatgactcggtgaaactactcaactgcaaaccccgccctttactgaatgttgccgagacgaccttgttgctaaataaactacaagaactgtccatggccaagctgcgtcctgacttctgcagtaatcacctaccaagccatgcactgagctctgtcagattggctctgggatcaaatcttgcccgtgccattcttgaagaagcttgaactctggttgtatctggtggagtgtcagctccagtttggtggcgttactccgcagttacaatcaggctccctattttgttgttgagaaagtttgaattagttcgctctggttcagcggctctgccatagatgtatcatatattgtttttagctttggtgatctcatttgtctgttgttttttatacgaaacggtgcttgtaactgtgttcctgggtaaaaaaaccagcatgttgttgcataaaatctagtgtgcttatttctaaaatgcagtggacctgtggaaaagaaagtactccgtccgttccataatttttgtagtggttctagttcaaaggagtatttctgctcaaaaaaataaaaatctgaacgacttggcccattgtc

SEQ ID NO: 13924 - DNA, 589 bp, Triticum aestivum
  Clone ID: PAT_TA_13924
ttttttttttactaaataatgacatcgcacaagtgaatatactatgagtaaaaaatgtacttttgagtatatgtaacctgtcatatattaccaaaatcctagcattgattatagggggaagaccattctttttttttgaactatcatagttactaatcatataaccaatggcaaatgaagatgtatgcaaatcgcttcaccgctttgaacattacactaagctaaccgggtaccgataaataaaccagcttcaaccaatgccttagaccttgccatcgttttcccttgctttctgccaagaagtgaatgaacacctagtgacttgctcttcttggtcgctttttgtcatgttgcgacatgcttggtgtctagagaggccttgtgttaaccaacagccagttgagaggattgccactcaagaaaggagaaaccttttcccaaacttgttcatggtattcattgacccaatttatctccgaaggtgatagcaagggtaagtcaataagctttctctgaatcggaacaaaagttagtttctcaaagcccagacctcggccgcgaccacgctatggctaaattacctcctcac

SEQ ID NO: 13925 - DNA, 586 bp, Triticum aestivum
  unsure (1)..(586): unsure at all n locations
  Clone ID: PAT_TA_13925
aatntaagtgaagngatcatgngttcancgnttnacagcaaagtgggagaccctanttaaagnttacggggggtgcggccgccaaggcgttgggaaagttgcagcttagagacaaaaaacgtaaagaggagatggagaggctcgagaaggagaagcaggctgaaataaggagttacaagggcctgatggtccaagacaagatgacttcgaacaagcaggttgcatctggtagcaagaccctgcaggaactagaggaggatttcatgtgaggcaacagtgtgacgaattcgatcatactgcaaaagctctctaagaactgattctgtcgaagacaggacaggcatcgcccagctttcaagactcttgacctgatgattccaggcggaaccttgacctgttactgttatgcttcgtattttaatggcatctgtagacctgtttgatgtgttgagacaacagctatgtgtgatctagccgtgggtccgatacatgggtcggttaatcgtgaacccgacatggtaataaaacttattttcaatggtttctctgcaacaaaaaaaaaaaaaaaaaaaaaaaaaaaaaaaac

SEQ ID NO: 13926 - DNA, 554 bp, Triticum aestivum
  Clone ID: PAT_TA_13926
gtatgggagcccctttattagtccaaaaaaatatcaaaaataaaaacaaccacgcgccatcaagtgcacaacaaaatatatgacccaacagaacggcactgggcagagaactgcttacactctcctgctaaatcaatgaacaacaaaactaagctgcactgggcagagaactaaaccgacgaagttcttccttctccccttttccctgtgtttatgctctcctgccaataaccacaacaaagctgaatcacaaaaaaacagggactgaacttcaagcatgttagtttagggattaattcacagataaaactgcaagtaatcggtgtgctggcatactgcatatcacctatgcgtgtcgtcgccctcctcatgtcagtgtactgcaagcacgcgcacaaccatggaggcgcgaacacggatcgaggaggatccctctcgtgaatgaagatgcagaggggggcgagaggcgtcggctagtggacccagcttggacaccgtgagttgtggagggggcgtcgccggccaactccacgacggtcttcgcggacgcgtgg

SEQ ID NO: 13927 - DNA, 866 bp, Triticum aestivum
  Clone ID: PAT_TA_13927
gaattcaatttttctttgggtttttgggggccgggcggttgtttttttttttttttttttttttgaaaatctacaacttttgtattcatatctcataagatgtaagcaagtggcagtaattcctaaaatacacaacaaggatgatgaggtatagtcatctaccatgtatttgatctaaagttgttctagtgctgagctacattatacaaacagagaactgacagtgatgtggttaatatgtacccacattctatacattttttctagcaaaactcactaccgaagcagctaagtcctgaagttgattccatctatgaacaagtgagtagaccttccatgcaaatgccctgcgggggatgtcaccttcccgctcctactgtctccaagcaaccgctcgggtaaaagctttgtccatgaagcatccatcgcctgtcccaaccacatcccagaaagtaggatttggggctcggtgggtatgcagcaaccaccaagttagtaatgctgcccactttgccagccggccgggggaagtccaatgccaggttgtcgactttatgctcgtaaatttcccccggccgcccggcctggtacctggatgtgccactgaagcagccatatgattcccacgggacacgcggtgtgccccacagttcccaccggacaactatcgaggtttctgttagttgccaaatgcgtgatacgtcgagcccaatttcactgaatagtagacgtccatggaatctgagagcccagaagattgttttgtagttgtcaatcccatggaaagtgttcaacggatcaacaaatgtgatgtcttcgcggtagatgtcgtagttgggctcccgacctcggccgcgaccacgcta

SEQ ID NO: 13928 - DNA, 727 bp, Triticum aestivum
  Clone ID: PAT_TA_13928
gtcacgtcgtaggcgcgcccgaacgtgtgggccggccgcgcggcggccagcgccgtcttgagccccagcttcagggagcccaggtacggcgtcgccgggagcaccagggacacgttgttgatggaccacttgatgtgcccgtccagcttgttctgcgtgttgagcagctcgatgcggcggtccgacgtcgccggcggcgggggcgtgccggcgcgggccttgatctgggtcgtgaacgccttgctgtgcgcggtgtcgttccacgcaggggtcaccggcggcgcgatggccggcagcttgaacccgcggttggggcggtagttgagcagggccagtgccggcgccgtcttgggcgtccggccacgcacgccgatgctgacccagtaggtggacgacgggtcctggtcggtggtgagcaggacggagtagctgtcgccggagtagatgtccatgtcgtccaccacgaacggcgccacgtagttgccgtcagcctccaccaccgtcagcttgtgcttcccgatcgcgaggttgagggaagccagcgaggtggtgctggcgatccggagcctgtaggtcttgttgggctcgacggggaggatcaccggcgcgcaatgcctgttgccgccggcggtgcactgcttggtgcccggcgtgtgcgccgccgcgagcgagcagttgaactgccccctaccgttgatcagcaacccacgcgtccgcggacgcgtgg

SEQ ID NO: 13929 - DNA, 629 bp, Triticum aestivum
  Clone ID: PAT_TA_13929
ccgtgggccgtgccgcacgccatgtctgagactgctgaggtcttcggttcgtacaaaccgagagaaaaatattaaattgttcggaaaattctcctcataataattgtagttgtcggggcggacttgggaagactgatttccacacaagagaaaagagggggtacttaaaagttttgtcaaatatgagatagtctgactttctagactacttctgctgcattcatggggcaattggacagagttccattttagaagctggaagtgtttccgttctgcacgtaactaaccgcgctttttcctcttcttggttgaaacatcttcttgaaggccctcgaaggccccaaaacgcacggggctggccggacccctcaccgcgcagacctcgaacgtaaccggactgaaccgagcccacgccgcctagaccatcccgggctccttgctgccccacacgacaccgaccagcaagcgccccctcctcgacgcagcccctggccccggtggggtgaaggccgtgacagcccgaggcgcgtgctctagacgtagggaagatgccagcgtgtcagaaagaaagacagaaagtggtaaactcaattcagcagagctactctgacatggcacataaaccagca

SEQ ID NO: 13930 - DNA, 391 bp, Triticum aestivum
  Clone ID: PAT_TA_13930
ccacgacgccacgcgttcgcccacgcttccgcgcgcggcaagcgtgacctccccctcctggccagactgtatcctaaggcggagccgagagccagcggcttcctcgcatcactcggtgccacggcgcgcctcgccagctccagcgcggcgccggccagaagcagcacgcccgtaatcccggcgcgagcgtgcgcacacactgtcggaacgaacggggcgagcgatggggctgctgtcgcaccgggtggagcggtcggagctaaagcccagcgaccacatctacacatggcgcgccgcctactcctactcccaccacggtatttacgttcggcggaaggcaaggtggtgcatttcacaacgaaaaatgaagcgggaacggggggccttgact

SEQ ID NO: 13931 - DNA, 1032 bp, Triticum aestivum
  Clone ID: PAT_TA_13931
gtaggggttccttctcttgcttcagtctttcacgctctgcttttgcagccgctttgcgcttttcttgctccttttgtttcttctcttcaagacgttttgcagcttcagctgccttgagtgccttcaccttaacatcttttttaacgcacactgttgtagattgcaacttttgttttacaagaggtacaaaagatgccacattggcaacaatattgataggcttagattgtctgtcaacatttgcttcactcctgtgtcttccatttttgctattgagtagttctgccgtgccttgtttgtcaacatttgcttcactcctgtgtcttccatttctgctattgattatttctgtcgtgccttgcttgtcaatatttgcttcactcctgtgtcttccacttctgcttttggttatttctttcgtacctgatctgtcttgcacgctccgcgtttcctgcccctctcccctttccgtgctccggtggttgcttctcggcttgacgctttgctgcctcagctgccttgggtgcctgcgccctctcctctctgtttccgcactctggtctaggttgcctctttccttgctcctcagcgactgaggcggtcacattggcaacaatattgctaggcttagattgtctgtcaacatttgcttcactcctgtgtcttccatttttgctattgagtagttctgccgtgccttgtttgtcaacatttgcttcactcctgtgtcttccatttctgccattgattatttctgtcgtgccttgcttgtcaatatttgcttcactcctgtgtcttccacttctgcttttggttatttctttcgtacctgatctgtcatgaagagaacgggatacttttccttctctcttaactgaagtagggtgattgtaacatagacttgagtgcagaatctgtcagtagtgagctcactcatcattcaaatatcagaaatgatagcattaagccaagatacttttccttctctcttaactgaagtagggtaattgtatcttcggacgcgtgggtcga

SEQ ID NO: 13932 - DNA, 1311 bp, Triticum aestivum
  unsure (1)..(1311): unsure at all n locations
  Clone ID: PAT_TA_13932
cagaagtgaagggagagagcggagaggagcagcggggatggccggagccggggaagacgaatcagctccccctcctccttctgcactactagatcagaagcccatggaagagacggcggcggcagcgggcaagctcaccaggctggagcacgagcacggcgcccccgacgagacgtccttccggatggaggaccttcccgcggaagttcaacctgttataatgtcacagctgccactgaaagaggctgtgaggaccagcattgtttcaaggagttggagaatgctctggacattccactctgatctatgttttgatggtcccactcccaatgatctggattctgacaccgatgacgagttcgctggtcaggatagtaccaaaatgaaacgagcaaagttcattgagactgtaaattcggttattcaacagcacagcgggataggaatcaataagttcagcgtcaggtgcggcatgcacaaagagtacactgatcatcttgacaggtggattgggtttgccacttcatcanagtccttatttctcgccagtgtttctataaagccacgctcagtaatatctggctttacaatactcagaaggcttgttttgagctcttgttcagatatttggagattttccaggcttgcttgcaaaatgttcaagacttgaggacttagagatcatcaggtgttctggtgtggatgacttcatcataccaaacacactcgataaacttcaaaatttgctgattgctggaacggatgtccagatggttgttattcatgcagctgatcttgctcattttgagtatgaaggacgactgatccctatagtgcttcatggttgctcaaaattagagaaggcaacaattgcgtttgataccactaatccttatgcactggcccatgcattcaatataattacaagcatttccccagtgaagatattaattgtgcgagctattatatcaacatatgcacagtccctggagctgccattaagaccacagggcatgtttatgcatctgaggcatatgacttgtcaaattgtcgtctattgtagagaattaaatgaagataatggacttcttcaactggcccattggttggacgctgcaccccgactggagacgttgcacttgcatatgcactatctgagtcccggtgctttcttcagtgccgaggtggcgggggcggaaggtccctgtatgtgtcgccatgatcatcttaagacggtcttcatgggtgggtttcagtgttacaagtctcagattgagctggcgtgctctatcttgggaaatgcttttgtac

SEQ ID NO: 13933 - DNA, 1209 bp, Triticum aestivum
  Clone ID: PAT_TA_13933
cgtccgaaaagtcgaagtgaagtgagctcctctggtcggagaggagcagcagaagacagggcccctgagccgactgcaccacccgagccgagatggccggagccggggaagacgacgcagctcctcctcccccttctccagatcgacagcagcccatgggaggcggcggcggcggccaagcggagccggtcggagaaccaccacggcctcgccgacggtccgtccttccggatggaggaccttccggcggaggttcagccggttataatctcactgctgccactgaaagaggccgtgaggacaagcatggtttcaagaagttggacaacgctctggagattccacggcgacctaggtttcaatgaaccccttgatgtggattctaacaccgatgacaatcccgctgatcaggtgaatggcactggcaccaacgaccaatccactaatcagtgtggtaccaaaataacacgagcaaagttattgagactgtaaatccgttatcaacagcatatgggattggaatcaataagttctgtccctggagctgccattaagaccacagggcatgtttatgcatctgaggcatatgacttgtaaaattatcgtccttgctagagatgtaaatgactataatggagttcttcaactggcccattggttggacagtgcaccgcgactggagacattggacttgcatcttccaatgcagatgtcctatctgaggtccggtgctttcgtaagtgccgaggtggcgggagtggaagctccctgtatgcgtcgccatgatcatctcaagacggtcttcatgagtgggtttcagtgttacaagtctcagattgagctggcgtgctgtatcctgggaaatgcttctgttcttgagcagctgacagtagaagcaatatggggtgatgatgattacaggcggatctgtgaatgggcagaggtaacctcgaagcgctttggtaaggtgatcactgtcttagatgccccccttaacagtgagtaaaccaatccttttcgcatgtacacgctgtcaattaatctcgtgtagtctgcagtatgcagcattcagtgtagctgggagaatgcccctctagactgtactgactgttttggtgtctacaaatggaatctgtagggcttttgcccctctaataaaaaacagtaatctctgggtcatcgtaccaaaaaaaaaaaaaaaaagcccct

SEQ ID NO: 13934 - DNA, 118 bp, Triticum aestivum
  Clone ID: PAT_TA_13934
gtttttggccatagggtatctctatctgtcatgacaaatacaactacatataggaaggatcagaccaggtcccaatcttttagtataatggagtaacaatgtagcagcggacgcgtgg

SEQ ID NO: 13935 - DNA, 1074 bp, Triticum aestivum
  unsure (1)..(1074): unsure at all n locations
  Clone ID: PAT_TA_13935
tatttttcttcccgtttcccgattcaagtcagcggttagggttcggagatctcggcgtcgcatcgcggccatggcgacaagcacgcttagcacagtcatggtgagcaatttgtcgctaaaagcagcactaagagatgtaaaggaattcttttccttttctggtgaccttgtgcatgttgaaatgcaaagtggcgacgagctgtctcaagttgcctacattacttttaaagataagcaaggagctgagacagccatgcttctgacgggtgccacaatagtcgatatggctgtcatcgtaacaccagccacttattatgagctaccagctgatgttttagctgctctagagcccaaagatgcaaagtcctctgctcttgagaaggcagaggacatcgttgggaccatgctggccaaggggttcattcttggtagggatgcactcgacaaagcaaaagctttcgacgagaagcatcagctcacatcaactgcgactgctcgagtatcttcctttgacaagagaatcggtctgagtgagaagatcagcgttggtacttcagttgtaaatgataaagtaaaggaaatggatcagaaatatctagtttccgagaagactaggtcagcacttgcagctgctgaacagggcgtctctactgctggatctgccatcatgaagaacaggtatgtccttactggagcagcatgggtaactggtgccttcagtaaggttgcaaataccgcgaatgatgtcggggcaaaggcgaaggagaaaatagcggctgagcaggagggcaagaccgtagcggccgggcatgcacaagctgacatgtcggacgctcgtgaaaagcccagggatttggatggtgaagtcacaaagatacatgtctctgaaaacctgaagatatcccatatctaccgctgcagtttcccattacagtagatgatcagcgatgctctcaacacgctgcacgctctccaagaacggaactccanggattgatacatatatcngcgatacatnattaataacatatagnggtgttaatcagntgtacttgtgcgcngtatgtatcctgt

SEQ ID NO: 13936 - DNA, 790 bp, Triticum aestivum
  Clone ID: PAT_TA_13936
tttttttttttttttttttttttttcttcttgtggctttaagcgaaatggaatgcaatgaattatgaccgagagcaattcaacaatgagatttacacggatgaggatgtctatcttctctatacaaaattctcacctttgcagattgacaccagagttgttgcagtagcacacaatctgccatgccgtcggggttgcggcttcgctttcctccccatctctatcatctcacaagctccacatcatgagctgtttgttaggttcacatgctcaacatgagggatgcccctgccaagcttcatggacggccaacagcaatgctatacaccagtccgttctctgatgttttgtcatgctcatgccatattcacacacgcacattgccaatggttctcttctcaaactcccgcaccgcgttcgcgacgcgcttcatgctgtcgtcgtagtaccagggcgtcttatcggaccacgtcacgccacctttcggcggcaccggcacaagctcgcggcataactcgccgggaacgttgatggtgttgtggtagtggtagtaccggatgaggtgctccgtcttgtgagtggtgttgccgataacgttctcggacatgtgcacgcccgtggcgtatgcgtgcttggcctggatcgcgtacttcctgtcacgcctcaccccggtgatcgaattccggaacaccagcttctcaaacccccattgtttggagtagtcggcctcggaatcgttggtgccccgcgcgcacaacctgctcgacatggggttctgctcgatggtgaac

SEQ ID NO: 13937 - DNA, 719 bp, Triticum aestivum
  Clone ID: PAT_TA_13937
tttttttttgttcccccccagggttcgagtgttccattacgacgttcttatgttcgcattatgaatatacatataacatattacagaagttgtagactcgtagttgcataacacatatgagatggttaaatgagcaaagatttgggcaagattgccgaacccaatagcctgcaggtacaaaacctccctgtaatgatgcatcttgtggcctccttcgataattatgtaccgatagaatgggcaccagttaagtggatttcaggattctccctcttccaattcagcaatgaacagaaaaatggcagggtacgagcttgccactccccatctatgcatttattcagatggcaaagactgccaccttggccgtcgttgtctatgtcagctccagccatattcacattgggtgggaattcagggtgaagatgctgagaggggaagtggaaacagatttgctgtagaaccgaatctgagcaaaaacgagccgagatctcatctcatctacgccaaaataaacatcttgagaagctttctgaacatccattttcatcccagcaatgggatcagaactctccaccatggatggtgacagtggcaccggttgcagaagttggaggacggagaagcatgtgtggagcataaatttttgacaactgcccagcattcccaaatgtagttccaggtgacgccggctgatttgctgaagagtccttggccag

SEQ ID NO: 13938 - DNA, 344 bp, Triticum aestivum
  Clone ID: PAT_TA_13938
gcgtccgggaggggggtccaccctccccgcctaaatccctccgcgttcttggccccctccccaaccacaaaacaaggggataaatccaaggggggagacgagctgaggaaaaaaaccctacttaaccgacagtctcgccggcgggaggtagaaccgcggcgcgtccagtcgtccagcaggcctccgcgcgcagcccgcgggtggtcccggcggcggcggcggggagctgggggtcgcgggggcggagtcagatgcgctcggaatggggaagcccgtcgatgtcgagctcggcggcgcgggaggcctcgcgatctccggcggaggaggaggaggaggagggtggg

SEQ ID NO: 13939 - DNA, 626 bp, Triticum aestivum
  Clone ID: PAT_TA_13939
gcacacactctttgctaatatcaattaaaatgctccccttattagaagtatgttctacaaaggatcgacaaacaactagagaatttacaccccaatcattctatgcttccaagttgaacaggtgaacattattagagagacctcaacactggatttcaaacaacatggagccatgtgaggccaccaccgctgagatgccccccttcatcacactccatctctttctactccagacttctgtgcaggtgcaccttgccaactttctcccgacaaccttttctagatccggcacgcttacagtgatcttcctcctcgcagtgtcgaggttgaagatggccacgtagatctctcctttgtctccaattgctgtccatgctcgtgctccggtagtttcattctctccttccttgttggaccgcattgtagcacacaatcccgagtagctgcttacaagctgtccattctctgttagctcccagacctgctttgtatgctgttcgcaggccgagaacatgggagtttggctcgctgagcttgttcgccatggactggcagatgcctcccagcaaccatcatcggtgtcaatacctgtcagatgaaactttgcttggtcttcccactgctca

SEQ ID NO: 13940 - DNA, 407 bp, Triticum aestivum
  Clone ID: PAT_TA_13940
cgtccggtgcacagagacgtgggaggcatgcccagccgcaacctgctgcgagatccagccacaccgcctctccgatgctacgggaggaggctccgatggcgagcgacactggccgccgctgctaacccgcacgagctgctccatggggcaggtgacggccactagtgacgccccttgtaagttccaacagtccctaggccccgacgagcggcagcgtcgatggccgttgcatagtgcatagcagctccggcgtcgtggccgctgcatcgtagcttcaatagccgctgcattgcaactccggcggcgtcaacggccgctgcattgaagctccagcgacgtcaacggccgctgcatcgcagctccggtgcgcgtcatggccgctacattgcaacttcggcggcatcaac

SEQ ID NO: 13941 - DNA, 774 bp, Triticum aestivum
  Clone ID: PAT_TA_13941
gacttgaatcttcatcactcactcactcactcactcgtcgatattataaaatatatatcgagaaaaaccacggtcgttcgtacaaaactgtttgtttgtatgtacagagtaacagagtctcaaatacgatgatgacctgatgtcaacctactacgaatatgtatgtacatgtttgttgtctgctgctgtcgtcgcctcgcctcgccgccccgcgcggcttattgtccgagtctagcactcgtataaaaaataactccggatgatgatgatgataatgatgatctgctgctgctcttgtcaagcccaaacccgggggatcatcatcattgttcagccgtcggtcagaagaaattgacctgccggatgggcgccggcgccagcgaccgcttctacatcaggttgggctgcagagggaacagcccgaacggagaagagcccgggaatcctccccctccccccccccccccagccagctggcagcgcggtggcttggcttgtcagcaatgtacgcctgctgccaggatggcatggccggggcttcccccaacggccgatgcgatgatgacatgagtggccacagccctggctgtacaggaggattcccataacccgggtatagaagattttcctcttctctatgttcttggaacatgcttaccaagatctgatacagagcttggctttaggctgagagttagatcaaggtcatcagattctttaccaaaacaccaaaggtccagttccaacctcgggcctgttgctctaggctcatct

SEQ ID NO: 13942 - DNA, 453 bp, Triticum aestivum
  Clone ID: PAT_TA_13942
actgcaaggtaaaacaacacataataaaatcgggatagctttaaatcacaaccaaaacaggcaaaactttctcagttcaacctaggactcgaacagtttacaaaaaagggggttcagtttgtctgcaaacatgacatggacccaacatctaaaaaaatccaacgagtaacatgcagcagcttttcgccctaagctggggcacccttgcccttcttcttcgggagcttcctcatgtaaaaccccagctccttgccctccaggaggtacccatcagctttgccacactggccagggcgaaacaaaatgcaggccagcagccttccaccgctgaactgctcctcaatgggcgagtccagggtacgtccctgctggcgcttctaaagcttcctctggacattggggctcttctttgcttcctcgggggcagcagcagcaacctcagccttttgtccc

SEQ ID NO: 13943 - DNA, 674 bp, Triticum aestivum
  unsure (1)..(674): unsure at all n locations
  Clone ID: PAT_TA_13943
ctctcagcctccctcgctgcgccgccgctagcacctccatccctagctggccgccatcacacccccagcagccatgtacagcggggcggcccaaggaaaggagctcccctccccgacccgatctgatggagagaacgccaggccttgccactccggttgtcgctgtggccagatccgatcgtgggagccgccgtagagcctccatgtcggcggagcagagcagtccgacagtggtggttgcccgatctcgtccagcaagtcgccgttggttgccacgaccacctcattccctgtcgcccctctccttcaaccatggtggcgctcctccccgcattgccgtcgttggtggagctcgcctcacccccctcacgtcgtcagctgcaaccgctccttacctccacggtgctccccttctacatccaatgcaggccagtgaacggcgacgactangaggcctctacctcgactctaccggccgtggtcgccccgcgtctccgcgcccccgccccttagcatcgcgtcgacgcgtcgcatccctctcaacgaagagaggaagaggtgtacgagagtgaggagaacgctgttcgcggggcctccaagcagaaagacacaagaagagaagcggatgtgaccgaaatctcacaatcgcatctcccgtctctctcatgtcaagt

SEQ ID NO: 13944 - DNA, 595 bp, Triticum aestivum
  Clone ID: PAT_TA_13944
ctggctttgcgcggggtgggccccattttctcataggggtcactgtttcaccgtggttgacaacgcacacctctgtggtgttgtcatcgccgctcacgcgccacaaaacacgtgtgctcctccggagggtaggctctgtgtagcgcgcccctcggctcacacctcatcgcgccccccccgccccactcccccctccttcccccccgccgtcggccagccccggccctcgctcgccctccggtgtcagttgcgtcctcccggcctcctggccgtcctcacactgctccggcacaaccggggtcgcagctccggctcgcacacctcctccaggtcatctcagacgcgggcctggccttctacgtttagtgatagttcatagaagcgacaggctaccactatgcaaatttatgggcaatgccctctatatatctaaactgtcactccaggctatagagtatgttgcgatatgtttcacatgttactgtttctcatctagctaaaaagaaagataaatatacattttgaaacagagcatcctactgtgtcagttgcatcctcccatcatccttttcaatcttaaattgctcctgaaaat

SEQ ID NO: 13945 - DNA, 424 bp, Triticum aestivum
  Clone ID: PAT_TA_13945
ggatctgaaggctacctctttgttcatgcaagccaccccagtgacaacatgaatgcaatgtactccctccgtctcataatataataacgttttggatactataagagctcttatatttgtttactcaactagtgtaagtatttgtaccagtgacaaatggtcaaaatacatataatgtaatgcatctctgtatgtagtgtacaaaagaagtataatcttctcttcctcgacccaatgttattgctctcctcgatctcaacctcccactaatcaaagaatattatgtaatagtctccgagccccaagaatggacaccatgcgtgaacctaattaacacggatcaaaacaacgctgtatgtgtgtggcacgtcgacccacagatctcagagccaggaccgcatctccagtcgtcgcggacgcgtgg

SEQ ID NO: 13946 - DNA, 1749 bp, Triticum aestivum
  Clone ID: PAT_TA_13946
tgcaccagcttaaatgctgtggggtgtttgaagttgtgaggatatcaagagcaggctatccaactcggatgacacaccaacagtttgctgaaagatatggatttcttctctctcattctgtcgcatctcagaatccacttagtatttcagttgctgtattacaacaattcagtatacccccagaaatgtatcaagttggctacacaaaattgtttcttcgtacgggacaggttgctgcactggaaaatgctaaaaaccggatgctccatggagctcttcggattcagagaaacttccgtgggttgcatactcgacgagaatattacacactgaagaaaggagcaacagctttgcagtcatttgtaagaggtgaaaaggcaagatttcgatttgattaccttttcaagagatggagggcagctgttctcatacagaagtacactaggcgtcgacttgcagccaccatgtttactgatcagctaaaaaatattgttgttctacagtctgtgatgcgtgggtgcctggccaggaagaaattcaagtgcttgcaggaagaaaaggaatctaaagtcatcaacagcaaagttaaaagggatgtaaggtatatatatttcacacgggaggttatgccatataaagcagggtgaacctgtacggcggcgaaggacgacagaagtcgagggacgcgtttcgaaagctgaggctttattacgagacaaagaggaagaaaatgcgatgctgaagcaacaattggaacagtatgagaataaatggtcagaatatgagaccaagatgaaagttatggaagaggcatggaagaaacagctctcttctctgcagttgagtcttgtggctgctaagaagagcctagctgctgatgacatggtcacccgagcagctcggactgataccactccaacgcatgctcaatacgactctgaagatacaatgtccacagggacccataccccagaagggacagagttgaaataccaaaaccacaaccctgaacctagagtggtgacaggaaactcagataggcgaataaatgctgtgaatcacctagcaaaggagtttgaggacaggcgacaggtattcgacgacgatgctggcttccttgtcgccgtgaaatccggacagattggttcgaatatgaatccggacgatgaactcaggaagctgaaggaccggttcgctacatggaagaaagactacaaatctcggttgaaggaaacgaaggtaaaccttcagaaggtcggcagtcatgacgagaaatctcggaaaagatggtgggggaagaagagctccaagtgaacgcggacgttacaaggtcagagcatttcctcatattttgagtgccattgcatcaaaggaagagagatcaagaaatggcaggagagaaggcggttttgtgattctcgctctctatcgcaagcaagcctggtgagatggcggcgacgacgaactccatcgccgatacctgcgcgtccagtttttcgggagtgtctgaaagggttgcaagaggcacagcaagagatctgtacatgtatgttagttctgagttgtcagtgtatgtatgtgtatgttgtcgtgtatgtagagcgatgaaccggaaatatgaaagggtaattaaatacagattatccgccgagagcgaatagagatgcaacagcaggactgtaatgtgtacagcaaagaaatcgttgaatgtgcaaggcgtttgaatccattgtttcctcaaaaaaaaaa

SEQ ID NO: 13947 - DNA, 758 bp, Triticum aestivum
  Clone ID: PAT_TA_13947
gaattgaattagctggtcgactatagcaaactagcaaatcttcctagaacaatctcgacgaaaaaatatatgcaggaggaagatagattttgtaccgataccggaagaacaacagagcaacctttttttttctaatcttgtaactttctctgtatgactggccgactagatctacaccgatcccagctcttaggcactaagttgcatgtacaagtgagtccgcacggaccgatccgcgttgttcagtgtgaattgctaccgttctgcttggtcgagtcgggtgacccgtacccgtaagggttcttgctagcccagttccactggtccctgcacatctccgtgatgccatattttgctttccagttgagttctctctctgctttgccagttcctgcaaagagaatctcggcatcaccagggcggcgctgaccgatgaccagcgggattttctttccagaagccttctcgaatgcattgactatctccaacactgacgtcccctttccagtcccaaggttgtatggttcacatcctatgttagacgaactatcaaaaagcttccgtagtgcagcaatatgcccctcagcaagatcaagcacatgaatataatctcgtaccccggtcccatctttagttgcatagttatttccaaagattgtcactgacggcctcctcccaacagcaacttgctgaacgtagggcataaggttgtttggaactccacgtgggtcttcaccaaggtatccactggggtgtgc

SEQ ID NO: 13948 - DNA, 152 bp, Triticum aestivum
  Clone ID: PAT_TA_13948
cttttttcatggtgcagtgctcaaacggtctctgtgatgctgtcggttagattcgtgtgcaaccttcctttctgaatattttctacagggggttgctctgctctcgtcgtgtgctctgtggaccagagcagagcacacgaccggacgcgtgg

SEQ ID NO: 13949 - DNA, 877 bp, Triticum aestivum
  unsure (1)..(877): unsure at all n locations
  Clone ID: PAT_TA_13949
gcggccgccgcggcggccacaggtccacccggccgtggaggccactcgtccacccagccggtccactcccccgcccccccggtcacgccacgcccacgcgcagaccgcggccgagagccaagcccgccgacgacgccccgccgccgtgccgggggttcaggaccgcacacccgccctcgtccacccccacctccatccgcccccccctctccccctgacggccctctcgccttctcctgcggaacccgcctgtgtccccggattgatccgcggcccgccattacgcgcccccccgcggcccccggtggcgcgaggggctggaccgctcctgccccccccccacccaccccgccggcgcgagcgtctggcggggctccagcctccatgcccccctgcaccgccctcgtcccgggctacgcttcgacgcgcctctgctgcccgccgggacggtgcccgactacggccctcccggctgacgcgcctaggcggtgactttgctcgcctacctaagcctgtggtggtttggaatatttaaccctgcaatagtatatgatcacctgggagagatatactcggctctggtctttggaagcctngtgttctggttatgcctgtacataaagggtcatgtagcaccatcttcatctgattctggatcctcagggaatggggtcattgatttctactggggaatggaactgtttcctcggattgggaagcatttcgatataaagtctttacaaacttgccggttgggagatgtcctgggttgtcttggtggccctactggataaaggcgttgaaatgaagggccggttgcagactcatgcttgggaatctggacgggagtgatctatttacaaaaggtttttggggg

SEQ ID NO: 13950 - DNA, 1051 bp, Triticum aestivum
  unsure (1)..(1051): unsure at all n locations
  Clone ID: PAT_TA_13950
ttttggtcccaggcccnaaaaaaggntggggcccttggncccagtnaaggttgggggncctncaancaaggttgtcccccctngaacccaaanantgggaaccaaaggaacccttgccagggtttgaanccgcctttttcagggtataaaaagcttcccttgacaatttttttcanannggnccttngagtacttagaagtggnggcatccattcttgttgcaacaancagatcatntgcttcacnccaanagtgaacncaaggaaaagcgtgctcacgggtctgnccatccttgaagatnccagnagagaactagttcgagttttttttttnnttttttttttagtgcagggacaaattaagtaccaatccacataaccaatggcacctttcatggtctaccacaagaatattgtttctaaaacatttattggaaggagcatcacatatcatagaagatgtaaagaggtattacaacgacaaaacggtttatcaggagaatctatcattgttcccttgtttagggactagagcatgtcatcctttcatgcgtgtagttctatcgaagattcaggcggcgggcacttgggattgcacttagggcatttagacttgcactcatccaaagtcttgaaacatggggtctcccggatgtcacagcagtagcagtcaccgaagtcgcaactccatttgccgcacaatatgacggtaaacttggcatcatctaacgatgatatcgcgttggccacggtagcattgttatcgccaccgtctagatagcttcgttttccagcctccatacgacactgtgcagtgaccgtgagccatcccacgaacaagatggccatggcatgaacccctctcattctggtttaatctttactgattgcttagtcgattgagtcaactctccgcaatggggtgggttacgtgagcgggcgccgggttcctgcagcccgggggatccactagttctagagcggccgccaccgcggtggagctccagcttttgttccctttagtaggggaattgcgaangacgtcnnctnnc

SEQ ID NO: 13951 - DNA, 715 bp, Triticum aestivum
  unsure (1)..(715): unsure at all n locations
  Clone ID: PAT_TA_13951
gatcacggactcaaagtaataaccaaattaaaatatgtagcctgcatgagtatatcatatcccgatatcgccaacaacattaatattcgattttccaaggggggcaccgcccattatactcccaacacatcacactgaagtcaccatacattatagcacaataacacaacatgtaatcccaaatctgaagtgcgcctgctgctcttattttgaatgcgcctctgactttgtcggcatggtacgaacgttcttgagaaggtcctgaattttggacagcatcagcgcctgagagggagcctgagaggaatcaccaggcacgctgctggcctgcgggggcctatggccgtcctggagctttattttctcaaaaagaaactgcttctctgcctccgcttcctccaggcgccgcttgaggtagaggctagcgtagtcctgctcagccctctcagatttggcaagcgcgatgctctggagcctctcagcctcctggcgggcctcacttgccttgagctggaacatctcagcctcagcctgtttcaaccgaacaatgctctcgagctcctccacctgctgcttncttccgcagcctctcggccttgaactcctgaacttgtctggccttctcatcaagctcacggtcacaggcctccacagcggtgcgagcctttttgtacagtcccattttctcttcagctcgtgccgaattcggcacgag

SEQ ID NO: 13952 - DNA, 616 bp, Triticum aestivum
  Clone ID: PAT_TA_13952
aagggtatggggtaaataaccaaatagcatgcatgttaaccaaggggcataacaggttcaaaaatacaagggtctggctacgcggcaaataaccaaataccctgcatattaaccaaggggcataacaggttcaaacatacaaggtttttacaacacaacaggttgtaaaacaaaccccacaaagcaaatgttcaaacccacggataacaaataaagcccctcgggcaaatcataggattgcagcaccatgccttgggaaagccccaggaggcaggctttagtactaatcgcccttgtcaccgtcctcacccttgtctaactcaacaccaactttttcgtagtccttttccagggcagcaaaatcctcacgggccttaaaaaactttccctgctccatgccctcacccacgtaccagtggacaaaggcacccttggcgtacatcaggtcaaacttgcggtccatgcgggaaaagacctcgacaacactgggggagttggaaatcatgcacacagccctttggaccttggcaaggtcaccgcctgggacaacaccagggggctggtagttgataccacacttgaagccaggggggcaccaatcaacaaactggatagg

SEQ ID NO: 13953 - DNA, 605 bp, Triticum aestivum
  unsure (1)..(605): unsure at all n locations
  Clone ID: PAT_TA_13953
ccacntaaatngaggggtaggtttgtcccttatcggatgctccataaaggccagcctcacctttgttgctatggtgtccatcaggtgttgctactgttctttctagtgttgtaaggcccggacttgcaccaacacctgctctctccaaccccgcctcgtcatcgcctcggtttctttggaagggcctgggctgcgcgggcggtggtctaaccccggccctcgtccctctcgacccttgggtgcagggccacccaggcgtacttggaaccaccgcgtggcccctcgcagccctcgctcgaggtccgtcgcgctcacttgctcgccctcgtgacttccggtgtcgtctccgttcgttgctcgagccaggaatcattgaccatctcgcgctcgactgcgcctggtcttccccctctcgccgttggggccctgttgcagtgtcctgcgctggcgccgctgcgccccccagccccactcgtgggcccgtgtggcggtggggcgctcctgcccctctcgttgccaggaagaacaaggcgatgatgctagcaagttaagtgcagctctagcaccctctgaatgaaagaaccaacagagtgtagatcaccaca

SEQ ID NO: 13954 - DNA, 877 bp, Triticum aestivum
  Clone ID: PAT_TA_13954
catgtaaactataatttcatcaaaaaaaaatacaactgatatccatcacctcaccaaggttcaaatatccatcgctttgcatttcattgcaatcaagcgttgacctaaaccgtttttcgtgtgccaacataaaagcaatcaatacaattggcattgatgcaccattatttaagtttgttcactacaaaaggttctgaattatcacttctcctaggcatacgccccgtcccctcgctccgcggcgcttgctggttacctcccggcctagtcaggccgtttcgcccctccgcatcctcggcaggtccctctcctccttgtgcgtggccctttcttcattagatgaaatcttttcaatgcccaacgacccaaaaggcatttagccactgaacacaacgccgccgccaccgcctagcgttttcggataaagcaaatcatttgctaatgtcagaggctcagagcaccaatgaagtaaattttgtctacgccatgtgaaattatttagaagagaaggctcgggttcttggatctggaccagcaagttcttggcatcagtttcccttggtcgaagtaggtggaaattgaccgcggaaccgccgccgttgccgtcaccggaggggacaggaacttcgaggaggaggggagatctggggaaggaggagcgcgacgaccacggacgttgcggtcgctggtggacggagcatggaggcggagcaccggagggagggggcggtccgtctctccggtcgctgccggggaaactcggaggaggaggactggatcttggccgtcgccggctcgccgcctttcggtcgctgcgctctcggtctcgctcgagccgtggcttctctccccgacccctagaggcgtggaacgtttc

SEQ ID NO: 13955 - DNA, 575 bp, Triticum aestivum
  Clone ID: PAT_TA_13955
tttttttttttaaatcttcagtaaagctcattctcatgctatagcattctctgattttccgcgcttcttttggggagtgcttcgtttcggaagcttcaagctcattacaccaacatatcaccagtacacgcagaggttacagctttaaaaatgaacaaatacgcgccactcgtcccgcggccttcgggtgtatttctcccctcccctgttcccggagcgcccggcgctcctcgtgcggcgcccgggcatatcccgtgacggccggcctgatgtcctgctccagccagtagtacttcatgcccagctgccacccctgcttatgtatcgactccgggtcactcaccgccgggtggtccttgccgtacttctcgtagagcgtgctctcctcggcggtgatgctgtactcgacgtcccgcagcctcatctccttggcctgcacgccgtagaatatcatggccgagtgctccatgtggccccacggcaccacctgcagcatcgccgcgtcggtgcggaggaagaagaagtttgtgagcccggccccgtgcgcgcccatcagcacgtcgcacgagtccacc

SEQ ID NO: 13956 - DNA, 1034 bp, Triticum aestivum
  Clone ID: PAT_TA_13956
gggttacacacatacatacatacatacatacactatttaaacaactgtctcgcaaataaatttacaaaggtatactactaacttttggtgccatcgaaacagggatatactacaaatcatcattggatactagttgtgtttcctacagtcaaattgtaaggctatcaaaggaatccagcttgaaaattcatttgttattaattccgacataatgagtcaatagcagatatgcactatagtaaaagcggtgaacattcatccggaattgagttgaggagatttacaaatttggattccgatgttcatgaaaatagcgatccatagccttatcgacttcctctaagctctgaaacggcccgcctgctttcggatatgtgtggaaagatcccttaagatcaaccctgatgtaatatccgaaaccccagtcctgtcgttctcgttgccaaatgcctggcccagaaggtgaggcaaggcagttccctgatggtggtgaggccataacagtgtcctgatccggctgctgcccagaggaagaagaggaagacgatttctcctccaatgttgtagccttgagcgagtccttgagggaagacacctctgcaggcttctcatcaggaaccttgtcggaaccggacgatttctcctccaatgctgtactagccttgagggatgacacatctgctgcaggttccaccacgaactcgaactggaatatgtcgtcggtcggagagggcggcggatccaggggcctctttaggaggcggcgggcgatgtagatgctggtgtagaatgtacggactgcttgctcaagatcctggagatctcggaacactcgcccaattttggcggagaaatacctcgggtgatagttcccctcctcgtccacacggacgtagaccgtaatcggctccgcgccgccgccgggactgcgccgggggaggcactcccgaggaagaagcgccttggacgccatgagagcggctgccggaggaagacgactagggtttcgattggggataatcccggacgcgtgg

SEQ ID NO: 13957 - DNA, 574 bp, Triticum aestivum
  Clone ID: PAT_TA_13957
aagagtcggcgggtacttcatttatttcctgcgcttcgttctttccactaccagttgtatacttttccatggtttttagagtccttaaacatttttttttgcgaaatgagtccttaaacattatggtgctacggaacattccatgtaggacgagacgggccggaagctgatgtctgtgctccacgcgtagctgaacgtgaccgtgccgtttccatacaccggacgaccgccattgagggtgcagagagaattgtcgccgtccggcgtgatcgtgtcagcagggatgacgtcgattgaggagtcgaaccccgcgcagtccatcttcacgttgagctgcatgcagacacaagtgttcttcaccgtcaccatatgcttcgggtacgtctctccgggctgcgtcggcgccgtggtctgggcgacgacgaggtgtttcactgtgcactgtgcgtctcctccattgctaaagaaaatcaacaagcaggccgcaaggatgactacaagcttggcctccatgctaatcactaagttgtgcgcacagttcctctatattgtattatgtcggacgcgtgggtaa

SEQ ID NO: 13958 - DNA, 1698 bp, Triticum aestivum
  Clone ID: PAT_TA_13958
cagcctcctcgctgtcggtccagccctctcgccgttgcccccgcttccgcagcctccgccccccccaccttagccatcttttctatccgtgtgctcgcatgccgtacctcccctccatcaagagcattgttcttcttcttgttcttcgccttctacctcttcttctccttctccttgtagggggcagcgcctaccaagctcttttccgccggtgaccattccagtagtccatcacatgggtcaagacgagcgccagcatccagagctgccggccatggagaaggagctctctgccgacgcggtagcctgcgaccactgcagcggcccacaggcggtggtgtactgccgggccgacagcgccaggctctgcctgccgtgcgaccgccacgtgcacgccgccaacgcggtctgctcccgccacctgcgcgccccgctctgcgccgcatgccgcgcaaccggggccgtcttccgccacgccggtcccgaattcctctgctccaactgcgacttcgggaggagccgggacgccgagctgccgctgcacgaccgctgcacagtccaggggtacacgggacgaccctcggcgcacgacctcgccgctcttctcggggtccccgacttggacaagccctcggccggcaaagccgacgacggttggtgggccatctgggaggagccccaggtgttcagcctggaggatctcatcgtgcccaccacttcttgccatagcttccagcccctcgtcacgccgtcctcgcccaagatccagaactcacccgaaggaaagacgaacgatgaggtcatacggcagttacgtgagctcgcggaggtggacatgggcggcggtcagataacacctcgtgaggaggcagagcaagctgctcatcagttgccttcctggacagagtcacagcacaccactggaaatggcgatttcggcacagataacagccatgaggttgcaaccatgccaacccctggttatgagaacggcggatggaacaacaacgattgtcatgccctaaaagatgactgcaagaccgagtatgaacaggagcaggctccagcaaactcagctgaagcatgcttgtcatcgtttgttcagatgtcagaactttgccccagcatgagcaatggtagcatgatggacgatggcagcaggcaaatcatggtactggcatgccaatgcaagctttccccaaaagaagtggctttgatgttgttgctggccctgaccgcgacattgtcatttcccgctataaagaaaagaggaggacaagaagattcgacaaacaggtgcgatatgagtcccgcaaagctcgtgcagacagcaggttgaggatcaaggggcgttttgcaaaggcaaatcagagttaagccttgactttgcagtatattttgcatcttggacagaaggaagaacactaattaggagtgagtgcagatgatacataaggcgtgaacattttgtttgccttcagttgggcagatggtagttcatgtacaatctgaataatgtatgttgccaacatatgggctatattaatgttttgaggggagttgttcttagtccaacccttgtatatagcttccatctatgaactctgtaaaagttagtgctacaggcaagtgagagtgacagtatgccattttggcatggtttagtgaattttgtctcaccattgggtttcgttgagt

SEQ ID NO: 13959 - DNA, 604 bp, Triticum aestivum
  Clone ID: PAT_TA_13959
gacatgtagtactttacatgtattaaaatttaaaagggataggagtttctttgcttcacatagcctctgtaaaaacataatgactataaaatacttattggcccatccgtgccaagtacttgtattgcccggatcggagcttcgtcagggccgtccggggttcctcccatattttccgcctgtccccttcctagtgtcttggttcacaaccatgtagtccctaaacccccgtcttccacccaccgagatgcttctcagttccccttcttaccgtttctggccctttgccctgttcatgtgcctcaccactcttccccgactcccccccaagctctgtcctcggtccctcccctgcgcgcctggatcacttactggtgcacgccctggccgctcctttaccggcccttcatgggagcctctgcccggcgcctcgcatatgctctctcctttctgaaaagcatagtagacaccacgaccctttacagctacctgctcatcatgcaaaaatctgaaggaatctccctgactgcataggatttctgaaagcatagtagacaccaagggattcccccttatttcctggaccatggcggacgcgtgggta

SEQ ID NO: 13960 - DNA, 1219 bp, Triticum aestivum
  unsure (1)..(1219): unsure at all n locations
  Clone ID: PAT_TA_13960
gcccggcccgagcagtcgtcgtcttaatcaaccccagccaagcaaagaataggcaggcagcaagagagagagagattcagatccatcctcgcctccctcggtccgtccccggtttgttctcccaccagccccagatccatccggcgatctctgtcgccgccatcgccaggatagaccccagaaaacccagcccagtggaaggggtgtgcgagtaggagaaggccagcagataggatgttcctgtgggactggttctacggggtgctggcctccctcggcctgtggcagaaggaggccaagatcctcttcctcggcctcgacaacgccggcaagaccactctcctccacatgctcaaggacgagcggctggtgcagcaccagccgacgcagcaccccacgtccgaggagctcagcatcggcaagatcaagttcaaagccttcgacctcggcggtcaccagatcgctcgacgggtctggaaggactactacgcaaaggttgatgctgtagtatacttggtagatgcatatgacaaggagcggtttactgaatcaaaaaaggagcttgatgctctcctttctgatgattccttggcaaatgtcccatttctcatccttggcaataagattgacattccatatgcagcatctgaagaagagctgcggtatcacctaggccttagcaacttcacaactgggaagggcaaggtgaatcttgttgactccaatgtacggcctcttgaggtgttcatgtgcagcgttgtccgcaagatgggctatggcgatgggtttaagtgggtctcccagtacatcaagtagggctcacagacgtcaaattttcttgtcatcggttggttgtttgtcacgacagcaaatgatatcatgatggtatcagagaaacaatcttaacattgggcgccgtgctgaatcttcaaaccatttgttatttcgagctgctaagattattttgcttttccataggactttaccaaggactttgattatgaattataaggttatttcttaaatgatgtttatggcttgtttgctttcaaaaaaaaaaaactcgagacgggcttttttggggaaaaaaaaaaaaaagagggaaaaanaaaaaanaaaaaanaaaanaanaaaaaaaaaaannaaaaaaaaaaggggggggggggggggcgcccctctcttttatagagggggggcccccccccgctttttttttttt

SEQ ID NO: 13961 - DNA, 922 bp, Triticum aestivum
  Clone ID: PAT_TA_13961
acggccctcctacccttccgccggcgccgcccacgcgtccgcccacttcttgcggcgcctcgccggcgtcccgtggcgccagatcgccggggaggccgtctccggcgtctcgctagtggcgcagggcctctgcgccgtccacgtcttcagcgagcacgtcctcggcgtcgccttcccgcggggctccagcatgctgccggcgctgaacatggcgggggacgtgctgctgaccgacaaggtgagcccgcgtcgcgggcgggtggggccgggggacgtggtgctcctcctctcgccggaggacccgcgcaaggtcgtcgccaagcgcgtggtcgggatggagggcgacgaggtcacctaccccgtcgacgccggcaacagcgacgccaccaagaccgtcgtggtaccgcaaggtcatatttgggtgcagggcgacaatatctattcgtctaatgactcgaggcagttcggacccgtgccttacggcctcgtaaaagggaagatgtcctaccggatttggccaccgtcaaggattggttcgattgacccaaaggagtaggacacagaggataagcgactgttcatacgatgcagccaggccctgcatttgttggtgcatcttgatgtctaccatttgatgcttcacaattttggtccttgccccccggaagccaaccccgttcagcgaatctatggcatgattcagttgctgcgtctcatgtgccgtaacttatggtctgtgatgcttgtaaagtgaactaacccgacgaaactacaagttccgggcatggctgagatcagctatcgtcttgacgttgagattgtattgaacttttttctagtcctggaccaaagcttgatgagttgcgcattgtatcatttgcttattattaaggccgttttaagcggaaggaaaaaaaaaaaa

SEQ ID NO: 13962 - DNA, 675 bp, Triticum aestivum
  Clone ID: PAT_TA_13962
atttcaaacgtcaataataataatacaaaaaaatacattcatgtcagcaaatgttcttccgacattagtgcgtgtcctggaaccatcatcaacgagtgcccataatgtaactttgaacagcagccctgaaatcacttaagtgtattcttagtacgtcctacaacctttcatcctgacagttacgctagtgtcatgcctacaagcacactccaattcgttgattaatgttcttgcttatcttctctttcttcatcacacaattaggcactctctactgcagagacaagtcagaaatccatatcacttttgaacacctctacgtcatctgatacatttaatatcaggcttaaagtgcgactcggacctttgcgacctttccgcatgtgcaatataccaactggtatgtccatgcaggaaccgatggctcctccttgttcaagataagtcccgcatattctcataattaagttctccaactccactgtggtagcaatgcactctccgttcatggagtaaatgatatcaccaggtctaactcctagttcctcagcaattgatccatgtgacacctcaataactattagacccgaatcgacattacacttacggaagatcttctccgcacgaattggatctagatatttaatggctgaaagcttcatcccggacgcgtgg

SEQ ID NO: 13963 - DNA, 1322 bp, Triticum aestivum
  Clone ID: PAT_TA_13963
cttcgtcgcctctctcgtctccgcgcagcttccactcgattaccacttgcaagtgcaaacatagcgcacgctagctaggtacgagcggtaaggcatggccagccacttcgtcctcagcaccggcgccaagatcccgtcggtcgggctcggcacctggcagtccgagcccggcgtcgtcggcgacgccgtctacgccgccgtcaaggctgggtatcggcacatcgactgtgctcaagtctacggcaacgagaaagagatcggattcgccctcaagaaggtgttcgacgagggcataaccagccggcaagatctgttcatcacctccaagctatggtgcactaaccacgcgccggaggacgtcccggtggcgctggatggcacgctccaggacctgcagacggactacgtggatctctacctcgtacactggccgatccggatgaagaagggcgccggcttcagcccggagaacgtcatcccggccgacataccggcgacgtgggcggcgatggagggcctctacgactccggcaaggcccgcgccatcggcgtcagcaacttctcgtgcaagaagctggaggagctgctcgccgtcgcgcgcgtgccgccggcggccaaccaggtggagtgccaccccgtctggcagcaggccaagctccgggacctctgcgcgtccaaagggatacacttctccgcctactcgccgctgggatcgccggggacgttcaaatcatacagcgtgctggagcacccggtggtggtgtcgacggcggagaagctggggaagacgccggcgcaggtggcgctgcggtgggggatccaggcggggcacagcgtgctccccaagagcacccacgaggagaggatcagggccaacttcgacgtcttcgactggtccattccgagcgacctgttcgccggcttctctgaaatcgaacaaacgaggctgatccgcgggaaattctggactcacccggaaggcgtgttcaagtccgaagaagagatctgggatggtgaaatatagtctgagcagttcggaggagggcagctgcttactttcggaggctgccaaggctgccatggcaacggaataacgtggtagtgataatcagcagtcgaatgagctcgagcttggctgctgttggtatgtatttgcatgagtgatttgagtccagaatcgtccctggaagttgtaaaatataaatagttttgtcctgctctgtcatttttgtgttttgatgcattagtcaatccaaagtcattgtgaaaaaaaggcagatagaacagttcattgcagtgtcaccaaaaaaaaaaaaaaaaaa

SEQ ID NO: 13964 - DNA, 679 bp, Triticum aestivum
  Clone ID: PAT_TA_13964
gaccccttaacctgggccccttcaaggaatcctttaaaccggccgccccgatctagaacccagttcctcatctactgctactgcttcccacctcctccctttggccgtttcctcatcccatcgtcccttgtatccctcaaattgtatcctaatattggtactgatccggttgttcatcacctccctatgtttgggtcgtgacaatttggtaatcagagcctcaaattttcctcaaaaatttgcttccgctttgtgttcctcaactccctcagcccgattcgtaacatccactgccctgggtgtgatttgcttctgtgaatcacacaaaatccctgggttaggttggatcggcttggagtggagcaacagcgacattcaaaccctcagcgcttagacaagaaaacaatcaccacccacttcctgcctaccaagtgtttgatgaaatgtcgagcaagcaagaggtgttcactgacggcattctccgcgtcactgtgcaccatgtgtactacccgatcagtgaggagaggttgcagcaggtgtttacagagtatggcttggtgaagatctccatgttccagagaatccaccatgtggaggcggtggttcaacttcggtcaagaagcggggcagtgcgagctctcgccatgcatggccggtgcatctacgagcgtgcatgcct

SEQ ID NO: 13965 - DNA, 330 bp, Triticum aestivum
  Clone ID: PAT_TA_13965
cgttcggtggtaggccgccctgacccgtgtcgttgaggcggaatacatcgcacacgtctcaaaaatcctaagttcggcggcggcggcggcggacggcgagccagatctcagcacgcggcggcgagcggcaatgggggagaagacgaggtgaggactcctcgtgagatgtaggcggaaggggattcctgggtcaccgattctcgtggccggaagaatccgagggatcatgttctgctcactgaactgatgaaggaggagaagtacctcacggaggaggggagagaactggtgaaggaaaagaagcagatggagccgacggacatgcccgag

SEQ ID NO: 13966 - DNA, 632 bp, Triticum aestivum
  Clone ID: PAT_TA_13966
cgtccgggagaggagaggggacgacgggacgggagcggcggagctgagcggcgcggcgcggcggcttctggcgctgcttccttgcctcccaaatccccctcgcgaggatccatcaccttcttcgtcttcttcgacattgcagcgtaattggatcttgagcaagaggcgccgaggtttcgctgcttcctcccgtcgccggcttgtgggctacgcacctaccccctggtgccggtgctgctgcttcctccggggttgcaccctctcgtgctccgccgcacttgacctgttcgacgaaatgccgggctactgacgctcctgctttatccggccttgtcatcctctaacttgtcttgttgctaaactcagcttacttcgatgaaatgctcgtgagctacgtcctcaccttcccttttgcaagactgtgaccgcatactcaattgtgctctgttcgctccgtgctgactcaacttgactgctcgcgtggctacgctgctcctcataactctaagatcggtgtccagtggttcttcctctttcacgagaccgggactgcctacacaattgtgctctgttcgccctgtgctgcctccacttgattgcttctttcgctacgctgctcttgctaaccctaa

SEQ ID NO: 13967 - DNA, 621 bp, Triticum aestivum
  Clone ID: PAT_TA_13967
acatatagaataggggaaaaaatatttgattcagaattaacttggttcagaattacaagatcttacacaaagtaaatatcattctttgtgttttcacccgacgtccttccgttttgcaagtccggtggcagtggtgtacagatccaaggcggccgtgctgaccgttcctcccgccgttcgtacatacaaaacgtttgtgcctggcaactgtccccgctaggacgccttatagtgcggcccagcggcgtgttgttccccccccctgcatccccgctcctcctgtcactccttggcaaccaagatcttccagatataagcacgcacactttaaaccagatccgcacaccaaatgaaacaaccatttctccctttttcattcttccagaagtccagcaatggaattatgatataaactgctctgttacctttagatgtagggtcctccttgatttaccacagaggatcgtctcgactaccaagtgtggttccagctccttcctttaccgtcggctgactcgctttcggctcatctctactgaaaataccatgcaggtatgcaccaggtcataagccaatcttcctactgtaaacaaacgactcctcctccctgggcctcctgct

SEQ ID NO: 13968 - DNA, 507 bp, Triticum aestivum
  Clone ID: PAT_TA_13968
gatatgtccacaccttttattcctttctagaaacaagcatttggtcaacttataaaaaaataaacaagtagcggtgaccactgaccaccgcaccggagaccatcttagctcacctcaggttacaatactggtcagtccatttgaccaactagtgactacgctgagtcgctggcgcagcgaacaaaagtaggctgtgaatcttgaattgcggcagcaaatcaccacatgccaacgataaatctcgtgcaaatccacacaaaaaaaagttgataaatccgtgggcaaaaaagtacttttccattgcaaactttcccggtcccttcctctgcttcggagcacccaatcagcccaagaacagtcaaaacaccccgtcttgggctctgggcgaccggcgaaatgcgtatatacagtgctcctccagccccggggacagggaaccacacggcacagtgcaggctgggttcgtcgagcacaccagcaacgccccacgcgtccgcggacgcgtgg

SEQ ID NO: 13969 - DNA, 627 bp, Triticum aestivum
  unsure (1)..(627): unsure at all n locations
  Clone ID: PAT_TA_13969
ggttttcggttgattcataaaaacctcttgtactacaagacaactcaccgaaattacagaagcaacacacctcccccaccctcccgctcccctcacacccacccctcccgctctcttgccggactctcgcccgtgcagcgctgtttctgaacccgcgcaccgcagggcagatgcccaaacggggcacccacccgcgcaagcccatcctatgcacccacccccgctcacccaccggacataccacccgcggtcgcgctccgtccgctggggcgcggcgctggtggaccggggtcgactgggcgcacggccgtccccggccgccaccgccgccgccttcgccggggctgggggtgggacgggttggtatcccgggtggggccgccggttccngtccgggctttggcacgggcccttatccaaagtggggctgaggctnggntcccggttntggccgcacggttcttgtggtggaangcccaggatgtcttctggattggccgcacaggtcatggaccccatccggcnatccccgacggctggcgtgttntccccgngacatcttagtggtcctcggaacggatatttggcggtctgncggggaagnccttgngancctntgactccaaa

SEQ ID NO: 13970 - DNA, 586 bp, Triticum aestivum
  Clone ID: PAT_TA_13970
gattcgtgcgttttacctgttgcccacaacacagtttccaaacagcttgaaactggagctctaattcatgaatctaaaaaatacgctgaggaagcaagggagcagtacaatgcacggaagcgtgcagcttatcggaagaaaaaaaatgaggatattatcagtttacaagaggagaatcggcctgtacttgcaaaatctggtgagttcattaacgtgaggttgctggatgctcttagtttgatatgcagacatatagtatgcacatgattcgttctattaacctatatacctgatttgagataatatgatgctcatactatgttgctcattagatcatggggaacttatcaacgctcgtaggcgggcggcttatcgaaataacaagacaaatggtttggattaccaacaagtcagtgggcagtcagcccgtcgctgatctctatgtgatatcacaaatgttctcgaagatagggagataaataaagccacgccagattatcatggttggtaaattgatccacgtcccgtatgtgatgtgtttgcaggaaggtagttactttttacacaatttgtagaattactgacc

SEQ ID NO: 13971 - DNA, 1063 bp, Triticum aestivum
  Clone ID: PAT_TA_13971
ccgactcccacgccacccactacgggttgtccgccttagggtgtactcccgctgcccttagccttggactcactctgcggcgcttcttcgcccggcccttcgtggtcggctccgcgttctgggctgggtaccaggccccgtgcggcctggaccgtgtccagttcgacggcgggaccctgccgcggctcgcctgcctccctgctcgcgggtcctctcccttcctgttgttcgttgtccagggctccccgggtcagagcgcgctcatcctgtctgggtggctggccgccctatgaggcgcctcgctcgccactatacagcatacttgtcaatcacctacaaagcttctaaaacagacccgcctgccggtaaggctccaccaacgtgttttccaagtgacccttctggattgcaacgtgggctactgtacttgaaagaagcctacgggaacattcccatttatatccaagagaatggtcaatcctctagtaatgacactctcggacaccgagaggaccgggtacttgaagggctatatagggagcacattggctgcattaaggaatggagtcaacgtgaaaggctactttgtctgggctttcctggacgtcttcgagtacctgtcagggtatcaggcacggtacggcctgtaccgtgtcgattttgacgacgaggcgcggccacggcaagccaggctctctgctcgctggtactctgccttcctgaagaacaataacgatgacatccatgttcagagtgagctcaacagtacaggatggcatgctgaacaatgagtcgcatcgtcggacacgtaaatacataggcataccacatacacatagatacggacaatgttgttctctttccttcatagggagagtcagcagtggatgcatcataatactacatctctagtgtctttcgacgtcaagtaaaaccataaggacggacccatctctaccgtttccttgctgaaaattttcaggggatgtttgattggtatatcaacattgccagcacaacagctgctgctatggttttttttaactttttgacatactaaaaa

SEQ ID NO: 13972 - DNA, 1108 bp, Triticum aestivum
  Clone ID: PAT_TA_13972
aatgaatatattgataccacgaatgtaccaattatacccagcctctacaccaacaaaatgtcttgaagacatccaggatgcacacagctcgaaaaaaacaaacaaagaccacaccacattgatcaactcctctcagcagcagcacacaaaccatcaccggagtcaacacccagaaaacataaaaggtcttcaaaagcgacaccttcaagaaaaaaaatagtgcacaagcgccttcatgtagtgtacggcccgtcgcgcatctccgcgcgccacccggaggccccagccaggccgcgccgctgtcctccgcaaccccggcctcctcctcgacctcgcctctccgaacaaagaaattaatcccgcaagtgagggagcaaaggaataaataaactctgcaacaataggactgtaggagcttacaatcagcagcatcggattcaacatcttcggtgaagaaagcagagatgcagatgggataataaagaacgaacgcaaagaagagtcccggtcgccgtcacctagcccaagcggcctcgccgcaccgacacttccaccggcaagggccggcttgcccgcgcgcagttcggcccacgcgagcgaggcgagaaggacggcgcgcccactcgagtgaggcgagaaggacggcccaggacggtcgacggcggcacgctgacatcattgtcctcacgcatggcgaggcatgggttgcagggaaggacgagcgccagcggccggcgaactaggaggaggcggctgcgcgacatgcccgggtggtggcagcagcggcgaggctccctgcatggtcaatgaaaaaagaaagaattgagatgcagggaaggctgagggtgttgcgaggaggcgctagagctccggtcaggcgatgtgcgcgagggcgcggcatgtcgatttggccagatcagaagcacggggccggtgactggggcggacgaccagattaggccgacggcagaggagctccaaggtgcgagccatggcgtcctctaggttcctcgccgtgtgctgctctggctctggccagccatcacggccccgcgcacgtgtggctgttctggctgggttggacggagaagaggaaccggacgcgtgg

SEQ ID NO: 13973 - DNA, 989 bp, Triticum aestivum
  Clone ID: PAT_TA_13973
ggttcacgccaatttttttttatgaaacgcaaacaatgacactacaaaagcaaagggttcagtgtttttgcaaccaatttttttcaaggagcaaaagggctctttcctttacagactagtttgatcccaaaatttgacaagttgcgggttccagctccgccaacaaaatcacctcaggtgtttctgtacccttttttttgctgaaagggctgttttgttctgcggctccaaagctaaagcatgcctgaaatcttgcaaagcttcttggtaattcaaaacacttttttttgcggtacctcgtcgtaggtatgctttaacattctttttatccaacagtaaggcctggtcgcaatccgcttcagcttgcttgaaacgtccaagttccagataagcagctgctctattgcaatagtatgtcgcatttgtgtcgttcaatttgattgccccggaataggattcaatagctttgctccattgttttctttggaaggaattatttcccttttctttcaacaactctgatgtatcaacatcacgatcaattactggtggaagtgccaacttggatgccaaaactatttgttcttggacggctgaatacatatccaagatagcacgaagaaggaacttgtctgatccatgagctgctacaaatgaaatagatataggatgatcattgtgatttcccaagggaacagtggcctggcaacagcctgaaagtgcagcaatgctgacaaatgcgtacattttatcttcaaattcggatgacaatctctgtttagagttccttttcaaagggtgtccagccatggttggcagaactaaaattccagtatcctttagaagattcttcagtgcagctcgccattcagttcgtacaatgtacaaggatttgatgttgtcgtctgtgaagtttacagcttgtagtacacgagtagatacttcaaggccaagcttgggttttacagtgttaacccacggacgcgtgg

SEQ ID NO: 13974 - DNA, 804 bp, Triticum aestivum
  unsure (1)..(804): unsure at all n locations
  Clone ID: PAT_TA_13974
tcctgcggccgcccgggcaggtactaaaggtcccattttcaaactctaccccccccccccccgggatcgccttttcagttttaaaaaaaataaaagaaaataatggaaatgtcaaaaaaataaaagaaaataagtttctcatgtgatatgtggtctagttgttgggaaaatttgcaaatgtgaattttgactttatttgcaaaatctctctgaaatttgtaaaaatgggcataacttttgcatactaactcggatgaaaaagttttttatatgaaaaatcatctactcgaaaagttacatccaaatttaacagggggaaccccgttaaacatttagtaacactaatattctagaataatccaaccgcgactaaaggtgcccaaaggcctttagtcgcgggtggccaggccaaccgcgactaaagctcctcccttttagtcgcggtttgtggcacgaaccggaactaatggggttgagacctttagtcccggttcgtgccacgaaccggtacctcagcggccgtcagctctttgccagtgtgcgccagaggcatcttggcctgctgggcttggagacggggcagacgtctgccgctcgcgctctctcgtctggagggccgggtgccccgggcttcgcccttggggaagnttgaccttagnntctantcttgntttgngctgagngctnattattacgngtgaggnatcaggggncttacaaattgggggncctcaggtntaaggcncaattgttttnagggcaaacctggaaggaagtannaccagcctgcnttnnttgaaaatt

SEQ ID NO: 13975 - DNA, 623 bp, Triticum aestivum
  Clone ID: PAT_TA_13975
aattaactagggatccatttctgtttaattgttcgtctaaacagtactatgtacacttgcagcttgcacaaacactctaatcaaagttgcaacatcaatcaacaaaagaaggagctgctcatctagtatctcctaattaagccaaaccgatcaaaaaagagaatggcgcgcactccatcatcacaagacggcgtcaatcccggtgtccgggcgaaggaggtcgtacttggcccagacggcgtcgagcgggcagggccggccggcgtcgagccggtcccacggcttgcccttgccgctccagtgcagcagggagacggggccggcgtgcaggccgcggcagaggccttggtagttgtcgccgccgaggccgtgctggttccagcggtggtcgacggcggcgatgcggccggcgaacacgaggaggaagggcggcagggagccgagctcgtagatgcgcacccgccgctgcagctccatccacccctcgatctgcgccgtgtacccggccgcccgccaccggggcaggtcgagcaccatgacgcccgtgttgaagtagcacgcgcggcgcccgcggaaggtccgggcgagcgccgggctcgcccagaaccccggcggacgcgtgg

SEQ ID NO: 13976 - DNA, 388 bp, Triticum aestivum
  Clone ID: PAT_TA_13976
cgtccgcccacgcgtccgcagagagaaaactccctttcccacaagcgccgatccggtgaccgagacgcgcgccttggcttcttcctcttcgtccatggcgggccctgcgacgacgtctccgccctgctgattcgatcgcgcacgctcgcccgtgacatctgcagcaactcacgcgagatacaggcggtggaagcagcgcagcacgcacgcttcaatggcttggtctaggatcgcgaggagctcgcagctgtcgcagtcgctctcgaggatcgcgtccgagggcggcgcgcccaccccggcggcgtccgcgctgcgcaatgcggcggcgctggggccacggagccgccacgccgtggttgtctatcacaccgcctcgtgcgtcggtctc

SEQ ID NO: 13977 - DNA, 456 bp, Triticum aestivum
  Clone ID: PAT_TA_13977
ttttttttttttgttgaacattgtccctttccgtctggctcggcgttggggcctgtcatgtacgcggacattccagcccggtgggttccggaaaatatgttaaaaatagagacatttaatctagtatttggacaaaccgcagtggatcacatgaatttcacacagggggggaaaggaatttacggaaagagtagctcgcagtgcaattctgttgccttaaaaaacaggaaaatgcactatcatcgaaaaataatctagagacacgtgtggaactctatccgttggtgatagcgatttgaagcaggctggcgcaaagtagtggttttgcgtgcgtgtatatcccatgtctctttggcatactggatggttgcctgaagtaacttacataattacacagttgcacttggattccaactttggaggcttcatattatcagatgcccttgtgattcctga

SEQ ID NO: 13978 - DNA, 1072 bp, Triticum aestivum
  unsure (1)..(1072): unsure at all n locations
  Clone ID: PAT_TA_13978
ggcacgagctcgaaccctagcggccaccggcgacgacgccgtcgcctgaccgccccgcgaccgaccacgacctgccgagctcctccgcgacaccctcgaccccggcctaccgacggctgctccttctcttcctcaaggacacaaactcaaagatgggaaagggtgacagggagaaggaagcgaagcgccgacgacgcggccgcagcagcaagagatcgcgcaatgccacaccctcttcggactctgattcttccccttcgccggactcctctcctagccgcagccctgggccccggagtcgcagtaacagcaaacctgaaaagtcgtcctcttctcgtcgccgccgccatcaccataagaacagcggccgctcacgcagttcccgggacgatgatagacatcgtcaccggcggaggcgccgggatgagcgtgcccgtcacagcagcgatggcagcgacctgtcgggatcaggctcagatgattcaggatggatggaggaggcgcaggaaatcgtccgtggcattctcagtgaattccctgccatcaccagcgagcttcgtcagcttctccaaatgatagatagtggtgaaggcattgatatttccggaatttctgacaagccattggtgaagccggtttgaagaaactttttcagatcccttgaaatttgaaagaaaggggcaaatggagcttactttgctttcagccaaaanggtgttcctacccttgatgttggttggacccagtatttggagcgcctgcctgccctggacatgggccaaatggatccccggctcgaaataggctgcgcgccccgttgccgaccttccacgggctaccgggtggggccttcccccctggacagggacgaaaagttgaccggggagcggtccccccctggaagaggggaaggggtcctgctttgcccccgcgtgaattgcgaccccccgcttaaaggaagggntaaatnggtccttgcnaaggcattacgngaaattcttagttgcagnaancccnaatggncaaaggnttttaggncccgganccttnattngaacctgatgaangattt

SEQ ID NO: 13979 - DNA, 513 bp, Triticum aestivum
  Clone ID: PAT_TA_13979
ggatggaacagctgtgtggattattcatgacatggaatcttactactagtgtttgctagcttaaccaattggccatcagctgtgaccacacaattaattaatcgatcagtagacacaccgattatcacctcttgctagaaaccacaacacacagacctaataaccaaacacgaaaaggaaaccacaagaaatgaggaaaaacaaacacgcactcatcaatccactcctagctgatcgatcgatctcttcttcttgctcgctacgtactagctgtctagctataggcgacgacgacgttcgacatcctctcatgtcgatccatccatcaatctccacttgccatggctcagtgactcacagagcttagctcgactagatggagcaggtgtagccggtgggaggggtcttgccgcaggtgaggaggagctggagggcgagggggaggacgaggttgatgttgaggagcttcagccggatggtggtgcacaggcacaccgccgcctccagctccac

SEQ ID NO: 13980 - DNA, 666 bp, Triticum aestivum
  Clone ID: PAT_TA_13980
aaagtaaagccatcatgttaaactaggcattttactaccccaattacatataaagtttattagaaaccgagctacgggttatttagttaggaaataaaacattttaacaagttatttaagaaaatttaaacaaacaacatattaaacattttgaacaaggatgaaaatgacatattatgaaactacacaaaattctaagcaactttcacatataaatcattttaaaccggtgcatagatgatgagttattatatgcatgaaacaggagggtttttctataaaaactgctgcctctggaaaatagacaaatctccagacaataaaaacattacggggccaaaactggggcggactaggcctcaccatgggccaagcccagttagtggaggagcttgtaggccgcgagctgggccgaggcgaggccggcccaggcgcgtgcggtcaatctggaatcggtcagcgcgagcggccgaggcactctactcgtttctgaagcagaacgacagcggcaggttcaagctgacgccgggatcggtactccggcgagcgggatgaaggggcggcgaggcgagggacttggcgcgggctcccggcgactccaggcgacgaagggcgatgaggaggagggcgcgagccacgggccttggcgcggcgcggacgcgtggt

SEQ ID NO: 13981 - DNA, 701 bp, Triticum aestivum
  Clone ID: PAT_TA_13981
cagacaggtttggtggtgttatgaagtttggcttgatgtcctcgttcagtgcttcagcagagggaattcgaataccaaagaagccaatatagagtatagatgaagcttgtacagttgcgtgcgtcggcgccttcaattccttggcactcatgctattgtgcctcaccatattttgattatattgcacaacactagacacctccatggcgtttctctctttcctagtagctacaacaccattggccacatcatcgggtaggggtgcatggtgaccaacggccatagatgtgcagaggactgtccggtgagacgcacgggtgctgccaggaagggagccacagcgtctgctgccgtggaggtcggccgcgccaggcggtagcgcgaagggtcgccggtgacgcgggggaggcggcggggatcgggatgtttcggcggcggcgcgtggtggtaaggcagcagcggaatgacgtgggaggatgcttgcgcgcgggatccatggcgcccatgagctgcgaatggatgcgtgcgtgcggtatccacggtggccggatccagcctgctgctggttggtgcgccgcatcactcgtcgccctgcagtgcacagagaaagtttcagacccgcgcgctagtgtttgaagtgccagaaattcagaacaaatcttcaagttcacttcaacaactgaacacttgaacatcaaaca

SEQ ID NO: 13982 - DNA, 840 bp, Triticum aestivum
  unsure (1)..(840): unsure at all n locations
  Clone ID: PAT_TA_13982
agaaattacatatgaatttgctgaaagatcatcagcattgtttgtttggcaagcattcacaacaaaacagtgatgcatcaatcaaaccacaatcatattcctttttgcgcaactttgattcttgccggagccccatgcttccttgcgttgtatatggggccgttacccgccgttccacggactgaccgccccggtacagcgcgggccatcaccgtaggaagggttttctcctgggagaaagtatcagaccgtatagtctccttgccaaaagcatggcacgcatgatgcctactggcctaatgaatttcgtgtgccgctgcggtggcggtgacatagtaggcgactgtgatccccgcatggacgaagcacatgatccctcccaggcccagggtcttgccgtgcacgaacccgcatgatgtcttcgacttggaattggacatggccccagcaagcagcaacgagaagccgacgatgagagcgatccatgagagaattataagagttgctgcaagtttcctgttgatggatgcccggataaactccagctgagagcagatgcaggcacagccgccgagaaagttggccactgcatgagcaactaccaggaacactgctgccgcgagccctagctggtatgctttatacaccggtttctcacattggatgaagagcactgtcacctttttagtcttgttttgtgcagcctgtgcctgaagtcctagtatgccagcagtgatatccagggntaaaaccaacacgcagacaatgacagcggctatcattttgnccatcttgtatagctgtattctcaaattctatcagctcagaagtgggngagct

SEQ ID NO: 13983 - DNA, 1190 bp, Triticum aestivum
  Clone ID: PAT_TA_13983
gccggccgggccggctcggtgtctcctctccctgcctccctagtccaccccgcacctcgttcactccgccgccgtctccctccattcctccgccaccgccagcccacctgcattccaccaatacccacccccgccctctataaataaacacgcgcacgcatacacgccactatcaccgccgccgcctccccagcccccagatctcgacccgacctcccatctgcaatggcggccgcatcgtcgctccacgtcgccgccccggccgccaccccgcgggtgggatctgccggccccaaatccgcgtcagcggcgaggagcgtgcgcgtggccagatcgggcgcggcggcgcgtcatggaggcaggctggtggcgtgtgccgccgttgcaaccaaggctgatgcgccggcgagcgaggcggcatccaagtctgaaggtcatgaggtcttgctgttcgaggctcttcgcgagggtttgatggaagagatgcaagcggatccaacagtgtgtgtctttggtgaagatgttggtcactatggtggttcttacaaggtgaccaagggtttggctgacatgtttggagaccttcgggttcttgatacaccgattgcggagaactcattcaccggcatgggagttggagcaggcatgaaggggctgaggcctgttgttgaaggcatgaacatgggcttccttctccttgcttacaaccaaatctcaaacaactgcggcatgcttcattacacctctggtgggcagttcaaaatcccacttgtgatccgaggccctggcggtgttggtcgtcagcttggtgcggagcactcgcagcgccttgagtcctacttccagtctatcccgggcattcaaatggtcgcttgctctaccccttacaatgcgaagggccttctgaaggctgccataaggagcgataaccctgtggtgctgttcgagcatgtccttctgtacaacctgaaggagaagatccccgacgaggaatacatctgctccctggaggaggccgagatggtgcgtccaggctcgcagctgaccatcctgacatactcccgcatgaggtaccacgtgatgcaggccgtcaagacgttggtgaacaaggggtacgacccggaggtgatcgacatcaggtcgctgaagccgttcgacctgcacaccatagggaactccatcaagaagac

SEQ ID NO: 13984 - DNA, 1710 bp, Triticum aestivum
  Clone ID: PAT_TA_13984
gccgcgcctccctccctcccctgccgcgccctccctccgtgtacgttcgccgcgccccctccaccccgagcgcgaccgcgaccccgacggccgtcgccccgtcgccgcacgccccggcgcccgccgccgccctcccccggcacccacccgcggccgccccaccacgccccgagcatcgcgcggggcggccccgccgcgggttcagcgggcaggctcgcctgcggccccgcggctgggtcgtggcgcccgccgtccgccgtcaccgagagcgtcggggacgagctggctgctcgcccggtgtggcggtcctcgcaggacgtgccgtccctgtacgccgcggccctagcggacgctgcagttgcgctgcgagcgcggagcgcggccgcggtggaggaggtttggcagtagtagcgctgtcgtgagttacaggtttcgaggattcagaggcagagtgggtgtacagtttgctttgtcgtgtaattagtgtgtttcgcgatcgtgtggacgttgtatcattctgggaacgacttaagtgtacccttagctgttgtttcttgactccatctgctcattctatgtatgctggagacctccttgttcttgatccccctactgagagctcttttgccggtgtgggcggctgttgttgaaggcatgaacatgggcttccttctccttgcctacaaccaaatctcaaacaactgcggtatgcttcattacacctcgggcggccagttcaaaatcccaattgtgatccgaggtcctggcggtgttggtcgtcagcttggtgcggagcattcgcagcgtcttgagtcatacttccagtctatccctggtctccagatggttgcttgctccactccttacaatgccaagggtctaatgaaggctgccataaggagcgagaaccctgtcgtgctatttgagcacgtccttctgtacaacctgaaggagaaaattccggatgaggagtacactctatgcctggaggaggctgagatggtacggcctggtgagcatgtgaccatcctcacatactcgcgtatgaggtaccatgtgatgcaggctgcaaagacgctggtgaacaaagggtacgatcctgaggtgattgacataaggtcgttgaagccattcgatctgcacacaataggcaactccatcaagaagacccaccgcgtgctgattgtggaggagtgcatgcgcactggcgggatcggcgccagtctgagatcggccatcatcgacaacttctgggactaccttgacgcccccatcatgtgcctgtcgtctcaggacgtgccaacaccctacgccgcaactttggaggatgcgaccgtcgtgcagcctgcccagattgttgccgccgtcgagcaaatatgccaatagggcatcatctgtttcagcatcgttaatttgtatctgccctggcttggaagaacctttaatttgtcatttttgccttgtagcgaggtgttcattgtggtataggcttgtatccattttttattcctgcttgagttaacacttgagctacataactgtactgtattatgctgaatgctactagggtctgaactcgggtttattggaagaaatctttgaatatccagggcaaggtaaaaaatataaagtattatgctgaatgcctcgaggctccgaactccggttcgttggccgacttgtcctgcttgataaaaaaaaaaaaaaaaa

SEQ ID NO: 13985 - DNA, 703 bp, Triticum aestivum
  Clone ID: PAT_TA_13985
aatttatgtacatgtttgctagtgcaataatagaatatttattaatgcaccacagtattatctatcttgaattattgatagccttttggcttgtactagtacaagattgtttcatgcttcttttttgaagcctaagattgtttcatgtcgccgcgcgcgcttacacgaccgatttaagttaaatttaattacagcttagaactgaggaagcatctgatgaccgaggccgcccagcaccgacgccgccccctgccagccgttcgccgactgcggcggcgcgtcgaagcacgacccgttaagcctcttggccgatgactcttccgggctcgcggccttgcgtttccccgcgctcccgccgctggcgtccggcgatgacgacgacggcgcgtagtacgacggctgtactccgtgcgcgttgtcgccgacggggaggagcatgttcagggaagggtggacggcgaggtggtgggtggcgccgtgctcggcctcggcgtcgaggatctgcgcgagcgagtagtcgtcgaagagctcggagaaggacgggatcgtggggagccccccggcgtgcggcggctgctgcgtgatcatggttccgctggcgctgctgctgctgctggagtgcgcgtagaagctgcaggcggcgtcgtcgaaggtgctgccgccgccggagaggtcgtcgtggtcggccatgtggtcgtagtcg

SEQ ID NO: 13986 - DNA, 716 bp, Triticum aestivum
  Clone ID: PAT_TA_13986
gtttttctggagtgctaaacgggaggagaaatactgaacattgatggtgaccaatatcacagggagaaatactctatattgttctttccgctgggatgtagggcgcgctgctatcgaccttgctctcgccccccaccgcaaggctctgccgctccccatgatgtatgctgtgctgcagcccccgtccaaattccgcatttgcaccttcttcaggcgtatgctcaccatctgttggtcaaggttgttcttgctttctccgcatcctggcccagcttcctcacatcatcctcccgtcgcagcgccgtccctgttctcagcacgtttgctcctcccccggccccgtgccatccgccacacccgatgatcgtgaacaggagtcaatgatgtgtgcgctaccgtcgaggtgagcatccttggtcgcctcaaccacttgagcctcatccgcctgtccggggcctctccatcactgcatgcacgacggctacatgtattgacgtacgtgatgttcgagttcaccaaaaacagcgcgcttagcaagtggctccacagcgatgaggtgctcggatggagcaagcacgtccaggtcgcgctggacatggcagccggactcaactacgtgcagaggtattccaagagcagtaacatcatgctcaacacatgcttcctccctaagctaacaaacttcggccttacactcgcgcggacgcgtgggtcga

SEQ ID NO: 13987 - DNA, 591 bp, Triticum aestivum
  Clone ID: PAT_TA_13987
acaggatacaacacaggatcaatgtatttgtataactagtcttagctctaatccaggtgaagtaacaatcaacctgcaggggttctagtgacgccaataaggtgcacacgcatagaaaaactggtaacttgacaagaaatgaaagcacatgtgtggtatgacaggacctacacagtgaacagctatgtaccaacacagcagagaacaacaacgaacaatgaagacgaaggacaacatctgcaacgtcgcaaatctacatattggatacctgcggcaacatcacatccataacatggcaccgggtacaaggccccccaatatgtaacttgactgaagagggaactttctccacgatgtatctcttgacggcaccgagtgctttatgtgcttccaagataatacgccggcttgtggccatgcatttaccggattctggggcagaacacctaacagactcaccaactgcatccgcaccaaatatgcagtccagtgtgaggctttcaagtgacgttgcattcttgaggatatgacatgttagctcaactatgctctttgcggagcaaaagccatcgatttgcaccttcttgagcc

SEQ ID NO: 13988 - DNA, 616 bp, Triticum aestivum
  Clone ID: PAT_TA_13988
gacctcgagaccctcgccctcgactccgcccactcctcgcccgccgccgccaccgacccgctcctccgcccgccctcctcctcctccaacggcgccgccgccacccgccacgagcccttcgtcatcgacgacttcctcgacgacgacgaagacgaggaggacgacgaccacgcgccccagcctctccccgcctcccgcgcgccggccgccgccgcgaacggcgaggcgggccccgagttctcccggatcaccgtctccgacccgaagaagcacgcggagcccgtctccggggccgccggcgtcatccccggctccgggagctacttctcctacctcgtcaccacgcgcctcgccgacggtgccgccgaggtccgcgtgcgccgccgcttccgcgacgtcgtcgccctcgccgaccgcctcgccgcggcccaccgcggcctcttcgtgcccgcccgccccgacaagagcctcgtcgagggccaggtcatgcagcgccacgacttcgtcagccagcgctgcaccgcgctccagcgctacctccgccggctcgccgcgcaccccgtcgtcggccgcagccctgacctccgcacgttcctcaccgagccgggcgccatcg

SEQ ID NO: 13989 - DNA, 662 bp, Triticum aestivum
  Clone ID: PAT_TA_13989
ggccattacgccggcgccgtcaaaagggaaaccgctacgcaccgtctgtgcgctatccagggcatttcccctcggaaactctatctgaactcctgcaccctcaccatacaatgacgctccttggtccctatctaaactagttcatcaacataaatcatctatcctcattcgtatgcagtatcccatcccgtcatagctcgaaggggacggtacaaatccttagccaattacctcgaagtgatcctgcaccagaggttttcggatgtagccactcctctacctgattcccagcttttagttacgggttgattcgacgttttcaacaccggggataggggcttcggctctttgccctcccagcccgccgtaacagcccgcaggtcggcagctggcctaaccctcctccctccttgaatggattgtacggccgcactagcaccattacgcaagtccgcctggtctggtctgacttcggcctttggccacccctcacgtacggtccctcccggagctccactcctcgtccacacctttggtgttgttttccccctcctgctggcgggaatgaaatgtatatccacattagcacttttccggaagtccttgagttcatgaataacattggcaatttggcatccttcacgaacggaacatcatagaaa

SEQ ID NO: 13990 - DNA, 920 bp, Triticum aestivum
  Clone ID: PAT_TA_13990
tgtggttcggagacgccggcgggagccacgatgggcggccacgatgggcggtcgaggaagcgccgctcttccccctcgtcaggggaggaagaggagagggagcggaagaagaggcgggacaagaaggagagcaggaggagcggccgagacggcaggggcagcgacgaggaggaggagaggcggaggaggaagaagaagcacggcgacaggggcaaagacaaagagagggattcgaaggagaggcgttccaaggagaaggataagagcaagcgaaaagacaaggatgttccatcgctaaaacaggacatcaaagaaatatccaaggacgactactttgcaaagaacaatgagtttgcaacctggttgaaggaagagaagggcaaatatttctccgacctttcttcagagtctgcccgtgatatcttcctcaagtttgtgaagcaatggaacaagggaaagctgccatcgcattactacgagggcatcaccattgggccccgatcagcgcacaactggaacatcaagaaggcatgagaaggctcgtcttgttcgtggctcgcagttcgggtcccttgcggtggttcggtttcttgacgaaactgccataccaaatgcttgtaccacttgttccatcttttagattttcataggtttctgatctaaacctgtcgctgtgtttagcattgatgttagttctgttgctgacgtttaatgaaaaaattctagcaaatttgttgctgtatcctatatgcaaaagagctggtattcatgtgattagccccaccaccaaacacccctggtcctcggccttctgccttgggtcttcggtcttccgtcgatcttcgtgctgcttgctgtgatctgcacactttcaatgttacgaattagtctgccgtatttcggaatcaccactggcagca

SEQ ID NO: 13991 - DNA, 802 bp, Triticum aestivum
  unsure (1)..(802): unsure at all n locations
  Clone ID: PAT_TA_13991
cggacgcgtggccgcgcctccgcctaaccaaacccgccgctctgttgtctctttcgtatatggccggcgcaagatcggcggcaaccaggctcacacactcttcgctattcctactgtctcgcgccgccgcagcggctgcgacccgccgtaccaatctcccctcctccccgagagattattcaaagatggctagttcagttggaggcaatggctacagtgatgttacacgggtgctattctgtggccactattggcctgcttctactatttatacgaaggagtacttgcaaaactatccatttattcaggttgacgaagtaggtcttgagcacgtacccgatgttattcaaaactaccatatatgtgtagtgaaaaataaatgtatagattcagatatcattgccaaagcaactaagatgaagattattatgcagtatggtgttggtttagaaggtgttgacataaatgctgctacagaacagaaaatcaaagttgcacggatacctgggagtactacaggaaatgcaattgcttgcgcagaaatggctatctatctaactctaggtgttctgcggaagcaaaaggaaatggatactgctgtcattcagaaggacttgggccttccagttggagaaacaatattcgggaaaacaatacttatcctggggttcggagccattggcatggaaattgccaagagactaagaccatttggagtgaaaatttttgctacaaaaagaaactggtcatcatacacggtgtcgggtgtgctggctgggctggtaaggnggccaaaaatttt

SEQ ID NO: 13992 - DNA, 1175 bp, Triticum aestivum
  Clone ID: PAT_TA_13992
ggaggagcattcatgtatcgatcatcaggattacaagccattacagagaggcagattacaagaaaaatacagatcttaatccgtatccaccgttaattagctgtcaaaaacaaagctgcagcggacacatcggcagtcatgagcacaaccacatccggaaaagttaaacaaagctcattccttgatgtcagtatctatatactacatatataaaaagatcaagagcgccttaatcagctgccccttttcacttctccagcaggtccgcggaagatatacatagtacgatgcatgtgggaattatactgctattaaccgagaactgtgacggaagggcggttcgggtgcttcagcaaggcctccttgaacgcgtccttgaccgctttggctttgaacgtgtagcaagttaaggtatcattactaatgcagacatcatgcacttggatctcctggaggtgtaacaagtgctccatgccgactggtacagtgccaccccagtgagacgcacggatccagagcgttcgtaaactgggcatagcacctgcctcgaagcccaggtacgctgtagtgtctttactagaccagaatttcagggactccagaactgggaataggcccgtgcctaacatagctctttcatcagggattgcacatgctctgaattcgaggtggacgagggagggaagctctccaagcagatgaatctcctcagttgatgtctcttcaacaaacatcttaaggaagcgcaggcaatgtgcaatccctgatgtctgacaaccccaaactaaaatctattgacatatgcagttccctcagattggtcagcttgctgagacccataaaacacttcagcgagctcttttccatgtccaaccctcgcagagtccgcaatgatttcatattcccaataccttcaggcagctttgtccaatttggaagaagcagataggacaggcggggcaaatgaactatatctgaggggatgctctccatcagtgtgcacttttctatgtccagtgtctccaagtaaacaagctcaccaagtttagtagggagctttatcttcccataagcacttaccgtcacacacctcagctggaacaattggctaacagcggtgaggtcaactatctcctcccacccatagtgccccttcaaaatgatcggacgcgtgg

SEQ ID NO: 13993 - DNA, 1425 bp, Triticum aestivum
  unsure (1)..(1425): unsure at all n locations
  Clone ID: PAT_TA_13993
gaggaattcggcacgagggccgccgccgccccctgctgccntggcgaaatcatcgtcagcgacggcgacggcgtcgggcactaagaagcggaagtctaacgtccgggccctcacccacgaggaggtgaaggcgctcggcctggagctcctctcctcgcgcgcccacctcaaccacgcccccaccctcctcgcgctcctctcccccaccgcgccgctcagcatcgccctcgaggcgctcatctcgctccagtccttcttcgagcccctgcttccctccatcccctccgcctccgccgccgccgccgccgcaggaggtgcgagcggtgaccccgagctcgtgtttggggcgtggctgcggcagcgcttcgaggagttcgttgccgcgctcgtcgagctcagcgtgtctccgcacagcgacgaggcgatcagggaagtggcgcttgatgcgttcatggatttcgtgaagctggggaaggacgggagcttccactcggcaatttaccacaagtttctccacgctgtggttcatgctacgaattcaattgatgatgttctagagttgcttgggtccaagtacgctaagtatgctgatgtttgtttttttacttatactagcttagataagatcgccaacagtctgggcagtcaaaccactggctctggaaaagatgtcttgcagaatggggatgacggggctgaagacaggagtgctgtctgtgtacgcaatgtatacaatattttggtgcatattcccgcgttggattttaagaaggaatcaaagtttgatatgtggagtactgttggcctttcttcaaaaggagagaaggacacctctgagggctcctctgctacgcgtataagcaaaaagttaaaattgaagttcaccaaagcatggctggcctttctcaagctaccacttccacttgatgtctacaaggaggtccttgctacacttcatcagaatgttattccttcaatgtcaaacccagccatcttgtgtgatttcttgactacatcatacgacattggcggtgttatcagtgtgatggccttaagtggtctattcatccttatgacacagcatcagcttgaatatccaaaattctatgataagctctatgcattactgactcctgctgtgttcatggcaaaacatcggtcagtgttcttgcaagtaagtagctctcagtaaatataagtgtaatattatggttacactatgaatgaatattgccatactttagtatgtattaagttatgaatgaatattgccatactttagcatgtattaagttctatgaactaaaaggggtttttgaaggactgccagtcatccaagctatggatccatttcacgttaacattttcattcatgatcttacaagtgctgtctagccatgcacacctttgcatcttttgaatgct

SEQ ID NO: 13994 - DNA, 1884 bp, Triticum aestivum
  unsure (1)..(1884): unsure at all n locations
  Clone ID: PAT_TA_13994
cccgcccccgcccccccagaccaccaaccgggcagccagctacagtcccacgcgcacgctccgatccggcctcccgcctcgaccccgatgagcaccgcctccgccgacgtcggggacgccggcgatggcgcctcctccgccgccacagcgcccgctggcaggcggatcccgccggcctcgtccatgccgtgggtccgcaacctccgccgcttcgtcggcacgggcgccggcctcggatccgaggcccttatggaattggaaacgaaaaggatattgcttgagatttttaaggagcggcagcgaaagagcgctgaagctggttccatcccaagtttttacaagaagaaacctgaagatggatctattagcaatagagtccagaggttggccaagtacagatttctaaagaaacaatcagaacttctacttaatgctgatgatctcgatgccatgtgggtttgtctcagagaaaattgtgttattgacgatgctactggtgctgaaaagatgaattatgaagatttctgccatattgccacagtgtgcacagagcaaattggccagaaatgcaaacgcttctttagcccttcgaactttatgaagttcgagaaggatgattctgggagaattgcaatcttaccattctatctttatgttatgcgaacagtttctcttactcaagcaagaattgatatgagtgaacttgatgaggattctgatggtttccttcaacctcatgaaatggaagcatacatcagaggacttattcccaatttggcacaattgcgtgacatgccatcagcctttgttcaaatgtactgccgcatagctgcacggaagttctttttcttctgtgatccacacagacgagggaaagcatgcataaagaaagtattgttgagcaattgtcttcaagagctaatggaattgcatcaggagagtgaggaagaggtaactgataccgagcaggctgaaaattggttttccttgacttcagctcagcgcatatgtgatatgttccttgcactagacaaagatacaaatggcacactgagcaaacaagagctgaaggaatatgctgatggcacactaacagagatcttcgtcgaaagagtttttgatgaacatgtacgccgaagcaaagttggaggtggcaacagtcgtgagatggattttgagagctttctcgactttgttttggccctagagaacaaagacacccctgaagggctgacatacttatttagatgccttgatctcaacggaaggggatttctgacaactgctgatattcatactctatttagagatgtgcaccagaagtggatcgagggggggaactacgagctttgcattgaagacgtaagggatgaaatctgggacatggtgaaaccagctgaccctctcaggatcgcactcgcggatctcctttcctgcaagcaaggcgggactattgccagcatgcttatagacgtccgcggcttctgggcccacgacaacagagagaacctcctccaggaagaggaggagcaagtagaagaggcttgagtgccaggcaacaaactatggtgctccgctgtctcaacactggtgcagacagcatgtgcttcctgccttcgttattgtagcttacgtagttgtattaggcctgttgtataacttgtgtaagtgtgccatttgtgtgagtgggttaaatccgagtgattaggagtttgtaagtgtggcgtggttgtgcaggctaactgtgtatcattctcagagcttgtttgaacggtgaaagcctcaggtatgtgaagtatttacttgaacgctctggcaaattatacagtgcgtgtattttctgtttctcccaccgatttttaactgcagtacctatgcgctncc

SEQ ID NO: 13995 - DNA, 380 bp, Triticum aestivum
  Clone ID: PAT_TA_13995
acgcaaaatgggatcctagtaattattggcgaacttccggttgttttggtgtctctccctctagatgttgtaacatgtgccttatactcattcaaatgtcacattaacatttccagccagctatgatcctgtgaccgcaacaacaaatgggtcagcatagcattccagctgcagacaagaattcccttttgagtttttcgtttggctggattctgcctacggaagtacaaggggaaaacaagtttctaatctatacaggtaaaggttcctccttcaaatccccccccgtctccattcttcacgagcggtccaccagcgggtatagttctcttatatcatgactcacaaccagtatcgtgtggtctttctttaggtccttt

SEQ ID NO: 13996 - DNA, 434 bp, Triticum aestivum
  Clone ID: PAT_TA_13996
gacggcgcaaacggtggagttgatcccttggtgcttgcccaacacagccaagaggcacaaccagtggaaaggcctgtatgggaggttggactgggagggcaacttccccacatccgtgacagatccccagccaatgggcaaggtcggcatgtgcttccaccctgatcaggacaggatcatcactgttcgtgaatgcgcccgatcccagggcttccctgatggataccatttcgctggcaacatccagagcaagcacaggcagatcgggaacgctgtgccgcctcccctctcctatgcgctagggaggaagctcaagcaagccatcgacgccaagcctcgactggcttaagttcactgcactgcatgatacaagtcccgtcattttttggttggtccgagtgggacttaattcatcattggcccctatatgtatg

SEQ ID NO: 13997 - DNA, 619 bp, Triticum aestivum
  Clone ID: PAT_TA_13997
ccacgcgtccggtccatctcgcgccgcggcgacggcggcggccagatcgtggagctccggcgacggcaggacgcagcggccgagcagctcagcaggagcaagcagcacaagtcgtgtgattttttcccccttcagtcggaggtagcacacaaggaattatgagtgccgagaacactataaatgatgttcttgccaaagaaaattccctgtctccgggagataggatgaatgcagtaggaaccaacatggaaagtattacaagagtagaactcgaccttgcatttgcctctgagaaattgctaaatttggagatgttggtgatggaaatagctcgccgagctactgagtttgagcctcttaccttggaaagtggatctgtttcttctgagactgctgaggatgccttcgagttggacaccttgtatggtattctcgatgcagaagtccaagagttagatgacatgatcagttctcttcagattgatgctaaaaatgttgaggacaaggtttatgacgaagaatctggaggcaaggttaaagctaagctggatgctgctatggcttctgggaaacagatgcaggatctaattgctgatatcatgaaaggagtctgcaaagt

SEQ ID NO: 13998 - DNA, 616 bp, Triticum aestivum
  Clone ID: PAT_TA_13998
ccacgcgtccggcttctgagcgtattcagcagacattacccgctgaagtgaggtttggacgtggctgggttggagaatatgagccaccattgccacctattctagttatgcaagaccagttacgaagtcaggttagctctgatacgaatatgcaaaggaatgcggcgcggcccagagataatgaaagactcagaccaacagaaagcattaattcaaaggatatgagcttgagtctacttaatcggataaccactggtaataatgtagttggtgtgactggttcacttgagagtccagaacttaagccaagattatttggtgtttctgctgaaccccagcacaggaacactgatgccttaccactgcacgataaacacagagcatctagaaatgctgtgaagacgaaaagggcaaccaatgatcaagttaggaaaggcagacactcctccaatgcctgccctcctgaagtgcaaccacagaggtctgaatgttcaaaaggagcttcttctagtgtgcttgatgtgcctgccgtgaacaaaatggctggccaccgaccttttttccaaccgccagaagcagtcaagagctcatcaaatgaaaaaaagcggcgcccctc

SEQ ID NO: 13999 - DNA, 697 bp, Triticum aestivum
  Clone ID: PAT_TA_13999
ccacccgcccgcgcgtccgaaggttttggacggatatactgcctatacagaattggatcacactagtaattgctcttggactgtttgagatgacactatggtactttgagtacttaaacttcaacagcagtggtgtacgacctgtcggaattacaacttgggttgtaactgttggcgctatcagaaaaacaatttcccgtctactgatcctttctatatccatgggatatggtgttgttcgcccaactctaggagggctcacctctaaggttttactccttgggcttacatatttcctggcttctgaattgctggatatttcagaaaatgttggaacaattaatgacatttcaggcaaagcaaagcttttccttgtccttcctgatgcatttttggatgcttttctcatactttggattttcacttccctttcccgcactctcgagaaactacaggcaaggaggagttctgtgaaattggatatatacagaaagttcacaaatgcactggcggtctctgtcataggttcagttgtttggattggctatgaggtctatttcaaagcaacagatccctttagtgagagatggcagagtgcctggatcataacagccttctgggacgttcttgcatttgttttgcttattgagatatgttatttgtgggcaccttcccaaagctcacaaagatatgcata

SEQ ID NO: 14000 - DNA, 798 bp, Triticum aestivum
  Clone ID: PAT_TA_14000
ccccgccgccgcccagccctcgtcgccgccgccgccgggtaggttgtcgcgcgctgacggccacgcgcggcggtgggtgagagcgaggagatacggggggtccccgcgtttggccgccgtcgcaactccggctgtctgcaattaccccggacggcggggagccgccggcgcggcagaagagagagccacagaggccctgcggctgcgaccaggtgttttaaaactttcagctcacaagtaaccagtcttaccgttttgctgcatgtggaaggaagctccaggttactgacgcaaattagaggatctggctcctgattggacagacatctctcctatttgtctcatgccatctacttaaattggactagacaatcagcaaagtgaaatggcagaaccatggccatcgtattcatcgtcatctcgtgggaaaaagaagcgaccacgctctcctgatggtgatgccacaagttcacaaggcagaaccgagaacagcacaagccttgaggacaaccttatattcagtgatactttgatagctctacagttgatgcgcacacagttcccgatgcttgtctggtactcctgggccccgcggtgctctggaaagccaaagtgcctgtcaagtgccttttcttcatctggttagcactgcaacaccattgctgggacagttgaccagcttaaatgcctgcagctgcccaaacacgccgagacggtgaacactgctcctggttgagtctcaattatatagcagcgtgaaggacaggacacaagttgatagagatttggagtcactga

SEQ ID NO: 14001 - DNA, 881 bp, Triticum aestivum
  Clone ID: PAT_TA_14001
gcgtccgaaacaaaatcctacgcgccggagccgtccaagaacccgcatcccattcccatcccccgcccgtcgaggcctcggggcacgcgacgggggggggcgcaggagctgcgcggtggcgggcccatccgatccggccgccggccgcgccggaaccaatctgaggagcccgcgatcgcggtcatggagggagggatggggggcggaggaggcggaggcgggccgcaggagctgtcggcggacaacgtgcgcgggatagtgctcgcgctcctctccagcggcttcatcggctccagcttcatcatcaagaagaagggcctccgccgcgccgccgtctcctccggcatcagcgccggggtgggtgggcactcctacctgctggagcccctgtggtgggttggcatgatcaccatgatcgtgggagagatcgccaatttcgtggcctacgccttcgcccccgcggtgctggttactcctctgggagcactgagcataatcgtcagtgcagtgctggcccatttcatcctgaacgagagattgcacgcgctgggggtgctcggctgcgtgatgtgcatcgcggggtcgatggtgatcgtcatccacgcgccgctggagcaggagatcacatcggtcaaggagatatggcacatggcaacacaaccatctttcttgctatatgttgcttcggttatagtcctggtctctgtgctggtgttccatttctcccctctctgggggcagtcgaacgtcttgatctacaccgccatttgctctttgatgggttctctttcggttatgagtgttaaagcacttggtacatccttgaagttgacttttgaggggacgaatcagttagcattatcccgagacgtggttcttta

SEQ ID NO: 14002 - DNA, 742 bp, Triticum aestivum
  Clone ID: PAT_TA_14002
ccacgcgtccgcaggcaccaagccccccccgcgcccccggaccagttcaccctcgcgctgcgcaaggcgctcatgttcttcaatgcccagaaatccgggaagctgccgaagcacaacaatgtaccatggcgcggcgactcgtgcctcaaggacggacgctcggaccaaacatcccggcgagacctctctggtggctactatgacggcggaagcgctgtgaaattcaacttcgcatctgccttctccatgaccctcctcagctggagcgtcatcgagtacaatgctaagtacgaggctgctggggaacttggccatgtccgtgacactattaagtggggggccgactacctattcggcacctgcaactccacggcacattccattgatcgcttgattgcacaggtgggtggtgctgcaatgtcagacggtccgagtcagcccaatgatcattattgttggatgaggccagaggacatcgactacccacgtccagtcaccgagtgccacacttgccctgatcttggtgctgagatggccgcagcattggccgcagcatccattgtgttcaaggataacagggtttactcccacaagctgttacacggtgctaccaccgtctgggactttgcaaggaagggaggtagtcgtcaaacatataagtctaccccggtcagatgctgcaaagttctacaattcaaccggttactgggatgaatatatgtggggtgggtcgtggatgtac

SEQ ID NO: 14003 - DNA, 1069 bp, Triticum aestivum
  Clone ID: PAT_TA_14003
cggacgcgtgggcggacgcgtgggcggacgcgtgggcggcgctgctcctcaccggctccatcgacgagaccgtccgcgcctggcaacccgacgacctcgccgccgcgtcccccccggcgggagggtacgcgctcggagtgatatccctcgcggcgcatcctgccggggtcatagccgccgcggtctccatcgacagccacgtccgcgtcttcgacgtcgactccggcgcatccgtcgccacgctcgatgccgcgccctccgaggtctggggcgtccagttccaccccaagggtgttgctctggctgcagctggtggtggcagtggatcagtaaaactctgggacacggagaagtggcaacctattgccagccttcctgttccgcgtccagagggagctcaccccgataaaacaggcagcggcaagtttgttctttcagtggcctggagtccagatggcaagctcttagcatgtggatccatggatggcacgattgcggtgtatgatgcggtccgcatgaagttcctccaccacctggaggggcaccacatgccagtgaggtccatggtgttctcgccggtggacccccacgtgctcttgaccggatgtgacgactcccacatccacatctacgatgccaaggagaagggcctgatcggggccatgtcgggtcatgcgagctgggtgctgagcatcgacgtgagcccggatggcatggcggtggcgacaggctccagcgaccgcaccgtccggctctgggacatcaatgcgagggcgtcagttcagaccatgagcaaccactcagaccaggtctgggccgttgcattccggccgccgggaggggaaggagtccgtgctggccggctcgccagcgcttcggatgacaagagcatctccctgtacgattactcctagttttacagattaggcgagctgtgatacagccctctgttattgccgtctgttgtaccatgacctgtaccactgtacgatgctgactaaagccgtcacttgcaagttgagcgggtttaattgtagtggttaaaagtgattttcctgcaaaaaaaaaa

SEQ ID NO: 14004 - DNA, 958 bp, Triticum aestivum
  Clone ID: PAT_TA_14004
ccacgcgtccgcaagattcagtggaaggagatatgctttcatttgagagcgaggccagttttcctactgaggtttctgggaaagagaatcaacataatatgatggcactgtcaaagggtcagatttcatctgtttgtaaagatgaaaataatgcaagtctaaatgcttgtggtctttttcctgaaatagaagttccactccaacaagctgacaaaaaatacaagttctttgaactacccccagagatatacctggctagaccttcctataacccttcttgctcagatggacttggttgtagtggcaaggaatcatctgctgtgtacctcgccccccaagattcttcaggtatcaaatcgcgctgtccagatcgtttggtacaagagctcaatgcatataactctttcgttgtcaaaccttgctctgctgattttgttggaaatgccaacgaacaagaatcacaaaatcaaatttcagagtcattaaatgcctccaatcgtaggaatccaagaagagccgcctcgtcaagaaatcgtgctcctgtggaacatgatcaaataaacaaaggaagcagtagcacatgcaaatctaagaaggtcgagagttcatgctctttagttgaaagcaccttgattaagttcccaaacaaaactaccaaggtaagaatttacatcaacagaccagtgaattcgactgcctggggcagtctagaaaagctagcagatggttttggtcagaactgtgaaccttctacctctaattctcatctgatttcccttgaaaatggtgggagatcaaacaaaagatctgggaagaaagagcagccaattgttcgaaaggctcgaagttcaagatgtccaaaaaataagttccctgccttttctgttaccagatatgcaccggatgaattgaatggcgaacctaccttttcagtcatggatggtgcttatggctaccc

SEQ ID NO: 14005 - DNA, 809 bp, Triticum aestivum
  Clone ID: PAT_TA_14005
cgtccgtccttacctaccggccagtatgcaacatcatcaagctccgccgttgttggtcatccagataactttccattgagagtcttgacgatgaaggaggatggtacccttaccccgacgaccaacggtgtagcgcccccaagcttatcggcacgaggccctcctccgcctccccgccgccgtcgccgccgcctgggccagccatgggcgccgctaccgcgggccagcaggcgggagggaccccggacaagctccggcacgtcgagtccatgtccgagcggccctccggcgccgggtccatctccgggatcagcgccgtcgtcctgggcgagtcgctcgccgacgaggagcacgaactcgtcttccccagcgccgagttctccgccaccgcactcgtttcgttgccccgtacaaggagatgtacgagaggtccatcaaggacccggccgggttctggtcagagatcgccgacgccttctactggaaggagaagtggaaccccagcgaggtctgctccgaaaacctcgacgtcagcaagggccccgtccacatcagttggttcaaagggggcaaaaccaacatatgctacaatgccgtcgaccgcaacgtcgaggctgggaatggggacaagattgcactgtactgggagggcaatgagcccggccaggatgggaagctcacctattctgagctcgtggagaaggtttgccagcttgcaaattacttgaagaagtgttggtgtcggcaagggggatgctgtgatcatctacttaccgatgctgctggagcttcccattgcaatgcttgca

SEQ ID NO: 14006 - DNA, 996 bp, Triticum aestivum
  unsure (1)..(996): unsure at all n locations
  Clone ID: PAT_TA_14006
ccacgcgtccgggcagagacatgaacaatcaacggaggatggacccacgttatcgtggtcgtggtggtggatatcatggccatccaaggaacttcaggggtccaagaatgagcgatgagtctgaaattgacttcgaagatgaacctattgttggcagaaggaggccacatgaaaatgactacgggcacttgcaccgaactcagcataggcggctgcgttcaccaccgcatcagatgcctggctgcctcatgagagaaatggagcatgacagattttctgggagagagattatggaccctaggctgttggaacacgggcagatggatgatgtcccagatgacatgatggaacagaggtttttcatgccccatcctcattcacagcacactctaggtgatcatgcatttatccacagggacagcagtcattcacctggtcaaagaaggggcgcccccgtgcatttccaccggggacggtcccctgaaaccatgcaaagatcaccaccactaaacagaagtgacagaccatacttacctcatcaacgccacatacgacgccgtggttctccattcgaccgagtaggacatgacgagagaggtatgcaaaggaacatgaagcggtgtggcatgcatcaaggtgtggaaggtgagacctttgagccacctttacatcccgctcaactagccgagctacatgcagaggctgagcttacagagagaaggaggttggggagaggagagcgtatcgtcgatccttggaacggagccccatgggcggcgacgaggagatgctctcgtaccacggcgatggcgacatcgactttgccgatggtgatggcggtccacgggagcctgacggccgtggcttcangaacagaatggagcancgagcaanggggcgagcaaggaaatgggttcaggtacgttggcctcaaggggggtgccgtgacngcaaccccgaaatgacantaanatncaaanaanangaggtactggc

SEQ ID NO: 14007 - DNA, 675 bp, Triticum aestivum
  Clone ID: PAT_TA_14007
ccacgcgtccgcgcggcactaagttcgagcggccgcccgggcaggtacatattatttactattgagctgactcgtagtttatatcttggaaatcagaagtaggtaacgaagattatcatgatagtaatttaatcaggaagtatttgctaatatgtcgcatacatgtttgaagaaattatctgcattttgagtttgaatgattgctctgatgtgttgtcactgtgctatatagctagttcggaaaatgtttaacaataatagagatagacaattgttgtttcaaaagccaccacaatattgatgcctgaatcgcagggtctagcaaatctcacatcgattgatgggcattgtcttaaaaaactgtttgttttgcaatcttattcataactacataacttgtgaatcttatatagttagtggcattttcccttattgagttcattctctttatagaacattcttgagaatgtgtatatgactaaccagacaatactgttctctcacctttaaatgatactccctccatatcaaaatataagtcgttttttgacacagttatagtgtcaaaaaacgtcttatattttgatagagggagtacctcggccgcgaccacgctatgtcactctctctggtgccttttccaatattagatactcttattacataatctatgtg

SEQ ID NO: 14008 - DNA, 706 bp, Triticum aestivum
  Clone ID: PAT_TA_14008
ccacgcctccgcggacgcgtgggcgggcccgcccgcgcgcccgcgcacacgcccacgactctgcctctccctccccacctccgttctcgcatccccggtccgtccgtcgtcccctgctccactccacccttctccctccttccatttgaccccgctcccccgtctcttcctcggcaaagcttcgaattttcctccctccccctatccccaagcctcccgcttccgtgtccgcgtcccgtcttggattcgtccgccgcgccaacaaagaaaccgcgtgcgtgcgtgcgtgcgcgtcggttcggtcccgtccggcccttgttccttccttgccggccgctgcttcgcgcgcattgccgccccgcccccgcccgcgggattcctccgcccaataagttcctttcccggggacgtttctcggaggacggacaggaagaaaaaagccgcgcgcgctgcctcgccgcatggatcagggtcccccgcgctgccgcctggagctgggatttcgggacgcgggcgttcaggggttccggccggacgccgccgccgccgcgccgcggcagggcgggatctcggagctctgttgaggcgttccgggtcaggtgatttagtccagtgctgtccagttcctcgtgtggctgcctcgcctgctttttttaggtaggtgggggcggtggagcctttcttggtgggtgggagcgcgccccga

SEQ ID NO: 14009 - DNA, 518 bp, Triticum aestivum
  Clone ID: PAT_TA_14009
cgtccgcggacgcgtggccaagatcactacggaggagagggtggagctctccatcgtggagcacctccccaacaatggcgacgccggcgtggaggaggatcatctatggcctaccaaagacggccctcttcctatattcctcaagtttgagaatgtggagtacaaggtgaagctgagtgccaagaaccccctgacggcggcaaaggtggccttctcgtcccacatgagggtggatcatgccggcagcagctgcaagcacatccttaagggcatcggcggcagcgttgaccccggcgagatcctggcgctgatgggcccctccggcagcggcaagaccaccctgctcaagatactcgggggcaggctgggcggcgccgtcaagggccagatcacctacaacgacaccccctacagcccctgcctcaagcggaggatgggatttgtgacgcaggacgacgtgctgttccctcagctgacggtggaggagacgctggtgttcgcggccttcctgaggctgc

SEQ ID NO: 14010 - DNA, 568 bp, Triticum aestivum
  Clone ID: PAT_TA_14010
ccacgcgtccgcttctcggtttctcctctcccattcagcctgcccacgctctcctccctcgccgccccctttcccccctctaccgcgctctgccgcgaaccctagcgaggatcccaaacaccatggacgcctggagcggggtctcggcggacgccgccgccgcgggggcgaacggcttgggtggcgggtggagggcagacgtggaggccgctgcggcgacgagcggcctgggtggctggggtgaggcctccgccgagctgctggatgtcgaggcatatgtcgcgccgtactctggccggacccgcttggcgcgcctcatggccatctcgtacaagtgcggggtggaggcgatccagttcgaggcgctgcgggtggcgcacgacgaggccaaggctggcgaggacacgatgttctacctctacgtcgtccgcgagatcgacggccgcctcggccagggctacctcctcgaccaggcctgggtcgactccggcaaccgacgcgccgagcagcgcaaggagacgctcctgagccaactccaaatctaccagagcaaccagatcagagagag

SEQ ID NO: 14011 - DNA, 965 bp, Triticum aestivum
  Clone ID: PAT_TA_14011
gcacgagggagagagagagagagagctgctggctgcccgatactactcccggctccgcccccccccctccaccctcccccgctcctctctcctcggcgccgcggagctccaaaccctcgccatttggccgcgccgaaccctaaccctagcccgccggccgcccccccgcggagcactcccgcgccgcggcccggggccgacggccgcgccgatccgatccgcacgcacgcccggccgccgcgccgatcgaggctgcagataaatagaagggacatctacagattcgtttagcctgagtaaattcttgtcagtccaggacagttcacgctttcacgggcattagacccgtagggacttcggaaatgtcacagtttcaccacacacagcatgggggtgatggtgattttcagatgtggcaacaacagatgatgtacaagcaattgcaggagttccagaggcagcaaaatgcccagcagattgatcatggagccagaatgcagccctcttttgggacagtttcaagctccagcaagagcagcgcctgctgatcaattgccgggtgataacaaatgaaatgccaagcaatgaggccacggcttatgcgtggccacaaaattttgctagtgggtgacccaaggttgccaagcaactcacaaatggtgaatacaggtagcaacacaaactgggagcagtatggtggtgctcctgccatgggcaatttcatgaatggtccggtttctcctcctactcaaagtcaaccgatgcgaccaatggggttagctacacagcaaatgaaccagtccttctatcaaatacctgctaccagcagaggcgggtctgttaaccagtacccccagttcttagggatcccagctgatctccagaatgcaatgacaagggcaagcagtcatcagcctgaaaaggtatcaaggccatttagctcgttaatggatgagcctagtccg

SEQ ID NO: 14012 - DNA, 886 bp, Triticum aestivum
  Clone ID: PAT_TA_14012
ccacgcgtccgctactcacaacagtgctgatcaacttcagtcctcatcagcagatcaacaatcgatgaaaaaatcagtagattcaagaagttctggtatttctgccgatcgcaatttggttcgatccacagttgttgcacctggatatgtgccaactgaagctgatgagagaattatagttgaacttccatcattgatggtgcgaccattgaaagttgtgcgtggaatcttccaagtaacatcaaagaggattaactttataattgacgagcaccccgcggccggtaatgtggatgatcatgcatccgctcgtggccaatgttatcagcaagataaagatcggagctggttgatctcttctctacatcagatatatagcaggcggtacttgttacgacgaagtgctttggaattatttatggtagataggtcaaatttcttttttgatttcggggatatggaagcacgcaaaaatgcttatcgggcgattattcacaccaaaccacctaatttgaatgacatttttctagctacccagagagctgagcaaatccttaaaagaactcagttgatggagcgctgggctaactgggagattagcaattttgagtacttgatggaactgaacactctttctgggcgcagttataacgacataactcagtatcctgttttcccctggataattgctgattaccagtccaaagttttgaatctggatgatccttctgcataccgtgatctttcaaagccagttggagcactaaacccaaaacgactaaagaagttccaagaacggtactcgacgttggaggatccaatcatccctaagtttcattatggttcacattactccaatgctggcacggtcttgtattaccttttc

SEQ ID NO: 14013 - DNA, 949 bp, Triticum aestivum
  Clone ID: PAT_TA_14013
ccacgcgtccggctctacgcagcgtatgagaggaggcgatttcttatgttcatggcgattccgggctattccaccgcccgatttcgatttctcctcccttttctcttcgatccccgctgccgcggtcggttgtccttgcctctcgcgtttccctgtgtgcttttgtttgtgttgtggctgtgtagttccggatctaggtaagttttggatccatggatccatggttcatctattcttggtgttgtcggtggatccgtggtaggtgcatgttgctgtcgtgtttgtttctagtccgccatgcctagcgctccatttcccatccttctgctcgcctgagttatgtaggagcttgttgtatgtggggagttctaatccatctgcttgttgtgggccttttctcccctgcttggagatgtggaggcaggcgttgggtgtttattccgacggtggttgtgaggtaggggaagttatagttgcagcggtggttagccctatcaattttatttctgccggcctgggtgtctgttcctttgtcattagatgtagttgcagatgatctagcctgatttctgcctgcttatgcagtttagttgtatttgctgttagctgctgcctgctgatgtttgctgttgtagtccctggaattcattatgattttttgtgttagatgtaggtgttcatttcccccggtacctgaatctctctgaatttgtgtgtactaggctgcagtgttgttgtagtgtcagtccaggaatctctctgaattgcatgcttctttacagtgtatatttactccagacttgaagtgtaacttacccctagaattacagtgtatccccatccagaattgcggtgtaatttaacccataattacagtgtaacttaccccataattgtagtgcatttacagtgtatcccgatgcttctttatttgttgttactctggaat

SEQ ID NO: 14014 - DNA, 681 bp, Triticum aestivum
  Clone ID: PAT_TA_14014
tacccctcccgtccgtcgggccaccccccgtccgatcagtccttacggaaacaactaccatgatagccagactggttcttcttactaccatggcaggaatgccattggtagtcagggagttaccttagcagcatcatttgaccctccgtattctgagaatgcaaggagtgcaaaatactcggagagagatcggatatacggtggaaaagctgcccagaataaagctcccaaagtggaagcgagggattggccagctggtagccatgctgatctcttaagtgactggcagagagggcagcctgaaggcgattacaggagcaggaagcctcaagttggtcatggtgtgaaggttaagtcctacaaaagtattgagcagcagataaatggtgcacattctggatctgatcctagaggcaggatatcacaggttaagattaatgttaaatccaatagtcagcatggtaggattggccagaaggactccaggagcaaagctgcccatgttcagagtgaggagacagaatctgattcatcagaacggtttgaagatggggcagatatgaatcttgttgaagaacagccaaaccttcaatattctgaacttcatataccagcatatggtgccaaaaagtcaaacaaacttagcaaatcagtcaaaacaaattatcctgcccctactgc

SEQ ID NO: 14015 - DNA, 630 bp, Triticum aestivum
  Clone ID: PAT_TA_14015
ccacgcgtccgcggacgcgtgggctggtccgcccggaagcaagagatggctgacttgtccctcgtgtgcgcggcatcgctcccactcactctgctcgcggcctacgcgctacaaccactggccgacgcgcgccgacgcctcccgcccggccccaggccactcccgctcctcggtaacctcctcgacatcggcgagcaccctcaccgttccttcgccagcctcgccgacatccacggcccgctcatgttcgtccgcctcggcactgtcccagccgtcgtggccacctcgccggaggccgcccgcgaggtcctgcagaaaaagaacgccagcatggccgctcgccgtggcctggacgcctggcgcgtcatggaccacgacgccaactccatggtcgcgctcccgccgcgcggcaagtggcgcgccttcaggcagcactccagggccgcgctcctcggcccccggccgctcgacgagcaccgggcggtgcgggaggaggaggcgcgcgagctggtgcggcgcttgtccgcggccggaggcgccccggtcgatgtggctcgcgaggcgttcgtggccatggtgaacgtgctgtgccgcgggatgttctcggagaagctagatccggccgtggtg

SEQ ID NO: 14016 - DNA, 811 bp, Triticum aestivum
  Clone ID: PAT_TA_14016
ccacgcgtccgattgatttgttggtgttccttgtccactacctccacccccaccccaccatctccatccctcccgccgtcctcccgatttctccccttttctcctccctttctcatgccttgacgccaccattgccggctccccctccccaccgcatcgacatctcctccgccgccccccgcctcccgctcccgcgcccgcgcctccgcggcccaccgcgcgaggcggaggcggagagagagagcagaaagcggcgcaggggaaggaggcggcggcggcggcggccattggagatgtttgacagcttgctcaactccaagttccacaacaaatgcacgcacgcgatcaaatgcacccggacccggctggatctggtgcgcaagaagaagcaggccatggtgaagttcctgaggaaggacgtcgccgacctcctcaccaacaaccttgaatcgcacgccttcggacggatggaagggctgattgtggagatgaaccaagcgtcctgctatgacatgatcgagcagtattgcgactacatagggaagcagctcaacaacctgcagaaacagagtgaatgccctcatgaagccttggaagctgtgtcaactctgattttcgctgctgctagatatcctgatttacctgaactgtgtgaactcagacatgtatttacagagaaatatggggcttccattgaaccttttgttagctctgagtttgttcagaagcttcagaacaaatcatttactaaggaggagaagttgcaagtgattgaagatgttgctgaagaatttgctatcccgtttaatac

SEQ ID NO: 14017 - DNA, 305 bp, Triticum aestivum
  Clone ID: PAT_TA_14017
cgaggttatggggtacctggaggccaagcaccacctgctgctcttgtctcacccataactttgtttatatgcctagtttcaagtgaacttgtcatagcttatattgttgcttttgtggatactgctacccgttgcttcaatgctgccttaacttgttagcatgttcatgtgaattggctaactgcttcctgttaattactactactcactgccgctgtattctattggcacgaactctgctgcccgtgtattatatatattcttcttgctcaagcacaagagcactagtgcaaaatacagatcat

SEQ ID NO: 14018 - DNA, 879 bp, Triticum aestivum
  unsure (1)..(879): unsure at all n locations
  Clone ID: PAT_TA_14018
cgtccgtggacgcgtgggcggacgcgccacgctgtccaccacaacccagatctccgcctcgccggctggccacccccaccccgaccaccaccatgcggagcacgggcccggccgctaccgcgacggtgacacgggtggcgcagagggtggtggccccgtcggcgcccacgcccggcggcgagctcccgctctcctggctcgaccgctaccccacgcagcgcgcgctcatcgagtccctccacgtcttcaagggccgcgccggcgacgaaggccgccgagtccccggtcaaggccatcgagcgcgccctggccgccgcgctcgtgagctactaccccatcgccggccggctcgcgctgtccgacggcggcgagctggtcgtggactgtaccggcgagggcgtgtggttcgtggaggccaccgcgagctgcaccctggaggaggtggactacctcgagtacccgctcatggtgcccaaggacgagctcctgccgcaccccacctaccccgcctccgaccccctcgccgaggactccgtaatccttctagtccaggtcacgcagttcgcgtgcggcgggttcgtggtcgggttccggttcagccacgccgtcgcggacggccccggcgcggcgcagttcatgtcggcgatgggcgagatcgctcgcgggcgggccgcgccgtcgctgatgccggcgtggggccgcgaggcgatcccgagcccgccggccgcgtccgtgggcccgctcccggtcccgacggagctccggctgcagtacctggccatggacatctccaccgactacatcgaccacttcaaggccccgntcctggaggagacggngcaccggtgcagcgcgttcgaagtgctgatcgccaaggcg

SEQ ID NO: 14019 - DNA, 491 bp, Triticum aestivum
  Clone ID: PAT_TA_14019
cctcgcccccgttccccatcactactgtgtcacttctcgaccgtgttcttctctcgggagccttcccctcctctctggtcttgggggtacatctcgcggcttgcctgtgcgtgttcttctctgggtcatgcaatttagggcatcggcgcgttggttctcgccccacgccttccttggttctctgctattggtgcagggcgactctcttgcacttccagcctgcgtggcagccgctgtcctgcatttcggcttgttatatctgcctgcttctccttggttcgcacctcgcagttgccacgggactcctgttgtcgtttgtccctctcgcctggataccttgccttccttcgcccctccgtcgtgtcctcctgttccgtttgtctgcctgcgcaagctgggggcgaactatgaaattgctacatgattgcttttgtcgtatttctcttttgatttgataccttggtttccatctctatgcattgtttcttata

SEQ ID NO: 14020 - DNA, 644 bp, Triticum aestivum
  unsure (1)..(644): unsure at all n locations
  Clone ID: PAT_TA_14020
ccacgcgtccggacatgagtagttagagcttcaaactcaggggaaaaccatgggtgtcttgacgctggttcatatccttgtcagctttgccgcctgtgccgaggccatacggagagccgacttcccccctggttttacctttgggactgcttcctcggcttaccagtacgagggtgctgtcaatgagggtcagcgtggacctacgatatgggatactctcgcaagtcgacccgggcgggtgatagatttcagcaatgcagacgttgccgttgatcactaccatcgctacaaggaagatgttgacttaatgaaggatattggcgtggatgcataccggttctctatctcatgggcacgcatcttcccaagtatgtctcagatggaacaggcaagcctaatgaagaagggttgagttactataacagcctcatagatgttctattaggaaaaggtatacaaccatatgtaacactattccattgggaccttccacaagcactggaggataaatatggtggctggttaaactcgcaaatcgtggaggtttctctgctccatgcccttcctcgcatgaagctntcttgcacaatctatgtcacataaaagttctttattttcacatgaaaaaactggtttggttgatc

SEQ ID NO: 14021 - DNA, 1197 bp, Triticum aestivum
  unsure (1)..(1197): unsure at all n locations
  Clone ID: PAT_TA_14021
ggcctccggcggtcggnacagatcgccgggcgtggggatggtgagcggcatggctaggctccagcgatcgcgggcatctcctccaccgcatccccaccatggacggccggccccgaactccttcgacgccgcatccctgccatggacggccggccccgaactccttcgacgccgcagctatggcgtcgtatgcgaggtaggcgtgtggggtgggggatctcggcgagctccgccgccatctgccaccgccgccgtccccgccaacccgcacggcaggatcccgatccccgctcttattccgcgtctgtcgtcaaggaggagcagcgccggacgctggaaggtccagtagccggggctgcggaggagccgcgccggccgccgggaggtccagtagtcgaggctgcggaggagccgcgcagagcgccggagaggtccagaccagaagccatggccgctggtgcgtgtgtgctattcctgccgctggtgcgtgtgtgctgttcctgccgcttcctgccgctggtgaatgcgggttgttcctgctatgggaaaaggcccgttggggcgatggagagagggcgttcgcgctgttgggagcgatgcttggtgttcgggctggggctcctctcgtcccgaactaattcgttcgatcgatgcccagattccttccgaacgaatcgttcggtgtggggaggtcccagaccgaacgttcggccgttatcggcgtccttaataagaattaaacaagaagcaaaccgtcatccgcctgcttcgaggattggtcgtgtctagccgcgtcttcccactcgcttgctgcccgcgttccacggcgcgaccgctggtctaggtaggtctgggtgcagcaacaacctctgatcaagtgctcatccgcaagcttattcatctcatccccaattcctaaactcccctaggtgaacacaaacactcaggtacttctcggntttggtttgcctggacctctcccgtgcatattccttaattgattccttgctgcgttttgtgtcaaaaaccagttgaaaatacgcaatatgtagtactactactctatncaggcatgtgctgttggttctaacaaagaaattacaggatttttttgtggcacactactcgtaggttaatttgtatcatttggggaattttctatgcaagtcaatccggcaagccattctattactacta

SEQ ID NO: 14022 - DNA, 955 bp, Triticum aestivum
  unsure (1)..(955): unsure at all n locations
  Clone ID: PAT_TA_14022
ctctcttacacggaatacaccacgaggccagcggtggacaggcaggggcggtcggcggcgcaggcctccggcggtcggagcagatcgccgggcgtggggatggtgagcggcatggctaggctccagcgatcgcgggcatctcctccaccgcatccccaccatggacggccggccccgaactccttcgcggccgcatccctgccatggacggccggccccgaactccttcgacgccgcagctatggcgtcgtatgcgaggtcggcgtgttgggtgggggatctcggcgagctccgccgccatctgccaccgccgccgtccccgccaacccgcacggcaggatcccgatccccgctcctattccgcgtctgtcgtcaaggtcagacgcattcagccaccccctcctctccccttttatgctataagtctaagataacacgcgggcctctttctggtggatgaattcgtggtgttccaggaggagcagcgccggacgctggaaggtccagtagccggggctgcggaggagccgcgccggccgccgggaggtccagtagtcgaggctgcggaggagccgcgcagagcgccgggaggtccagactagaagccatagccgctggtgcgtgtgtgctattcctgccgctggtgcgtgtgtgccgcttcctgcgcttcctgccgctggtgaatgcgggttgttcctgctatgggaaaaggcccgttggggcgatggagagagggtgttcgcgctgttgggagggatgcttggtgttcgggctggggctcctctcgtcccgaactaattcgttcgatcgatgcccagattccttccgaacgaatcgttcggtgtggggaggtcccagaccgaacgttcggccgttatcggcgtccatgccttaacatacaacaacttcaatgggttgtatctagttntctaatagcatgtagaaataaataaaa

SEQ ID NO: 14023 - DNA, 806 bp, Triticum aestivum
  Clone ID: PAT_TA_14023
ccacgcgtccggccgccgccggccatctcccgccgcaaccctaccaattccagccgccattccttaccaagaaacgtagccagcgctcgccccgtacacacggcatggaggagccgatgtccacgctcacccacgacctaatcgcggagatcctctctcgcgtgccctacaaatcgctctgcatctgcaagtgctgtctgcccggcctggcgcggcatcatcgccgaccccgcgcaccggaagaagatggcgcagaccctggccggcttcctctaccgcatcaccgccgatgccacggccgagccccgcggcctcgccggcgtcaactacgccgacctgtccgccttcccttgggccagcgtccccgagacccacccgcgcctgccgctgccgcccgacagcacggaccgcttcgtctccctcgagggttcctgcgatgggctgtttctcgcaagcatccgcacgggcacccctgctgctgctggaacttctcgctacatggtctccaatccagctaccggtgagtatatcgtgctgccccactctggccaagacgccggcgactgctgccgcgcttacctgggtttcgacagtgccgtgtccactcaagagtttcatctgttcgagtttgtgctggatctgtccccccccctcctccggcgccgactgtccgtggtcgcgtccggagcgaggatttactcttcaaaaactggtgcatgggtagcaatggaacccaaatgggacatccaagttggcttgtgctttggtcaacctggagttttccataagggatgtttgcacttgct

SEQ ID NO: 14024 - DNA, 971 bp, Triticum aestivum
  unsure (1)..(971): unsure at all n locations
  Clone ID: PAT_TA_14024
ccacgcgtccggaacccaccactttctctccctcttcctcgccctccctcccttctctcttctctccctgccctgccccccccgaccggacccgtcccggatacgtcggagctccgggtgtcctccgccccgatcgcccccctgccgccgccagacagatttgcctctttcttttcgttggttctaggatagatactacatagataaataaatatcctgccttggttgggttgggcgggttcttgggcggcgcggggtttcttggggcatggccgtggcggcggtgccggacaggacgctcgcccgccgaatgctgcgggtcgtcaggctcaacccgctgcagcgcagcgccaagaatccctgaggttatttctctttaagtgccattcagattgggaggtagttttgattcacctgagcaagtcaagctgtccagttagctcaaagcattaaagatgaatttcacacgtgcattgcattcacactgtgatttccctttggtctcccgtccggtgatgatcagtgctggttgccgtccgggtcaaggggaattttagcatgattgctacatgctcattgttttgactgtaatactaatgggagctaaagtggaaggtgagagttacaatcctggatactatgctacaggggatctgcacatggactcaaatggttggcgctctccatactatgaggatagaacatcaaatggacagttgtacaatggnttcatgacaaagcaggcagatggttattcagaatacgacaacgaaacgctaaagcgcacaatgctttcacatgaagctatgtttagacagcaggtttatgaactgcaccgggtttacaaaatacagagagacctgatgaagcattatgaaaacaaagatgcatatgcatacccagaactggcagatgcatcacagacaaattcgtcatcaccagttcaaccaaatggctcaaagatgatatgg

SEQ ID NO: 14025 - DNA, 810 bp, Triticum aestivum
  unsure (1)..(810): unsure at all n locations
  Clone ID: PAT_TA_14025
ccacgcgtccgatttacacggcgacaactctggcctgcctctttccctgagccaggcccgcctcgaaaaccctagccctggcgtcgtcgtcggcggcggcggccatggcgtcggcggcgcccaagcgctgctactacgagatcctcggactctcccgagactgctccccgaccgacatcaagctcgcgttccggcgcctcgcgctcaccctccaccccgacaagcaggccccgggctccgacgtcgccgccgccaccgccgccttccaggagctgcaacacgcgcactccgtcctctccgacccccaggagcgcgcctactacgactcccaccgctcccagatcctcttcgccgaccccgtctcctcccgttccggcaccgcctccgcctcacccgtccccgacctattctccttcttctccacctccgccttttccggcttctccgactccggccgcggattctacaaggtctacggcgacgtattcgacaaggtatacgcccaggaggtcgcctatgcccgccgcatgggcatccccaccngactccaatccccacgccngccggtcattgggcaacctccgctccccccccacccaggtcaccgctttctactcctactggctgggtttcggctcggttatggacttcggngtggngctggcgagtgggacgcatccctgtgggtgagaaccgcgtgttagtgagtgctcatggaggagtgataacaagaaggcaatgcgcangngcgngtgggagtataacgatgctgtgannagggttgggttgcttctgtaannaagagagatn

SEQ ID NO: 14026 - DNA, 615 bp, Triticum aestivum
  Clone ID: PAT_TA_14026
ggcgtcggagctagctgcacatcgcggcaggcgagcagaaggaagagtggtggaggcggatggcggaggaggggaggtccctcgcggccgcgccgacgtggtccgtggccgcggtcaccacgctcatggtcgccgcgtgcttcctcatcgagcgctcgctctcacgcctcgccaagtggctgcggaagacgaagcggaaggccatgctcgccgcactcgagaagatccgcgaagatctgatgctgctcggcgtgatatcgctgctgctgagccagacggccaggtggatatcggagatctgcgtgccatcgacactcttcaccagcatattctatagtgtgcacagaggaggattgcgccgatctggaccaacatggggactccgctaacgatacccacattgctagaatcctagttggcggccagtcgatgcatgtttgcgatgagggtcacgaaccttttgtttcatatgagggtcttgagcagctgcatcgctttctgtttattcttggttttactcatgtgctttacagtttcgtgacagtggttctgtcgatgattaagatatatagctggaggaagtgggaaactcaagcatctacactctcaagggag

SEQ ID NO: 14027 - DNA, 480 bp, Triticum aestivum
  Clone ID: PAT_TA_14027
ccccccgtcccaatggcctctgggttccccggcctcctgccccgcgccctgctccctcccagccctcccccgtccccacgcccccccgcccccccgtcgccccggagcgccagtgccccggtgcccaggcgcactcagccggcgccccctccccgcccgcacccccccctcctccccccccgccaccccgcccagccgccccacccccgcgccctcgtgcgcggccacgcggccctggtgcgccagccccccccccgcctcctacggcaccgtcggccccggcttgcccggtcgtcccgcgcgccgcgccgcccggcgcgggccaaccctccccggccggccccgcggggtcccgcgcaggcagtgccacggccgtaccaccaccccgccccgggtcatggccctccacgacgactttggggccccgccggccggcgcgtggccggccccccgggccgcggcggaggggtcatcatcggg

SEQ ID NO: 14028 - DNA, 992 bp, Triticum aestivum
  unsure (1)..(992): unsure at all n locations
  Clone ID: PAT_TA_14028
ccacgagcggcctcgctgagagtgatcgaccggtgccaccgggcaagggtcggaccccaactcgctccccgcagccgggccggccgtgatgcttccgctgcggcgcttgtcgtgggcctgccgccggcgaggtctcgcccagttcgccgccggaaccccccgggaggcggcggacgcggtcgtggtgggcgccggcgcggtcggcctcgcggtggcgcgcgcgcttgccatggccgggcgcgaggtggtggtggtcgaggcggcctccagcttcggcaccggcaccagctcccgcaacagcgaggtcatccacgccggcatctactaccctccccgcagcctcaaggctaatctttgtgtaagaggaagggaaatgctctacaagtactgcacagaacgagcaatcccccataaacggctcggcaaacttatcgttgctactggtgttgcagagactgcaaagctggacatgctcctcaagagcgctaaagacaatggggtggatgatcttcagatgatggaaggttctcaggccgtggagatggaacctgaactgcgttgtttgaaagctttgctatcacctagtactgggattgttgactcgcattcattcatgctctcccttttgggctgatgctgaaaacctaggcgcaaccatatcatataacacagcagtcatcagtgggcgtgttggagatgaagggattcggcttcatatttcctgaaagcaaagagctgggagaacattccattgggtctcctgtcccccacagttgttttgcctccaaaacttctgataaatgcagcaggttgagtgcattccactgccaaaagactgatgggcctgccaagcattgtgccccggcttacatgccctggatgttactcacctccacaaacaagagccttcagcacttatatccccccaaaggatgtgatagggtcagtaacaactaatgctgtaattgccaattnaagtaatgaatgcactt

SEQ ID NO: 14029 - DNA, 812 bp, Triticum aestivum
  Clone ID: PAT_TA_14029
ccacgcgtccggcccactccacttcactctccatcccccagctgccgcccacccaaatcaaaatcacctccacctccgccggtacctcggcacgccgtccatccacccccccggctcgcgtgcgtgccatgaggaccctcgtggccgtgcccgtcctcctcctcgtggcgcagctgctgggcgcgtcgtgccatgggcaggagcagcggaagaactacgtggtgcacctcgagccgagggacggcgaggggagcgcggctgtcccggtggaggactggcaccgctccttcctgccggaggccgcgccgagctccgccggcgacggcggggcggacgccgggcccaggatcatctactcctacagccacgtgctcaccgggttcgcggcgcggctcagcgacgccgaggccgacgcgctgcggggcaggccgggctgcatccggctctaccccgaggtcttcctgccgctggccaccacccactcgccgggcttcctcggcctgcagaccggcaaggacggcttctggagccgctctgggttcggccgcggcgtggtgattgggctcgtcgacaccgggatactgcctagtcacccctcctttggggacgccgggatgccgccgccgcccatgaagtggaggggcgcgtgcgagttcaaggcgattgccggcgcggggggttgcaacaacaaggtcatcggcgcgcgcgcgttcggcagcgccgccgtcaacgacacggcctcgcccgtcgacgacgccggccacggcacccacactggcagcacgggggccggcttttgcgtggacctcgct

SEQ ID NO: 14030 - DNA, 830 bp, Triticum aestivum
  unsure (1)..(830): unsure at all n locations
  Clone ID: PAT_TA_14030
gtcgagcctcgcgcctactcctccccctccccctcccgagccggcaaccgcggcagcaggagcggcgagaggagggcaaggcgaaggcccaagaggacgcaatggagtacagaagagtgaaggatcaggagagttatgacgccgtgtctcagaaggacatagaaagccctgatgggaggtctctttgctagcactgcagcaacttccccccttggcaccgcagcaggttcgaagggcaagaatagttggaagcaaaagtctattgtaacaattgcattgacattactaacaagttcccaggcttccccccttggctccgcaggaggtgcggagggcatgatttggtgcacgcagcagcctttcgtgacctttgcggcgacatcactctcccggtccccggcactgctgggtctgtggtcagtaagcgctggtgagtaggtatcttctgcccctcctgcagactttgcggtgcttgctttaaaatgtctattatcacttctagccctgtacagaacatggaacagtcaaggtgttacagaagataataggttaagtacatcattttgacgaagttagtgtttatccctatccctgccgcactttacatggtaaagaatctattgcagtattacatcttcgcctatgtgggtgcaccagcttaccagttcctgaagaacctgaatattatcaccccgggtctcttcgtccgtttcatgttaaattagtgaatcatgggcgcattatccctaagtgctggctcacacggcaactaacctcacancagtctaaacccaataaggtganatgcatggaggcctcaatggttcggg

SEQ ID NO: 14031 - DNA, 1128 bp, Triticum aestivum
  Clone ID: PAT_TA_14031
gattcggcacgaggttgattttgctactacagcgtatcgccaacaggttgaggctctagctaaaaaacagttgttggaggaacaggaaagacaagctcttgaagcagccaaagagctagaggaaatgaatgacatggcgagtcaccgcaaaaagtcaaagaagaagaaaaggaaggcaggcaagtttaagtctttaaaaaaaggacgtgtgtcatctgactcagaggccatgcacgatgaaacgtctgtagatactatgagtattgatgacaatgcaccctcgccagagcttatgagtgatgaatcaccacatcatggttcacataagcgtaaaaagatgacacctagaaatgaggaagtgagcagcagtagcagagccctgaagaagttcaagaaagcccctaaatcgaactgtactcctgagtcctcatcacataagcactcgctcgaaggcaagcaactcaagttgatggatgaagtgaaccacgcggccccccacgcggccggaattaagagtgatggccggatttccatgccctccatgccagcaaaacgtgttatggtaatcaagcctgagaggttgaagaagaagggtcttttgtggcctcgagattgtgctttagattcgtggactaccgaggaagatgcagttctttgtggaactgtacatgagtacggtcctgtttgggaactggctagtgactttcttcattccatacctggtggtgcattttataggggaagatatcgtcatcctgtacattgctgtgagagattccgagaattattctgcaaatatgtattgtcagctactgacaatgcaaacagtgagaaggctccttctggtgccgggaaggctgtcttgaaagtatctgaggatcaaactcggatgttgctgaatgtgatcagtgaaattcctaacaacgagttgcttctccagaaacatttcatggccatactttcttctgtttggagatcaaaatgtgctcatgagtcccgacatgttacaagtgtttgttctagtgcaacccataagcctgttagattgagtgagaactggtccatggcaaacgacaagccatcatttaatctggtaaggacagccctcgtagacgcacaggcccaatg

SEQ ID NO: 14032 - DNA, 641 bp, Triticum aestivum
  unsure (1)..(641): unsure at all n locations
  Clone ID: PAT_TA_14032
gccagccagnacacctttttagnatcagaatcagggcagtcaaggaaacgtgcggactattttgctcagcagtatggcaaggtgattgagtatcagatgcttccatgcctggatttgagcaagagcaaagacaaacccaattatgtgcccattgagctttgtaagcttgttgaaggacagaggtacccaatggcaaatttgaataaggacactgatagagcactgaaaggcaaggctttaattaaggcagctgagcggaagtgggagattgagactgcggtcaaagctgaagatgggccttgcaggggagaaatagctcaacagtttgggatatctttggatgtgaagatgatggaagtcaccggcagggtcctttctcctcccatgctgacactcggctcctccagaggagcccccggcaatttaagtatcactccatctaattgccagtggaacctcatggggaagaaactggtagaaggtaaacactccattgctggggcattgtggacttcattgcacggcatctcacaacaagcaccaagcgcttggaacgattaataatatttcccangaatgcttacctggnatcaatgaanaaaaacatcttgtcatcaacgaattagtcacanttcaacatt

SEQ ID NO: 14033 - DNA, 764 bp, Triticum aestivum
  unsure (1)..(764): unsure at all n locations
  Clone ID: PAT_TA_14033
ccacgcgtccggcgcgccgtgcctatcctacctgaaacacctgacgtgagacggccccgcgccaaaccaagcgtcactccattataaactctagtgcgcgggtgcgtgcttcggcccgcagcagcagccagctctggcaggcggtagctagccaggttgacgacgacaaggtccgcggcgttcatccatcgtacgtcttccatggcgccgcagcacttcctggtcgtcgcgttcccgggccagggccacatcaacccggcgcgcgctctggcggagcgcctcgcgcgggccgcgccgggcgcgcgggtcacgctctcggccgccgtgtccgcgcaccggcgcatgttcccctcgctcgcgtcccccgacgacgaggtccacgacggcgccatctcctacgtcccctactcggagggctacgaccacggntcagcctcttggctgggcgacggggacaaagtgcagagatacgcggaggtgttccgccgcgtangtcgcgtgaccttctccgcggtgctggaccgctcgcggnccngggccggccgtcaactnnctccttgtacgcaatctcatntgtttggccgccaaggtccccctttancgcgggttccccgggcgtctactggatncggccggcaacatnctgcctgtncnanaataattcangggtacaaaagtcttacgacaactgccaaccggggttacgggtcatccgggctcctcgatgggatcntnactccgagttttacanctnagacgaagaa

SEQ ID NO: 14034 - DNA, 565 bp, Triticum aestivum
  Clone ID: PAT_TA_14034
aatttcgtcgtcgtcgtcgtcgtcgtcttcttattcttcttctttccgtgtccgtccaccattgctgcttatttctttctttaattctttctggtcatcaatctacctatcctatatatctgcttcctcttcttcttcttcttcttcttcttcttcttcttaacactgaatgacaatgtggcttgggatctccaattccaagcaaggagaaggacaaggagcagtggtcgccatgcttggcctctgcgccatatccatatccatgtcgatgctgcctctcgccgcacctaccatccaccacgaaggaggcgctcaaggcggaggggggaacccaaacccagccaacgcgctggtggcgctggtgaacgccgaccgggcagccgccaagctacccgccctccgcaccaccaagggcctcggctgcatggcgctgcagtgcatcgcccgctgcctcgccctctcccccgccaccgcctgcgccgccgacggcacgctggcgccgccctgccacccgccggagaccgacatcaccgaggtctacgccgccaattgcggggtcgagctg

SEQ ID NO: 14035 - DNA, 672 bp, Triticum aestivum
  Clone ID: PAT_TA_14035
ccacgcgtccggccttctgctacctcatatagtgatcctaatgaagaaacttctgctgaggcatggggtataccacacaagatgcttgtgaagttggtcgatgcatttgctaattggctgaaaagtggtcaggaaacccttaagcaaataggatcccttccaccacctccagcaccaaatcctgcaaacttggatttgaaggaaagatttaaggaccttagggcccagaaaagtctgaacacaataagcccaagctctgacgaagcaagggcatatttccagcgtgaggagtttttgagatactcaattcctgatagagcattttgctatactgctgctgatggggagaaatctattgttgctcctttgcgaaggggaggcggaaagcccacatcaaaagctaggggacatcccatgctcttgcctgatcgccctccgcatgtcactattctctgtcttgtaagagatgctgcttctaggttgcctggaagaactggaacaagagctgatgtttgcacacttctcaaagattcacagtacctaaatcatgcagaatccaataaagaggctgctgttaatcaagttgtcagtggcgctcttgatcgcttgcattatgagcgtgatccttgtgtggctgtatgataatgacaaaaaattgtggacctatctgca

SEQ ID NO: 14036 - DNA, 1369 bp, Triticum aestivum
  Clone ID: PAT_TA_14036
cagggccgcggcccgagcctcatccgccgccggcgcgtcctccctcttccgcccggcactcgcctcgtccgcgactgcgggaccggccaccttgacttcagggctcatatgccagggcattgtacttgtgcccccccgcagggtcgtcttccctgaagaagaccttattgcagccttcatggcagttgttcgctctattgagaggaacaagccatctggtgcaaaggggatatactggaaaacggcatatgtatgctcatcaatgggaccttcaatcaagctaaacatgaaagaaatgctcgactatggcgctgattcgtctaactagatgtcaccacgagcaccaattaagtcatcaggcatttgctaccaaattcacaggcttgactatccatcccttgtgataaatacacaccgagaaacacgactctgggggaacactgggaggtgcttagataccggcatcacgcactctcacggacatccggacccagcactccaagagacgcttaattaacccacgggcagtggtcatggtcggttaaatgtaggactcaaccaaggcaagcacatacagaaggcaatttgtgtagatgctgatattatgggctcagttgacttaattgaacaaataaaaggaggattcatggagtttgacaaattgattgcgtcacctgaatatgatgcctaaggttgccagcttgggtaagattctaggaccaagaggattgatgcccaaccccaaagctggtactgtttctccaaacattactcaggctatcgatgagttcaagaaaggtaaagttgaattcagagttgataagacagggattgcgcacattcctttcggcaaggttaacttccctgaagaagaccttattgcaaacttcatggctgttgttcgctccattgagaggaacaagccatctggtgcaaaggggatatactggaaaacggcatatgtatgctcatcaatgggaccttcaatcaagctgaacattaaagaaatgctcgactatggcgcagattcgtctaactagatgtcaccacgaccaattaagtcatcaggcatttgctgccaacttcacaggcttgaccatccatcccttgtgataaatacacactgagaaacacgactgtgggggaacactgggaggtgcttaggtacagtttttttttagtttcacggacatccgacgtcggcagttaaacagtgccctgatcaacaaacaagcggtattgttggtcgtttgtatttatgagcgaattatgcatgcacttacacatgtatgctcgtccgggggttgttttgtctgatgtttgttgtaatgttcatcattttgtcaatagtcatccttgagcttcagcc

SEQ ID NO: 14037 - DNA, 600 bp, Triticum aestivum
  Clone ID: PAT_TA_14037
tgctgtctactcccccaccgagctgccggccggccggccagccaccgctgctcggagacccgatggccatggacgcatcacctcggctctaccgccggctcaggaaggcatccgacatctccatcgccacccccgcgcccgcctcgtccaaccggatgcgtacgaaggaggaacacagcagctgctgcgaggacaagatcagcagcttacctgaggagatactgatcatgatccttgacaagctagacgcgcgcacaacaataaccaccactgtcctttcaaagcggtggctggatcttcctcggcggtcacacgcattttatgatctttccatttatgatattctccctccacgctaccacaggctgaagaaaatagctatggagactaaggccagctatgaggcggtgaagaggactcagaatctgactgacatctgtgacaagtacgatcggtataatgccatcaaagaccggagtgagcagtggatgtggaaagtccgtctgctcacacccatcctgcaacgatatgagcgtctggccatgcgatgctatgttaaacgggtgaatgcattccttctgcctcccgataatgttcagc

SEQ ID NO: 14038 - DNA, 530 bp, Triticum aestivum
  unsure (1)..(530): unsure at all n locations
  Clone ID: PAT_TA_14038
ccacgcgtccgggagtatgccgagatattcgacatcttgggccacggcatcttcaacgccgacggcgactcctggcgctctcagcgtgccaagtcccagctcctcatggccgccccccgtttccgctccttctccgcacggtgcacccgcgacaaggtggacaagagcctcctccctttcctcgcgcacgttgccgacgccgacgccggcgcacgctgtgacctgcacgacgtcatcctgcgcatgaccttcgacatgacgtgcaacctcgtcttcggggtcgacccgggctgcctgcggattggcctccccgttgtgcccgtcgcgcgcgccatggacgacgtgctcaacgccaccttcctccggcacgtcttcccgcccgcgtgctggagcctcatgtaccgctacgagcttcggcccggagaagaagtggcgtcctcgtaggacatcnacgctcccgccgaacatgcaaacgnggccgtnacnacttggtctctcngaatgctctctcctnanngcgaacaaganat

SEQ ID NO: 14039 - DNA, 694 bp, Triticum aestivum
  unsure (1)..(694): unsure at all n locations
  Clone ID: PAT_TA_14039
ggtccgcggtgctttcccggngcgaccatggcggcggcggcggcggcgggaagtgatttggtggtggttcgcctgccttctccctcggcggaggaccccctgcaccatgataagaagaaattattggaggctaggaaactatcctgttcatttcaagtcccaatctcttcctcccctgttgacgcctgcaaattgcttgaccagatgatccatgctgctagggtcgctcatatggatgagctggagctttattttgctgggggtgatgattatggcccattctctgcacggaatgagcttgagtccctgaatctgcttctcaaaaccgtcaacacattgcttgtagctgccaatgatggcgccaagggcgtccgcccacgcgtccgggatgagatacttgttaggctcagatctgtgggattgacagataagcatcagatggcacttcaaacagagaaccatgaaactgaggattctcttcttaaatggggggagcagcatggtgtcaaaagtaaactgcagatagcattttttgaaggagctgggagaggaatgctagcttctgaagatataggtgtgggtgacattgctcttgaaattccagagtcccttatcatatatgaggaacttgtatggcaggctgatatgtatcttgcgctgaaagaagcgaatagcatctctcactccgcctatg

SEQ ID NO: 14040 - DNA, 1165 bp, Triticum aestivum
  Clone ID: PAT_TA_14040
gccgcgcgagtctaaaaaagggccaagaggagagagagagagcccgagagatccgcggacgcacggtcgccggagaaactgcaggagcccagtcgatggcgtcatcggagaccggccgcacgccggcgcaaggcgcggaagacgcctccgcctccccctggcctctccgcaagctccagagctttgcgccagggctgtggtcacagtacaaagcctacgaggatgtgttagtggagagggctaaagttactatttcggatgcgctagttcttgcgagcgagcatcaagcggaggcaattggatgtgccactgtcgcagggttcatcttgttcagaggccctcggagatttttataccgcaatactctgggtcgttttaaaactgagaaggatttactgaatgatgttgaacaaagtatgatcgaatacaaaacatctattgagagcttgagaaaggattccaaatacaccctggacaaagtagtcattggtgaaagtgatctgcagcgtggccgaactgatttgagatctactggtaagcaaatccagtccgttataagatctatttacaaagcagaatccacagctgcaggtttgatggatcaactaagaattattcctacaagacagtctcttgaattacgagcagaggtggcttccatggcctctggtttgaaaaacaggagacatgtcctggaagaaagggtgaaccgtatatctgaatatggtgtccgcgtctgaatttcgccataaaaccgctcctgggcccctccatggaataaactcaattcactaaagacacacgccttccattgattataagcttcatcttctatggtttatatcctgggttatcaatattactcgcacaaccagtcgttcgacgcccccttatccatttactccctccgcccccaaataagtgacttagctttgtacgggagtactattgcctgtgttgagcattgttcactactgtatctttcatgtgcacacataagaaaggcttaagctatgtgcttcggcattttgcctcctgttaagaatgaatatcattctagtccggaaataaagagcatgttaatctgtcctaaaaatgtgtactcgctggaatttggacgatcaactttgtatgaataaaacatcgcatgaataaaaaatacaaa

SEQ ID NO: 14041 - DNA, 614 bp, Triticum aestivum
  unsure (1)..(614): unsure at all n locations
  Clone ID: PAT_TA_14041
aattgatctaaatcttactggtgttttcctctgtacacaggctgccacaaaaagtaatgatgaagaagaaaaagggaagagtcatcaacatagcatcagttgttggccttactggcaatgctggccaagctaattacagtgctgccaaggctggagtcattggtttcactaaaacagttgctagggaatatgcaagcaggaatatcaatgtgaatgcaatcgcacctggattcatagcatcagacatgaccgcggaacttggagaggagcttgagaagagaatcttgtcaactattcccttggggaggtatggccagccagaggaagttgctgggttggttgagttcttggccctgaatcccgcggccagctacatcactggacaggtgcttaccatcgatggtgggatggtaatgtgaaacctttgagcaagtttgatggaaggttgacatttgccctgtgtagcggacgttttagtaatttgcatcgaacaattttgagctgtagattaggtttccttttcgaactttgtaatcccatgcagaataatcaggtgtgaccatgggggaantcagtgttgcgtcactctccgtttcttttacaaaaaaaaaaaa

SEQ ID NO: 14042 - DNA, 801 bp, Triticum aestivum
  unsure (1)..(801): unsure at all n locations
  Clone ID: PAT_TA_14042
ccacgcgtccgatcacatctggacgggagagaaagagggagagagaagcgaacgggcgcttcgtcaagcgccgggctgcggcacaagatacgagagctttgcgcccgcttgcagcccgtggcgagcgctagagccggcgctctcgatcccctgcgcctctcccgcctcccgcgcttctccttcctccttcgcgcgcaaaaatcagcccgtgccgtcgccccaaatagcttcctcgcgccaaatcaagccttccaaatttccccaaatcgccacctctcccgaaccctagaactgtcgccggcgcacatcaaggagatgggtcagcagtccaaacggacgcgcgcgccggcacctcgtgaagcccctccaccagcgcctctgctcaccccgccgccagcgcatctcctggtcccgccgccggcgcatctgctggtctcgccggcgcctaagtccgccccgccgccggggatcccatcggccttcccttcaaagcagagaacaagcacttggatccccccaagaccacaagatctctggcggctagtctgcagcaaccaagtgaatcgggtcctacgtctcaaggccttgtttgggcaccgcctgcctgcatcggtgactcctacatcacctttggtacatggctggcaatatggactatcctgattcaacaagtatgggagtgtggttctcaaccaacttggtgggtanctttagtacttttaagaacacggaggccccacacaactatgcacaatgggttcaaccgcaacaatcnatgctgggcggtccacatggtggtnn

SEQ ID NO: 14043 - DNA, 548 bp, Triticum aestivum
  Clone ID: PAT_TA_14043
ccgccccgccgccccggcttcctttctctggcgcgcgtgcgttgtcgccgccggtcctgtccgcgctgccgtccggctgcgcggtgcccggagcgcctccggcgttcggccccccggccccgcctctcgccgctctttgggggtggccggttcctggctcccccgcgcccggcagcgcccggcccctttgccaggcgatattgtggcgcccttcccctcctctcgccctgcgcacgcgggagtcgcttgcggcggcccctcaccttgccgtgcggggttggctcccatgggctgctcgctgctgggtccctccttgacctggatcgcgctaggcaagatggcgccgtccggagtgtacaccggcggcgcccggcgcggcgtgctgcaggttgctagggggatgctctgggtactccctctgaagctgagggcggaccgcgtctctcgtcgccgccgcgctgatgacaagtagattgaagtgaatggtgctagagaagaaggagcggtcgggaaagtacaccagtgatgccctgcaaggcgagcaacag

SEQ ID NO: 14044 - DNA, 718 bp, Triticum aestivum
  unsure (1)..(718): unsure at all n locations
  Clone ID: PAT_TA_14044
ccccaactaatctcatcaatcgcttgcgagcgatgaagcgntccactccacctgagtcgccctcaagcagagaggcctgttctccactctctaggaagaaccacgcgtccgagcggattcatctggtgccgggggtgaagcgcttcagcccaccattgacagggcccagcaattccgatgccctttctaggaagaagcacattatcaaacggattgttgttgtgcgagtgacgccaaagcgctcccgccgacctgagtcaccatccagcaacactgatggcgaaacacagtcaactggagatgcctctgcttccatttataggaagaagaaaattattaagagggtcttggacattggccagccgaaggtggacatcgcctcgttgattttcacgccagcaagggatagctgctcttgccactctccgacaaatgaaccccttttagaagaagagtttgccacgtcgaagcaaatgatgaatgacagcataagcaagccagatggcgttgagcctgccaactattgtgtcgatgcaaatccaaggatggacaaattaattcctcctgctagccgcagcaagagcagttcagaagaaagtacatggacacaagagaagatggtaaacatcccaatcctagctacagaagagaagaaggttctaactgaccacaaacaagaacagggaccagaggaattacaaaacctccttgatctgga

SEQ ID NO: 14045 - DNA, 940 bp, Triticum aestivum
  unsure (1)..(940): unsure at all n locations
  Clone ID: PAT_TA_14045
ccacgcgtccgggggaattgcatgttgctgggctgaaatccatcataaaagatattgaggatgttgcccggacttcttcagttgtttccggagtgaatcagagcagttctgctaatccaggaggtggacatccacagattgttgaaggggcatatgcttgggggttcaacatacttacctggcagcgccacttgacttatcttacatggcctgaaatattgcgccaatttggtttatctgctggttttgggcctcagttgaagaaaaggactgaagatgtataccatgacgataatgagggccggaatagtgcggatgttatttccactctgcgaaatggttcagcagctgtgaaatctgctgctttgatgaaagaaaggggctacaccaaccgtcgcaggtctaggcaccgtctgacacctggaacggtaaaatttgctgctttccatgttttatcacttgaaggagacgaaggtctctcgatactgggaagttgcagaaaaaattcagagatctggacttagggaccttacaacaagcaagacacctgaggcatctatatctgctgcattgtcaagggataccaagctttttgaaagaccgcgccctctacatattgnggttaaaactncttatagaaaagacccactgatctgaggcttgggtctcacacacgggaaaaataagggtgnttcaaaatgcacttcggcgtgtgaaaaantggnaaaggatgtggaggatcttnaaggggggatgatgatnttaatgtgccangncnatgatnatcctgtgcgatnaaatgaatttnaggaaaagatgttatgnttnntanacaaaanatctggttgccatgcnntggggcataanganaanaaaagggggttanccttttcntnagcctnnngaaattcnannggntgnnngnnggnananccctgnt

SEQ ID NO: 14046 - DNA, 741 bp, Triticum aestivum
  Clone ID: PAT_TA_14046
ccacgcgtccggcgacctgctcaagcgccaacaagttagccagcattgctgcaacagaaatgtccatgaagctcgccctgcgcgctctcctcctccctctagtgcttggggcgatcctccaccctgccgccgtcgtcgctgtaggtgatggcaaaccaggccgccgtggcggggggcttcagcctgcggctgatacccagtcccggctggaaccgtagcatccacgtcgacgacgacggcttcgtgcatctgaatgaggatgccaacaccgcgcttcggccgcccatgcacacacaagttgggggcacgtacagtgttgtcaccagcgttgggacgggggccggccgacgcacgtacgtcctcgcgctggacatgaccagaaacctgctgtggatgcagtgcaacacggtccaaaggcccctcgtgcgccgccccccgccctgcccccctgcccctgcgccatcttccccccccgttccccgttcccccccaccgcgcgtgcgcggcccccatcggccccctgcgccccacccctgcaacttccggctcccccccacccgccaccacgccctcggcctgtccggcctgctcgccggtcccaccccgcccttcggtgccgcccgcgcggtgcctggggccgctccgggcgcccgggctgatgaacaacactaacgccgtactaaaaaccttaaacgacaaaggctgctaaataggaaggtatggagcaccaacatatgctcc

SEQ ID NO: 14047 - DNA, 389 bp, Triticum aestivum
  Clone ID: PAT_TA_14047
cgtacgcccacgcgtccccccacgcggtcgagcacgcgagagaagacgcgtgggggcgtggctacccgctgagtttaagcatataaataagcggaggagaagatctcccttactaagaaccggcttacttttctgcagtcaacagtttccacataaacatagtagtcagcgtggccctcagaaggccaattctgattgtcagtaaagcaaatctcgacagaaatggtcacctcagagtagcacagcagatcagtacataaatggactacattgaaaagaagcacattacattttggcttaagaaatccatttttgacaccttgatgtacaacacattcgaccacgctagcgttttttttttttttgcatgctatacatttttgtttgag

SEQ ID NO: 14048 - DNA, 948 bp, Triticum aestivum
  unsure (1)..(948): unsure at all n locations
  Clone ID: PAT_TA_14048
ccacgcgtccgcatcacatcaccaggacgtgagcccacccaaagccgtgactagtactagtagtactggttataacctgctctgctccattaacacccacacaacacacgcagagaaattagagagagagaagacagacaccaccggctgtggtaatcaggcaggcacgctcaatcagtgggaataagttgatgatctgtcgtctctaagccaccacgacgcgccatgcctcccatcatggtcttcctccccccctccctattaaaagcccccgcttccttgcttcctgcttattcagcttcaattccccccccgctccgtccaccaccaccaccgcccaagagagagaggcatccagtccctgccgtgccaactcgcagccgcatcgccatccagattctagacccgcagcaagcgtcggatcaaacctccctctagtatttcaagagggctctcctcgccggcggcgcagttcaaagacacacacacagagagagagagagagagagagccgccagatagacagatagatgttgggcggcggcaagatgaagggggacgcggttagcggcggcagcagcagcattagccccatggtgtccttcgtgctgggcgccgccgcggccaccgtctgcgtcctcttcttcatgtccgccagccccggccgcagcctcgtcgacatcgccgcatggagccacaacaacggcaccgccacccagcaccaccacctgcgctccgtcgccgacgccgccgacgccgcccacaacgccaccgccgtcgccgtcgcggctccggcacccgcccccgtccaggcgtcgccgtacggggacctggaggaggtgctggcgcgggcggcgacggcggaccggacggtgatcatgacgcagatcaacgctgcgtggaccaagccggggtcgctgctggacctcttcttcgngnncttccgga

SEQ ID NO: 14049 - DNA, 574 bp, Triticum aestivum
  Clone ID: PAT_TA_14049
gctcagcttctcgccccgcgtccgtctgattattggttgaaaattagtgggaaatccaatcccctcccaatcccaccgctgatcgatgatgctttccgcccccacttgccgatgctcctccggtttcctccgcgactaagccaagccccggtccaggtccaatgtcttcgtcttcgtcttccccccaccaaacctccggctcactccccccacccatgccggacgccctccgctgaccggacccctccgctccttcaacttcctctccgcccaggcccggttctttcttctcccgcgggacgggattcgaccggcggcagcagctcccgctgaggaactccggctgaacccgaggtgatgcgctctgggatgccgccgagcttgattgggaccttttctccgttggtcagccacgccgccgccgccgtttcaagacagggcggattaagcggcgctaactaataatcttctccgcttccccacctgcgcgctaactgcagctccaatgccgccaagattgtagcggacttcgtccctaaccatcacatgctggactggatggtgcccccgagat

SEQ ID NO: 14050 - DNA, 690 bp, Triticum aestivum
  Clone ID: PAT_TA_14050
tcgaccccgcgtccgcgccgtcttgcacggcgtcaccgtggtctcctccgccggcaactccgggcccggggctggcacggtgtccaacaccgcgccgtggctcgtcaccgtccctcccggccccatggaccgcgagttcccggcctacctggtcctcggcaacaagaagcagatcaaaggacagagcctgtcgccggtgcccctgcctgccaacgagcattaccggctgatcagctctgtagaagccaaggcagaagatgcaacagtggcccaagcgcaactgtgcatcgaggggtcgctggacaagaagaaggtgagggggaagatcgtggtgtgcatgcgtgggaagaacgcgcgggtggagaaaggcgaggcggtgcatcgtgccggcggggctgggctggtgctggcgaacgacgaggccaccgggaacgagatgatcgccgacgcgcacgtgctcccggccacccacatcacctactctgacggagtcgcgctgctcgcctacttgaattcaaccaggtccgcgtcgggctacatcaccctgccaaacaccgcgctggagacgaagccggcgccgttcatggccgccttctcctctcagggcccaaacacggtcactccccagatcctcaagcccgacatcaccgcgccgggggtgagcatcctggcggcgttcaccggcctggc

SEQ ID NO: 14051 - DNA, 808 bp, Triticum aestivum
  unsure (1)..(808): unsure at all n locations
  Clone ID: PAT_TA_14051
ccacgcgtccgggcgcataagtgaggcgcaactcatgatttgcgctccactgacccatattgtagtgccctacgtgtgttaattaacgggtgaccacggggctaagactgttgtcgttttcgagcgagatcatgccacagcacatctatgctgctgctactactactcccttcgttcggaattacttgtcttcaaaatggatgtatttagaactaaaatacgtttagatacatccattttcgcgacaagtaatttcgaacggagggagtagtactgagtactagtatacgtcgcaatgataccatggtaagatccgagccatcgactaatgcggacgcaatcatgtgcccgcccagtttgttcaagacgccgtagtactagtataatgtcactcgtactcctgtcctccatcattccaccaactagtaaatactttctccgtccgaaaaaacttgtcgctccaatggatgtgtctagcaccaagttagtgccagatacattgatgctaaatatattcattcgagaaacaagtttgagacaagttttttcggacggacagcaagtctagatagaggtttgtacatcagccacgcaatgatggatggtatgatccgtgcatacaccttatccggacatgtatccatatttttgttgggtccgtccatgtcacatttagatgtgagataatatctcacatctaacatgatattatcttagttgattttttttgtttgttgtctttcatttttgttgttgtccagcctagcgtaatttttgtttttagagaatcacccagcatgactaaaan

SEQ ID NO: 14052 - DNA, 660 bp, Triticum aestivum
  Clone ID: PAT_TA_14052
cacgcgtccgcctccatcaccatccgcctccggcggcggcgccgcccaccctcgcgtcccaccacacaatagccctccgcgccatgcccctgcccctgcccgttcccacctcccgcctcctcgccgccatctccgctgccgcgtcctcaactgcagacctccgccgcctctcccacctcctcctcaccccctacaccccactccccccgctccgctgcctcaataccctcctcatggcgctcgcccgccaccgcatgctcccggacatggagtccttcgcatcccgcatgcccgcgcgcaaccttcgcacgtacaccacccttatcaatgcctactgcctcgccggcgacctccctgctgccaagcggcatcttgcctccctactccgcgctggtcttgcgccggactctcatgcgtatacctcatttgttctcggatattgtcgggccgggctgctttcgcacgcctgccgggtgttcgcgctaaatgccgctccgaggatgtgcacgcactgtgttcacgtacactgctctgctccatgggctgtgtggcgccggtatggtgcgtgaggctgtggcagtgtttgctgggatgcgggcagacgggtgcgcccctgacacacatgtgtatgccacgatggtgcatggactgtgtggggcg

SEQ ID NO: 14053 - DNA, 623 bp, Triticum aestivum
  Clone ID: PAT_TA_14053
cccacaccccccgtccgaaaccctcccggcctccttctggccgccgccgccgacggcgaggtcgccatggccaccgcgacctctacctcctgcaggatagcgggcaccgaggtccccatcacgggctcggacaagctgcggtggatcgacctcaccgtcccctcacccccctccccagcgccggcgagccccgccgacccattcgtctccgtgcccccgcgcgccgcctcggggtgccacgtcgtgttctccggccgcgactcccaacgctacctcgcctggaggattcacgaagaacaccaaaatgtgctcgaggtcattgaactctgtgctttgaaggagttcccaagctctggactgcgtttggtattccaggaggcgctatgtccattcgcttttatgtgtgaaagtgagggtgccaggcgaggcgagtctgtatatctgctatatgtgctcactatttctggagttgctattctgtgcaacttgcgcagcccattttcctatgtatctggttcaatactgtctcaaaatgacatagttggatttaatcttcaaacccacacacagagtgctaaggttacagctgttaaagcgaagccaggatgtctagtaattgggcg

SEQ ID NO: 14054 - DNA, 486 bp, Triticum aestivum
  Clone ID: PAT_TA_14054
ccacgcgtccgctctgctcccctgtcccgtctggctccaacctcccgtcccgacccgcagggcagggcgatgaagtacagcaaggaggccaagcccgagagggcgggcggcggcggcgccggggcgagggccgtgccggtggcgctcatgctgctcctcctctgcggcttctccttctacctcggcggcatctacagcaccggccgcaccttcaccttctcctccaccaccaccagcatcatccccatcgtttccaccacgaaacaggagggctccgcggtcgcgctcgccattgccaggaacggcaacggcgacgactaggtggagttctccgagtgccccgccgactaccatgactacaccccctgcaccgaccccaagcggtggaggaggtacggcaactaccggctcaacttcatggagcggcactgcccgccgccgccggagcgcgccgtctgcctggtgccgccgccgcggggctacaag

SEQ ID NO: 14055 - DNA, 689 bp, Triticum aestivum
  Clone ID: PAT_TA_14055
ccacgcgtccgcggacgcgtgggctgggagggaaatcacaaagtaatggcggcgaacgcgcaaataccgaaagcaggagtcatttaaaagttcgatctgccacattgtcttctgctgaagctgcactttctatgcgtaaatattgtatcgattttgtgaagtcaaaaagtgcgtgctatacggtcagctacatatactctgcttacaagttatatcaggtatgttcctcatgttttcaacgaagaagccgtgaagatactgtcttccacaatacttggcgccttcaatgaaaaggacccattgtgtcactctgctatgtgggacactattcttgttgtttctagaaagtttccagaggcttggtcatattgcaatattcacaaggttgtcctcaatcggttttggcacttcctacaaaatggttgctatgggtctaaacaggcctcataccctctaattgttcagtttttggatgttataccatcggaagttgctacagagaaatttgctattgagttcttacaaaatctttgggctggtagaaaccagaggcagttatcagctgctgacagtttggttttcttcattgccttcaaacagagctttttgtggcttcttaagaaagtaccaagaaattctgtaggagattctacagataatattcacaacaggcttataacgaatgttct

SEQ ID NO: 14056 - DNA, 442 bp, Triticum aestivum
  Clone ID: PAT_TA_14056
cgacccacgcgtccgtcctccccgcctcccggcgttcccacccggcaggtgcctccacggctccaccaccccggacccaagccaactgagcaaagcgcacgccaaagcgaggggctttgcctcgaatcctgggcgagccgagccacgaaccccaccaccgctgctttcgcctttccgttcattccaagaaccgggcgcaggcacacaccaggtacgtacatggagccggcggcggcggcggacggggcctcggacgagccggtgcacaaggggcggaccaactccatcctgctccccatcctcgccgtcctcctcgcctacctgctctaccgctacctccgcccgcgcctccgcggcctccgcctcgaccgcctcccgttccgcgtcccgggctgccttcgccgccgcggcaatgccacccggagcaccctgctgccctact

SEQ ID NO: 14057 - DNA, 520 bp, Triticum aestivum
  unsure (1)..(520): unsure at all n locations
  Clone ID: PAT_TA_14057
ccacgcgtccggctcgagttgcacgaacgcacgccttcttctagctctagacacgcgcgcctcaccggtgctttgctgtccatgcaagcttcttccagatccagctccatggagaggaccagccagtggttgtcgtcgcaggacgtacaaacggacctcgtcgtccgggtcgccggcgccgccttccctcttcataaggcggtgatggtgcccaagtgtggctacatccgcaaaggccgtcgccgtggccacgcgccccgacccgccggcgaccgtcgaatttgagtccgacggctaccgggcggcgccgacgccttccgagaaggccgcgcgttactgctacggcgccaattccaaatatccgcacgcaacgctgctgcgtcctctgcgccgccgcgttcctccacatgcagccggcgacggngctcgcggccgcgntggaggantcctcncgcaagcggtctccngacctgccangcgattgcctnctgccgcctgtnaaggccctcctcanggcgcc

SEQ ID NO: 14058 - DNA, 697 bp, Triticum aestivum
  Clone ID: PAT_TA_14058
cgtccgcccacgcgtccggtcctttttacaccccgtcttttcttcgtctacctgttctccatgaccctccgcttcctcttcctccttccacatcccgatctaatcccatcgccccaacgctctacccttcccctccatggtgagccgcctctcttcccagctagttgcgccgcccaaactctctccgacctccatggcggtgctccctccgtcttatgctgcacaaataccagcgtgatctgggtcgacaggacacaggtgatatcgtcatcaaccgccgcccctggtgcctcgtgcgtgctgaggggcatctacttcggatctggccgcggagcgggaacggtccatcggattgggcggtgattgcaagctctgcctctattcttcacagtaggttctgaatttgaatcggaataaacctggctgaagttgcaatctgcactatggaggatcattacgggctgtggcgagccgtctgctcttcctacagagttagtgtccatttgcactgtactatataattcgttagtgatcatgatcaccttacttggtgttctcgatcgagccgcgtagatggtgactacgttgttgttgctggtggtttgagagaaactgaattgaaaagattcctggacgtataatctgtcaggtatcatctgtaatttggattcaagtttcagatgtcttagatatattg

SEQ ID NO: 14059 - DNA, 784 bp, Triticum aestivum
  unsure (1)..(784): unsure at all n locations
  Clone ID: PAT_TA_14059
cgtccggcggcctttagtctggcgttctcgtggatctgagctcttcctgctggggtggtgaggagtcgacggacgggcggacgggaggttcccgaaatggcgatatcggccaaggagcgcaagctgagcaggcttggcagtggtaaggcggtaaacggaggaggaggcgggagcctcggcgcgaggggtggtcaccggtcgcctgcggcggggggccggcggcgactgttcgccgtcttcttcgtgttcctctgcgccggcgcggtcgtcttcggcggggtgcacgccattggagcgtccttccggccggtgctcttgaaggcctggccgtcggcgaccctgaacgccctctcctcggagcgccgggtgcagcaagctggaggcaacggtgccggcaccgtttcagcgtctgcccaaatccggcatgctgtcgctctgccgggccatcttctcgtaatcctcggcgacggatcattgctgccagctcccgggcagttcgagtgcctctactccactgccaactcaacgcagctgtgtcgtcgtcccctctcagttgctgccttgccagatggaccaagcctcgtgcattgccctgccggaccgtctgagatggctgtgtccctgtcgctgtcccagtcacctccggtgacaccattccaatgagatcagctcgtgtacaccgcacttcttgacagccgggacaactccaccgttgtgtttgccaaaaggatgaaccttcgtncaggccgtctcggtgtgccatcacggtatgagtgtgtctttg

SEQ ID NO: 14060 - DNA, 638 bp, Triticum aestivum
  Clone ID: PAT_TA_14060
aacccacgcgtccgctggaaagcttgaggcgccaggccccgatcgagcaagcgcacctcccttcggagagagaggcagcagccgtccatctccggcgccggctggctcgacctcggccgcagtcatgtcgaagaagaaggcggtgacgacgatgacgctcaaggacttccacggcggctccatcccctccgagctccctctcccctccgcccctggcgtctctgcacgaccgcccgaccgccccacggccgctccgtccgcctcttcgactgcatccgcgcgcccgcggactcccgccgcttcctccgcagcggcggcggctgccgctgtcccttccttcctcaccaatccctcccgcatcggccgccacttcgatgaggacgagcgcacgcccttcgagctggccgcgcctcgccgccctgggccgtcgcccccgtcgttcccatccgtgccggcggtggcccccgctagatctggaccgggtaacgcctggggtgcgaagagggaggtcgctccagccgcgccgccggttgttcctgccgccagcagcggtcagatctggtcggcgacgcgcatcgcgcaggcgagcgctgtggagaaggtaatctccggtaggtggcatttgtccaagccctcct

SEQ ID NO: 14061 - DNA, 2134 bp, Triticum aestivum
  Clone ID: PAT_TA_14061
ttgctgcaggtagccacaccctgcgcgcgccatggcggctctggtcacgtcccagctcgccacctccggcaccgtcctcagcgtcaccgacagattccggcgtccaggttttcagggcctgaggccccggaacccggcggatgcggcgctcggcatcaggactgtcggagcgagcgccgccccaaagcaaagcaggaaaccgcaccgtgggaaccggcggtgcctctccatggtggccaacggtcaccgggtcatggtcatctccccgcgctacgaccagtacaaggacgcctgggacaccagcgtcatctccgagatcaaggtcgttgacaggtacgagagggtgaggtacttccactgctacaagcgcggggtggaccgcgtgttcgtcgaccacccgtgcttcctggagaaggtccggggcaagaccaaggagaagatctatggacccgacgccggcaccgactacgaggacaaccagcagcgcttcagccttctctgccaggcagcacttgaggtgcccaggatcctcgacctcaacaacaacccacacttttctggaccctacggggaagacgtggtgtttgtgtgcaacgactggcacacgggccttctggcctgctacctcaagagcaactaccagtccaatggcatctataggacggccaaggtggcattctgcatccacaacatctcgtaccagggccgcttctccttcgacgacttcgcgcagctcaacctgcccgacaggttcaagtcgtccttcgacttcatcgacggctacgacaagccggtggaggggcgcaagatcaactggatgaaggccgggatcctgcaggccgacaaggtgctgactgtgagcccctactatgctgaggagctaatctctggcgaagccaggggctgcgagctcgacaacatcatgcgcctcactgggatcaccggcatcgtcaacggcatggacgtcagcgagtgggaccccatcaaggacaagttcctcaccgtcaactacgacgtcaccaccgcgttggaggggaaggcgctgaacaaggaggcgctgcaggccgaggtggggctgccggtggaccggaaggtgcccctggtggcgttcatcggcaggctggaggagcagaagggccccgacgtgatgatcgccgccatcccggagatcgtgaaggaggaggacgtccagatcgttctcctgggcaccgggaagaagaagtttgagcggctgctcaagagcgtggaggagaagttcccgaccaaggttagggccgtggtcaggttcaacgcgccgctggctcaccagatgatggccggcgccgacgtgctggcggtcaccagccgcttcgagccctgcggcctcatccagctccagggaatgcgctacggaacgccgtgcgcctgcgcgtcgacaggcgggctcgtcgacactatcgtggaaggcaagaccgggttccacatgggccgcctcagcgttgactgcaacgtggtggagccggccgacgtgaagaaggtggtcaccaccctgaagcgcgccgtcaaggtcgtcggcacgccggcgtaccatgagatggtcaagaactgcatgatacaggatctctcctggaaggggcctgccaagaactgggaggacgtgcttctggaactgggggtggaggggagcgagccgggcatcgtcggcgaggagatcgcgccgctcgccctggagaacgtcgccgctccctgaagagagaaagaagaggagcttctggtgcatggagcatccatccaatctgcagggttctcgtatggggagatagccgcttgttgtagcgaagaagggccgatatatataatatatagacttataagtacttaacttttgttgtgccgcttgcctcttttacaaacaaaaaagaagttaggggttgtgcttgttattgttgcagttgctgttgttgttgttgttgttgttgcaactgttgtttttgttcttgttgttgttgttgttgttgatgcataataatagcatgagcaacattatggatggcttggcacctcgactgctcagggatctgcaacagttgttacaacacaattgttgcaatagctggtaagtactttgttgcaaaacttgtgagcttgcatgcgc

SEQ ID NO: 14062 - DNA, 2390 bp, Triticum aestivum
  Clone ID: PAT_TA_14062
cactcacgaatgccccggctggagtactgtgagatacgctcccgtctaggaagaagaagaagaagaagaagaagaagcagaacggagttccgaagagatcagaccagtcgtctcttgctgcaggtagccacaccctgcgcgcgccatggcggctctggtcacgtcccagctcgccacctccggcaccgtcctcagcgtcaccgacagattccggcgtccaggttttcagggcctgaggccccggaacccggcggatgcggcgctcggcatgaggactgtcggagcgagcgccgccccaaagcaaagcaggaaaccgcaccgattcgaccggcggtgcctctccatggtggtgcgcgccacgggcagcggcggcatgaacctcgtgttcgtcggcgccgagatggccccctggagcaagactggcggcctcggcgacgtcctcgggggcctccccgccgccatggccgccaacggtcaccgggtcatggtcatctccccgcgctacgaccagtacaaggacgcctgggacaccagcgtcatctccgagatcaaggtcgttgacaggtacgagagggtgaggtacttccactgctacaagcgcggggtggaccgcgtgttcgtcgaccacccgtgcttcctggagaaggtccggggcaagaccaaggagaagatctatggacccgacgccggcaccgactacgaggacaaccagcagcgcttcagccttctctgccaggcagcacttgaggtgcccaggatcctcgacctcaacaacaacccacacttttctggaccctacgccatgctatgccgtgccgtgccgcgccgcgcaggggaagacgtggtgtttgtgtgcaacgactggcacacgggccttctggcctgctacctcaagagcaactaccagtccaatggcatctataggacggccaaggtggcattctgcatccacaacatctcgtaccagggccgcttctccttcgacgacttcgcgcagctcaacctgcctgacaggttcaagtcgtccttcgacttcatcgacggctacgacaagccggtggaggggcgcaagatcaactggatgaaggccgggatcctgcaggccgacaaggtgctgactgtgagcccctactatgctgaggagctaatctctggcgaagccaggggctgcgagctcgacaacatcatgcgcctcactgggatcaccggcatcgtcaacggcatggacgtcagcgagtgggaccccatcaaggacaagttcctcaccgtcaactacgacgtcaccaccgcgttggaggggaaggcgctgaacaaggaggcgctgcaggccgaggtggggctgccggtggaccggaaggtgcccctggtggcgttcatcggcaggctggaggagcagaagggccccgacgtgatgatcgccgccatcccggagatcgtgaaggaggaggacgtccagatcgttctcctgggcaccgggaagaagaagtttgagcggctgctcaagagcgtggaggagaagttcccgaccaaggtgagggccgtggtcaggttcaacgcgccgctggctcaccagatgatggccggcgccgacgtgctggccgtcaccagccgcttcgagccctgcggcctcatccagctccaggggatgcgctacggaacgccgtgcgcgtgcgcgtcgaccggcgggctcgtcgacacgatcgtggagggcaagaccgggttccacatgggccgcctcagcgttgactgcaacgtggtggagccggccgacgtgaagaaggtggtcaccaccctgaagcgcgccgtcaaggtcgtcggcacgccggcgtaccatgagatggtcaagaactgcatgatacaggatctctcctggaaggggcctgccaagaactgggaggacgtgcttctggaactgggggtggaggggagcgagccgggcatcgtcggcgaggagatcgcgccgctcgccctggagaacgtcgccgctccctgaagagagaaagaagaggagcttctggtgcatggagcatccatccaatctgcagggttctcgtatggggagatagccgcttgttgtagtgaagaagggccgatatatatatataatatagactaataagtactttaacttttgttgtgccgcttgcctcttttacaaacaaaaaaggagttaggggttgtgcctatgatagtgtgctgaattgtgcttgcattttggtgtggtatattgcaataaacaaaggatttgttaaaaaaaaaaaaaaaaaatgaccgatcgctcgccgtcgatcgatcaagctagctcctcgtcgtctcaacccgcatggtgtttgataatttcagtgagtctttgcgtctgctggttacaatttccaggtccggggcaagac

SEQ ID NO: 14063 - DNA, 2468 bp, Triticum aestivum
  Clone ID: PAT_TA_14063
ccggggtccgcccccattcgggacgaggaacaccagcaaggacactcgcccgccagtccctggccgtcgagaacgagcacgcacgccgcccgatcgtccgtccgtccaccaagaggaggagatcagatgagtgtgggccccgctagcttcagctagccacacgacgagggcgaaccaggagcaggaggagaggacaagcctccccccgcgaggaacgaccttcgctccctcgccagggcccggccggcgactgtgggtacgcgtaacggccctggtccgcccacggaggccgatcagagccgtgaagtcctttctcagtgcaggcagccacaacgcgcagccgcgaaggcgccccgcggcacgccgccggtcgccacccccggggccggcgtgggccaccccgaagcggttcgggcgtacactcgtgttggtcgtggggccccggggccccgcaggcgcgcccgcccggcacggcggcctaccggagcgcgtgcccccccccatggccgccaacccccgaagagcgctgctcggctccccgcccgacgcccagtccatggacggctgcgagacaaccgtcgtctcggcgagcaatgaagcctccaaggtcgcgacgggcgggtaatttcagtgctcctagagcagggtggggcgcgtgttcgtcgaccacccgtgcttcctggagaaggtccggggcaagaccaaggagaagatctacgggcccgacgccggcacggactacgaggacaaccagcagcgcttcagccttctctgccaggcggcgctggaagtgccgaggatcctgaacctcgacaataacccctacttttctgggccctacggggaggacgtggtgttcgtgtgcaatgactggcacacgggccttctggcctgctacctcaagagcaactaccagtccaatggcatctacagggccgcaaaggtggcattctgcatccacaacatctcgtaccagggccgcttctccttcgacgacttcgcgcagctcaacctgcccgacaggttcaagtcgtccttcgacttcatcgacggctacgacaagccggtggaggggcgcaagatcaactggatgaaggccgggatcctgcaggccgacaaggtgctgacggtgagcccctactacgcggaggagctcatctctggcgaagccaggggctgcgagctcgacaacatcatgcgcctcactgggatcaccggcatcgtcaacggcatggatgttagcgagtgggaccccaccaaggacaagttcctcgccgtcaactacgacatcaccaccgcgttggaggggaaggcgctgaacaaggaggcgctgcaggccgaggtggggctgccggtggaccggaaggtgcccctggtggcgttcatcggcaggctggaggagcagaagggccccgacgtgatgatcgccgccatcccggagatcctgaaggaggaggacgtccagatcgttctcctgggcaccgggaagaagaagttcgagcggctactcaagagcattgaggagaaattcccgagcaaggtgagggccgtggtcaggttcaacgcgccgctggctcaccagatgatggccggcgccgacgtgctcgccgtcaccagccgcttcgagccctgcggcctcatccagctccaggggatgcgctacggaacgccgtgcgcgtgcgcgtccaccggcgggcttgtcgacacgatcgtggagggcaagaccgggttccacatgggccggctcagtgtcgatagcgcgccgtcaaggtcgtcggcacgccaagcctaccatgagatggtcaaaggaactgcatgatcctcgacccgccggcataccatgagatggtcaagaactgcatgatacaggatctttcctggaaggggccagccaagaactgggaggacgtgcttctggaactgggtgtcgaggggagcgagccgggggtcatcggcgaggagattgccccgctcgccatggagaacgtcgccgctccctgaagagagaaagaaaaggaagttatggtgcatggagcgtccatccagtctgcagggttctcgtatggggagatatccgcttgttgtagcgaataagggccgatatatataatatatagatttataagtacttaacttttgttatgccgatagactgttaaaaaaacaaaaaagaagttaggggttgtgcttgttatagtgtgctgaactgtgcttgcattttggtgtggtatattgcaataaacaaaggatttgttatgtgttaaaaaaaaaaaaaatatattgaattaaacaaaggatttgttatgtgtttttttgcgctcgtcccttcattggccccggtttttaactttctgattgggaaaaacctgggttcccaacttaatcctttggggacaacccttttttccagtttgggtataataaaaaagcagctgcgatatccttttctaacaattggcggcgttatg

SEQ ID NO: 14064 - DNA, 893 bp, Triticum aestivum
  Clone ID: PAT_TA_14064
tcccacgcgtccgcatcaacatcatatgtgggatgcatgggacatggctgcggagatctgcctttccaagcttcctcatttgattgctgatcctaatgcagagtttcagccgagcccatttttcacggaacaattgacagcatttgaagtgtggcttgatcatggctctgaggataagaaaccccctgaacagttacccattgttcttcaggtcctgcttagccaatcacacagatttagagcacttgttctgcttgggggatttcttgatatggggccatgggcagttgatttggccttatctgttggtatcttcccttacgtgctcaaactgctccaaacaagtgcgatggagttgcgtcaaattcttgtgttcatatggacaaaaattctctctcttgataagtcatgccaggttgatttggtgaaagatggagggcatgcatattttatcacgtttcttgatagtttggatgcttacccggagcagcgtgcaatggctgctttcgttttagcagttattgtggatgggcataggaggggtcaagaggcttgcatgagtgcaggtcttatagatgtttgcctgagacatctgcaacctgagaatcctcatgatgcacagacagagcctttgcttttgcaatggctttgtttatgccttggcaaactctgggaagatttccctgaggctcagttacttggtctacaatcaaatgcacccgaaattgttacatgtttattgtctgagcctcaacctgaggtcagagcctctgctgtttttgcacttggaaatctgttggacattggatctccatcagtgaatggaggtgatgacgactctgatgatgatgaaaaggtgagagctgaaataaatgttgttcgaagccttctgc

SEQ ID NO: 14065 - DNA, 514 bp, Triticum aestivum
  Clone ID: PAT_TA_14065
ccacgcgtccgctcgagggttcggggcatgggggacaccctcgacatgtcgctcgacgacatcatcaccaagaacaagcaccaccaccgccgtggccgccacaacccagcgtccgccgcctcgggaggatccgcgcacccacgccgccgcttccgcagccacaatgccagcctcgagctcactcaaatcttctttcctctctcgtgtgtagcacaggtgccgccggctttcggatatgttgcccagccgatggccatggtgacggcgccgtctgccttggactcgcccaccaagctctacatctccaacctcgactacaacgtctccaacgaggatatcaaggaactgttttctgagatgggtgaaatccagcgctactccattaactatgacaagagtggaagatcaaagggaactgcagaggttgtattttcggcaagatcgtctgccgtagctgctcttaagaagtacaacaacgtgcatcttgatggcaaacctatgaaaattgaagtca

SEQ ID NO: 14066 - DNA, 1532 bp, Triticum aestivum
  unsure (1)..(1532): unsure at all n locations
  Clone ID: PAT_TA_14066
cgtccggtaaatcatcaaatctatgtatacgggggcaaaagatccaatcccccgcccactcctcgctcgaaatcccgtccagattcgttcggagatggcgcgagagggagtaggggcagccatggcgcccgcagcggcggaagtgaggtacgggatagttggggtcgggatgatggggagggagcacctccacaacctcgcccacctcgccggagaagtcgagcgggagcagtccgtccgcgtctgcgtcacctgcctcgccgacccccacccggagtccctcctccttggcctccgcctcgctgcggagcttggcctgccacctccccagacattttcaggtcatcgcgagttgctggacagcgggctctgtgacgccgttgttgtgtcatcgccaaacatgacacactctgagatactcatggacatcattggttatgccaagccgcaccacgttcttgttgagaagcctctgtgcaccacggtacaggactgcaagaaggtcatagaggctgccaaacagagaccggacatactcatgcaagtcggattagaataccggtatatgccgccggtcgctaagctgatagatattgttaaaagtggcacactagggcaggtcagaatggtggctatccgtgaacaccggtttcctttccttgttaaggtgaacaactggaataggtttaattgcaacagtggggggactctggttgagaagtgctgccacttttttgatttgataagattgtttgcagatgcgaaccctgttcgtgtgatggcttctggagctattgatgttaaccataaggatgaggtttatgatggaaaggtaccagatataattgataatgcatatgtgatcatagaattcgataatggctgtcgtggcatgcttgatctctgcatgtttgctgaaggcagtaaaaatgagcaggaaatttctgttgttggtgacactggaaagggcgaggcttttgttccagagggcgttgtgagggttggaaagcgagcaggaggcagagatggagttgtaacgttaaaggccgaagatgaacgaatcaagtaccaggggcttcaccatggatctagctacttggagcacctgaatttcctgtctgccatcagggcacaaggtgcatgtagcccagctatcagtttggatgacggcttactatctgttgcaattggtgtggctggccaattgtcgatcgagaaaggccgtttcgtcaccattgaggaggtgctatcaagctgataatcagcgatttatcgatgcactacagatttcgtatcagttgtatacatctgtaatagcataagctgattttcttcaacttgcatgcacagcattgggtaattgcctgtcttgcgcagtaagctgttaaggaatgttcatgttcccccttttgttctttctaagagctagcgatccacaaactcggcaacgatgatcatgtatgctatgtatgtatgtatgttcctggcttcaaatgatttcagctancngcctttgnttcaaaaaaaaaaaa

SEQ ID NO: 14067 - DNA, 1406 bp, Triticum aestivum
  Clone ID: PAT_TA_14067
ggcagatgatgatgatgctgtaaagcttggacttgcggaaagtagcgctgctgggttggatgtgctttctaatgtttttggggacgacattcttccgactttaatgcctttgattcagcaaaatttggctcggacagatgatgagtcctggaaggagcgggaagctgctgtgttatcgattggtgctatagcagagggatgcatcactgggttatatccccaccttccacagatggttgccttcctaatcccacttctcgatgataagtttcctcttattcggagcattacttgctggaccctctcccgatacagcaagttcattgttcagagccttggccatccaaatggtcgcgaacaatttgataagatcctcatgggtttgcttagaaggatattggatactaacaaaagagtgcaggaagctgcctgttctgcatttgcaacgcttgaagaggaggctgcagaagaactagtaccgcgactggaagtcattttgcagcaccttatgtgtgcatatggaaaataccagaggcggaaccttaggatactctatgacgctcttggtacccttgctgatgctgttggagcagagctaaaccaggcaaaatatcttgatatatttatgccaccattaatcgcgaagtggcagcaacttcccaactctgacaaggatctatttccgctgcttgaatgctttacatctatcgcacaggcactgggaccaggattttctcagtttgctgagccagtgtttgtgaggtgcatcagtcttatccaaacccagcagttggcaaaggttgatcctgctgcggcaggtgcgttgtatgataaagagttcattgtctgtgcattggacctgttgtctgggcttacagaaggacttggtggcggtatagaaagcctggttgcgcaaagcaacttgagagatctacttctgcaatgctgcgtggatgaggcacctgatgttcgacaaagtgctctggcccttctcggcgacatttctagggtctgccctatacatcttcagccacggctccaagaattccttactgctgcagcaaagcaattgactccacaatctgtgaaggatgctgtgtcagttgctaacaatgcttgttgggccattggagaattagcaatcaagattggcaaagaaatttcacctgtggtcatcagtgttgtttcatgcttggttcctattctaacaaccccagagagcttgaataagtcactcattgaaaatagtgcaatcactctcgggaggctttcatgggtctgtccagacattgtggcccctcatatggagcatttcatgcaagcctggtgcacgctttgtgcatgataagagatgatttcgagaaagaggatgcgttccatggtctttgcgcaatggtggcagcaaa

SEQ ID NO: 14068 - DNA, 749 bp, Triticum aestivum
  Clone ID: PAT_TA_14068
ccacgcgtccgggcccagatgagcgccagattcgcgtcccccttggacttgtgagaggtttccatccccggaagcttcccgatccgtccagtcctatcgccgcctccgcgctcctccaatccgatcgcctcgacgccgcctggaatcttgtttgataacccataaaccatgttcaagaagaatgttgatgcaaaagctctacaacgtttgtcaggcgctgacaaaaagaagctgagaagaaccgccaagcaaaggtttccgcaagcatctgatgatgatctggatgccattcttcctccaaaggttgagataacagtcgctaagtacccaagccggactcttgtttatggcatagagggcgaactgccaatgctattcgacattgatggaagaggccatgagctgtttccaacagtttatgcactctggaaggtcccttatctgttgccagcttttacacttaagggtggtgaagtttcacacttcattcttggtggcgccgatcttatgtttcctggtatcagcgtacctccagaaggattaccttctttccaagctggccagccatggtcagttaaagtccctggtaaccctgctccaattgctgttgggaccacaactatgagcaatactgaagcactaaaggcaggattacgtggcaaggctttgcggattgcacattactataaagatttgttatgggcttctgctgatggtcgttatgttcccaatgaaggattttatgatga

SEQ ID NO: 14069 - DNA, 856 bp, Triticum aestivum
  Clone ID: PAT_TA_14069
cctctgaacccggctcaagtgatattgcagttactgatgaccttttgaagctacgggcactctgtgcaaaattgaatgccactgcggacactgttaaaacaaaagccaaagggaaatcaaagtcactgggaggtgatgattttgatatcttatgcaatgtcgaggaacagttagacgacatcatagacaaaatattgtctgagcttagcaatggggatggggtttccacgtttgagtttattgggagtggagttatctcagcattgcttaattttctctcgcgtccgacctttggaaaggaaaaggtggccgaagcaaacctacccaagttgcgtcacctggcactcacgcgatataaagcatttatatatgttgcccttccaaatgatgcggtagggaatcaaactccaatggcattcttagttcaaaaactgcaaagcgcgttgtcttcgctggaacggttcccagttgtgattagccattctggaaggacgtccagtttgggaggatctcgtccatcctctggattaagtgctctatctcagcccctgaagttgcgcctgtgtcgagcagcgggtgaaaaaacgcttaaggattattcatccaatatagttcttattgatcccttggcaagtttagcagccgttgaagatttcctttggcctagaatccagcgtagtgagtcaatatcttatcctgcagtatcatctggaaagaattctgaatctgtggcacctagtgcaacagcaccagtggcttcgtcaactcaatctgtccggcggccctcaactaggtcgaaatcattggctgatgctgattctgcaactaagacggatattcaggaggggagcggaaa

SEQ ID NO: 14070 - DNA, 961 bp, Triticum aestivum
  Clone ID: PAT_TA_14070
cgtccgcggacgcgtgggctttataactaattaaacaaaaagcaagtaagttcctagaaatacagggtgagaaagccagccacaagcagagcaccaagcagcttgaaagcttaaggtggaaaatcttacagttacagatttcttttggccggttccgagatcacattggatcgttttcactttttggcgtatgagatgcccattggtttctttgggctgatcttaaaccccgggagggcttccattgaaaccttggattggtcctcgtcctcgtaccccacaaaagcaatgcccggcttggcttctatcatccgcaccatcccggaaaccagggtattgctggaacaggatctggagcatcatgctcgtggtctggtccggcatgttctggaggaagaggatgttgttcggcggagcagctggctcttgcggaggcttggcaaaacgagaaggttgatgaccagttccattgcttggggcaacaggagcaatagcgccaggttgttgcccatcttcagttcgccgttttttctcagcagctttctcctcttgcttcttccttttctctttaggagcataagacccatctgcttttgcaaaacagtcagactttgtttttgcatattgtacccgcatttttttgccgtaaaaatcgaagtcctgtaggccccggaaagcgttggtagccgctgtaatttcactgaatgccacccaggcttgccccctcagtttatgagttttcaaggccacaacatccactatccttccatactgagagcacaatgcataaagtgatctcttcagctcttctttcttgaccttctcgttgaggttcctgaagtagacggtctggttcgggggaacgtcgccggacagcatcgccaccgccgtcgccgccgccgaagacgaggaggagagaggcgagcgcgaccttgcgccctcgctgtttcgccgacgcgtg

SEQ ID NO: 14071 - DNA, 679 bp, Triticum aestivum
  Clone ID: PAT_TA_14071
ccacgcgtccgcccacccctcccatcgcaacaatgcatggtttgtagaacaaatcatccccatcctcagcattcattcatagcctcggccttagctatcttagagatcttagtctaaaccatcccatcctcaacattatttcacaaccatggcctggctacatataatctcgagagtttttagtccaaatcatcccccatatcctcaaaaaaaattcacaaccatggcctagctactataatgcccatgagtttctagtttttatttaatttattgttaatttgttggagagtttgctgtgtttgatcaaggagatcaaggaggcacgggcatggaactggacatgtataacatggctggtgcacgcggacggcaccgtcacataccacgctgacccgacccaacaacgtggggcgcagtgggcacatcgacgggcagcggccgtgggcgtccatgtctggcggattgctggctcgatccaatacaacgcgcgaccggtgcccgcagacgggcaggcatgcccggacgggcaccccgtcggccctccacggcgcccgggcccgcccccctgccccgccccccccctcccccgcccccagctccgccccggtgcgcccccccacgccccacgcgcgcgcgccgccgctggtcacccgccgccgacctgcgcgcgcgggct

SEQ ID NO: 14072 - DNA, 721 bp, Triticum aestivum
  Clone ID: PAT_TA_14072
ccccccgccgccccccccgctccccccgcgcgaccgccgccgccgccgcccccgccgtccccgcggccgctgcggccgttgggtcgctccgggcccgccgggcctgcgctccgcgcgcgccgcgcggcgccgcgggcgcctcgagctcgggccccgcgcccgcggcgctcctctcctggtgtggcgcgcgagggaaggaggaggggatcgatccaagacgggagctgaggccggcggcgcccttcacacaagcctcaccggcggtgccctctacacaagcctcaccggcggtgcggcgggagagctccgacccgtccataggtgcggggatgcagatccgcgtcgccagcctgtactaggccgaggtggccccgccggcgccggcctcccccgccagcccccccgggccccccggctactcccgctgcacccccgggccggcggggttcctcccggggggcccactgggtggcggggccacgcccgctcggcctcacccctcgctcgccgcgcccggggggcgtggggcgcttcgcggtgcagcccgcgcgcctcccgggggtgctgtctgggtggctgggacaccccagctccgccagactgccggggcacggccatccgggtgctagaggctcttggggttgcagcccgctcgcctgctggaggtacaatgttgattatttagagacctcatcttcatgagactagcaagggatggaca

SEQ ID NO: 14073 - DNA, 304 bp, Triticum aestivum
  Clone ID: PAT_TA_14073
ccacgcgtccgcccccccgccccccccgcctcccccctcgcgcccgccacaactgaacactccatgggggccttctcctaccacgccgcccacatggcggcgctcacgctggcgatgctgctggcattgctgcgggtgtgcgccgccggcaacccgccgttctcgtgcggccagggagccccgacgcagggcctcgcgttctgcaacccggcgctgccgcccgcgcagcgggcggcggacctggtggcgcggctgtcgctggcggagaaggtgtcacagctgggcgacgaggcgccgggggtgc

SEQ ID NO: 14074 - DNA, 574 bp, Triticum aestivum
  unsure (1)..(574): unsure at all n locations
  Clone ID: PAT_TA_14074
gttcagcggttcagccccctgctcctcttcaactcccccacagctcaccaccccgtgggctgctggagcgttcataagcagcaagcagagctctccatactcgctctcctctcactctcgccctcgcctcttcgccatggatcctcgcggcgcgagatggacggctccgtcgctgtgcatggcgctcgtgcttctccaagcgagcatttctgcctgcgcgggagcccccaagacttacattgttcacatggccgcgtcggagaagcccagctcgttcgattttcaccacgagtggtacgcctccacggtcaagtccgtgagctctgcgcaggttgaagctgaggaggaagatggtgcttatgcgaggatcgtctacaactacgagacggccttccatggcttcgcggcgcggctcgacgaggacgaggccgagcggatggccgaggcggccggcgtgctggccgtgctcccggagacggtcctgcagctgcacacaacaagagccccacttctgggcatcggccgggccgggggcaggatntgggccnccggcttgccaacnaaaantcttctc

SEQ ID NO: 14075 - DNA, 988 bp, Triticum aestivum
  Clone ID: PAT_TA_14075
tcccacgcgtccgcccacgcgtccgccgcccgggatccaccgacaccccacccccctcccccgccgacgccactcccactgccgccccagatccagatccggcggccatggccatggcggcggcccgcccgcgcctcctcctcctgctcgccgcggcggcggcggcgctcctcctcaccccggcccacgccttctacctcccggggagctacccgcacaagtacgccccgggggagcccctcagcgtgaaggtgaactcgctcacctccatcgacaccgagatcccctacagctactacagcctgcccttctgcgcgccgccggagggggtcaaggacagcgcggagaacctcggggagctgctcatgggcgaccgcatcgagagctcgccctaccgcttcaagatgcacgccaacgagtcggacgtgctgctctgccgctccgcccccctctccccgccggacttcgcgctcctcaagcgccgcatcgacgagatgtaccaggtcaacctcatcctcgacaacctccccgccatccgctacacccgcaaggacgactacttcctccgctggacgggctaccccgtcggcatccgcgtcggcgtcgactactacgtcttcaaccacctccagttcaccgtgctcgtgcaccgctacgaggaccccaacgtcgcgcgcgtcatgggcgccgccgccgacgcctccgacggcgccgccgtccccgccaacacggggaaggacgcctccgccgcccccggctggatggtcgtcggcttcgaggtcgtgccctgcagcatcaagcacaaccccgaggacgccagggccctcaagatgtacggcaaattccccagcaagatcaagtgcgacccctccaccgtctccatgagcatcaaggagaacgagcccatcgtctacacctacgaggtctccttcgtcgagagcgacatcaagtggccctccaggtgggacgcctacctcaagatggaggg

SEQ ID NO: 14076 - DNA, 645 bp, Triticum aestivum
  Clone ID: PAT_TA_14076
ccccgcgtccgcccaaagccacagcgaactcgagctccccccaatggcagctccgcccatctccggccacccccattcctccgtcgactcgccgctccccaccgacgccctcctcgcgcacccccaactcccctccgcccccgcgccccaggcccccaccgcctcccgcttcctcatcatcctcaccgccgccctcgccgtctccacctcctacctcctcctcctccgcccgcccttctccgccgtgtccgccgccgcctccacctcatccttcgcacggcctctatccaagctcccgaagccgggggtcctcctcatatcctccgatggcttccgcttcggctaccaccacaaggcccccaccccgcacatccgccgcctcatcgccaatggcacctccgccgccgagggcctcatccccgtcttccccaccctcaccttccccaaccactactccatcgtcaccggccttcacccttcctcccacggcatcatcaacaacttcttccccgaccccatctcgggggacaacttcaacatgggctcccacgagcccaagtggtggctcggggagcccctctgggtcaccgccgccgaccagggggtccaggcctccacgttcttctggccgggctcggaggtgaa

SEQ ID NO: 14077 - DNA, 1404 bp, Triticum aestivum
  Clone ID: PAT_TA_14077
ccacggtccgcaaccatgtttttgttctccgggagtacatgagagactgccgcccccgcgtccgcaggagaaggtttcatagcatgattcgaactgataactgccttcagcgaccatcaatcatagaatctctcctaagaagacacctaagcatcatccatctggcagagcagcatatcagtatggaccttactgaaggtatacgggaagtgctcctagcagaaagttttactgggctgttctcaaacctgcaagtatctgagagaccagtagagacaaatggaggaggatctgccatagagataatatgtagttggtacatcgagaacatagtaagagatgcatctcggaccggagttgtttttgatgcaactcatagttgcttcaggagctcacagcccattggtggtggatatttagcggaatcatttacagataaaagagaactcaaagcacttgttcgtctttttggtggttatggaatagataaaatggataagatgctaagggaacatacttctgctctgttaaattgtatcgattcagcactgaggtccaatcgtgatgcattagaaggcctggccggaagtgtaaattctggtgataggattgaaagagatgcaaatctaaggcagataattgatattgaagcgttggccgacttctgtatccaggcagggcaggcaataactttccgtcagctgttggtagaagctgtcggagcagtcctccaagagaaagtacctcttatatattctctactcaagggattgactatgcagttgccagatgaggcgcctgataaaaacgagatcattagattgagaagggttgcaagcagtgttggtgttggtgacaaacatgacgccgagtgggtgcattcaattctggcagaatctacttctgctagtgataattcttggatcctacttccatatctttgttctgcatttatggtgtccaatatgtggagcagtgctgtttatgatgtcaatacaggtggtttcagtaacaatttgcactgcctagcaaggtgtgttagtgctgtggttggaggaagtgaatacactaggctggcgaaggaacagcgaataaattctctttcaaatgggcatacagatgagcttcaagagactgaattgctgagccgtgcctcagctgaatcaaatattaaatctgctatgcaactgcatgtgaaattatctgctgggatcgtcctggattcatggaatgacagtagcagaccacacatcgttccaaagctaatattccttgatcaactctgtgagttgtccccctacctcccccgcggccccgctgaagctcacataccctacaccattctgcgctcgatctatcaccagctgtatggagctgcacaaatgggttcagaaccaacggagc

SEQ ID NO: 14078 - DNA, 779 bp, Triticum aestivum
  unsure (1)..(779): unsure at all n locations
  Clone ID: PAT_TA_14078
ccacgcgtccgcccacgcgtccgggtttctgatttcggtctctcgaagacgggacctgagttggatcagacacatgttagcactgcggtgaaagggagcttcgggtatcttgaccctgagtactaccggaggcagaagctgaccgacaaatcggatgtgtactcatttggcgtggtcttgctggaggtgatctgcgcgaggccagtcatcgacccgacgcttccaagagacatgatcaaccttgcagaatgggcaatcaagtggcagaagaggggagagcttggtcagattgtcgatcaacggatcgctgggacaatcaggccagagtcattgaggaagtacggtgagacggtcgagaactgtcttgcgaattacggcgtcgaccgccctaccatgggtgatgtactgtggaatctggagtttgtgctccagctgcaggaggccggcccggacatctccaatgtcgacagcatgaatcagatctctgaacttccttcagacgccagaaggatgggctctctggagatccgcaccgcagacgaagcagacgaaagccgcacaaacatggttacccnagatgttcgaccaacgatgccttctcgcanctggatttacactgaanggaggtgaactnngctgcattgttcccgtgtcaccaaagatgttttggaaaaaatttnacctggagaaaaanngtccggtgcctgtccanacangtattgttgttcccganaacccttattgcatcaagttcccgaaaaagttttgtcccttggacc

SEQ ID NO: 14079 - DNA, 562 bp, Triticum aestivum
  Clone ID: PAT_TA_14079
ccacgcgtccgctgcactcctcccgcccgcggcacacgactcgcacgcctcactacctcatctccaactctgaatccagatggcgcaggtggtggcggcagcgggcgcggcgggagcggccaggccgctcggcggcgcatctggggccgactcgctccggcccgtggcgaggctgcccttcggcccgcgcgacgtgagggagaggtggagcgggagcgtggcctcaaggggtcgacgtgagcacccggtcgcctcggtgattagcgccgatgccgaggtgctgccggtgtcgcccgacgacgacgcggtcgtcaaggaagaagaaaatttccagcatcttaaggctgtccagcaactggcaacagcagccaatggtgtgtggtctaaaccaaatgttaggcgcaagacaaagattgtgtgcacaattggtccctcaactaacacgagagagatgatctggaaccttgccgaggctggcatgaatgtggctcggcttaatatgtcacatggagaccatgcatcacaccagaaagttatcgacttggtgaaggagtataatgct

SEQ ID NO: 14080 - DNA, 660 bp, Triticum aestivum
  Clone ID: PAT_TA_14080
ccacgcgtccggcctacctcctctgctccccgcctcttcctcctctgcttcttcgctctgctctcccactcccacttctccgccgctaggccgcaccacctccgcctctcggccgaggacgtcgccacggtcgaggcggcgctgccggctcgccacctcgccaaggccaagaccaccttcttcgaggtcaaccggccgctgcacccgccgcgggggagctcggggccctgctccacgctcctcctctcacagtccttcgcgctcactctcaacaagccgccggtcaccaccgcctactcgccgccctcctgcctgaagcggcgggggggaacgtctccctcgccgtcctcgagtggcgcgcccgactgccaaggcgtgcagtacgaaccgcatctttggcgtcctggctcggcggggcggagctcctgcgccggaacaccgcccagccgcgcccgggcggcgtcacgtggtccgtgcacaaggacgtcacaaattacgcctccttcctcgcggccggcaactccacgctcgcggtctacctccgcggccccatcgtcggcaccccccacgccgcctactacgcgaaccgcgcgcttcacctctgcttccggggcacggcccccctgacgtcgggggcgtcggcgcccgccctcctgatcg

SEQ ID NO: 14081 - DNA, 341 bp, Triticum aestivum
  Clone ID: PAT_TA_14081
ccacgcgtccgcccacgcgtccgcccccgcgcccgcccgccttctccgctggtctccgtccgcccacgccgacggtcccgcgcgcccgcccggatgcgcgcccccaggcctctccaaccccaggccgtgccctgggctactttcccaatcccatccagggcgtgacaaatcggtatcatgagccaggcgtttcctcggcggcgagatcgcgcggtgacaagctgatttttttccccttctcccaccctggtttccggcggcggcggtgattgtggacgttggggcggtttttgggggggcgttggaggtggtgcttggtggcgttggaggcggtcgaaatt

SEQ ID NO: 14082 - DNA, 646 bp, Triticum aestivum
  Clone ID: PAT_TA_14082
tcggtgcgtaccatggtcggatgggatgcagctgctcaaagatgcggcagaaggaaaacatttcctccctaccggacttgaaggcattgacacgcttcttggaggtgggctgcgcaaaggccagttgacagaaataaccggccagtcatcttctggtaaaacacaggtctgtctatattctgctgcacatgttgcagccaggcatatgggtgctgttctctacttggatactagtaattcattctcccctagccgaattgctcacattcttgatgaacttcccatctctttgatcaaagagccaaaggatatgaggcttaagagggtcatgagcagtatcatttgtgaatctgtatttgatatatttgctttgtttgaagtactagatcgacttgaagtctcattgaattgcaaggtaactaatggcagtaacaagatatgcctgcttatcattgactcggtatcatctctacttgctcccattatcggcgggaagaattcacaagggcggtcgatgatgatatcagtggcgatgattcttaagaagttggcacataagcacaatctatctgttctggtaacgaatcatatggtcgccgggaatggagctccaaagcccgcccttggtgagagctggaaagctgct

SEQ ID NO: 14083 - DNA, 438 bp, Triticum aestivum
  Clone ID: PAT_TA_14083
cgtccgcggacgcgtgggatcgaatccaacgggaggggacgggtgggctaagatctaccctgccgagggaacggaacggaaggacggaagcacggaaggaaggaggaagaggcggacgccggcgacctcgaaagaaaagacggacaagagatggcgtggcggctggcgctgccgctgctcctcttctactcacccatcctcctctgctcctcctcccaagtccaagacaatgacccctccaaactcttcaagagcgcctccgagatgatgagcctaaggaaatacgacggggcgctcggtctgctcaacgccgtcctcgagctcgaccccaaccattccgaagcttacaggcagcgcgcgacggggcttcgccacagatgcagacacaaggaagctgagagtgactataacaaattcctggagctcaagcccgggact

SEQ ID NO: 14084 - DNA, 1105 bp, Triticum aestivum
  unsure (1)..(1105): unsure at all n locations
  Clone ID: PAT_TA_14084
cgtccgcggacgcgtgggtcgtctccttcgtcttcttcttgctctctccctctccctcgacctcgaatcgagtagaataggatccaacgggactggtgggctaagatctaccctgcctacggaacggacggaaggaaggaggaagaggcggacgccggcgaagagatggcgtggcggctggcgctgccgctgctcctcttctactcccccatcctcctctgctcctcctcccaagaagtccaagacaatgatccctccaaattgttcaagagcgcctccgagatgatgagcctaaggaaatacgacggagcgctcggtctgctgaacgctgtccttgagctcgaccccaaccattccgaagcttacaggcagcgcgcaacggtgcttcgtcacatgatgcagacacaaggaagctgagagtgactataacaaattcctggagctcaagcctgggactgcttcagtgggacaaggaactagctcagctgctgcaggctcaaaacgcattagaatctgcttatagccagtctgatgctggagaattttccaaagtcctggagtacgtcaacaaaatcgtgctcgtcttttctccaggttgcttaaaggcaaagcttctcaaggctaaagcattgctagcactgaaagactattcgaatgttatttcggagacaggatttattctcaaggaagatgaagataacttggatgcgctgttacttcgtggccgagcatactattaccttgctgatcatgatgttgccaacagaaaggccttcgtctagaccctgaacattcagaattgaagaaagcatattttgggctgaaaaaacttctgaagaagaccaagagcgctgaagataatgctgccaagagcaagtttcgcgtggctgttgaggactacaaggcagcactaagcaatggatccaagaccacactttgtacaacgtacaacttcatcttggggctatgtaagactctggttaaacttgggagaagnaagggggcaatcaacacctgttcgggaagcgctcancataaattaagaactttgtttgaagcttttgtcacanagangtgaagcttaacntctaacaaaagacnggga

SEQ ID NO: 14085 - DNA, 413 bp, Triticum aestivum
  Clone ID: PAT_TA_14085
ccacgcgtccgagaatatagggataggaggggaaagaaataagaaaccactcctcatggcacataagaagaacaacacacaggctctatgtttggtagttcttctgatgatgtctagcactttatggtcatgtgaagcaattgcgagaaaccaaggtacaactggattgtggacttcatgtacgcctttccgagcatgccagataccaacgcccaacaatgttgctatgtgcaagattagctgtgaatggcgtggttacagctttgaaaaaagtcactgcgaccgttctatatggtgttgttgcgaatggtgaatgctatggaaatgatggatacaatgtactttcatgtgccaaaaccttgtgctagtaagatatggaaacttaaaataaattatacaaactgaaaaaaaaa

SEQ ID NO: 14086 - DNA, 809 bp, Triticum aestivum
  unsure (1)..(809): unsure at all n locations
  Clone ID: PAT_TA_14086
ccacgcgtccgcccacgcgtccgcccacgcgtccgcaaaatcgccctgctttctcgcacccaatttgaagcttctacatggaacacctcaacctagggccggcagccgcaggagaagaagacaagccgcggtagacatcgagatcagccggagagaaaaatcgaggggacacgatacgagagcaggaagccatggccttcctcctccccaagctcaccacgcctccctgcagatcgccgccgcccagtcccctcaagccccagctcggcctgcccagccacggaggcggcaggctccacggggccggctcggcgcaggccgcggcgccgacccacctcaacctcccgctcctcctcagcgcctcgcagcaagaagcccccacggccaagtccgccgagaccaggaacagggctgcgagcggcggcggcggcggcggcggggacccgcgaaggtcggatttttacctcaaccttggggcggcggtgcgcgcgctgcgggacgacctgccggccgtgtttctccgggaacccaactacgacatctaccgcgaagacatcacatttgttgatccgctgaacactttccatgggattgacaactacaaaacaatcttctgggctctcagattccacggacgtctactattcagtgaaattgggctcgtgttcaccatttggaactaacaaaactcnatantntcggtgggaatntgggnanacgcgttcccgtggaacaatggtgctcantggaatcaagtaaaatcaanggacgggaanttcncaaantcaaaanttgaatggctncccgcg

SEQ ID NO: 14087 - DNA, 1001 bp, Triticum aestivum
  unsure (1)..(1001): unsure at all n locations
  Clone ID: PAT_TA_14087
ccacgcgtccgcccacgcgtccggtctatggcaaacctccccgcgagccgtccgatcaagtttgatcatgcggcgctggcgtctctctctcgcatcatggacacagtctcgttggttcgaccacgccgcaaccacgcggtgtctcacgaacaagaaagccgcgacgtcagatctagcagcagctgatgcgagaggcgacgcggcggccagcatctggagcagcaaagccatggcgacgacagggaagtggaggcgtggtgacgacttagagcatcgaccgaccctctgccgcacagagcctcagcaatgtgatgatgaagattctactgatggatgattatcaacatagttttcaacaagccgcttctatacaattgctcagaaaaatcaagggcggtcttaagtgactgctgctagccagggctgcgtcgggcgcccgttgcggcgggcatcgaccatcctgcgaggggccgtggagtggctgttgtgaaccggccgcggacgttgcgactggtgctgcgaaggggacacgcggtgggccagattattgctggttgctatgacactgagtggtgagcggctgggccagagacttgaagcatcgcctagccgtcggagcatcagcggtgcagcaaatggagcattaccagtgcttgcgatggagctttcgataggtcatcggagcatcatcgggccggcaacagtgcttgcantggaacttttttcgggtttgtcaaaagcttggccggaagcattttccggtgcttgnaaccggaacattcgtcgggcccgccaaaacatttgtcagtgcttcaatggaagcttnttcgggnttgncaanaacattcgccggaaccatttttccggngctttnnaccggaaccattctttngggcccgccaaaaananttnttaangnctttcaannggagccnttttcaaggttggcaaaaacattncccggaccatttnaaggncctngnaaccggaccattgtcacn

SEQ ID NO: 14088 - DNA, 1001 bp, Triticum aestivum
  Clone ID: PAT_TA_14088
cgtccgcggacgcgtgggccgccgcctccgcagcagccctcttcgccggggtgacctcggtgcggcggcgttgcgtccggacctctctccggggaaggcgaggcaggacgggccatcatttgccgtaggggcggaggtcgcgtcggggggagggtgctctagggtttcctgcctctgcggcgggcgggatgtacgtgccacggccctcccgctccgatggcagccgagacgccggcgagcagcctagggtttaccaaggtttggcgcggaaacaacgaattcttcttgcaagggaggcttatatttgggcctgatgcgagatccatatttcttactatgtccctcatctttgtaccagtggtggtgttctgtgtgtttgtcgccagacacctcataaatgactttcctgatcactgtggtatctcagtgatggtagtggtggttgtcttcaccgtctatgatttgacgctacttcttcttacatctggtagagatcctggtataatacctcgcaatactcaccctcctgaacctgaaagcatctatgggagcaattatattagaggtcaaacaccgctccgtttgcctcggacaagggatgttgttgtaaacggaattaatgtgaaggttaagtattgtgacacctgcttgctttaccgaccacctcgatgctcacactgttctatttgcaataactgcgtggaacggtttgatcatcattgcccatgggttggccaatgcattgggcagcgtaattatcggttcttctacatgtttgtattctccaccatgttaatctgcctctacgtatttgccttctgttgggtgtacataatcaagattagtgatgctgagcagttgtcaattgggagggcaatgttaaagacaccagcctcagttgttctgattgcctactgttctctttgtgtgtggtttgttggtggtctgtctgtcttccatttctatctgatgagcacaaaccagacaacttatgaaaattt

SEQ ID NO: 14089 - DNA, 576 bp, Triticum aestivum
  Clone ID: PAT_TA_14089
ccacgcgtccgcccacgcgtccgcacccgggccccttcccctcgcatctcttcctcccgagccccgaccccaggctagggttccatacgccgccgccggtgtctcaccccctcaccacacacgcatctctcctttccatccccacctgaggtcctcaatcgccatctcgaggtccgagaagagagggccgccgcaccgtcttcctcctccaccgacctccgaggcgccctactcgtgggacgacgccgccgccgccttgtggaaccccagggcagggcagggcgtggtcgagttgcgggcagggaagagcggcgccgacgccgtgcgtagccagttcgtgcgaggacaaggactgcccgccgcccgggccgcgggtgaccaacggacgtgggagctgctgaagcggttcctcaaaatcatgtctattaagtgtttccttctctctctctccccccctccatatttatatatgcttgatcgctccggttttattcccttgcatgattttcgctgccgcgggccttgtgctgccactgatttgggccaccttgtttatgattcgtgcacgcatgtgtt

SEQ ID NO: 14090 - DNA, 1513 bp, Triticum aestivum
  Clone ID: PAT_TA_14090
agctcggcctctgctgtgccgtcttcgacttctccgatccggccaagagctccgccgagaaggacatcaagcggcagacgctgctggatctcatcgacttcgtcgactccaccaccggccgctacccggaggccgtcatcgccgcctgctccaggatgctcgccgtcaacctcatccgggtgttccccccgagctacaggtccggtggctcgtcatccggcggcggcggcgagggcgacgaggacgagccgatgttcgaccccgcgtggtgccacctgcagctggtgtacgagctgctgctcaagttcatcggatccaactccctggatgccaagatagggaagaagtacttcgaccactccttcatcgtcaggctgctcaacctgctcgactccgaggaccccagagagcgagactccctcaagaccatcctccacaggatctacggcaagttcatggtgcaccggccgttcatccgcaaggcggtgagcaacatattctaccacttcgtgttcgagacccagcggcacaacgggatcgccgagctgctcgaggtgttcggcagcatcatcagtggctttgcattgcctctcaaggaagaacacaagatctttctctggagagttttgattcctctgcacaagccgaagtcagttggggtgtatctccagcagctgacatactgtgtgacacagtttctagaaaaggaccccaagcttgccggatcgataatcattggtctgctgagatattggccggtgacaaatagccagaaggaggtgatgttcctgagtgagattgaggagatcctggaggctaccagcatggtggagttccagaaatgtatggttccgttgtttcggcggatagctcagtgcatcaacagttcccacttccaggttgctgaaagagcactcttcatgtggaacaatgatcacatcatcagcctggtggcacaaaaccggcaagtgatcatgcccatcatcgttccggcgctagaacagaacggccagaaccactggaaccacgcggtcctgaacctgaccgccaatgtgatgaagatgttctccgagatggacgaggaactattctcggcgtgcctaacaaagtgcaaggaggacgaggaaaagcaggcgtcgatgtaggagaagcggaggctgaagtgggcgaacttagagtccgccgcagctctccagccagtgactggccacaccgccgtcctggtggggtggctcaccgtccggcggcctgtcccgcgcccccgcctcctgcccgtggcgggtgcttgggccgcccggcggcaccccagtgggggtcctccccgcgtcgctgctccgcgccccagcgctgtccgcctccagggctcgtcgttttgctttttttctgtacgttgtaactatgcccactatgtgtatgctttagaggcaaatgtacctgtgagcgagcgccttgtgctgagactcattacctgtaacttttgcctgtttattttatgaacattatcctagagcct

SEQ ID NO: 14091 - DNA, 283 bp, Triticum aestivum
  Clone ID: PAT_TA_14091
tgattttcaacggccgacaactctatgatatcatggtggagcgtgctggaccgtcggaaacaagtgggccaggtccttgagacagacgacgagttgtgctaagttccatgagccaaaatcaatggtgtcttcactacgcgtgttgacagatttgaagaaactacttcaatgcatgtattctgtgttttgaattatctactccttgaaaacaaaagatgtacaataagcatgttaaagtcgatacgtgagataatgatgtaagagcatctccaacagagttggt

SEQ ID NO: 14092 - DNA, 848 bp, Triticum aestivum
  Clone ID: PAT_TA_14092
cgtccgagaccactctctagttatcttctgccctctacctcgccgctccgaccagagctagaggaggagtggtttcagccggtccatcatggagcactgcaaatcttccgcgcaagggacgttttgctggtatgaggagacgtgtccggtagcaacattgaagcacaccaatagcatctgtgtttggaagaaagaccgcatagaagaccactagagaaacggtcgtcccgtacccagactattgattaccgatcgctatacttgggatatgtggtgtgtttgcatatgcagacaatttatttgccgctagacctgaagagcctactggggctgcttctcttgtttcagactactagagttaggttcgtctttgatgatgattccctggaagtgaaagtgggcaatcagctgcaggagtcaggcgaaaacgtgtttgttggtggcaagaaccgttggaagtactcaacatttgtgaactgggaactatggtggccgcaatttcctatcctagtttacttcaaagagacccaaacaaaacccgaaggccaaattcatttcttcccagtgattttcaacggccgacaactctatgatatcatggtggagcgcgctggatcatcggaaacaagtgggcctggtccttgagacagacaacgagttgtgctaagttccaggagccaaaatgtcttcactaagcgtgttaacagcccttgaaaatctccatgaatgatttgaagaaactacttcaatgtatgtattctgtgttttgaaatatagtatcctactctttgaaaacaaaagatgtacaataagcatgttaaaattgatacgtgagataatgatgtaag

SEQ ID NO: 14093 - DNA, 980 bp, Triticum aestivum
  unsure (1)..(980): unsure at all n locations
  Clone ID: PAT_TA_14093
gacgagcgagcgccgcgagaggagaggagcaccagccatggcgaccactctctcgttatcttctcccctcgtcctcgccgctccaccaggagccagggcggcagcgctctcgttatcttctcccctcttgctccgccactccgccgagcagctggacttgtggtttcaggtggtccatcatcgggcactgcaaatctaccatgacagaggcattttgtgggtatgaggagaccgggcaggaaacaccactgaagcaccgctcttgtatctctgtttgggagaaataccgcgaagaagaccaccagagaaacggtcgtcccggacccagactatcatctacctaccgctgtacttggtaggtctactgggatatctggtgtgtttgcatatgtagaaaatcttcttgccgctgcacctataggcctactgggactgcttctcttgtttcataatgctagagttaggttcgtctttgatgatgatttcctggaagtgaaagtgggcaatcagctgcaagagtcaagcgaaaacgtgtgtggtcgtcgcatgcccagctgagtgtactcaacatttgtgcactgggaactccggtgtccgagcggccgcccgggcaggtacttcaaagagacccaaacaaaacccgaaggccaaattcatttcttcccagtgattttcaacggccgacaactctatgatatcatggtagagcgtgctggaccgtcggaaacaagtgggcctggtccttgagacagacgacgagttgtgctaagttccaggagccaaaatcaatggtgtcttcactaagcgtgttaacagcccttgaaaatctccatgcatgatttgaagaaagtacctcggccgcgaccacgctaattttgaaatatagtatcctactccttgaaaacaaaagatgtacaataagcatgttaaagttgatacgtgagataatgatgtaagagcatctccaatagagttggtnn

SEQ ID NO: 14094 - DNA, 695 bp, Triticum aestivum
  Clone ID: PAT_TA_14094
gtcgacccacgcgtccggcttgaacttctaatgcaatcgctgttcttctcacgggctagcatttcagacggggagagttcaaaaaacttgtcttgcataaaggttgctgggctgtttctgagggacacattttctcgtcctccatgcacattgatacaaccatctatgcaagctgttccacaagaacccgtgcctatccccgcgtccggtcaaagtttctgtcctccgggctatccatttgggaatcagctcttggaattcgctgctggaattcctttgttttccctttattgtctccagaccactccttctccatcacctccaaagtttgcttcgaaaacagtcatcacatgccagcctcttatggtgacccttcaggaacaatcctgcttaagaattgcctcattcttagctgatggagttgtgcccaatcacagtgccacagttgctgattcctcaattaacagcctgtcgttttctctcaaagagttcgatctatctgttccgttagatgctgaagaaattgcaaggtgcagtggaaccaagaccgcttgctcccagtcatcattttcaggagcaagactgcatgtagaggacctacacttctgcgagtcaccatcatcaaactgttcactactaaaccttgacaaagatccagcttgcttccttctttgggaatatcaacctgttgatgc

SEQ ID NO: 14095 - DNA, 901 bp, Triticum aestivum
  Clone ID: PAT_TA_14095
cccagccccaggcccagtgacatgccatacacccaccacccaagatcgggacgccgccatggccgcgcttagggaccggggggacgccgccattaagctcttcggccgcaccatcccgctcctcgacgccgcggccgaggttgtcaccaagcttggaaatgatgcaaacagcaatgatgtcatgccttgtgtctcaaacaagcttttgaatgtcgaagcaactcctttctgttccaagaatagagagcagaatgatcaagctatcagcaaacatggggtggaagtgagaactggtttcaaatctgaggagattaaaactgggtctgatggatctggccaagacaaggtactcaagaagcctgatataatcgtgccatgccctcgctgcaatagcatggaaacaaagttctgctacttcaacaattacaatgttagccagcctaggcacttctgcaggaattgccagaggtattggaccgctggtggaaatattaggaatgtccctgtaggttctggaagacgcagaaataagcatgcctctcacttccgccatgctatgatgtcatgtgatgctaacatagctgctcccggagatgtttccaatgagatccaccatctagctcttccacttttaccgcaggttcttccagggccaattaaagaaaatgaaacagtaaaggagttcggatctcaagtgccagtttgtaagcctatgtcctcaatccataatattgaagaacagaaggatactcaccttgttgccttggcctctggtgataatagcgaagaacaatcatgtccatctccagcgacagtgtcgggttgctcagaaaatcagacgccggatagcgcagttaaaaaagaaccaagcaatgtgttaggatactataatggcatcaca

SEQ ID NO: 14096 - DNA, 724 bp, Triticum aestivum
  Clone ID: PAT_TA_14096
acgcgcctccgccgtctgcaagcgctggcgatgcggcgtcaccgaccccaggttccaacgccgattctgccaacaccaccggaagccgcccctcctcggcttcttcaagcacagcgtcgatggtatcgttttcaaacctgtcctggaccctcccgtccgtatccctcctcaacgcttccacatgcgactccacggcattgacagtggccatggcacgggggttaaactgctggggtgccgccacggccgcctcctcatcatgccctggcaacggtcagagcttattgtaattgctcccatcaccggcaagaagctctgcctgaccgttccgtccaagttcaagggggactgctaccttgatggggaggtgctctgtgctgctgctgaccatggacacgtgcatggaagctgccactcaagcccattcaaggtggttttgctgtcgacgagcacctaccgtcatggtccacagcccgcctttgcatgtgtttactcctcagagactggcatgtggagcgatcttatctcaacgccgactccatgtcagcttcatggtgcttatattcatgggtcacttattggtaattcactttactggatgtgcactcacagaatgtatatatttgagtttgatttggatggtcagagcctagctttgatcacagtgccctccaaaataaatgatgtccgccacaactatgaccaacgtgagatcattccagat

SEQ ID NO: 14097 - DNA, 871 bp, Triticum aestivum
  Clone ID: PAT_TA_14097
ccacgcgtccgagtaacgtaagacggaacctttcgtatttttcaaatgggagagattatttggtttgtaggtgtcgatattttttttctactaacttggtcaaattttacaaagtttggtttatgacaaaactaatgtgcaatgcattgcgaaatggagggagtatctgtagaagtcaaacttggcttctaaaagctgatactgtatttgttgtgttttgcatgtggatgcatacattttgtgaccgcccttcagtagctgatgttgtatgcgcggtccggattcccgggtcgtcccacgcggccggcgaaattttaatcgcgcgtcttaacatgtattcatctaaaagtcatacagaagctgaaggaaatttatgatagacataatggcatgtcatgaaatttctaaatccgaatttgacacatggcctgagatataaagaagtcgtgctgtgaatagtgccaagttgggtacttctactcaatatttgaatctggtaatattcaaagttggatttatttttcttgttctaagatcaattatttgaaattttgtactccacatgatgtgcacgtgatgtctatgttgttaataaaaggttggaactttttaatgcttttagaggtcatttgtaggctcaggtgcaccaggtacaccacaatcctaggtgcacaagacacactgttgtatatacatgactgtttgtaggtctttatacaacctgtccttgctatccatctttaaacatgtggggcattagaggtacctatgaaatcgacacacttaatgctaagcagataaagtaacatagatttcagacagaattttctgcttcctagtaaattaattagtcatttctactgaatcttcc

SEQ ID NO: 14098 - DNA, 789 bp, Triticum aestivum
  Clone ID: PAT_TA_14098
gcgtccggtttgatcctttacagtgtacaagaaacaaatgctgacccactttggtgaacttgaaaaggtctctagctactggggttctttgttatgtgatggagaaggccgttcttttgtctcggctgcttttctggaagctggaatcgtggagtataaatatggtcgagttgatgcttcaaggctgcacctcgcgtccgctcaagaggcatgtgggattcatctctctctcacagggattcttggttttcgaacaatacaccaggtggacgccaagtcccaaatggttctagttgcgaagacttctaaaccagcacctgacgatggccaatcaacagagctagcaggacctcagagtgatggtgtggcttccagaaaagcgacgagctctgttccagatgaaagtggtgaattttgtgatatactaagaacaccaagactggctgaaaatgggaatggctcgagcagtgagagtatgacatctgcaaacacacagataccgctatctgctatccagcaggccgctgtacttgcacaatgtttacatgtgagtcggaggagtcggagtgatgaaatgtctgggtggggagatggcaccatacatagagtcaattgattctcaagacaagtcatactttgtggtcaggagcttgtgtgatgttctgcgtattaggtggggagtccacccgcagtcggacaaaacagcgggcactgttaatgatggagaatttggttgaagatattgccaaagaatttcctgtagtttcacaaagagccaaactggttttt

SEQ ID NO: 14099 - DNA, 616 bp, Triticum aestivum
  unsure (1)..(616): unsure at all n locations
  Clone ID: PAT_TA_14099
ccacgctccaacctctccctcctccgccccccgtctttctcccctggtctttggcagattttcctccacccattccctccctccctcctcctctccacccgcatcgatctctccgaattctgtccccccacctagctgccatctctccccctccaccgattgattggttcttcctccgtttcttgggctgattctccctctccatctgtgtcttggcttgagaggatcggcaggagaaacaaggtggatgcgaacaagtgctaggattgtggctccggcgagctcttgaatatctcgggaccgcttcctgctacgagtctcacttgaatcgctgggaaagaggcgagcagcatctgacatgctattgccgcagaacaatctgtagaaggacacccctttaccctttcgataatgcaagggcagaggaattccgtcgaacagctatccgacgtcttcgggtttgaccatgggtctggttcgggcaaccccgtcatggaccagcaggcgtactggaacagcatgcttggagcggcagagtcgcagaacctcccangttacgagatgaaccgcggtgacggcgccattccgtatggaagcgaggcgcatcangatggcc

SEQ ID NO: 14100 - DNA, 1114 bp, Triticum aestivum
  Clone ID: PAT_TA_14100
tcgacggaaacccttcaggcgatcacttcccctcctccctctgggccgccatttctctcccctcgcgcgtctcccagggtttgccgatccagcgcgcgttagggttccctattccggcgaccatggcgaacgagcagccggcggagacctacacggtggaggagctcgtggcggtgaacccctacaaccccgacatcctcaacgacctcgaggtctttgtcaacgagcaggtttcttctaaaacatataacctggatgcaaatctcagccttctacgcctttaccagtttgagccagaaaggttgagcgtacaaattgtagcccgcatattgatcaaggctctcatggcaatgccagcccccgacttcagcctatgcttgttcttaattcctgaacacgtgcaaatggaggagcagttcaagacgttgatagttctttctcactacctggagactggtaggttccgccagttttgggatgaggcatcaaagagccgtaacatactggatgttgtaccaggttttgagcaggcaatccaaagctatgcgattcatgtgctttccttgaacataccagaaagttccaaggccagttctagccgaggccatcaacattgaagggcttgcattggacaagtttatggagtatcatgctgcaaactcaggatgggtcattgagaagggtgcacgctcccaactgattgtccttccgcgcaacgagttcaatcaccctgaactcaagaagaacacagctgacacagttcttttgtcagcacgtgacccgcatattccccatcttgagctgattcaagcaaccatgatcaagattgacatcaagcacttttgtctgtctcggctgcacccagaccaactgaggaggtttaatagaacttgagccagtgaagaagctagtcttggcaattgtattctctcttgtatggtgtaccgcattttgaccactcggagtatcggatgcgcctgttttagctaaatgagtaccagattatgttttcttattcatttctgccgaatgttgcaattgcctgacatttcctgagcgcacctttcctgtcaaatgttgcaatcgcctgaaatatcatgtttgcgtttttttg

SEQ ID NO: 14101 - DNA, 1051 bp, Triticum aestivum
  Clone ID: PAT_TA_14101
ccacgcgtccgaccgccctgcctctcccctcctctcttctcttctctccactgcccagcctttgccatagacaagaacctctaggtagcttacctccagagcagcaatggccatgcaccctctctctcaggggcacccacaggcctggccatggggggtagccatgtacacgaacctacactaccaccaccagtacgagagggagcacctgttcgagaaacccttgacgcccagtgatgtgggcaagctcaacaggctggtgattcccaagcagcacgcggagaggtacttccccctgaacggcggcgactcccccggcgagaaggacctgctcctgtctttcgaggatgaggccggcaagccgtggcggttccggtactcgtactggacgagcagccagagctacgtgctcaccaagggctggagcaggtacgtcaaggagaagcagctcgacgccggagacatcgtgcacttcgagagggtgcgcggccttggcacaggcgaccggctcttcatcggctgcaggcgtcgtggcgagagcgcgccgccaccacctgtacgtgtacctccgcccgctctgaacgccggggagcaacagccttggagcccgatgtgttacagcacgtcaggatcataccctaccagccctgccaactcccacgcctatcgccgctcggtggagcaagatcacagcgacatgctgcatgcaggcgattcgcagagagaggcagacgccaagagcagcacggcatcggcggcgccgtcgagacgtctccggctgttcggcgtcaacctcgactgcggtccggagccagaggcagaggcaataacgccaacgtacggctacacccaccagagcccctacgctgcagtggccacggtgccaagttactgttcataaagatgatttggtttgaagccattcttgaggatcctgacaaccagcagtgaaactagtttctaccagcctactaggctaccctggaccaagtgacaagcttgaattgaccctttgaaggaaaaggaaaaggaagaggaagtggaagatccc

SEQ ID NO: 14102 - DNA, 491 bp, Triticum aestivum
  Clone ID: PAT_TA_14102
gtaccgggccccccctcggagctgcccacgcgtccggtaatagagtggccgcagtactgcaaccacatattgcagatctcacatcttcgtggaacacatgccgagttagtctctgcaattgagcaggcacttgccaagatatcatcaagtcaaaacgaaccaaatattggcaacatattttctgtggatccgcatggttctggttcaccatctatcggaaacacagaggtttctgacccatcatggcagttccccgtgccgactgcggcacggcttgaacggtcaccttcttttccactgcaacagaggtaccagggttttcttggggagaggtccaaaggttctacaaacagcgtccaagctaagaacattctatctatcagtcaacctattgcttcaacacctggtgatttgtctatggctccgaaagctactgcaccaccatccttacaagcttcttctcatcattctgccactatttcagcttcttc

SEQ ID NO: 14103 - DNA, 752 bp, Triticum aestivum
  Clone ID: PAT_TA_14103
gcacccgcccctccgccccctcctcccgccccgccccctcccggccgcccgcgcctcccccaccgccgaggcctccaccacgtattccccacagatttctgcaggaatccatccaatttgcgccctctcctttccgcccggtccaattcgcctgcaagttttggggggaaacagcgattttctcgcctttcgctttaccccctttcccttttgaccccgcgcggttcttctttttacgggtgccgccgatcggaaaggcgcggtcttcttcgtggatttcggctccggatttgatctggttgatgaatgatggatttgcgggacttctttagcgcggtttgatcggggccttgttcggccaatccgttatgattaagcaaatcctgggcaggttacccaagaagccggccaagtccggggagaaggatttcgctggagccggctcgtcgtccctgtcaagcccgacggcggatgcaagaaccaccacagatttgaccatgtctagtaggattggcaatccgaacaattatgtcacgaatcctgggcagagttacagcaacaggaacgctggtgttggtgcgggtgccagcaatggtttcatggccccgcctgtgtatgaggcgctcccgagcttccgggaggtgccgccttccgagaaacctgccctgttcctcaggaagctctccatgtgttgcgtggtgttcgacttctcggaccccaccaaggacgtgaaagagaaggaggtccagagg

SEQ ID NO: 14104 - DNA, 635 bp, Triticum aestivum
  unsure (1)..(635): unsure at all n locations
  Clone ID: PAT_TA_14104
ccacgcgtccggcgatgcctgtgacctagcccgtctcccccagcgaaccccgcctcctctcctgccgccgccgccgcgcccccttcttcccttctccatgctcgccgctgccgacgccgcgtctgccagccgccccgcctcgagccagccgccgttcggtaaaaacctaacctccacacccacgcccccaccagtccctccctcctcttcctcgacctccctcctagctgcctccgcctcccctccgcggtcgacctcctcgttgccggtgatgctccagcgccttggcccggtcgtctctgtctcttgccgtgctctctcatgctgctgtgcctcctggacgacgctcgcgtgcctcggatgcacccccttctctcccgagctccagatccatggctgcagcggcgagccccgctgcgctctcgcgccccccgcgcacctcctactaaatacccttttttttgttcaaataccaaaatactttgtcagggttgtcaatggaaaagaagcaaccttgttatttagttcagtccaccataaagacagctcaggagacaaccttcttctgaaatcattgatttgtttttttttagaaaaggagtaccacccccaacctctgattgatctggtatann

SEQ ID NO: 14105 - DNA, 988 bp, Triticum aestivum
  Clone ID: PAT_TA_14105
ccgcgcctccgcggccactcccgccctcccccctcccgccccccttgcccccccccggcgcgcccgccgcccccccggcgcagtccgcccggagcggccgcccccccggccgcccccccgggtgccccccgcagcgcccccggccccccccgcggcaccccctgcgcccgccgccccgccggcgccggccgccggccccggcgcgtcccccgccgatggcgccccctggggccccccgcccctcccctcctccagctccgcccccctcccccccgcccccggcggcccgacgcaggtcttctcccgccgatggcgccccttgtggagcgccgcgcctctcaacctcgaggtccgcgtcccacaccccggccgcggcgtccccatccgcacctcctccgtcttccccgatgccgcctccgaggtaatctccaagcatcctggccccgcccgccgattctgcttccacggcctctgccccggcgacctccaagaccaggcggagagctggttccgctcccgagccctcgccaagcttcaggagctcgatgtcggctacgcgttctgcgatgaacgtaatccggggagaaacccgctgccgccatcggcgctccgctctgcgcctaccctcctagttgccaagatcagctgttgtgatttgccccgagagatggtgccgtccatgggctttgacctcctccagcgtctctccttgatctccgtttacatctcagtggacgtcttccgtggactgctccctgcttgccgtgccttggagagcttacacatgtccaacgttcttggtacgcgttgcctccatgttcgctcgccgactcttaggagtatatgcttccgtaacacctctggtagaagcagagctggtcatccaggatgtgcctcgccttgtgaggttactaataccttttggttgccgagaaaactgtgggactatccgggtaatttctgcgcctaaattggagatatggggccc

SEQ ID NO: 14106 - DNA, 1390 bp, Triticum aestivum
  unsure (1)..(1390): unsure at all n locations
  Clone ID: PAT_TA_14106
tacccacgcgtccgcccccacctcgctccccagggttatcgcccctcctccttccttccctcccaagcctcgcccgcccgcccgccagcgatccccacacgggaggctccctccgccgcggcccccccgcaaatgctgccgccgatcatgatttttcgatgaacgtgctgcgcggggctgaagatggcttcagcgtgtccacgccgatgcattggatgatgcgttgctgagttttactggagccgcaacaagcatgtcagttgtgcaaataatgatgcataaccattcatgctctgacacccccgtctggacctttcttcttcttatgcaaccctgcacgagcgaacctactaccgtcatgagcttcaaaggtggtgcgggttccacagtgctcggttttgttactgttcagtgattcctgctgaagcctctgtcagtgaagttaacgaccatggaaaggtataaagtaataagggagattggtgatgggacttgtggaaacgtttttagggcttacaatatagaaacaaatgaaattgttgcggttaaaaagatgaagagaaagttttaccactgnnnaagagtgcatcagtctgcgagaagtaaaggccctccagaaactaaatcaccctaacatagtgcaattgaaggaggtgacgatggaaaatcatgagttgttcttcatttttgaacacatggactgtaatttatacgatgttataagggaaaggagtgctcctttctctgaagaagagatacggacgtttatgctccaaatactgcaaggccttgtgtacatgcataataatggatattttcatcgtgacctgaaacctgaaaatcttctggtgacaaatggtattgttaaaattgccgactttgggttggcaagagaagtatgttccagtcctccttacacagattatgtctctaccagatggtaccgggctccagaggtgctgctgcaagcttcagcttacacaccttctatagacatgtgggccattggtgcaattctggctgagctttttacactgtctccactttttcctggtgaaactgagacagatcagctatacaagatatgcgctgtgcttgggaccccagatcactccctctggccagagggaatgaacctgcctcgttcaagtagcttccagttttttcagattccgccaagaaatctgtgggagcttattcctaatgcttccctggaagctttagacctgatcaagcaactttgctcttgggatccacgaagaaggccaactgctgagcaagcactacaacatccattctttaatgtgcgcaagtgggtaccaagacctctccaggatgcttcctacccaaagatgaatgagcctagagcaacaccaaggttggaactgga

SEQ ID NO: 14107 - DNA, 548 bp, Triticum aestivum
  Clone ID: PAT_TA_14107
ccaagcgtccgaattcgccgaatctctcggcaacgcgcctagacccctgattctctcggcgacgcgctcggcagatctatccgggacgaccctcgcatccccgtcgtgcgggcggtggtggatcagtcgggaccggaaagatgcagaaaaataagagggcgagtggtcacgcaagtagcttgagaaaggtgcaaagcaccatcaaaaagaaggaaaaaattggaagtagtcgcaaaagaggcattactactcggaaaggacacctgagagagaatatatttggctactcatcgcctgatcgggatatttctagcaccaagttcgaagagcgacaatttggcaatgtatatgaacctggtcaagctgactggtgtgaactaagtaaaagactagcttcacatttgtctgtggaagttgtctcacttgctttgttcgatggagataagatgttatatgcatgcacgggtatagttctaccacgtgggacatcaagactggacctaacaagattcctgacttcatcacagttggttgcagtctttaatttt

SEQ ID NO: 14108 - DNA, 626 bp, Triticum aestivum
  unsure (1)..(626): unsure at all n locations
  Clone ID: PAT_TA_14108
ccacgcgtccggctcgccgcaacactaaaggctcgcccgccgcatgccctctccgccatgaccacccgccgccgccgccgccgctgctcttcgccagcggctccatccattcccctcgcccctcctgcgctccgcttcctcccctgctcgggcttccttggctgctctgtgctgcgtgttcttggccttcgcgctgtccgtctcggcggcggcggcggcggaggccgattccgcggaggagagccatgaggacggtggctgcctcggcttccgggatgtgtgcgccgacggggcttccttctgcttctcgtcctcgggggtccagacgctgctcgccagcgatgacgtcatcaaggagcctgatttgggggtttcaagggactgggggccatcccggtcaatgtgcttcccgatgtccgggggaggcatggtaacttgctcctctgccgatgcgatcgtcgcaggggcgcgcgatgcgttggggagagagggcaaggatgttgctaggtatgatgcggggtcgtgccnnncgccgcttgtgcctgacaattggatgcaggcatcgcatggggtgccactggaactggatggcgcgnnnacagatgtcagcccaaatgccctctann

SEQ ID NO: 14109 - DNA, 619 bp, Triticum aestivum
  Clone ID: PAT_TA_14109
ccacgcgtccggcaaagcactgaacacgcgcctaattaattttttgcgagacaaagttcaagtcgagttactgctccgctacattgtggaggagacacctgaagatgctgaaaagaagaggatatttagatttccttttatagcttgtgaaatattcatatgtgaagtggatgtcatcttgaagacattggtggaggatgaagatcttatgaatttacttttctccttcctgagtccggaccatcctcatgggactttattggccggctactttggcaaggttgttatttgcttgatgatgcggaagacactcccacttatgaattatgtgaagagccatcctgaaatagttagtcaacttgttgatcttattgggattacttctctcatggaggtgttgattcgcttaatcggcgctgatgaaactatgtattcaagttatgcggattcaatgcaatggttagatgacatacaagtccttgagatgattgttgacaagttcagctcatccgattctgctgaggttcatgcaaatgctgctgaaatcctatgtgcagtgactagatatgcccctccagcacttgctacaaaaatttccagtcctagttttgtggggaga

SEQ ID NO: 14110 - DNA, 622 bp, Triticum aestivum
  Clone ID: PAT_TA_14110
tccacgcgtccctccacatgctatcgggtgatgaaataacggagttgctagatacaatttccagatcttttgatgcatcatccgtttcagtcaaagcattgggtttgacaataactacttttaaggttcaagaacttttgggaactttattatcaaagtcaactacagatcttcagcgcattgcaaaaggaatggtcgagacattttacaaaaacttgcctctctcaagagacttagatcctcaggaaagcatgcatggagaagaactgctgtctatggctagcaatattcttgtgcagcttttttggcgtacaaggaacttggggtacttacttgaagcagttttggtgctagagtttggattgactgttcgcaagcatgtctggcaatacaagattactctggtgcatctgtactcttacttgggagctcttccgttggcacatcgatggtatgtaagcctggaggtcaaaaacattcttctagaatccgtctcacaccacatcttgccacagatgttgagttctcctttcttgcaacaaactgccagtcttgtgaaggattatcttaggttcatggatgatcatttgaaagaatctgctgatcttacctgtcttgcata

SEQ ID NO: 14111 - DNA, 657 bp, Triticum aestivum
  unsure (1)..(657): unsure at all n locations
  Clone ID: PAT_TA_14111
ctccatttctctcacttcgccgccactcccagaggccagagacctctctctctctctctctctctctctctctctctctctctcgggactcctccccttacagctactagattctagaagccaacaaaaacagacgggcgcccccccgtccggcaaaaccccaagtccaccactgtcagttctccctctctctctagatctgcgcgagcctcggtttccgcgatcgctggccgcggcggttgctcctgcctgccgcgccgtgctgctcccgcgcgcgcgtgtgctcgaccggccgatggtccgctaatccgaggccggagggagcgatgcggacgggaggcgggtgcctcgggcgggcggggggtcgggtgctcctcccgctgctgttgatcgccacgacggtggcattgctgccgcgggcgctcgccctcaccgacgccgccgacgtttctgctataaatggattgtatgttgcacttgggtcaccagctcttcctgaatggactgcaaatggtggagacccctgcggtgagaagtggcagggtgttgtatgtattggctcaaatatagacgcaataaattatattgctgcaacgatgggaggacagctgggaagcctnnnnnncttcacagcnntaaccacnntaaatcnnnnnn

SEQ ID NO: 14112 - DNA, 517 bp, Triticum aestivum
  unsure (1)..(517): unsure at all n locations
  Clone ID: PAT_TA_14112
gcacgagccccccctccggcgagctctgcaatggccgcgtcctcggcccccctcgcgttctccgcctccgcctccgccctgtccgcgcgcctgcgcctcgccgcgccggcgccggcgtcgtgcgcggccacgacgcgccgccgccgcccggtggtggtccgcgccaagatccgcgagatcttcatgccggcgctcagctccaccatgacggagggcaagatcgtgtcctgggccgccgcggagggcgaccgcgtcgccaagggcgacgccgtcgtggtcgtcgagtccgacaaggccgacatggacgtcgagaccttctacgacggcatcgtcgccgccgtcctcgtccccgcgggggagaccgcccccgtcggcgcccccatcgccctgctcgccgagtctgaggaggacgtcgcgctcgccgtcgcccaggccaangcgctctccagcggacagccccagcagcaggcccctgctccttcggacgccnnngctccaccgcccccgccggcggctc

SEQ ID NO: 14113 - DNA, 693 bp, Triticum aestivum
  Clone ID: PAT_TA_14113
aacaccttggtccatctgatcgcctttcagtcattgctttctcgtctactgccaaaaggttgttccatctccgacgcatgtcacactctggccgacagcaggccctgcaggctgttaactcacttggtgctggtggcggcacaaatattgctgatgcgttgaagaaagctgctaaggttattgaggatcgcagttaccacgcccccgcgggcgcgtgggctctgtggtcagatggtcaagatacctataatatttcctcaaatgttaggggaaccgcgtcctgatctataggtccacttgttccatcttccattctaaaccaagctgtaggcgatagtacctgtccatgggtttggttttggagcagatcatgattcagatgctttgcactcaattgccgaggtctctggtggtacattttccttcattgaggacgagggtgtgattcacgatgcatttgctcagtgcatttggtggtcttcttagtgttgttgttcaggatatgcgcttaactgtgcagtgtgtgcatactggtgttcacctttcgctccatcaaatctgggcagctacttgagttaggtggcaggagatggtcgagatggttcaattgatgttggacatctttatgctgacgaggagagggactttttgctgtctgtgagcttcccgcaatcccgtgaacagaccatactc

SEQ ID NO: 14114 - DNA, 1493 bp, Triticum aestivum
  unsure (1)..(1493): unsure at all n locations
  Clone ID: PAT_TA_14114
ggcacgagctccaaccccgcgtcgcccaccggtcaagccggtctccctccgttccccacaccggcgacgtccggtctcgcttcccttcgtgcgttcgctcgactcgtcgtctccgtttcgtttggtttcgttgcgcggggctccatttgtcgcacacaaaaccaaaaattattagaggcgacgaagaagggtgcgaacccgccgccgttccgggttccgattagatagagctgtcgcgccgccgatcccgtcgccccgccgcgccgagcttacagtttgtgcgtcatggggacttcttcaggtgcgaatttccatcaacagcctccgccccaggggatgctgccgcctcgccatggtgcccgggcccctagcctgcagacttccctctcattggcctcgtcggaacaggttggctcgcctgaaatgcaggaacctgtgtccaattctgaccagggccatgactctgccaccgaaagtgcaagttcgagggagacctggcctgtagagccggaacatagcaatgctgctgctgctagtagtggcggtgctgtgaaaaaggtggagatggaaaaggatatcagaaatggtatccccaagttgcaggttattcgtggaagctcccgcatcgatagggtgtcactgagggagattgcgcgggagagagtggacctagttgttgagaaaatgaaggtaatgccagaggagcacctggaggagattaaaaatgagctcaggtcgattctggaggggacagggggctctcatcatattgaggagtttctgtatctgcagaagtttgtccanggcagaggtgatttgacaccaactatgctttcaatggcccatcatgtccaactggagatcctcgtggcaatcaagactggaatccaggcgtttttgcaccccaacgtcaccattccccaaagccacctggtgggaggtcctcttgtataagaggtgccggaacattgcttgccagagtgctctcccggctgaggaatgcagatgcaatgtatgtgctaacagaaatgggttttgcaacctttgcatgtgcgtgatttgcaacaagtttgattttgaggtcaacacatgccgatgggttgggtgcgatttctgttcccattggacgcacaccgactgtgcgattcgtgttggccagattgggacagggcaatcaattaagagcggcacccgtcatgccgaagtgctttttaggtgcccggcttgccagaagacctcagaattattcggttgggttaaggatgtgtttcagccatgtgctcctggttgggatagggatgccttagtacgagacctgagttgtttgtaaatatttcgctaagcgaagacccaaaaggaagaattgttcaggaaatgtgcgaatctattgaagatnaggaaagtcncctatctgcaanctngatatactcancacttcaganttagtgatccctagncctaaatgagatcggacgctnatannccagngcatn

SEQ ID NO: 14115 - DNA, 1146 bp, Triticum aestivum
  Clone ID: PAT_TA_14115
gcgctcgagcgaaccgtgagcgaccctcgcccaccgcctcggttccccatgacgatatcgctgccggcgacggcggcggctctgtccgtcgtcctcgccgcgctctgcctcctcgtggtcccggccgccgggttctacctcccgggcgtcgcgcccaacgacttcgaaaagaaagaccatctccctgtgaaagtcaataaactgacccccgcgtccgcacaacttccctactccttctactctctcccattctgtaagccagatacgatcgttgacagtgctgaaaatctgggtgaagttctccgtggggatcgcattgagaactctccatatgtgtttgaaatgagggtacctcagatgtgtcaaatagtctgcaagatttcagttggggaaaaagaaggaaaggttctcaaggaaaagattgaagatgagtaccgcgtgaacatgattcttgacaacctacctctagttgttcctattcaaagagtggatcaagaaggtgcttatttctatcaacatgggttccatgttggagccaaaggacaatactcagggagtaaggatgaaaagtacttcatccacaatcatttgtcctttacggtgaaatatcacagggatgcacaaagggatgtttctaggatagtggcctttgaagtaaaaccctacagtgtgaagcacgaatatggacagtggaatgacaggaagactcatctgaccacttgcgatccgaatgcgaaacgtataattacatcatctgattctcctctggaggttgaagctggcaaagacattgtcttcacatacgatgtggatttcaaggagagtgatatcaagtgggcatctcgctgggatagttatctgctgatgacagatgatcaaatccattggttctccattgtaaattctctcatgatcgttctcttcctttccggaatggttgcaatgatcatgcttcggaccctttatcgggatatctccaagtataaccagcttgagacctcagggaggaagcccaagaagaaactggatggaagcttgttcatggtgatgttttcaggccgcctgccaactctgattggctctgtgtttatgttggtacaggtgtccagttttttggcatgatgcttgtcacgatggtctttgcag

SEQ ID NO: 14116 - DNA, 1068 bp, Triticum aestivum
  Clone ID: PAT_TA_14116
ccacgcgtccggtaacttacacacagacaaaagaaggtagagcgggagggcgttgcgcgagcgcttcgacggcatgaccgccgacccgtccccgtcgtcgtcgtcggccgccgcggcgccgtcggtgaagggcgtggcgagggcgctgtcccagcaccaccgcgccgtggtcggcttcctcttcggcttcttcgtcatcctcgtgctctacaccacggcgtccggccagttcgggacgaccaacaccattgtcgccctgcggtccacgccggccgaacagaatgccaggacgtctcctcctcctcctccccctccagcgtcgtcgtcggcgccaaataataattccgctcaaggtgcagtacatgacatggaaaatgggaagaaggacgaggcagccaagacgatgggacaagtacgcatcgaaagacaaaaacgtacctggaaccgaaatgaataaaacgatcgataacgtgcaaaccaataggacagacttgtcaagccagacagtgaatgaagctagtgacaggatggaggaagagctcattcggcaagaactcggtcaagacggcgacaagaatgagagcaacgtcaagcatggtgccccgcccaagcccgtctgcgatttgtccgacccccggtatgacatctgcgagatctccggcgacgcccgggccatcggcgtcaaccgtaccatcctctatgtaccgcccacagccgaacgcggcgccgacggccaggaatgggccatcaaggaccagtcccgcaagtacctggagtacatcgagaaggtgaaggtcaagaccctgagcgctgcggagtccctggtggcgcccgagtgcacctcccagcacgccgtcccggccgtcgtgttcgccatgaacgggctcacgtccaacccgtggcacgacttcagcgacctgatcgtcccgctcttcatcaccgcccgcgcctacgacggcgaggtccagttcctcgtcaccgacctccagccgtggttcatcgacaagtaccgcctcgtcctcgccaacctgtcccgctacgacatcgtcgacttcaacaaggacgccg

SEQ ID NO: 14117 - DNA, 623 bp, Triticum aestivum
  Clone ID: PAT_TA_14117
ccacgcgtccgctccgcctcgcgcgccccggctctcttctcgcgcactccggcagcgggcaaacgcgccgcgccggtcgccggtgacggcgtcgagcgccaccgcgccgcgctgcgccatgcgagcctcctccttttccttcctctgtttctccctgtctcccgcaacagagagcgtgagagagagcagagaggcacagcccgcctaaccgatgcggcggatggggccaccccggccaccggcgacggcgacgagccgcgctgtgcgagccttccctttcccccttcctttctctttttcacccatccaccacctccttctattggagagagccgtgagctacggcggcgccctccctgtccgctttgccggcgtgcgcgagcacctcgatggtgaacgcgccgccgtcaaacggctcggtggtggtgcatgtactttgcccctgtgagagggtagttcttcgtccctgtcgcctcggcttgccgatgcgcgacgggatcgagaggaacaggcgccgccttacggcggcgctctttgtcggtgaggcccgaggccatactccggtgaacttttgtggttcttttgtttgcttttctctgccctgctagagttctttggggggg

SEQ ID NO: 14118 - DNA, 697 bp, Triticum aestivum
  Clone ID: PAT_TA_14118
ccacgcctccccttgatcatcggctttgagcctgcttaatcattctagtgctctgacgttcttgccgaccgaccaaccatggccggcggcgccgtcgtgaacacgtccggcggtaaggactaccctggcaggctcaccctcttcgtcttcttcacctgcgtcgtcgccgccaccggcggcctcatcttcgggatatgatatcggcatctcacgggggcgtgacgtccatgaaccctttccatgaaaaactgcttcccggaggtgtgacaacaagaagcagatgaagggttccgccaaccaatactgtaagtacgacaatcaagctgcatcctacacccttcactccctccctctatctccgcggcgctcgtctcctccttcttccgccgccaccgtcaacacgggtcgttggccgcaagtggtccatgttcaccgggaggctcaccttcctcatcggggccgcccttaaacggggcggcggagaaatcgccatgctcatcgtcgggcgcatcctcctcggtgtcggcgttggcttcgccaatcactctgtgccggggtacctctcgcagggggcgccggcccgtcaactgggcatggtcaacctcgggtccaccttaatgagccccaaataatccggcaggcggcgcgcaccacctgccgcacctgccaggtcgggcccgaatacacctcggcctta

SEQ ID NO: 14119 - DNA, 473 bp, Triticum aestivum
  Clone ID: PAT_TA_14119
ggccagtgagctggagattagctagctcgctgtgatcactcactgagagccaccctcgctgaccacgctatataaccatcactcctccgctctcgcttcctcccactgctccccacccccgaccaagaacaagaagcaccagatcaaaatggcgctcctcccgctggtcctcgcggtcctcgtcgtctcctgcgccgcgcagcagccaccggtgcagccgccgccaacgcccaacgcgccgcctgccggcaacccgcctcctgctcccaacgcgcctccggccggcaacccgcctccagctcccaccgcgcccccggccggcaacccgcctccagctcccagcgctcctccggcccccaccacgcctcctcaggcgccacaggccccggccacgccccctccgggccccaaggctccggccacccctcctcgggctccaacaacccccgcggggcaccccctcgtccaggaac

SEQ ID NO: 14120 - DNA, 651 bp, Triticum aestivum
  Clone ID: PAT_TA_14120
ccacgcgtccgcccacgcgtccgaagctgtgggcaaccatgaagttttgagtcccagttgcggcccccacgctccagcctctgctctcccgaggtctacaaagttctcggtaaaataggaccaacgccatgtactgagctagttctgacagattggcgagaaatttcttctgaatttgtgcaagagagagcaaacacaaggatcggagtccatcgttccgagttacccccaaggagaacagcacccacaccaagcaacatggactgggtggaacaatttaacatttctgacctgaaaggaccaaaggatctgccaacatctggtccactgagtttcaccaagcagacaagctccctcgaagattactacgatgtttaaatcaactgaaggttaaagcctttacctgcaacttcggcggcactctctccccgccgccgggcgacggcgaccgccggtgctcccggggtgcctcccggcgggcggacgtgggccggctcgtgtcttggcaagagttggtcagcaagacaacaaggctaataaggagagcccacacgataaagtaccacctcccgggggagcaactgagcatgctcatctccatcacctccgatgatgacctccggcatatgattgatgagtgcattgtgctag

SEQ ID NO: 14121 - DNA, 1266 bp, Triticum aestivum
  unsure (1)..(1266): unsure at all n locations
  Clone ID: PAT_TA_14121
gccatcgggcatgagccggccaccaagtttctcaatgggcagcttgagctccatgccgatggctatgtggccaccaagccgggctctacacataccagtgtggagggggtgtttgctgctggggatgtgcaggataagaagtatcgtcaggcgattactgccgctggttcagggtgcatggctgctttggacgcagagcactatctgcaggaggtgggtgcacaggagggcaagtctgattgactctctcttggtgaagcgacgaccatcagctcaccgaaagccgcactctgagcttgatgaagttggttgtccagttcttcaacagtttcattatgctgcttagcagcaccgtattattattctccgtcattaggaggccctagatcaactttcattagtgtgctggaaatgattcatatttaccactggtggaactcaaactgattcctatgtatcattggcgaaatcacattattattctgagatatctatctgtattaaaaaaaaaaaaaaaaaaaaaaaaaaaaaaaaaaaaaaaaaaaaaaaaaaaaaaaaaactctcctcctgacctcgccagaaccccccttccaaactcccactccccgaaccccgaaggcgatccatggcggcggcgggttggctccggcgagcggcatcggcggtggcgttgcctcgcatgccgtctggactcaccatcatgccaccccctccccccgctcctctccccgaggcacagtccctcgtgctccccagcctcggcgccgccatcgcccccgcgatggaactcatggccgtccccaagaagaagatctcgaaatataagaggggtttgagaaatgggcccagagccctgaagcctgttccagtgattatccgttgcaggtgctgcgggcgagtgaagctgccgcacttctactgctgcagcggagaaaaagggaacgccggtgactccagctcataagcaccgagtttgcgcatgaagccctggcagaacatcgtagtgcaatggaaatccccagttatcgctttgtattctgctgctatctctttgcgagcagtaaattgtatgtagactttagtttggttttcataattccatggcgaacttagtgttggtctttgccaggagcgtggatgctctctgagttgagtgatggttgattattatgtgttgctaactntcagtatgtacgacgccccgttgctacatcaaaaataaaggaaaaaaatggtagcaaaaaaaaaaaaaaaaaggcccctag

SEQ ID NO: 14122 - DNA, 1946 bp, Triticum aestivum
  Clone ID: PAT_TA_14122
cgtccgaggacgcgtgggatcgccgccgccgccgtcgcatccaagccgtgcagtcatggaaggatgcgccgtccgggcgccgctccgcacgcgcgtgggcatcatcggcagcggcccggccgcgcacacggaggccatatacgcggcccgcgcggagctcaagcccgtgctcttcaagggctggatggccaacgacatcggcgtggtgggccagctcaccaccaccaccgacggcgagaacttgccgggcttccccaccggcatcatgggcatcgacctcatggacaactgccgcgcccagtccgcccgcttcggcaccaacatcctctccgagaccgtcaccgaggtcgacttcgcccgccgaaaccccccttccaaacccctactcccccagccccgaaggcgagcgctgccgccggcggggcgccgccgcgcagccgcatcggcgttagcgccatctcgcctgccgtcccgactcccctccatgccaccccctcccccggcctctcgccccggggcgcagccccctccgcgacccgggacctcgcggcggccccgaccccgaggtggacggaataggcgtccgcatggagaatgcgtcccagagctaggatggctgtgccgagcttgggcccaagcacggcggccgtctgggcgactagccccccgttctactgcgccggcggcgaaggggggctcgccgacgactacgggtccgacgggcagcatatgcgaaccaccgacggcgctggctcatcctgcatcgctggtgagcgccgcggtctcgtgtctcctggagctgcgtcggtaggagccctagtctgtttggacttccgttggcttctcctactgcccatgggccaacttaaactcccgcccttttcgggtctctgcattcggcactgtaatgaagggccagtccattataggtgcctacgtttccatctcccagcccgtcaattttgcgtgccccaaaattcaaccggaaacacgggttccacggctgcatgatttaggagggtaccgcgcccatcaaccggaacaagcccatcgccttcgtcggtgggggggactctgccatggaggaggccaacttcctcaccaagtacggctcgcgcgtctacatcatccaccgccgcgacgccttccgcgcctccaagatcatgcaggcacgggctctctccaaccccaaaatccaggtcgtgcgggactccgaggtcgttgacgcctacggcggctcggagggcggccccttgggcggtgtcaatgtcaataacctggtggccggcgaggtatccgacttccaggtggccgggctcttctttgccattgggcacgagccagctaccaagtttctcgccggacagctcgagctcgactccgaggggtacgtggccaccaagccgggctccacgcacaccagtgtgaagggggtcttcgctgccggggacgttcaggacaagaagtaccgccaggccattactgccgcaggatcaggttgtatggctgctttggacgcggagcactacctgcaggaggttggcgcacaggaagggaagactgattgactatatgtggggaaagcagctggtagttctaccaaaatttcattgtggaaatcaatctgcactctgatgtataattgtgatgaatcgtggcagctcctcaaaatcagcagattgttattgtttttaggccacaagtatatgatactctgttggaaatttattcctgtggatggtcaagttgtgctggtgttttcgcattcaaaatatctgaatgacaaaacgaatttgtgcggccccccgttggtcccccggcccgacgggataaaacgagagcccttctgggccaagacaataatacaaaaaccaaatcctgattactgtctccttcctgtggatggaaggaacatttaaactctattaggccaatttcgttctttg

SEQ ID NO: 14123 - DNA, 644 bp, Triticum aestivum
  Clone ID: PAT_TA_14123
ccacgcgtccgctcgcctcggccgtcacctgcttcaccaccccgcgcaacgcgcccttcatccgcgctggcctcgctggtgccggcgccggcgccgcggtcgtcgagcttccgttcccctccgagcaggacgccccgcagagcacggacgagctcccatcgtcgaccagtcttgtcgacttcgtcaccgcggtggcggcgctccagccggcgttcgcggacgcgctcgccaagatcgagcccaggccggacctgctcgtccacgacggcttcctccggtgggccaaggacatcgccgacgagctcggcatgccgcggcttgtcaccctcggcttcggcggcttcgccacgtacgtcaaccgggcagtcacggcacacaggccgcacgcacgcgtgagctcgccgtccgagccgttcccggtccacggtgtgccggacctccgcctcacgaaggccgacctcaacccgccgttcgacgacccggagccttccggcccgcactgggacttaatttgcaagaaccgcatcagcatgtactccagccggggcatcatcgtcaattccttccacgagctggagtcgatctacatcgacctgtggaaccgggagttcgacgtcaagatgtggcccatcggaccgctctgt

SEQ ID NO: 14124 - DNA, 1019 bp, Triticum aestivum
  unsure (1)..(1019): unsure at all n locations
  Clone ID: PAT_TA_14124
cctcgcccccgctccctttcccttcacgagcctccccaagcaccaaaccgacaggagtggtcgtccgcttcaactccgactgtttcggccgccgccaacctccggtcgattctgacgcaactagggactcctccctctctttatctctaccattagaatctttgtggtccctctaacccaccccactcgtcattttttctcgggaagtgtcgtaggcaaaatccccgatttggctccgccggaacatctcgggagagctcgccgctggcggctacgtccctcccagagactgttgcgcacctccacctgaccgctacgagtccctaagaatgatggtgcggtcttcttccgtcgccatgcccccaatcaccggcgagggtcgtcaagagcccctcctccgctcggccagaggagggagaaggccggtttgaccagggccaaacccgaccgaaggtccccgcgcgtcagtgactagggcgtgcctgagccatcctaagtgatggcatatttcggaaagtatgcctccctgtctcgtatgcgtactcgctgccggagcggctcccttctttttctacttcaccaccgaatttccacccagcgtggactgcctcgaggcctctccccctgcctagaaaatgggagatagcnnctcaccgtgaggatagaaagttagcccagnccanttgttccctgntgggaaatggnnngtttccattnaaccnttgggannaatccgacgaagtttcttntncggttantccanccaacntancangnaatnatttggnttataccttcnanngggcccccttntnatantgggccctttggnaacccccaaaatattctttcttaaaantnggggtctggcnaattntctnggaatntnaaggnganaaagggntcaacccnancntatcnggtcaantctcttggggggttttnnacgnnatagnnacnattaaagngggncccaantttntctcttggggggaaaattttaaagngactcctcgccc

SEQ ID NO: 14125 - DNA, 382 bp, Triticum aestivum
  unsure (1)..(382): unsure at all n locations
  Clone ID: PAT_TA_14125
ccacgcgtccgcaaaagcgacctgcttgaagcgaccctactcccagccggcacagtccaattgtccacagctccacatggcttctcctccccggcacctgctccccctcctcctcctgctcgccctcctcgccccctcctcggcggcggcggngccgggcgtcatccggctgccgcgcgccggggcctgcgccgcgccggcggacccggccgtctacgaccgccccgtgatcggcatcgtcacgcacccgggcgacggcgcggccgggaggatcgacaacggcacctccacctcctacatcggcggcctcctacgtcaagttcgtcgaggccggnggngcccgcgtcatcccgctcatctacancgagcccgangagcgcct

SEQ ID NO: 14126 - DNA, 936 bp, Triticum aestivum
  unsure (1)..(936): unsure at all n locations
  Clone ID: PAT_TA_14126
ccacgcgtccgcccacgcgtccgctgacgtgctggcctcgcctcagttggttccggatttggccacatgcgcgcgtccgtcgtccgtcgtttgctcggtcgtcgccatgggaaagggaggtggatagggtttggtgcgagggtttgttccttcttcggatttggccgtgcttggtcctgtttttttgtttcagatgcggatctgaaccatccacatatgcgtttatttttgttgattctttaactgttcgctgttgtcgttgcatggttgtctggtttgggtatgtaagattacaatcaaactgaactatgacaatttatacatcatagttaggtatcaaagtgattatgtattcacgtgaagactatgcaagccgaatggatgtatagtcgttacatatgttcaggtttaggagatttaccatgacagcttgtgacagatgcaaatcatggatgctagcaagtgtgattggatgacggttgtgaggtgcgtccccgcggttgctgtggtgtctcctccggtggtgcgttcccattgcaacctctcgcctagcgcccgggtcgtttgttgtctggggtgcgggtatgcctcttgtggatggggtggccgcccggcgttccgtgcctgtcctgtcccgcctcggcccccgccccgctttggtnaaatgatgatggctgtgatgtgttgtccctgcacatcactaaattaatgatgcatttcccgtggggaacttcccgaataaactgtaattaagcttgccgntaantgccaagttcntccctgcattgttgtggtgccccnactgttatcatcccaattgaaactttcgcctaactccaagattttgtgtaattgtcntgtagcacaatggtgnggtgcaaccggtgtcgtgcaatcaatcgactnaaaaaaaatggcaatgggcatnccgngant

SEQ ID NO: 14127 - DNA, 716 bp, Triticum aestivum
  Clone ID: PAT_TA_14127
gcgggggtctctggtccacgcgtccgaaacagtttccaaatcccaatccgtcgtctcgtcctccgccggccttgggcgagccgctccgccccgccgtagggcctcaccgaccggagctcctaccaaccactgcggcaagcccataccgcaccgttggccacgtaggctccttgattgaggtggctgattgtttcagatcgtctcgctcacaaaattgcgatcagtttcttgattcgttttgctactgagactgggtagttcaaattcaggggattgtgtatactctgttggcctgcctttgaagatggctgaagcatgccctgataatcggcgatgtctacctgcttggatgatgaagccgtgctcaagtaatgaagtgtcaaagactgagcatcggaataagcagtcggcggaatctgataagggatcaggggctctggatcaggctaagcccatcagaaggcagaaaaaaattgtggatccagaggatgctggtggactgaaggcgttgcagcgatgccagggtaaagaaaaggccaggagaaagagcaaggatgctgatcgtgctgtcacggatgaatttggtgaaatcgagaaaataacttgtgagaatgagaggaaagttaggggaagagctgctccgaagaatagcaggaagcggatgctggaggatgtgggatcagatgcataggtatgaggaataactgatgatgaga

SEQ ID NO: 14128 - DNA, 603 bp, Triticum aestivum
  Clone ID: PAT_TA_14128
ccacgcgtccggagaggaagggatacacgccttctgttctgcactactggggtcctgttgcgaagattgctggtggacagaagcttgaaaggtgtcacccatgttattgtggatgaaattcatgaacggggcatgaatgaagattttctccttattgtcctaaaggaccttcttccacgccgaccggagctaaggcttgtattgatgagtgcaacactcaatgctgagatgttctcttcatactttggtggagcacccatgatacatatacctggttttacataccctgtccggagtcgtttcctagaagatattcttgaagttactgcccgctcgcggccgccgtacaatcagatcgatgactatggccaagagaaaagttgggagatgcaaaagcaagctctacggaagagaaagagccaaattgcttctgttgtggaagatgcagttaaagctgcggatctaagggattatagtccgcaaactcgtgactctctatcctgctggaatcctgattcaattggttttaacttgatagaaaatgtcttgtgccatatttgtcaaaaggaaagagatggtgctgtacctgcccgggcgccgtca

SEQ ID NO: 14129 - DNA, 611 bp, Triticum aestivum
  unsure (1)..(611): unsure at all n locations
  Clone ID: PAT_TA_14129
ccacgcgtccgttcattcattcatatactagtcctgcatccacatctcctctcctctctctctctctctctctctctctctctggtgccgcttcttgcttgccattattagatggtcttccccagctgaccctgagatgcgagcgggctttgcttgagagattcccctctccgcggcgcagacgaccacccgccggccgcccctgccgtcgctctgctaggcagcgatgatgagcttcaagggccacgacggattcgggcaggcctccaatggtggtggtggtggtggagcctccgtgccatggtggacggtgtcccagatgctgtacggggagccgggggccgccttgtcgtcgtcgccggaggcggagcctcgccgggacgcccagttccaggtcgtgcccagagctcagggcatcctggatccactgccggcgcccaagagcggggctcctgaggtcctcaagttctcggtgttccaagggaatttgggagtccgggagggcaacaaaaaggagagaagcccaatggagcactccgccaacatccgcactgcagtncgccggctccccgggaatacaacaatcccntcgaattttggcccgggtcctt

SEQ ID NO: 14130 - DNA, 754 bp, Triticum aestivum
  Clone ID: PAT_TA_14130
ccacaaagccaagcaacactagttaacaccaatccacaatgaagagcttcctcgtctttgccctcctcgctcttgcggcggcaagtgccgttgcgcaaatttcacagcaacaacaaccaccaccattttcgcagcaacaacaaccaccattttcacagcaacaacaaccaccattttcgcagcaacaacaatcaccattttcgcaacaacaacaacaaccaccattttcgcagcaacaacaaccaccattttcacaacaaccactaatttcacagcagcaacaactaccattttcacagcaacaacaaccacaattttcacagcaacagcagccaccatattcgcaacaacaacagccaccatattcgcagcaacaacaaccaccattttcgcagcaacagcaaccaccattttcgcagcaacaacaaccatcattttcgcagcaacaacaacaaccaccatttacacagcaacaacaaccaccgttttcacaacagtcaccaatttcacagcagcagcagcaacaacaacaacaacaacaacaaccatttacacagcaacagcaaccaccgttttcacaacagccaccaatttcacagcagcaacaaccaccattttcgcagcaacaacaaccaccattttcacagcaacaacaaataccagttattcatccatctgttttgcagcagctaaacccatgcaaggtattcctccagcagcagtgcatccctgtggcaatgcaacgatgtcttgc

SEQ ID NO: 14131 - DNA, 2861 bp, Triticum aestivum
  unsure (1)..(2861): unsure at all n locations
  Clone ID: PAT_TA_14131
ccgtcttacactnacatacaacaggacacgtccccccccggggcacttctgtgctctccgtgtccctatcggggcccgctgttaatggaaaatcaggatgttcctttccgccctcttgctggattatccctcttctcctaattacagggcatatggaattgacagaacatgtcttacagtaaaactatgttcaggttatacgagcagtgagcaattaggaaatatattaccttaagagtacttgtcattttttcacgtgtcgcttattttgagaagtgtggaaaaatcactgcattgtgggctgttgagatatttctttaacaaagataattaagggggtatgaacaattgtctgattatgatctacattaatgctataattgttaacaaaatcttcagataccttatataaaaacgtctgcatgttatcgcggactatggtgtatcggtttttcttgtgtaattatcaatgtttgccgtagcgtatactgtgcttacttctatcctttcagaattcttgtgaaacatcagtgtgttgtggtttgctagttatgaagcaatgcatagcataatacatcgtgtcccttataatgccttcgctgagtttacacgtgatatccctgttgattgcttttgtttttgtttcaaaatgcattcagcatgaattatttcgcgatcttcttgcttttgttctttctgacttcaaatccgacaccaatgctgttcccggcgctagggaccacattacgcctgtctcttgtcatcctactgtacaaatccgcctcggcgagtgctagcccgccctctatcttctggggggggcctgctttccttgccatcccttatctgccaacaaccccccctccccctcttctgcaacgcatccacccacacccagaacgttggagccacaacagccccggtgacggcgtcgatggagccccccccaaaagcgggggggccggacgacccccccaaccccccccccacggccggccctcatgaagccggccccccgggccgcccccaggacgccacttccccgggcgctctccgcgccagccaaccaccctcggggggggtggccgttccaaaagtttaaggaaaaaaagaaagttaaggaatcaataaaaaaagaaagataaaagaagagtgcaggcgttatcactaacaaggcaatctgcagctgtgacaaagaaatcattctccgagctaaaaacaagggctgcgcattcacaaaatacgaggaaaatcttttccaattcatttactctggaagaggtttgtatattgctgaaaataaatgtgtttgagacaataaaaaaaataaccaaatcctccgccgcaacccctcctcccccaagcctttcccatcgagtttgttgaggcgcagcgaactcgcctaccatttgcaagaaattccagatccgcaaaaagcagagaggaacaactccaccggcgatggcgatggcgatagcggccctaagacgcgaggggcggcgtgtcctcctcaacaccccctccccggcagccaccatggctgcgctctccccggctgcctcccagtcgcagattgctccgcttggtgcacggtccatctcaacacaaattgtgaggaaccgcatgaaaagtgtcaagaacatccaaaagattacgaaagcaatgaagatggttgcagcatcaaagcttcgtgctgttcaaacaagaactgagaattcacgtggtctatggcagccattcacagctcttcttggggatgctcctagtgtaaatgtcaagaagaatgttattgtggccattacatctgacaagggtctctgtggtggtatcaattctacatctgttaaagtcagcaaagcactccagaaaatgacttctggtccagagaaagaaagcaagtatgtcatattaggagaaaaggggaaagttcaactcatccgtgactccaggaagcatattgaaatgacagtatctgagttgcagaagaaccctattaattacacacaggttgctgtgctggcagatgatatcttgaaaaatgttgaatatgatgctataagagttgtttttaacaagtttcagtctgtcatttcatttaggcctacactggccacaatactgtccccagaggttatggagaaagaatcagaatctggcgggaaggttggtcagctggattcgtatgaaattgaaggaggtgaaacaaaatcagaaatcctgcagaatcttaccgagttccagttttcttgtgttatgtataatgctgttctagagaatgcgtgcagtgagcttggtgcccgtatgtctgctatggacagctccagcagaaatgccggtgaaatgcttgaccgtcttacactgacatacaacaggacacgtcaagcatctatcactactgagctcactgagatcatatcgggtgcctctgctcttgagggatgatgatgaaactttacgctatcatcttttttatttttctgttccaatgaaggccacttctaatctaaaaacagccttttgcattctcctgtgagtggatctgagcatcaataattagcctgaatacgggacggatatgccttgtggcgctatcaaccttgctttgttttgttcaaagttcagcagatgtccacttataatttgaagcagacttctgttttttcccgtgagcggatctttgttctaagttgcaataattagcctgactaaaggagatgctttaagaatatgtcttggtcttgttttgtccaaagtggcatcatgagaccgcttgtactctgaaatgaagcaataacacccgagcacttttgatccaaaataaaatgaattcactggcacgtcgttataaaacgaagtaactc

SEQ ID NO: 14132 - DNA, 896 bp, Triticum aestivum
  Clone ID: PAT_TA_14132
ccacgcgtccgcccccgcgcccgtcccccccgcgcccctcctactccacctccggccgccgccacggccaggccggcgtggtggtgcgcctccgcagcccatctatccactagcaccaccatcacaccatcacccaccagcgccatccatcaccatcaccaacacccagcgccaccatcacctcctgccgccatcaccaccaccacctcgcgcgccctgcgagacaaagcagcgggtgtgtctggtgccccgcgcgagcactccatccaccacacgcacctccctgcctcttccttcctctgctctctgcttgctgctgcttcttcttcttcccacacctctctgctgctccttgcccatgtctcctgctgctgctcctccctcttgcttcgcccctgttgcttctcttcttcccctgcctcgctgctgcccttcttctttccctcgctactctgaatcttctccatttgctgctgcttcttctccaagcctccatgctgctgttgttccccttccttgctgttgttcctttctaaagaaaacgaccctgctgtccttctctgaatccccaactcgctgctgcagtttctatctctttctctctctttaattcgcaggatttagtacttgtataatatagtgtatgtgttctaggatccgactagttgatgcacctatataaaataagttcgcgaatgttatatttgtcacctgtgtggtacatgtatgtttgtcatttgcactgaatttacgtaattccagttcatgtatgtgttgtcacagtgtgtttccttttctgcagaaatatattcagttttgtagtccatgtattagctcaagttcttgtaagataaatgtatgtgctatataaatatgtgtgtgttaaaaaaaaaaaa

SEQ ID NO: 14133 - DNA, 1014 bp, Triticum aestivum
  unsure (1)..(1014): unsure at all n locations
  Clone ID: PAT_TA_14133
ccgcagccgacctgcgcctcagtgcgtacggagacgagcggaggatggggtgtctaatccatttgttgcagtgatgtgcaatggttcgccagcgccgaccttggccttggccacggtcgatgggagccattgggtataaagcatctccgggcgtgggtcgcgcaatgtcggaaagcacgtagcccagaccggttcatggtgccagaccatgtgtttggactgtcggataaaccggtcagaacttttgaggggcattcagaggatgttctggatctatgctggtccaagtcacaggacttgctttcgtcttcaatcgacaaaacagtaaagttatgggtcagggcaagtgtatcttgtttgaaaacgttctcgcgctgtgcctatgtgacatgcatccagttcaaccctgtcgatgatagatacttcgttagtggttctctcgacgaggcacgcagtgccctcagcacctcccaaaagggcattggccacgggcatgacccgcctgagattgtcacttctcaccacgatccacttgacctgcagagtgcgttagttggttcccacaagggcagctgtcatctttatgacacatccgataataagcttatccaacagagacaaattgacttgcaaactaaaatccgggcccgccagggcttcgtccctcgtctccagtttcttgggctgctcctccccggcagcccttcctcggcgcgctccgctgctgccgattcacggatccgagttattgatgattttgaactagttcacaaatttaaaggtttccgaaacaccaacagccaaatctcagcttgctacgcagcgagaggcagatacgtgatctcagcgagcgaaaactcccatgtgtacatgtggagaaacgacgacggncctgagcaaagaagcggcagcagcaagggcgtcgtgtctgtcgcaaactcctacgaagtacttctactggcangacgtgacngtggncgctgncntgccatccacggnggggtcaacggggaa

SEQ ID NO: 14134 - DNA, 598 bp, Triticum aestivum
  Clone ID: PAT_TA_14134
gttttagaaaaggactgtgatctgaaataagtaacttaatctcgtcgaagatcaaagcaatgatgtcaaatgggtgctgctccacaatatgatgtaggaggttccagttgtatccgtggactttacttccagaagacttgggatagatggttttccaaataatcttattggctatgctagccaatggagagaggcccctggtttggtctactgtgcattctgcagctgtgtacatgatcctcttgtcatcatcatcaaagaaaaactctgagtgaattcttgcagtgtgaatgctgccagcaatgccaaatgtctcctcccatgctcttttgttggtagtgaccctcctgccatctgccatccaagtaatagagctattgtcgtcgctgatataaactgtggagtaaaactgccgaatcagttcgatgtcccaatcacaatggtaactcatcatctgctcaagccccacatgggcacatctctgtctgacaccagaaaactcatccatgctatcaatatagtcccagtctatccactgcataggaaccaacccggccctactgtatatggagttgtaccagtcctgctgctcaatgga

SEQ ID NO: 14135 - DNA, 643 bp, Triticum aestivum
  Clone ID: PAT_TA_14135
ccgcgccgcccgtgcgagcggcttcggaggaccccaaaccctatccttcaggcggcccgatctccctcccccggccgctgccgctgccggcgccggcggtggcggccacgcccgacgagtgatggaggcgctccctgacgtgcactttcgcgcggaggcgggtcgtccccggggaggcgttggtggtgggtgtccggcggcacgagtctcgtcgggcttcgccggcgcacggcggggatcgtggaggagaggtgggctttggtgaggctggcagcacgacagtggagcagggcggcgcgtcaacgcaacttggaggcagcggcgcgagatctcggccttggaggcggtggcgctatgaaggctcggtcaggaaggagctcctggcgagtagtgggcggccgacctcctcctagctggggcgtgcgttggtgccctcccggcgatgctggcgtccgagtggagcgtggagggcgggtcagatctgtgcctctgctcaggttcgatctgggcctggggctagggtcgtagcgtgggtgtcccctggagcgggtgattctatcgcggtgatcctggtccatgcccgaggtgccgggaggctgctggccgggttgatggtggatgattgggccgcgttctctctgct

SEQ ID NO: 14136 - DNA, 661 bp, Triticum aestivum
  unsure (1)..(661): unsure at all n locations
  Clone ID: PAT_TA_14136
ccacgcgtccggttatatctcctcctccccaggccagactccgccggtgaatcaccgagcaagcagccatggcgcccccttccctctcctcctcccacctcctcatcaccgcgtccctccccaagccctcctccatccggccgccgcgcctcccggtctcctcccggcccgtgcccgccctgctcctcgcgctcgccgcctcgccggccttccccgccctcgccgtcgacgcccccgcgccgctggaggcggcggccccgcagctgcagctgcaggccgaggcgccgacgcccgccgccaaccccttcgccgacaccctgctcaccgcgcccaagcccgggtcggcgacccaggccgccgacatccccgacggcggccagtggcgctacagcgagttcctcgcggccgtcaagaagggcaaggtcgagcgcgtgcgcttctccaaggacggcggcatgctgcagctcacggccgtcgacggccgccgcgcctccgtcgtcgtgcccaacgaccccgacctcatcgacatcctcgccaccaccgcgtcacattccgtggcgaaggcacgccgcgggccggggcttctcgcttntcgnaactgtctcccttatcgcctcgcggntctctctcttcgcggcgaggcggccgcggggcccggcgg

SEQ ID NO: 14137 - DNA, 962 bp, Triticum aestivum
  Clone ID: PAT_TA_14137
aaactactgcggccgtgtcctcaactacaagaaggatggcacggcattctggaacctcctgaccattgcccccatcaaggatgaggatggcagggtcctcaagttcatagggatgcaagtggaagtgagtaaatacactgaagggaacaaggacactgttgttcgtccaaatggactgccagagtcactcatcaaatatgatgccaggcagaaggaccaggcccgtagctcagtgtctgagcttctgttggctctcaagaacccacggtcattgtcagaatcaagtaatagcaccttcaaaagaaagtcacaggaatcagtaggcgtgttaacgggtgatggtactggccacgcgtccgcagagagtggatctcgacgtacctcgcgcactggagcaagaagctcactgcagaagatcagcgaagtacctgaaggaggcaataaaactagaaaatcgggtctgttttcgcttatgggtttacttggtatgggccatggaaatgtggaaaagaacatgctgaaaccaagagatgaagatcccttacttgacagtgatgatgaaagacctgagagctttgatgatgagctaaggaggaaagaaataagaaggggtatagacttggctactacacttgaacgtatcgagaagaactttgtcattactgacccaagattgccagataatcctattatatttgcatccgatagtttcttgcaattgactgaatacagccgtgaagaaatattgggaagaaactgcaggtttctccaaggtcctgaaactgatcgtgctacagtgaggaaaattagagatgccatagataaccaaacagaggtcactgttcagctgattaattatacaaagagtggtaaaaagttctggaacctctttcacttgcagcctatgcgtgatcagaagggagatgtccagtattttattggggttcagttggatggaactg

SEQ ID NO: 14138 - DNA, 2468 bp, Triticum aestivum
  unsure (1)..(2468): unsure at all n locations
  Clone ID: PAT_TA_14138
acgaggacttccacatctactgcgcccacttcgccgccgacgtcgtcttcaccgtcaaggccgcgcagcccggcggcgccgcgctccgcggccgcgcctcccgctgatcctccattgcctgggtcaggctatgaaaaggcacagaacgctcggcggttcatgatctatgttcactccaagaggatcatcgcggaccccgagtacacctgcggcgcagctgccaacacctaccagccgtcgcccgccgggggggcgcgggccgcggtggccaggggcgccccggcgccccgtccaccttactctcccagcggcccggctgcagggccgccccgtgcctgcacgagctcgccccggtcgcggcccctccccaggccccactctgccttcgtcgacccggcaagcagggactgcgcccggagggtgtgctagatgccagacgtgtcccgcgccacctgttccagcgacgagctgaaccacgacctccccgggcacctccgcacctacccggttgccgtgaccaaggaggccgcggtggtggacctgcctggtgccaggtgcttccccgccacggcggctccggtgctcggaatcaaatccaaacagcccgcacctccgtcgagtccctcggcatgacttgggggtatatggccacgcaagacgccgggacggcgtagatacttccgcggcaccgacgtgcggtgcgtcctctgcccgcggaaacccgactacggcagaagcgccgtcatgggcttgcagactgcctacatgatcagccaccaccagaagatcatcgcggtcgaccacgacatgccggtgaggggcagctcgagccgccgccgcatcgtcagcttcgtcggcggcctcgacctctgcgacggtcgctacgacacgcagttccactccctgttcaggacgctggacacggcgcaccacaaggacttccaccaactcaactttgtcgacacgtccatcaccaagggcgggccgagggagccatggcacgacatccatgccaagatcgaaggtccggccgcgtgggacatcctctacaacttcgagcagcggtggaggaagcaaggtggtgacaatgacctcctcgtcgatctgagagccttggcgaacctgatcataccgccatccaccgtgacattccccgatgaccaggaggcgtggaatgtgcaggtgttccggtccatcgacggcggtgcgagcttcggctttcctaacacccctgagcaagctgctcgatcaggccttgtcagtggcaagaacaacacccttgacaggagcatccaggatgcctacatccacgcgatacgccgcgcacagcacttcatctacatcgagaatcagtatttccttggcagttcattcgcgtggaaggccgacgacataaggccggaggaaatcgaggcgttgcatctgattcccagagagctctcgctgaagattgtgagcaagattgaggctggtgagcatttcgtggcctatgtggtggtgccaatgtggccggaaggtgctcctgaaggtggatctgtgcaagcaatattagattggcagagaaggacgatggacatgatgtactatgacattgccatcgcacttcaggcgaaggggatcgacgcgagccccaaggattacctcaccttcttttgcttagggaacagggaggcgaagaggagtggagagtatgaacctgctgatcgtccattgcctgggtcaggctatgaaaaggcacagaacgctcgtcggttcatgatctatgttcactccaagatgatgatagttgacgacgagtacatcatcgtcggatcagccaacatcaaccagcggtcgatggacggggggagggactccgagattgccatgggcgcattccagccacaccacctgaacaccaaaggccaggttgccagagggcaggtccatggcttccggatgtcgctgtggtatgagcacctcggcatgctgcacaacgacttcctcaacccgggaagccgggagtgcgtccagagggtgaacaagatggctgacaagtactgggacctctatgccagcgacgagctgaacgacgacctccccgggcaccttctcacctacccggttgccgtgacgaaggacggcacggtgacggagctgcccggtgcgaggtgcttccccgacacggcggctccggtgctcggaatcaaatccaaacacctgccccctattctcaccacatagggtgcgtttgcagagttgcaaccccggcaatgctagatgctgctgcttctagctagatatgatgcactttcagcagtgtaaacttgttctattgttgctacctctatatatgatggttctggaagtcggaatctatagctgatagtctttacctaaagcctgaacatttctgctggccctagtccgtcttgcaagatgcatacttgagagtgctaagcataagatttcgcaatgcanaaaaaaaa

SEQ ID NO: 14139 - DNA, 1348 bp, Triticum aestivum
  Clone ID: PAT_TA_14139
tgttgtctgacttttatgttgggaaggcacttggcaggggcaagtttggccttcgccaccggccccccacgccccggccggccgctcctccccctgcgcccccctccgctcctccgctccgcggacggccagccatggcgatctccaccgattcgcgcagcgaggagaagccttcgcagcattctcaggtggagaagcggtgggtgttgtctgactttgacgttgggaaggcacttgggaggggcaagtttggccatgtctacttggccagagaaaagaggagtagtcatattgtggctttgaaagttcttttcaagagccaactcaaacaatctcaggtggagcatcagttacggcgcgaagtagagatacagagtcaccttaggccccccaatacccttcgcctggagggctgggtgtgcgatcggtcccgggctttccctggcctggtccttcccgcaaccggagagcggcgctgggtggggcagtagatgcaagcatttttctgaaagtcgcgcggccactgcatgattaccatgtagacatatggagcttgggcatcctatgttatgaattcctttatgggctcccaccttttgaagccaatgagctcgagtacagggagagctgaagattgcagactttggctggtctgttcataccttcaaccgaagaaggacaatgtgtgggactttagattatctgcctcctgaaatggtggagaagacagagcacgattaccatgtagacatatggagcttgggcatcctatgttatgaattccctttacgggctcccacgttttggcgtcaaagaacactccgagacatatcgaaggatagtaaaagtggacctgaagttcccgttgaaaccgtttgtgtctcctgctgcgaaggacctcatctcacagatgctggtgaagaattcagcgcatcgcctgcccctccataaggttctggagcacccctggatcgtccaaaacgccgacccctcaggcgtgtacagggggtagagcttgtctcgcctgctcctgtgccttgatccagggctctgagttaactcaattgttgtcatatctggctttcgttagccgtgcctgtactacctaccaccactgttgctcctgcagctgcgtcgataatgttcattgaagcttcagctttactcgatgaagatttggagccaacatgtagcagctgtctcaagtgtgtgttgtgaatgtttatgttgtgtagggggtgtgtgtatcctactctgtgtatctcttgttggacaactatttggtctatatattggaggttcccgcagttcgtatccagtgccttgtaattgttattattcattcagg

SEQ ID NO: 14140 - DNA, 1100 bp, Triticum aestivum
  Clone ID: PAT_TA_14140
cgactttccgtttggtggaataacggcttttcaacaccaactactccgtccattttttctacccctggttccagttttaacatgccaacctcaacactgttttcaatgaaccagcaaccaattttcactggcgtccgcggacgcgtgggtgctgaagcttcagctgatgcggatgaagatgctgaagccgagcaaccaagcagcccttctgtaaagaaagcataagagaaaggaatagttgttgttcatgaagccaaatgcaaggtgtatgtgaagcatgatgatgctaccaagggttggaaagacattggtgtcggtcagctctctatcagatgtaaagagggtgcaggagaaagcttcaaaagagtccaccccaacagttgttatcagaaatgatgtcggcaagattcttctgaatgctatgatctacaaggggataaaaatgagtgttcaaaagaacacggttgcctcgatatttcacacttcagatgcgcagtctgaatcagatggtggcaatgttgtagctcgaacatacttactccgactgaaaaacgaagaggcggctacaaacttgtcagcggtgatcaaagagaacgcgcccctggactgatcctgtatggtctgcattaattattgtcttgaaggtttgcgtttggcaatagtggtaatgtttagggggggctcgataacttgctgcgatgggcgaagggatgccctgcggagtttctgtgcccgagctacacacctaagaagcacacctggatgaatttttgttgcctagtacgtttagctggtcgtgttgtaccacctgttctttatgttattgatagtgtgttctagcacctgttggctccagtaaggttacgccttgttaatgctaacgaggcaacgtatcttgtcagtggcccgaactacacagttgaaaaccatttcgaggccattgtgcgatgttcagctatggaattgtctgttgcttgaatcttgcaatctggatttagggagaatatcatatggaaaacggtggagagtggtgaattaaaaaaaaaaaaaaaaaactcgaggggggggcccggtacccaattcgccctatagtggctgta

SEQ ID NO: 14141 - DNA, 765 bp, Triticum aestivum
  unsure (1)..(765): unsure at all n locations
  Clone ID: PAT_TA_14141
ccacgccttcgcgaggtggacggtggtagcggcgtaatggacctcgtcgacgctgtcgatggtgtcaacctgggtcgagcactccgtcgaacaggtgacgggcaccatcgtgatgcacaccggggctgcatcatgggcgaccgtgggaatctcctgggccttggtggtggagccggagacgtccgggacgggcgccgacgcgttggttgtgctctccggcgaagtggtagctgatggtgggttgtggacgacggcgggtgaactggtggcccaactgacgtcaagggcgttcagtttatcggcgagggacctggcggcgttggtgtaggcgtcgagcctggcgccgagccgctcgagatactcctgaaggaacggatccatggttgattccgtcggatggtggtggtgaaaaaaattgggctctggccccggggccggggggtccctggcgccgcagaccagctgtaaggtacaggatatatctcctctagattatagttcacacacactcacgatctgatacaggaattgagttacagatgaactgggggagcanaggtaggagaaaagaggaaggtagccgccgccgggttggtccgtgatccactggatggtttgctccttgccttcgatctggtacttgtagttgcaacganggggtancatgcgggccangtccaatgagcggcccagtgggcaagcccatgtgcgtacatgctatngagggctcctaacatcnccccttccttaaaattcggnttgccc

SEQ ID NO: 14142 - DNA, 1066 bp, Triticum aestivum
  Clone ID: PAT_TA_14142
cggcacgagggaagctttggcgagaatattgaagtggaggtaaatggaagcacaaaggacactcaaacttttgctcaacagcaagccaaacaggaaatgggtactttggcaaatgatgatagtaataggatggacgatgatgcaattgatgaggaagaagatgctcagagaagaagatcaaggtctaggaagagttcaaaggaagctagtaatcctgcattagcatatcaacttcatccactcaaagttgttctccatgtatatgatactgaagatcctggaaccaagcgtcgtaagctcatcactttgaggtttgaatacttggcaaagttgaatgttgtctgtgttggatctgaagattcagatgggatggacagcaatatcctgtgcaacctatttccagatgacaccggcttagagctgcctcatcagatggctaagctttatgctggggagactccaaattttagtgaaaaggattcgcgtccatacaagtgggcacagcatctagctggtatagatttcctcccggaggttcctcaatctgttggggatagttctaacagagcgtcgagaaatgctgatttgtcatctgggcttgcactataccgtcagcagaatcgtgcacagactattttgcagagaatccgctctcggaaaattgcacaaatggctctcacgtgagtcacctgctctaccatgtttgccgtttgggatgtcaatagccaaatccggacgccagggccttcccgctccccgccgtgtactttgcccggttggtccttgtccggcgttgttcctgtccctccggctcgtgctgcttgagtggtgggtgcgcctcctggaagtgttgtctgtgctctggtgacaagatctgtgacaaatgggcaagaaaccgagggtaacagagaggatggtgagcttccaattgtggttcacgctgaagatatgccagatgattctaaagtatcacacgcggaggtctcacctgaagttctaaaccattctagaggcttatctcttatatcaaagggctctgcaccatctaagctaagcatctcacaca

SEQ ID NO: 14143 - DNA, 464 bp, Triticum aestivum
  Clone ID: PAT_TA_14143
ccacgcgtccgcccacgcgtccgcccacgcgtccgcccacgcgtccgggtgccacccccccgccgagcggccgccacgatgcggtgccatggcaggagatctgcgctcttcgccgtggccgtggtcgcggccatcgtggcggcggcggcggcggcggaggtcgtgcacgatggccggaggacgtacatcgtccactgctcgcacgccgccatgcccagcgagttcgcggcgcacggcgactggtacgcctcgtcgctgcagtccgtgtccggcggcgccgccgaggtgatctacacctacgacaccctgctccacggctactcggcgcggctcacccgcgcggaggcccgggcgctggaggcgcagcccggcgtgctgctcgtcaacccggagacgcggtacgagctgcacaccacccggacaccggagttcctcgggctggaccgggcggaggcgctcttccc

SEQ ID NO: 14144 - DNA, 549 bp, Triticum aestivum
  Clone ID: PAT_TA_14144
ccacgcgtccgagctcgtcggcgccattgctcctcctcattctcctccgccttgcccctctcctcgccgaccttcgccgtcttcggcgccaacaccggcgtcggcaagaccctcgtctccgcgggcctcgctgcctccctcctccgttcccacgccgcctccccctccgccgtcctctacctcaaaccgctccagaccggcttccccgccgattcggacgcggggttcctctaccgcagggtccccgcgcttgtccgcccctcccacgccgcgcacctcgtcgcctccatcgacaccctctcccctgccccgtccgtggaaaccccatccccttcccgcgaggaggcggccttctcctacgatggggagggtaaggcggtgaggaagcttctggcttgcaggacgctgtacgcatggcgggaggcggtgtcgccgcacctggcggcggagagggaggggatgacggtagaagacgcgcatgtgaggtcgctcctggcggcgtgcctcgccgagggggaaactttggggaagggggagggggatgtgtgc

SEQ ID NO: 14145 - DNA, 363 bp, Triticum aestivum
  Clone ID: PAT_TA_14145
ccacgcgtccggacagataacccacacacgcccacgcgtcccccccccccgcgtcccccgccgcgcggcccgcccccgcctccgcgcctcccctccccatcgcctctctcccctcccggaccccttctctctcctccgcctccgcccccgccggagccggtgcggcggcccgccgtaccgcctcatccccgacccccgcggccggcggatcgccggatccgtgtccgtgcccgatctcgaggcgcgtcctcggctcccgccgatccagtcggggtttcgatccgatccgggcggcgcgatcccgtcgggctccgttgggcgattctgcggccgggggctcggattcagggggggggggggggg

SEQ ID NO: 14146 - DNA, 659 bp, Triticum aestivum
  Clone ID: PAT_TA_14146
ccacgcgtccgcccgtacctgaatcgcgcggcacttcactccccagcgcccgctccccgtacgctccgcctcgcctcgcctcgccgccggtgagctaagaaagcgagagggccaggggttggtggcggcggcggcccgacgccgcggcgggagatgaaggccaagagcctccccttcatcgccctcgagcacaagcgggacgcctatggtttcgctgtgcggccacagcacttgcaacggtacagagagtatgccaacatctaccaggaggaggaagaggagcggtctgatagatggaagaactttctggataggcaggcagaagacgatgaatcatctggagaagatgctaagattgcgccgtccattgaggatgaaggagctgtcggcgatgctggcaggaccgacctgcctgatgagaagacagccaaacagcagagaccacataagatccaaatatggtctgaaatcaggccttcactgggccacattggggagctgatgagcttgcgtgtcaagaagaagaagaagcaatcttctgctgacgaggagaacactgaagatatcaagccctcagaggactctgatgatgagttctatgatgtagagaaggttgatcccagcgaagggcctgttgctgacagcgccaatgcggattc

SEQ ID NO: 14147 - DNA, 717 bp, Triticum aestivum
  Clone ID: PAT_TA_14147
ctgaaccttccaactatatataggtgagagggggcgcaccaaaggcacaacaattagcctcgcgtcccttttccctcatcgcccgcacgcttatttctctctcggtccggattgaatctagatcggacaccactaggtcgtttctccctctagttcttcctgttgttctttgtgttggttccacgaagtgccgtggtgctgttaaattggcatgcggatacctcggtggtgttgtatactacggcactagatcccggtgcaaattctcgtgcctgggaggtataacctaactccaggaatcggcgagcttcatcaactcttcttcctctgcttccgctgcgtggattgttgagattgttaccaggagtctacacttggaagaattagtggagcagtaggcgataaacttgcccagggcgtgtccaaatgcagtaaaacttgaaacaagaagctctgatctgctgccggctttctgaagttgctctggagctagcagtgcatccttccacgctggaagtaccagattctgttctagaggagttgctgggcatagagatggcagacgatcctaatcaaaacttcgggccgttttcgcagccgttctgcagccagaatgtggtttcatttcagacgagcgcgacgcctagcgggtcgggaggcagcatgccggtgtacctagactgctccagcagcatgggttctaacatggggatgatg

SEQ ID NO: 14148 - DNA, 820 bp, Triticum aestivum
  Clone ID: PAT_TA_14148
caatctcccaatgagagcggtgcatctgccggcgtccgggtcgagcgcgcctcatgggaggcctatgtcctcgccaacaagcacttcttcgagaagattgttgaggtcatcaacccggaggacgactatgtttgggtccatgattaccacctcatggcgctgcccaccttcctccgccgccgcttcaatcgcctccgcatcggattcttcctccacagcccattcccctcatcagagatataccgatccctccctgtcagagaggagatcctcaggactatgctcaactgtgatctcattggattccacacattcgattatgccaggcactttctgtcttgctgtagtaggatgctcgggatagagtaccagtcaaagcgtggatatattggtctggattactatggccgcactgttgggatcaagatcatgccagtgggaatccatatgggtcaattgcagtcagtgctgcgattacctgaaatgcagcagaaggttgctgagctgcggcagcaatttgagggcatgactgtgttgcttggtgtggatgacacggatatctttaaaggcatcaatctgaagcttcttgcatttgagtatatgttgaagacacatcctaagtggcgggggtagggctgtgttagtacagattgctaacccagcgcgcgggaagggaaatgatattgagtccattcgggctgagattcaggatagttgtgagaggattaacagggagtttggccagtccgggtacagcccaattgttctcattgaccggaatgttccaagtgtggagaagcttgcatattatacagtcgct

SEQ ID NO: 14149 - DNA, 608 bp, Triticum aestivum
  Clone ID: PAT_TA_14149
cccacgcgtccgctctttgcccttcacggcacaatcagtaccatcggcagatggagcaggcatttcaccacctgaggtccttggcatgcctggtgtttctgattcaaagcgtgacccaagaagagatcctcgtcgccttgatccacggcgaacagttgcacctgctgctactagtcccatgcagatgacggtggaaatgaccagtgtgcatcagacaaatcctttgtcaaatacactttctcctcttcatgggaagattgaaaagtgtgcagattattcaccggacccaccaaataatgaagatgacgagcatccatcttcgaagcctcatcagccaatggacgaaaagagatctgagtttttggatgattccacagaaccagatacaaaatttgaagtgtacccaccggtggaagcccgatttccttcttctgatgtcaatgaagagatgaacaatcccttgacaccagaagctatttcaaacaacggatctgatagtacggatttggaggtcggtcacttttcaccagtctccaagacatccacaccagaggataccaatcatgagttgccacttcttccatctcatttggaattaagtgacagtg

SEQ ID NO: 14150 - DNA, 911 bp, Triticum aestivum
  unsure (1)..(911): unsure at all n locations
  Clone ID: PAT_TA_14150
tcggcacgaggctgatgtctaatggtatcagtagctttgcaatcatcttctactgtttctctcctgaagcttaaaggtatggatgggttggaagtaatccatagctttgaccaaccagcctctgtgagtgatgctctgacaataacagaaaaagatgaagcctttgctgttgtgcaacatgtgggttctcaaattgaatttattgtcaaagttacaagtgatttaaccaatgagattattagggagaaagttgatataggtcagcatagagccacgcgtccgaaggtcttcttgaataattatgtccgcactgataaatctcatggttttcgggctctggttgtaatggaagatcattccatcctgttaattcaacaaggtgctgttgtctggagcagagaggatggacttgcttcaattgttgatgtaatggcttctgaattgcctgttgagaaggatgttgtctcagttgcggatgtggaacacaatctctttgaatggcttaagggacatgtgctgaaactcaaaggaactctaatgcttgctagtgttgatgaacttgctgcaatccaagcattgagagtcagaagctctgagaaaaataagatgaccagagaccataatggattccgcaaacttcttattgtattgaccaaggctggcaaagtgatagctctgcatactggagatggccgtattatctggtcaaatttgttgccttcccttccgtgcttctaaatcgggcgaaaggccttctgccttgaggatataccaatggcagtacccatcaccgcgttatcgtnaaaaccgacaaacttgtgtggaaaatntgaancaattggttcnctgggtcctcggatctgatcaatccggnaagaanacccaannctngcatcgtgccaataccatgc

SEQ ID NO: 14151 - DNA, 3144 bp, Triticum aestivum
  unsure (1)..(3144): unsure at all n locations
  Clone ID: PAT_TA_14151
cctcccccccgtgcgcttgccggagatggctccgcgcggtctcttcctgcctgcgtcccgtgctgttcccaccggttggctcctgttcccgttcgacagctggcgctcggccgctatctgccgtgctacatgggtgcaatttttcagcaatcatctgcaggccgttcttcctgctatattagcatggccttgctgatgagaatgaatctgttcgtgatgctgcactttctgcgggtcatatctttgtggagtactatgcaacgacgtctttacctctattgcttcctgccattgaggatgggatattcagtgataattggcgtatccgacaaagttctgttgaacttttgggagatcttttgttcaaggtggctggaacttctgggaaggcaatccttgagggtggaagcgatgatgaaggtgctagcacagaggcccagggacgtgcaattgttgaagttcttggaagggcgaaacgcaatgaggttcttgctgccgtttatatggtccgctctgatgtcagcttgaccgtccggcaggccgcggtacatgtctggaagacaattgtagcaaatactccaagaactctgaaggagatcatgccagtacttatggacacccttatttcatctcttgcgtcatcttcctcggaacggcggcaggttgccgggagagcacttggagagcttgttaggaagcttggcgagagagttttgccctctattattcccattttgtcacaaggactcaaggatccaaatgctagcagaagacaaggcgtttgcatcggcttgagtgaggttatgggaagtgctgggaaacatcaactattaagttttatgggtgaacttattcctaccatcagaactgctttgtgtgacagcacgcaggaggttcgggaatctgctggattagcatttagtaccctatataagagcgctggattgcaagcaattgatgagattgtccccacactgctacgggccatggaagatgacgagacatctgcaacagcccttgatggcctaaagcagattctaagcgtccgaactgcagctattttgcctcatatattgcccaaattagtccagccccctctctcttcattcaatgcgcatgcattgggagctctagctgaggttgctgggccaggtttgagttcacacattggnaactatcctcccgacattgatacttgctatggatgatgaagatgtggatgtacaaagcacagccaaaaaggctgctgaaaccattgtgttacgtattggtgatgaaggagttgagacattaatacctgaacttctgagaggagtcaatgacaatcaggcatctatgagacggggcgcagcctaccttattggtttcctcttcaaaaatagtaaattgtatttggctgatgaagctccagatatgatgtctaccctaattactttgttgagcgatactgataacgctactgtattggctgcttgggaagcattttcaagagttgttggctctgttccaaaggaacagctccctacacatataaaattagtgcgtgacgctgtctctacagccagagataaagaacgtaggaggagaaagggtgtgcctgttctcctacctggattatgtcttcctaaagcactgcagccatttcttcctatatttcagcagggtttaattagtgggtcggccgagacaaaggagcaggcagcagaaggtctgggagagttaattgatgttacaagcgagaaaacacttagggaagtcgtcgtgccaattacaggacctcttatacgcatcctgggagaccgatttccatggcaagttaagtcagctatcctatcaaccctgactattatcatcgcaaaaggtggtcttgcacttaagcccttccttccacaacttcagacaacatttgttaaatgtctacaagatagcaacagatctgtccgcacgagggccgcatcagctcttggaaagcttagcgcattaagcacaagaattgatcctttagttagcgatcttttgtccatgttgcagtcaggagatgacgctgttaaggaaagtgtgctgtctgcacttaaaggtgttgttaggcatgctggcaaaagtgttagctctgcaatcagatcacgtgggtgtactcttctcaaagatttgctgcaggctgatgctgatgatgtccgcagttctgctgcaaaagcaattggtacattatctcagtacatggatgagaccgagaccaccgatctggtgcagaccctgttgagcatgggcacattaccagactggtgtaccagacatggtgctttgttaacattctcttccatatcaaggcattgtccaacaaaactgtgccattcaacatcatttccatctattgttgatcttctgaaagattcgctaaaagatgacaagttccctgttcgtgaagcctctacgaaaactctgggaaggcttctttgttaccagttacaattcgggggcagcaccttgcaacttgttcaattgctcatcttggccttgcgtgatagttcaaccgaagttaggagaagatcgttgtcctgtatcaaagctgctgcgaagataaatcattcagctcttgccacacatatctcgatattgggcccggcaattggtgatactttgaaggatagtagttcgccagtacgtatagctgcagagcgctgtgccgttcatgttttccagttgaccaaaggggcagattacgttaccactgcgcaaaagcatctcaccaacatgacaggcttagaagtaagaagacttgcaaagcttcctgtggagagtgacgacagtgaaagcagtgacgatgacaggagggcatagacactgcccagccacagcggcctcgaaggacgttttttgtgcctgtccattcatacatcttataggtaaaccggaaatggaacagcgtggtcaatttttgcctgtgacccttgatgtaaacaccgtttttgacaagttacagtactagaggaaggggtcggtgttgtttctatttcttactacaaatgaacaatgttcatatccgtcggcaatattttaaacatttaaattagattattttgaagatgtacttgaggttgagcacttgcatgaaatccaactcccttgttcacttgccaggacgag

SEQ ID NO: 14152 - DNA, 710 bp, Triticum aestivum
  unsure (1)..(710): unsure at all n locations
  Clone ID: PAT_TA_14152
agcggataaaactagcaagtgggagatcgacgcaggtgaacaccaccacagctacaagtagtagtggaaggaagtggaatttcttgtgtggagaaaaagagctgcttgagtgaccatgatgggaggtgggctgctgatggatcagggcatggcgttctccggcgtgcacaacttcgtggatctgctccagcagaacggcgccgacaagaacctcggcttcggctcccttatgccgcagacatcctccggcgaccagtgcgtcatgggcgagggcgacctcgtggacccccccacgaacaacttcccggacgccggtgaggacgacagcgacgacgatgtggatgacatcgaggagctggagcgccgcatgtggcgcgaccgcatgaagctcaagcgcctcaaggagctgcagcagagccgcggcaaggagcaggccgccggcggcggcggggctggcgacggactgaagccgcggcagtcgcaggagcaggcgcgccgcaagaagatgtcgcgcgcgcaggacggcatcctcaagtacatgctcaagatgatggaggtgtgccgcgcccaggggttcgtctacggcatcattccggagaagggcaagcccgtgagcggcgcctctgacaacctccgtgcctggtggaaggagaagggccgcttcgaccggaacggnccggccggcatcgccaagtaccaggccgacaacg

SEQ ID NO: 14153 - DNA, 2721 bp, Triticum aestivum
  Clone ID: PAT_TA_14153
ctgacctcggaaccgctcccgacgccgcgccgacagcatgctcagtgctgtccatcacatgacccagcacctgcagttgccgcattccccccaccctccccaggctctggttctctcgtcccctcccttcctcgctctcccaggtcatggcaaaggtgaaaagcggataaaactagcaagtgggagatcgacgcaggtgaacacccccgctacaagtagtagaggagggagaattttatctgtggagaaaaagaactgcttgagtgaccatgatgggaggtgggctgctgatggatcaggggcatggccttctttggcgtgcacaatttcgtggatctgctccactagaacggccccgacaagaacctcggcttcggctcccttatgccgcaggcaatctcatgggccccctgcgtcatgggccacggagacctcgtgaggacgccggcgaccaacttgtgcgtcacaccggggtacggccacccacgtcctgtcatgggcgagcaggcgactcaagcgcatcaccggagcggcagcataaccggacgccggagaggacgacagccgccaggatgggggtcacatcgagtggctggagcgcagtatgtggcgcgacccgcgcaacaacaagctcctcaaggagctgcagcagagccgcggcaatgagcacgccgccgtcagcgacgtcgttcgcgaccgctggatgccgcgccagtcgctggagcaggcgcgccgcaagaagatgtcgcgcgcgcacgacggcatccccaagtacatgctcaagatgatggtgctgtgccgcccccaggggctcgtgtacggcatccttccggagaagcgcaagcccgtgagcggcgcctctgccaacctccgtgcctgccggaacgcgaacgtccccggcgccccgggccgccccgccgccctcgccgcgctccgcgcgcacgccgccctgccggcctccgcggccgagctgcccgcccgcgccgccagcccgcactcgctgcaggagctgcaggacaccacgctgggctcgctcctctcggcgctcatgcagcactgcgatcccccgcagcgaaggttcccgctcgagaagggcatctctcctccatggtggccgtccggcgacgaggagtggtggccggagcttggcatccccaaggaccagggcccgcccccgtacaagaaaccccatgacctcaagaaggcttggaaggtgagcgtgctcaccgctgtcatcaagcacatgtcgcccgacatcgagaagatccggcgcctcgtccgccagtccaagtgcctccaggacaagatgaccgccaaggagatctccacctggctggccgtggtcaagcaggaagaggagctgttcatgaggctgcacccgggcgctcgccctccagcgtctgccggcggcatcgccagtgccatatcattcaacgccagctcgagtgagtacgacgttgacgtcgccgacgactgcaagggcgatgaggccggcacccacaagatggccatggccgatccaaccgccttcaacctcggcgcggccatcctgaatgacaagttcctcatgcaagcgcccatgaaagaggagaccgcggacatggagtatgtccagaagaggagcgcggtggccgccgagccggagctgatgctgaacaaccgcgtctacacctgcaacaacgtccagtgcccacacagcgactacgggtacggattccttgaccggaatgcgcgcaccaaccaccggtacacctgcaagtacaatgatcccctcccgccaagcgcggagaacaaggcaacgccacctgcgccgccgcaagtcttcccggcagcctacaaccagcagaaccatgggctcaacaacctggattttggcctccccatggacgggcagaggtccatcgccgagctgatgaacatgtacgacaccgccttccccgccaacaacaagaacatgggcaacgacgacgtcaccattatagagaggcccaatgccatcaccccggtaatggacgagggtttctttggacagggcaatggaattggaggcaatggcgacagtatgttcagtgatgtcagtaacatgatgcagcagcagcaggcacaacaaccacagcagcagcagcagcagcagcagcaggccccggcgcagcagcagttcttcatccgtgacgacgcgcaggccagttcggcaaccagatgggcagcatctccggcgcatcggatttcaggttcggctctggcttcaacatgtccggcaccgtcgactacccgcagaagaacgacggccccaattggtactactgaatgaagaataaactcatagggtcataagctttcttcgtggcaaaaccaaccttgtgtttccatggggaagtgtcgtcgtcgtcctcctaagaagtgggtaattctataggtcttctcttaattttcatataggttttgcagtagttgcaaataggctggaacttggaactggttatatacatgtatgtccatccagctggtgaacctcttctcttatggaaaacttaattttattcctagttgaactttgttagttaaaataaaaaaaaaataaaaaaaaaagcgtcaacaatctagccggtgctcctgcgccccttcctttccatcggccatggaccggcggcgaccccccaccccgccaacccccccggagggcttacaaaggccacgtaaaaaagagacaaaagagaaaaa

SEQ ID NO: 14154 - DNA, 616 bp, Triticum aestivum
  Clone ID: PAT_TA_14154
cgtccggctgtatctgcttcttcttggcaccacagcgcttagcttggtaacaacacccctgctattgaaaatgatcccagccgtggtccaccttggtgttcttttgagatggttttccgtcgatagcaatcaggtggagctgggcctaaaaggcgaagtcctccgcaatgatagcggcaagcgcataaatttgataatccaaggcccacacgactcatgacacacttggcacaccgcaagctacttttagtatggcttaagttaacgagctctgtaaagtgtttccgcatgtaacgaagagtttatagcgcgtatgcacggccgggcgggagttggaagcagaagaaatcagatctcgttcaaagtgtgtgagatcgacccttccccgcagcgacgactggaaatgcaaggggaggatttcgccagccttgtgagcagtggatgaagcgggcagtgagtgcaatgctcgcggtgtgatccctctaatgagggttttctgtagtataagaatgtaatctgattgattgattgattggattagcgtgataggatttaggcttgaccggtataccactgtattaattccacaaaatgtgcagaacgccacctgatcatg

SEQ ID NO: 14155 - DNA, 535 bp, Triticum aestivum
  Clone ID: PAT_TA_14155
tccgccgctccaagaaggggggcatcggcggcccggagctgctgcccccgcccccgccggcggcgaccggcaattacgggggattctccatgttcctgagggccgcgcggcccggcggcaacaagatgatgggggcgagggggaaggccagggtgagggtgcggccggaggaggtcgccgaggcggcctatcttgccgccagcgggcagccgttcgacgtgctctactacccgagggcgagcacgccggagttctgcgtgagggcggccgaggtcagggcggagatgcgcacccagtggtgccccggcatgaggttcaagatggccttcgagacggaggactcgtgcaggatcagctggttcatggggactgtgtctgtcgtgcaggtggccgaccccattagatggcccaattcaccttggagacttcttcaggtgacctgggatgaaccggacctgctgcagaatgtgaagagggtgagcccatggctggttgagctgttctcaaacatgccggacattcaccttgctccgtt

SEQ ID NO: 14156 - DNA, 719 bp, Triticum aestivum
  Clone ID: PAT_TA_14156
ccacgcgtccgcggggctcagccttgtttcctcccctcttctccgccttttcctccgccggggccgggaagctccgacgaatcgcgccgctcgccaagttgatgtcatcgtcgcactgaacatttattgataaagtagtcaaaactaactgctgttaatctcggggaggtgtactgtctccttggattccggcaaatagatcacctccacaaggttggaaaatatgtcagcaaaggcctctaacatgtcatacagatatccagacaattctcaaataccatactacagcagttcaatgcatgtggggggaaatggtacttgctatgtgcaacaaaatcatgaggatcatcactacgtgtcctctgatgatggctcacagaacagcgattcaaagtctcaggtgattcacccacagtacagcactctagagtcttcatcagccaattgtgtttatgctgccaatagctctacatctcctcagtgcataagtgggagccacatttctctgcatgatagccactcagatcacacatatgattctcctgcaagtggcatcaccgaggttccaggtttggggtttacaacacttcaggagctagcagatgcactgtttggatctgattcagatgcagttagttctgacagatccctagtaattggcgccgcaatgcaccaaagtaactggagagagcttctgggaatcagctctggggacttga

SEQ ID NO: 14157 - DNA, 571 bp, Triticum aestivum
  Clone ID: PAT_TA_14157
gcaggaattccgtccgaggaacaagcaccgccgctgacgcatctcgagtagtttccagttcgccggagaaggagcaagatggccggaaggaagggcggcgacaggaagaaggcggtgacccgctccgtaaaggccgggctccagttccccgtcggccgcatcgggcgctacctcaagaagggccgctacgcccagcgcgtcggctccggcgcccccgtctacctcgccgccgtcctcgagtacctcgccgccgaggtatgtacccatctttcctgtccccgagcatctcttctgctctgttcttctcgtgctcgacagataactgattttgcatctgtgtgcttttgaatcgcaggtcctggagcttgcaggcaacgctgccaaggacaacaagaagacgcgcatcatcccgcgccacctgctgctcgccgtccgcaacgaccaggagctcggcaggctgctcgctggcgtgaccatcgcccacggtggcgtgatccccaacatcaactctgtgctgctccccaagaagtccgccgcagcccgagaaggaggccaagtcgcccaagaagaa

SEQ ID NO: 14158 - DNA, 1012 bp, Triticum aestivum
  unsure (1)..(1012): unsure at all n locations
  Clone ID: PAT_TA_14158
gggtacttttatcggacattatgttctcatatnttggaagtgttgacggcttgttgtcagattatgcttgttccgcgcgcggctgttttcggttacttctgttcgtgcaggagggcgcaaaatgcagcgcggggcacagctttctccttatccatgtattgctgatagccgtacaaatattgagcatgacggtccccataattgataacaagggagatgaattattccaaccggaagctccattccgcagcttatgcagcttgccttaatttttgtgtcttcatcttcagccggtccatgaactgggagttagcctggagcctccccttaacataagcatttctagcagcattggccaactcgtcggctttcatcgcatcttccacttagagcatacagtgttctcaagcaatcttttctgttctcttctcgatgatcaaacctttcactgattattgtgagctcatcttttcctgaattatacctctttccaacaacctcacgtaatcgacggaaagcatgccgtgaaagtcccagttccttgacggttacactgagtttaactttcctatttttgggatgccatgcatcaccaccaggggcaaagacaatgcgtgactcccaccttagaacaggtccctcaccaggtggatcattcaactcgacgctcttattatctgcctcagaaagttcatttacagtcagcggctctgcttccatcagttctgtgcactccgagaccatcttatcctcaaattctttaaatagctcaaaagcctgctcaggttcaagctcccccctctcacacatgtcccccaactcgttaaatttggcctccacctttggctttatctcatcaggtagtaacttgcccctggggcgctcgccctcgaggatatcctcacactccttcatgttactcagctggcccttctctgctgctttcttgatctcctcatcccacttggtttcattcatgttattagatgacttatcgtccttcatctttttc

SEQ ID NO: 14159 - DNA, 474 bp, Triticum aestivum
  Clone ID: PAT_TA_14159
ggttttttttaaaaaaaacctgggtttgttttttattcccaagtttgaactaatatatttcgggtttttacatgatagggcatgtcaaatttttttttcaccgctacaacaaccaaaccatggactgaaaaaacggggtttcatatttttaatactaaagttttttttttttcaattaatccccaaaatcccaaatggccccatggggcaatttggggggatgtaaactttgcacattgcaggtaccgtctggagggctaggttccttatttcctcaaactggggcaattgttgagggtggacaaaaccctgggcctgggggttttgctaaaatggcccgaaggacccctggcctaatggatttttttccaaaagcttttgaaaagaaacccgccccaaggggtgttgttgttgtttttgttggggaccccaaataataccctgaacaacattggggatggcctggccctgcaa

SEQ ID NO: 14160 - DNA, 871 bp, Triticum aestivum
  Clone ID: PAT_TA_14160
ggggcttttcttaaccaaaacaaaacaatcacaaggaaacatgtttgtatcacttggttctagcagccaacgtatccacaaggtagccctgtagtcctaagctatactgacactacctctgattctcagaaatttcgtcattctgctccaccaaaaaagcctacatggtgaatcacattggtttggttcacctttttgcatagcgggtttgtagtcgatgccaaactcagcaaagcgtcggggttgtggcgtttcaccgacccgccggcgcggccggccatcacaaaatactacaagcaaggggtttatcattgcaaaggcggaattaggtgttccagctagccactacaattttgcaaccaccagagcacagtttccaagccaattaaccaacagaggccatgataagccacatgctaaacctacaacatctccataaccaacaacaaaccagtagcctggtgaccaccaccacaaaaactatccacactcagtcatccacaagatgatcagctaggaatcaagcatggcatacccagggctcgacggtcacgactcagagcaaccagaggcgtaatccagaggtgaagatgagctcaccatagcgggtttgtagtcgatgccaaactcagcaaagcgtcggggttgtggcgtttcaccgacccgccggcgagttgggccaccagccttcgaccgtgcacgcacgggaggccagtggagttctcgaggagtaggtggacgaagtaggggtgagcacggccgacggccaactgtggccattgcccatgatcacatcgagtcgcccgcttgctgaggaaagaaccggcaagcagcagtcaagacaccccacccttgtattcctccctcgtgc

SEQ ID NO: 14161 - DNA, 1019 bp, Triticum aestivum
  unsure (1)..(1019): unsure at all n locations
  Clone ID: PAT_TA_14161
ccgcaccgcaccgaatcgccctccccccctccccggccgctttcccctcatcgacctccgcaccgcaccgaatctctccccctccccgtggccgcgaggtgaaggcgagagcgcgcgctccaccaaccaccaatcccccacgcgcgcaccgcgaggccgaggccgaggccagggcagagcgcgcgatcaccaccaccacaagaggagctcgccgcgccaccaccacctcacagacagtccatataactcgtcttcttggtcgctgctgctcgatcgaccgaccgggcaagaagaagcaagaagcggcaggagagagcgagagctggctggatctgctcgtggcggggatccaacaagaagaggagcgctggcgatgcttgcagctgatgatggcgctggccttctcggcggcgccgctgacgctctacgtgccgcccgtgcgcagcctcagcctcttcgtggaggccatggagtacggtgtgccgcgagtgcgcgccctactcccagggcgccgtctcgcgcttccgcctcggcctctcccgcatcttcgccggcctcgcgcgcgccctgcgctaagagacggacgcgtccgccgaccagatcgatccttcttcttcttctcgccgtaggtacacgtgcgctacaccatgggcagggggcgcccccccttgcgcagcgcagcgcagcggctgtgctcgttcgtcttggatattgattacttagcttctacgtatactagctgctagctttgttctcgttttgagtaacatttagagaagaaaatgggtaataatctctgcccaaagaggagtttttgtgagagatcgtgacaagatacatggtgttcttatgcggtggatgcgaggtactctagtccgtgagaatttgttgtgatctgtacataatcatagtgctaccagttgggaaacacgtgttgcctcctaatccttgagaaaccccttccaacgggtaanacaaaggccnacgatgcctcaaattnnaacnatggaangacccct

SEQ ID NO: 14162 - DNA, 920 bp, Triticum aestivum
  unsure (1)..(920): unsure at all n locations
  Clone ID: PAT_TA_14162
gcggccgcccgggcaggtactcgatcgtgcacaagaatgggttgagaaactattgcctgacaaacaaaaggaacgccaaggtttactttacggctctctgctggatgaaagaaaccttctggagtcccaggcaaatgaagtagcatctgttctttcagaggttgaggatccgttcgatgagattcgcttagaagctgatgggctagatagccgagtagctgctttgaaggcaaaagagtctcaaaaggtgcaacaagagttgaagtctgtaaagtctcagatggaccttctaatcaagaactttgaagttcaacttaagaattcgaaacttgaacagtacaactcaataatgaggaaagcagaatctgcgaccgcctcattggctgctgctcaccagccaactgagtttgctgtcagcgacggcgaaaacaagagtttatatgttcctcaaattggcgacaaagtgtatgttgaaggactgggaggcgggagtatggccactgttgttgagatactcaagtgaagatgggagctgtatggttcaagtatggaaaaataaaggtcccgggccaagaataacaagattgaagtttggccccagaagagacaccaaaggaaacatccggttccttcccttccggcaacaaaggaaaagggaccgagcgccagaagccggcctcccccnggcggggacttgccgctactggcagtgtgtccctttttcccccccggcggtggcagaccttncgaaggacacngnttngcctttccggggnaaaggcggttcccggggaaggcgtcctccnaaagcttggagatggcgatttcgacgaagggcaggcataccagtcctccctttnccnnggcccaacggaattgnaaccgggccgtttaaggatgccaatgactccctcccnggc

SEQ ID NO: 14163 - DNA, 531 bp, Triticum aestivum
  Clone ID: PAT_TA_14163
ccgtacgcgccgctcgtcctgaaccgcatcaggtcggagcctttgcggtcgtctgcccggctggcgcccgacacctgcttctggaaggaggaccgccaccggcccctctacagctcccgaaggtcgctctcggcgtggacgagtatgcgccgcccgtcctgaagcgttagctagctaggccgcgaccaccccacgtttggatggcgcccgtcacttgctaactgtaggaggaccggttgttgtgtaattgtaccactggggtaggtccatgcttggtacgtacgtggtgttagttatgttagatgtggcgcttttagctggctagtaagcaagtcccacgtttttaggagccatgttatgtaataactgtagtgagctttgttgttgtgtaattgtagtgagcttgtttttccatgcttggtacctgctgttagttatgtgatattgtgatgtggacaagggatattaagcaagttactacatgagatgagaatagattagggaaaaaaaaaaaaaaataaaaaaaaaaaa

SEQ ID NO: 14164 - DNA, 356 bp, Triticum aestivum
  Clone ID: PAT_TA_14164
aaaaaaaaacctgggtttggctttttttcccaagtttgaactaatttatttcggggtcttacatgaaagggccttggcacatttttttttccccggtccaaccaccaaaccttgggctgaaaaaacggggtttcatttttctactcctaaagttttttttttttcaattatcccccaaaatcccaaagggccccatggggcaatttgggggggtgtaaactttgcacattgcagggaacgtttgtacccctagggtccttatttcctcaaaccggggcatttgttgagggtggacaaaaccctgggcctgggggttttccttaaatggccggaaggacccctggcctaatggattt

SEQ ID NO: 14165 - DNA, 1184 bp, Triticum aestivum
  Clone ID: PAT_TA_14165
gcacgaggatgaccagcagttaacagagcttcgcaactcctcttccatggcatcaaccatgccgttctccgctggcctcgtttcccttgggtctccgccgccgcagcgccacagctgcaggctccagcgatatcagcgaccgtgcactctcatttcatcagctataagacatggtcaggttaaagctatggctggagtgagcatggatggcttggcacagcctcaagccccggttgcagtggttaccggagcatcgagggggattgggcgagcgatagctgtggctcttggcaaagcagggtgcaaggtagttgtgaactatgccaagtcaggcatggaagctgaagaagtgcgcagagagatcgtggagtccggtggcactgccatctccttttcagccgatgtctccattgaagccgaggttgaaaccatgatgagagcggcaattgatacttggggaacgctggacgtcctggtgaacaatgcagggatcacacgagatgctctgctaatgcggatgaagcgggcacaatggcaggaagtagtggacgtaaaccttaccggtgtttacctctgtgcccaggctgcggcggcagtgatgatgaagaggaagaagggaaggatcatcaacatcgcctcagttgccgggatgattggcaacattggccaggccaactactgcgccgccaaggccggggtgattggattgaccaaggccatggcccgggagtacggtggcagaaacataaatgtgaatgcagtttccccgggctgggtcgcgtctgacatgaccgcaaaactaggcgatgacatcgagcgaaaggcgctcgagacaataccattaggacgattcggcaagccagaggagatcgctggactggtggagttcttggctgttcatccggctgcaagctacatgaccgggcaggtgctcccagttgatggtggcctgtccatttgagtgttactgaaaccgaaccgaagcgaggtgtggaaacttcaattttccaatgagaaacaaggttgtgtcacacaaaattaagcacaagagggctccatgccttcgcgtcaggcttgtggctactcttgtcttctttacagggaggttggagaaagttgtagtctggatgaaattcagtagtatgtatggccaaagcaaaccgaaagaccagaaaaaaaccaaa

SEQ ID NO: 14166 - DNA, 859 bp, Triticum aestivum
  Clone ID: PAT_TA_14166
ccgaaaccacacacacgcagctagagctgctagcacgggcgagctgagagagctggccgccttcacacacacaccgccactcctgctcgccggcggcggagaaggatcggtggtgacaagaaggaggagaagaagaagaagatggtggggagcggcatgcagcgcggggccccgctggtggtggggcgcgtgatcggcgacgtggtggacccgttcgtgcggcgggtggcgctgcgggtgggctacgcgtccagggacgtggccaacggctgcgagctgaggccgtccgccatcgccgacccgccgcgcgtcgaggtcggcggcccggacatgcgcaccttctacacgctggtgatggtggatccggatgctccaagccccagcgatcccagccttagggagtacttgcactggctggtcaccgacatcccggggacgacaggagtatctttcgggaccgaggtggtgtgctacgagggcccgcggccggtgctcgggatccaccggctggtgttcctgctcttccagcagctgggccgccagacggtgtacgcgccggggtggcggcagaacttcagcacccgcgactttgccgagctctacaacctcggcctgcccgtcgccgccgtctacttcaactgccagagggagaccggaaccggcgggaggaggatgtgatcatgatcaccagctccttgtagtacgatactagtagtatatgtgaccacaggatatgacgatgatgatgatggtggtgaggatgaagtcgatcgtatgggtggtttgattatacagggcgaaatggagaaagcatttgtaatgttcgagataataactatgcgtgcgacatttttggtcc

SEQ ID NO: 14167 - DNA, 525 bp, Triticum aestivum
  Clone ID: PAT_TA_14167
gagtatctttcggtacaggagaagaaaactgatctcacgtctcaccactttattatacagaactcagcgtcgctctgggctctaaatctaatggaacttttcgtacggatgcatgtccagggaccgaggtggtgtgctacgagggcccgcggccggtgctcgggatccaccggctggtgttcctgctcttccagcagctgggccgccagacggtgtacgcgccggggtggcggcagaacttcagcacccgcgactttgccgagctctacaacctcggcctgcccgtcgccgccgtctacttcaactgccagagggagaccggaaccggcgggaggaggatgtgatcatgatcaccagctccttgtagtacgatactagtagtatatgtgaccacaggatatgacgatgatgatgatggtggtgaggatgaagtcgatcgtatgggtggtttgattatacagggcgaaatggagaaagcatttgtaatgttcgagataataactatgcgtgcgacatttttggtcc

SEQ ID NO: 14168 - DNA, 991 bp, Triticum aestivum
  Clone ID: PAT_TA_14168
tcgaccctttcggtacccgacgggagcagcaaaaccacacacacacgcagctagagctaatagagccggccgccttcattaacatatcgccacttgcgccggcggccggcggagaagggcgccagtggtgacaggaggaagaagatggtggggagcggcatgcatgcccagcgcggggacccgctggtggtggggcgcgtgatcggcgacgtggtggacccgttcgtgcggcgggtggcgctgcgggtcggctacgcgtccagggacgtggccaacggctgcgagctgaggccgtccgccatcgccgacccgccgcgcgtcgaggtcggcggcccggacatgcgcaccttctacacgctggtgatggtggatccggatgctccaagtcccagcgatcccagccttagggagtacttgcactggctggtcaccgacatcccggcgacgacaggagtgtcttttgggaccgaggtggtgtgctacgagggcccgcggccggtgctcgggatccaccggctggtgttcctgctcttccagcagctgggccgccagacggtgtacgccccggggtggcggcagaacttcagcacccgcgacttcgccgagctctacaacctcggcctgcccgtcgccgccgtctacttcaactgccagagggagaccggaaccggcgggagaaggatgtgatgatcaactccttgtataataccagtacttaagtagtataagtgacgacacaagatgatgatgatgatgaggtcgtatgggtggtggtttatacagggcgaaatggagaaagaattgtaatgttgaagaaataataactatgcgtgcgacttttttgatccgatgccggtgcgatactacaaagattaaaaagatgttaggatccaacgagccagttgggagatcgtacgggaatcagatgggaaccgtcgtatgtgtagcatcgttgttctaatatactacgtgaattgtctttatacttttt

SEQ ID NO: 14169 - DNA, 799 bp, Triticum aestivum
  unsure (1)..(799): unsure at all n locations
  Clone ID: PAT_TA_14169
ccccctcatcctcttcctccgctctcggcagctgccgctcatctcggtgggaggccctcaggcgggcaggttcccctagatccccggagtcactcaatcaaatggctgacggtgaggacatccagccccttgtctgcgacaatggaactggcatggtcaaggctggttttgcaggggatgatgcacccagggccgtcttcccaagtatcgttgggcgcccccgccacactggtgtgatggtggggatggggcagaaagatgcatatgttggtgacgaggcccaatccaagaggggtatcctcaccttgaagtacccgatcgagcatggtatcgtcagcaactgggacgacatggagaagatctggcatcacactttctacaacgagctccgtgttgcacctgaggagcacccagtacttctgactgaggcacccctgaaccccaaggctaacagggagaagatgacacaaatcatgtttgagaccttcaatgttccagccatgtatgtggccatccaggctgtgctttccctatatgccagtggacgcacaacaggtatcggggtggattctggngatggtgtcagccatactgtgccaatctatgaaggatatgccccttcccatgccaatcttcgtcttgaactcgctgggcgcgacctaactgactggtggaggagaattctaacggaaagagttactccttacccccaccggcaaacggaaaattggaggggacatcagggaaaccttgccaaattggctctttgcttttaaccaaaattggaaaaggccaaagc

SEQ ID NO: 14170 - DNA, 784 bp, Triticum aestivum
  unsure (1)..(784): unsure at all n locations
  Clone ID: PAT_TA_14170
ggccgtcttccccagcatcgtgggccgcccacgccacaccggtgtcatggtcgggatggggcagaaggacgcctacgttggtgacgaggcgcagtccaagaggggtatcttgactctcaagtaccccatcgagcacggtatcgtcagcaactgggacgacatggagaagatctggcatcacaccttctacaacgagctccgtgtcgccccagaggagcaccctgtccttctcactgaggcgccgctcaaccccaaggccaatcgtgagaagatgacacagatcatgttcgagaccttcaacactcctgctatgtacgtcgccatccaggccgtcctctcgctgtacgccagtggtcgtaccacaggtatcgtgctggactctggagatggtgtcagccacactgtccccatctacgaaggatatgctctcccccatgctatccttcgtctcgacttggctgggcgtgatctcaccgatcacctcatgaagatcctgactgagcgtggttactcattcaccaccaccgctgagcgggaaattgtgagggacgtgaaggagaagctgtcctacattgcccntggactatgaccaggaaatggagacttccaggaccagctcttttggggagaagagctatgagctgcctgatgggcaggttatcaccaattgtttctgagcgtttccgttgtcctgaaggtctctttccagccatcttcattgggaaggaaactgcaggtattcatggaaattactaacacttccttattgaagtgcgacggtgga

SEQ ID NO: 14171 - DNA, 168 bp, Triticum aestivum
  Clone ID: PAT_TA_14171
gacgacggcgcttactcgataccattaccggttgccactgtaagacagacagacagacaccgggaggaaacagcagtacattacagagtgctagccaaaatgcgaaagccacaataccgttcccgttccgaaaagcagaaagacgaccttaaataaagcttacacaac

SEQ ID NO: 14172 - DNA, 590 bp, Triticum aestivum
  Clone ID: PAT_TA_14172
tccccacctacccgcaccccatggcgccgaaggcggagaagaagccggcggcgaagaagcccgtggaggaggagcccgcggcggagaaggccgagaaggcgcccgccgggaagaagcccaaggccgagaagcgtcttcccgcggcgggcaagacctccgccaaggacggcgacaagaaggccaagaagaagagcaagaagagcgtggagacgtacaagatctacatcttcaaggtgctcaagcaggtgcaccccgacatcggcatctcctccaaggccatgtccatcatgaactccttcatcaacgacatcttcgagaagcacgccgtctccgagggcaccaaagccgtcaccaagttcacctcctcctaggttcgcccgccccccctcatggtgaccgctgttgatcccctgctggatctgcctgcctatctagatatatatagtagtattagtagtgcttgatggaaatcgttggacggatgatggttcgtgtgtagtcgtcggtggttgtaagatgatgttcccgtggtgctacttttgcgtagtcgatctgaatattaatggaacaaaaatctgctaaaaaaaaaa

SEQ ID NO: 14173 - DNA, 849 bp, Triticum aestivum
  Clone ID: PAT_TA_14173
aggaaacaggagtacattacagagtgctagccaaaatgcgaaagccacaataccgttaccgttccgccgcgcagagagacgaccataaataaagcttacacaacatagccaacaaggagaccgttcggacctggggctgccgccgaggcgcgtgtgccgtgcatcacgattgcccaacaacaactaggattgcagaagccaacatgatgaaaggataatgcagcaaagacgcacgatgacgaggtagcgcagatttgatttgggaccttatgttctgccgaccgtaggggggcccttcctagatcttgtccgagtaacggtgcgtcgcgcagtagaggttcccgcaccggcagttgaatccggtcagcccgaccctctttctgcaggtgctgcaccggcttgggcctttggggttctccatcgccgcctcgctgggaccggcgatatcagcaggctgtgcggtaataagcgtcttcgcctctacgtgagcaactgccaccgccgtgttgccagcagcaagatgttctttcgcggcatcaccaccgttgacgatgctgtcaaaagaggaggcggccagcttggcctgctcctgcttcatcgccatctccttgtggcacttggagcacatgttcatggtcgccgcactaccgaagaagccgcagttattgacgcaaaggatggggccctcacgagactggcagccggtctccttgtgctccatgactttgatttaactgataggaggaagccctcgtcgcgattcctctccggcgatcccctaggagggggaggacgaggaggcgaggggagaggaatcgcgaagaattcggtgggctcctcgtgccgaat

SEQ ID NO: 14174 - DNA, 656 bp, Triticum aestivum
  Clone ID: PAT_TA_14174
acaatctttgacaacggaagccaaagcaaaccaatccatttcagggttcaccactccaaactatatacagacacaattaagattctactcaactggagaccccacacaccaacaatctgcttaaaaaccactgatacatgatgcaagaattaacaaccaggtcatagccctaataacaacatcagcgacctcgagtctcaaccggacaccaaactacgaacaagctggcactaacatacaccccttagtcctccactatagctgcttacatggccacattggccagtcaccatcacctgcccgcttcgactccccagctcgtccgtggtgggttcatcaccgaggagccttgctcatccaagcctccaaccacgagggcgtcacggcttagatctggtgatgcgttgcggaacctgccatccttgtcctccagcaagttgcccagacctcccaggtcgcctatctcagctgccatcctgggctcatcccatgccaccggctttctgcccatctcgatgtcgccgacagctctccccatgtttgggctcatgaaaccgttcgtcgagcgaggcctcaggccctgctcctgtggaactctggcgccgaagttgttcctggaagcagggatcggcgtgaagaagatctccttgatgttc

SEQ ID NO: 14175 - DNA, 799 bp, Triticum aestivum
  Clone ID: PAT_TA_14175
attcggacgagggtccttccaacctctgccgagggggaaattgtaagggacatcaaggagaagcttgcatatatagcccttgactatgagcaagagttggaaactgctaagaacagctcatcagttgaaaagagctatgagctacctgatggtcaagtaatcaccatcggtgcagagagattcaggtgccctgaggtcctcttccagccatccatgattggtatggaggctgctggaatccatgagacaacatacaattcaatcatgaagtgtgatgtggatatcaggaaggacctctatggcaacattgtgctcagtggagggtcaactatgttcccgggtatcgctgatcgtatgagcaaggagatcacttcccttgcaccaagcagcatgaagatcaaggtcgttgcaccacctgagaggaagtacagtgtctggataggagggtcgatcctagcctcgctaagcactttccaacagatgtggatatcgaaggaggagtatgatgagtctggcccagcaatcgttcaccggaagtgcttctaagtttcaccagttgttgttacctagtctcaagtagtcaagttatgtccccttcatttcttgagatatgtgtggcagatttgcatgctacgtttatttgcatcggacctgagtcttctctgggatagacccttctttgtgtgttgttgcttcatgtgcggtttgtgaggttagttgtcaaacatgcttggcttgattggttgtacctctgagagctgatagttatataaattgcttggattgtgctggtgctaaa

SEQ ID NO: 14176 - DNA, 594 bp, Triticum aestivum
  unsure (1)..(594): unsure at all n locations
  Clone ID: PAT_TA_14176
ttgggatgggacagaaggatgcttatgttggtgatgaggcccaatccaagaggggtatcctgactttgaagtatcccatcgagcatggaatcgtaagcaactgggatgacatggaaaagatctggcatcacaccttctataatgagcttcgtgtagcaccagaagagcacccagttcttcttacagaggctcctcttaaccctaaggctaacagggaaaagatgacacaaatcatgtttgaaactttcagtgttcctgctatgtatgttgctattcaagctgtcctttccctttatgctaagtggccgtaccactgggtattgtcctgggattctgggagacggtgtcagccacactgtcccaatctatgaaggctatgccctcccgcatgccattcttcgtctcgatcttgctggtagggactcactgatccctcaatgaagtcctgactgagagggttacccttcacaacactgctgaacgggaaatgtccgtgacacaaggaaacttgcatattcgcgctcgatacgaacaagaatcgagacgcaagncantatcagtgagaaantanaatgctatgncaatganaaatag

SEQ ID NO: 14177 - DNA, 404 bp, Triticum aestivum
  unsure (1)..(404): unsure at all n locations
  Clone ID: PAT_TA_14177
tctcgctctgggccgccgccgccgccctaagccacgtgctgaggctttcgttggtctcttcgccggcgacgagcacccaccagcagttctgtagaaatggctgatggtgaggacatccagcctcttgtctgcgacaatggcaccggaatggtcaaggctggttttgctggggacgatgcaccaagggcggttttccctagcattgttggccgtcctcgccacactggtgtcatggtagggatgggacagaaggatgcatatgtttggcgatgaggcacagtccaagagagtatctcacctcaattaccgattacacgtattgtgacaactggggatgacatggaaaacctggacatacttcctacaacacttcntttgcaccaagacacctgtttctcactgag

SEQ ID NO: 14178 - DNA, 587 bp, Triticum aestivum
  unsure (1)..(587): unsure at all n locations
  Clone ID: PAT_TA_14178
cgtgaccttaccgacaacctgatgaagatccttactgagaggggttactccttcactacgactgccgagcgagaaattgtcagggacatcaaggaaaaacttgcctacgttgcccttgattatgaacaggagctggagactgccaggaccagctctagtgttgagaagagctacgagctgcccgatggccatggttatcacaatcggtgcagaaaggtttaggtgccctgaggttctattccagccatccttcattggcatggaatctgctggcatccatgaagccacgtacaactccatcatgaagtgcgacgtcgatatcagaaaggatctgtacggtaatgttgtcctcagtggtggctccactatgttccctggtattggtgaccgcatgagcaaggagatactgcacttgccccaacagcatgaagtaagtggttgctccccggagagaataagtgtttggattggtggtcatctggctcccagtacttcacaatgtgatncangaagattacaacnggncggcatatcaataaatctcgaattcggacataancgtnctnatttantattgatcaattgcc

SEQ ID NO: 14179 - DNA, 954 bp, Triticum aestivum
  Clone ID: PAT_TA_14179
ctgtgccaatctatgagggatacgcgcttcctcatgctattcttaggttggatcttgctggtcgtgatctgactgactgcctaatgaagatcctcacagaaaggggttattccttcactacaacagcagaacgggaaattgtaagagatataaaggagaagctggcctttgtcgcccttgattacgagcaggagcttgagactgctaagagcagctcctctgtcgagaagagctatgagttgcctgatgggcaggtcatcacaattggcgcagaaaggttcagatgcccagaagtgcttttccagccgtcactgattgggatggaagctcctggcatccatgagaccacctacaactctatcatgaaatgtgatgttgatatcaggaaggatctgtatggcaacatcgttctcagtggaggaacaaccatgttccctggcattgctgacaggatgagcaaggagattagtgcccttgcaccgagcagtatgaaaatcaaggtagtggcgcctccagagagaaaatacagtgtttggattggtggttcaatccttgcctccctcagcacattccagcagatgtggatatccaaggaagaatacgatgaatccggacctgctatcgtccaccgaaaatgcttctgagctttcagccgcacctttcgttgtgtgtcaggctgttgagatctgcattattgagtgtctttgtgaagtacatatagtttttgcgagcatgattgcatgagggaaggagtacacccaactaagcatttgcctttcatatgccctgctttagtgatccagatgctgcttcttcaagtgatttgtcgatatagtatgcgagcaatgtattggttttggctacagctgtcctgtcatgacattagctatgtatctatctatatctgcatacagtattggctatttggtcgttagaaaaaaaaaaaaaaaaaaa

SEQ ID NO: 14180 - DNA, 427 bp, Triticum aestivum
  Clone ID: PAT_TA_14180
gaggagcaatcggggtgctaataaaatcattgttgttggtattggtgaagtcacacaaattagtattatcttgagccatcgtgacaagcaagcaaactaacacacaagcaaacaaaaagcaagcgggcaaaagaggcaaatggcgaaagagagggaggatagaaagagagagagggcaaataaaacggccggggagaagtggcgcagcatgtcggatgaggagaaggcaaagtatggcggcaagaaggcagatgccccagcaagcaaggtggtgaacaagaaggagagcaccagctccaagaaggccaagactgacgctgacgaagaaggttctgacgttgaggatgatgccgaggaggacgaggagtaaatagtagatgagggaacagcagcggtgcaaatcagcgtttgctgcttaaggtttagc

SEQ ID NO: 14181 - DNA, 672 bp, Triticum aestivum
  Clone ID: PAT_TA_14181
cagaaagagatctccaagcacgcgacgatatggtagcagtatcatcctagtgcctatctagctttctacttcctttgttttgtagactaatataagatgttttagatcactagtcaggatcgattactttattatcatataggtaacctaaccaaagatatactcctccatcgattaaccgcgtctgtgcatgcagtcaacgccggcgatgaagatgggcccgtatggcggcccaggagggaatcactgggacattaatgctctcaatccgcccaaaaagattgtgagcatccagatttggagcactgattcctcatgcgaaggggccagcggggtcatcaacggcatctctttcagctatcttgacatggcagggcaactaatcccctcgggtccatggggctcccagaccggtaaaccccacgtgattaacattggtgaagacgagcgcctgatcactgtctacggcaccagcgatggcaaatttgtcacctcgcttaaatttgtcactgacagggcttccgatccgtatgggccatacggggcaccgtctaccataagtactttcagcttccagggcggctccatcctcgccttcttgggccgctcctcagacaaactcaatgccatcggcgcctaccaaacttggggtttgatccatctaaccatcat

SEQ ID NO: 14182 - DNA, 719 bp, Triticum aestivum
  Clone ID: PAT_TA_14182
gtaacaagaggttattctcaggatggcattatgttactactagtaaagaacattgccaagccagaaaaagtccaaggactaaatatagggctacaagcgtcatatagcaccattggtggctggcggacgaaggaatagggatgcctctagcccgccacctctggttttatagtaaataagtcctgaaccatcaaaataaaaccacgtggttctctagcgtctacataccccaggagtagattctactggaggattatgatagttatgtacaccttgactgtaacttcgcacgtcgcaggaagctgtggggctttgcagttgggaagtcaccatcttcatcaggatcagaggactctcagctgggttagaaaggcagaacacaggtccagaaacaggagctgtggtccactgaccctttgcaagtcgagaagatacttctcatcccttgttttgtagagctgaatttcaaacttcacgatgtgggttgatttgtcactgaggccatcagcttcaattatagcagattccacaccgaagccattgttgttatgcatcatagtctcaacaaagccaggactccacctgcacttcatgttatagtgcccaatcttcttccagcaaacatttagctcttgcagagctttaagcacttcagttatgatttctcgtggatgtgctcgagactgaagaccaagagcccatttcctctcagctgcaaa

SEQ ID NO: 14183 - DNA, 885 bp, Triticum aestivum
  unsure (1)..(885): unsure at all n locations
  Clone ID: PAT_TA_14183
aacagacgacgacgcttactcgataccattaccggttgcgactgtaagacagacagacagacggacaccaggaggaaacaggagtacattacagagtgctagccaaaatgcgaaagccacaataccgttaccgttccgccgcgcagagagacgaccataaataaagcttacacaacatagccaacaaggagaccgttcggacctggggctgccgccgaggcgcgtgtgccgtgcatcacgattgcccaacaacaactaggattgcagaagccaacatgatgaaaggataatgcagcaaaaacgcacgatggcgaggtagcgcaaatttgatttgggaccttatgttctgccgaccgtaggggggcccttcctagatcttgtcgagcttctccgccttcaccaccgggttggccttggcgatggcgtccatggccgcggcgcggtagtcaaacttgcactcatgcttgtccgagtaacggtgcgtcgcgcagtagaggttcccgcaccggcagttgaatccggtcagcccgaccctctttctgcaggtgctgcaccggcttgggcctttggggttctccatcgccgcctcgctgggaccggcgatatcagcaggctgtgcggtaataagcgtcttcgcctctacgtgagcaactgcctgcttggcctgctcctgcttcatcgccatctccttgtggcacttggagcacatgttcatggtcgccgcactgccgaagaagccgcagttattgacgcaaaggatggggccctcacgagactggcagccggtctccttgtgctccatgactttgatttaactgataggaggaagccctcgtcgcgattcctntccggcgatcccctaggagggggaggcctcgtgccgaa

SEQ ID NO: 14184 - DNA, 648 bp, Triticum aestivum
  unsure (1)..(648): unsure at all n locations
  Clone ID: PAT_TA_14184
ggagaagctcgcatatgtggctcttgactatgaacaagagctggaaaatgccaagagcagctcctctgtggagaagagctatgagctgcctgatgggcaggtgatcaccattggggcagagaggttccgttgccctgaggtccttttccagccatctttcattgggtatggaagctgctgggaatccatgagaccacctacaactctatcatgaagtgtgatgtgggatatcaaggaaggatctgtatggtaacattgtgctcaagtggtggctcaaactatgttccccgggtattgctgaccgtatgagcaaggagatcactgcccttgcaccaagcaacatgaagtncaaggtggtggaccgcctggagaggaantacagtgtcccgggatttggaggtccatccttcctccctttaataccttccaaacagatgtggtttcccaaaggcgatatgataatcaagtcaaacatttccaccgnangcttccaaattccaattgtccggnnctccggaccatccgggtgtcttcnaaatctgcaagtaagcacangttaanaatgctggatcgtgacngantgcggntaattgtggtaaaatggtncntganaccganagtaagggcngaaatttccgnccataaaaa

SEQ ID NO: 14185 - DNA, 917 bp, Triticum aestivum
  unsure (1)..(917): unsure at all n locations
  Clone ID: PAT_TA_14185
gcggccgcccgggcaggtgaattgctctgagaggattattcatcattgacaaggagggtgtgattcagcattccactattaacaaccttggtattggccgtagtgtggatgagaccttgagaacccttcaggctctgcaatacgtccaacaaaacccagacgaggtctgcccggcgggatggaaacctggggaaaagtcgatgaatcctgaccccaagggcagcaaggagtcttggctgggcgtgatctcaccgattacctcatgaagatcctgactgagcgtggttactcattcaccaccactgctgagcgggaaattgtgagggacgtgaaggagaagctgtcctacattgccctggactacgaccaggaaatggagacttccaagaccagctcttctgtggagaagagctacgagcttcctgatgggcaggttatcaccattggttctgagcgtttccgttgccctgaggtcctcttccagccatccttcattgggatggaagctgcaggtattcatgagactacctacaactccatcatgaagtgcgacgtggatattaggaaggatctgtacggcaacattgttcttaagtgggtgggtaccactatgttcactgggaatccgctggataggatgagcaaggagatcactgccttgggctccctaagcagcatgaagattaagttgttgctccctccctggaaaggaantacagtgtcctggatncgagggtttcaccttggatctcctcaacaccttcccagcaatgttggatgcaaagctggattacgacgatcctggccaccaatggtncacaggaatcttcaattcttccgggcccaanaaagaaccaagagaccttaacgcgacctcctnctcntccnccatttggtgcngntcttgtaacgtggaa

SEQ ID NO: 14186 - DNA, 566 bp, Triticum aestivum
  unsure (1)..(566): unsure at all n locations
  Clone ID: PAT_TA_14186
gtcgtggcgcctcccgagaggaagtatagtgtctggatcggtggctccatcctcgcctccctcagcacattccagcagatgtggatatccaagggagagtacgacgaatctggcccctccatcgtccaccgcaagtgcttctaagccttggggccgtgtcttactccgtgtctctgcacttttcctatgattgagcttgtatccgactcccctccattgaagtattccccgagctttcctgcggccgtttttacggatgatttggcattgccggatgaaggaaattagtcctgtatcgcttaatacagaagacccgcttgttcttaagtgatatactacaagttgggtgaattaaccggtgcgcncggaggaagaccgaccacggtttcggtgtgggcttgggctgttgttggctgcaaaatgcaanaccttggcgtgtagtanaatattcctccaacaaatanatggggtggaatatataatgtaataccgttaatgcttggtcaanaaggtgncacggtcaatcggctgcggntttattanaatttcaaangaaaanaantcta

SEQ ID NO: 14187 - DNA, 630 bp, Triticum aestivum
  Clone ID: PAT_TA_14187
aagtggtaaaaggacagaacgcacctccccgcgattcaaactatcctgatttgtacatcttcaggcaaataaaagaaccccgaacccacatcctatatgttccgcacggtgaaaaaagagtctcctgttacttcacccacctacttggccgcagcgccacggtaaaaagacagaacccactcaggttcaacctacactacaggtattcgtttgcacactctcacctaagctcttcgcttgctctgccaaaaacaagtcactcatgttttctacatcgactattaccttgtcaaccgctcctacttcttcggcgccgcttcagggccctgcccagcagcactgcccttgctctgactcttctccttgtccttgtccttgtcacctttcctcttggaatgttcgagacggtccaacttctgcctctggaactcagagaacctcttggcctttgctgctgctgccgtctcctctatatccctggtgctcttcccctccacaggcttcttggtcgggctcttggtgggttcctcattggcgggcttcttgtagctgtagaatgggttgcagaggtccttgatgctctggataaacgtggcgctgggggtcttggcacggctgcccctggatgta

SEQ ID NO: 14188 - DNA, 693 bp, Triticum aestivum
  unsure (1)..(693): unsure at all n locations
  Clone ID: PAT_TA_14188
agctgtcctacattgccctggactacgaccaggaaatggagacttccaagaccagctcttctgtggagaagagctatgagctgcctgatgggcaggttatcaccattggttctgagcgtttccgttgccctgaggtcctcttccagccatccttcattgggatggaagctgcaggtatccatgagaccacctacaactccatcatgaagtgcgacgtggatattaggaaggatctgtacggcaacattgttctcagtggtggtaccactatgttcactggaatcgctgataggatgagcaaggagatcactgccttggctcctagcagcatgaagattaaagttgttgctcctcctgaaaggaagtacagtgtctggatcggaggatccatcttggcatctctcagcaccttccagcagatgtggattgcgaaggctgagtacgacgagtctggccatccatcgtgcacaggaaatgcttctaaatcttcggaccaagaaagaaagcaagaggagccttatcgcgacctcctgcttcgtctctccnatttggttgctgttcctccgttagcgtgggacaaagtttccggcgccctaccggcacctttcctccctaatcaaagacggtatatcaatgctactgggctcccaacttggggatttggacacatatgttcggttaatcaatcaaatc

SEQ ID NO: 14189 - DNA, 633 bp, Triticum aestivum
  unsure (1)..(633): unsure at all n locations
  Clone ID: PAT_TA_14189
acaactgctcctcctgcattccccctttccccttccgtccgctgcattcctgctctcttgctctcctcgctctcagaccacagttgccgccgccgccgccctaagccagggtgctgaggctttcgttggcctcttcgccggcagcgagcacccaccagcagttctgtagaaatggctgatggtgaggacatccagcctcttgtctgcgacaatggcaccggaatggtcaaggctggttttgccggcgatgatgcaccaagggctgtattccctagcatcgttgggcgtcctcgtcacaccggtgtcatggtagggatggggcagaaggatgcatatgttggtgatgaggcacagtccaaagagaggtattctcacgctcaagtacccgattgagcacggtattgtaagcaactggggatgacatggagaaatctggcatcacacttctacaatgactccgtgttgccccggaggacacctgtgttgcttactgaggtccttgaaccaaaggcaacaaggagaagatgaccagattattttcgagacttcaatgttcctgccatgtacgttgcaattcaaagcatcctgtcaccctatgctaatggcctactacnggtattgttcncnatccgg

SEQ ID NO: 14190 - DNA, 823 bp, Triticum aestivum
  Clone ID: PAT_TA_14190
cggtcgcgtggggttcgagttcaccggccgttatggagatgaagcccgccgtgcagccggtcacgggcgtccccgtgggcgcggcgcccgtcgcctggtcctccggcctctttgactgcttcgacgactgcggcctctgctgcgtgacctactggtgcccgtgcatcacgttcggcaaggtggcggagatcgtggaccgggggtcgacgtcgtgcgggacgagcggcgcgctctacgcgctcctgtgctcgctcacgggctgccagtggatctactcctgcacctaccgctccaagatgcgcgcccagtacgcgctcccggacgggccctgctgcgactgctgtgtccacttctgctgcgagccgtgcgcgctcgtccagcagtacaaggagctcaaggcccgcggctacgaccccgagatcggctggcacctcaacatggagcgccacagcgccgggcgctgtcaacccgcccggcgtgccaggagatgggccgctagctggctagctggtcgaattcagctgctgctttatttattaccgtttgcgtttgcgtcgtttgtgtttgataaattatcgcatatattgtatttgtacgcagtaacttgtgtgagtatgttggatggtgatgtgatgacttgatgttttgctcttgcaacttcaataatcttttggtttgctaagtgcacactccgtgcaccacagttatgagttgatgtcaggaatgggaggaccggaacgtgtgtcgcctataatgcctctatgcattttcttcaatgtaccttatgtttgcattttatttattgtattgtataatatactcc

SEQ ID NO: 14191 - DNA, 434 bp, Triticum aestivum
  Clone ID: PAT_TA_14191
gcactttccaacagatgtggatatccaaggatgagtacgacgagtctggcccggcgatcgtccacaggaagtgcttctgatctccgggagcgctccacggctgttatcatctagtctcgggttatgtttggttcattcttctagaaatgtattgcgtatttgcaagctatgtttttttccagacgtgacgtgagtactctcgggatatgccacctatatacgtggcggctccatggtgcaagtgcaagtacaagtacactatatctatgtttgtgcattgtcacagtgtgtttgtgagatcagttgtcaaacttgggttggcttgatttgttgttggagttgtctgtaatagctcatgtttttgcgatgtactatatcttattatttctttgaggggaaaaaaaaaaaaaaaaaaaaaaaaaactcgagactag

SEQ ID NO: 14192 - DNA, 950 bp, Triticum aestivum
  Clone ID: PAT_TA_14192
tttttttttttttatttctgaacgattttgattgcataatcaactcatccaagcactgtaactgcacacgagctccaaagcaagaaactttcagaagcctcaaatcatctatacacaccaaccatgaaagcctccaaacctcacatgcaccctggggcaactctactactccagcgcttgcacccacacaaagctacagcttccctccagagaccagaccccaaacaacgcgaaaaacaaggggagggtacgcgaaaactaggtgcggagcgccatgaacaggttctgccttctcgcgtgctccggaaccaggcgctcgacgacttctggaggtataccgtttagctcttgagatctgaagttgaagaggggaggtagagggcggccgttaggtagacgggtgtttggatctctcaactcgtcaaagaacgggtgcatgcaggcttccatagcagtgcaccgaagatctggcgagtattggagaaacctgctgacaaggtccattgcttcaggtggaagctttttctgaaaaaccttgtgccatgggtgagccttaatttgtgggaacttgaactccgtgtagtttggattcatgcacttgatctcttcccttgttggagtacccaagaccttgataatctcaaccagctgatcaactccactttccccaggaaaaagaggcttgtccaagaagcagctttgccatgacacagcctgtggaccacaaatcaatggccgtagtatattcagttgcaccaaatatgagttctggtgctcggtagtatcttgagcatatgtaggagatatttggctctcccttgaccaagacctttgcactgccaaaatcacatattttaagctggtgtgtatgtgggttaacgagaacgttctgtggtttgatatcacggtggcagatgccaacacagttgtgtatataagctagttctctc

SEQ ID NO: 14193 - DNA, 884 bp, Triticum aestivum
  Clone ID: PAT_TA_14193
gtgagaagctagcatatatagcccttgactatgagcaagagttggaaactgccaagaacagctcttcagttgaaaagagctatgagctacctgatggacaagtaatcaccattggtgcagagagattcaggtgccctgaggtcctcttccagccgtcgatgattggtatggaggctgctggaatccatgagacaacatacaattcaatcatgaagtgtgacgtggatatcaggaaggacctctatggtaacattgtgctcagtgggtgggttccgactatgttcccgggtatcgctgattcgtatgagcaaggagatcacttcccttgcaccaagcagcatgaagatcaaggtcgttgcaccgcctgagaggaagtacagtgtctggataggagggtcgatcctagcctcgctcagcactttccaacagatgtggatatcgaaggaggagtacgacgagtctggcccggcaattgttcaccggaagtgcttctagggtttcacaagttcctcgtcgttacctagtctcaaattatgtcccctccatttctcgagatatgtgtggcagatttgcatgatacgtttgtttgtttccatcggacctgaagtcttcttggggataggctcccccctttgtatgttgtggctccaatccatgtgcgagcacgctgtgtctgtcgtgacacctggttcgtgagatgggttgtcaaacttgattggtttgttgtgcgtggctggaagagctgatagttatatatttggcttggactgtgccgcttgtatgtatctgaattctgaaagcgttgtaatctgagcatccgtgcaaagtatgaatggcccttttatatgggctggattttccggtttctatacaaaaaaaaaaaa

SEQ ID NO: 14194 - DNA, 1341 bp, Triticum aestivum
  Clone ID: PAT_TA_14194
aatcacaagtgagaagcacaagtagcaatagatattacagtctttgaataggaggaaacggtgaccggtagggcagccgaaaactttgtccacgctaacgaagaaacagcaacaaaatagagagacgaagcaggagggtcgcgataaaggctcctcttggctttctttcttgggtccgaagaattagaagcatttcctgtgcacgatggatgggccagactcgtcgtactcagccttcgcaatccacatctgctggaaggtgctgagagatgccaagatggatcctccgatccagacactgtacttcctttcaggaggagcaacaactttaatcttcatgctgctaggagccaaggcagtgatctccttgctcatcctatcagcgattccagtgaacatagtggtaccaccactgagaacaatgttgccgtacagatccttcctaatatccacgtcgcacttcatgatggagttgtaggtggtctcatggatacctgcagcttccatcccaatgaaggatggctggaagaggacctcagggcaacggaaaccggacgcgtgggcggacgcgtgggcggacgcgtgggcggacgcgtgggtttcaatgttcctgccatgtacgtcgcaattcaggccgtgctttccctctatgcaagtggtcgtactactggtatcgttctcgactctggtgatggtgtcagccacaccgtgcccatttacgaaggatacgcgcttcctcatgccattcttcgtttggatctcgctggtcgggatctcacggactccctcatgaagatcctcaccgagagaggttactccttcacaacctcagccgagcgggaaattgtaagggacatcaaggagaagcttgcgtatgttgcccttgattatgaacaggagctggagactgccaagaacagctcctcagttgagaagagctacgagcttcctgatggtcaggtcatcacgattggcgcagagaggttcaggtgccctgaggtcctcttccagccatccatgatcggcatggagtcttctggaatccatgagacgacctacaactccatcatgaagtgtgacgtggatatcaggaaggacctgtccgctccccactccgcagcagttccgcaccgacgccctcgccctcaccctccccaaagccctaaccgctcgcccgctccgccgccatgaggtccaaggccaacggagacaccgcgttcaaggcctccggcaagaacaagacggccaccggcggcgtcgccaagccgaagcgcgcccccacccccttcttcgccttcctggctgagttcaggccacagtacctcggccgcgaccacgcta

SEQ ID NO: 14195 - DNA, 570 bp, Triticum aestivum
  Clone ID: PAT_TA_14195
ggaagtacagtgtctggatcggcggctccattctcgcctctctcagtaccttccagcagatgtggatctccaaggcagagtacgatgaaaccggcccgtcgatcgtccacatgaagtgcttctgatcagtccgaggctgaccaacctgtacctgtcattcagttgcttgaggtccaaatcgcagatgcttgaatgtgccatggtttccatggcgtcgtggttcgctgaaagtgttttggtcatggaacaaatttgaaaggtaaggtcgattgatggtttcgaacaattctgtaggacgtcgggtcagtttcaagtgggttcactgaagcatgtagtctgggacatttattttgggtttcggcgattcagctcatgcgtgtgctggagacctgaaacagagtgtcgtttgtttgcaccaccccggcgagggtgttgattcttgtaccttttgtagcgggggtttcttgtcaaaccacctggtcagttctcgcatgtagaagcttattttgttggtacttcagcatttgtacattttgaattattattgaaggaagtttatgtttgttaaac

SEQ ID NO: 14196 - DNA, 877 bp, Triticum aestivum
  Clone ID: PAT_TA_14196
acaatacacagctagcaagccatcgagatcaccaacgcacgtacagagacctcgtctcatctttccagttcacaggccgttgtcaagaatgaaggtgaagcccggcacggagccggccaccggcgtccccgtcggcggcgcacccggcacccccaccgcctggtcctccaccggcgtccccttcggcggcgcacccggcgcccccaccgcctggtcctccggcctcttcgactgcttcgacgactgcggcctctgttgcctgacttgctgctgcccgtgcatcacgttcggcaaggtggcggagatcgtggaccggggcgcgacgtcgtgcgggacgagcggcgcgctctacgtgctgctcgcgtcgctcacggggtgccactggatctactcctgcacctaccgctccaagatgcgcgcccagtacgcgctcccggacgagccctgctgcgactgctgcgtgcactactgctgcgagccctgcgcgctcgtccaggagtacaaggagctcaaggcccgcggctacgaccccgagatcggctggcacctcaacgtcgagcgccgcaacggcggcgccggggccggcggcgtcaacccgcccggcatgcagcagatgggccgctgatcgaacccggctgctcaatgccttgctctacgtctacgtgtgaagggagtatccatcgagcaagcgttctttcgtgcttggtttcagttcataatgtgatgtcaggaccagaaacgtgtgtattttttttctcttgcgatggcagaacgtgtgtatgttaatgtcgctatgcatttcatcattgtatttatgatggctggccaccgagccggccggcctaccggttttgaataaaaattcgtgtttgctatt

SEQ ID NO: 14197 - DNA, 1191 bp, Triticum aestivum
  unsure (1)..(1191): unsure at all n locations
  Clone ID: PAT_TA_14197
cgggcaggccgacagcagtgtgtgtgcgcgcgcgagatccagacttccagaccggcagagtgagggagggaggacagtccagagcggcagcagttatagccaccgncttccccaccaccttcccccttctcctccgatcgcatctcccctcctccgcgggccccctcctcccgtcgcccgcctcggcctcctccgagctcgctcgctcgctctccacgatattctgtaggaaatggctgacggtgaggacatccagccccttgtctgtgacaatggaaccggaatggtcaaggctggtttcgctggagatgatgcaccgagggctgttttccctagcatagttggtcgcccacggcacactggtgtcatggtagggatggggcagaaggatgcctatgttggtgatgaggcgcaatccaagagaggtatcctcacactcaagtacccgatcgagcacggtatcgtgagcaactgggatgacatggagaaaatctggcatcacaccttctacaatgagctccgtgtggcacccgaggagcaccctgtgttgctcactgaggctcctttgaacccaaaagccaacagagagaagatgacccagattatgtttgagactttcaatgttcctgccatgtacgtcgcgattcaggctgtgctttccctctatgcaagtggtcgtactaccggtatcgttctcgactctggtgatggtgtcagccacactgtgcccatttacgaaggatacgcgcttcctcatgccattcttcgtttggatcttgctggccgtgatctcacggactcccttatgaagattctcaaccgagagaggttactccttcacaactcaagccgagcgggaaattgtaagggacatcaaggagaagcttgcgtacgtagcccttgattatgaacaggagctggagactgccaagaacagtcctcggttgagaagactacgagcttcctgatggcaggtgatcacgattgggcgcagagaggtcaggtgccctgaggcctcttccagcatccatgatcggatggatcctctggaatcatgagacaactacaactccatcatgaatgtgacgtggatatcangaaggactgtatggaacattgtccatggtggacaacattccaagtatnctacgtagacaagaatacgccntgctcgacacataaataagnctc

SEQ ID NO: 14198 - DNA, 838 bp, Triticum aestivum
  unsure (1)..(838): unsure at all n locations
  Clone ID: PAT_TA_14198
ttgctggccgggacctcacggactccctcatgaaaattctcacggagaggggttactccttcacaacctctgctgagcgggaaattgtaagggacatcaaggagaagcttgcatatatagcccttgactatgagcaagagttggaaactgccaagaacagctcctcagttgaaaagagctatgagctacctgatggtcaagtaatcaccatcggtgcagagagattcaggtgccctgaggtcctcttccagccatctatgattggtatggaggctgctggaatccatgagacaacatacaattcaatcatgaagtgcgatgtggatatcaggaaggacctctacggcaacattgtgctcagtggtggttcaactatgttcccgggtatcgctgatcgtatgagcaaggagatcacttcccttgcaccaagcagcatgaagatcaaggttgttgcaccacctgagaggaagtacagtgtctggataggagggtcgatcctagcctcactcagcactttccaacagatgtggatatcgaaggaggagtatgatgagtctggcccagctattgttcacaggaagtgcttctaggtttctgccaagttcctcaagtgcttttagggttcgccatgttcatcatcgctacctagtcttaagttatgcccccttcatttgctgagatatgtgtggcagatttgcatcgttttggtatttcgtggctccatgtgtgaagcatgctgtgtcctaaaacctgggtttatgagatgagttgttaaacttgcttggcttgattggtttacctgtaagagctgatagttatataaattgcttgtacntgg

SEQ ID NO: 14199 - DNA, 1123 bp, Triticum aestivum
  Clone ID: PAT_TA_14199
attccccaatctcctcccgcactcaacctcaaccccaatccccacctaccccaaccccatggcgcccaaggcggagaagaagccggcggcgaagaagcccgcggaggaggagcccgcggcggagaaggccgagaaggcgcccgccgggaagaagcccaaggccgagaagcgtctcccgtcggcgggcaagacctcggccaaggacggcgacaagaagtccaagaagaagagcaagaagagcgtggagacgtacaagatctacatcttcaaggtgctcaagcaggtgcaccccgacattggcatctcctccaaggccatgtccatcatgaactccttcatcaacgacatcttcgagaagctcgccggggaggccgccaagctcgcgcgctacaacaagaagcccaccatcacctcccgcgagatccagacctcggtccgcctcgtcctccccggggagctcgccaagcacgccgtctccgagggcaccaaggccgtcaccaagttcacctcctcctaggttcgcccgccccccctcctggtgaccgctgttgatccccgccgtggatctgcctgcctatctagatatatatagtagtattagtagtagcgcttgatggaaatcgttggactgttgatggttcgtgtgtagtcgtggttggtttgtaagaggatgtccccgtggtgctacttttgcctggtcgatctgaatattaatggaacaatatctgctactccgaatttgtcttgaatcatatcaagagtagttatattttgacatcctgtctgtgctatgcttgatgaatttgagatggttatttgattttgatccggcctgttgtgcaccgtgcgtgctagtttacctcattctgttgttcctggccgctgttgtcaatggtataaaagtagtcacaattgaataaatttagacctaattggggtgttacaattggttgatctgaatgttaatgaaatcatgtcagctactctgaatttgctatgtcaggtcaaaatcatataaccatcccaaattcatcaaccacagccacacaggatgtcagatataactactcttaatatgatacatagcaaattcagagttgacaagctgcaagtaattttatat

SEQ ID NO: 14200 - DNA, 879 bp, Triticum aestivum
  Clone ID: PAT_TA_14200
tgttatctgctccgcatctctgatcttaataatgtacacccaggagaatccaaagacatagaggcagagaagagtcgtcgagaagacgaacatataaaagaacctgtaattccgaagtcctatgcactgcccaacccatgggcagtgatggtcaaatcgctcgacacagttgttgcagatagagcaatgggagcatcgaggaggccggtacagcatacaggtgtcacagtactttgtcttcacagtgattccattcacaacaacatccttcactcggggcaaacgcaatggtggagtctggttagctccaacttcagcattgccttcaaaaccttcaggttctggaggatgtgcatttcgaggtatgattcctggatccctcccagaagtgagaaatagaagactcaaatcatatgccgtgaatacaactgccacaaccatcaccggtaaccccaggccataagagaagctattcatcaattctttcgcgacgaacacacagaagactgttactggagcgataatgaggaacatggtgacaaacaaggatctcgcatcaggtccaaatataaacctcccctggaggaaaaacgacattgttccctttccaggcctggtacaccagcggcccctcgccgccggagccggagccggcgctcggcccgttcatcgccgcggcgctcccgggccagcaatcccctgcgggatcacgccccggatcgcggcatggccgccggagagctccctcccttgctcccgcgcccgctccgccgcccgccgccggggccgtgagctccctcccaatgcccgcccgccgccgcgccgccgccgatgccgggagcccagacagagaaacctgacaccccgcccacgcgtccg

SEQ ID NO: 14201 - DNA, 666 bp, Triticum aestivum
  Clone ID: PAT_TA_14201
attggagtggcagcataaattgaaaggtacaatgccgttcacaatctttgacaacggaagccaaagcaaaccaatccatttccgggttcaccactccaaactatatacagacacaattaagattctactgaactggagacctcacacaccaacaatctgcttaaaaaccactgatacatgatgcaagaattaacaaccaggtcataggcctaataacaacatcactgaccccgagtctcaaccacgacaccaaactacgaacaagctggcactaacatacaccccttagtcctcctccactatagctgcttagatggccacattggccagttaccatcacctgcccgcttcgactccccagctcgtccgtggtgggttcatcaccgaggagccttgctcatccaagccaccgaccacgagggcgtcacggcttagatctggtgatgcgttgcggaacctgccatccttgtcctccagcaagttgcccagaccgcccaggtcgcctatctctgctgccatcctgggctcatcccatgccaccggctttctgcccatctcgatgtcgccaacagctctccccatgtttgggctcatgaaaccgttcgtcgagcgaggcctcaggccctgctcctgtggaactctggcgccgaagttgttcctggaagc

SEQ ID NO: 14202 - DNA, 1344 bp, Triticum aestivum
  unsure (1)..(1344): unsure at all n locations
  Clone ID: PAT_TA_14202
aggaattcggcacgaggccgctctctgcagctgccgctcatctcggtgggaggtccttaggcgggcaggttcccctagatccccgggtaagcacgcccggccgtcctcgcaccagtttcctttcttcttttccggagtatccctgctaattttggcctggaagcatgcgatttctgcgcggccggggctggggcgtgctagatctgttgaattacccgcgaaaggactaatttagtcactcaatcaaatggctgacggtgaggacatccagccccttgtctgcgacaatggaactggcatggtcaaggctggttttgcaggggatgatgcacccagggccgtcttcccaagtatcgttgggcgcccccgccacactggtgtgatggtggggatggggcagaaagatgcatatgttggtgacgaggcccaatccaaaaggggtatcctcaccttgaagtacccgatcgagcatggcatcgtcagcaactgggacgacatggagaagatctggcatcacactttctacaatgagctccgtgttgcacctgagggagcacccagtactgcctgactgaggcgcccctgaaccccaaggctaacagggagaagatgacacaaatcatgtttgagaccttcaatgttccagccatgtatgtggccatccaggctgtgctttccctatatgctagtggacgcacaacaggtatcgtgttggattctggtgatggtgtcagccatactgtgccaatctatgaaggatatgcccttccacatgccatccttcgtcttgacctcgctgggcgcgacctaactgactgtttgatgaagattcttactgagagaggttactccttcaccaccactgccgaacgggaaattggtaagggacatcaaaggagaagctcgcatatgtggtcttggactatgaacaagagctgggaaaatgccaagagcagctcctccggtggagaagagctatgagctgcctgatgggcaggagatcactgcccttgcaccaagcagcatgaagatcaaggtggtggcaccgcctgagaggaagtacagtgtctggattggagggtcgattcttgcctcccttagtaccttccaacagatgtggatctcgaagggcgagtatgatgagtcaggtccagcgattgtccaccggaagtgcttctaagttgcgagttgtctgggtcttctgaatctattcnggctgttcttttctcaagtccttgccatgtaagctactatgtttaagattgctgggattctgttgactgtattgccggattaatttgttgggtcaaaattgtgtaccttgtagactcgtaatatgtaaag

SEQ ID NO: 14203 - DNA, 818 bp, Triticum aestivum
  Clone ID: PAT_TA_14203
gcgagcgacatcatcaacacacaaagacctcatcacatctttccagttcaccggccgttatggagatgaagcccgccgcgcagccggtcaccggcgtccccgtcggcgcggcgcccgccgcctggtcctccggcctcttcgactgcttcgacgactgcggcctctgctgcgtgacctactggtgcccgtgcatcacgttcggcaaggtggcggagatcgtggacagggggtcgacgtcgtgcgggacgagcggcgcgctctacgcgctcctgtgctcgctcacgggatgccagtggatctattcctgcacctaccgctccaagatgcgcgcccagtacgcgctcccggacgggccctgctgcgactgctgcgtccacttctgctgcgagccgtgcgcgctcgtccagcagtacaaggagctcaaggcccgcggctacgaccccgagatcggctggcacctcaacatggagcgccgcgccggcgccggcgccgtcaacccgcccggcgttcaggggatgggccgctagctggctagctggtcgaactcagctgctgctttactattgccgtttgtgtcatgcgtcgtttatgtttcataaattactattgcatatatggtactagtgtccgtagtaacttgtcaaaaaaagtaaccgtggtaacttgtgtgagtactccctccggtgctttttactctgcacattagatttgccgaaagtcaaactttgctaagtttgaccaaatttatattgaaaattattagcatctataatatctaataaatatagtatatatatttcaagatgaaaaaaaaaaaa

SEQ ID NO: 14204 - DNA, 879 bp, Triticum aestivum
  Clone ID: PAT_TA_14204
tgaagaaattattcgtgtacgtggtctggtctggagacccagacagtaaaaattacatgcaagtaaacagcagtagagtaggagtatgtcccaaggggccaatataggattaatcaataatacttctatatcctagtgcctttggcggcagctggaaataacctgatggcaatagttccttgcttgcttcacttgcccgcccctgccaggtctaaattcagcatataggcgccgaaataagcacacaacagctccgcatgtctacatactccacgactttgatccgctggagaaagcttgctatttacatctctttagagtgatacaacatacattcctcgggcacatctggtatcaaaggactctcagctgagctagaaaggcggcacatagatcaagaaagaggagatgcggcccgctcgccctttgcaaatccagaaggtatttctcatctcttgttttgtaaagctgaagttcgaacttaattaaatttaacttgtcacccaggtcgtcggtttcaataggctctgcactgaagttatagttggtatgattcatattctcctgaccgggaaagccaggaggactccatctacatttcatgttatagtgtccaatttttttccagtatacattcagttcttgcagagccttcagcacttcagtcataacttctcttggatgtgctcgagactgaagcccaagagcccatttcctatcagctggaaaatgtggtctcaaggcaactggagattccatatatggttgttgccgatttccatgagctggactttgtgtttcacttggagtaatgggtgagaatgacgattccatagattcttgatacccagctccaagatagccagttgttgagaacaa

SEQ ID NO: 14205 - DNA, 701 bp, Triticum aestivum
  Clone ID: PAT_TA_14205
ttgttcacgcgtccgcccacgcgtccgagatacatcatcaacacacaaagacctcatcacatctttccagttcaccggccgttatggagatgaagcccgccgcgcagccggtcaccggcgtccccgtcggcgcggcgccggccgcctggtcctccggcctcttcgactgcttcgacgactgcggcctctgctgcgtgacctactggtgcccgtgcatcaccttcggcaaggtggcggagatcgtggacaggggctccacgtcgtgcggcaccagcggcgcgctgtacgcgctcctgtgctcgctcacgggctgccagtggatctactcgtgcacctaccgctccaagatgcgcgcccagtacgcgctcccggacgcgccctgctgcgactgctgcgtccacttctgctgcgagccatgcgcgctcgtgcagcagtacaaggagctcaaggcccgcggctacgaccccgagatcggctggcacctcaacatggagcgccgcgccggcgccggcgccgtcaacccgccgggcgttcaggagatgggccgctagctggctagctgctcgaactcagctgctgctttattattgccgtttctgtttgcgtcttttatgtttgataaattgttgatatattgtattagtacgtagtaacttgtgtgagtatgtgggatagtgatgtgatgacttgatgttttgctc

SEQ ID NO: 14206 - DNA, 1666 bp, Triticum aestivum
  Clone ID: PAT_TA_14206
ctgttcctttccatttctgcccccggttcttcccccctcgcgcccaccacgacggcgggccgacgtcgttcccctccgccgccgccggcgcgctgaccgcccgccgcgcctccgccgtgtccccagccgtcctcctccccgacgccctcgcctcgctcctccggttcgcccaccaacataccaacccgggccccgatccgcgcggagagagggggggaggagatggcggtggtgctcgcgtggctcaacgccagggtcgtcgaccccctgctgcaggtgatccagaggggcgcggagccgaagcagctcgccttctccgccgcgctcggcgtcaccatcggggtcttccccatctgcgggaccactgttattatcggtggacttgctgtggccatgttaggagctcgttgcaatgccgttactgtcatggttctcaatttagctgccactcctcttgagctaagcttgatcattcctttcttgcgtttgggagaaatagtcacgggcggtgagcacttccccttgacatctgatgcattcaagatggtcctcacaggccacgcctcaaaggacgtgctactcagcatttttcatgcgattcttggctggattgttgctgcaccgtttgtgatggctgggctgtacaccttgtccgtcccttgtttcaagtacctggtcggcaggtttggcgtcatcccttcgagccccaggacgccgatgaaagcggtataacgtagctgtttccccctaaagcaactttattacgtttctgaagccgtgtgcgtgaattccttatattgcccgactgagacggcccggccgtcctaacttctgaacgccggcgcacaaataggcttgcagaggcatatactcgtatctgttagcgtgccacatgttgagcggaggtggtgtaattctcaatatatttttaagctgtagcaaacctttccttttttttctcttcttcttacgaacaagtgtgcgactcgattcacctgtttcaaaaccgatgatacttattcattcattacttcggaaactatggcctgttcatttggtttgagaaaaaaaaaaaaaaaaagggaaattgtaagggacatcaaggagaagcttgcgtatgttgcccttgattatgaacaggagctggagactgccaagaacagctcctcagttgagaagagctacgagcttcctgatggtcaggtcatcacgattrgmrcagagaggttcaggtgccctgaggtcctcttccagccatccatgatcggcatggagtcttctggaatccatgagacgacctacaactccatcatgaagtgtgacgtggatatcaggaaggacttgtacggcaacattgtgctcagtggtggcacaactatgttcccaggtatcgctgaccgtatgagcaaggagatcaccgcgcttgctccgagcagcatgaagatcaaggttgtcgccccacctgagaggaagtccaacatcaactccgtgctgctccccaagaagtcccccgccgccgtgggcgatggtgacgccggcgagcagcctgccaagctcctgatcgttgcggacggcgagcagcaggtggcgcgggatgatgcgggtcttcttgttgtccttggccgcgttgcccgcaagctccaacacctcggccgcgaccacgcta

SEQ ID NO: 14207 - DNA, 1606 bp, Triticum aestivum
  Clone ID: PAT_TA_14207
atcaaaaaccttgtagggtatggaagttcttggtgcccataacagttgtatgttgggaattccctcttgggagcgcaaatgtaatttgagttcatgctcgtctttttgggagcaaatgacatggtaagcacatctcttgtcaaacatgtacccacccaaagtagcaactccacaaccaacatctagaatcacacggcttcgtttaccccatgcaatatcaggtagagcctgctgaatagtatcgatgtagtggagtgcgccattcttgaactgagtaccgcccccaggaaacagaagatgatcaccagacactttaacccagttctgatggcccttgtactctgcaagcttggtgtgagggacgttgctgtaccataccttgtccatgctcttgggccactcgatggggtgcttatatccttccggaagtggaacaaggcaagtcggaggctccgcagggcaatgcctctcacggtgttcataatgcttggtagaatgaagtttcttgatagccttctcattgtcaaggcaaggtatgtaatctgtcaccgcactgctattacataatttccagctataggtgatttcatcacctgaagattttgatgctgcttgagcttccttctcattctttgactctgcagcctgtgtagggaatgacccattctcggtattcgactccttcagaagttcagactgagctccatcaggaaatacctcattggcttttgcagccggttccttctctccactttcttccactttctcctcgatttgaggctgttcagttgcatcgtcctcagactttccttcttgatcttccttcttctccccatcggatttttcaacatcattgtcagttgtgatcttctcctcctcatcaccagattgcccagtcaccccaccctccttagcactctgtccttctgattttccatttgcatcatcgaacgaatccttactgtcctccttctcctttggtgattccttttcttcagccatctccacaggcttctccattgtgttctcagggaacttctcttcctcaggagcatccctgttactatgcgactcatctggaacattgtcattgttgtcagtgtcctcgaatttctccgagctaacactgccggatttcgccgcctcgtcggtttcaccaaagccaacttctgcgcgctgatccttgacctccgtcttcttattcgatgttgatacctctatcggctccgacttcttgtttgaagtaggctctaccgggaagacggtggtggatgtcatcatccaggcgcccaccaggcagagcgccacaaacacgacgacggtggtcgtcgtgcacatcgacgaggacggcgacgagggccgcctgccgtccatcttcgcgcctcggccgaatgccatcagtcccgctagcacatgtacaggaccacccccgctgcacgcggcttgtttatatcagaggttgcagagctttgctgctttctgccacacaccgcgcgcacctcgccggccggggagctggggtccggcggctccgagcggatctcgaggaggggccgaggggatctagcaggcaaggcgcacgcgtgggcggacgcgtgggcggacg

SEQ ID NO: 14208 - DNA, 933 bp, Triticum aestivum
  unsure (1)..(933): unsure at all n locations
  Clone ID: PAT_TA_14208
acacgccaatcatatatcagctttgcttagatgtggtttctcaaatgtattttctttctcctgattgcagaaagccatttcaagcgcaaggagctgctgaacctactggatgatatgaagcagatggtgctctacttctgtatcatgattgtagccttgtaagcaagcagctagcatttcctgcaaaaactagaacagaaagagatctccaagcacgcgacgatatgtcaacgccggcgatgaagatggccccgtatggcggcccaggagggaatcactgggacattaatgccctcaatccgcccaaaaagattgtgagcatccagatttggagcactgattcctcatgcgaaggggccagcggggtcatcaacggcatctcgttcagctatcttgacatggcagggcaactaatcccctcgggtccatggggctcccagaccggtaaaccccacgtgattaacattggtgaagacgagcgcctgatcactgtctacggcaccagcgatggcaaatttgtcacctcgcttaaatttgtcactgacagggcttccgatccgtatgggccatacggggcaccgtctaccataagtactttcagcttccaagggcggctccatcctcgccttcttggggccgctcctcaagagaaactcaatgccatcggcgcctacaaacttggggttggatccatctatccatcatggccagcatacgtgtctgctgacttccgtaagttttggctcccgtttgaacatgtgtttcgacctanatctactgcttgtattttcaagcttaattaaagggattcctccgcttctcancctaaggatgatggtttcctgcctccgtttcnttntntcgcctgctcctcttggtttccanatatttgtacaaccctacccgtgtaactttaanatnaaaaaatctcaa

SEQ ID NO: 14209 - DNA, 843 bp, Triticum aestivum
  unsure (1)..(843): unsure at all n locations
  Clone ID: PAT_TA_14209
caagcaagcagctagcatttcctgcaaaaactagaacagaaagagatctctaagcacgcgacgatatggtaggagtatcatcctagtgcctatctagctttctacttcctttgttttgtagactaatataagatgttttagatcactagtcaggatcgattactttattatcgtataggtatcctaaccaaagatatactcctccatcgattaaccgcgtccgtgcatgcagtcaacgccggcgatgaagatgggcccgtatggcggcccaggagggaatcactgggacattaatgctctcaatccgcccaaaaagattgtgagcatccagatttggagcactgattcctcatgcgaaggggccagcggggtcatcaacggcatctcgttcagctatcttgacatggcagggcaactaatcccctcgggtccatggggctcccagaccggtaaaccccacgtgattaacattggtgaagacgagcgcctgatcactgtctacggcaccagcgatggcaaatttgtcacctcgcttaaatttgtcactgacagggcttccgatccgtatgggccatacggggcaccgtctaccataagtactttcagcttccagggcggctccatcctcgccttcttgggccgctcctcagacaaactcaatgccatcggcgcctacaaacttgnggtttgatccatctaaccatcatggccagcatacgtgtctgctgacttccgtatgggtggcttcggtggatacatgtgttcgacctatatctactgcttgtatttgcagctaaataaatggggatccctcgctgatgcatcctatggatggatggatcc

SEQ ID NO: 14210 - DNA, 857 bp, Triticum aestivum
  Clone ID: PAT_TA_14210
gcgcacgacacggccactttccacgcctccgtctccgccttcctcgccagcgagctccgctccgttccgcctcctcctccggtccccaagaccaatggctgacggcgaggacatccagccacttgtgtgtgacaatggcactggaatggtcaaggctggttttgctggtgatgatgccccaagagcagttttccctagtatagttggccgccctcggcacacaggtgtcatggttggaatgggccaaaaagatgcctatgtgggtgatgaagcgcaatcaaaaaggggtatcctgaccttgaaataccctattgagcatggcattgtgagcaactgggatgacatggagaaaatctggcatcacaccttctacaatgagctgcgtgttgcccctgaagaacatccagttttgctgacagaagctcctctgaacccaaaggcaaacagagagaagatgacccaaatcatgttcgagacattcaatgccccagctatgtatgtggctattcaagctgttctttctctatatgcaagtggtcgtacaaccggtattgtgcttgattctggtgatggtgtgagccatactgtgcctatctacgagggatatgcacttcctcatgctattctccggctggatcttgcgggccgtgatctgaccgactccctgatgaagatcctcacagaaaggggttattccttcactacaaccgctgagcgggaaatcgtaagagatataaaggagaagctcgcctatgtcgcccttgactacgagcaggagctggagaccgccaagagcagctcatccgtcgagaagagctacgaactgcctgacgggcaggtcatcacgatcggcgccg

SEQ ID NO: 14211 - DNA, 776 bp, Triticum aestivum
  Clone ID: PAT_TA_14211
aatcaacccggcacacacaacagccaacaggcaacagcaaagcgacctcaccagcgcacaaagatcacctcatcacagctttccagttcaccggccatcgtcgcgatgaagcccggcaccgagccggccaccggcgtccccgtcggcggcgcaccgggcgcccccaccgcctggtcctccggcctcttcgactgcttcgacgactgcggcctctgttgcctgacttgctggtgcccgtgcatcacgttcgggaaggtggcggagatcgtggaccggggcgcgacgtcgtgtgggacgagcggcgcgctctacgtgctgctggcgtcgctcacggggtgccactggatctactcctgcacctaccgctccaagatgcgcgcccagtacgcgctcccggacgcgccctgctgcgactgctgcgtgcactactgctgcgagccctgcgcgctcgtccaggagtacaaggagctcaaggcccgcggctacgaccccgagatcggctggcacctcaaccaagagcgccgcaacggcggcgccggcggcgtcaacccgcccggcatgcaggagatgggccgctgatcgaacccggctgctcattgccgtacgtgtgaagggagggtcgatcgagcaagcgttctttcgtgcttggtaaattgttgcatagacttggttaagttcgtactctttgtcaataaaatcaccctttgtcgaaaaaaattcatactgtgaatggggtatgtacttatgttgtatggtgagttgatgatgtgatgtca

SEQ ID NO: 14212 - DNA, 934 bp, Triticum aestivum
  Clone ID: PAT_TA_14212
ggcgacctcaccgacccctcatgaagatcctcacggagcgcggctactccttcaccaccacggcggagcgcgaaatcgtccgcgacatgaaggagaagctctcctacatcgccctcgactacgaccaggagatggagacctccaagaccagctcctccgtggagaagagctacgagctgcccgacggccaggtcatcaccatcggcgccgagcgcttccgctgcccggaggtgctctttcagccatccttcatcgggatggaagccgcggggatccacgagaccacctacaactccatcatgaagtgcgacgtggacatcaggaaggacctctacggcaacatcgtcctcagtggtggcaccaccatgttcacccggcatcgccgacaggatgagcaaggagatcaccgccctcgcgcccagctccatgaagatcaaggtcgtcgccccgcccgagaggaagtacagtgtgtggatcggaggctccatcctcgcctccctcagcaccttccagcagatgtggatcgccaaggccgagtacgacgaatccggaccatccatcgtccaccggaaatgcttctagatactcatgcatatatccaccccattccatcgtcattatcttatcttatcatcatcaccaaacaaaacaaaagtaaaggcgcgccgacgatgcatgggatcatcactactactgctgccggggcgcccgtccgatcgccatcgatgatcctttttttcttgtttccctttctttttctttcttgccaatctttctacataaatcatgttttcttttctcacttcaattttatttaattggagaagatgctatctatgcatcccattccatcgtcatttaatttatgaatgacgcggtggtggcatgtttcaattcaatctaatccaatggccgtctaccggccgatattatt

SEQ ID NO: 14213 - DNA, 1432 bp, Triticum aestivum
  Clone ID: PAT_TA_14213
agtatatataaacaacaaaattgatacacgattgtctgtggcccgtcagcagctcagctttcattaaccgttgcaatttgaagaaattattcgtgtacgtggtctggtcctgggagacccagacagtaaaaataacatgcaagtaaaacagcagcagagtagtatgtcccaaggggccaaaataggattaatcaataatacttctatatcctagtgcctttggcggcagctggaaataacctgatggcactggtttcttgcttgcttcacttgcccgtccccgccccttccaggtctaaattcagcatataggcgccgaaataagcacacaacagctccgcatgtctacatactccgcaactttgatccgctggagaaagcttgctatttacatctctttagagtgatacaacatacattcctcgggcacatctggtatcaaaggactctcagctgagctagaaaggcagcacatagatcaagaaagaggaggtgcggcccgctcgccctttgcaaatccagaaggtatttctcatctcttgttttgtaaagctgaagttcgaacttaattaaatttaacttgtcacccaggtcatcggtttcaataggctctgcactgaagttataattggtatgactcatattctcctgaccgggaaagccaggaggactccatctacatttcatgttatagtgtccaatttttttccagtatacattcagttcttgcagagccttcagcacttcagtcataacttctcttggatgtgctcgagactgaagcccaagagcccatttcctatcagctggaaaatgtggtctcaagccaactggagattccatgtatggttgttgccgatttccatgagctggactttgtgtttcacttggagtaatgggtgagaatgaagattccatagcttcttgatacccagctccaagatagccagttgttgtgcgactcttattatccaaaaataaataatatgcaactgttacctcattttgcaatctattatgaattgattcaaccagcaggtttttgtcaaatcccagactgataactttaacaagagattcttcatcaatctacaaaatcatgagagaaaccaacaccttatttgaggacttaaatgaagaaatacatgactaaaaaatcctgtcagctcccatctggacagtcacacagaaaactgcaagattgactccaatacacataaaattttaagaaaccagtgagcactcccatgcatagcctcactaaatggcacaaggcagaagggtaatgtacagaccccagaaaaaaactttaaaatatatcattataaatcatgaagagaaatgatgggcacatttttaaccacatataaacttaaccaccaagtttatatgccttaataggagatatcaacaatataaaatatttttatgg

SEQ ID NO: 14214 - DNA, 937 bp, Triticum aestivum
  Clone ID: PAT_TA_14214
tagcgtggtcgcggccgaggtacattacagagtgctagccaaaatgcgaaagccacaataccgttcccgttccgccgcgcagagagacgaccataaataaagcttacacaacatagccaacaaggagaccgttcggacctggggctgccgccgaggcgcgtgtgccatgcatcacgattgcccaacaactaagattgcagaagccaacatgatgaaaggataatgcagcaaagacgcacgatgacgaggtagcgcagatttgggctaccacaactagtcttcagaaagtggccgtcacgcataacattacttaagccaaaatctgcaatcttaacattacatttcgaatccaacagaaggttctctggcttcagatcacggtgaaccaccatatttctatggcaatattccacaccagatataatttgctggaaaaagcgacgagcttcttcctcttgtaatcttcccttctcaacaatgtaatcaaacaactccccagatttaacatactccataacaacataaatatccgctggggtatctatgacctcataaagtcgtatgatatgaggatgcataaataacctcagtatcttgatttctcttttcactttctcttccatctccatgctcttgatcttacggcgattgaggatcttgattgcgaccttgtggcccgtaattatatgctcggcgatcttcaccttaccaaaggacccgatgccgagggttttgccgatccggtagccggccagcgggttggcatctctgcctgctgcgtccatcgtcgacctgacgggggcgggcgggcgagccgcgtcgggaggctgcgtgatggagctctcgcccaagggcgcaggcggcggtgcggcggcggtgcggcaacggatgggttgcggcggggcgcggccgggaggatcgaatcgggggatggcag

SEQ ID NO: 14215 - DNA, 1654 bp, Triticum aestivum
  Clone ID: PAT_TA_14215
taggggccttttttttttttttttttagaactcacgacacaacatttcttctcttctacagccacaggacttacacttgcacgcttattatacgtatatttcacccatacgattcacatcacacgagcacatcctattctttctttcttccatgcgcggtagtaatagtaatacggttcacttcacataaacacagcatacaggacactactacgtttcttcacaaatacgtagtataaggccattgagcctgctagacactcaggtgacagatgatagatacctggtttaacgacgaaatcaggtgtaggaagcacgagcctgttataatctcaagggagggtcctcgcggagatgagctcgaacgacaggccgttctcctcgaggcgcttctggagatcagtggggccgaagacagcgcccggcgtgtacaccccgcccttcggcagattggcccgctggctcagcaggacgagggcgcactggacgaggacgatcggggtggtgatgtacccgatctcaggccccgaaactctggtcacgatctccttgtctggcttgcccccacgctctgatgctcgggccaagtcgctgtagccacggccgatgaaccacattttgaacgaggcgctgcggacctcctcttctgtcggtccggtctttctgaacagcccgatggagaagaactcagggaatttcagcaagagggacctaccgaaggagaaacccccgagaatgccgatgaaaagtccagtacacagccaccagaaaaggcccaggatggaacggctgctgatcttcataccgaaatgtgcaggtttgatagaggaccagaattccttcctatgctccgcaaattctggggtttcgtccgcaccaggaaggccctcgggatgctctgtcacttttgctagggttctcttcacaaccactgtgtcggcggaaggtaacttcatcacccacagtcctagtgccttgtcatgctcaatcagtgaccctttgggaggcggaggccccggaatcctgggcttcgccggccttggcctggatcggcgcagcgcctgcagctcgctggcgttggccacgccgagaacggccgactgaaacgtgccgaagttcccgacgatcttcctgtccgactccaggttgacgtaggcgaccacgctcagcggcgcggagggcggcgtccactgcctggagttgaacaagaacccgagctccgcggggatggagtcaaacccgcaggcggagacaatcagcgacccgttcttggcggcgacctcgtggaggtcggcctcgacgcgctccatgaactcgggctcgccggagatgtcgaggcagtcggcccccgcctcagcgcaggccgcggccacctggcggccgtggaggcggaagggccctgcgcaggagagcaggacgcgcgcccgcgcggcgaccgcggcgagggaggccgggtcggaggcgtcggcgacgaggatggggacgtcgggggcgggccccggcgcggcggcccagcgtagcgcggcggcgacgcggtcccggctgcggcccgcgagcgcgagggaacgcagcggggaggcgttggggggcaggaacttgagcgcctcgcggatgacgtacttgccggtgaagcccgaggcccccggacgcgtgg

SEQ ID NO: 14216 - DNA, 1129 bp, Triticum aestivum
  unsure (1)..(1129): unsure at all n locations
  Clone ID: PAT_TA_14216
ggcggcgctcaggcggcgggtccgaaaccatccaaatctttccctccctcccatcctttcttcccctccgcctccgcctcctcggccgccggtgacgcgccaggcgctagccagccatgtcgtgctcccacctctccaccgcgtggtcctcctccgcgcttgccagcacctccacccgccgccgcgcctccaccggcagcagcagcagcctggtggtgcggtgctccctccgggacctccgcaaccgcatcgactctgtccgtaacacgcagaagatcacggaggcgatgaagctggtggccgccgccaaggtccgtcgcgcgcaggaggccgtggtctcctcccgccccttctcggaggctctggtggaggtgctctacaacatgaaccaggagatccagtcggaggacatcgacctgcccctcacccgccagcgcgccgtcaagcgcgtcgcgatcgtcgtcctcaccggcgagcgtggcctctgcggcgccttcaacaacaacgtgctcaagaaggccgaggcccgcatggaggacctcaggcagctgggcgtcgactacaccgtcatcagcgtcggcaagaagggcaacgcctacttccagcgccgcgactacatccccaccgagcgcttcctcgagctcgccgggatccccaccgtcaaggactcgcaggccatttgcgacctcatctactccctctttgtcgccgaggaggtcgacaaggtggagctcgtctactccaagttcgtcaacctcgtccgctccgaccccatcatccagacgctgctgcccatgtcccctaagggcgagatctgcgatgtcaacggcatctgtgtcgacgccaccgaggacgagctcttcaagctcaccaccaaggaaggcaagctcaccgtgggagcgcgagaagatcaagatcgagatgcagcccttctcccccgtcgtccagttcgagcaggacccgtcagatctcgacgtctcctccgtctacctcaacagcagtctgcgtgcctcaagagtcgtcgctagcaactcccgcaagatgacgcatagnangcacagacatgcatcactcggnaaattncatggcaaacgcgancagcaagntacgggagtctgaattcctggcg

SEQ ID NO: 14217 - DNA, 1090 bp, Triticum aestivum
  Clone ID: PAT_TA_14217
ggcgcggctaaagagttggcagtatattgaaagcagcaaaaaccctggtgcgaaacagatcgtcttccatagtacctcataatgtgctcatcaacaaatcacctaagcagaaagtaaacagtaactcaagctgaaagtaccaggcagacaatgttgcctcagaacagtcaaaaacttgacgggcattacaacctctctggccagcaagacccctacgcgtatccggcgaacccggcttggatcttgaagaccctgatggtcccgtcggtgtatccggtgtagagggtgcttccgtccgcgctccagctcaagcttgtgcagtacagcatctggttcttggagacctgcacttctggcttgaggtcctgcacgacatgcttggactcgaggtcccagatcttgacagactcctctgtcgcagcgcagagccagtagcggttgggcgagaagcagagcgcatggatgatggagccggcttccagctggtacagcctcttcccctcggacaggtcccagagcagcgtgacgccgtccttgccgccggaggcgcagagcgagccatcggggctgacggcgacggcgttcacgtagccaccgtggccggcgagggtggagcggagcttgcagttggtgagattccagaccttgacggtcttgtcccaggagccggagacgatggtgggctgctggatgttgggggagaacctgacgcacgagacccagccggtgtggccctcgccgccgcccatgtcgccgccagatggtgtacttgcactcgccgagggtgttccagagcttgatggtgttgtcgcgggaggcggagacgatctggcggttgtcgacggagaaggcgaccgagatgacgtccttggtgtggccgacgaagcggcgggtggtgaggccggtggagaggtcccagaggcggagctcgccgtcccaggagccggagagcgcgaactggccgtcggagctgatgaccacgtcctggacgaagtggccgtggccggtgaggcggcggaagggcacggcgtagtcggtgccgacggtgccgtcgccgagggacggcaccgggttggtgaggtcccagacc

SEQ ID NO: 14218 - DNA, 1173 bp, Triticum aestivum
  unsure (1)..(1173): unsure at all n locations
  Clone ID: PAT_TA_14218
atgaaccacattttgaacgaggcgctgcggacctcctcttctgtcggtccggtctttctgaacagcccgatggagaagaactcagggaatttcagcaagagggacctaccgaaggagaaacccccgagaatgccgatgaaaagtccagtacctcggccgaggtgggagattgtggatccggattgcgacggcgtgcagatcgagaccctggacgccctgctctctctcgctacaacaagaagcccaccatcacctcccgcgagatccagacctccgtccgcctcgtcctccccggggagctcgccaagcacgccgtctccgagggcaccaaagccgtcaccaagttcacctcctcctaggttcgcccgccccccctcatggtgaccgctgttgatcccctgctggatctgcctgcctatctagatatatatagtagtattagtagtgcttgatggaaatcgttggacggatgatggttcgatgtgtagtcgtcggtggttgtaagatgatgttcccgtggtgctacttttgcgtagtcgatctgaatattaatggaacaaaaatctgctactctgaaaaaaaaaaaaaaaaaaaaacccggcgaacccggcttggatcttgaagaccctgatggttccgtcggtgtatccggtgtagagggtgcttccgtccgcgctccagctcaagcttgtgcagtacagcatctggttcttggagacctggacttctggcttgaggtcctgcacgacatgcttggactcgaggtcccagatcttgacagactcctctgtcgcggcacagagccagtagcggttggcttgctttgagcactctaatttcttcaaagtaacgatgccggaaacannacccggccaattaaggctaggagcgcgatgccggccgaagggtcgagtaggtcggtgctcgccgtgaggcggaccggccgacccggcccaaggtccaactacgagctttttaactgcaacaacttaaatatacgctattggagctggaattaccgcggctgctggcaccagacttgccctccaatggatcctcgttaagggatttagattgtactcattccaattaccagacactaatgcgcccggtattgttatttattgtcactacctcccccgtctcaggattgggtaatttgcgcgcctgctg

SEQ ID NO: 14219 - DNA, 1847 bp, Triticum aestivum
  Clone ID: PAT_TA_14219
ttttttttcatcataacagcatgggttattctcaggccggcattatactagtaaagaacatcacaaagccaaaaatgttcggctaaatatagatagggctacaagcgtcatatagcaccattggtgacaggtggacgaaggaacagggatgcctctagcccgccacctctggtttagtaaataagtcctgaaccatcaaaataaaaccgcgtggttctctagcgtctacataccccaggagtagattatactgggggattatgatagttatgtacaccttgactgtaacttcgcacttcgcaggaagctgtgaggctttgcagttgggaagtcaccatcttcatcaggatcagaggactctcagctgggttagaaaggcagaacacaggtccagaaagaggagctgtggcccactgaccctttgcaagtcgagaagatatttctcatcccttgttttgtagagctgaatttcaaacttcacgatgtgggttgatttgtcactgaggccatcagcttcaattatagcagactccacaccgaagccattgttgttatgcatcatagtctcaacaaagccaggactccacctgcacttcatgttatagtgcccaatcttcttccagcaaacatttagctcttgcagagctttaagcacttcagttatgatttctcgtggatgtgctcgagactgaagaccaagagcccatttcctctcagctgcaaaatgatgcctcaagccaaaccctggagaaccatactgccgagcttcagatgctgaacttggtgtttcaggtgaaacttgggagaaagatgagtccattgactcttgatactcggctccaaggtaaccactggttgtacgaagcttattgtccaagagtaaataatatgcaactgtcgcctcattttgcaatctcttttgaagagattcagtgagcttattcttgtcaaatcccattttgataacatcattcagagtttcatcatcaagctttttgacttgttgtgcaagtgtctggaggaggcacggccaaatagcgtggaagtctagctttgaaccatgaatgttcacggatttcacgtatggtaatcctcttcataggatcaacaaccagcattcttgggatcaaatctcttgctaaaggagacaagtgactaggaagggtgtatattcccccctttattttcttaaaaaggtttggtatgttctcatcatcaaatggaagagtgccacaaagaagggcatacagaataacaccacagctccaaacatcaacttcagggccagcgtacagtttacctgatatcacctcgggtgctgcataatttgggctaccacaactagtcttcagaaagtggccgtcacgcataacattacttaagccaaaatctgcaatcttaacattacatttcgaatccaacagaaggttctctggcttcagatcacggtgaaccaccatatttctatggcaatattccacaccagatataatttgctggaaaaagcgacgagcttcttcctcttgtaatcttcccttctcaacaatgtaatcaaataactctccagatttaacatactccataacaacataaatatccgctggggtatctatgacctcataaagccgtatgatatgaggatgcataaataacctcagtatcttgatttctcttttcactttctcttccatctccatgctcttgatcttacggcgattgaggatcttgattgcgaccttgtggcctgtaattatatgctcggcgatcttcaccttaccaaaggacccgatgccaagggttttgccgatccggtagccggccagggggttggcatctctgcctgctgc

SEQ ID NO: 14220 - DNA, 899 bp, Triticum aestivum
  Clone ID: PAT_TA_14220
cggcacgagggcagctagcattccttgcaaagactagaacagaaagagatctccaagcacgcaacgatatgtcaacgccggcgatgaagatcggcccgtatggcggcccaggaggtaatcactgggacattaatgctctcaatccgcccaaaaggcttgtgagcatccagatttggagcactgattcctcctgcgaaggggccggcggggtcgtcaacggcatctcgttcagctatcttgacatggcagggcaactaatcccctcgggtccatggggctcccagaccggtaaaccccacgtgattaacattggtgaagacgagcgcctgatcactgtctacggcaccagcgatggcaagtttgtcacctcgcttaaatttgtcactgaccgggcttctgatccgtatgggccatacggggcaccgtctaccataagtactttcagcttccagggcggctccatcctcgccttcttgggccgctcctcagagaaactcaatgccatcggcgcctacaaacttggggtttgatccatctatccatcatggccagcatacgtgtctgctgacttccgtatgtttggcttcggtggatacatgtgttcgacctatatctactgcttgtatttgcagctaaataaaatggggatccctcgctgctgcatcctatggatggatggatccctgccgtccgtgcgtgtgtgcgcgtgctcgctctttgtttccatatatattgtatcgtcctagcctgtgtaactataagatgaataaaatctcaagaaactaagtactccctccataaagaaatataagagtagtgatctagacgctcttatatttcttcgcggagggaggtattttcctgagaatttatacttcttaaaaaaaaaaaaaaaaaaa

SEQ ID NO: 14221 - DNA, 1743 bp, Triticum aestivum
  Clone ID: PAT_TA_14221
tcgacccacgcgtccgcggacgcgtgcgcggacgcgtgggccgcctcgctctcacgccgctcgcgtcactccgagctcccacgaaccaccccccaatccgtcaacgagcccgcccgacgcaaagaaaaccgcttgagaaatggctgaagaggatgtccagccgattgtgtgtgacaatggcaccggaatggtcaaggcggggttcgccggcgacgacgcgccgagggccgtgttcccgagcatcgtgggcaggccgcggcacacgggggtgatggtgggcatgggccagaaggacgcgtacgtgggcgacgaggcgcagtccaagcgaggcatcctgacgctcaagtacccgatcgagcacggcgtggtgggcaactgggacgacatggagaagatctggcaccacaccttctacaacgagctccgggtggcgccggaggagcaccccgtgctgctcacggaggcgcccatgaaccccaaggccaaccgggcagaagatgacccagatcatgttcgagaccttcagctgccccgccatgtacgtggccatccaggccgtgctctccctctacgccagcggccggaccaccggcatcgtcatggactcgggcgacggcgtcagccacaccgtccccatctacgagggcttcacgctcccccacgccatcatccggctcgacctcgccggccgcgacctcaccgacggcctcatgaagatcatgacggagaggggctactccttcaccaccaccgccgagcgggaaatcgtcagggacatcaaggagaagctcgcctacgtcgccctcgactacgagcaggagctggagacggccaggaccagctccgccgtcgagaagaactacgagctgccggacggccaggtgatcaccatcggcgcggagcggttcaggtgccccgaggtgctcttccagccgtccatgatcggcatggaggccgccggcatccacgaggccacgtacaactccatcatgaagtgcgatgtcgatatcaggaaggatctgtacggcaatgtcgtgctcagtgggggttccaccatgttccctgggatcgccgaccgtatgaacaaggagatcaccgcactcgcgcccagcagcatgagggtgaaggtggtcgccccgccggagaggaagtacagtgtgtggatcggcggctccattcttgcctctctcagtaccttccagcagatgtggatctccaaggcggagtacgatgaaaccggcccgtcgatcgtccacatgaagtgcttctgatcagtccgttggctgaccaacctgtacctgtcattcagttgcttgaggtccaaaccgcagatgcctgaatgtgtcatggtttccacggcgtcgtggttcactgaaagtgttttggtcatggaacaagtttgaaaggtaaggtcgattgatggtttcggaacaattccgtagggcgtcgggtcagtttccagtgggttcactgaagcatgtagtctgggacatttattttggtttcgggcaattcagctcatgccgtgtgctggagacctgaaacagagtgtcgtttgtttgcacccaccccggcgtgggtgttgattcttgtaccttttgtagcgggggtttcttgtcgaactacctggtctgttcttgtttgtagaaggaagcttattttgttggtacttaagcatttgtacattttaaattaattgaaggaatttaagtttggtatgtgttgttgtgggtaaaaaaagat

SEQ ID NO: 14222 - DNA, 650 bp, Triticum aestivum
  unsure (1)..(650): unsure at all n locations
  Clone ID: PAT_TA_14222
gaattcactagtgattagcgtggtcgcggccgaggttttattggctaattcgaattcgtctgtacaattcgtaaaattctttcttatttcttattgttgaaatccaaaattaaagtctcttggctctcttcacgctttctcacaaacagattaaaaaatagatttttatttttgaagtttggataaaccattgcttcgtctggtgtctacaatacatatgactcattatagtactaatttcatttttaccagatcgaaaaattttatgttgaaaagaaaaatttatagatccaatgtcacattccgtaaaaatttacgatacatgtataaggatgcactcaatgtgtacgagcttgtccaacaagatgtattaagaaatgatacccctggggatgggatgtaaaagccaaagcaaattgcttccgccgccgagaaccggaagattgtgtgggttgtaagagatgtgaatctgcctgcccgacagattttttaagtgtccgcgtttaattaagggcctggaaacaacacgtagcatggctctatcttattgatacgttacaaaaaactcgcatctcgcacaccgacagcacgacgcaccgcacacttccctgggagcntgcgcaatgtgccggacatggaaaacaaangta

SEQ ID NO: 14223 - DNA, 1654 bp, Triticum aestivum
  unsure (1)..(1654): unsure at all n locations
  Clone ID: PAT_TA_14223
ccgcagcgcaggacgccaccactttccacgcctccgtctccgccagcgagctcctctccgcttcctcctccggtccccgccgccgccccgctccccaagaccaatggctgacggcgaggacatccagccacttgtgtgtgacaatggcactggaatggtcaaggctggttttgctggtgatgatgccccaagagcagttttccctagtatagttggccgccctcggcacacaggtgtcatggttggaatgggccaaaaagatgcctatgtgggtgatgaagcgcagtcaaaaggggtatcctgaccttgaaataccctattgagcatggcattgtgagcaactgggatgacatggagaaaatctggcatcacaccttctacaatgagctgcgtgttgcccctgaagaacatccagttttgctgacagaagctcctctgaacccaaaggcaaacagagagaagatgacccaaatcatgttcgagacattcaatgccccagcgatgtatgtggctattcaagctgttctttctctatatgccagtggtcgtactacaggtattgtgcttgattctggtgatggtgtgagccatactgtgccgatttatgagggatatgcacttcctcatgctattctccggctggatcttgcgggccgtgatctgaccgactccctgatgaagatcctcacggagaggggctattccttcaccacaactgctgagcgggaaatcgtaagagatataaaggagaagctcgcctacgtcgcccttgactacgagcaggagctggagaccgccaagagcagctcgtccgtcgagaagagctacgaactgcctgacgggcaggtcatcacgatcggcgccgagaggttcaggtgcccggaggtgctgttccagccgtcgctgatcggcatggaggctcctgggatccacgagaccacctacaactccatcatgaagtgcgacgtggatatcaggaaggacctctacggcaacattgtgctcagtggagggacgaccatgttccccggcatcgccgacaggatgagcaaggagatcaccgccctcgcgccgagcagcatgaagatcaaggtcgtggcgcctcccgagaggaagtatagtgtctggatcggtggctccatcctcgcctccctcagcacattccagcagatgtggatatccaagggagagtacgacgaatctggcccctccatcgtccaccgcaagtgcttctaagccttggggccgtgtcttactccgtgtctctgcacttttcctatgattgagcttgtatccgactcccctccattgaagtattccccgagctttctgcggccgtttttacggatgatttgggcattgccggatgaaggaaaagtaggtcctgtatcgcttaatacagaagacgccgcttgttcttagtgatatactactatgttggttgatatttagccggtgcgcgcggaggaggaccgacgcaccggtttccgggtgtgggcttgggctgttgtgtggctgcagagtgcagaacgcttgggctgtgtatgtataattattttcttccatcaagtatattggtgtggaattattaataatgttattaccgttagttgcnttggtcaagcaaggctggcaccggtctaaaanaaaaagt

SEQ ID NO: 14224 - DNA, 1048 bp, Triticum aestivum
  Clone ID: PAT_TA_14224
ggggcgacgagtgcggccgtcccctgccccgtcgcccgcctccccgctatacatacccccgaccccaccgccccaaccctaccgctcacccccgcctcctccaccgtctccgccctccgtcgcgccaccgggccgccaccgccgctccccgtcccccccttcccggtagaaaatggccgacgccgaggacatccagcccctcgtctgcgacaatggtaccggtatggtcaaggctgggttcgctggagatgatgctcccagggccgtcttccccagcatcgtgggccgcccacgccacaccggtgtcatggtcgggatggggcagaaggacgcctacgttggtgacgaggcgcagtccaagaggggtatcttgactctcaagtaccccatcgagcacggtatcgtcagcaactgggacgacatggagaagatctggcatcacaccttctacaacgagctccgtgtcgccccagaggagcaccctgtccttctcactgaggcgccgctcaaccccaaggccaatcgtgagaagatgacacagatcatgttcgagaccttcaacactcctgctatgtacgtcgccatccaggccgtcctctcgctgtacgccagtggtcgtaccacaggtatcgtgctggactctggagatggtgtcagccacactgtccccatctacgaaggatatgctctcccccatgctatccttcgtctcgacttggctggggcgtgatctcaccgatcacctcatgaagatcctgactgagcgtggttactcattcaccaccaccgctgagcgggaaattgtgagggacgtgaaggagaagctgtcctacattgccctggactatgaccaggaaatggagacttccaagaccagctcttctgtggagaagagctatgagctgcctgatgggccaggtatcaccattggttctgagcgttttccgtgtcctgaggttctcttccagccattcctaattgggatggaagctgcaggtattcatgagaactactacaactcctttattaaaggccacgtggattttaa

SEQ ID NO: 14225 - DNA, 1517 bp, Triticum aestivum
  Clone ID: PAT_TA_14225
aaagctacagctcaatttacaagcttccctccagagtccaggcaccaaacaacgcgaaaaaacacggagaggacatgcgaaaactaggtgcggagcgccatgaacaggttctgctttctcgcatgctccggaaccaggcgctcgacgacttccggaggtataccgtttagctcttgagatctgaagttgaagaggggaggaagagggcgaccgttaggtagacgggtgtttggatctctcaactcatcaaagaacgggtgcatgcaggcttccatagcagtgcaccgaagatctggcgagtattggagaaacctgctgacaaggtccattgcttcaggtggaagctttttctgaaaaaccttgtgccatgggtgagccctcgagtttttttttttttttttttttgctcttataacttattattccatatagaaatttaatagcatttagctagtacacgggtgcgctttgggcactgtttattcgacacgaccgagggatagcacgtatacgtacgtacccttcgatccacaaacacacctgctagtacatgacttacaacaccacactgtttaccactggcttgtagttttctttacctataggatggttgtccgtccgtcatttatggcttctgcttgcgcatgccaggatagtaaccgccacccgcccgccggtgctgttgccgccggggggcatgtagccgccaccgccccatgctgctattgccgctcatggctggcgcgaacttggcctggatcaagtcgacggtgtccttctcggtcatgaaggccttggcgaggatgaggtcgctgatgggcggcgtggacccgaagacgggcgttggcgatggtgataaccccggcgtcctggctgctgaacgcggcaatggccacggcgggtaccttgccgttgttcacctggaagtggatgagcccctgcgggaacacgaacacgtcgccctccaccagctgcttggtgaagagcaggttcttcccgtccgcctggttggaagtgacgaaccccaccatgcagctgccccatgatcacggtgaggatctcggagccgcgagggtgcgtgtggggtgggttctgcccgccgttgggcccgaagtcgatgcgcgccaatgagatgcccagcgtgttcagccccgccagctgcttcaccgtcaccggtgtcaccgccgagccatgagcgttactacatggccgggctttgtttaagcccggacaagaagaagtcgttcgccgtcaccatcttcatgttcttgcacacgaacccattcacaatcacagggttcattatatcagcaacgcagaagtcctggagctgggtggggtcagtggcgagaacacgaggcgccggagagcagaccatgagtaccaccacagcaagcagtgcagccaaggcacgggaagccgccatggtttttcttacctagctagcttcactaacacaagacctaacaatgtctgtcaaggtaattaagctggtgagttgagcttcggacgcgaaa

SEQ ID NO: 14226 - DNA, 1635 bp, Triticum aestivum
  Clone ID: PAT_TA_14226
acgcagcgcaggacacgcccactttccacgcccccgtctccgcctccctcgccagcgagctccgctccgctccgcttcctcctccggcccccgccgccgcctcctcgctccccaagaccaatggctgacggcgaggacatccagccacttgtgtgtgacaatggcactggaatggtcaaggctggttttgctggtgatgatgccccaagagcagttttccctagtatagttggccgccctcggcacacaggtgtcatggttggaatgggccaaaaagatgcctatgtgggtgatgaagcgcagtcaaaaaggggtatcctgaccttgaaataccctattgagcatggcattgtgagcaactgggatgacatggagaaaatctggcatcacaccttctacaatgagctgcgtgttgcccctgaagaacatccagttttgctgacagaagctcctctgaacccaaaggcaaacagagagaagatgacccaaatcatgttcgagacattcaatgccccagcgatgtatgtggctattcaagctgttctttctctatatgccagtggtcgtactacaggtattgtgcttgattctggtgatggtgtgagccatactgtgccgatctatgagggatatgcacttcctcatgctattctccggctggatcttgcgggccgtgatctgaccgactccctgatgaagatcctcacagaaaggggttattccttcactacaaccgcagagcgggaaatcgtaagagatataaaggagaagctcgcctatgtggcccttgactatgagcaggagctggagacagccaagagcagctcgtccgtcgagaagagctacgagctgcctgacgggcaggtcatcacgatcggcgccgagaggttcaggtgcccggaggtgctgttccagccctcgctgatcggcatggaggctcctgggatccacgagaccacctacaactccatcatgaagtgcgacgtggatatcaggaaggacctgtacggcaacattgtgctcagtggagggacgaccatgttccccggcatcgccgaccggatgagcaaggagatcaccgccctcgcgccgagcagcatgaagatcaaggtcgtggcgcctcccgagaggaagtacagtgtctggatcggtggttccatcctcgcctccctcagcacattccagcagatgtggatatccaagggagagtacgacgaatccggcccctcgatcgtccaccgcaagtgcttctaagccttggggccgtgtctctctgcacttttcctatgattgggcttgtatccgactcccctccattgaagtattccccgagctttctgcggccgttttcgccgatgatttggcattgccatgtggatgaaggaaaagtaggtcctgtattatcacttatatacagaagatgccgcttgttctcagtgacattactagtatgttggttgatatttagccggtgcgcgtggacgaccggtttcgggtttgggctttgggctgtttgtgtggctgcagagtgcagaacgctggctgtgtatgtataattattttcttccgttaagtatattggtgtggaattgttatcattgttattattatacctgtagttgctttggtcaaaaa

SEQ ID NO: 14227 - DNA, 920 bp, Triticum aestivum
  Clone ID: PAT_TA_14227
agcaagcaagcagctagcatttcctgcaaaaactagaacagaaagagatctccaaacacgcgacgatatgtcaatgccggcgatgaagatgggcccgtatggcggcccaggagggaatcactgggacattaatgctctcaatccgcccaaaaagattgtgagcatccagatttggagcactgattcctcatgcgaaggggccagcggggtcatcaacggcatctcgttcagctatcttgacatggcagggcaactaatcccctcgggtccatggggctcccagaccggtaaaccccacgtgattaacattggtgaagacgagcgcctgatcactgtctacggcaccagcgatggcaaatttgtcacctcgcttaaatttgtcactgacagggcttccgatccgtatgggccatacggggcaccgtctaccataagtactttcagctaccagggcggctccatcctcgccttcttgggccgctcctcagacaaactcaatgccatcggcgcctacaaacttggggtttgatccatctaaccatcatggccagcatacgtgtctgctgacttccgtatggttggcttcggtggatacatgtgttcgacctatatctactgcttgtatttgcagctaaataaaatggggatccctcgctgatgcatcctatggatggatggatccctgccgtccgtacgtgtgtgcgcgtgctcgctctttgtttccgtatattgtatcgtcctagcctgtgtaactataagatcaataaaagtctcggaaactaagtactccctccgtaaatacatataagagtagtgatctagacgctcttatatttctttgcagcgggaggtattttcctgagaatttatacttttttaagggggggggggggggggggggggggggggggggggggggg

SEQ ID NO: 14228 - DNA, 1605 bp, Triticum aestivum
  unsure (1)..(1605): unsure at all n locations
  Clone ID: PAT_TA_14228
gccggccgggttccgacagaaggaggtacttcccttgtgttagatccaagaagcaaccacaaacaagaatcaacaagagaggaggaggaagaagaagagatcgaagatggccgacggcgaggacatccagccgctggtgtgcgacaacgggacaggtatggtgaaggccgggttcgccggcgacgacgcgccccgggcggtgttccccagcatcgtggggcggccgcggcacacgggggtcatggtgggcatggggcagaaggacgcgtacgtgggcgacgaggcgcagtccaagcgtggtatcctcaccctcaagtaccccatcgagcacggcatcgtctccaactgggacgacatggaaaagatctggcatcacaccttctacaacgagctccgcgtggcccccgaggagcatcccgtcctgctcaccgaggcgcccctcaaccccaaggccaaccgtgagaagatgacccagatcatgttcgagaccttcaacacccccgccatgtacgtcgccatccaggccgtgctctccctctacgcctccgggcgaaccaccggtatcgtgctcgactccggtgacggtgtgagccacacggtgcccatctacgaggggtacgcgctgccccacgccatcctccgtctcgacctcgccggacgcgacctcaccgaccacctcatgaagatcctcacggagcgcggctactccttcaccaccacggcggagcgcgaaatcgtccgcgacatgaaggagaagctctcctacatcgccctcgactacgaccaggagatggagacctccaagaccagctcctccgtggagaagagctacgagctgcccgacggccaggtcatcaccatcggcgccgagcgcttccgctgcccggaggtgctcttccagccatccttcatcgggatggaagccgcggggatccacgagaccacctacaactccatcatgaagtgtgatgtggacatcaggaaggacctctacggcaacatcgtcctcagtggtggcaccaccatgttcaccggcatcgccgacaggatgagcaaggagatcaccgccctcgcgcccagctccatgaagatcaaggtcgtcgccccgcccgagaggaagtacagtgtgtggatcggaggctccatcctcgcctccctcagcaccttccagcagatgtggatcgccaaggccgagtacgacgaatccggaccatccatcgtccaccggaaatgcttctagatactcatatatccaccccattccatcgtcattatcttaccttcttatcatcatcatcatcatcatcaccaaacaaaacaaaagtaaaggcgcgccgacgatgcatgggatcatcactactactgctgccggggcgcccgtccgatcgccatcgatgatccttttttttccttgtttccctttctttttctttcttgccaatctttctacataaatcatgttttcttttctcacttcaattttatttaattggagaagatgctatctatgcatcccattccatcgtcatttaatttgatttgtggatgacgcggtggtggtatgtttnaattcaatctaatccaaggccgggctagcgngccgag

SEQ ID NO: 14229 - DNA, 2380 bp, Triticum aestivum
  Clone ID: PAT_TA_14229
atggggaataaagagagtatatgtttctgaacgattttgattgcatcaattcatccaagcaagaaacttccagaaaccccaaatcatctatacacatcaaccatcaagcctgcaaacctcacatgcaccctggggcaactctactacaccagtgcttgcacccacacaaagctacagctcaatttacaagcttccctccagagtccaggcaccaaacaacgcgaaaaaacacggagaggacatgcgaaaactaggtgcggagcgccatgaacaggttctgctttctcgcatgctccggaaccaggcgctcgacgacttccggaggtataccgtttagctcttgagatctgaagttgaagaggggaggaagagggcgaccgttaggtagacgggtgtttggatctctcaactcatcaaagaacgggtgcatgcaggcttccatagcagtgcaccgaagatctggcgagtattggagaaacctgctgacaaggtccattgcttcaggtggaagctttttctgaaaaaccttgtgccatgggtgagccttaatttgcgggaacttgaactccgtgtagtttggattcatgcacttgatctcttcccttgttggagtacccaagaccttgataatctcaaccagctgatcaactccactttccccagggaaagagtggctgtccaagaagcagctctgcccatcacacagcctgtggaccacaaatcaatggctgtagtatattcagttgcaccaaatatgagttctggtgctcggtagtatcttgagcatatgtaggagatatttggctctcccttgaccaagacctttgcactgccaaaatcacatattttaagctggtgtgtatgtgggttaacgagaacgttctgtggtttgatatcacggtggcagatgccaacacagttgtgtatataagcaagtgctcgacatatctgataagtgtatagtttgacataaatgaggggcactctttgattcattctgttgtactgtcttgccatccggtttactgtctctggaacgaactcaaggacaagattaagataaagctcattcctttcagtggttgagaagaagtaatgcttaagaccaacaatgttcggatggtcaagcatatgcataatttgcaattccctgtttttgtaacgcttatcttgaagaacctttttttatgggaacccgtttctcgacatttggcctgaagagttgacaataacaggttatatgccttcgacaatcagttgagcatagaccagttcagacaacgcaaatgtcagaactcagaagtctacctgtttgggcagaccatttcggcgacagattgtggtagcagttatgtgaccagcttcagcaccaggatcttgtgccacggacgagtcttaattcaggagaactcgaacttcgtgtagtttgggtttatgcacttgatctcttcccttgttggagtaccttccaacagatgtggatctcgaagggcgagtatgatgagtcaggtccagcgattgtccaccggaagtgcttctaagttgcgagttgtctgggtcttctgaatctattctggctgttcttttctcaagtccttgccatgtaagctactatgtttaagattgctgggattctgttgactgtattgccggattaatttgttgggtcaacacctcggccgatgaaccacattttgaacgaggcgctgcggacctcctcttctgtcggtccggtctttctgaacagcccgatggagaagaactcagggaatttcagcaagagggacctaccgaaggagaaacccccgagaatgccgatgaaaagtccagtacctcggccgaggtactcgaggacggcggcgaggtagacgggggcgccggagccgacgcgctgcgcgtagcggcccttcttgaggtagcgcccgatgcggccgaggtacattccatgcagcatctgcatcgtcagtttccttgcatagcggtgggctgtcttctgatcttttctcgtagcaattgttgtccattggcttctgatatatggccataccaacttgatttaatgtatcctttgttttcttaaccattttccagcacatggactttgccagagaagacatggcattccaaatttcaacatcttcagggagcttttggtaaacaggagtggcagaccagacgaagtaaccaccaggacgtaatagtcggttcaattccagcaaaagcttgccaccttcaatgtgccaagggaccctgcagcgagcacagtgaatgacatcaaaaaccctgctaggatatggaagtctcttggtgcccattacagctgatattgctggaattcccctctcgagcgcaaactgtacctgcccgggcggccgctcga

SEQ ID NO: 14230 - DNA, 1298 bp, Triticum aestivum
  Clone ID: PAT_TA_14230
ccacgcgtccgacgaggcgcagtccaagaggggtatcttgactctcaagtaccccatcgagcacggtatcgtcagcaactgggacgacatggagaagatctggcatcacaccttctacaacgagctccgtgtcgccccagaggagcaccctgtccttctcactgaggcgccgctcaaccccaaggccaatcgtgagaagatgacacagatcatgttcgagaccttcaacactcctgctatgtacgtcgccatccaggccgtcctctcgctgtacgccagtggtcgtaccacaggtatcgtgctggactctggagatggtgtcagccacactgtccccatctacgaaggatatgctctcccccatgctatccttcgtctcgacttggctgggcgtgatctcaccgatcacctcatgaagatcctgactgagcgtggttactcattcaccaccaccgctgagcgggaaattgtgagggacgtgaaggagaagctgtcctacattgccctggactatgaccaggaaatggagacttccaagaccagctcttctgtggagaagagctatgagctgcctgatgggcaggttatcaccattggttctgagcgtttccgttgtcctgaggttctcttccagccatccttcattgggatggaagctgcaggtattcatgagactacctacaactccatcatgaagtgcgacgtggatattaggaaggatctgtacggcaacattgttcttagtggtggtaccactatgttcactggaatcgctgataggatgagcaaggagatcactgccttggctcctagcagcatgaagatcaaggttgttgctcctcctgaaaggaagtacagtgtctggatcggaggatccatcttggcatctctcagcaccttccagcagatgtggattgcaaaggctgagtacgacgagtctggcccatccattgtgcacaggaaatgcttctaattcttcggacccaagaaagaaagccaagagggcctttatcgcgaccctcctgcttcgtctctctattttgttgctgtttctttgttagcgtggacaaagttttcggctggcctatcggttaccgttttctcctattcaaagactgtaatatctattcctacttgtgcttctcacttgtgattttggacacatatgttcggtttattcaatcaaatttaatcagatgcctggtgaggctactagagaaatacggatggtgttctgattttgtcatgttgtcacctcaatcttgttaaatgaataatatgaaagtctcttggtccta

SEQ ID NO: 14231 - DNA, 962 bp, Triticum aestivum
  unsure (1)..(962): unsure at all n locations
  Clone ID: PAT_TA_14231
aaaaaaatcctaaaaacccccctttccaactttaaaaaaagggggggggaaaaaccaaaaaaaaaggccttggggggaaggccnttcccaaccccggccgggggtggggggccgggggccccggctttctttaaggaaaaactttaaggtggggggaatccccccccccggggggccttggccaagggggaaaatttcggggcaaccccaaggccttncccggcttttccccaagttccccggcaaaagccaagtttcccgcaccccggacacccttcaccctccccaaagccctaaccgctcgcccgctccgccgccatgaggtccaaggccaacggagacaccgcgttcaaggcctccggcaagaacaagacggccaccggcggcgtcgccaagccgaagcgcgcccccacccccttcttcgccttcctggctgagttcaggccacagtacatggagaagcaccccgaggcaaagggcgtcgcggccgtcaccaaggcggctggggagaagtggcgcagcatgtcggatgaggagaaggcaaagtatggcggcaagaaggcagatgccccagcaagcaaggcggtgaacaagaaggagagcaccagctccaagaagaccaagactaacgctgacgaagaaggttctgacgttgaggatgatgaggaggatgaggagtaaatagtagatgagggaacagcagcggtgcaaatcagcgtttgctgcttagggtttagattgccatgtcgatgtccggattatgtaatgttatgtaaggagaatgtttagatgcgtactcctgggctgtggcatgctggagatgtctttgtttgacaagaaaagcttaaaacccttgactgcttttctttcgtggatttccacagcatgtggaaacagttattatgcttgcttttatctactgatctgatgactagcctgctgttggattgctaaaaaaaaaa

SEQ ID NO: 14232 - DNA, 1081 bp, Triticum aestivum
  Clone ID: PAT_TA_14232
gatctattctggagtctacctaatcccctccccggcactccccgcctgacaaccgcggccatggcgtgcgccttctccgcctccaccgtgtccacggcggccgcgctcgtcgcgtccccgaagccagccggggcgccgcagtgcctgtcgtttccccgcgccatcgcaggcgccgccgccaggccttcccgcctcgccgccgccagctcgaggacggccagggcccgcagcttcgtcgcccgcgcctcagcggagtacgacctgccgctggtggggaacaaagcaccggacttcgccgcggaggccgtgttcgaccaggagttcatcaacgtcaagctatctgattacattgggaagaagtatgtgattcttttcttctaccctctggacttcaccttcgtctgcccaactgagattacggctttcagcgacagacatgaggagttcgagaagataaacactgaaattcttggtgtttcagttgatagtgtgttttcccatcttgcatgggtgcagacagagaggaaatctggtggacttggtgatctgaaatatccgctggtttctgacgtcaccaaatcaatctcaaagtcttttggtgtattgatccctgatcagggaattgctctgagaggattattcatcattgacaaggagggtgtgattcagcattccactattaacaaccttggtattggccgtagtgtggatgagaccttgagaacccttcaggctctgcaatacgtccaagaaaacccagacgaggtctgcccggcgggatggaaacctggggaaaagtcgatgaagcctgaccccaagggcagcaaggagtacttcgctgctatctagatgtgtccttgtcctttgcactcgctgtcagttttgtcatggccgtttcttggttacatgtgtttttgtgacccgagttgtagttatcatgcgtacaattgactctgtaatttctgcaataagggtttgtctgtgtgtggattttccctgctccaatttggaaagaacaatacaagattggaaataaaatcttatcttatgtcagccaatggctttatttggaaaaaaaaaa

SEQ ID NO: 14233 - DNA, 819 bp, Triticum aestivum
  unsure (1)..(819): unsure at all n locations
  Clone ID: PAT_TA_14233
atcgcagcccaaattccccaatctcctcccgcactcaacccaatccccacctacccgcaccccatggcgccgaaggcggagaagaagccggcggcgaagaagcccgtggaggaggagcccgcggcggagaaggccgagaaggcgcccgccgggaagaagcccaaggccgagaagcgtcttcccgcggcgggcaagacctccgccaaggacggcgacaagaaggccaagaagaagagcaagaagagcgtggagacgtacaagatctacatcttcaaggtgctcaagcaggtgcaccccgacatcggcatctcctccaaggccatgtccatcatgaactccttcatcaacgacatcttcgagaagctcgccggcgaggccgccaaactcgcgcgctacaacaagaagcccaccatcacctcccgcgagatccagacctccgtccgcctcgtcctccccggggagctcgccaagcacgccgtctccgagggcaccaaagccgtcaccaagttcacctcctcctaggttcgcccgccccccctcatggtgaccgctgttgatcccctgctggatctgcctgcctatctagatatatatagtagtattagtagtgcttgatggaaatcgttggacggatgatggttcgtgtgtagtcgtcggtggttgtaagatgatgttcccgtggtgctacttttgcgtagtcgatctgaatattaatggaacaaaaatctgctactctgagtttctgatgaattgtttcaagagtagttatatttgacatcctgtttgtgctattcttgattagtttngatgggggggggg

SEQ ID NO: 14234 - DNA, 1608 bp, Triticum aestivum
  Clone ID: PAT_TA_14234
ctcctccaccgtctctgcccccgtcgcgccaccggacctccaccgccgctgccccgcccccccccccttcccggtagaaaatggctgacgccgaggacatccagcccctcgtctgcgacaatggtaccggtatggtcaaggctgggttcgctggagatgatgctcccagggccgtcttccccagtatcgtgggtcgcccacgccacaccggtgtcatggtcgggatggggcagaaggacgcctacgttggtgacgaggcgcagtccaagaggggtatcttgactctcaagtaccccatcgagcacggtatcgtcagcaactgggacgacatggagaagatctggcatcacaccttctacaacgagctccgtgtcgccccagaggagcaccccgtccttctcactgaggcgccgctcaaccccaaggccaatcgtgagaagatgacacagatcatgtttgagaccttcaacactcctgctatgtacgtcgccatccaggccgtcctctcgctgtacgccagtggtcgtaccacaggtatcgtgctggactctggagatggtgtcagccacactgtccccatctacgaaggatatgctctcccccatgctatccttcgtctcgacttggctgggcgtgatctcaccgattacctcatgaagattctgactgagcgtggttactcattcaccaccactggctgagcgggaaattgtgagggacgtgaaggagaagctgtcctacattgccctggactacgaccaaggaaatggagacttccaagaccagctcttctgtggagaagagctatgagctgcctgatggggcaggttatcaccattggttctgagcgtttccgttgccctgaggtcctcttccagccatccttcattgggatggaagctgcaggtatccatgagaccacctacaactccatcatgaagtgcgacgtggatattaggaaggatctgtacggcaacattgttctcagtggtggtaccactatgttcactggaatcgctgataggatgagcaaggagatcactgccttggctcctagcagcatgaagattaaagttgttgctcctcctgaaaggaagtacagtgtctggatcggaggatccatcttggcatctctcagcaccttccagcagatgtggattgcgaaggctgagtacgacgagtctggcccatccatcgtgcacaggaaatgcttctaattcttcggacccaagaaagaaagccaagaggagcctttatcgcgaccctcctgcttcgtctctctattttgttgctgtttcttcgttagcgtggacaaagttttcggctgccctaccggtcaccgtttcctcctattcaaagactgtaatatctattgctacttgtgcttctcacttgtgattttggacacatatgttcggtttattcaatcaaattcaatcagatgcctggtgaggctactagagaaatacgggcggtgttctgattttgtcatgtgtcacctctatcttgttaaatgaataatatgaagtgtcttgatcctacatggtgttgtcacatgaatggattctcttgttcatttcttgtacggttcatttggaccctacaacc

SEQ ID NO: 14235 - DNA, 2134 bp, Triticum aestivum
  Clone ID: PAT_TA_14235
ccacgcgtccgcccacgcgtccggtgtgcgtctgggagcgagatccagtccagagcggcagcagttatagccagcgcctcccccaccaccaccaccaccttccccctcctcctcctccgatcgcatctcctctcctccgtcctcccctcccgtcgcccgtctcagcctcctccgagctcgctcgctcgctcgctcgccacggtaaccaacctctctctctctctctttctcttggtaccttgctggatcttgctgtgcgcccgcctccggccggcccgagatccggccccgcggcgccggatctgggcgtgccgggcggagatccggcgggaactcgggcgcttcaccgtcttcttggggcccgccttcttggagttgctgccgcttcttggctggacctccaccggctccgcccgcgctggcccccgcgtagatccgcggcggctgggcgtgttgctgcttgctggccggcgactgctcccggtttccgcagacattctgtaggaaatggctgacggtgaggacatccagccccttgtctgcgacaatggaaccggaatggtcaaggtaattgtgattagctgatcacactctataacataatttcttttggggggatgtcatattttgatcctgaaattaattaagggctaattgttttcatctttcataggctggctttgccggagacgatgctccacgtgctgttttccctagtattgttggccgtccacgccacactggtgttatggtagggatggggcagaaggatgcttatgttggtgatgaggcccaatccaagaggggtatcctgactttgaagtaccccattgagcacggaatcgtaagcaactgggatgacatggagaagatttggcatcacaccttctacaatgagctccgtgtagcacctgaagagcaccctgttcttcttacagaggctcctcttaaccctaaggccaacagggagaagatgacacagatcatgtttgagacattcagtgttcctgccatgtatgtcgctattcaagcagtcctttctctatatgctagtgggcgtaccactggtattgtcttggattccggagatggtgtcagtcacacagtcccaatctatgaaggttatgcccttccacacgctatcctacgtcttgatcttgctggtagggatctcactgattccctcatgaagatcctcacagaaaggggttattccttcactacaaccgcagagcgggaaatcgtaagagatataaaggagaagctcgcctatgtggcccttgactatgagcaggagctggagacagccaagagcagctcgtccgtcgagaagagctacgagctgcctgacgggcaggtcatcacgatcggcgccgagaggttcaggtgcccggaggtgctgttccagccctcgctgatcggcatggaggctcctgggatccacgagaccacctacaactccatcatgaagtgcgacgtggatatcaggaaggacctgtacggcaacattgtgctcagtggagggacgaccatgttccccggcattgcagacaggatgagcaaggagatcaccgccctcgcgccgagcagcatgaagattaaggtcgtggcgcctccagagaggaagtacagtgtctggatcggtggctccatccttgcctccctcagcacattccagcagatgtggatatccaagggagagtacgatgaatctggcccctcgatcgtccaccgcaagtgcttctaagccttgggccgtgtcttactccgtgtctctctgcacttttcctatgattgagcttgtatccgactccccctccattgaagtactccccgagcttcttgtgcggccgttttcgcggatgctttagcattaccttgtggatgaaggaaaagtaggtcctgtattatcacttatatacagaagatgccgcttgttctcagtgatatgctactatgttggttgatatttagccggtgcgcgcggaggaggaccgacgcaccggtttccggggtttggggcttgggctgttgtgtggctgccagagtgcaggacgctgggtgtgtatgtataattattttcttccattaagtatattggatcggtgtggaattattattatacctttatttg

SEQ ID NO: 14236 - DNA, 1561 bp, Triticum aestivum
  Clone ID: PAT_TA_14236
aatttcagtgcggaccggcctcctttacatctcattcccaccgtcaacggccaccaccctcgccgctcccacgccctcgcaccgcacctatatctcgccctcctcctccccccctctccccacccaccattcgcctacgctcttcgcttcctccgccgccgccttcccccggtcttctcgcttcagatcagttaacgtaaatggctgacgcagaggacattcagccccttgtctgcgacaatggaactggaatggtcaaggctggtttcgccggagacgatgctccacgtgcagttttccctagtattgttggccgtccacgccacactggtgttatggtagggatggggcagaaggatgcttatgttggtgatgaggcccaatccaagaggggtatcctgactttgaaataccccattgagcacggaatcgtaagcaactgggatgacatggagaagatttggcatcacaccttctacaatgagctccgtgtagcacctgaagagcaccctgttcttcttacagaggctcctcttaaccctaaggccaacagggagaagatgacacagatcatgtttgagacattcagcgttcctgctatgtatgtcgctattcaggccgtcctttccctatatgctagtgggcgtaccactggtattgtcttggattctggagatggtgtcagtcacacagtcccaatctatgaaggttatgcccttccacatgctatcctacgtcttgatctcgctggtagggatctcactgattccctcatgaagatcctcactgagaggggttactctttcacaaccactgccgagcgggaaattgtccgtgacatcaaggagaagcttgcatatgttgcccttgactacgaacaggagcttgagactgcgaagagcagctcatcagttgagaagagctacgagctgcctgatgggcaagtgatcaccataggcgcagagcgcttcagatgcccagaggtcctcttccagccttccatcatcggcatggaagctcctggcatccatgagacgacctacaattccatcatgaagtgcgacgtggatatcaggaaggacctgtacggtaacattgtcctcagtggtgggtctaccatgttccctggcatcgccgaccgtatgagcaaggagatcacagcgcttgcccccaagcagcatgaagatcaaggtcgtcgctccaccggagaggaagtacagtgtctggattggagggtctatccttgcatctctgagcacattccagcagatgtggatctccagggcagagtacgaagagtctggcccagctatcgtccacaggaagtgcttctagacagttgtcgtcagacctattctccatgcatacccttgtctagtagcattattaggtggtggttttgttggacaaatgttaggccgatggcctgtctatgggtgtatctactctattatgtgtgtagtctgatttgatggatttattattggattctgcaacttcatcgctatttctcatatggctttgcttggcaatggccgtattgcgtcccaaaaaaaaaaaa

SEQ ID NO: 14237 - DNA, 1033 bp, Triticum aestivum
  Clone ID: PAT_TA_14237
taattgcaattgaaacatactgcaaacatggaaaatgaagccacacgcaatatgatgaaccattgctggctactattactgatcagaatttaacacacatgggacaatagtacataacagagctagctaaaatgagaagccacaatactgaccgaaaaaaccaccatgaataaagttacacaacacgcaaaccattcggaatgactgaggattgagttcttgcagctgccacgacgcagtgtgcatcacgacgccgtacaatttaggaaatgcggcagccaacaagaaagggaggtgcaaggatggcacagcaaagacggatgatgaaccttggcagattgcaaccatttcttccctgtgggacacctaaatcttgtcgagcttctctgccttcaccactgggttggccttggcgatggcatccctagctgcagtccggtagtcgaactggcagtcatgcttgtcggaatagcgatgcagcgaacagtacatgttaccgcagcggcagttgaatcccgtcagcccaaccctcttcctgcaagttgagcaccgattcggcccctccttcctcttggggctcacggcaacagcttcgctggtgcctgcaacatcagcagcaggctgcacaacgagcgccttcacgtcaacttgagcaaccaccacctctgcgctcgcggctacagccgcaacaacaggtgctttcccaccgtcgccaccgttgacgatgctatcgaaggaggaggcagccagcttggcctgttcctgcttcatgaccatctccttgtggcacttggagcacatgttcatggtcgccgcactgccaaagaagccacagttattaacgcataggattgggccctccggctgctggcaacccgcctccttgtgttccatcttgaataaccgtgagcctgtggcgaggcggcggcggcggcggggccggaggaggagggcgaggaggcgtgcggggattgggaatcgcgaggagctcggctcgattgggggcgtcacctcgtgccgaattcggcacgag

SEQ ID NO: 14238 - DNA, 1496 bp, Triticum aestivum
  Clone ID: PAT_TA_14238
ggcacgaggcctggttcgccaccaccgccgccacccaccccctcatcctcttcctccgctctctgcagctgccgctcatctcggtgggaggtcctcaggcgggcaggttcccctagatccccggagtcactcaatcaaatggctgacggtgaggacatccagccccttgtctgcgacaatggaactggcatggtcaaggctggttttgcaggggatgatgcacccagggccgtcttcccaagtatcgttgggcgcccccgccacactggtgtgatggtggggatggggcagaaagatgcatatgttggtgacgaggcccaatccaagaggggtatcctcaccttgaagtacccgatcgagcatggtatcgtcagcaactgggacgacatggagaagatctggcatcacactttctacaacgagctccgtgttgcacctgaggagcacccagtactgctgactgaggcgcccctgaaccccaaggctaacagggagaagatgacacaaatcatgtttgagaccttcaatgttccagccatgtatgtggccatccaggctgtgctttccctatatgctagtggacgcacaacaggtatcgtgttggattctggtgatggtgtcagccatactgtgccaatctatgaaggatatgcccttccacatgccatccttcgtcttgacctcgctgggcgcgacctaactgactgtttgatgaagattcttactgagagaggttactccttcaccaccactgccgaacgggaaattgtaagggacatcaaggagaagctcgcatatgtggctcttgactatgaacaagagctggaaaatgccaagagcagctcctctgtggagaagagctatgagctgcctgatgggcaggtgatcaccattggggcagagaggttccgttgccctgaggtccttttccagccatctttcattggtatggaagctgctggaatccatgagaccacctacaactctatcatgaagtgtgatgtggatatcaggaaggatctgtatggtaacatcgtgctcagtggtggctcaactatgttcccgggtattgctgaccgtatgagcaaggagatcactgcccttgcaccaagcagcatgaagatcaaggtggtggcaccgcctgagaggaagtacagtgtctggattggagggtcgattcttgcctcccttagtaccttccaacagatgtggatctcgaagggcgagtatgacgagtcaggtccagcgattgtccaccggaagtgcttctaagttgcgagttgtctgggtcttctgaatctattctggctgttcttttctcaagtccttgccgtgtaagctactatgtttgagattgctgggattctgttgactgtattgccggattaatttgttgggtcaaaattgtgtaccttgtagactcgtaatatgttcagtgggctgctatatttgaccggtgctgaatcatatgccgcatgttccgggtttttatttca

SEQ ID NO: 14239 - DNA, 1300 bp, Triticum aestivum
  Clone ID: PAT_TA_14239
aacgatcaggcgcggctaaatagttgcagtatattgaaagcagcagtcaaagcaaaaaaaccctggtgcgaaacagatcgtcttccatagtacctcataatgtgctcatcaacaaatcacctaagcagaaagtaaatagtaactcaagctgaaagtaccaggcagaccaagtgcctcagaacagtcaaaaacttgacaggcattacaacctcttcggccagcaagactcctacgcgtacccggcgaacccggcttgaatcttgaagaccctgatggttccgtcggtgtatccggtgtagagggtgcttccgtccggcgctccagctcaagcttgtgcagtacagcatctggttcttggagacctggacttctggcttgaggtcctgcacgacatgcttggactcgaggtcccagatcttgacagactcctctgtcgcggcacagagccagtagcggttgggcgagaagcagagcgcatggatgatggagccggcttccagctggtacagcctcttcccctcggacagatcccagagcagcgtgacgccgtccttgccgccggaggcgcagagcgagccatcggggctgacggcgacggcattgacatagccacccgtggccggcgagggtggagcggagcttgcagttggtgaggttccagaccttgacggtcttgtcccaggagccggagacgatggtgggctgctggatgttgggggagaacctgacgcacgagacccagccggtgtggccctcgccgccgcccatgtcgccgccgatggtgtacttgcactcgccgagggtgttccagagcttgatggtgttgtcgcgggaagcggagacgatctggcggttgtcgacggagaaggcgaccgagatgacgtccttggagtggccgacgaagcggcgggtggtgaggccggtggagaggtcccagagacggagctcgccgtcccaggagcccgagagcgcgaactggccgtcggagctgatgaccacgtcctggacgaagtggccgtggccggtgaggcggcggaagggcacggcgtagtcggtgccgacggtgccgtcgccgagggactggaccgggttggtgaggtcccagaccagcagcgacttgtcgcgggagccggacacgatgtagggcgagttgtcgatcggcgcggcgatcgccgtcaccacgtcgttgtggccgcgcatcgtgcccaccaggccgagcgactcctgcatgttcgccatggctgccgcggggagattggggggcgggggtggcggcggcggcggcgagggggtgagggtt

SEQ ID NO: 14240 - DNA, 1763 bp, Triticum aestivum
  unsure (1)..(1763): unsure at all n locations
  Clone ID: PAT_TA_14240
cgtccgcccacgcgtccgcctctccctcccctcccctccagtccgtccttgcccaactttccagtgcggcaccggcctctccctcctttacatctcattcccaccgtcaccggccaccacccccgccgctcccacgccctcgcaccgcacctatatctcgccctcctccttcccccctcttcccacccaccattcgcctgcgttctccgctgcctcccgccgccgcctccccccggtcttctcgcttcagatcagttaaagtaaatggctgacgcggaggacattcagccccttgtctgcgacaatggaactggaatggtcaaggctggctttgccggagacgatgctccacgtgccgttttccctagtattgttgggccgcccacgccacactggtgttatggtagggatggggcagaaggatgcttatgttggtgatgaggcccaatccaagaggggtatcctgactttgaagtaccccattgagcacggaattgtaagcaactgggatgacatggagaagatttggcatcacaccttctacaatgagctccgtgtagcacctgaagagcaccctgttcttcttacagaggctcctcttaaccctaaggccaacagggagaagatgacacagatcatgtttgagacattcagtgttcctgccatgtatgtcgctattcaagccgtcctttctctatatgctagtgggcgtaccactggtattgtcttggattccggagatggtgtcagtcacacagtcccaatctatgaaggttatgcccttccacacgctatcctacgtcttgatcttgctggtagggatctcactgattccctcatgaagatcctcactgagaggggttactctttcacaaccactgccgagcgggaaattgtccgtgacatcaaggagaagcttgcatatgttgccctcgactacgaacaggagcttgagaccgcgaagagtagctcatcagttgagaagagctacgagctgcctgatgggcaagtgatcaccataggcgcagagcgcttcagatgcccagaggtcctcttccagccttccatcatcggcatggaagctcctggcatccacgagacgacctacaattccatcatgaagtgcgacgtggatatcaggaaggacctgtacggtaacattgtcctcagtggtgggtctaccatgttccctggcatcgccgaccgtatgagcaaggagatcacagcgcttgcccccaagcagcatgaagatcaaggtcgtcgctccaccggagaggaagtacagtgtctggattggagggtctatccttgcatctctgagcacattccagcagatgtggatctccagggcagagtacgaagagtctggcccagccatcgtccacaggaagtgcttctagacagctgtcttcagatctattctccatgcatacccttgtctagtagcattattaggtggtggtttgttgggacaaatgttggggccgatggcctgtctatgggtgtatctactctattatgtgtgtagtctgatttgatggatttattattggattctacaacttcatcgctgtttcaactcgggtccgttactcgcctgggcgctgcttctgcctgagcaaacttgttgtttgatctttctctgtatggctttgcttggcaatggccagcttgcgtccacttctgtcagaggcttgacagctgctgggaaccggtgtagtttgctncgacaacaatcccttttgttgagtaaaaaaaaaaaa

SEQ ID NO: 14241 - DNA, 1763 bp, Triticum aestivum
  Clone ID: PAT_TA_14241
ttcggcacgaggcttgtggctccgcgtcagcaggccgacagcagtgtgtgtgcgtctgcgagcgagatccagtccagagcggcagcagttatagccagcgcctcccccaccaccaccaccaccttccccctcctcctcctccgatcgcatctcctctcctccgtcctcccctcccgtcgcccgtctcagcctcctccgagctcgctcgctcgctcgctcgccacgacattctgtaggaaatggctgacggtgaggacatccagccccttgtctgcgacaatggaaccggaatggtcaaggctggtttcgctggagatgatgcgccaagggctgttttccctagcatagttggtcgccctcggcacactggtgtcatggtagggatggggcagaaggatgcctatgtcggtgatgaggcgcagtccaagagaggtatcctcaccctcaagtaccccatcgagcacggtatcgtgagcaactgggatgacatggagaaaatctggcatcacaccttctacaatgagctccgtgtggcacctgaggagcaccctgtgttgctcactgaggctcctttgaacccaaaagccaacagagagaagatgacccagattatgtttgagactttcaatgttcctgccatgtacgtcgcaattcaggccgtgctttccctctatgcaagtggtcgtactaccggtatcgttctcgactctggtgatggtgtcagccacactgtgcccatttacgaaggatacgcgcttcctcatgccattcttcgtttggatcttgctggccgtgatctcacggactcccttatgaagatcctcaccgagagaggttactccttcacaacctcagccgagcgggaaattgtaagggacatcaaggagaaacttgcgtatgttgcccttgattatgaacaggagctggagactgccaagaacagctcctcagttgagaagagctacgagcttcctgatggtcaggtgatcacgattggcgcagagaggttcaggtgccctgaggtcctcttccagccatccatgatcggcatggagtcttctggaatccatgagacaacctacaactccatcatgaagtgtgacgtggatatcaggaaggacttgtatggcaacattgtgctcagtggtggcacaactatgttcccaggtatcgctgaccgtatgagcaaggagatcacagcccttgctccgagcagcatgaagatcaaggtcgtcgctccacctgagaggaagtacagtgtctggatcggagggtccatcttagcctcactcagcactttccaacagatgtggatatccaaggatgagtacgacgagtctggcccggcgatcgtccacaggaagtgcttctgatctccacgaaacgctccgccgccgttatcatctagtctcgggttatgtttggttcattcttctagaaatgtattgcgtatttgcaagctatgttttttttccagacgtgacgtgagtactctcgggatatgccacctatatacgtggcggctccatggtgcaagtgcaagtacactatatctatgtttgtgcattgtcacagtgtgtttgtgagatcagttgtcaaacttgggttggcttgatttgttgttggagttgtctgtaatagctcatggtttttgctatgtatttttatatcttattattgctctaaggggagaatcatggtaaattatggatttttttaagctctcaaagcgttatacagtggtcatccatggaccattttcc

SEQ ID NO: 14242 - DNA, 1827 bp, Triticum aestivum
  Clone ID: PAT_TA_14242
tcggcacgaggcgcgtcagcaggccgacagcagtgtgtgtgcgcgcgcgcgagcgagatccagacctccagagcggcacagccaggaaggacagtccagagcggctgcagttatagccagcgcctcccccaccaccaccttccccctccctcctccgatcgcatctcccccctcctccgtcctcccctcccgtcgcccgcctcggcctcagcctcctccagtcctcggagccctccacgatattctctaggaaatggctgacggtgaggacatccagccccttgtctgcgacaatggaactggaatggtcaaggctggtttcgctggagatgatgcaccaagggctgttttccctagcatagtcggtcgcccacgggcacactgggtgtcatggtagggatggggcagaaggatgcctatgtcggtgatgaggcgcagtccaagagaggtatcctcacactcaagtaccccatcgagcacggtatcgtgagcaactgggatgacatggagaaaatctggcatcacaccttctacaatgagctccgtgtggcacccgaggagcaccctgtgttgctcactgaggctcctctgaacccaaaagccaacagagagaagatgacccagattatgttcgagactttcaatgttcctgccatgtacgtcgcgattcaggccgtgctttccctctatgcaagtggtcgtactaccggtattgttctcgactctggtgatggtgtcagccacactgtgcccatttacgaaggatacgcgcttcctcatgccattcttcgtttggatctcgctggtcgggatctcactgactcccttatgaagatcctcaccgagagaggttactccttcacaacctcagccgagcgggaaattgtaagggacatcaaggagaagcttgcgtacgtagcccttgattatgagcaggagctggagactgccaagaacagctcctcggttgagaagagctacgagcttcctgatggtcaggtgatcacgattggcgcagagaggttcaggtgccctgaggtcctcttccagccatccatgatcggcatggagtcttctggaatccatgagacgacctacaactccatcatgaagtgtgacgtggatatcaggaaggacttgtatggcaacattgtgctcagtggtggcacaaccatgttcccaggtatcgctgaccgtatgagcaaggagatcaccgcccttgccccgagcagcatgaagatcaaggtcgtcgctccacctgagaggaagtacagtgtctggatcggagggtccatcctagcctcactcagcactttccaacagatgtggatatccaaggacgagtacgacgagtctggcccggcgatcgtccacaggaagtgcttctgatctccacgaaacgctgcgccgccgttatcatctagtctcgggttatgtttggttcattcttctagaaatgtattgcgtatttgcaagctatgttttttttccagacgtgacgtgagtactctcgggatatgccgcctatatacgtggcggctccatggtgcaagtgcaagtgcaagtacactatatctatgtttgtgcattgtcacagtgtgtttgtgagatcagttgtcaaacttgggttggcttgatttgttgttggagttgtctgtaatagctcatggtttttgctatgtactatatcttattatttctttgaggggaggatcatggtaaattatggattttttaagatctcaaggcgttatacagtggtcatccatggaccattttccatgcgattatcaacgggttcatcactggtttataaggccttcaatc

SEQ ID NO: 14243 - DNA, 1619 bp, Triticum aestivum
  Clone ID: PAT_TA_14243
gccggccgggtcggggttctcctgcctctgcctggttcgccaccaccgccgccaccaaccccctcatcctcttcctccgctctcggcagctgccgctcatctcggtgggaggccctcaggcgggcaggttcccctagatccccggagtcactcaatcaaatggctgacggtgaggacatccagccccttgtctgcgacaatggaactggcatggtcaaggctggttttgcaggggatgatgcacccagggccgtcttcccaagtatcgttgggcgcccccgccacactggtgtgatggtggggatggggcagaaagatgcatatgttggtgacgaggcccaatccaagaggggtatcctcaccttgaagtacccgatcgagcatggtatcgtcagcaactgggacgacatggagaagatctggcatcacactttctacaacgagctccgtgttgcacctgaggagcacccagtacttctgactgaggcacccctgaaccccaaggctaacagggagaagatgacacaaatcatgtttgagaccttcaatgttccagccatgtatgtggccatccaggctgtgctttccctatatgccagtggacgcacaacaggtatcgtgttggattctggtgatggtgtcagccatactgtgccaatctatgaaggatatgcccttccacatgccatccttcgtcttgacctcgctgggcgcgacctaactgactgtttgatgaagattcttacggagagaggttactccttcaccaccaccgccgaacgggaaattgtaagggacatcaaggagaagctcgcatatgtggctcttgactatgaacaagagctggaaaatgccaagagcagctcctctgttgagaagagctatgagctgcctgatgggcaggtgatcaccattggggcagagaggttccgttgccctgaggtccttttccagccatctttcattggtatggaagctgctggaatccatgagaccacctacaactctatcatgaagtgtgatgtggatatcaggaaggatctgtatggtaacattgtgctcagtggtggctcaactatgttcccgggtattgctgaccgtatgagcaaggagatcactgcccttgccccaagcagcatgaagatcaaggtggtggcaccgcctgagaggaagtacagtgtctggattggagggtcgattcttgcctcccttagtaccttccaacagatgtggatctcgaagggtgagtatgatgagtcaggtccagcgattgtccaccggaagtgcttctaagttgcgagttgtctgggtcttctgaatctattctggctgttcttttctcaagtccttgccatgtaagctactatgtttgagattgctgggattctgttgactgtattaccggattaatttgttgggtcaaaatatgttcagtgggctgctatatttgaccggtgctgaatcatatgccgcatgttctggttttttttttcatgccaaaaagtttggtgctagcgtggggggagtgtcaaactatctaccagagtctttgtaagatttttcccgtgcgagtcccataatcatttccttgtgtacattcacttctgcgatgtttaatc

SEQ ID NO: 14244 - DNA, 1976 bp, Triticum aestivum
  Clone ID: PAT_TA_14244
ttttttttttgaaaggtacaatgccgtttcacaatcttcaacaaaggaaggcaaagcaaaccaatccattttcgggttcaccactccaaactatatacaggacacaatcaggattccactaaactggagacctcacacaccaacaatctgcttaaaaatcactgatacatgaagtgcaaagcaaaacaacaacaggtcataggcctaataacaacatcagcgaccccaagtctcaaccggacaccaaagtaggaacaagctggcactaacatacaccccttagtcctccactatagctgcttacatggccacatttgccagttaccatcacctgcccgcttcgactccccagctcgtccgtggtgggttcatcaccgaggagccttgctcatctaagcctccgaccacgagggcgtcgcggcttagatcaggtgatgcattgcggaacctgccatccttgtcctccagcaagttgcccagacctcccagatcgcctatctcggctgccatccttggctcgtcccatgccactggctttctgcccatctcgatgtcgcccacagctctccccatgtttgggctcatgaaaccgttcgtcgagcgaggcctcaggccctgctcctgtggaactctggcgccgaagttgtttctggaagcagggatcggcgtgaagaagatctccttgatgttctccacgacccctctgttgtatgggttggcccgttggtcatagcgatacctgaagttctcatatgttgtctggttagtgctcatgagatacaagtgaaacactgagaggccaccaacgaaccaaaaccgcgataaacgtatagacaaccagagcaatagacgcaggggtctttgccattgccttccatattgttatctgctccgcatctctgatcttaataatgtacacccaggagaatccaaagacatagaggcagagaagagtcgtcgagaagacgaacatataaaagaacctgtaattccgaagtcctatgcactgcccaacccatgggcagtgatggtcaaatcgctcgacacagttgttgcagatagagcaatgggagcatcgaggaggccggtacagcatacaggtgtcacagtactttgtcttcacagtgattccattcacaacaacatccttcactcggggcaaacgcaatggtggagtctggttagctccaacttcagcattgccttcaaaaccttcaggttctggaggatgtgcatttcgaggtatgattcctggatccctcccagaagtgagaaatagaagactcaaatcatatgccgtgaatacaactgccacaaccatcaccggtaaccccaggccataagagaagctattcatcaattcttttgcaacgaacacacagaagactgttactggagcgataatgaggaacatggtgacaaacaaggatctcgcatcgggtccaaatataaacctcccctggaggaaaaatacattgttccctttccaggcctggtacctgcccgggcggccgtcaccaaggcggctggggagaagtggcgcagcatgtcggatgaggagaaggcaaagtatggcggcaagaaggcagatgccccagcaagcaaggcggtgaacaagaaggagagcactagctccaagaaggccaagactgacgctgacgaagaaggttctgacgttgaggatgatggcgaggaggacgaggagtaaatagtagatgagggaacagcagtggtgcaaatcagcgtttgctgcttagggtttagcttgccatgtcgatgtcctcattatgtaatgttatgtaaggagaatgtttagatgcgtactcctgggctgtggcatgctagagatgtctctgtttgactattagcgaagaaaagcttaaaacccttgactgcttttctttcttggacttcccacagcatgtggaaacagtcattatgttggcttgctattaatcgcgttatgtcttgtgttc

SEQ ID NO: 14245 - DNA, 1867 bp, Triticum aestivum
  Clone ID: PAT_TA_14245
ggactctgcctggttcgccaccaccgccgccacccaccccctcatcctcttcctccgctctctgcagctgccgctcatctcggtgggaggtccttaggcgggcaggttcccctagatccccggagtcactcaatcaaatggctgacggtgaggacatccagccccttgtctgcgacaatggaactggcatggtcaaggctggttttgcaggggatgatgcacccagggccgtcttcccaagtatcgttgggcgcccccgccacactggtgtgatggtggggatggggcagaaagatgcatatgttggtgacgaggcccaatccaaaaggggtatcctcaccttgaagtacccgatcgagcatggcatcgtcagcaactgggacgacatggagaagatctggcatcacactttctacaatgagctccgtgttgcacctgaggagcacccagtactgctgactgaggcgcccctgaaccccaaggctaacagggagaagatgacacaaatcatgtttgagaccttcaatgttccagccatgtatgtggccatccaggctgtgctttccctatatgctagtggacgcacaacaggtatcgtgttggattctggtgatggtgtcagccatactgtgccaatctatgaaggatatgcccttccacatgccatccttcgtcttgacctcgctgggcgcgacctaactgactgtttgatgaagattcttactgagagaggttactccttcaccaccactgccgaacgggaaattgtaagggacatcaaggagaagctcgcatatgtggctcttgactatgaacaagagctggaaaatgccaagagcagctcctctgtggagaagagctatgagctgcctgatgggcaggtgatcaccattggggcagagaggttccgttgccctgaggtccttttccagccatctttcattggtatggaagctgctggaatccatgagaccacctacaactctatcatgaagtgtgatgtggatatcaggaaggatctgtatggtaacattgtgctcagtggtggctcaactatgttcccgggtattgctgaccgtatgagcaaggagatcactgcccttgcaccaagcagcatgaagatcaaggtggtggcaccgcctgagaggaagtacagtgtctggattggagggtcgattcttgcctcccttagtaccttccaacagatgtggatctcgaagggcgagtatgatgagtcaggtccagcgattgtccaccggaagtgcttctaagttgcgagttgtctgggtcttctgaatctattctggctgttcttttctcaagtccttgccatgtaagctactatgtttaagattgctgggattctgttgactgtattgccggattaatttgttgggtcaaaattgtgtaccttgtagactcgtaatatgtaaagtgggctgctataaaaaaaaaaaaaaaaaaaaaaaaaaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatggcccgcctttttaaaataacaaaatatacccctctcgccaggtgaagtaataatttttattttgggacccataaaactaattaacaggggcgcattttaaaaagggaatgggagaaaaaccttaggggtacacaaataaaagccgtttgaaaaaattccccttttcgagaccggtacaataaccaaaaacctaccccccgttccttttcctaaaatgcgttactttctaaagagaaaaggaaacccccctttaaagc

SEQ ID NO: 14246 - DNA, 1739 bp, Triticum aestivum
  Clone ID: PAT_TA_14246
cgagtgcggccgtcccctgccccgtcgcccgcctccccgctatacataccccccaccccaccaccccaaccctaccgctcacccccgcctcctccaccgtctctgccaccgccgcgccaccggacctccgccgctgccccgtcccccccgtcccggtagaaaatggctgacgccgaggacatccagcccctcgtctgcgacaatggtaccggtatggtcaaggctgggttcgctggagatgatgctcccagggccgtcttccccagtatccgtgggtcgcccacgccacaccggtgtcatggtcgggatggggcagaaggacgcctacgttggtgacgaggcgcagtccaagaggggtatcttgactctcaagtaccccattgagcacggtatcgtcagcaactgggacgacatggagaagatctggcatcacaccttctacaacgagctccgtgtcgccccagaggagcaccctgtccttctcactgaggcgccgctcaaccccaaggccaatcgtgagaagatgacacagatcatgttcgagaccttcaacactcctgctatgtacgtcgccatccaggccgtcctctcgctgtacgccagtggtcgtaccacaggtatcgtgctggactctggagatggtgtcagccacactgtccccatctacgaaggatatgctctcccccatgctatccttcgtctcgacttggctgggcgtgatctcaccgattacctcatgaagatcctgactgagcgtggttactcattcaccaccactgctgagcgggaaattgtgagggacgtgaaggagaagctgtcctacattgccctggactacgaccaggaaatggagacttccaagaccagctcttctgtggagaagagctacgagcttcctgatgggcaggttatcaccattggttctgagcgtttccgttgccctgaggtcctcttccagccatccttcattgggatggaagctgcaggtattcatgagactacctacaactccatcatgaagtgcgacgtggatattaggaaggatctgtacggcaacattgttcttagtggtggtaccactatgttcactggaatcgctgataggatgagcaaggagatcactgccttggctcctagcagcatgaagattaaggttgttgctcctcctgaaaggaagtacagtgtctggatcggaggatccatcttggcatctctcagcaccttccagcagatgtggattgcaaaggctgagtacgacgagtctggcccatccattgtgcacaggaaatgcttctaattcttcggacccaagaaagaaagccaagaggagcctttatcgcgaccctcctgcttcgtctctctattttgttgctgtttctttgttagcgtggacaaagttttcggctggcctatcggttaccgttttctcctattcaaagactgtaatatctattcctacttgtgcttctcacttgtgattttggacacatatgttcggtttattcaatcaaatttaatcagatgcctggtgaggctactagagaaatacgggcggtgttccgattttgtcatgtgtcacctcaatcttgttaaatgaataatatgaagtctcttgatcctaaaaaaaaaaaaaaaaaaaaaaaaaaaaaaaaaaaaaaaaaaaaaaaaaaaaaaaaaaaaaaaaaaaaaaaggaagacaaaaaaaagagaggcaaagcggaaaaaaaaaggcaggggac

SEQ ID NO: 14247 - DNA, 1657 bp, Triticum aestivum
  Clone ID: PAT_TA_14247
accggcagagggagggagggagggaggacagtccagagcggcagcagttatagccaccgcctcccccaccacctcccccctcctcctccgatcgcatctcccctcctcccgtcgcccgcctcggcctcctccgaccgagctcgctcgctctccacgatattctgtaggaaatggctgacggtgaggacatccagccccttgtttgcgacaatggaaccggaatggtcaaggctggttttgctggagatgatgcaccaagggctgttttccctagcatagttggtcgccctcggcacactggtgttatggtagggatggggcagaaggatgcctatgttggtgatgaggcgcagtccaagagaggtatcctcacactcaagtacccgatcgagcacggcatcgtaagcaactgggatgacatggagaaaatctggcatcacaccttttacaatgagctccgtgtggcacccgaggagcaccctgtgttgctcactgaggctcctttgaacccaaaagccaacagagagaagatgacccagattatgtttgagactttcaatgttcctgccatgtacgtcgcaattcaggccgtgctttccctctatgcaagtggtcgtactactggtatcgttctcgactctggtgatggtgtcagccacaccgtgcccatttacgaaggatacgcgcttcctcatgccattcttcgtttggatctcgctggtcgggatctcacggactccctcatgaagatcctcaccgagagaggttactccttcacaacctcagccgagcgggaaattgtaagggacatcaaggagaagcttgcgtatgttgcccttgattatgaacaggagctggagactgccaagaacagctcctcagttgagaagagctacgagcttcctgatggtcaggtcatcacaattggcgcagagaggttcaggtgccctgaggtcctcttccagccatccatgatcggcatggagtcttctggaatccatgagacgacctacaactccatcatgaagtgtgacgtggatatcaggaaggacctgtacggcaacattgtgctcagtggtggcacaactatgttcccaggtatcgctgaccgtatgagcaaggagatcaccgcgcttgctccgagcagcatgaagatcaaggttgtcgccccacctgagaggaagtacagtgtctggatcggagggtccatcctagcctcactcagcactttccaacagatgtggatatccaaggatgagtacgacgagtctggcccggctatcgtccacaggaagtgcttctgatctccgggagcgctccgcctccgccgccgttatcatctagtctcgggttatgtttggttcattcttctagaaatgtattgcgtatttgcaagctatgtttttttccagacgtgacgtgagtactcttgggatatgctacctatatacgtggcggctccatggtgcaagtgcaagtacactatatctatgtttgtgtattgtcacagtgtgtttgtgagatcagttgtcaaacttgggttggcttgatttgttgttggagttgtctgtaatagctcatggtttttgctatgtatttttttatcttattattattgctcttaagggaagaatcatggtatattatggattttttt

SEQ ID NO: 14248 - DNA, 1012 bp, Triticum aestivum
  Clone ID: PAT_TA_14248
gccggccgttccgggaacacgtcgcattctccccctttcgctgtccttccccgtccccattccctccgctccccagtccgcagcagttccgcaccgacgccctcctcaccctccccaaagccctaaccgctcgcccgctccgccgccatgaggtccaaggccaacggagacaccgcgttcaaggcctccggcaagaacaagacggccaccggcggcgtcgccaagccgaagcgcgcccccacccctttcttcgctttcctggctgagttcaggccacagtacatggagaagcaccccgaggcaaagggcgtcgcggccgttaccaaggcggccggggagaagtggcgcagcatgtcggatgaggagaaggcaaagtatggcggcaagaaggcagatgccccagcaagcaaggtggtgaacaagaaggagagcaccagctccaagaaggccaagactgacgctgacgaagaaggttctgacgttgaggatgatgccgaggaggacgaggagtaaatagtagatgagggaacagcagcggtgcaaatcagcgtttgctgcttagggtttagcttgccatgtcgatgtccggattatgtaatgttatgtaaggagaatgtttagatgcgtgctcctgggctgtggcatgctggagatgtctctgtttgactagtagcgaagaaaagcttaaaacccttactgcttttctttcgtggacctccacagcatgtggaaacagttattatgcttgcttttatctactgatctgatgactagcctgctgttggcttgctattaattgctttatgtctaaaaaaaaaaaaaaaaaaaaaaacctcggccgaggtccagtctgcaccgagccaccgaatccacctctcgccggagtcccagcaaggagcaagcaagcgacgatggacggcagcaagctgaagaaggtggccgggaagaagttcggcgggccgaggaagaagtcggtgaccaagtccatcaaggccgggctccagttccccgt

SEQ ID NO: 14249 - DNA, 1071 bp, Triticum aestivum
  Clone ID: PAT_TA_14249
caatgagaacacaaactatacaaccataaacataattgacttggacatactcaaacatggaaaatgaacccacacgcaatatgatgaaccattgctggctactattactgatcagaatttaacacacatgggacaatagtacataacagagctagctaaaatgagaagccacaatactgaccgaaaaaaccaccatgaataaagttacacaacacgcaaaccacaatactgaggattgagttcttgcagccgccacgacgcagtgtgcatcacgatgccgtacaatttaggaaatgcggcagccaacaagaaagggaggtgcaaggatggcaattggcacagcaaagacggatgatgaaccttggcagattgcaaccatttcttccctgtaggacacctaaatcttgtcgagcttctctgccttcaccaccgggttggccttggcgatggcatccctagctgcagtccggtagtcgaactggcagtcatgcttgtcggaatagcgatgcagtgaacagtacatgttaccgcatcggcagttgaatcccgtcagcccaaccctcttcctgcaagttgagcaccgattcggcccctccttcctcttggggctcacggcaacagcttcgctggtgcctgcaacatcagcagcaggctgcacaacgagcgccttcacgtcaacttgagcaaccgccacctctgcgctcgcggccacagccgcaacaacaggtgctttcccaccatcgccaccgttgacgatgctatcgaaggaggaggcagccagcttggcctgctcctccttcatgaccatctccttgtggcacttggagcacatgttcatggtcgcggcgctgccaaagaagccacagttattaacacataggattgggccctccggctgctggcaacccgcctccttgtgttccatcttgaataactgtaaagcctgtggcgaggcggcggcggcggcggcggcggcggggccggaggaggaggcgtgcgggggttgggaatcgcgaggagctcggctcgattggggcggacgcgtgggcggacgcgtgggcggacaagggg

SEQ ID NO: 14250 - DNA, 3069 bp, Triticum aestivum
  Clone ID: PAT_TA_14250
ccggcttgaaaaccccacctgctcacttctccacccaaacccaatccaaaatctttccctccctcccatcctttcttcccctccgcctccgcctccgcctctgcggccgccggtgacgcgccaggcgctagctagccatgtcgtgctcccacctctccaccgcgtgggtcctcctccgcgcttgccagcacctccacacgccgccgcgcctccaccggcagcagcagcctggtggtgcggtgctccctccgggacctccgcaaccgcatcgactctgtccgcaacacgcagaagatcacggaggcgatgaagctggtggccgctgccaaggtccgtcgcgcgcaggaggccgtggtctcctctcgccccttctcggaggctctggtggaggtgctctacaacatgaaccaggagatccagtcggaggacatcgaccttcccctccgcctccgcctctgcggccgccggtgacgcgccaggcgctagctagccatgtcgtgctcccacctctccaccgcgtggtcctcctccgcgcttgccagcacctccacacgccgccgcgcctccaccggcagcagcagcctggtggtgcggtgctccctccgggacctccgcaaccgcatcgactctgtccgcaacacgcagaagatcacggaggcgatgaagctggtggccgctgccaaggtccgtcgcgcgcaggaggccgtggtctcctctcgccccttctcggaggctctggtggaggtgctctacaacatgaaccaggagatccagtcggaggacatcgacctgcccctcacccgccagcgcgccgtcaagcgcgtcgcgatcgtcgtcctcaccggcgagcgtggtctctgcggcgccttcaacaacaacgtgctcaagaaggccgaggctcgcatggaggacctcaggcagctgggcgtcgactacaccgtcatcagcgtcggcaagaagggcaacgcctacttccagcgccgcgactacatccccaccgagcgcttcctcgagctcgccgggatccccaccgtcaaggactcgcaggccatttgcgacctcatctactccctctttgtcgccgaggaggtcgacaaggtggagctcgtctactccaagttcgtcaacctcgtccgctccgaccccatcatccagacgctgctgcccatgtcccctaagggcgagatctgcgatgtcaacggcatctgtgtcgacgccaccgaggacgagctcttcaagctcaccaccaaggaaggcaagctcaccgtggagcgcgagaagatcaagatcgagatgcagcccttctcccccgtcgtccagttcgagcaggaccccgtccagatcctcgacgctctcctcccgctctacctcaacagccagatcctgcgtgccctccaggagtcgctcgctagcgagctcgccgccaggatgagcgccatgagcagcgccacagacaatgccatcgacctccggaaaaatctctccatggtctacaaccgccgacgccaggccaagatcaccggagagatccttgagatcgtcgctggcgccgacgccctgtccggctgattcctcctccccacttgagctgagccgccgctgttatatataactctttgcctccttttctcctctcttctacttatcttgcttggtctgtgtctgtctgtaataatttctcatagcacaaaaaaggatgtctgttctaagattcagttcggagatgccaaatgtataatccagagtaattattacagacagacacagaccaagcaagataagcggacgcgtgggcggacgcgtgggcggacgcgtgggtcatattcgggaaccctatctatctggaggctacctaatcccctccccggcactccccgcctgacagccgcggccatggcgtgcgccttctccgcctccaccgtgtccacggccgccgcgctcgtcgcgtccccgaagccagccggggtgccgcagtgcctgtcgtttccccgcgccgccgccaggccctcccgcctcgccgccgccggctcgaggacggccagggcccgcagcttcgtcgcccgcgccgcagccgagtacgacctgccgctggtggggaacaaggcgccggacttcgcggcagaggccgtgttcgaccaggagttcatcaacgtcaagctatctgattacattgggaagaagtatgtgattcttttcttctaccctctggacttcaccttcgtctgcccaactggtgcgttaaccatcttgtgctctgtgacggaaactatccatttctaaaacgcatacatgcaaaatttgcagagattacggctttcagcgacagacatgaggagtttgagaagataaacactgaaattcttggtgtttcagttgatagtgtgttttcccatcttgcatgggtgcagacagagaggaaatctggtggacttggtgatcttaagtatccgctggtttctgatgtcaccaaatcaatctcaaagtcttttggtgtattgatccctgatcagggaattgctctgagaggattattcatcattgacaaggagggtgtgattcagcattccactattaacaaccttggtattggccgcagtgtggatgagaccttgagaacccttcgggctctgcaatacgtccaagaaaacccagacgaggtctgcccggcaggatggaaacctggggaaaagtcgatgaagcctgaccctaagggcagcaaggagtacttcgctgccatctagacgcgtcctttgcactcgctgtcgagttttgtcatggccgtttctcggttacatgtgtttttgtgacccgagttgtagttatcacgcgtacaattgactctgtaatttctacaataagggtttgtctgtgtgtggatcttccctgctccaatttggaaagaacaatacaagattggaaataaaatcttatcttatattgttctttccaaattggagcagggaagatccacacacagacaaacccttattgtagaaattacagagtcaattgtacgcatgataactacaactcgggtcacaaaaacacatgtaaccgagaaacggccat

SEQ ID NO: 14251 - DNA, 1638 bp, Triticum aestivum
  Clone ID: PAT_TA_14251
cgggggaacttgcaggtcattggacatcattcttaaaaaatccctcgacataacaagcagcaacactgattccatgattcacgagacaatatattgaacagccaaaaccaacaaacgatgcattatccatgagatcatgactgcggctaagacacagatagtaaattaagcagaagtaccaaggcagatattacgcctcaagacagtcaaaaaaagaagataccacagccgttttaccagaacagaggccactaaaacaagatacataatctagctagagtagctgaaccctgagatcttgtagatgcggatagttccatcggtgtaaccagcgtagagagtgctgccatccgcgctccagctcaagcaagtgcagtagagcatctgcttggtggagacagggacctcgggcctaaggtcctgcacgatgtgctttgactcaagatcccagatcttgatggaatcctgtgtcgccgcgcagagccagtagcggttgggcgagaagcaaagtgagttgataatggatcccgcatccagcgagtagagtctcttgccctcggtcaaatcccacagcaaggtgacgccatccttgccaccagacgcgcagagcgaaccgtctgggctgactgcaacggcactaacatagccgccatgaccatcaagagtgcagcggagcttgcagttggtaaggttccagaccttgacagagcggtcccatgagcccgagacgatggtcggggcgaagttgttgggtgagaaacggacgcaggacacccagccggtgtggccctcgccacctccaaggtcaccgccgatggtgtacttgcactcaccgagggtgttccacagcttgatggtgcggtcgcgggaagcggagacgatctgtcggttgtcaatggagaaggcgacggagaggacgtccttctcgtggccgacgaagcggcgggtggtgaccccggtggagaggtcccagaggcggagctcgccgtcccaggatccggagagcgcgaactggccgtcggagctgaggacgacgtcctggacaaagtggccgtgtccggtgaggcggcggaaggggacgccgtactcggagctggagtcctgggtggcctggatggggttggtgaggtcccagacgagcagcgacttgtcgcgggaggaggagacgatgaagggcgagttgtcgatgggcgtcgcgatggccgtgaccacgtcgttgtggccgcgccttctgccttccttggatgtggtagccgtttctcaggctccctctccggaatcgaaccctaattctccgtcacccgtcaccaccatggtaggcccctatcctaccatcgaaagttgatagggcagaaatttgaatgatgcgtcgcgggcacgaaggccgtgcgatccgtcgagttatcatgaatcatcggatcagcgagcagagcccgcgtcagccttttatctaataaatgcgcccctcccagaagtcggggtttgttgcacgtattagctctagaattactacggttatccgagtagcacgtaccatcaaacaaactataactgatttaatgagccattcgcagtttcacagttcaaattggttcatacttgcacatgcatggcttaatctttgagacaagcatatgc

SEQ ID NO: 14252 - DNA, 1429 bp, Triticum aestivum
  unsure (1)..(1429): unsure at all n locations
  Clone ID: PAT_TA_14252
cacgaaattgcaggtcatttgacatcattcttagaaaatccctcgacataacaagcagcaacgctggttccatgattcacttgacaatatattgaacagccaaaaccaacaaacgatgcattatccatgagatcatgactgcggctaagacacagatagtaaattaagcagaagtaccaaggcagatattacgcctcaagacagtcaaaaaaaagaagataccacagccgttttaccagaacagaggccactaaaacaagatacataatctagctagagtagctgaaccccgagatcttgtagatgcggatagttccatcggtgtaaccagcgtacagagtgctgccatccgcgctccagctcaagcaagtgcagtagagcatctgcttggtggagacagggacctcgggcctaaggtcctgcacgatgtgctttgactcaagatcccagatcttgatggaatcctgtgtcgccgcgcagagccagtagcggttgggcgagaagcatagtgagttgataatggatcccgcatccagcgagtagagtctcttgccctcggtcaaatcccacagcaaggtgacgccatccttgccaccagacgcgcaaagcgaaccgtctgggctgactgcaacggcgctaacatagccaccatgaccatcaagagtgcagcggagcttgcagttggtaaggttccagaccttgacggagcggtcccatgagcccgagacgatggtcggggcgaagttgttgggcgagaaacggacgcaggacacccagccagtgtggccctcgccgcctccgaggtcaccgccgatggtgtacttgcactcaccgagggtgttccagagcttgatggtgcggtcgcgggacgcggagacgatctgtcggttgtcaatggagaaggcgacggagaggacgtccttctcgtggccgacgaagcggcgggtggtgaccccggtggagaggtcccagaggcggagctcgccgtcccaggatccggagagcgcgaactggccgtcggagctgaggacgacgtcctggacaaagtggccgtggccggtgaggcggcggaaggggacgccgtactcggagctggagtcctgggtggcctggatggggttggtgaggtcccagacgagcagcgacttgtcgcgggaagaggagacgatgaagggcgagttgtcgatgggcgtcgcgatggccgtgaccacgtcgttgtggccgcgcatgacaccggcgtagacgagggactcctgcgcgccggccatggtggtggggcggggcgaagcgagcgctagggttttggggggtgcggtggaggcggcgcctgcagcccgggggatccactagttctagagcggccgccaccgcggtggagctccagcttttgttccctttagtagggttnatttcgagnaaggtaacaaat

SEQ ID NO: 14253 - DNA, 1139 bp, Triticum aestivum
  Clone ID: PAT_TA_14253
aggataataacagacgacgacgcttactcgataccattaccggttgcgactgtaagacagacagacaaacatcaggaggaaagagcagtacattacagagtgctagccaaaatgcgaaagccacaataccgttaccgttccgccgcgcagagagacgaccataaataaagcttacacaacatagccaacaaggagaccgttcggacctggggctgccgccgtggcgcgtgtgccatgcatcacgattgcccaacaactaggattgcagaagccaacatgatgaaaggataatgcagcaaagacgcacgatgacgaggtagcgcagatttgatttgggaccttatgttctgccgaccgtagggaggccccttcctagatcttgtcgagcttctccgccttcaccaccgggttggccttggcgatggcgtccatggccgcggcgcggtagtcaaacttgcactcgtgcttgtccgagtaacggtgcgtcgcgcagtacaagttcccgcaccggcagttgaatccggtcagcccaaccctctttctgcaggtgctgcaccggcttgggcctttggggttctccatcgccgcctcgctgggaccggcgatatcagcaggctgtgcggtaataagcgtcttcgcctcaacgtgagcaactgccaccgccgtgctgccagcagcaaggtgttctttcgcggcatcgccaccgttgacgatgctgtcgaaagaggaggcagccagcttggcctgctcctgcttcatcgccatctccttgtggcacttggagcacatgttcatggtcgccgcactgccaaagaatccgcagttattgacgcaaaggatgggaccctcccgagactggcagccggtctccttgtgctccatggctttgatttaactgataggaggaagccctcgtcgcgattcctctccggcgatccctgcagagagacccaacaaaaatcatcagcgacgaaaagttatggggggaaacgagcccggatcggccgagccggagccctaaatctggagacggatccgggggagagggcgacccgtggcggaatccgggggggagggtaggggtactaaccctaggagggggaggacgaggaggcgaggggagaggaatcgcgaggaat

SEQ ID NO: 14254 - DNA, 2929 bp, Triticum aestivum
  Clone ID: PAT_TA_14254
caggtagacaggaactattgacaaggggggatcaccatgggtaccataataacagacgacgacgcttactcgataccattaccggttgcgactgtaagacagacagacagacagacaccgggaggaaacagcagtacattacagagtgctagccaaaatgcgaaagccacaataccgttcccgttccgccgcgcagagagacgaccataaataaagcttacacaacatagccaacaaggagaccgttcggacctggggctgccgccgaggcgcgtgtgccgtgcatcacgattgcccaacaacaactaggattgcagaagccaacatgatgaaaggataatgcagcaaagacgcacgatgacgaggtagcgcagatttgatttgggaccttatgttctgccgaccgtaggggggacccttcctagatcttgtcaagcttctccgccttcaccaccgggttggccttggcgatggcgtccatggccgcggcgcggtagtcaaacttgcactcgtgcttgtccgagtaacggtgcgtcgcgcagtacaggttcccgcaccggcagttgaatccggtcagcccgaccctctttctgcaggtgctgcaccggcttgggcctttggggttctccatcgccgcctcgctgggaccggcgatatcagcaggctgtgcggtaataagcgtcttcgcctcaacgtgagcaactgccaccgccgaccgccgtgctgccagcagcaagatgttctttcgcggcatcgccaccgttgacgatgctgtcgaaagaggaggcggccagcttggcctgctcctgcttcatcgccatctccttgtggcacttggagcacatgttcatggtcgccgcactgccgaagaagccgcagttattgacgcaaaggatggggccctcacgagactggcggcgaccatgaacatgtgctccaagtgccacaaggagatggcgatgaagcaggagcaggccaagctggccgcctcctcttttgacagcatcgtcaacggtggtgttgccgcgaaagaacatcttgctgctggcaacacggcggtggcagttgctcacgtagaggcgaagatgcttattaccgcacagcctgctgatatcgccggtcccagtgaggcggcgatggagaaccccaaaggcccaagccggtgcagcacctgcagaaagagggtcgggctgaccggattcaactgccggtgcgggaacctctactgcgcgactcaccgttactcggacaagcatgagtgcaagtttgactaccgcgccgcggccatggacgccattgccaaggccaacccggtggtgaaggcggagaagctcgacaagatctaggaagggcccccctacggtcggcagaacataaggtcccaaatcaaaatctgcgctaccttgtcatcgtgcgtctttgctgcattatcctttcatcatgttggcttctgcaatcctagttgttgttgggcaatcgtgatgcacggcacacgcgcctcggcggcagccccaggtccgaacggtctccttgttggctatgttgtgtaagctttatttatggtcgtctctctgcgcggcggaacggtaacggtattgtggctttcgcatttccatatcctagcagggtttttgatgtcattcactgtgctcgctgcagggtcccttggcacattgaaggtggcaagcttttgctggaattgaaccgactattacgtcctggtggttacttcgtctggtctgccactcctgtttaccaaaagctccctgaagatgttgaaatttggaatgccatgtcttctctgacaaagtccatgtgctggaaaatggttaagaaaacaaaggatacattaaatcaagttggtatggccatatatcagaagccaatggacaacaattgctacgagaaaagatctgaagacagcccaccgctatgcaaggaaaccgacgatgcagatgctgcatggaatgtacctttacaagcgtgcatacccaaattgccgattggtccgtcagtaagaggatcaaaatggccagagatgtggcctcaaaggcttgagaagactcccttctggattgatggttctcgtgttggagtttatggaaaaccagcgaatgaagacttcgaggcagactatgcacactggaaacgtgttgtaagtaagtcgtatgtgaatggcatggggattgactggtctaaagtgagaaatgtcatggacatgagagccgtatacggaggttttgctgcagcactgagggaccaaaaagtctgggttatgaatatcgtgccaatcgattcggctgacacactgcccattgtttatgagcgtggcttgtttggaatgtatcatgactggtgcgaatctttcagcacttacccaagaacatatgacctcctacacgcagaccatctcttctcaaagctcaaaaagagatgtaaattgttgggagtgtttgccgaggttgaccggatattgcggccagaaggcaaactgatcgtgagggacgacgcggagacaataagcgagctcgaaagcatggcgaagtccctgcagtgggaggtgcgcatgacctacgccaagggcaaggaagggctgctctgcgtccaaaagaccacgtggcggcccaaggagatcgaagcaagcatgtagtgaaatatacattcgacgcaaaactgttcccggttagtgggcacgtattacactagactgaattttggctctagatataagcatatgattcttgttgatgctgaaaaaggcaaaagcattgtgcagctgtagaatcatgtatgtgtttttttttccgcgccaagcgagggcggccttgcattctttcttttgcttggacaacatttgttgtaaaatgaatgtaatgctgtactggaagccaataggtagacccccggcccggagggtggtatctgttct

SEQ ID NO: 14255 - DNA, 1560 bp, Triticum aestivum
  unsure (1)..(1560): unsure at all n locations
  Clone ID: PAT_TA_14255
gccggccggtccgggaaaaggaatcaatccctcatccttcccaggccgtcatcacgttaccgttgcagtcgcctttgccgagtcttgacagcccattcacaatgtctcaccagaagaacgagaaggacgtcggtgatgctcccaagagccaccgtatccgaatcaccctgaccagccgaaaggttcagtctcttgagaaggtcagcgctgagctcattgagcgtgcccgcagcaagggcctcaccatcaagggccctgtccgcctgcccaccaagaacctcaagatcaccacccgcaagaccccttgtggtgagggttccaagacctgggactcctacgagctccgtgttcacaagcgcctcatcgacctccacgcccccaccgaggttgtcaagtccgtcatcgtcaacatcgaggccggtgttgaggttgaggttaccatcgctgcttaaatgtggtcacgatcctagtcagtagtaaaacagcctggttgtgtcctggcattgtgagggaagggaatgatgggaacatcaggcccttgccctcgagaagagtggtggatataggatactcagtcatgattaatgaatatctgagaacctcgtgttctaccattcnnnnnnnnannnnnannnnnnannnnnnannnnaanaccaaagcaagcaagcagctagcatttcctgcaaaaactagaacagaaagagatctccaagcacgcgacgatatgtcaacgccggcgatgaagatgggcccgtatggcggcccaggagggaatcactgggacattaatgctctcaatccgcccaaaaagattgtgagcatccagatttggagcactgattcctcatgcgaaggggccagcggggtcatcaacggcatctcgttcagctatcttgacatggcagggcaactaatcccctcgggtccatggggctcccagaccggtaaaccccacgtgattaacattggtgaagacgagcgcctgatcactgtctacggcaccagcgatggcaaatttgtcacctcgcttaaatttgtcactgacagggcttccgatccgtatgggccatacggggcaccgtctaccataagtactttcagcttccagggcggctccatcctcgccttcttgggccgctcctcagacaaactcaatgccatcggcgcctacaaacttggggtttgatccatctaaccatcatggccagcatacgtgtctgctgacttccgtatggttggcttcggtggatacatgtgttcgacctatatctactgcttgtatttgcagctaaataaaatggggatccctcgctgatgcatcctatggatggatggatccctgccgtccgtacgtgtgtgcgcgtgctcgctctttgtttccgtatattgtatcgtcctagcctgtgtaactataagatcaataaaagtctcggaaactaagtactccctccgtaaatacatataagagtagtgatctagacgctcttatatttctttgcagcgggaggtattttcctgagaatttatacttccaaaaaaaaaaaaaaaaaaggccccta

SEQ ID NO: 14256 - DNA, 806 bp, Triticum aestivum
  Clone ID: PAT_TA_14256
ccgggggtactcaactcactccaatgcaaataaaaattatacgtactacaatgggggaattacactctatgtatccacctttaccccttccctgcaagtcaatcaatctagtaaagctcaaacctcaaacgtaatctccatctcatgcttgtcaaccatgaggaaatgaaatcctttgtctaccaccttgctgccatccttcctcacccctgctaaagtgctcacacgggctgatgtcaaatgtgagtctggccttctcccctgccttgaggtgctgtctcctgaacccgatgagctgcttcgccggccggccggccgttgcgttggcccaccggaggtacacgagcaccgagtgcttgccgtccatggggccgtggttttccacctcgaccacggccgggaacctgagctgctcgcaccgttgggggccaatatgttcgacgtggtagctcgcgacgccttgttccgccgctggcgatggcattgtgctcaggcctgcgagcaagtccgtgttgggggtgccggatgagaccagccggcgagagtagctggagtagctgaggccgtagccaaacttgtagacggtctctccctggtagaagcggtagctccggccggggtagccggtggccgggtcggcgcgcatccgcatgtcggtcatgggcaccttggtgaactcttccgggtaccaggtcaccggcagcctcccgccggggttgtggtcgccgaagagcaccctggcgatggcgagcccgccggcctggccggggtatccggcccagaggatggcgccgatcttggggttg

SEQ ID NO: 14257 - DNA, 500 bp, Triticum aestivum
  unsure (1)..(500): unsure at all n locations
  Clone ID: PAT_TA_14257
gaaatccccaatctctggggaaccctagaccccaaatcccccccacccttcctacgctccattatcaccggccggcggccggcggccggcaatggtgtgacctaaggcgcatcacatcgctcttggttcctgcttccatggagcgcacgcgggggcatcggcggcgaaagctctccgtcgccgccggcgtcggcgttggaggtggcgaggaccgcctcagcgcgctgccggacgacgtcctcgtccacatcctccttaagctccgcgacgcccccgtcgccgctcggaccagcgtcctcgcccgccgctggcgccgcgtctgggctctcctcccggagctccatttccccgtcggcactgaccccgaccgcatccgcgccgccctcaccgcccatgatgcgccggccctccgccacctcttcgttgccggcatcgaggtcacccccgaaatcgctgcggnatggntccccatcgccgcgcgccgcctctctggtgtcctn

SEQ ID NO: 14258 - DNA, 451 bp, Triticum aestivum
  Clone ID: PAT_TA_14258
aaaaaaaaacctgggtttgtttttttttcccaagtttgaactaatttagttggggtttttacatgaaagggcttggcaaatttttttttccccggtccaacaaccaaaccgtgggctgaaaaaacggggtttcatttttttagtcctaaagttttttttttttcagttagcccccaaaatgccaaaggggccgagggggcaatttgggggggtgtaaactttgcccattgcagggaccgtttggggggctaggttccttatttcctcaaacgggggcatttgttgggggtggaaaaaaccctgggcctgggggttttgctgaaatggccggaaggacccccggcctaagggattttgttgcaaaggctgttggaaggaaacccggcccgagggggggggggggtgtttttgggggggggcccaaataattccctgaacaactttggggggg

SEQ ID NO: 14259 - DNA, 786 bp, Triticum aestivum
  Clone ID: PAT_TA_14259
aaagacaatgaataatatattcacgcaagcttaaacactgaatatgttcactgacgcaacctcataaactccagtacaattaaaaccaattaaaacacaaggagtgcagctaaaaggttcacatgacgaatactaagcgttcactcaacacgacctaaacgctcctttactgaaatgcccactggttctccctgcggatcgtctgctcctcctcaggcaagtagtcgttcttggtgctcaagaaactacggatctcctccagagaattgtcactaatcgtgtcgatagtcgtctggctagtcaggtccaacaaccccttgatgttgaggtaacttgcagcctggatgaggtcgaagcgggtggcacgattgaccttgatgaattctgcatcccaaatcttgaggtcctcggctagggcggcgggagccacggtgtcagacgcagcggcaccggtggctccagtggtcggtacgtgtttgttgcagtactcgatgaccctggagaggatcttggagttgatgttggggatcaaaatggctgtgtcggcgcagtcatcctcgatcattttgcgaatagtctgcgactccatggcgactgcctcctccacctcgaactccatgccgtcgggtgacttgagcatgatcatcttcttgcctgcctctcgggtcgccatcactgctggatccgggttggaggtggtggcggacgaattggggatgggggaaaccctagatactcgacgcggaacagccggcagcagcgtagaggaaaagatgggagatttgg

SEQ ID NO: 14260 - DNA, 801 bp, Triticum aestivum
  Clone ID: PAT_TA_14260
ttcgtgatctcggcggcggcggctctcctcgggctcctcctgttcgccggcgggaccaagaggttcaggcacttcatgccctgcgggaaccctgccgcgaccgtgggaaatgtcttcgtcgctgcgacgaagaagaggcacctcaccatcccagcccaagtggaaaaactgtatgagttggatggaactcacagcgtcaatgggggcaagaagattgcacacacaccaggatacaggtttttggacaaggcggcggtgatcgaggacccgtccatccttctaccgggcgagcagccagcatccaggccgcggcatctctacacggtcacccaagtggagcaagtgaaatgcatccttcgactcattcccatatggctctgcagcatcatctactctaccacatactcgcagatgtcgtcggtgttcatcgagcaagcacaggccatggacaacaccctcaacaagttcacgatccccgccgcgggcatcggcatcttcgagatcatcggcgtgacatcgttcgtcttcatctacacgttctgcatcgccaagccgctgtcgaggcgctcaaaggagcccaccgagctgcagaggatgggcatcgggctggtgatatcgacggcggcgatgatcgcggcggcgctggtggagcggcagaggctgaagcacgcggagcggtaccggctgagcgtgctgtggcagatcccgcagtacctgctgatcggggcgtcggaggtgttcatgtacgtgaccatgacggacgctcttcaacgaccagctcccggccgacatggacgcccc

SEQ ID NO: 14261 - DNA, 1091 bp, Triticum aestivum
  unsure (1)..(1091): unsure at all n locations
  Clone ID: PAT_TA_14261
cgtccggggactttgcccactacacatcctagctttgcaccgcagaaacaccttgagatgtttccagcttggcaggcccctcccctgccagaagaaccagccgagatattcatcggcatcctgtcagcaggcaaccattttgcagagcgtatggctgctcgcaagacatggatgtctgctgctcagaagacttcgaatgtcgtcgctcgattttttgttgcgctgcatgccagaaaggaagtgaatcttgagttgaaaaaggaagcagaattttttggggacattgtcattgtgccattcatggacagctatgatctggttgttctgaagacggttgccatatgcgaatatggggtccgtgccgtctctgcgaaatatataatgaaatgtgatgatgatactttttgttagacttgatgcagtaatggctgaagttaagaaaataccgaccggtagaagtctttatatagggaacatgaattatcgccacaatccattgcgcattgggaaatgggctgttacttacgaggagtggccagaagaggattatccaacatatgcaaatggtcctggatatgttatatctgctgatatcgcagattccattgtttcagaatttacagatcataaattaaggctcttcaaaatggaagacgtgagcatgggaatgtgggtggggcgtttcaaccacaccaggacccgtcgaatacgtgcacagcgtccagttctgtcagttcggatgcatcgacgactactacaccgcgcattaccaatcaccgaggcaaatgctgtgtttgtgggacaagctgcaagctgggaaaccacggtgctgcaacatgagataacgattagggaaaccggtgggcanctgacctcctttttgggtggttactggattcngggccgaagtttttgtttaagagaatgacaacgggcccgaagtttcaagctaagaaaacgaacccgangggaaatgaaacgaaacaaaggcaagcntggtngggggaacncctcctggattcgggcttgtngggggcnncctcctttcncccaaaattatataaaaantttctgaccngcncaaaaaactt

SEQ ID NO: 14262 - DNA, 685 bp, Triticum aestivum
  Clone ID: PAT_TA_14262
ccacgcgtccgattcttgcaaggtcatggaccaataattggtgggcgaaaaccccactttctttctttggacaacactatttgttctctctctctctctctacccctctctcgccccctacctcctccactccgcccgcaacccatcgcccacaccccacccccacccccaccctagggcacgcacgcacgcacgcgcgcgccgccgcatcgccgccgccgccgcgcgatcccgcggccggcggtccgctccgccccgccccaggtgaatccagttgctgcttaagtgggtttcctttgtaccaaacctgaaggtgaacccagttgctgtttaagtgggcttcctttgaaccatacttgaagttaaacgcaaggcttcacagttcctgggaatctgcctgtatagcttccttcaagcatggagaacctaccaaatgttcctgcaagtattgctgagaagaaccagggaaatgagacatctgatgatgctggcgagcctgaagaagtaccagacgtatttgtttacagagaagatgtcgtcagcttgaaatcaaacaaagatgcccgtggtttggtgatggaagtagctggcgaatatgattcttgaaggtagcatcactgacgatgaatctgatgctgaggaggaagtgcggcgtagcgctcctaaaactgaaaatttcggtcct

SEQ ID NO: 14263 - DNA, 665 bp, Triticum aestivum
  Clone ID: PAT_TA_14263
cccacgcgtccgaccagactctgcacgcaaacagttgtcggatcatatgggtacatggctccagaatatctttacagaggtgaaatatcagcccagtcagacatatacagtttaggcctagtgataattgagatcaccactggagagcagaatcctcgcgaaaaagaccaaccatctgcaagaagttttgttgataaagtgcgtaaagaatggacgctggagaacataacatccaaatattcatcactggatcatgaaagcctccaacaagttaaaacatgcattgatatcgggtcaaactgtgttgagattgataggacaaaaagacctcgcatagaagaaattgttgactcgctcaatggactacgttcaagccaaaaggttaccgaggtctcccgtccgcctacaactggcaagaagctaatgggctccatttttggtctgaagaaatgaaacatgcacgcctgttactgctggaagattgtaactttaatttggaaataggagcctttgttgccatctcgtcttggaagcatttaagtgtaattttcttatgtgtaatatgtctttttattactattagtcaactactgcagatgcaatagtagttttcatgttgtctctgtttatggcagtttgaaataagaatctgtttctctagcctg

SEQ ID NO: 14264 - DNA, 1417 bp, Triticum aestivum
  unsure (1)..(1417): unsure at all n locations
  Clone ID: PAT_TA_14264
ttcaaccttctctctcaggcagcgtctgctactgccagcccgggatcctgccatctcgaccctcatgcccctccgaaatgccccacggaagatacagtccgttctacgatagtatgcagccatgcctcgagcataccaatcaagagccgcaggattggcccaagcaaataactatagttttcgcgtaagaaagcacgagagccgtaagccactgcagaaccttcaagacgaggatctaacctcagcaagcaacggtattggccaagaagggaggagaggggaaagccccgaagacagcatctaagtaggcatccttggagactgaggctgtccattaacttaaaatatacattatagttgggctccaaaggttgctgagattaatggggaagtaaggcctccaatagaatgaaattgttagacacgctcaacggactacgttgtaaatgaaagttgcgaattgaagtaaaaaaatcgtgcagcatgatccatcttaggtcagggagtacatcagtcatcaaattagttgcaagaagaaattaaacatttgttactattgctggaagagctttatattattgcgttagatgtaaatatatttgctttggaaataagacctttagatgctatatatgctggcccaggacaaatacagactgtgcactctaacagttgtcggattctatgggtacttggctccagaatatctttacagaggtgaaatctcggctcagtcagacatatacagtttaggcctagtgataatcgagatcgccaccagagagcagaatcctcgcgaaaaagaccaaccatctgcgagaagttttgtcgataaagtgcgtaaagaatggacgctggagaacataacatccaagtattcctcactggatcatgaaagcctccaacaagttaaaacatgcattgatattgggtcaaaatgtgttgagattgatagaacaaaaagacctcgcatagaagaaatcgttaactcgctcaaaggactacatccaagccaaagggttaccgaggtcacccgtccgtctacaactaccaagaagtcaattagctccttttttggtcataagaaatgaaacatgcacgccctgttattgctggaagactgtcactttattttggaaagaagaccctttgttgccatgtcattttggaaaatattgaagtgtaattttttatgagtaatgtattttattattattaatcatgaaattgaattttaattgatatccttttttactttctcttcttgttagcatttttgtgtcatgttatcaaatgctttatgtccaataataactattagtcaactaccgcagatgcaataggtagttttcatgttgtctctccttcccgccattcggaagggggtcgtntcattgngngaaantcgnggtaattc

SEQ ID NO: 14265 - DNA, 645 bp, Triticum aestivum
  unsure (1)..(645): unsure at all n locations
  Clone ID: PAT_TA_14265
gaaagccaaccccgacattgaatcattgattccgccctgctcgaggccctgctcgtgtaccactacggctgtccctcaccctccgagcgttcgctagtctccattccccaactccacacctccattggcgcgctcgagctccaccgcgtacctgcgtgcagtgtgcaacggggcaagggagctggcgaaaatggcgcccgtctccttcctcgagctctcgctctccttgctctgcttcgtcgtcttctactacttccacgccaggtccaagcggaagaacccggtgatcccgctggagtggccgctggtgggcatgctcccggcgctcctcgccaacctcccgcgcctccacgactgggtcacctccctgctcaccgccagcccgctcaacttccgcttcgtcggcccgccgcgctccggcatggagctcttcctcacctccgatccggccaacgtccgccacgtcttcacctccaacttcgccaactaccccaagggccccgagttcgccgagatcatggacatcctcggcggcggcatcttcaacgccgacggcgactcctggcgccgccagcgcgccannncgcagctgctcatgtccgncccnnnnnncnnngccttcgtgacacggtgcagccnnngnaa

SEQ ID NO: 14266 - DNA, 735 bp, Triticum aestivum
  Clone ID: PAT_TA_14266
ccgcgcgggggtactgcgttcttatgtatttcctttcaccttgatgacggtggccctttccatgcttgctgtgaaagggctgaaagaacaaggccggttgggtagatcttttggcaaagtgacaattagggatcaaccaccctcaaacacaattcagaagatcctagcacttaaagaggcaatggcctcagtggaaaattatctccagaacctgaatgtctccctgctgaaaatccgcacaatcttactagctggccaacctgaggtgacaacacaggttgcgattgttcttctagcatcctcagccgtccttcttgtgtttcctttcaaatatgttcttgcattcgttacatttgatctcttcacaagggagctagaattccgtagggaaatggtgagagccttcatgaacttcttgaaggaacggtgggaatcaatacatgctgcccctgtggtcgtgttgccatatgagggcgctgaaagtagccccaagacactcccggcaaaagcctcggggcaatcagaaccccagaatgtgcaagggggaagcggttatgtcacctcaaagaacggcatcagcagttcatgatccgcacagctctgagagcatcttgttgtacacttatgtacagttttgtacagttggttccggtgtggattgctggcggcgtgcgtttgcgttgtgctggaacggtgggagtcaatacacgctgcccctgtgatcgtgctgccata

SEQ ID NO: 14267 - DNA, 504 bp, Triticum aestivum
  Clone ID: PAT_TA_14267
aggggggaggcaaaccggataacatgccttttgaccaaggggcgaaacaggttcatacaacacaacagggtgtaaaccaaaccccccacagcaaactttcaattcaaacagacaaaaaacagataaagcccctcgggcaaatcatcagggcgcaatctcagctgctttaatactcatcacccttatcaccatcctcacccttgtcaaactcaacaccaacttttttatagtccttttccagggcagcgaaatccttacgggccttaaaaaacttttccttctccatgcccttacccacgtaccaatggacaaaggcccccttggcgtacattaggtcaaacttgtggtcgatgcgggaaaaaacctcgacaaccctggtggagttggaaatcatgcaaacggccctttggaccttggcaaggtccccgcctgggacaaccctggggggctggtaattgataccacacttgaaaccaggggggcaccaatccacaaactggatgg

SEQ ID NO: 14268 - DNA, 355 bp, Triticum aestivum
  Clone ID: PAT_TA_14268
gaccgggggcaaccaaacatgggcttcaagcccacaaaatcaaaacagttgaccgcaataaaaatcttgcaaaatatcattccaaccccggggcgaaaaaatttgctactctcaatacaaaggactttactaattaccatcaattggtcaaacaaaacaacagccggtccccacaaacagggactaacaaaaaagggggacttaaaccctgaaaccccgggtggtcctcctaccacaaacccttttaaacttcctacccttggaacccacatagggcttgggggggctgtgccgcacaccaagccccttgcccaaatgccttaccgcctcacgcccatttttggggccccccaac

SEQ ID NO: 14269 - DNA, 892 bp, Triticum aestivum
  Clone ID: PAT_TA_14269
gggagaaaaaattttgcgaagaaaatatggccaaaaaaagcgcgggtgaaaatgggaaacttgaagggccttgacctccggaatgcaggagctcaaaaacctactttaggttatttatgctatcgactttcctgctgatgttcatgttctgctcgaggatatcaaaaaacaggagcagagactcagataacatttgaatcccacgggcgaatcaattggagctaggctattcagctcagtatgggttggcaatggtgctcatggtttattgccgcagatgaacaaagtacagcatgaatcattccaacaaaagtccgttttcgggggcaactttggaggcacggcgacaggagatgacaaggatggtagaatcagaatggtgttttgcagcctctgcttagatgctagatgtatgtcaagagtgatctgtttatgtcttcgacgagtcataaatgtaagttgtagagctgttgatatctgttcgtggtgatgaataggtagaatcagaatggtatgtgcgcctttcgtaggttgctggttttttgacacaattgtgaatctaacattcaatcgtcgacttattgtgatcgtgggcgaaaaacaggagcagagactcagatgaacaaagtatagcatgaatcattccaacaaaagtccattttcgggggcaactttggaggcgcggcgacaggggatgacaagaatggtagaatcagaatggtgttttgcagcctctgcttagatgctagatgtatgtcaagagtgatctgtttatgtcttcgacgagtcataaatgtaagttgtagagctgtcgatatctgtttgtcgtgatgaataggcagaaacatcaatgaatatgcgcgccttttgaaggttgctggttttttgacac

SEQ ID NO: 14270 - DNA, 640 bp, Triticum aestivum
  Clone ID: PAT_TA_14270
ggaaaacgaaaggttccctgtgtcaaacgaagagtgcatgcattacaactcaataatcgaacttgcatatacaaaaagaattcagaggaagtatgcgttgacgtactcgatggttcattgcaattacgtatcacttggacaaagcgcttattgccaaccgggcacgtcgacaacttccttgatcccttgcttttgtccggaagttcttcgaggaccgtcatccctcaatctctggaaggcaccatttcttcccgaacattggtcgtccgattctgaactacccaaaagacgataaactaagatcaattgccacttcttttttgggggcagcatcagcaagtaggggtaaacggctagatttgtcaaatacgctgttcttccccacatgcctcgacaaccattggatagtgtttgctgtcaatttcaagtggaaactttttgctttcttggattctttttacgacaaggactcatatcttcacaagcctaccagagagaaatttataaccttcgtcatacctttgtggttcatcttgttcctcacattctggtctttagaaaggatctccccccatctatatgaattttaaatcgttatgtctccattttcttcaatatttttttttttgtaccatgtaag

SEQ ID NO: 14271 - DNA, 1528 bp, Triticum aestivum
  Clone ID: PAT_TA_14271
gtggatctggccccccctccctctagccctcctcgcccctcacacggtcgccgcggccctgctcggtgggcccctcacgcatggctgagtctcctcgcgcacctacccccgccagctcccgcccaccttatcgacggcggaatcctcggtgccggttgtctcaccgccccgatggtgtatatcctcccaccgcacgaaaggggtcaagacgctgggaggatcattcaccaccagagctttgatacttgttcttggatatgcatatccgccctatgattgctacaagacagtggagctgaataggcctgagattgagcagttgcggttctggtgtcagtactggattttacttgcaatgcttactgttttcgagagagttggggataatttcatatcatggttgccaatgtatagtgaagcaaagctggcttttattgtgtatttgtggtatcctaagacacaggggacttcatatgtctatgagtcgttcttcaagccgtatatcgcaaaacatgaatctgagattgatcgcaatcttcttgagttgaggacaagggctagtgatatggctgttacttacttccacaaggttgcagactacagccagtcaaggttccatgagatcttgcaatatgttgcttctcaatcacaaagatctcgttctcaggcacagcaacagcagcagcgtccaccacctccacggactcggatggcgaatcctgcaccaccacctgttcctgcaccaacggcaccaccgatgccaccgcagcccgcccaagttcctcctactccaccaaggatgcaggtgcaagataagggcccagttccagttgcccctcctggcgcagtgcctcctgtgcagcaacaaacaccttccggtcctggccctgtcaccggcaacagccccccaaacagtgaagacatgctggttgatcaatctgggccatcgacaagcaacgtgccactccgcccaacaatgcctgacgacgaggagacgctcatccaggaggctattcggttgactcggggccggctcaggaggcgcatgggtggatctggacctccatccaactagctcttctcgcacttacgacgatgatggcaggggaaatgctgggttggtccatcaggcatggctgaatttcctcgcacagttgcgcatgcgcgctcacgtccaccttgtaaaacgcacgagtccggttcctgttgtttcatagcccagattgtgtatataaacccaccccacaccaggggtaaaaacgctgggatgtcagtggaccaccagtttagctaggcggtagcagaagatggttaagatgctcggtgaaatcggttccaacttagttctgtcgaaattcgttggtggtgacttcgtctgtactggaaagtggttcaaaggtgaagtgaaataatcttaggctgtactgggatgatagaagcctgcctcgcattggcacgttctgttgctgctacatttctttaaaaaaaaaaaaaaaaaacccaccccctctaaacaatccaaccttac

SEQ ID NO: 14272 - DNA, 1035 bp, Triticum aestivum
  unsure (1)..(1035): unsure at all n locations
  Clone ID: PAT_TA_14272
ccgccccaggctcggcagcgccgcccgcgcccaggcccctctccgccgccccgctccccgccgccgccgcggtgccatccccccgactcgccaacaaggtttcccccctctcccccgcggcgctaaccagcctccacccggccgcgcagtcctcgcggctccctcgggccgccaccgcctgcttcgcgcgcctcccggcggcccacccggggtcggggtcctggggcagggcggcggtctccgtcgcggcgccgcggcgccctaggcgggcgcccggcgtcgtctacgccgccgccaccaccgagaagagcatctacgacttcaccgtgaaggatgttgatggaaaaaacgtttctcttagcaagttcaagggaaaagcactgttgattgttaatgttgcttctcaatgtgggcttacaacagcaaattacactgagctatctcatctttacgagaagtacaagactcaagggtttgagattttggcgtttccatgcaatcaatttggttttcaagaacctggatcaaatacacagataaagcaatttgcttgtacaaggtttaaagctgaatttcctatttttgataaggttgatgtcaatggaccatttacagcccctatttataagtttctcaagtcgagtgctggaggatttttgggtgatatagtgaagtggaactttgagaagttcctagtggacaaaaatggcaaagttgtggagagatacccaccaacaacttcaccattccaaattgagaaggacatccagaaactcactgcggcataagtgcttttgagtccggcttcagttaagcactcctgtatatattgccttttttttgggcggaaactagagttttacttgtgattatggctcttgtgcgatataatgttttccattcctgtaaaataattcactgatatgtatagacatttccggacttcggttttaagtgtagagatggggcatgaggaaagcacaatcaactttttttttttcgggggccggnccaatcnccaaangntccttancc

SEQ ID NO: 14273 - DNA, 1174 bp, Triticum aestivum
  Clone ID: PAT_TA_14273
gttcagaagtttcatacatcctcgtgctctatgcccaaatgtatattgataattcaaccagttcccgctatcattgagttattacttaagcaccaaaaggagtcccatttccaccttcaatcaaatcagcatacagggcttgaaactaagatagctgggaatcctagtattaggaccagacgttaacttattagcaatgtaagtagtatcccagatagtacttgaactctccatgcctcccaaccagtgcaagtccttttgtttcattgccacatccagtttccatgaataaccgtgaagccaaagatgttgatcagcaattgcatctaaaatgtagcacacacataaagcaaaataattagtattttgcatcttggggcatcattagtaagcaaagcaaaaggatggactaagcaagtcttcacaatctaagctgtgggggagcatgaaccagatattaggaggggccaaaatgagtgtatgacataaaaaaggctagggtgatcagagacgccggagggttagtagaacgattagcagaaatataagcatatttggtaaaatttcctctaggaagggaggtgggggcaaggaccagtagtgtcccgcctatgctccagtactgcatccaaggttatccctttgtacatttcactgaactattcatcacaagtacttgagaacctcaagattcaacctgacatcatccaagctcctgatttggcttcactctaggttgtcggtatagcagctagcttccaccaagttaacaattagacggagaagctccaactgcctgcctctggcatgcaacaccacaaaagatggcgcccgctgaatctgagtttgcaattctcgtcacacagcagatatgtaacaaaatctaacactaaagaaaagtaagcctcaaagaacaaagagttgcattcctctcaactgaatcgctttgcatgataccgagaaaattcacgatctctgccaagtctgcagaaccccaaccatcagcaccaggtacaagaaagcattcctaatccagtacgatgaaaagggtggaccaagaaccgtacgttagatcctactgttgtcctcgtcgccgttgaggctgtccgaaccaagaagtgtgagaggatacgcaattagctaggcgagcgagattgattggcacaggtattac

SEQ ID NO: 14274 - DNA, 1298 bp, Triticum aestivum
  Clone ID: PAT_TA_14274
cccccccttaaaaaatcaatttccaagttactaataatttgaatttttcacaatttgacaacgtatatcaccctttctccacaaacatggtcatagcaaagatcctctcactgcttggccgtcaaataccatgccaacccgtgatcctcagcgtgggtgaaatgttttgcttttcaacacgccaactatgctttgaacacccttttaagattttgcagatgcatcaaaagcatccggctataatattacaagtacaaaacagaactcaaaattgctgtgcacgtcaaaatcaactcaaaccccaagcgatttctgcttcttagcagtattcatgtacggccgtagcacaaactcgttctgtgcttcgctttggtccatagttcctcgtttgatctggtacagtcgcaactcaaaacggggcccaacctccttcaggtcaatggatttggggccaccatgtttttcgtagatatgatgcctgaaagagatatagtcgtctctattagcaaaagtgattagacgctttgactccggcttcggcacaggaaagagatgcttcattatattggcagtcctttcaccagtcttggttgtgaaattgtccagtatcaaatgagggtaagcttctgacattttgcccatggccttcctatctttgatatcatgccgtgttaccacattgagtaacccaaagtatgcagttggacctaatggtagatgacacacaatcaaaccatcaggctggccacgatgctcatgcaccaaaataagatcagtgatctcgtgtgatcggcaggactcaacgatttctgaaatcacctgaccaccacggttcatcctctgtgagttcggaaatacaactttcagctccttaacaaactgagtcaggggcgcactcgggttacgggatgtggtcaagagaatcttgggctcgcggagcgtggcgccggcgtactcgtcatctatgatgctcctcggtactgcgcggtcttggtcgtcgaggtcgatctcgcggcggagggcgagctcctcgttgcgaagctcggtggggataggcttgccctcctcgagcgcctcccggacgcggcgcttcttctcgtagtgctgacgctccttcccctcgaggctcttccggtagaggtactcccgacggagccgcgtgttccgacgcagcatctcgcctccctctcccgactggaccaagcaaaaccctagctaggcgcttgatgagtggaggcgataaaccctagtagcgacttcaaagctttggccgcgcgccgcgagctcggacgcgtaca

SEQ ID NO: 14275 - DNA, 498 bp, Triticum aestivum
  unsure (1)..(498): unsure at all n locations
  Clone ID: PAT_TA_14275
tttgcagataaggttttccctcgttcatccttttctcccacaagatcttgatcttccgtgcaatgcacgggcatcttgctagtactccgacaatatgtatattattgtgaaagttcatatacaccagccgagattaatgcaaacacgccagattttcattacatttcgaacttttataggacagaaaaataaaagaaacccgatcctaaacctattctacggcggtgaccaacgtcctccatctgcgatctctatgtacgggggcggggttcaagacccgtgaagtgaaggtgcggtctccggtgaggaagagtagaacacgggatacggaccggccagttggcacaccatgccctgccgcctcccatgccctactcatcctcggaggagttcccgaccattggacggcgacaagtaggacgcgaattaggacgcgcccgttacgtctcccgtcctccggccgcaacgtttgcaacgcttttccgnaatttaaccagg

SEQ ID NO: 14276 - DNA, 716 bp, Triticum aestivum
  Clone ID: PAT_TA_14276
caggatctcttacttttcatcactattaacattactcaaactcagagcacctccaaaaacgcattactcgaagcattataaaggccttcgggcactctacatctatcttccttccagacgggccctgcatcgatctgcactcggccaatcttcggatggagttctatagttccagcagcctcgagtatttcagcaaccactttttccagagcgaaaccaacgctgaagaagccatcgggacgaacgccgggcaacctgaccaccgtcagaacctggccttccaccccagaccactccttctcgagggccaccagactcaccatgtttatgtcgccatcgccgtcgccgtacgccacctccggggtccccgcgaacccgtcttccccgtacacgaacgtctccggcgtgctgacgccgaccccgatgatgctggtcgccggcaccatcggcgccggcagcgcctcccatgctggcagcacccgcgtcacgtacggccggaccccttccgggaagccgacggcctcgaagaactccgcaatgttgtgtgccgtgtacgtcgcgttcttggtcaccaccagcggccggtccccgaacaccgccggcgtgggcaggcgccagagcgcgctctgctggctccgcgccagccggaccctcgccggccgcgcgacgttcggcagcccgtagtccgtgccggcggccaggtcgttcatcccctc

SEQ ID NO: 14277 - DNA, 319 bp, Triticum aestivum
  Clone ID: PAT_TA_14277
tagatcgcgagcgtatgcccaacggcggatggcgcgctaggtactacaacagttttgtgtggtcatggtttcacctggaggaagatttttggcacgctgctgacccgccgatggagagcctggccttctgctaaattattcgtgtaatatctaggggttttacaggaacatacgcttgttttaatttcttttggtttgccgcttgtcggagttggtgatagaatgttaacagctactactacatgggccttgtaaagttctacagaaccaagaaagcattcagaactgttacacgtcgattagaattattactgccgtg

SEQ ID NO: 14278 - DNA, 1979 bp, Triticum aestivum
  unsure (1)..(1979): unsure at all n locations
  Clone ID: PAT_TA_14278
cccacgcgtccgctggaaagacgttagcctttggtatacccatgatcaagcaaataatcgagcaggacgaagggcgcacccctgggcgaggtcgtattcctcgagctttggtccttgcacccactagagaactggctaaacaagttgagaaggaaattatggaatcagcaccaaagcttagtacagtgtgtgtttatggggatgtctcgtataatacccagcagaatgcactctcccgtggtgttgatgttgtcgtaggaactccaggtcgcctaattgatttgataaacggtggaagtcttcagttgggagaagttaggtatctggtccttgacgaggctgaccagatgcttgcagttgggtttgaagaagatgtggaaacattattgcagcagctgccagctgaacgacaaagcatgcttttctctgcgaccatgccgtcctgggtgaagaaattgtctaggcggtatttgaataatcctttgacaattgatttggtcggcgatcaagatgaagaactagctgaaggaatcaaactctttgctattccactcacaacgacttcaaagcgcaccattcttagcgatctcattacggtatatgcaaagggtgggaaaactattgttttcactcggacaaaacgggatgcagacgaggtatcattggcattgacaaccagtattgcatctgaggcgcttcacggtgatatttcacaacatcagcgtgagaggacattaaatggtttccgccaagggaaatttactgttcttgtggcaactgatgttgcttctcgtggtcttgatatacccaatgtcgatttgattattcattatgagttgccaaatgaccctgagacttttgttcatcgttctgggcgcactggacgagcggggaaagcaggaaatgcaatctgtgggtttacaaccaaccagcgaaggacagttaaatcactcgaacgtgatgttggatgcaaatttgagtttattggcccacctacaatggaagaagtccttgattcatctgcagagcatgtcattgctactctgcgaggtgtgcaccccgagtcgattcaatactttgttccagcggctgagagactaagccaagaactaggacctactgctcttgcttctgcattggcacatctgagtggattttctcagccaccttcttcacgctccctgattagccatgagcagggagcggtgacattacaacttaccagggatccagcatatgcaagaggcttcttttctcctagatctgtcactggttttctgtctgatgtctctccatctgctgctgatgcagttggaaaaatatacctaatagcagatgagagggtccaaggagcagtgtttgatttacccgaggagattgcaaaggatctgcttactatggaactgcccgaaggaaacaccttgagcaaagtaacaaagctgccggtgttgcaagatgatggccccgctaccgactcttacggccgattctcaaactcggaccggggttctaggaaccggcgggggtcgtccaggggcggtatgggcggcggctcaagaggccgtggtagttgggactctgatgaaggattccgtcgcggtggcaggagctccagcagacctgacaacgatatttggtcagatgatgacttttcaggtggtggtgcaaggagatcaaaccgttcgtcatcccccggcggtggtcgctcgtcctatggtgggcgtggtggctcatcatccttgggtgacagatcatcgtcctttggtgaacgctcatcgtcatatggtggtcgtggtggctcatcctttggcagcagggacagaagcttcagtggcgcttgcttcacatgcgggcagtcagggcacagggcatcaggctgcccaaacaagtagggtccaactgtatttttgaagtggcatgtgctcatncttgattcttttccacacatgatgttcttttcactaagtagatgcgagttt

SEQ ID NO: 14279 - DNA, 731 bp, Triticum aestivum
  Clone ID: PAT_TA_14279
agctccagcagacctgacaacgatatttggtcagatgatgacttttcaggtggtggtgcaaggagatcaaaccgttcgtcatcccccggcggtggtcgctcgtcctatggtgggcgtggtggctcatcatccttgggtgacagatcatcgtcctttggtgaacgctcatcgtcatatggtggtcgtggtggctcatcctttggcagcagggacagaagcttcagtggcgcttgcttcacatgcgggcagtcagggcacagagcatcagactgcccaaacaagtagacggcgcagaggacgcgctgtttgcctgccgcactgcttcgttcgggcccgatcagtttcggacaagcggctggacagttgaacacaactccaaggacatcgccggcgtacctgatctacgcgtatgcccaacggcggatggcgcgctaggtactacaacagttttgtgtggtcatggtttcacctggaggaagatttttggcacgctgctgacccgccgatggagagcctggccttctgctaaattattcgtgtaatatctaggggttttacaggaacatacgcttgttttaatttcttttggtttgccgcttgtcggagttggtgatagaatgtattgtaaagttctacagaaccaagaaagcattcagaactgttacacgtcgattagaattattactgccgtgaaatgcggagatgtcaaacaactctgaagcttttggttg

SEQ ID NO: 14280 - DNA, 768 bp, Triticum aestivum
  unsure (1)..(768): unsure at all n locations
  Clone ID: PAT_TA_14280
gttttccgcgcctgctccagcaggggggcgcggttgagctcgcctctgcctggtggtgcaaggagatcaaacccgttcgtcatcccccgggcggcggccactcgtcctatggtgggcgtggaggctcatcatccttcggtgacagatcctcctcctttggtgaacgctcatcgtcatacggtggtcgtggtggctcttcctttggaagcagggacagaagcttcagtggcgcatgcttcacatgtgggcaatcagggcacagagcatcagactgcccaaacaagtagatggtccagacgacgtgctgcttgcctgccgcactgctccgttcgggcctcatcagctttcgacaagcggctggacaaagttgaacacaatggcaaggaacatcgaaggtcggcctcccttggcgcgttgatctgatctgcatatgcccgatgaacggctggcgtgctagatactacagttttttgtgtgtgtcgtttcaccggggagatgatttttggcacgctgctgaccccgccgatggagagcctggccttccgctaagttatccgtgtaatatctaggggttctacagagacatacgcttgttttaatttttttggtttgccgcggcttgttttaatttttttggtttgccgcttgtcggagtcggtgatagagtgttaacaacagctactacatgggccttgtaaagttctacagaaccaagaaagcattcagaactgttacacgtcaaaaagaaatactgctgtgggggggggn

SEQ ID NO: 14281 - DNA, 1021 bp, Triticum aestivum
  unsure (1)..(1021): unsure at all n locations
  Clone ID: PAT_TA_14281
ggcaggtgagtgcgagagactgtgagggtgagcctgagcacgagccaaagacagagccggaacgccggacgatgggcccccgatactccaagccgttgacccagctacccttgagatgattactaaaaactttgaagattatcctgagcaccgcctcaagtttttctctttacttcgtgctatcggcacccattgcttcaaagctttaattcagctttccagccagcaattgaagcttgtgattgattcgatcaactgggcatttagacatacagagagaaacattgccgagactggtcttagtcttttattggaaattctgaagaattttcaggcttcagaattcacgaatcagttctacaaaacatattttttgactatagagcaggagatttttgcagttctcacagattcatttcataagcctggcttcaaacttcatgttttggtgctacaacacttgttttgtgtggttgatggcctaactgaacctctatgggatgcatccacggcatcatatccatctaatgccatgtttgtacgggactacacaatcaaacttcttggagcatcatttcctaacatgacggcagctgaggtgaccaagtttgttgatgggcttcttggttcgagacatgacctcccaagcttcaaaaaccatattagggacttcctggtgcaatcaaaggagttctcagcccaggataacaaggatctgtatgcggaagaggctgcggtacaaagagaaaaggaaaggcaacggatgcttgccatcccagggctgattgccccaagcgaattgcaagatgagaggtagactcatagtgctctgtgattgtgcaccgcattgctaatcatttgatggcgataagctccagaggcctcaatgtgccggagcctgagttttctaggtggtggtggtggtaaaggagggtgcccgcgtaattttattcggttgcatcagattggctgcattatatagggaaatttnccagagtgctcgtancttcgctgttgtgta

SEQ ID NO: 14282 - DNA, 459 bp, Triticum aestivum
  Clone ID: PAT_TA_14282
gcaaaccccccttaaaaacatttgtttttgagttttacattttgaaccccaaaaattggcaacaaccccttcaaacaaaaaaaacttttcatccatttacaaaataagctttccacacccccatgcctgcccattattatggccattttttctcggggggtacagcttaccgaggctttgctacaatttaaaaaggacgggctcggcatcagcaaccttttaaaaggagggggcggggttatttcccgattagcatttaatccaccgagggcagcatttcacactgggcaccaaaaagccccccataatttttaaaaacaagcgatctcaccttatcccggccccaaaaccagtccttatacctttaccaccggaagaaaccttcatccaacattatccggtggcatgcaaaacattgtctgctttggcagggggggaacccccccacccgggaagctc

SEQ ID NO: 14283 - DNA, 1881 bp, Triticum aestivum
  unsure (1)..(1881): unsure at all n locations
  Clone ID: PAT_TA_14283
ggcgcctcgcgctctcgcgcattcggctgcatcaacctctcttgcccccggtggtcagccgccggtctcccgcgccctcagcgaccaacagccgagctaggtctcccccgcggaggggggctcgaagctttattagatgtatcttggcgttctttgcttaatacaatcttgatatcgagtcctttctcagtgtgatattgacgttgaatacgtagtgacgcaaacatcgcaaatgcagtcgggaggtcatgcctgaggggagaagttgctagagaacttcgtggttgttgttcatgtgctatggctgtgtaaaggaggactaatggctgtttgaaacttacctctcacctttgtggagtctaaaaagacatataaactgtttcttcatgagcatatcaactatcatattattactaaatgttagccgaagcgtatattttctcgccttttgtggatgcacttcttacattgactgcggtaattccatttgagtttcctcatttcatgacccactcaagtagaatcgaatgcaatgggatgaaattaatgacggttgatgttcatatatttgcgcggatgacatcaaaacaaaggactgcccaaaaaatgatgattagtcggggtcgaaggatgtcttgagaaaccgtgctggttctactcttatgattgtgtctttccctcctgctatgagtggcagcagtggctgatttttctaatcgtcaagtagttaagagtagatatgctattctcggatggtcattcgatggcactgaaagttggttagcgttgcgaacagtggagctctacggacttatcgataaaaaatatcgattatcatgtatgtcattgctgcttgtcggcctagggccgggttcttcggtgacgttttccgtggtatatggaatggcactgatgtcgccatcaaagtatttctggagcaggatctgacgactgaaaacatggaagatttttgcaatgagatatacatcctgagccggctgcggcatccaaatgtaatattgttccttggggcatgcatggtacctccgcacctgtcaatggttactgaatatatggaaatgggatcactgtactatctcatccatatgagtggtcacaaaaagaaactcagctggcgcaggaggctgaaaattattcgtgatatatgcaggggattgatgtgcatacaccgcatgaagatagttcacagggacctgaaaagtgccaactgtctggtgaacaagtattggactgtcaagatatgtgactttggcctttctcgagcgataacagatagtcctatgactgataactcctctgctggcacaccagaatggatggcccctgagctcataaggaacggacccttctcagaaaaatgtgacattttcagccttggtgtgataatgtgggagctgtgcacattgagccgcccatgggatgggatcggcccagttaaagtggtgtatgcagttactgaagggtcgctgcttgaaattccggaagggcctcttggcaagttaattgcagattgctgggcagagccccaggatcggccgagctgccaggagatcctcgctcgcttgctggactgcgagtacgctgatagctgagacgaacctggcgaatgctttacaacagacctcccagtgccttgagaggtggaaccgtttctctgtataaaacttgtaaaaatctagcctgttggtcctgcagaccggcagggatacatatattgaactcttgtatttcggctgtatatcggcgaccctttctttcaaatttcttaaggaaaattctctccttttatagaagaatgtcgcagggcaaagctagcgtgtcctcggataaaaaaaaaaaannnnnnnnnnnnnnnnnnnn

SEQ ID NO: 14284 - DNA, 809 bp, Triticum aestivum
  Clone ID: PAT_TA_14284
aacaccacataatcaatataaatatctccggatatcaaccgtcacatgcatacatcaaatgcaaaacatcaccaaccatatcatttttgtcaaaaaaaatagtgtagctagctagagtttgctacagctaaccaattgaacatctcaactagcatgtacagtacataattgttataggccaagccaagtattagttggagtttgcaacatcactgaacatcagcatcatgttaaccatactacttagtgcacaagttccagtccgattgaaaaaggccccaaacacccgttcaagacctgcagcaggctccatcttcttctcttcaacaggttgttgcccgcttggctcgattgcagctgggacttcggatggcaatccatgttttcttcttgtcaatggtagaggcatgggggtggaaccgggcatgtaaggaatcatggatgcagatcctcggttggcgaaggggggaagaaacggcggtcgggattccctggctcatcccgcggggggggacgacggatccggtgcacgcggacctcaccaagtgcttgtcgtcgcgatttgggtctttctctcctgtcactaactcacggcggggaggggtggcggcacgcttgcggcggaggtacatgacgtggaagacgagggaaagcggctgctgatgaggggcgctgagagcatagacacagtctgcaccagctccgcggccatctacttgctgcagatcggcatcaaatcgggctggcggctttcggagagaactggatctggggagaagggatggagacctagcggcggctcgttttgg

SEQ ID NO: 14285 - DNA, 797 bp, Triticum aestivum
  unsure (1)..(797): unsure at all n locations
  Clone ID: PAT_TA_14285
tcggcacgagggcaatcctaccgctaagaccttcctaaggatgttcatcaaatctggccaagaagagaagaagtatcctagcctgttgctggagttcatgggcagctatctcaccgagctgagccttttggattatggctgtgtccggttcttgccatcagccgctgcagcttcagcggtgttcgttgcacggctgacccttaatccagactccaacccttggagcaagaagttgcaatcagtaaccgggtacagggcatccgagctgaaggactgcatcacggccatacatgacctgcagctcagcaggaaagggcaatcgtggaatgcaatccgggacaaatacaagcagcacaggttcaagggtgtatctgcattgctacctcctgtcgggatccctgcatcatactttgaagacctcaaggagtnaggtgttccttggtgctgctgcagtgagatcaaatcaacaccctctgaggtttcctcgagcgtcgtacatgatgagtgaagttcaggagtggcttcgtcagtccagctagggtagtcgcagatccttaggtgctggcaatgtcaaacctcagctaggcgctttcggagttaaattattacaaattagcctggcaggaggcgaggcaagtggagacctgtacctgtgtatcatacctatacattacactctgatgccgtttttctttcttaaaaacaacagtctaatgcctttatttattgggcctgcccaatcaaaaaaaatttccttagctgtctttactgtaagtactatatgtaatggggggggc

SEQ ID NO: 14286 - DNA, 945 bp, Triticum aestivum
  Clone ID: PAT_TA_14286
aaccataaccaaaaaatttgttaaataaaaaaggacaacaacagagttcccaacaaatcaatatggggttttcgtcaaaaaaaaataatactgtatattggcaaatttgaaaattttaccgattataaagtgctgtcgtgttgatgagttcatccatcaaaaaaaaacctttggcaggttgaaacaaacagagcattgcacgcctacaatgcatgactactcctagctagtgtacaagcaagcattttcatggatgcctttttggatcccgagagagggaaaacaacacaagcctgcaaagaaagaagatagatagctccattaccaaaatactagtagtcctgatactgactactccagtctggacttgtcggaagaaccatctgacgacacttctactgaatcaaatctgcaaaggaagatttgtgtaaacatagggtctagggaataagagtgcagaatattgagaaatgaaaatagaaacttatgaagacggttcttcaaaatacaaatggtaaacaaacaaaaagtagtgcacactcaacaggcttccagagaatcgttttaagatgatcaatctcaaacatcaagggatctaaacgatcaaacgaggaacttggtaatccaatggacatacctcctactgaccttttacgtccacatgaactttgatcctgttaagcagcagacataacatccaaaaaacattaaaaaaagaaaataaattattacagtttaataataaaaaaagaagcagaacgattgtaatttaaacagccatgaaatttcaataacggacattgacaagtaaaaataaactcaattcctgacgagtaaaataaacggaatgccttttcttttagaagggacaaaataaactaaacttccaatcaatattcttccaagggtctctccaacattttttataaagaaaaagcctcgaac

SEQ ID NO: 14287 - DNA, 714 bp, Triticum aestivum
  unsure (1)..(714): unsure at all n locations
  Clone ID: PAT_TA_14287
cccacctgacgtccgcccgtcccctcagccagtctttttcctcagccagtcgacctccgccacctcccccgcgtcttccagaagcttccagaactcgaagaaaccttttggcggtggtcactgagaaggagggttgggaagggcaccgcagggatctccacggcagaggccatggcgagccggcagtgctgagatcacggtggagcggaggggagtgtccagtcccacgcgtggcgcgcgggatccgggggaaaggaggggaccgaggtcctgatgcagatccgggatggcctgcggcggcaagcgccatcggtcactggggcgatgcggtcgccgatgtcggcgatgatgctcgccatgttcgccaccatggcatccttctacgtcgctggccgattgtggcaggatgcacagaatcgggtttacatgataaaagagctcgacaggcgaactggccaggggcgatcggcaatatcagtggacgatactttgaaggttgttccatgcagggcaagcaaggcaaccggttggcatcacttcagatggagttggctgcagccaagcatgaaggatttgttggcaaatatacccctgggacaaatccgactctctctaggaaccacccgcgggttgggattgggctactggcgagctttggccggtaacnntnggaatcanggtcccacagtnacngtgaacaactnanatncaaag

SEQ ID NO: 14288 - DNA, 693 bp, Triticum aestivum
  Clone ID: PAT_TA_14288
ggttcacggccttcaagtggacatacattgtggagaacctgaccagctccaccatgagcgtcaggcttgtgccggtggtgggacggccgattctctgcgggctcgagaattacgcaatggtgccccttgagacaaggacggtgccacatcaagcggctgcgatgaaggccctgaaggattcactgaaaattccagcaaggatggggtggaacggggatccatgcgcgccgaggacgtgggatgcatgggagggagttacttgccatcccggtaacaaagggcttgtgatcactcagctggatcttgcaagtcaaggactgaaaggcttcattgctgatgaaataagttatctgacagacttggtaagcttgaacttgagctctaattccttgaccggaagcttgccaccaggtttaggccaaccttcacttgcgacactggatctgtcctcgaaccagtttactgggagtattcctggcaccataggctcgtctaaattacagactgttctactaaacggcaatcaacttgatgggcaagttccagaaagactttattcagttggcgtgcatggtggcgtgatagatctgtcaggtaataaaggcctatgtggggtgcctaccctacctgcgtgtgcattattctgggagaaaggaggcttgaataaaaccggcaaaattgcacttggagcct

SEQ ID NO: 14289 - DNA, 503 bp, Triticum aestivum
  Clone ID: PAT_TA_14289
cgtccggccagagtgaagtgggcactgagcagtgagcacagggcgggtgcttgcttgcttgccgaagcagagcgaggaaggagcaatgggggtccggtcggcggccacgaagctgcacatcccccccgcccactccgccgcccggcgctccttcttcctgccgctcgccgccgtcgccctcctctgctccgcctcctacctcctgggcgcctggcaccacggcggcggcttctccccttcctccccctcccgctccgtcaccattgccaccgacatcttctgcaccaccaccaccctcaccccctccaccaccaccaccaccaccaccaccgctcagtccctcgacttctccgcgcaccacgcggcggcggtcgacgccgtggcggccagggccgcgtcctccgcgttctcggcgccgcggaggtcccggcgtgcccggccgagtactcggagtacacgccgtgcgaggacgtgaagcggtccgctgcggtacccgcgggacc

SEQ ID NO: 14290 - DNA, 906 bp, Triticum aestivum
  unsure (1)..(906): unsure at all n locations
  Clone ID: PAT_TA_14290
cgtccgaacggccgaagctgcccactccggcaagcaaccggccgtggcctccggcgtccgatcgccatcccttcccttcaaagccactgcttcctcgccgtggcggcttcgcctacttaagcgcgcgcctccgctgctcgtacactcactcgcctccatcttcctcagccgctcgctgctggctgtggcgttcatgacacacggactacattagcgttctttacaagatgaagcgtatgggttccaaacaagtgctcgttcctaccgtctcatgcttgctgctcctattctgccttggatgcaaatgcctagcattggaattagaggcgacacagacggccaccctcaaggttgatgcctcgcgacagcgtgcccgaaagatcccggacacactgtttgggatgttttttgaggagattaaccatgcaggagccggtggcatatgggcagaacttgttagtaatagaggttttgaagctgggggactccatacaccatcaaatattgacccatggtctataattggaaatgactcttccatatttgtggcgactgaccgtacatcatgtttcagtcgaaacattatcgctcttaggatggaggttctctgtgatgaatgcccagccggcgttggcatttacaaccctgggttctggggcatgaacatagaagatggaaagacctacaatctagttatgtatgttaaatcagcagaagctgcagatntgacagtttcattagcaagctctgatgggttgcagaagctcgcttcagttactgtaccagttgctggcacttccaactggacaaaagtagagcaaaaactgattgctaaagggacaaacagggacctcaagactttgagataacatctaacaagaaagggagttgtatgggttttgatca

SEQ ID NO: 14291 - DNA, 2117 bp, Triticum aestivum
  Clone ID: PAT_TA_14291
gaatgcgatccccgccgagggcgaaattggaaacgacccagccgtccccccccgagcttgaagcgtatgcgttccattacaaacgccagctcgtgcccctactacgctccgcttattgcttcgcttccgcgcgatgtgcgaatgttcagtgtcagcatgtgtcatcccccaacaggcaggccctggtgttcatgcctcccagcacctttctccaacaattgccaatccttcgagatgaatcttctttgtgtaaagcaacagatcaggcgttcgggttccatgggcctaacgtttttctaatactggtgcttatcccggataaccgccctggcggccaaataggcagttacaaccttgggttctggggaatgaacatagcggatgggagtacccacaatcacgttatgcatgccaaatcaccagaaatgagattctatgacagtttcactaacaagctctgacggattaccagttctggcttcaggcgccatacgagcacactcccgggtttattggatgatgttagacaataagacggttctatatggacctggcagcacctcaaaacatcgaatacttgtctagaaatataggggattgttgcttgatcaatttttactttggaaacccagtcactgttaagggtgacagttctcgcgttatgcacacatacatggttgctgaataaaaacccaatctggttactttgccttgaacataaaatgttgaaggtcctacagtctcattagcaatctctgatcggtagcagaagctcccttcagttactgtaccagttgctggcacttccaactggcacaaaagtagagcaaaaactgattgctaaagggacaaacatggacctcaagacttgagataacatctcacaagctgggtattcaacaatggaatcatccacaatgacgaaggtcgtcccactgctattgcccctttggttatcgctctattggacagtctagaattcgcaagggggagtgcaaactcaacatggggctctgttagagctgcaatggggcatcctgaaccgttcccagtcaaatatgttgcgattggaaatgaagattgtgggaaaaaatactacctcggtaattacctcaagttctacaatgctataagagaatcctatccagacattcagatgatttcaaactgtgatggttcatctaaaccacttgaccatcctgctgatctgtatgacttccatgtctacaccgattctaagactttgtttaacatgaagggtacgtttgataaaacttctcgtactggtcccaaggcctttgtcagtgagtatgccgtatggagaactgatgcaggtagaggaagccttcttggttcactagcagaggctgccttccttactggactggagaagaacagtgatattgttcagatggcaagttatgcaccactctttgtaaacgacaacgatcaaacgtggaatccagatgctatcgtcttcaactcctggcaacaatacggaactcctagttactggatgcagaagtttttccgcgaatctagtggtgcgatgattcatccaattacaatcagttccagctactctggttctctagcagcatctgctatcacctggcaggattccgggaatagcttcctgaaagtaaagattgtgaactttgggtcagacaccgtgagcctcacgatctctgtgtctgggcttcaggctagcatcaacgcgctggggtcaaatgctactgttctcacgtccagcaatgtgaaggatgaaaattctttcagtaacccgaacaaggtcgtgcctgtgacgagccagctgcgcaacgccgcggaacagatgcaggtcacactcgctgcccactccttctcctcgttcgaccttgcgcttgctcagtccgagcttgtcgcggagatgtgaagcagctacacgacgctagcgacacgtggaaacacgataaatacacgaggcgtgatatggaaaatgcaggacgttgtcagtaattatgcttatatcttgataaagcactcactgtacagtgtaacaaagaggagatactcatacatacagcagtactaaataaagtccatatcaggctgatttgcagttaaaaaaaaaaggg

SEQ ID NO: 14292 - DNA, 1448 bp, Triticum aestivum
  Clone ID: PAT_TA_14292
cccggtcgacccagcgtccgcactccttccagccagccagccacctttcctttgctttggtttttttctatccgattgatcgatcgaccgccgaaaagagctttttctctagcgctccgcctcaccgcggcatctcccctctaaaagcaccggacgccgaccgcagccacgtaccggagcacccaccagactcctcctccgcaactcagctcagctccctcccccactctccccgcagcgagcgagcgagcgagcgatcggcgatgaagaagtgcgcgtcggagctggagctggaggccttcatccgcgggcgggggctcgccgccgagcagaagcccggcagcgccgccgcgggcgcgaatggtccctacggcctcttctccgccgccgacctctccagcgccttcggcttcgccgactcggccctcaatggaaccattcagaatcacctgtggcctcagtccccgaacctcggcgcacggcatcccgcagtctccacgacaatcgagtcgcagtcgtcattctatgcagcagcgagtcccacgtcggccaccaatctgagtatcaaagagagccaagcattcggaggcacgagcggctcggactccgacagcgagtcgatgttcgacgacggtggcttgtgcgacaacggcacgaacccaacggacgttaagaggatgagacggatggtgtcgaaccgggagtcggcgcggcggtcgaggaagaggaagcaagctcacttggttgagctggagacgcaggtggatcagctccggggtgacaacgcgtcgatcttcaagcagctgacggacgcgaaccagcagttcacgacggcggtgacggacaaccggatcctcaagtcggacgtggaggcgctgcgggtgaaggtgaagctggcggaggacatggtggcgcgcggcgcgatgtcgtgcgggctgggccacctggggctgtccccggcggcgctgaacccgtgccgcgtcccggacgtgctggccggtctggacttcctccccggcggcgccgacgacgcctgcttcgggagcctgtccccggccgagcaggtgcagagctcgccgatgcagagcatggccagcctcgagagcctcgagcacagcagccggatgcagcacggcggcggcgccgacgccgtcgacgtctggggctgggactccagctccaacggcgccatgtccaagtgaagccatgcacgttcctccctgtctgcgtacctacctatgtcgaagtgtttgagctgatgaaaactcttgatggacttgagtttttcagagtcctctcgtgtcgcgtcagtcggtaataactctgcgtcttcggggtgcctagtagctatgtaatggaactttctacccagagtacatgtaatggtacgtaagaccatgtcagttaactgtgatctgtcagtcagtggtaagcttcatttacagatt

SEQ ID NO: 14293 - DNA, 660 bp, Triticum aestivum
  Clone ID: PAT_TA_14293
attcggcacgaggaggaggccaagaagaagcgggaggaggagttcgacgccttcacgtccaccaaggcgcaggaccttgcgcagccgctcgtcggcgcgcagatcccctttaagatccacatcgtcaaagaccacgacatgaaggagcgcctctgcctcgaggccgagcgcctcggcctgtccgccatgatcatgggcagccggggaattcggtgcctcgcgcagggcccgggaaagggaggctcgggagcgtcagtgactactgcgtgcaccactgcgtctgccccgttgtggttgttcgctacccagatgatgccttcggggatgagctgcgaacagtgcctgaaaatgagcctgtgtatcatgaggcgccggaggcgcagaaagaaaaatgaggcaagtgcaggggcggctaggcggcgagagggagcaagcagaggccttctttacgttatgtcagccagccctagtgtaacacgagtgccctcttccgtggccactcggctctgcaactctgcgttgcgtttgtaccagaatctgtagatcatggacgagtccccgctgttttgcttcatgacgtgtcatgtgtgttggtaaaacgaagacaaatgtttctgcgtacatgggccttgttttgcttgtactggcgttcctgcttgg

SEQ ID NO: 14294 - DNA, 207 bp, Triticum aestivum
  Clone ID: PAT_TA_14294
gaattcggcacgaggagaaactagtctcgagtcacacacacacacacacacacacacacactcttgacgccctaccgatcacagatgatacatgaacacatggtttatttctgagccatacgtgggcaccacaccgaccattccggctctcgagggctgcgcgttggtgcatgcaacagaggggcctctccaacaaccgccgctccc

SEQ ID NO: 14295 - DNA, 308 bp, Triticum aestivum
  Clone ID: PAT_TA_14295
gtcacgcagctcagttgccttctcccctctctcgattcctccatttcaaaccaaaacccccaatcagcatcaccccacctcaccttggttcgatccgccacagccaccgagaaatcccggaataagctcggaagcagagccgcttctgttattaagaataaataaagaggatcggtgcctggctgcactggccgggcacccggatctgtaagataagataatgtgtacgtacgtattgtattcctgaacttgtactgtgacgagcgagactcgctttgtaacgtgctattctgttgctaaaaaaaaaa

SEQ ID NO: 14296 - DNA, 799 bp, Triticum aestivum
  unsure (1)..(799): unsure at all n locations
  Clone ID: PAT_TA_14296
aggttgctgactgcaccaccaaggaatacgcagagaacacgtttgatgtgatctacagccgtgacaccatcctccacattcaagacaaacctgctctgttcagaaacttcttcaagtggctcaagcctgggggcaaagtgctgatcagtgactactgcaggagccctgggacaccatcagaggaatttgctgcgtacatcaagcagagaggctatgacctccatgatgtgaagacctatggaaagatgcttgaggatgccggtttccacgatgtcgtcgccgaagaccgcaccgaccagttcctgagggtcctggagagggagctgggcgagaccgagaagaacaaggaggccttcctggcggacttcacccaggaggactacgacgacatcgtcaacggctggagcgcgaagctgaagcggagctccgccggcgagcagaagtgggggcttttcatcgcgaccaagtgatctggccgccgagcagcgacgccgtggacgcgatgatccggaagcagagcggcttctgtcgttaagaataaataaagaggatcggtgctcgaccgtgctgtggccgtgtgttgggtgtgattgtttgtttgttgcagtggctgggcaccatgatccgtaagataatgtgtacgtacgtacgtactgtattcctgaacttgtactgtgacgagcgagactcgctttgtaacgtgctattctgttgctacgtggccttcttcactgtggtggagttgtgtgaccaaaaagggggggccccggtacccattcgccctatagtgnctcgtata

SEQ ID NO: 14297 - DNA, 752 bp, Triticum aestivum
  Clone ID: PAT_TA_14297
ctatcaacatggtttcgttcgcaattgagcgtgccatcgggcgctcgtgctccgttgagtttgaggttgctgactgcaccaccaaggaatacgcagagaacacgtttgatgtcatctacagccgtgacaccatcctccacattcaagacaaacctgctctgttcagaaacttcttcaagtggctcaagcctgggggcaaagtgctgatcagtgactactgcaggagccctgggacaccatcagaggaattcgctgcgtacatcaagcagagaggctatgacctccatgatgtgaagacctacggaaagatgcttgaggatgccggtttccacgatgtcgtcgccgaagaccgcaccgaccagttcctgagggtcctggagagggagctgggcgagaccgagaagaacaaggaggccttcctggcggacttcacccaggaggactacgacgacatcgtcaacggctggagcgcgaagctgaagcggagctccgccggcgagcagaaatgggggctgttcatcgcgaccaagtgatctggccgccgagcagtgacgccatggacgcgatgatccggaagcagagcagcttctgttattaagaataaataaagaggatcggtgcctggctgcactggccgggcacccggatctgtaagataagataatgtgtacgtacgtattgtattcctgaacttgtactgtgacgagcgagactcgctttgtaacgtgctattctgttgctacgtggccttg

SEQ ID NO: 14298 - DNA, 1147 bp, Triticum aestivum
  unsure (1)..(1147): unsure at all n locations
  Clone ID: PAT_TA_14298
agtaggagtattcatgttcagcgatcatagcacatactgtacaggagcaagtcctctaactaggccaatcacggcataggtattcggtggtacagtagcttttatttttgttggtcgagcggaagaggctgccattttattacatcaaagaccattgctgcataaggtttgcctcttcaacaactcccgggcgtggggcctgctgatctttagtggagttccttgaggaagtccgcatgatccaccagaaccactttccagccatcggggtcaaggaaagaggtgatcttcgtgttcagccccggtagtggcccaggctgccgtagaatctttccacctagttctttggtaaccagctcaactgcttcagcactcttgtacacatcgtcagtgccaatagcaacctgagcatatgcattgcccttgttatattctgtgacaccatagttgtatgtcaactccagaacagtggtcttatcctcctcggcatagcccatcatggcaattgtgtacttgtactgaggcacatcttttttcctcagaagcttcatcccaagggccttctcgtagaacatgatagaccgatcaaggtcaccaaacacgaagcaaacttgacagagaggctcaggcgtcggacccatcctgataagctcgaacatgtaaccatctgggtcttgtgcaaaggcaatcacagtggaccctcccttgacaggaccaggttcacgagtgatcttacaacaagaagatgatttaattgtctcagccagcttgtacacatccatnatttgcgatggcaaaatgtccaaagcccgctccaatgtcatacttgtcaacacctatacttgtaagtcagctcaagtgcaaaattagtgtcctcaggtccaaacccaagaaacgcattggtgtacttctcttcaggaacatctcttttcctcaacagcttcatcccaaagcattctgtgtaacacttaatggtacggtccagatctcccacacggtaaacagcatgcagcatcctctttttgtcctgcttaggccactccagcacgacctccgcgggctttccagcttcgctaccggttgccatccctgttgtcacttgtcagagctcggaaattcgatccggcagataatcggcttattcggt

SEQ ID NO: 14299 - DNA, 634 bp, Triticum aestivum
  Clone ID: PAT_TA_14299
gctggatgtggctacagaggtctttgcgaggaaacagggtcagaaacaggttctgaaactgagatcaccggtcaaaacgccttctacacagagaagggcaagttctccaaccaagaaggtactgctgttaggcgataagaaaaccaactcaggtacaaagggaaaaaccacagcgcaaaagaagagggcatctagcaacactgatgacgacgaggacgacgactttgtcgaaaccaactcaagccacaaagggaaaaaccacagcacaaaagagaaagaaggcatctagcgacacagatgacgacgacgatgatgactttgtcatgcctaagaagcccaagaagcaaaagatctctagctaagtatccgatccttaaacaaggcatgtgtcctttgtgttaccattgactttgtactagatcagtataaccttaggaaacggtgagacttttccttattccgtgcactgacgctgtgatgcgtatgaacttctggaacaaaactattgaggtgtgaagcggtgcgatgactccatgtcttccagtgcttgcgtagattcatgttatccatcgtgaaccttacgaaactattgacatgtcttgcagtacttgcgtaaaaaaaaaaaaaaaaaaaa

SEQ ID NO: 14300 - DNA, 1234 bp, Triticum aestivum
  unsure (1)..(1234): unsure at all n locations
  Clone ID: PAT_TA_14300
ccttctcccctctctcgattcctccatttcaaaccaaaacccccaatcagcatcaccccacctcaccttggttcgatccgccacagccancgagaaatcccggaataagctcggcgtgaagggtcagcgcataaaccctagcctagccagctccccatggcggccaactcctcctccccgtcggccggcggcgacgcgccggccccggcgctgccgccggtgcgcctcgcggcgggccaggcggccacgatccagccctcctccccgcgctacttcttctcctcgctcgccggcaaggacgcctcctcccatcgccgcatcgccatcgccgtcgacctctccgacgagtccgccttcgccgtgcggtgggccgtgcagaactacctgcgccccggcgacgccgttcgtgctcctccacgtgcgccccacctccgtcctctacggcgctgactggggctccatccccgtctccgtctccgacgacgacgcggacgacgccgccgtcgccgtcgccgccgagggctccgaccccgccgcctccgcggaggagctgcagaagaagcgggaggaggacttcgacgccttcacgtccaccaagtcgcaggacctggcgcagccgctcgttgccgcgcagatcccctttaagatccacgtcgtcaaggaccacgacatgaaggagcgcctctgcctcgaggccgagcgcctcggcctctccgccatgatcatgggcagccgcggcttcggcgcctcccgcagggcaggcaacggcaggctcgggagtgtcagcgactactgcgtgcaccactgcgtctgccccgtcgtgcttgtcaggtaccctgatgacgccggagcggctggcggtgccgagtctgcgggggatgagctgcggacggtgcctgagaacgaggtggtgttccacgaggcgccagagggtcagaaagaaaactgagggtcatagcaaaagcacagagcagccagatcaaagaggagagagcaagtcttgcttgatgccaaacccccttgtaactaagtggtctttccactctgctttgcactttgtgtttgtatcagactcgtgtagatcatggaccagtccttgctgcttcccttcctgagaattgaaatgagaataatgttattctgcatattgtagctgttaacctgttgtatgaatgtttctgcttggccccctggaacatgatttcgtatgccgactaaaaaaaaaaaaaaaaaa

SEQ ID NO: 14301 - DNA, 628 bp, Triticum aestivum
  Clone ID: PAT_TA_14301
cccacgcgtacgaccacgcgtacgccaccaagtcgcgaggacctggcgcagccgctcgtcgccgcgcagatccccttcaagatccacatcgtcaaggaccacgacatgaaggagcgcctctgcctcgaggccgagcgcctcggcctctccgccatgatcatgggcagccgcggcttcggcgcctctcgcagggcaggtaacggcaggctcgggagtgtcagcgactactgcgtgcaccactgcgtctgccccgtggtggttgtcaggtaccctgatgacgccggggctgcgggcggtgccgagtctgtgggggatgagctgcggacggtgcctgagaacgaggtggtgttccatgaggcgccagaggggcagaaagaaaactgaggaggtaatagcaagcaccaagcagccagattacaaggagagagagcaagtcttgcttgatgccaaacccctctgtaagctgtaactgagtggtctttccactctgctttgcaatttgagtttgtatcagacgtgtggtagatcatggaccagtccttgctgtttcgcttcctgagaattggaatgagaataatgtaattctgcatatggtagctgttaacctgttgtgtgaacgttttttgcc

SEQ ID NO: 14302 - DNA, 829 bp, Triticum aestivum
  unsure (1)..(829): unsure at all n locations
  Clone ID: PAT_TA_14302
ggcaaatccagtcccccctcccccaatcacacagctcagttgcaagcacaaagggcaacacgaccattccttcctcccagcctactctcgattcatccatttcaaaaccaaaacccccaatcagcatcaccccggatcaaatccaccaccgagaaattccggaataaacccgagagaacccggcgagaagggtcagcgcaaaaaccctagccagctagctccccatggcggccaactcctcctccccgtcggccggcggcgacgcgccggccccggcgctgccgccggtgcggctcgcggcggggcaggcggccacgatccagccctcctccccgcgctacttcttctcctcgctggccggcaaggacgcctcctcccaccgccgcatcgccatcgccgtcgacctctccgacgagtccgccttcgccgtgcggtgggccgtgcagaactacctgcgccccggcgacgccgtcgtgctcctccacgtccgccccacctccgtcctctacggcgccgactggggatccatccccgtctccgtctccgacgacgacgcggacgatgccgccgtcgccgccgccgccgagggctccgaccccgccgccgcctccgcggaggagctgcagaagaacgggangaggattnacgcttaactcaacaaatccaagactggcgaacgctgtcgcgcgcagtccttaagatcactctnaggacacacatgaaggacgctcncccangcgacgctggctgtcgcanatatggaacccgatncggctcccaggcgaaggagtcgatgtatatagntgaccnttcgccgttgtngcaacat

SEQ ID NO: 14303 - DNA, 1128 bp, Triticum aestivum
  Clone ID: PAT_TA_14303
ttcggcacgagcagccccaaatctcatctttggcaaaaccctcgtctcctctccccccattctctcctgagattcccctcatcagatcgagagctgcacagtagtgttccgcattcggatcgagcagccggaggaccaacaaccatcatggcgacgcaccacccggcctccccgaccggcgccggcgccggcggaaagtccccctcctcctcgccctcgccgccgccggccgtgcgcctggcggcgtcgcaggcggcggcggtggcggcgatccagcccagctcgccgcgctacttcttctcctccctcgccgcctcctcctcgccgcaccgccgcatcgccatcgccgtcgacctgtccgacgagtccgccttcgccgtcaagggggccgtgcaaaactacctgcgcccgggcgacgccgtcgtgctcctccacgtgcgccccacctccgtgctctacggcgccgactggggctccatccccgtcaccgtcgacgacggcgacgagaaggggggaggaggcgcggcgccggcgtccggggacccggaggaggacgcgcgcaagaagcgggaggaggacttcgacgccttcacctccaccaagtcgcaggacctggcgcagccgctcgtcgccgcgcagattcccttcaagatccacatcgtcaaggaccacgacatgaaggagcgcctctgcctcgaggccgagcgcctcggcctctccgccatgatcatgggcagccgcggcttcggcgcctcccgcagggcaggtaatggcaggctagggagtgtcagcgactactgcgtgcaccactgcgtctgccccgtggtggttgtcagataccctgatgacgccggagcgtcgggcggtgccgagtctgtgggggatgagctaaggacggtgcctgagaacgaggtggtgttccatgaggcaccagaggggcagaaagaaaactgagggtaatagcaaagcaccgagcagccagatgaaagaggagagaccaagtcttgcttgatgccaaacccccttgtaactgagtggtctttccactctgctttgcacttctgagtttgtatcagactcatgtagatcatggaccagtccttgctgtttcgcttcctgagaattgaa

SEQ ID NO: 14304 - DNA, 1255 bp, Triticum aestivum
  Clone ID: PAT_TA_14304
agaaagcgagcgcggcgagcgccaccaaggtcaagaaggaggaggacgacgatgataacattccgcttgcgcgtcgggccaaaaaagcgagcaatgggggtgcaaagaaggagaaaaaggaggagtacgaggaggaagaggaggagtacgaggaggaggaggaggaagacgacgacgacgaggattttgcagatgagtacactccggtttcgcggggaaagaagggaaatgagaaggagaaaagcacttccaatagcaaggtgaaggcttctaaagtaaagaaagaagaaaccggttctgatgatgaatgcaagccaaaatctcagaagagaagtccagctgcgggcaaacccaagatttccaagattaagaaaccaaaagatgaatatgatgatacaaaggaggaaaagaaaataaagaaggaagttggtatcaagaaagatgaaaagaaggctgctggggtgaagaaggagggggctgctggggtgaagaaggagaggaaggtgtatgaattgccagggcagaaacatgatcctcctcctgaaagggatccattgaggatattttatgaatcgctctatgagcaggtgcccgatagtgaaatggctgcattttggttgatggaatggggtttgctaccgctggatgtggctacagaggtctttgcgaagaaacagggtcagaaacaggttctgaaactgaggtcaccggtcaaagcgccttctacacagagaagggcaagttctccaaccaagaaggtactgctgttaggcgataagaaaaccaactcaggtacaaagggaaaaaccacagcacaaaagaagagggcatctagcgacacagatgacgacgaggacgacgactttgtcaaaaccaactcagccacaaagggaaaaaccacatcacaaaagaagaggaaggcatctagcgacacagatgacgacgacgacgatgactttgtcatgcctaagaagtccaagaagcaaaagatctctagctaagtatctgatccttaaacaaggcatgtgtccgttgtgttaccattgacattgtgctagatccgtataaccttaggaagcgatgagactttttcttcttctgtgcactgacgctgtgatgcgtatgaacttctggaacaaaactattgaggtgtgaagcgatgcaatgactacatgtcttccagtgcttgcgtagattcatgttatccatcgtgaaccttaggaagctattgacatgtcttgcagtaaaaaaaaaa

SEQ ID NO: 14305 - DNA, 967 bp, Triticum aestivum
  Clone ID: PAT_TA_14305
gccgcttctgcctcttccccatcggccgataggcgcaagcgccccagcgccgccgtccgaccgccggcgctggtgagggcgtccttcatccctcggtctgaatcctctgttgttattcctccttgtccaccagctcgggccctcggggtctctcccccattaccccccaaaaccgaccgcgaaaagccgaaaccctcgcctcaccaccaccgcagcaatggccggagaagacgccgcgctgcagaatccgcccaagaaggagaagtacgacgaagacgatgaagacgacgtgccgctggcgttctctcgaggcaagaagaaagcgagcgcggcgagcgccgccaaggtcaagaaggaggaggaagaggaggacgacgaggataacattccgctcgcgcgttctcgggccaaaaaaacgagcaatgggggtgcaaaggagaaaaaggaggagtacgaggaggaagaggaggagtacgaggaggaggaggaagacgacgacgacgacgaggattttgcaaatgagtacactccggtttcgcggggaaagaagggaaatgagaaggagaaaagcacttccaatagcaaggtgaaggcttctaaagtaaagaaagaagaaaccggttctgatgatgaatgcaagccaaaatctcagaagagaagtccagctgcgggcaaacccaagatttccaagattaagaaaccaaaagatgaatatgatacaaaggaggaaaagaaaataaagaaggaagttggtatcaagaaagatgaaaagaaggctgctggggtggagggggctattgtggtgaagaaggagagaaagttgtatgaattgccagggcagaaacatgatcctcctcctgaaagggatccattgaggatattttatgaatcgctctatgggcaggtgcccgatagtgaaatggctgcattttggttgatggaatggggtttgctaccgctggatgtg

SEQ ID NO: 14306 - DNA, 990 bp, Triticum aestivum
  unsure (1)..(990): unsure at all n locations
  Clone ID: PAT_TA_14306
ccacgcgtccggtccgagaaggcagtgcacgccgccgccgccccctcctcaatcccccggccccgccgcccaactccctccgcctctcacgcgcgtcgccgcccaccgcgcccctgctgtctccaccccgtccgcaatctctcgccactgggtttcgaggggaacatggcgaggctggtgtcgtcttccctcgtcagggggctcgtgcggtcgtgccgcgcgcccagcacggcgaccgtgtcacgaccagctttccaacagttcatgacctactcatcaggaatcagtggtgattctaacgtgaatgggggcacaagtgcaacacgagtaaccgctgatactgatacacatcaagatttccagcctacaagcaaaggttctgacatgtctttgcaagacatcgttgctcaggatatcaaggagaatccagtcattatcttcatgaagggttatcctgaagctcccaggtgtggatttagtgcactgggctgttaaggtcctccagcaatatggcgtctctatcactgccagagatattctgactaatatgaagctcaaggagagtgtcaaagcttactctaactggcctacctttccgcaaatatttatcaacggggagttcgttgggggctctgacatcatattaagcatgcaccagaaaggggaacttaagggtttacttggtgattccgcacaaaagggcgagcaagacagtgcccagtgaaacaagctacagtatgttagcttttgcatcgagatggatgcttcctctctgagtacactttaactcgaagctcttcatgtggtgttctgtcgttttggcgcgggattttcatcattgtgttgccagccatgatggaaatctctcggttccaagagcatccaagtttccgtttcatgacaaataaatgccacttttcaatactgttttttgtacgttgtaatagtcaggnattttgttggattctatatacttgggctccgtttgcg

SEQ ID NO: 14307 - DNA, 816 bp, Triticum aestivum
  Clone ID: PAT_TA_14307
ctagcccgtcccatcatcgccctgctgctgccgctgccagtgtcactcgccgccggccaccgtaggatcgagagagagggcagcatgagcgagcagggggcagggcagggtaccaaggagcagtcagtgccggccaccgtagggtcgagagagatcagcttgagcgggcagggggcagggcagggtagcaaggaggagagactggccgagctggaagagctcgagctccaaacggaccaccaaggggtgctggccatcctcccgtcgtacgcgggcaagacggtgctggagctcggcgccggcatcggccgcttcaccggcgagctggccaaggaggccggccacgtcatcgcgctcgacttcatcgacagcgtcatcaagaagaacgaggagatcaatggggacatctacaagaacatcaccttcatgtgcgccgacgtcacctcgccggagctcaagatcgaggacaactccgtcgacatcgtcttctccaactggctgctcatgtacctcaacgacgaggaggttgagaagctgattggcaggatagtgaagtggctgaagcccggtgggcatattttcatcagggaatcgtgcttccaccagtctggggattccaagaggaaagtgaacccgacgcactaccgggagccgaggttctacaccaaggtgtttaaggaatgccactcctatgaccaagaggggaattcctttgagctttctctggtaacttccaagtgcattggagcttatgtgaaaagcaagaagaaccagaaccagatatgttggctgtgggagaaggtcaagtgcacagaa

SEQ ID NO: 14308 - DNA, 724 bp, Triticum aestivum
  Clone ID: PAT_TA_14308
caaggaccacgacatgaaggagcgcctctgcctcgaggccgagcgccttggcctgtccgccatgatcatggggagccgcggattcggggcctcgcgcaagggcggcaaggggaggctcgggagtgttagtgattactgtgtgcatcactgtgtctgcccggttgtggttgtgcgctacccagatgatgctgcaggtgtccccggggaggcagcagcggcgacagatgagctgcacactgtgcctgaggatgagcccgtgtatcatgacgcgcctgatgcacacaaagagaactgaggcaatggcatccaaccggagcgcaaggaaaccatgaatgaggcttgtgtacctaggcgatccctgtgtacctgagcaaagcaactctgtatccagcatccgcttcacgagcatgcgcataccgtaatctggctttgccggcaggctttagcgccgtgctctcaggtggcgggggtctctgttggtttgcgtcgtgtgatgttttatgttgtcgactgcaagtagactgaactgttggtgtgtgcatgtgctgtatttttatgaacctctcttgttttgcaagtccaggcttaccggtgtaatatgtgtacctgttgtattcttccctagttttcagcattggatacttgggtaatggacgctgtctagttttctgcatgtacatgtctgtgttcaaataaatgcaaggttggcatgcttctttgtggc

SEQ ID NO: 14309 - DNA, 695 bp, Triticum aestivum
  Clone ID: PAT_TA_14309
gccgagcgccttggcctgtcagccatgatcatgggaagccgcggattcggggcctcgcgcaagggcggcaaagggaggctcgggagtgttagtgattactgtgtgcatcactgtgtctgcccggttgtggttgttcgctacccagatgacgctgcaggtatccccggggaggcagcagcagcaacagatgagctgcacaccgtgccggaggatgagcccgtgtatcatgatgcgcctgacgcacacaaagaaaactgaggcaatggcatccaatcggagcgcaaggagaccatgaggcttgtgtacctaggcgatccctgtgtacctgagcgaagcaactctgtatccagcatccactgcacgagcgcgcgcaaatcataaactggctttgccggcaggctttagagccgggctctcaggtggcgggggtctttgttggtttgcgtcgtgtgatgttttatgttgtcgactgcaagtagactgaactattgctgtgtgcatgcgctgtatttttatgaacctctcttgttttgcaagtccaggcttccggatgtaatatgtgtacctgttgtactcttcggtagttttctgcattggatacttgggtaatggacgctgtctaggtttctgtatgtacatgtttgtgtccaaataaatgcaatgttggcatgcttctttgtgacaaaaaaaaaaaa

SEQ ID NO: 14310 - DNA, 1369 bp, Triticum aestivum
  unsure (1)..(1369): unsure at all n locations
  Clone ID: PAT_TA_14310
cccctgccccgccgcccaactccctccgcctctcgcgcgcgtcgccgcccaccgcgcccctgccgtctcgaccccgtccgcaatctctctccactgggtttcgaggggaacatggcgaggctggtgtcgtcttccctcctcagggggctcgcgcggtcgtgccgcgcgcccagcacggcgaccgtgtcacgaccagctttccaacagttcatgaactactcatcaggaatcagtggtgattctaacgtgaatggcggcacaagtgcaacacgagtaaccgctgatactgatacacatcaagatttccagcctacaagcaaaggttctgacatgtctttgcaagacatcgttgctcaggatatcaaggagaatccagtcgttatcttcatgaagggttatcctgaagctcccaggtgtggatttagtgcactggcagttaaggtcctccagcaatatggcgtctctatcactgccagagatattctgagtaatatgaagctcaaggagagtgtcaaagcttactctaactggcctacctttccgcaaatatttatcaacggggagttcgttgggggctctgacatcatattaagcatgcaccagaaaggggaacttaaggatttacttggtgattccgcacaaaagggcgagcaagacagtgcccagtgaaacaagctacagtatgttagcatttgcatggaggtggatgcttcctctctgagtactcttttactcgacgctcttcctgtggtgttctgttgttatgacgcaggattttcatcatcgtgttgccagccatgatggaaatctctcggttccaagagcatccaagttttcgtttcatgacaaataaatgccactttttcaatactgttttttgtacgttgtaatagtcaggtgatttcgtttggattctatatattttgggccccgtttgcgttgcagtaataaatggttaggctgttacgtagttaaaaaacctgcccgggcggccgctcgacgcccgggcaggtgtttggggagggttatgttagcaccggtggattcgagaccacaaaggagtttgtggacaagctggacctgaaagctggccagaagtgctcgatgtagggtgtggtatcngaggangcgacttctacatggctgaaacctatgatgtcatgtcctccgcatcatcttctaacaacatggnttcgtcccaantgancgtgcatcgggcgctntgctcgttgagttnaggttccgacncaccacaaggataccanagaaactttgatgtcaccanagccttacacaacctcanatcaganaaactgcncgttaanaaanttttancgggtaaacctggggaaatgctgttatnacaacg

SEQ ID NO: 14311 - DNA, 1229 bp, Triticum aestivum
  Clone ID: PAT_TA_14311
agaaaaccattacctcaaaaaaaagacatagaaaaccacactccgactacgcaaacagatccatctcagtagtatccatgttcagcgatcatagcacatactgtacacagcaagtcccaagcactcttctctaactaggccaatcacggcatacgtattcggtgctacagtagcttttatttttgttggcggagcggtagaggctgccattttattacatcaaaaggccattgctgcataaggtttgcctcctcaacaacccctggccccggggcctgctgatcttcagtggagttccttgaggaagtccgcatgatccaccagaaccactttccagccatcggggtcaaggaaagaggtgatcttcgtgttcagccccggtagtggcccaggctgacgtaggatctttccacctagttctttggtaaccagctcaactgcttcagcactcttgtacacatcatcagtgccaatagcaacctgagcatatgcattgcccttgttatattctgtgacaccatagttgtatgtcaactccagaacagtggtcttatcctcctcagcatagcccatcatggcaatagtgtacttgtactgaggcacatccttcttcctcagaagcttcatcccaagggccttctcgtagaacatgatagaccgatcaaggtcaccaacacgaagcataacttgacagagaggctcaggcgtcggacccctctggataagctcgaacatgtaaccatctgggtctggtgcaaaagcaatcacagtggaccctcccttgacaggaccaggttcacgagtgatcttacaacatgaagatgatttaattgtctcagccagcttgtacacatcctcatgtgtgatggcaaaatgtccaaagcccgctccaatgtcatacttgtcgacaccataattgtaagtcagctcaagtgcaaaattagtatcctcaggcccatatccaagaaacgcattggtgtacttctcttcaggaacatctcttttcctcaacagcttcatcccaaagcattctgtgtaacacttaattgtgcggtcgagatctcccacacgggtaaacagcatgcagcatcctctttttgtcctgcttaggccattcaaacactgcctcagcagactttccagcttcgctaccggtagccatccctgctgtcaccctggaaatacgatcgggtagagattcgtcgcacgctgatgaggagcttcagtct

SEQ ID NO: 14312 - DNA, 1635 bp, Triticum aestivum
  Clone ID: PAT_TA_14312
gacccacgcgtccgattattaagtgagcgaggaattgattagtgccagtgtttgattttgttctgtttgtcatggtactataatagcaacatataatataagcaacacagctcagttgcaagcacaaggcgcaacacgaccattcccttccttccttccagcccactctctcgattcatccatttcaaaaccaaaacccccaatcagcatcaccccacctcaccccggatcaaatccaccaccgagagattccggaataaacccgagagagcccggcgagaagggtcagcgcaaaaaccctagccagctagctccccatggcggccaactcctcctccccgttggccggcggcgacgcgccggccccggcgctgccgccggtgcggctcgcggcggggcaggcggcgacgatccagccctcctccccgcgctacttcttctcctcgctcgccggcaaggacgcctcctcccaccgccgcatcgccatcgccgtcgacctctccgacgagtccgccttcgccgtgcggtgggccgtgcagaactacctgcggcccggcgacgccgtcgtgctcctccacgtgcgccccacctccgtcctctacgggcgccgactggggctccatccccgtctccgtctccgacgacgacgcggacgacgccgccgtcgccgccgccgccgagggctccgagccccacgccgcctcctccgcggaggagctgcagaagaagcgggaggaggacttcgacgccttcacctccaccaagtcgcaggacctggcgcagccgctcgtcgccgcgcagatcccctttaagatccacgtcgtcaaggaccacgacatgaaggagcgcctctgcctcgaggccgagcgccttggcctgtccgccatgatcatgggaagccgcggattcggggcctcgcgcaagggcggcaaggggaggctcgggagtgttagtgattactgtgtgcatcactgtgtctgcccggttgtggttgttcgctacccagatgacgctgcaggtatccccggggaggcagcagcagcaacagatgagctgcacaccgtgcctgaggatgagcccgtgtatcatgatgcgcctgacgcacacaaagagaactgaggcaatggcatccaaccggagcgcaaggaaaccatgaggcttgtgtacctaggcggtccctgcgtatctgagtgaagcaactctgtatccagcatccaccgcatgaccgtgcgcatatcatggacttgctttgccggcaggctttagggccgggctctcaagtggcgggggtctttgttggtttgtgtcgtgtgatgttttatgttgtcgactgcaagtagattgaactatttactgtgtgcatgagctgtatttttatgaacctctcttgttttgtaaggccaggcttccccatgtatgtgtacctgttgtattcttccctacttttctgctttggatacttacttgggtaacgggtgcatgtttacatgtgctgtctagatttctgtatgtacatgtttgtgtccaaataaatgcaatgttggtatgcttctttctggcatttaccgcatgctacatgttgttaggctttgtataatgctagatgtttcttaaagaataaattgagtttttctt

SEQ ID NO: 14313 - DNA, 921 bp, Triticum aestivum
  Clone ID: PAT_TA_14313
ttttttttttagcgataatcaaactgcaagcaacttgataacactaggtcaatcaccgcatatgcatgcagtggttgctttttatttttgttcgtcgagcggaagaggctgccgttttattacatcacacagaccattgctacataaggtttgttttattacaatcacacacgtaccattgctaacataaggtttgcctcctcgcgaacactaacatttgagcctgcccatcttcagtgcagctccttgaggaagtccgcatgatccaccagaaccactttccagccatctgggtcaaggaaagaggtgattttggtgttcagccccggcagtggccctggctgccttagaatctttccacctagttctttggtaaccagctcaactgcttcagcgctcttgtacacatcgtcagtgccaatagcaacctgagcatatgcattgcccttgttatattccgtgacaccatagttgtatgtcaactccagaacagtggtcttgtcctcctcagcatagcccatcatggcaatagtgtacttatactgaggcacatccttcttcctcagaagcttcatcccaagggccttctcgtagaacatgatagcccgatcaaggtcaccaacacgaagcataacttgacagagaggctcaggcgtcggacccctctggataagctcaaacatgtaaccatctgggtcttgtgcaaaggcaatcacagtggaccctcccttgacaggaccaggttcacgagtgatcttacaacaatcagatgatttaattgtctcagacagctccaccgtgctgcggccgtgtggtgttgggtgtgattgtttgcttgttgcagtggctgcattcactggctgggcaccaggatccgtaagataagataaatgtgtacgtacctcggccgcgaccacgcta

SEQ ID NO: 14314 - DNA, 1244 bp, Triticum aestivum
  Clone ID: PAT_TA_14314
gaattcggcacgaggcgcagcagcggcccgggcctgggcccacccagatccagcgggggattcgcttcgttttgctcgggcctcgccaccgcaacaccaacaggcgcggcgcaccccccgccgcgacgcccggcgcggctataaaacccgcgacccgttcgccgcagatcagcaaccgcacagcagagagacacacacagcacactcttggcgctctccgctccctggtcgttcggtcgttggaagttggaacctcctcctcctcctccgcagccgcgggcggcgtcgggaggtttccgggctgcgcgttggtgcatgcaacagaggggcctctccaacaaccgccgctcccgcggcttctcccgatcccgcctcgccgtggagggcgcctaaacagaaccccaccgccacccccggcccagccaacacacacaccacaccttcttaacaacaaacacacaccagagctcacacccaacgacgacactcccctgctcccttcctttcgcctctgaaaaactttgaaacgagagaagaagatggacaccatcaccgtcgtcgagaatgtgttcggggaggtggagcgcaaggtgcagaagagctactgggaggagcactccaaggacctcaccgtggagtccatgatgctcgactcccgcgccaaggacctcgacaaggaggagaggccagaggtgctggccatcctgccgtcgtacgcggggaagacggtgctggagctcggcgccggcatcggccgcttcaccggcgagctggccaaggaggccggccacgtcatcgcgctcgacttcatcgacagcgtcatcaagaagaacgaggagatcaatggggacatctacaagaacatcaccttcatgtgcgccgacgtcacctcgccggagctcaagatcgaggacaactccattgacatcgtcttctccaactggctgctcatgtacctcaacgacgaggaggttgagaagctgattggcaggatagtgaagtggctgaagcccggtgggcatattttcatcagggagtcctgcttccaccagtctggggattccaagaggaaagtgaacccgacgcactaccgggagccaaggttttacaccaaggtgtttaaggaatgccactcctatgaccaagatgggaattcctttagctttctctggtaacttcaagtgcattggagcttatgtgaagagcaagaagaaccagaaccagatatgttggctatgggaaaa

SEQ ID NO: 14315 - DNA, 1965 bp, Triticum aestivum
  Clone ID: PAT_TA_14315
gctagcccatcccatcatcgccctgctcccgctgccactctcactcgccgcaccactcgcgccggccaccgtgggatcgagagagagagagggaaccatgagcgagcagggggctgggcagggtaccaaggagcagtcagtgccggccgccgtagggtcgagagagatgagcttgagcgggcagggggcagggcagggtagcaaggaggagagactggcagagctggaggagctcgagctccaaacggaccaccaaggggtgctggccatcctgccgtcgtacgcgggcaagacggtgctggagctcggcgccggcatcggccgcttcaccggcgagctggccaaggaggccggccacgtcatcgcgctcgacttcatcgacagcgtcatcaagaagaacgaggagatcaatggggacatctacaagaacatcaccttcatgtgcgccgacgtgacctcgccggagctcaagatcgaggacaactccatcgacatcgtcttctccaactggctcctcatgtacctcaacgacgaggaggttaagaagctgattggcaggatcgtgaagtggctgaagcctggtggccatattttcatcagggaatcctgcttccaccagtcgggggattccaagaggaaagtgaacccgacgcattaccgggagccgaggttttacaccaaggtgtttaaggaatgccactcctatgaccaagaggggaattcctttgagctttctctggtaacttccaagtgcattggagcttatgtgaaaagcaagaagaaccagaaccagatatgctggctatgggagaaggtcaagtgcacagaagacaaaggctttcagagattcctggacaatgtgcagtacaaatccactggaatcttgcgttatgagcgtgtgtttggggaaggttatgttagcaccggtggattcgagaccacaaaggaatttgtggacaagctggatctgaaagctggccagaaggtgctcgatgttgggtgtggcatcggaggaggcgacttctacatggctgaaacctatgatgtccatgtcctcggcatcgatctttccatcaacatggtttcgttcgcgatcgagcgtgccatcgggcgctcgtgctcggttgagtttgaggttgctgactgcaccaccaaggaatatgcagagaacacgtttgatgtcatctacagccgtgacaccatcctccacatccaagacaaatctgctctgttcagaaacttcttcaagtggctcaagcctgggggcaaagtgctgatcagtgactactgcaggagccctggcacaccatcagaggaattcgctgcgtacatcaagcagagaggctatgacctccatgatgtgaagacctatgggaagatgcttgaggatgccggtttccacgatgttgtcgccgaagaccgcaccgaccagttcctgagggtcctggagagggagctgggcgagacagagaagaacaaggaggccttcctggcggacttcacccaggaggactacgacgacatcgtcaacggctggagcgcgaagctgaagcggagctccgccggcgagcagaagtgggggctgttcatcgcgaccaagtgatctggccgctgagcagcgacgccatggacgcgatgattcgggagcagagcagcttctgttaagaaataaataaagaggatcggtgctcgacaatgttgtggccgtgtgttgggtgtgattgtttgtttgttgcagtggctgcattcactggctgggcaccaggatctataagataatgtgtacgtacgtacgtactgtattcctgaacttgtactgtgacgagcgagactcgctttgtaacgtgctattctgttgctacgtggccttcgtcactgtggagttgtgtgacctcacaccatcttttgtccttccttcataatgctttaatccctaaaaaaaaaaaaaaaaaaaaaaaaaaaaaa

SEQ ID NO: 14316 - DNA, 1330 bp, Triticum aestivum
  Clone ID: PAT_TA_14316
tttttttttttttttttttatacgctgtaggtgtgcatcttcctccttttcccgcactatactaatcacctctcacaatctagtccccagttcatgtttatcaagaactaacaatcacctttgtggtgacaatcaaactgcaagcaacttgataacgctaggtcaatcaccgcatgttcgtcgagcggaagaggctgcccttttattacatcatcacacacagaccattgctactacacaaggtttgttttattacaatcacacagaccattgctaacataaggtttgcctcctcgcgacacaatttgagcctgctcgtcttcagtggagttccttgaggaagtccgcatgatccaccagaaccactttccagccatctgggtcaaggaaagaggtgattttggtgttcagccctggcagtggccctggctgccttaaaatcttcccacctagttctttggtaaccagctcaactgcttcggcgctcttgtacacatcgtcagtgccaatagcaacctgagcatatgcattgcccttgttatattccgtgacaccatagttgtatgtcaactccagaacagtggtcttgtcctcctcagcatagcccatcatggcaatagtgtacttatactgaggcacatccttcttcctcagaagcttcatcccaagggccttctcgtagaacatgatagcccgatcaaggtcaccaacacgaagcataacttgacagagaggctcaggcgtcggacccctctggataagctcaaacatgtaaccatctgggtcttgtgcaaaggcaatcacagtggaccctcccttgacaggaccaggttcacgagtgatcttacaacaatcagatgatttaattgtctcagacagcttgtacacatcctcatttgcgatggcaaaatgtccaaagcccgctccaatgtcatacttgtcaacaccataattgtaagtcagctcaagtgcaaaattagtatcctcaggcccatatccaagaaacgcattggtgtacttctcttctgggacatctcttttcctcagcagcttcatcccaaagcattctgtgtaacacttaatggtgcggtcgagatctcccacacggtaaacagcatgcagcatcctctttttgtcctgcttaggccattccaacactgcctcagcggactttccagcatcactaccagtagccatccctgttatcaccctggagattcgatcgggcggagattcgtcgcacgctgatgagaggagctcagtctagaggcttcccaggagaagagagggggggggggggggggggcgtgacgcccaggcaggccggacg

SEQ ID NO: 14317 - DNA, 1920 bp, Triticum aestivum
  Clone ID: PAT_TA_14317
gtcccatcccatcatcgccctgctcccgctgccactctcactcgccgccggccaccgtgggatcgagagagagcagcatgagcgagcagggggcggggcagggtaccaaggagcagtcggtgccggccaccgtacggtcgagagagatcagcttgagcgggcagggggcagggcagggtaccaaggaggagaggctggcagaggtggaagagctcgagctccaaacggaccaccaaggggtgctggccatcctgccgtcgtacgcggggaagacggtgctggagctcggcgccggcatcggccgcttcaccggcgagctggccaaggaggccggccacgtcatcgcgctcgacttcatcgacagcgtcatcaagaagaacgaggagatcaatggggacatctacaagaacatcaccttcatgtgcgccgacgtcacctcgccggagctcaagatcgaggacaactccattgacatcgtcttctccaactggctgctcatgtacctcaacgacggggaggttgagaagctgattggcaggatagtgaagtggctgaagcccggtgggcatattttcatcagggagtcctgcttccaccagtctggggattccaagaggaaagtgaacccgacgcactaccgggagccaaggttttacaccaaggtgtttaaggaatgccactcctatgaccaagatgggaattcctttgagctttctctggtaacttccaagtgcattggagcttatgtgaagagcaagaagaaccagaaccagatatgttggctatgggagaaggtcaagtgcacagaagacaaaggctttcagagattcctggacaatgtgcagtacaaatccactggaatcctgcgttatgagcgcgtgtttggggagggttatgtcagcaccggtggattcgagaccacaaaagaatttgtggacaagctggatctgaaagctggccagaaggtgctcgatgttgggtgcggcatcggaggaggtgacttctacatggctgaaacctatgatgtccatgtcctcggcatcgatctttccatcaacatggtttcgttcgcgatcgagcgtgccatcgggcgctcgtgctcggttgagtttgaggttgctgactgcaccaccaaggaatacgcagagaacacgtttgatgtgatctacagccgtgacaccatcctccacattcaagacaaacctgctctgttcagaaacttcttcaagtggctcaagcctgggggcaaagtgctgatcagtgactactgcaggagccctgggacaccgtcagaggaatttgctgcatacatcaagcagagaggctatgacctccatgacgtgaagacctatggaaagatgcttgaggatgccggtttccacgatgtcgtcgccgaagaccgcaccgaccagttcctgagggtcctggagagggagctgggcgagaccgagaagaacaaggaggccttcctggcggacttcacccaggaggactacgacgacatcgtcaacggctggagcgcgaagctgaagcggagctccgccggcgagcagaagtgggggctgttcatcgcgaccaagtgatctggccgccgagcagcgacgccatgcgacgcgatgatccgggagcagagcggcttcggttaagaaataaataaagaggatcggtgctccaccgtgctgcggccgtgtggtgttgggtgtgattgtttgcttgttgcagtggctgcattcactggctgggcaccaggatccgtaagataagataaatgtgtacgtacgtgctgtattcctgaacttgtactgtgacgagcgagactcgctttgtaacgtgctattctgtttctacgtggccttcttctaaaaaaaaaaaaaaaaaaaaaaaaaaaaaaaaaaaaaaaaaaaaaaaaaatcggccgct

SEQ ID NO: 14318 - DNA, 1312 bp, Triticum aestivum
  unsure (1)..(1312): unsure at all n locations
  Clone ID: PAT_TA_14318
atcaagaactaacaatcacacctttctagtgataatcaaaccgcaagcaacttgataacactaggtcaatcaccgcatacgcatgcggtggttgcttttttatgtttgttcgtcgagcggaagaggctgccgttttattacatcacacacagaccattgctactacataaggtttgttttattacaatcacacacagaccattgctaacataaggtttgcctcctcgcaacactaacatttgagcctgctcatcttcagtggagttccttgaggaagtccgcatgatccaccagaaccactttccagccatctgggtcaaggaaagaggtgattttggtgttcagccccggcagtggccctggctgccttaaaatctttccacctagttctttggtaaccagctcaactgcttcagcgctcttgtacacatcgtcagtgccaatagcaacctgagcatatgcattgcccttgttatattccgtgacaccatagttgtatgtcaactccagaacagtggtcttgtcctcctcagcatagcccatcatggcaatagtgtacttatactgaggcacatccttcttcctcagaagcttcatcccaagggccttctcatagaacatgatagcccgatcaaggtcaccaacacgaagcataacttgacagagaggctcaggcgtcggacccctctggataagctcaaacatgtaaccatctgggtcttgtgcaaaggcaatcacagtggaccctcccttgacaggaccaggttcacgagtgatcttacaacaatcagatgatttaattgtctcagacagcttgtacacatcctcatttgcgatggcaaaatgtccaaagcccgctccaatgtcgtacttgtcaacaccataattgtaagtcagctcaagtgcaaaattagtatcctcaggtccatatccaagaaaggcattggtgtacttctcttcggggacatctcttttcctcagcagcttcatcccaaagcattctgtgtaacacttaattgtgcggtcgagatctcccacacggtaaacagcatgcagcatcctctttttgtcctgcttaggccactccaacactgcctcagcggactttccagcatcactaccagtagccatccctgttatcacctgtaagagttgcctggagattcgatcgggcggagattcgtcgcacgctgatgagaggagctcagtctagaggtttccaaggagaagaggggaaggcaccgtacttatacacagaccattgctactacataaggtttgttttattcctcgtgccgaattncctgcagcc

SEQ ID NO: 14319 - DNA, 2694 bp, Triticum aestivum
  Clone ID: PAT_TA_14319
gaattcggcacgagatgagcttgaacttaatcatttatatgtcatagttctgcaaatcctgcacagagcttaaacaacatatgccctggcgacttaacgtcaaaagccagggcgggtaaccaccaaaatgtagtcttgccctgcacagaagtagatcacaagaacccttggcggtttaccgcagggcgggtcataatacctcacatataaccactgtgatattgaatttgtactgccggtttacatgacctatgtagtaagggtgataacccaatccttagaagccaatgcttccatataaatgatggttgtcataagctggcgacttatagtcaaaagtcaagccgggttaatcataaaacacttatatacatttgagatataatccccaacaggtctcaagttaagtaattgtggctgcaataaactttaccagagatagaataaatttttttgaggcttctgattcggatacgatcagtaaaccattccaaaggggttaagctaagattcgcactcttggcgccccactccctggtcgttcggtcgtcggaagttggaacctcctcctccgatcctccttcgcagccgcgggcggcgtcgggaggtttccgggctgcgcgttggtgcatgcaacagaggggcctctccaacaaccgccgctcccgcggcttctcccgatcccgcctcgccgtcgagggcgcctaaacagaaaccccaccgccacctccgggctcacaccttcttaacaacaaacacacaccagagctcacactcacacctttgaaacgaccacactcccctcccctgcccccttccttcctcccgcctctctggaaaaaccttgaaacaagagagaagaagatggacaccatcaccgtcgtcgagaatgtgttcggggaggtggagcgcaaggtgcagaagagctactgggaggagcactccaaggacctcaccgtggagtccatgatgctcgactcccgcgccaaggacctcgacaaggaggagaggcctgaggtgctggccatcctcccgtcgtacgcgggcaagacggtgctggagctcggcgccggcatcggccgcttcaccggcgagctggccaaggaggccggccacgtcatcgcgctcgacttcatcgacagcgtcatcaagaagaacgaggagatcaatggggacatctacaagaacatcaccttcatgtgcgccgacgtcacctcgccggagctcaagatcgaggacaactccgtcgacatcgtcttctccaactggctgctcatgtacctcaacgacgaggaggttgagaagctgattggcaggatagtgaagtggctgaagcccggtgggcatattttcatcagggaatcgtgcttccaccagtctggggattccaagaggaaagtgaacccgacgcactaccgggagccgaggttctacaccaaggtgtttaaggaatgccactcctatgaccaagaggggaattcctttgagctttctctggtaacttccaagtgcattggagcttatgtgaaaagcaagaagaaccagaaccagatatgttggctgtgggagaaggtcaagtgcacagaagacaaaggctttcagagattcctggacaatgtgcagtacaaatccactggaatcttgcgttatgagcgcgtgtttggggagggttatgttagcaccggtggattcgagaccacaaaggagtttgtggacaagctggacctgaaagctggccagaaggtgctcgatgtagggtgtggtatcggaggaggcgacttctacatggctgaaacctatgatgtccatgtcctcggcatcgatctttctatcaacatggtttcgttcgcaattgagcgtgccatcgggcgctcgtgctccgttgagtttgaggttgctgactgcaccaccaaggaatacgcagagaacacgtttgatgtcatctacagccgtgacaccatcctccacattcaagacaaacctgctctgttcagaaacttcttcaagtggctcaagcctgggggcaaagtgctgatcagtgactactgcaggagccctgggacaccatcagaggaattcgctgcgtacatcaagcagagaggctatgacctccatgatgtgaagacctacggaaagatgcttgaggatgccggtttccatgatgtcgtcgctgaggaccgcaccgaccagttcctgagggtcctggagagggagctgggcgagaccgagaagaacaaggaggccttcctggcggacttcacccaggaggactacgacgacatcgtcaacggctggagcgcgaagctgaagcggagctctgccggcgagcagaagtgggggctgttcatcgcgaccaagtgatctggccgccgagcagcgacgccgtggacgcgatgatccggaagcagagccgcttctgttattaagaataaataaagaggatcggtgcctggctgcactggccgggcacccggatctgtaagataagataatgtgtacgtacgtattgtattcctgaacttgtactgtgacgagcgagactcgctttgtaacgtgctattctgttgctacgtggccttcttccctctggtagagttgtgtgacctcacagcatctttgtcccttccttaataatgctttaatcccttaaaaaaattagctttgaggaattaacaaccgcctagcccttccttc

SEQ ID NO: 14320 - DNA, 485 bp, Triticum aestivum
  Clone ID: PAT_TA_14320
actgggggaaaaactaacatacaactggggcaaacccaggacaataaagcccccctcttgtccaggggaaacggcctcggggccaaccccaaaaaagctcccccagtaacaaaacttacaaggataaagccccccggtccccccaaaatggcaccatttccccccccaaaaaaacggaaggggggggggaaattttcccaacaaagggcaaggggcgggaccccttttaaccaaaggccccaggaccctggggggcaaaaaaaagcttcaaccccctttgggccaggccctaactccggggggcccttgggtccttaaaccttggggcaaccagtttgggggccccccaaccccgggactttttttgggcaaccctctttttttgggcggcaattcgggcccccccccttggggggggcaggggagtcacaaaaccctggatctggggagccttgcccacctttttgccctttttgtaaaggaag

SEQ ID NO: 14321 - DNA, 894 bp, Triticum aestivum
  Clone ID: PAT_TA_14321
ccgacctcctgatctcgtcgttcgcttgtcggttcctattgccgcccgcggactcgaaaacgtatgatctcgctggctatccctcgagcagcgccaggcccccgcgcgtgcagtcagccgtatcaacgaagcggcatgcttcggccagctaccagcttactacccggcccggccccgtcttgcttctgttcaccgccacggctgtcagcgccgccttgtcgtgcccccccccgctcgtcccccgcctcgtctccgcggtcgcggcgccactccctgccggcatggggcccccgcacaccggcctgtgcggccccacgagcgccagcatcccaccgcgggcgcggcagacgtaccctccattcgttgatgtcactgctgccgacaacctgatgtcgttgttcgcttgttgtctacctatgtcagtcatcatcttaatatcgaatgggaaactaaatcttaagcaaattatttcatgattaattctaatgcattgcacgaacaaacatccgtataaacaaaagtggaaagcaacgacaaattatgagctgaatatgtgggcaggcaccatgatacttattttgaaaacaacgacaataagattctaaataatctccacccactcctccaacacgctactcatttctgaaaagaaagcactactcactgttggaaaatgactaccacaaaattgacaaccaaaccttgcagtgcagccggagtagtgacaataaggcaatgctggaagggaaaaattattgatcattggtaacacggttggtcaaaagactgcaatttagagcagtagcaaagcttagctgtagcccaaaatggcagatccatactgatacggttgcccgacatgcagcaacagtacctgcccgggcggccgctcga

SEQ ID NO: 14322 - DNA, 561 bp, Triticum aestivum
  unsure (1)..(561): unsure at all n locations
  Clone ID: PAT_TA_14322
acatcaaatcaccaaacattttactggatcagtccatgcatgctagggttgccgactttggattgtcaagagaagaaatgcttactagaaacggggccaacatacgtggaacttacggatatcttgatccggagtacgtgtcctcacgatcattcacaaagaagagtgatgtgtacagctacggtgttctgctatttgaacttattgctggcagaaaccctcaacaaggtctaatggaatatgttgagcttgctgcaatcaacgctgatggcaagactgggtgggaggaaattgccgactctcggctagaaggcgcatttgacgtggaggagctcaatgacatggctgccgcagcttacaaatgtgtaagccgtgtctcccgaaagcgaccgtcgatgcgagatgttgtccaggcactgatccgggtggtgaaacacagccacagcagcaggaaccatcatggcaggaggcttccaccgggcaggacggatgacgaatctgttgaccttgaggcatcagagggtcagtcatctgcctctggccatnagagacaggaatcgg

SEQ ID NO: 14323 - DNA, 990 bp, Triticum aestivum
  Clone ID: PAT_TA_14323
gaattcactaggtgattagcgtggtcgcggccgaggtgcggcttgaagcatattcaaacaacttggttgattaccatctgattttggcatcttgtacctatcttatgcacatgagtacttctcaggagaagcttcctgtaaccctacatggtgcccaagcttcagttttgttctgtatgggtctacaggacaaagacataggtgctacaaaggaagagcttggcatagaaagggaacaagttctatctaacttcatcaagacaatgaagaagctttatggttatcttaataacactgcaggaaacgaaattgaagcaaccttaccgagactcaaggaaattgaagccccacttagcagatcaatggacgaagaccttgacgaagcagctcaggaacgtgaaggaaaaaagaagagtcgctgacgaagcaactgtggacccaaagctactgcagaagtatgcgatttaaagcgatggccatgagattgagaaggctctgcagaatgagaaattgtctgcaagcggcgttatcagtgtaaaacccagcaaatcaagtgcagacaagaaagagaagcatagggaaaattgaaaaatcgaaaagaaaaggacaagacagtggtcagatcggagaaaaagaagaagaggacttgaagttgcctacttggaatttgagaccgtctggattcttggtatttttgtaatcgccaagcggaaaccatgcttattcgtccagaagggctaagagggaagcagaggttgggaaccaggctatattatatgtagaatctccctgagaaacctcctcacaaccctgtggcaccaccatgcctcaattttgatgtaccatttgcttcattaggatactcgacgttcgcgattaaaagcgatgaccttgaggtaccatctgctttgttggaatataattttgcattctctggactgtacaacattctattttgttggggaacttgtttattaaaggaatggacat

SEQ ID NO: 14324 - DNA, 751 bp, Triticum aestivum
  unsure (1)..(751): unsure at all n locations
  Clone ID: PAT_TA_14324
tcggaatncccccggcggcccacgcgtccgcggacgcgtgggatcaactccccacctttatctttcatgcacgctctgcctccctcggtgattttttctggcgtgctacccccctccctccctgcctcctatagcagcggccagcagctaaacacaagcctcacttcacatcgcactgcatcgcatcgaccggcctctccctccgaggagagctcccgcgcgtcgccgccagtgcgggcgagagccatgagaggaggaggaggtggaggaggaggagaggacacgcggaggacggcggccgggcaggccatggtggagctgcaggccaacggggcgaccgcgacgtcggccagcggcgcgatggtggtggggctgagcccgctgagcgagacgctgtggcgggacagcaaggcgatgcccggggcgggcgcggcagcgctcatcggcgaggtgtcggcgaggctgacgtggaaggacctgtcggtcaccgtggcgctgggccccggcaagacgcagaccgtgctggacgagctcaccggcttcgccgagcccgggtcgctgaccgcgctcatgggcccgtccggctccggcaagtccacgctcctcgacgccctcgccggccgcctcgccgccaacgccttcctctccggcagcgtcctgctcaacggccgcaaggccaagctctccttcggcgccgcggcgtacgtgacgcaggacgacaacctgatcgggacgctgacggtgcgggaga

SEQ ID NO: 14325 - DNA, 1240 bp, Triticum aestivum
  Clone ID: PAT_TA_14325
cgcccccgggctccccagccccagcatcaccccgccgccgccggacgggtccggtggccatcgccgctgcggaggtcgcagccactgccaggaaagattaagggccagcagccatgtccatcagatctctcatcgccgcgtccaggtccggccatgccctcgccgctgccaccatttctcaggcagcctccagagcgcaccagcacgccgccggcgtgcctcctctgctccccaggcttggaccactcgcccgcgccttcagctcaagccctgaaacagcagatgtcgattcaggtgtccctgtcatggaagtgcagaaacggcgggtgggcaaaaaggccaagggcgcgaaaagcggaaaagccatgatgttcccactccatttccactacgtagatgtgttgcgcgaggatctgttgctcaaactgaaccacaccaacaccatggaggtccctgggttgtttgagatcagactggtgcccaagtctaccaccggtgccaaaatccagtttgggaaactggccatggagattctgtgcggccagaggtgcatacaggcagagctgcctgcccatctgaaagggaaggcgaccaacgcatacctggggtcccagaaggacgccgtgtccctgaggcagagcatcatccgagggcacgggatgtacaacttcctggtcagggtcctgactgtgatgtctatgctggactccaaggtggcgatcgagcaggggaactgcgtaaagttcttcatggccacggagttctgcgagttctcccccgagatagaggaccactttgagatctttgagaccatcggagggttcaacgtgaccatcgtcaccacggcctgctcgaaggaggagacctcgctgctgtggagcggcttcttgctcaaggatgaaggtgagatcagctaagtaagatgctggagtgagatcataagcattgtggctaaagacaaactctggtggaagcttctatcgttttgtgatccgatctttgctagctagagtcaatggccagcttttctttctagagcaatcttgttcgggaatgaaactgagttcccctgttatgtctatcttcagaagaggctcgtttttcttctgatatgcagagattcattggtttctacggtttcaaaaaaaattctagatggtgattcctcctagttctgtatcctgataggctttggtcatcctcttcatgtgaagagaactaaataataatgcatttgatt

SEQ ID NO: 14326 - DNA, 1078 bp, Triticum aestivum
  Clone ID: PAT_TA_14326
gggattcaacactcattactcaaaaccatgttctcaaaatgccgagctcgtaaccagatggaaactccacacacgcacgcacaatgtggcatcatggaggaacacgagcaaaatacaagacgcaagataaccaaacgcatgcacgcacactcgcgcacacagcaaatgcaagcaggatcagttcacagacgagcttgccaaacatgcttgatttgaaagcagtaaactaaaggaacgacaggttaagtactaatgaatcggaacaggtcaatgttcccttcaatcttcgactggcagagcacagaaattgtcaaattaagcaattaattcctacaaatggacctcacagctgaccggtgcatgctacatagagagtcaatctgttcgtcgaacatagaaaatagtagagcctacagccaaaacccatttcttcatttcagtcaccagaatgtaacctgcggagcaaacaatatcatcagtcaaaaaaatttgcaccattcttgcatgaaaatccattgcagttactctcataattttgtacgacacaaaacagtaaacattatctccaccattgtggaaattgtgtcaaaaagcttcaaaggcgaatgattcgttagacaaaaccaacacttgaaacagagaataacattaggaaatttgcagtgtagtggcacaccttcaacttctaatattagaagtatttggctatattgatctgagacctagtccgagtggaggctaaaagagtgggcatatgaggggctgaatggagtaagaaagcagaaacgtccgatttttagcttgcaggcatacttgcatagacaggacaacatgcaagttacagtttgacttgataggcccttaaccacatacaaaagttgacatcgacgtagcaattagtaaaagtaaaaaaaataatccccaaagcacagtgaagcatatgcataaatagggaatggggaagggttctagttcattagctactaccatctctgagaagggcacaagcatatgcataaatagggaatttatcagtcactgcatgggctaaagggagaagaacccgacactaccagaa

SEQ ID NO: 14327 - DNA, 878 bp, Triticum aestivum
  Clone ID: PAT_TA_14327
aatcaaacttcatcttttattaataaagaaacttcttttcacaggtaaagagtacactttgcttttacaggaatgctaacaacaaatgcactacagctcgaacctttacacatcatatacaatggatgtgccgtcgagccctaacaggaatcatgtattggttactgggggtaaaaaaagccagtgcgacgctagtcacgctaccactaaccagcacagactatttctggcaagctacaactgatggcaggatcaaaactggtggcgcaaacccgccgttttcagaagttgatcagccataagcacatgaaagaattggaaagggaaaaaaaaactagcctgaagaagaatttgtacatgctacaaattagggcctttaaaaggggaagaaatgtcttgggaatgtcccatgaaatcgctacgtcttctggctgttctgtggggaatccttttgctgtcccgccacgtgttgtctatttcgctatcttgacgcagaagctttaccaaatctaccctaacctgggatttctcccgcgtgttgctgctacacttattatcctccacagtttctggttcgtcaccagatgctggaggagtgtgaggtcctgcttcggcgcttgatctatcctcctccctggctgaccggggaagcgatataaacccttcgccattattaggactgcaagcaggacaatagaatgtttttggtggggggccacacaagttgatgcaatcaaaatgataccactcgtcacactgatcacatgctatcacggccctgttatcatatggcttgcggcaaatgcaataaagaatgctccgatctctgagtaactttagttccttctcaacatgtacctgcccgggcggccgctcga

SEQ ID NO: 14328 - DNA, 858 bp, Triticum aestivum
  unsure (1)..(858): unsure at all n locations
  Clone ID: PAT_TA_14328
gggggccactgaccacaatactttttttgctcacccaagcataaacactgaaaatgttcaccgacaccacttcatagactccagtgcaattacaaccaattaaaacataaagagtgcagttaaaaggttgacatgacgaatactaagcgttcattcaacaccacctcgatgctcctctactgaaatgcccacgggttctccctgcggatcttctcctcgtcctctggcaagtagtcgttctcggtgttgaagaaattacggatctcctccggaggtttgccactaatcatgtctgcagcagtctggcaagtcaggtccaacaaccccttgatgttgaggtaacttgcagccttgatgaggtcgaagagagtgtcagggtcgacattgatgaattctgcgtcccagatcttgaggtcctcggcaagggcggcgggagccatggtgtcagatgcagtagcacatgtggctccactagagacgtcgactgtcttggccaggacatgtttgttgcagtactcgatgaccttggagaggaccttggagttgatgttggggatcgggatgcctttgtcagcgcagtcatcctcgatcatgtggcggatggtctgcgactccatggtgactgcctcctccacctcgaactcctcgccatcggccgacttgagcatgatcatcttcttctcacctgcctctgcggtcgccatcactgctggatctgggctgaggtgggggcggatgacttggggatccgggaaacccgagccacgcggccgcgagcggccgccaccgcggtggagctccagcttttgttcccnatagtaggcaaggtttcgagnangngtttatannnnaccctnn

SEQ ID NO: 14329 - DNA, 647 bp, Triticum aestivum
  Clone ID: PAT_TA_14329
ggttttaacaaaaccgctaggcctactctttggaatcacttactagtgggctgggggccggccttattacaactctacttgctgagcctaccaacatttcctcttatggtaataccctagcatctttgtttatcccatctacataacacaaaccccaaagggaaagaaaacaaggacggacatgtgtacatttcctctgtatactctcccctagacgctagactgaagcaccgatcatatatgtccacggtcaaaacgctttactcttctccttcttcctcctgtgcaatcctatggaccctgatgggcaggcccttggggaagtcgacgaacgggtagacgaacgcctggtccggctcggcgagctcccaccggaagttgagcaccaggtggtgcaggaagatggccatctcgagcttggcgagctccgacccggcgcagagcctggtgccgccgccgtagggcatgaagttgctgttctgcgccacgccggatgcgttgcccttccatctccaagggttgaagctgctggggtcctcgtacagcgacgagtcgagatgcaccgccgctaacaccggcagaattttccatccgctcgggatgtcatacccattgtagtgcacatctcgaatgaccttccggtgcag

SEQ ID NO: 14330 - DNA, 799 bp, Triticum aestivum
  Clone ID: PAT_TA_14330
gtttttttttaaaaaggggttcatatgtccccaggttcatccatacacttttgggcacaaggccaacaacaacccgttgaaaatgaaaccacaattgaggaaacaatgcccatatggaactcctataaatattttgagtgaccgtaaaaatcccacaagtgtagatgaacaaggattttctccttttgatatctatgaacctagaaactgggacactcttgacaataaatcaagagattttctgattataaaaagggcctacaagggaacaaaatcttgtgtttgaaacagactacatttatcttgacattttcatttaatgattttgcatcaaaaaatgcatggacccgtttctcatgattactggaggcttggaggttcgctagtatgccatttctttttggttatgctctgtgacttctatgatgttggatttacacctacagtatgaaattgttatttatgactgggagtgttatttaccaagaaaaattaccgttgtttattatagctttgcaatatattttttatcaaagtatggaatatttttttccctccaatgctgtcattgggcccattcatttgagttccccccggggcctccgaaactccaggaccggcgctgggcatgcacacggatggcaggcaattctgacccctcctcctatcctacttcatcgtcttggtctcctcttgttcctcctgtcgctgcttctcgcagtccagaccgggctcgccggcctgctcctcgccgctcgccgctgctcctgcgttgttgtactcctggtccttgtccttg

SEQ ID NO: 14331 - DNA, 428 bp, Triticum aestivum
  Clone ID: PAT_TA_14331
accggtccggaatcccgcgtccggggggagaaggagttcaacgaggagctgatgagggtgatgctggggatcgccaagctggtggagccattgatggacaagaacggcaacttcccctaccacctcttcagccggtcagcatgagccgcggcagcagcagctccagggcagagctcgctgcgttgtatctgactgctgggtccctgtggcgccggcagtaccgcaagtgcggttagtagtgctagtgactttgcctctcgagagaaggacaaccaagatgatgcatctcctgtcatgtagtactagtgtataattacctcttgttttctgttttgtcagagcatgtatgaactctctcgattctagtcgtcatcagactgtcaattaagatgtggttaaggacaccaaaaaaaaaaaaaaaaaaaaaa

SEQ ID NO: 14332 - DNA, 1274 bp, Triticum aestivum
  Clone ID: PAT_TA_14332
gccggcccgaggctccggctgggccagacctcccctcgcaccccccacccccccccctcacgcgaacaccacttccccctcgccggaagcgagagcggcggcggcggccatggcgcggtgcagcgacgggctgctgggcctgctgaacccgccggacctcgtcaccggcaccctcgtcctcggcggcggcgtccggatcggcgacggcggcggccatggcgcgttgcagcaacgggcggcggggcctgctaaccgcggcggtgctggtgctcgccctcgtcctcctcggcggcggcatctggctgagccaccgggcctccaccaccgattgcgagcggttcctggaccgtccggtcatcgcgctcggcgccctcctcttcgcgctctccctcgtgggcctcgccggctccctctgccgcgcctcctgcctcctctggctctacctcgtcgcgctcttcctcctcatcgcgctcctcctcgtcttcaccgtcttcgccttcgtcgtcaccaaccgcggcgccggctccgtcgtctccggccgcggctacaaggagtaccgcctcggggagtactccacctggctccagcgccgggtcgagagcgccgacaactgggccaagatccgcagctgcctccgcgacggcggcgtctgccagaggttcggggccaggggggagtcgctgcagcagttcgtcaccaacaacctctccccgattcagtctggatgctgcaagcccccaaccgggtgcaacttcacctaccagagcgagaccgtctgggccaaacctactggcctcaactctaccaacgaccctgactgcaacacgtggtcgaatgatcagagggccctctgctacgactgccagtcatgcaaggccggcgtgcttgccaacctgaagaacgactggaagaagatcgccaccgtcaacatcatattcctcatcttcctcatcatcgtctactctgttgggtgctgcgctttcaggaacaacaggcgggacaactcgtacccagcctggaagtgagtgagatgcctggcgaggcttaggtaattaggctgatgttcagcgttagcagttggctcgttgtcctgtgtcaagcaacactatcgtctatcctgtagctccgatgatgtttgaaccgtcgatagttggtaatggcgcatgcttgctatatttgctatgccgacctcaaacatatcatatatggaggttcctattatcatgatatgagatatgttcataagttgtcaaaaaaaaaaaaaaaaaaaaact

SEQ ID NO: 14333 - DNA, 830 bp, Triticum aestivum
  Clone ID: PAT_TA_14333
tcccgccgtcgttggcctcgtggatctgtgcgtgctccgccctcacggcctccagcagcttcggccggtcgtggaggtacttgacgatccaggtgagcacgctggccgtcgtgtcctgcgccgcgaacagcacgccgatgacgttgtcggcgacctgctcgtccgtcaacagcgcgccctcgtcgccgtcgtcgccgccggcccgcgaccgcatgaggcagccgagcaggtcgtcgccgggctcgccccgctccctcctctcgtgcaggatgtcgctcagcacgccgttcagccgccgcctcgcctggatcgccttgtagtatagcgtcccggggaagctgttggggaaggagttgtagcctttctccacgtcggcgtagttccgccggagctcctccttccgccgctcgtccagccgcccgccgaagatcgtcacgatgccgacgtcgaacgagagcctcttcatggcgtggaaggtgctggcgacgtccccgtccgcccaggccgcgagggttgcccgcacggcggcctcgatgtccggcacgagcttgcgcagggcctcggggccgagcgggccctggacgagcctgcggagacggaggtggtagtcgccctggtggaagaagagcgccgacgggccgatgaggcgctccttgctccgcgggtacgtcggcttgaacaggtttgcccgcgacaccagcacgaaccgcgccgcctccgggctcgccagcatcacgcacgggcagccgaggaggtgcgtcttgaagatctcgccgtaccgcttctgcttggaggagaggaagacgctggggtcctgcctcgtgccgaat

SEQ ID NO: 14334 - DNA, 895 bp, Triticum aestivum
  Clone ID: PAT_TA_14334
gccacccccccccaccggggctcctccacgctcgcttgccgccgccctgattcccccctccctccctccaagcctcaccagtcccccgccgtcgcgccgccgcggtcgaggggctagtctgcgccggcgaccggagaggaggagtattataagcagccctgaagccaaaatggcagccttgccactggccaccgcggaggcctgcgacgccaactcgcacatgatcaccagcggcgagctccgcgcgctgcagcccgtcttccgggtctacgggggccggcggctcttcgcgggccccgtcgtgacggtgaaggtgttcgaggacaacgtcctgctccgcggcatcctggaggaggagggccagggcagggtcctggtggtggacggcggcgggagcctccgccgcgccctcctgggcggcaacatcgccatgctggcgcagaacaacgggtgggccggcatcgtgatcaacggctgcgtccgggacgtcgacgagatcaacgggtgcgacatcggcgtgcgggctctcggctcgcacccgatgaagtcggacaagaggggggtgggcgagaagcacgccccggtcaccgtcgccggcgccaggatctgtgatggtgagtgcctctacgccaacgccgacggcatcctcgtatcgaagaccgagctcagcgtgtagtgcagggctccccagttgcctgtgctgttcccctctgtgtatgtattttctggcgtgtaaaatgatgtatgaatgcatgaactgggcagttgctccttcagaacagaagctctgatatctgaacttgagatgtcatgagctctcaactgaacatgtaaatgataatggcaggcttgtcttgcttgatcaaaaggaatgaacaatggggataataataat

SEQ ID NO: 14335 - DNA, 425 bp, Triticum aestivum
  Clone ID: PAT_TA_14335
gggtcgagacgggccgtgagctcatctcctttggccccaagtccgactaccaccacaacctgacatgctcctccataggccttggattactgttagctaccagatgaagttcggagaaaggagctaagacatgactcaccaggtctgctctatattgtaccatacagttcatattttggtagtcttgcttcttcggaaatttctgaaattcaaagttaccctcgaagtggtagagaatgaacagaactagagcatgggccattgtcagcttctgtgttggtagggcgattcttaggcgcaccaagatactggtcctggacgaagccactgcttcggtgacagtgcaaccaataacctgatccagaacacaccacaacatcatttctcagggtcaactgtcatcacgaccgtgcatcgaatcacct

SEQ ID NO: 14336 - DNA, 494 bp, Triticum aestivum
  Clone ID: PAT_TA_14336
ctcaaggacatggccagctcctcctacttctaccagacgatgcaagcggagaggatggcacattcgagcagcatgaacggcaggaacagccatagccgtcaggtgcatgggtcttttgcccgcgcaagcgcaaacgggcaccagtcgatgaggagcatgtctgatggcccccgcgcgtccccgtttcgctactcaccaaagccgaacgtgaaataaccatagctccgcgtcgcttcgtaatcctggtcgaacctagagtctctccagatcattctgggggtggtggaacttgggtcggggcggtaggtgccgcgggttaacattgttgtgcgacatgaattgatgtctgtctgtctggtgtagatttgacatgtgaagaagatataggtggaaaaagaagatgctttgcgtgggaaaactcctcgtggatgctttgcgttgaaggttaatctcaaactggatgctgctataaaaaaaaaaaaaaaaaaaaaaaa

SEQ ID NO: 14337 - DNA, 650 bp, Triticum aestivum
  Clone ID: PAT_TA_14337
tgtaagtccactcaaagcataggcctcaaatcatcttgtgtatatgacagaacggcgcctttgaagttcagcttcatcctcatcaatatatcgctccatagctttaaactttctagtgtttaaggaattgtgcatctctatcctaatctccatggatgcctcgggacacttatccgcatcactggaacccccagaaaagtgctgctttagccttctcactccaccatggactatcttgccacacaatgtacactggagtaaatctttcctctctaaatctggccagaacccatacttccaggctggatcatctgatgtagctcttctcctaggatcattggctagatccatcagagcaggtacacctggctcctgtcaaagataaagagagaagagccaaatctctagagcagccagatcaagcatggggaaggagagaagcagtggtggggctgctgccttgtgggtggagaagcagatctgggaagaaacagatgcagacgtccggcgggcaagcacatctagctacactgctgtgcataagagaggcagctcctaacagttagtagaggagctgtgcattactgagctacagaacatgcaagcatggcaagctacactgctggatggaagaaagaggagagggggga

SEQ ID NO: 14338 - DNA, 1328 bp, Triticum aestivum
  Clone ID: PAT_TA_14338
cccggcggccgcccgggcaggtactgcggctgagcgcgactctggaatcccaaggttttggttaagctgattcagtcctggatggacatttggtggtctgctcgtgggtattaaaacgtgctatatatgttggtagttctgctgtttcaaagtaaaagtttcaccgctttcccctacattcaagtacctcggccgcgaccacgctaccactgccaccactatcactacttctgcagccacgactccttctaccacaacaactgcatttcctagttttagcttgcaagcttccacaccagctcctggctcaacttcggcagctcagtctacactgcttggcggttcttccgcagctgcaagcacactagccaccatcgccaccacaagtcaggcgacttcctcagctattcaacctagcagcactggagctagtacgagtgccatcactccagcagcacctcaagcagctaagcttccatcagaaattgttggtaaatgtgtcgaggagattattagggactggaacaatggtcttcaagaccgcactgcaaagttccggaagcatgcaactgccatatctgaatgggacaggagaattctgcaaaacaggaatgttcttataaggcttgaggctgatgtggccaaagttgttgaaacacaaacaagcttggagaggcaacttgagttgatagaaactcatcagaaagaggtggacaaggctctgcagagcatggaggaggaagccgagcgtatattccaggatgaacgggtcttacttcgtgaagatgaggctgcctcagcaagggatataatgtacgagcaaggtgaagttgtggagaatgagttgcagcatatgacagaacaagttaaatctatcattcagaccatgaattctactcagggtggtgagcttgaggctacggataccatggcaccatttgatgttgctgtccgaatactggataatcaactgcgctctctaatgtggattgacgagaaggcaaacgagttctcaaacagaatacagagactgcccaacaatagtactgcggctgagcgcgactcaggaatcccaaggttttggttaagctgattcaatcctggttggacatttgatggtctgctcatgggtattaaaacgtgctatatatgttgttagttccgctgtttcaaagtggaagtttcactgctttccccttcattgaagtacttctgtgacatgtgactcttaacatgatttccgtgttgatgctgtttattcaaattcaaactgcttgttagcatgaactgccctgcttgcattataacagattttaaaaaatggtaaa

SEQ ID NO: 14339 - DNA, 717 bp, Triticum aestivum
  Clone ID: PAT_TA_14339
tcgacccacgcggctggtggcggcggaagaaaccctaggagcgaggcgacggggaatcggttctgccggcgacaagtccgactacccgcctgccttctctcagttaacaggaaggggcagcggtatgggtaactctatcgcagctagttcagctcctgcactgctgggagatactcacaatccatgcttcaaatggaaggttcataacttctcaaacctactccagaggggagaggtctcagtcaattcagccccctttttctactctgggtacaaatggttccttcagttgactcctcttaccaagtcttattctgcaaaaccatgtgttgctctttctctaggaattactcgaggaagtctgggcttggagccaggttccgtgatggctgtggtgtttgagttgtccatatacaatcattcagatcatgtgcattggggatccaaagctaccttcaactttgatgatgagcatataaactcgaagaaggaatgcttgattccacttaaagaactactggtttcaactgattttttggctgatgactgctgtgtctttggtgtggatatattgaaaattgatgccctttttcctgaaaaggaggaaattgcgatccagaaggctgcaccaattcagagcctcttcatccaagaatgataatttcatcaaattgacctgcagcgtgacgataaataactttcttgaaatgagcatga

SEQ ID NO: 14340 - DNA, 409 bp, Triticum aestivum
  Clone ID: PAT_TA_14340
aaaaaaaaccaggggttggtttttattcccaagttggaactaatttagttgggggtcttacatgaaagggctgggcaaatttttttttcaccggtacaacgaccaaaccatgggctggaaaaacgggggttaatttttctagtcctaaaggttttttcttttcagttagcccccaaaatgccaaagggggcgagggggcaatttgggggggtgtaaaccttgcacattgcggggaccgtttggacccctggggtccttatttcctcaaactggggcaattgttgggggtggacaaaaccctgggcctgggggttttgctgaaatggccggaaggagccctggcctaacggattttgttgcaaaggctgttggaaggaaaaccggctcaaggggtggtggtgctgttttt

SEQ ID NO: 14341 - DNA, 970 bp, Triticum aestivum
  Clone ID: PAT_TA_14341
cgtccgctttcaccactttgcgtcgagcttcccgcgcgcgcccacgctcttgatcattgccgccggggcctgctcggggcgtacgtgcgtgccatccgtcgtattctattttcacagcaatgcgcatggctccggcggcggcaggaagagcccacggcgcttggagcagcgcaccgcgcgtgctctccgaccggcgcggcctccggtcgtcatctcgcgacgtcgccgccatggcgacggttcggttcggcgctcgtcgtcgtggcgcagttgggagcagagtggtcctctgccgcgcgtctgggggcggcggcgagtgggagcccgcgggctcgccgtgggacggccggatggtggacgagggcatggccgcgctgcggcggcgcatccgcgaggtggaggacgaggaagtggaagagccggaggaggaggaggaggagggcggcgtcgacgtcttcgtgcccccgggcgagtggacggagctggagcggcggcaccacgggctgtacgtcgcgggcgtgcgcgaggcgctcggcatcctgttcgcgctgctggtgcgcgcgcggccggggctcggcgcgggggtcgtggcgctggtgctgctcagcgtgccggcctcggtgctcctcgtgtccgccgagctcgtccgggctgtccactccatctcggccgccgtgctcagcggcagaatgtaggattgtaccttgtacgtacgtactagatggctctgtacgtattttcccgcaaaaaaaaaaaaaacagaggctctgtacgtattttctgccttgtgcacgtgatggttttcgttcttcccagggaagaatcaaatgatgtagtagtagggttttcttgtctcgactcatcaagagcatgatgaccatgagcatgacattaagagaactcttggactgtttgcgggcataggctctgaagatcctaatattgtttaaaaaaaaaaaaaggggggcga

SEQ ID NO: 14342 - DNA, 1032 bp, Triticum aestivum
  Clone ID: PAT_TA_14342
taaacactgaatggggtctattaatggccagcatttcagaggataataatgaagagactccgttgcaggtgcggttgaatggagtaccaacattcataggcattgtggggcttgttgttgcagcaatggtccttgtagttctctttgcaagatattttacagtacatactacaaacccagatggtactgttcagtttgttaaggggcacacaggtgtgaaatctacaatatttggagtaataaagatactaactgtcgcggtgactattgtcgtcgttgctgtacctgagggactaccgctggctgtgacactaaccctggcttattcaatgcggaaaatgatggcaggtcaagctctggtgaggaggctttcagcttgtgaaacgatggggtctgctacaacaatttgtagtgacaacactggtacattaacgctcaatcagatgactgtggtgcgatcaatagttggggcgatagagctgcaacctcaggctactattgagaagttgtcacctacagtgacctctcttgtacttgaagcaattgcacagaatacttcaggcagtgtgtttgagccagaggatggtagcactgtcgaggtaacaggctcaccaactgaaaaggcaattctttcttggggtcttgagcttcatatgaaatttgccttggagagatcaaaatccgctatcattcatgtctctccattcaactcagaaaaaaaacgcggaggcgttgcagtgattgggagagattcaaatgttcatgtgcattggaaaggagctgcggaaatagttctcgcgttatgtacaaattggcttgatgtagacggctcaactcatgaaatgacacctgataaggctaatcacttcaggaaatacatagaagatatggcggagcaaagtcttcgttgtgttgcttttgcttatagaaatcttgatccgaaggacattccatatgaggaacaaagaattaattgggagttgcctgataatgacctgactcttattggaattgtggggatgaaggatcctt

SEQ ID NO: 14343 - DNA, 1017 bp, Triticum aestivum
  Clone ID: PAT_TA_14343
attcggcacgaggctctttccgggcgaggtgttcgtcttcgagtctgtgcgtccggagaaggtgcaagcggttctcttattgcttggaggaagggagctcggcccgggtatgggcgtggggccgtcgtcttcagcatcatacagtaagaggttgaattcacatcggatggcatcgctgatgaggttccgcgaaaagcgcaaggaaaggaacttcgataagaagatccgctattctgttaggaaggaagttgcacacagcgtgcggcgccataaaggtcagttcacatcatcaaaagcaaaggccgaagaagcggcagctgcggctaattcagattggggtgcagtggaaggtcgacctctttctgcacctatgccagcattgtggtattagttctaacaatacacctatgatgcgtcgaggaccggatggaccaaggactctgtgcaatgcatgtggactcgcgtgggcaaacaagggtatgatgagagaggtcaaaggtcatacacctttgaaagttgtgctgccagcaaccgatgacgctcagaatggagttgctgaagcacccactgctgagcagcaacatctcgcactagaagctgcaccagaagcaccagtagcgcctgctcctgctgccaatggccatgattcatagccatcaggtggtggatgcttcagaggacgctgcgtttgtcatggagttgcatgcttagaagttataatcggcataatttgaactggaggcttgcaatgtgcgcattgtggtgtggatgtaccgacggtctgactccgttgccgcatgtgtatatagagataatggacgtttttcgacatgggtttttcctgagcgttcattaggtttaaatcctcctagaaatgacactgttagcgacagcaacatcccctcctgcatggcggttgagaaaatctgttcgacaaatgcttcggaatgacattttttcattaatttgttacatggatatgtgtaccagataatttgcgtttacttggtaaaaaaa

SEQ ID NO: 14344 - DNA, 456 bp, Triticum aestivum
  unsure (1)..(456): unsure at all n locations
  Clone ID: PAT_TA_14344
cctgcccgttcgcgcacggcaccttcgagctctggctccacccgtcccgctaccgcacccgcccctgccgcgccggcccggcctgccgccgccgcgtctgcttcttcgcgcacgcggccggggagctccgcctcgcctcccaccacaaggggccggactcgccgctggcgctgtcgcccaagtccacgctcaccgcgctctgggagtcgcccccggtgtcgccggtggagggcaggatgaggtggctggacggcatagacgacgccgccgacgccgaggtcgaggagatcatgctcgcaatgcagcagctcagcttcgccaacgcagcagcaccgtcggcaccgtccggtacgctgccggcggtgacggaggacgacgcgccgggacctggggntgggtgtccggagctggtcatgtgatcaatcaaagacaccgaagccccacagcagatcctcg

SEQ ID NO: 14345 - DNA, 1648 bp, Triticum aestivum
  Clone ID: PAT_TA_14345
ttttttttttatctctagaaccagttttttcaaggagtgggatttcatctttacacaaacatgtggagcaatgaagtgcaaaataatccttcccaatggggtacaaaaagccctagcaagataatatcactgagttgataattattattacaaaaataatacgggcctaattagtctgaaaccagcagatttgcaaggggggcgttggggctggtgacaaaaacgaagtatcacccatagcattgcgacgatacaatgaacgtcttcagtttgaagacttgaaatggcgttcaccgatagtagtgtacatctcaccgagtcggatttgctctattattactttcatgatatcgtcttgacttgcgccaagtgcgctgcgaagcagctttagacttaccccatgatccatgtcactgcatacagaacggtatgctgggtcgcgcaaaatggaaaatatcttatcctcaaagctgcaatcttctggtatctggctcggagcaatctgataccttggcatgacggttgatgctgacggggtggcaacggaattttcctgaagctttagtctgctctgcttagaaatatcgatatgggccttgatgcagtagataaagtgatgggttatatcattgaagttctttacggtcctgaccatgtaggctttgatttggaaaaattgctccaaactggtagccctcccaacaacacgtacatacatgccttcgttgaacgaccaagcatccttggagtcttgacggccatcaaaccagaagtatacattaacggacccagtgccatcatataggtcgaacgtgcagtgatccatgctgagtgatttgtttctgaccatgcctatcagatccaccgttgacacggccatgccgtcgatgatttatggatcgcgttcagtgtcctcgaagagagaatcaagcagcatcttaatagtgaggcgcctgagagacgatggagcggtattgatggacgatgtaccaaataagtagggcccttaaagcccaattcagcggaccgtgaacagctggggtgtagccttggctcgatgttaaacaccatgcttcgcacgcaccagcacgaggaagcaaaacatctgcccgtcccaacggcccaggggccccgtgggctcgatcccccacgaaaaagaacaggtccggcgggcagcgcggcacgccaccttcttctactgcccatccccaccctcctagtaccagcgcggagggtcgtcccgcccttcatgatggccctggcgcagcccgcttcttcccctgcgccggggcgacagaaaactgaatgagactgacggcctgtcggacgctcgccgttgacgccaaccaggtggccgcgtcctccgcccccgtttttttagcatagctcagcaaagaattggggaatatgagatgaatatagttcagtatcgagatggatatttccgatctggtacgggtttgacgagttctgttgatttgttacctatatgctttgccggatcgacttgccccagttcgatctgccacaccgccgtcggcagtgtctctgaatcggcgccacggcggtggaggagctgagtggcggaggagatggataaaggggaggaaagctgcggaggtgtggggggagggaggggtactgtgcg

SEQ ID NO: 14346 - DNA, 321 bp, Triticum aestivum
  unsure (1)..(321): unsure at all n locations
  Clone ID: PAT_TA_14346
gcgtccaccttcttcctccacccgcttccaccaccgagccgcgccgcacccgccctgaaaccggccgttgcgccaccttcgacccttgatccggccgccgcgccatctccgacccccgatccggccaccgcgccgctttctaccaccggatcctcccgcggacccaccttctccccctggatccgcctccggcggcccctcctcccctggatccgcccgcgggcggctaaccgcccatgctcccgccccgccctgggaacccactcaacctcccccccgatcggtgtccncncacnctcccnaatnctccccaaatngtct

SEQ ID NO: 14347 - DNA, 700 bp, Triticum aestivum
  unsure (1)..(700): unsure at all n locations
  Clone ID: PAT_TA_14347
gagaccaatctttatattgggtacccgcccccccggtttgatgattcagggctgatcaacctattttcacaatttggagagattgtcatggcaaaggttataaaggatcgcaacacagggcagagtaaagggtatggatttgtgaaatattcagatgtctcacaggctaatgcagctattgctgcaatgagtggttaccatcttgaagggagaactattgcagtccgagttgcaggcaagccaccacagccagctgccccccctggtcctccagcagcgccagcaccacagatgtaccactctgcagatccttctgctggtggctacaactcacagccctacatgggaggacatccaccaccaccagctcctccaggtagctatgctccagttccttgggggcaaccaccaccttatgcttcgtaccctccgccgccaccaccaggcatgtacaatcctgcacctggccaaactgctccacattcatatggtatgcaatacccaccaccaccagctccagtgcctccaccaggcactacgtcaaatgatggtgcacagaactaccctccgggtgtaacaccaccaagttctggtgcacctacccagcctgtccctgctccagcatatggggcctctggtgcgcaaaacatgccacatatgtaccctccaccaccttatggttatgccccatattatcnan

SEQ ID NO: 14348 - DNA, 1535 bp, Triticum aestivum
  Clone ID: PAT_TA_14348
tggacaacatataccttaccggaaccataagttgacaatgcttatgagtgattcacttggaggcaatgcaaaaaccctgatgtttgtgaatgtttcaccagcggaatcaaacccgcgcgtccctctcttcgctcctttgtcggctgcacgagttcgcttcggggtgacgcaggacctcccgcagtcttctggcaaagaaatcatgcggttgaagaagttgatttcttattggaaggagcaagcaggcaagcggagcgagggcgatgaactggaggaaatacaggaagagaggatatcaaaagagaaagccgacacccggttgaccgcatgagtgttagatatcactgcccttgcccgccctgatggcgcctcgtttgcgtgctcgccccctgcccctgtggtggcccagtgctgccgggcgtccacaatgccgatttagtggggtgtcccggggtcctctgactgtggtgcacgtcacagttgtaatcatttcaagttttgaagaattgaaaactataattacaagaggttctgagagaagacacacagctggaacaaatatgaatgatgagagctcaagatctcatttaatcctttcaataattattgaaagcaccaatctccaaactcaatcttatgcaagaggaaagctaagttttgtggatcttgctggttccgagagggtgaaaaagtccggttcagcaggaaaacaattaaaagaagcacagagcatcaataaatccctttctgcattggctgatgttattggtgctttatcttctgatggacaacatataccttaccggaaccataagttgacaatgcttatgagtgattcacttggaggcaatgcaaaaaccctgatgtttgtgaatgtttcaccagcggaatcaaacttggaggagactcacaactcactcatgtatgcttcacgagtacgttgcattgtcaacgacacgagcaagcacgtttcccccaaagaaatcatgcggttgaagaagttgatttcttactggaaggagcaagcaggcaagcggagcgagggcgatgaactggaggagatacaggaagagaggacatcaaaagagaaagccgacacccggttgaccgcctgagggcgacataccactgctgatgccctccctgaatgcacctggtttgcgttctcgcacccagccgcagaggtgacccagtgctgtcgatcattcacaacaccgacgcagcggatggaatgttccggtgtcatctgaaaatgttgcacaccaattgtatagttagcgattatatattatggcggcggcgcctgtttgtacaaagagcctgtagtacactttcataggagaagggatgaagagtttttaggagagaaaatcccactttcttttgtcgtcttggcggtgattgtcgcgccctctagttctatgtagacatgtcagcgctgggtacggttaccagtgttatcatcgatgatgaattggctgcaacgtgtttattactacggatataagcaattcacgaatgcctgccgtatgctg

SEQ ID NO: 14349 - DNA, 981 bp, Triticum aestivum
  Clone ID: PAT_TA_14349
gatttgtgggataccgacaatggaggaggagttcctgcggttcgaagaggacaaggcgatgggatgtggcaacctttcctcgacactacagaaactatacatgtgggaaaggaagcttcttcaggaagttaaggctgaagaggaggaaaggcttaagtatgataggaaacgccaggacctgcaaatattagatgagaaaggtgcagaaactgaaaagatcgtagcggctgaaaaggagataaggaacgcgtcgacaagaataagcatagctattcaggttgtgaacaccatctcaggcaagatcagtaagctaagggatgatgagttatggccacaaacatgtgagctcattcaagggctgatgcggatgtgggacgttatgttagaatgccatcagatccagctgcatgccatatcccaagctaaaaacatagactccatgatagatgctgcaaggtttggtgatgatcacatggacttgatcaagcatctagagcttcagctattggactggactacctgttttgccggatgggttaccgctcaaaagaactatgttagtacgttaaatgactggctgcggaaaggagttgagtatgtgcccgaggaaacggatgacggtgtccctccattttctcctggacggttaggtgcaccgcccatctttgtgatatgtaataattgggcagccggcgtggcgaggatatctgagaaggaagtcgtcaaggcaatgcaagccttttgcgccaacgttctccacctctgggagaagcacaggtcacagcaaaggcagggtatgatggctaataaaggaatggacagggacctgagggtgatggaaaaggatgaacaaaaaatgcgcaaggctctggaagcaaagaacaagaagcttgtcctggtttctgatcagacaggcgtgtccttgtccgcgcaggtgttacaaggcgcaggcccccaagccgaaaacagcagtctgcagtc

SEQ ID NO: 14350 - DNA, 521 bp, Triticum aestivum
  unsure (1)..(521): unsure at all n locations
  Clone ID: PAT_TA_14350
gaaacatgtagccattgtgtgctcacctacgaagtctctttgggcaaagccaatgcgttcctcttccttggtgaaagtgtgtgtgtgtacgtatgtgttttctgtgtagtgttgttcttgttgagagaaacttgagagagatagaggtctagctgtgagaggcagcaagaggtagaagaagaagcaagcgctgcgaggaggcagcgccaacaattggtatcaagagccaggttggtccgtgatagccgacggcggcgcggttcctctccatgttgaaggtggagggtgtccccgccgcgaaggaggaggccggcgaacggcgcgatgccccctgatgtccggcctgcggtgcgattgccgnctagatggagatggcggcgcgaanntgccacaagnaagncancggtgttacgcccgtttgggaaggtancggcggtngccnaaagccgttcatgaaggattcgggcgntcnagccccgttcgnacggtgctgtctanagggtggtgtnantgncatcaan

SEQ ID NO: 14351 - DNA, 695 bp, Triticum aestivum
  Clone ID: PAT_TA_14351
caagttttccactttcttgtacggcccatcaggatgtggaaaaagaacggtagtcaggcatgttgcgaaccatcttggtatgcatgtggttgagtgttgctgtcatgatctgatgacatcatcagaaagcggggcatctgctgcacttgtggctgccttcaaagaagctcagaagtattctccttctataatacttcttcgccactttgacgcaattgggaatacatcctccaatgaaggcccacaatctgagcaatctggcattgcagcaaatgttgagtctgtcattaagcagtacactggacagcgttgggttgtgaaagactcgctgccagcaagggatgtgattggaaattcataccttgtcgaacgtgaatgtgtaagctccgttcaagttatactagtggcaactgcagacagtgctgaaggaatgcagcaatcaattaggcgatgtttccgccatgaggtcaacatgaagactataaatgaagaccagaggaaaaacttgatatctgaaacactccatggtgtctcagcagttgccgatgagagtatcgatgacaagttcgtaaaagatatatcagtgcaaacgtctgggttcatgcctagggatatacttgcattggtcgcagacgctggtgtgtcatttgcgcataaagttgcagtggagaaaagcagcaatgatgagcttgagg

SEQ ID NO: 14352 - DNA, 724 bp, Triticum aestivum
  Clone ID: PAT_TA_14352
gcgcaccattcaagccaagcaagcagtggtcaatacaaatccaccatgaagacctttctcatccttgccctccttgctatcgcggcgaccaccgccacaactgcagttagagttccagtgccacaattgtagccgcaaaatccatctcaacaacgaccacaatagtaatttccgttggtgcaacaacaacaatttccagggcagcaacaaccattcccaccacaacagccatatccgcagccgcaaccgtttctgtcacaacaaccatattcgcaaccgtaaccatttccgccacaactaccatatccacaagcgcaaccatttccaacacaacaaccatatccacaaccgcaaccacagtatccgcaaccacaacaaccaatttcgcagcagcagcagcagcaacaacaacaacaacaacaacaacaacaacaaatccttcaacaaattctgcaacaacaaatgattccatgcagggatgtcgtcttgcaacaacacaacattgcatatgcaagctcacaagtattggcacaaagtaggtaccaactgggtgcacaaattatgtgtcagcagctgtggcagatccccgagcagtcgcggcgccaagccatccacagtgtcgttcatgctattattttccatcatcatcaacaacaacaaccgtcgagccaggtctcctaccagcagcctcaacaacaatatccatcaagccagggctccttct

SEQ ID NO: 14353 - DNA, 583 bp, Triticum aestivum
  unsure (1)..(583): unsure at all n locations
  Clone ID: PAT_TA_14353
tngggcgtcatatgagtcctaactggatatattatcaaccacaggatcaagcgatcaatctcaacatgtcacaaaatgatctctcaagtcttgccgcacgagtataaactcttaatgaccacaacacggctggggcagaccacccagcaagcagagtcgacgacaccatccggttctaatctgagtataaaacaaaaatgtaacaacagacaacatctattgctcctgttcgagctcgcttttcagttcccagccgagaggagaagatgatcaatctccacggatcaaaggttggttctcgagaagcactcgttcgctgccctatcgcttccttgaccgcctgggcgccgcctcctcgtcgctctcgctgtcgtcgtcccggaaggcactcctgccgaacctgtccccggactgggacctgttcccgtccgctccggagttcccggcgttgttgtcatggcccctgctcccctggtcagaccctgtctcgtacctgtcaccccggttgttgtcgccgcccggcctcctctggtcccgtttcgcggggcggggaggcggcggcggcatgaagggggccatgccg

SEQ ID NO: 14354 - DNA, 955 bp, Triticum aestivum
  unsure (1)..(955): unsure at all n locations
  Clone ID: PAT_TA_14354
gattcggacgaggcactagagcacaagcagaaaatcaaagtacgtagtagttaacgcaaatccaccatgaagaccttactcatcctgacaatccttgcgatggcaataaccatcggcaccgccaatatccaggtcgaccctagcggccaagtacaatggctacaacaacaactagtcccccagctccaacagccattatcccagcaaccacaacaaacatttccccaacctcaacaaacattcccccatcaaccacaacaacaagttccccagcctcagcaaccacaacaaccatttctccagccccaacaaccattcccccaacaaccacaacaaccattcccccagactcaacaaccacaacaaccatttccccagcaaccacaacaaccatttccccagactcaacaaccccaacaaccatttccccaacaaccacaacaaccattcccccagactcaacaaccccaacaaccatttccccagctccagcaaccacaacaaccttttccccagccccaacaacaattaccgcagccccaacaaccgcaacaatcattcccccaacaacaacggtcattcattcaaccatctctacaacaacagttgaacccatgcaagaatatcctcttgcaacaatgcaaacctgcgtcattggtgtcatccctctggtcaataatctggccacaaagcgattgccaagtgatgcggcaacaatgctgccaacaactagcacagattcctcaacagctccagtgcgcagccatccatagcgtcctgcattccatcatcatgcagcaacagcaacaacaacaacaacaacaaggatgcaatctttttgcccaaattccgccgccccgaccggttggccctgttatccccccggcaggggctccatccaaccaacttaacctccggtgggggaaatcggtgtttcctttttacncntngaaga

SEQ ID NO: 14355 - DNA, 552 bp, Triticum aestivum
  Clone ID: PAT_TA_14355
cgccgccgccgccgcccccgaattcgccagccccgaatccgtctacatgacctaattactacacccccaaatccaattcggactcgatgctcttacaatttatatttattcagccggctcgatcgatctcttcatacaaatatttcgtttttgcagatccatagatttgcaaatctaagtgattcctcctgcagagcgcaagttcgatctacgaattcggagtttcaggacttatggctctctctcacgaggaggtggagcaggaggaggaggaggacgatgatcttgacgacggccccctaagccccgaggatgtgctgcggtctgttgagagtgttggttccgtggagcctgccaagaggaaactgttgatgaaagacactatgggggttccgcccgaaccctatgactggcccaacatctgcccgctccccgggtcgtccagagatcggagctctgcgtgtgatctttactggcaccaggcctaccagatgaatcaagcctccgcggcctgcctgccttctatgcggtatactcgctgttgcaatgaag

SEQ ID NO: 14356 - DNA, 821 bp, Triticum aestivum
  unsure (1)..(821): unsure at all n locations
  Clone ID: PAT_TA_14356
attcataagaacgagggtagccacctttttagcattgggattctttataacaagtaactcataaaacaatctttgcaaggtaggatgggtatggatgaatttattttanagtttcagaactagtgccgaaatagcttctgcataagattttgttattctaagtataggagcatcatgaagagttaaatttcagacacaattgaaaaattcttggatatgttcttttctcataatattcccttgccccaaaataaaagttttagcatccagattgccagatcgtccaattttaggagttaggccatcatctgtttctgccatgccaaagttactcatggtgacaagatcatgcactcaaaaagagatctgacgagaaaacagcgaacgaaaaagggggcgaataaaacagcaaatttttgtgaagtggggggaggaaaatgagtggcaaatgggaaataatgtgaattgcaaggagatgagatttgtgattaggaacctggtagatgttgatgatgtctccccggcaacggcaccagaaattccttttgatgtttgcttgaactacgtcggtatttccccaaagaggaagggatgatgcatcacaacaacggtaggtatttccctcagtgatgagaccaaggttatcgaaccagtagaagaaccacacaacaccacataaacagctcctgcatacaaagaacaaatacttgcaacccgacgtaagagaggggttgtcaatccctcacgggtaaaaagatagataaaattgtagtagattggataaatagatctcgcgggaacgtgagataaaataaataaca

SEQ ID NO: 14357 - DNA, 610 bp, Triticum aestivum
  Clone ID: PAT_TA_14357
ttcggcacgaggcgggcacgtgccctaggcgcaggcggaaatggaacaaagaaactgatgtagtcggcgctcggccgcgtcgggtggcgtttccgcgccccgcgcccccgcgccggcgcccccttcccggccctcccccgcaccgcctccgccgccccccctgccccccgccgccctccagtcggccgccaccgcgcctcggatccgatggacacgggcgcagatcctccacgccaccgccggctcaggaaggcctccgatctccgcaccgcccccgccgcatacccacccccgaaacggatccgcccgggcgaggagcacaacagttgccgcgaggacaagatcagcagcttacctgacgagatgttaatcttgatcatcgacaagctagatgcacggacagcgacagccaccactatcctttcgaagcgatggcgggatctctatacacactcgcacacaggttatgaccttacggttgatgacattctccctccacggtaccacagactgaagcaaattgtggtggaggctgaggcagggtacgaggcagagaacaatgcactgaagtcggacggcagtgatgcttctagagactggttatattcct

SEQ ID NO: 14358 - DNA, 1147 bp, Triticum aestivum
  unsure (1)..(1147): unsure at all n locations
  Clone ID: PAT_TA_14358
tccttttcccgagccccagatttgcgcgcctgtgctaggtcaggcctatggttccgtcagaggtcggggtcatggaccaccccccaatagaagggcttactcaagcgcatcaagctcaactcagcatgtagtgggagaattggcctctacaaaggagattgttgctacgcagcaaactccaattgaggctccacaatctcaccttgaagctcaacagaagaagatcgattggctacaaagtgtcgtgtctaacttggttggcatttcacctcctatggacggcactagtgcaacagggctaggtttcacaactgagcggccaatgccatctaatggaataggttcgctgatatctaacactgtagaaaggatgtcaagttttccaagatcatttgcaagtnatttgaggccaggatatagacctgctccaacttcttcttctgatggcaatggctctctggtgtcggatggagggtccaggtattcatgatcaggttgctagctttattttatgttgtttacctcaccaaccaaacacgctcctgccccccggcccccgggccgacacgattcaatgctgcactttccctgcttttcgtgcctgctaccacatctcaagaaaggcacattgcattgccgattaattctctgccttacctagtcattctattagttaatccccggcacaagcttgtctttctcgtcttgggcgaatgacacggcttggcactagttaacttgccatttcttcattgacgattagctagccttaaacactactggcctctgaatttttgggtgtgccggtgcacctagatccaccccgttgcttcttcaaaatgccagatcaatctacttatctgactgaattctcttgaccacatttactctcgcttagtcgagttctgccaccacccatgcactctggttattaacaccagtttaagttaatttaatgcgctcatttttatttgattagtttgctgcgacgctgataatattaagtgtacgtagattagctcaagtcttggatgtaatcacgtatgcagtctgtttacttttgctagacctgacctgaccatgttccttaatgttggtttcacacgattcgttagttcattatccagcgacgtctcttggtggacaa

SEQ ID NO: 14359 - DNA, 643 bp, Triticum aestivum
  Clone ID: PAT_TA_14359
cttcttgaaggcgatgccaccatgcactggctcctccttggggcttgtaggcgaccaaggaaactctacgatcttccggaatctccatgacctcaaagaaagtctccacttcatataaccaatcacggcacccttcaatatcaacatttccattaaaggttgggatctcagctctcaccttgtctttatcccttgcatatgtagggttgggtactctctgatatgcatagagattaagttcttcaagggcatcatcatattcttcaccttcaaaagcttcaacataaattggccttcttgaagcacactgaactgcacatttttgtggtagtcagtaatcttgctccaagattacctcctcttcttccctgtcgaacatcttattcatcctttttttttgacggaaaggacagtaggaaaggctcctactgtgttttcatatatatgtataaagatgttacacttttacatttttacaaacaagttcctcccaacccaaacaagcttgggttaggtaggggaagagaaggagctacttttagtgtagatcagaaataaattttctttgttggcagcatccatctcttctccaattgcttcattgcttgctgcaactccactatcaaagagaacaacaagaact

SEQ ID NO: 14360 - DNA, 1255 bp, Triticum aestivum
  unsure (1)..(1255): unsure at all n locations
  Clone ID: PAT_TA_14360
cgtccgcacctctcctctcctccgcccccctcttctctacggcctccaggcccgcgactcgccaacgacctaatggcgaaaaagggcaaggccgccgccgccgccgcttcagcgtccgactcgggggcgtcgagcccccagggctccgtcgagggcggcggggagaaggagggcggcttcctgctaggccagccgacctgggaggacgccggcggcgggcggtggcggtgcgcggagaccgggcacgagctgccggagcgggagaaggacgcctacgcgcggtcccgcgcctgccgcctcgcgctcatcgaccacggcgtcgcgcacaagaagccgccgctcaacgccttcaagccccacccggagcacaagtccaagcttgtatgcaacattaccggggacaccataaacnaaattcgggaggagcacatctggaagacatgttaatgggaaagaggtttcctgaattaaacttcaaaagcgcgaggaggggatggcatcgggtgagacgggcaaactagggcgtgaactgtcaaggggagtcgcatccaaatccaagtcccccaagaagaaggacaagaagaaggagaagaaggagaagaagaaagctgttgttgtcaacccttctttgccacgagaacctgaaccagaaattgatgattcagatgattcggaattttgggtgcctcctgttggaagtcgttgggatgatgatgacgggaaagaccgatgggagtcctctccggggaaggatgatatagcagaggatgaaggtgcatccgatgacgaggacgacgacgaaatggctgacaaggatgatgaagtgtcggaggaactggcttcaagcaggacaaagcgattgtcagtggaagctgttggaccaagtagtttcgctacaaggaagaaaaagccccgaaaggacgagtagacggttatttttgatttattctgttagctatgcatgagcttgtttcaccttgcttcatttggagccgcgaacttcactttctttgttctccccgtggaggctttgggttggctaatcaatggccgattttgtattagttaactcgtgtttccttggtttttctcagtgctgtcacacacgctgcttgctgcaacatgatgtgtgctaactgagcagcctttcgttagtggtaatgaacagtaatggccatacttcgtcgcctacactttgtgactatccttgatcatataagtttgacgtaggaggaaactgtgtttttttgttttc

SEQ ID NO: 14361 - DNA, 839 bp, Triticum aestivum
  Clone ID: PAT_TA_14361
cggcacgaggagtgttcaccagcaccatgtggcgggagatcctcaacgccgcgggcaccaagcttctgtactccacggcgtactacccccagacggacggccaaacggagcgcgtcaaccaatgcttggagatatatctccggtgctccgtgcacgacacaccctagccatggcgccggtagctctctgcagcggagttctggtacaactcctcgcaccacgcctcgctcaactgcttcccgttcaaggcgctgtacggcagggagcccaacctcggcggcatgccagcgggcaacaccaacctgcccgcggatgcgcccctcgtcgagatcgactgggcgacacacacggagctgctccgcgctcagctcgcgcgcgcccaggcgcgtttcaagaaacaagctgatcgccaccgcgccgagcgcgctttcgacgtgggcgaacaagtctcctcaagcttcaacgcctacgctcaaacctccgtcgccaaccgcccgtgccgcaagctggcatacaagttctttggtcccttcactgtgacggagcatgtcggcacgttggcgtatcgcctgaacctgccacccgacagccgcatccaccccgtcttccacgtctcgcaactcaagccgttcgtccccgactacacacccgtcttcgccaagctgccgaagataccggacctcactgccactgaacgcgttccggtcgccattctggaccgccacatgatgaagaaaggagacgccccagtcgtccaagttcaggtgcaatggagttccatgccgccgtcgacagcaacctgagaagactactacgtgctccggcagcattacccggac

SEQ ID NO: 14362 - DNA, 321 bp, Triticum aestivum
  Clone ID: PAT_TA_14362
ccacgcgtccgcagagagacagtacacagctcagtcgcgggcgcgcagcgagatcgccacgctctcctccactctccagcgagcgcggagccggactccaaggcggccggcggtccggcgctcctgctccccgcgccgcctccgcgcaatgctggccgcttccggcccagatcgggccgactcctcaccctcctcctcccggccgcggctctcgatcggcgcctgactccgggtgagcggaggacggctggatcttgccgcggacggcgcgagggagggacggacggacgcgctccgccgtctcccgatttccgcctgcca

SEQ ID NO: 14363 - DNA, 1112 bp, Triticum aestivum
  Clone ID: PAT_TA_14363
gtgaatcagacgggggttggatccaagaagagggtggggaggctacatggaggcggcgatggatctgatgcggcggatgccgccggggagcaccgagacggcgctcaacgcgctgctctccctcctccccgaccactccctcgacctcctctcccaggtcgatctcccgctccaggtttgcatggataaggagaacaataaggaatacattctttgcgagtataaccgcgacgctgattcctatcgatcaccttggtcaaacatatatgagcctcctttagaagatgggacagttccctcagaagagatgaggaatcttgaagtcgaggcaaatgaggttttctctgtctaccgtgatcagtactatgaaggtgggatctcatctgtgtacatttgggaggatgaagacgagagtttcattgcatgcttcttaataaagaaagatggacaagggaaaagaggttatatgcaaataggttcgtgggatgctattcatgttatccaggttggtcctgaagaggaaggagcagcacattactgcttgaacagcactgttatgctgtcattgacaacagataacaagcaatcgggaactttcaacttgtccggatcaattaggcggcagatgagcatgactctcgctgtggcagatgggcatctggttaacatggggaaaatgatagaagagatggagggcaagctgagaaattcactggaccaggtctattttgggaaaaccagggaaatggtttgcactcttaggccaccgcctgaagtacttaacatgagactacccgacagctgatcagatacattgatagcaatgccaatttaatatcgcgctttatctctagtgtcatatcactttccgcatctgtatctgtatttaatcacaacagagttttcttgtcctttgatgtgtgatgacgaactgggtattgcaaacggtgccggctgcaaaatactccctacgttcctaaatataagtctttttagacatttcaaatggaatacgacatatggatgtatgtagacatgatttagagtgcagattcattcattttgctctgtatatagtcatttgttggaatatctagaaagacttatatttg

SEQ ID NO: 14364 - DNA, 609 bp, Triticum aestivum
  Clone ID: PAT_TA_14364
acaggaacgacgcgcctcggcttgggcggcggttcttggacggctccatttcgtggcggcggcaatggacggcagggccggcggcggcggtagcggcgactacatttccagcctcctcacctcgtcgccgatgctcgacttcggtgtgctggacggcgccgtggcggcgggcggggactgcctggagaagttctgcggcgacccggggttcgcggagcgggcggcgcggctgtccagcttcaacgggcagcacttcacgccaggggctcttcgggatgccgccgccggcgcccggcgcgggcaacggtgagttcggcggctcgcgggaggcgtcttccgtgtcagaccctgcctcggcgatgaaggacgccaatgccaagaagaggaaggcgcccgcgggcaaaggcaaagccaaggagccttccctcagcacctcttgccaggtcggggagcagaaggagtcggacggcaagaggtgcaggacgggcgacgccgagaagaaggtgaagcccaaggcggagcaggccggcagcgacagctcggtggaggacggcgagcagaggaagggcggcaaggggaagaatgccaagccggtggagccccccaagg

SEQ ID NO: 14365 - DNA, 575 bp, Triticum aestivum
  Clone ID: PAT_TA_14365
cgtacaggctgcgcatcgccacgggcggcctgcggagcacgctcggcgttcatgatccaggaccacaactgtgacgctcgtggaggtggagggcacccacacggtgcagaacacctacacctccctcgactgtccacgccggccagtcgctctccgtgctcttcaccgccgaccgccccgccgggggctaccacatcgccgtctcgtcgcggttcaccaaccagaccctcaactccaccgccgtgctgcgctacgccggctcgaccggccccgtctccgggccgccgcgtgccgggaaccagagcgacgttgacttttcactgaaccaggctcgctccatcaggacgaacctgacggcgagcgggccgcggccgaacccgcagggctcgtaccactacggctccatcaacgtgagccgcaccatccggctggccaactcggcggggcaggtcggcggcaagcccaggtacggcgtgaacggcgtgtcgtacgtggacgccgacacgcccctcaagctggcggactactacaacatcagcggcgtgtaccggatgggcgccatcccggacgcgccc

SEQ ID NO: 14366 - DNA, 633 bp, Triticum aestivum
  Clone ID: PAT_TA_14366
acctttcggtgatccgacgccggtcgtttcccttggggaagctggagcgtacggtggccgtttcatcaagtactactaggagcttcaaatcatattctttaagatcattgtcttctaaactttgaacttccattttttttttgattaaaatctgatctttacttgctgaacacgctgaagcatcaatggccatatcatcaagtactactgaaagcaacaaatcataatctttaagaacaatggcatataaacttaagaacatcaaaggccatacacaggcatgcatcagaatgtaccaacaacacctagggtgcaacacaaacatcacttaaattcggtttctgcttcccaacatagtttcagtttcgacgccgacgcacatgcatacttcagttccatcgcatccctcttctaggtaggcaactcatccatttcgctccgaagccacatgaccgcactcacttctcgggggagaaggccagctttccctaggaagaagaggaagcaggcgtccgacggcgttagcagcgacgacggcggctgcgcgcggttctcgccgtctcttgtgaccgcggccgcgtctcctctcccccccgcccgcggcgcgtctcccgcccgcatgaggcgtgtgag

SEQ ID NO: 14367 - DNA, 542 bp, Triticum aestivum
  Clone ID: PAT_TA_14367
cgtccgcggacgcgtgggcgaccatcgcgcggtgcgcatcggcgggcagcggaggatgctcgtctcagcaggagtacactacccccgcgccacacccgagatgtggcctagtataattgcaaagtgcaaggaaggtggtgcagatgtaattgagacatatgtcttttggaatgggcatgaaccagccaaaggtcagtattactttgaagacagatttgatcttgtgagatttgtgaagctggttgctgccgaaggcctattttttctccttcgtatcggcccatatgcttgtgctgaatggaatttcggtggtttcccagtttggttacgtgatatccctggcatagaatttcgtactgacaatgagccatacaaggctgaaatggagacttttgtgacaaaaattgtagacatgatgaaagccgagaagctttattcttggcaaggtggtcccattatattgcagcagattgaaaatgagtatgggaatattcaaagcaagtatggtcaagcaggcaagagatatatgcaatgggcagctc

SEQ ID NO: 14368 - DNA, 630 bp, Triticum aestivum
  Clone ID: PAT_TA_14368
gttctagggttggagcagcagctgagcttagggcaagacaagcacattagttgaatcctgaactgataggatggtttcccctgccacaaccattgtcatcggcctgcattcccttgtcaagcgtgcatcggtgctggatatgcaagctgcaacagtgcatcaacgggcaggcaagagcaagacgatggtcatgatttttggtttgaagttgcttttatgaactccaagcagtggaagacaatgttaactgaagccacttttgttggtcatggatttacaagaaagccagtagagtatgaaaaggttctcatgggactcaccctgaactgaaatctgtgttcaaccttggtataattctgtgacaaaaaccccaagtggtccaatattttgtttatttagtgcctgttgtttttggtttgttataaccgaatttacaacctactattcatgcatttcttttattctgttttggtgggttctaaactatgaaattaggactatagtttattagttagagacctgcttctggataaagaatggaaggaagaattcttacttcatgatgacacacatgattgtcaaactacagaaaatacttgacttatgtactggatgaattcccgagttcct

SEQ ID NO: 14369 - DNA, 833 bp, Triticum aestivum
  Clone ID: PAT_TA_14369
gcacgaggctgtagtacggagtagaagatagatcgatctagggttttcttccgtcaggagagcggcgatggcggagacgcaggcagaaatcgattcttacattgagctttactgggctgataggatggaggcgttcttggaggaggaggaagcggaggtggggacgccgtgaagggagagtggttccggcggcgaaatgaagaaaaggaagacggcggcgggagtaggctcgaagaaggcggcggcggcggcggaggatccggtggaggagagcgacatccaagaggggccagtggagtcgatcagtacagcgaaatcgaatctggcgaggacaaaaaagattctaaacgcaaagattgccaagcttgtgggagtggagagcggggagggcccccattataagaccaagacgatgaccgaggaagacgtcgcggcggcagccatgtacagagccaagggggaggaggcgcacaggaaccaggatcggaagggggagctggacgccgtcatcaagtggatcgccacgggagatcccgaggcaatcaggatctcggaccagtggatggctgaaaatgtggaggccatgaagctggagccaaaagatcctaccgactggctggacgaacaagccaaggactaccgtgaattctgggatcttcattgggctggctccttcggtaaatgggaggatatcacgcttattcaacccatgctttacacggacgggaagcctccgcaagatgtgtaccctatccgaactctgcaggtcttttcggtccaagttgcagccatcacagaggaattggggtggccactggatgtctttggtatcg

SEQ ID NO: 14370 - DNA, 567 bp, Triticum aestivum
  Clone ID: PAT_TA_14370
tcgacccacgcgtccgcgtgcttgtccctcccttccctctcccccgagaaaccctagaccccccgtccctcggcgtcggcgtcggcctcgcggagggtcggcagcatgtcgccgcaggcggcggcggcgctcgggttcctcctgcccacctgctgggagatcgaggtcacctgcgccgcggccatgctcatcgtcgcgctctacgccgcctacgagctcctcggcccgcgcgccccgcccgcgggcgccgacgacctcgccctcgcgcgggacctcgacggcgccgacaagtactccacggggccgtcggcgtacgtggtgaagctggagctgctagccgcgaagaatttgatcgcggcgaacttgaatgggacctcggacccttatgcgctcatcacctgcggcgaagagaagcgtttcagctccatggttcctggctcaagaaacccaatgtggggagaggaattcaattttgttgttgactctcttcctgtaaagatacaggtgaaaatatatgattgggacattgtatggaagagcacaacacttggttctgttactgttcca

SEQ ID NO: 14371 - DNA, 583 bp, Triticum aestivum
  Clone ID: PAT_TA_14371
cagcgtcctctctctgcgcctggaacgctccacgcgcgctcaccggcgcgcttgccagcaccacgcagtgctcctcctgtagccacgctgaagccgtaggcggcgggaggcggcgaggtcgcccacggcagagtaacaacaacacgctactgcacatcacctgggcagaagacatcaacaaaggcgtccgcccacgcgtccgatcagctagttttgtttcctcggaaaaaaaaacagatattggtcaactcctgtgaaatcaatgtggagggtttcctgctattcgtcaggaccgtttgaccttgtttctccagaaacgttgtgggagagtctcagaccagctatctcgtaccttcaacctgaagagttgaacttcgtacatgacgctttagagttagcatatgaagcacataatgggcagaaacgccggagtggggaacctttcatcattcatcctgttgaagttgctcgtattcttggggagcacgaacttgactgggaatcaatcgctgctggtttattgcatgacactgttgaagatactgacatggttacttttgaaacaaccaaaatgagtttgggg

SEQ ID NO: 14372 - DNA, 562 bp, Triticum aestivum
  unsure (1)..(562): unsure at all n locations
  Clone ID: PAT_TA_14372
gcggttatgagtggggccgtagcaacaaggacaatgggagcaacccacatggttatctcccaactcactacgagaaggtccagatgcttctcagtgaccgcttccttgggttctacatggttccggacaacgcgccctggaactacaacttcatgggagtcaagcatgacccattgatgaagtacagcatgaagctggggacgccccgagacttctaccacgaggaccacaggccgacacacttcctggagttcagcaacattgaggagggcgaggttgctgagggggacagggaggacaccttctcgtaggcaccgtagcatgccttgcgccgaattttgttagcacatcgaaactagctattaactacgcagttttgaaatagagacatttgtaacctgcaaactttgacttgatatgtggtagtatgatgtttgtctgccccttgagatgctataacttctgttgcaagcctgctctcaagttgggtaatgtacagtgtacacgcatcataacagtgaatattttgcttagtggcttanaaaaaaaaaaaannnnaaaa

SEQ ID NO: 14373 - DNA, 2945 bp, Triticum aestivum
  unsure (1)..(2945): unsure at all n locations
  Clone ID: PAT_TA_14373
ccggtcccggaacctcccgggttcgaccccagccgtccgaatttgggctgagctttgaagcggcaggaagcacagtcgcacaataggcgcttaacacttgaggatctcgaagattcatgggatagagacataacactattccaaaaagaccgccacactttggcctatgactttaagcagtatgaagtgctgaaacagaacccattatggtgtgacatgatggaaagctatggagtctgaacaactacagaactgacatcatccaaacacttggtggtgtggaaggtatcctggaacataccttatttaagggaacatactactgtatttccctacttgggagggtttgttttgggagaaggcttcaggttttgaggaatcaatcaagtacaaaaagctgacaaatgcacagcgttctgggcctaatcaaatccccaacagaagatttaccctatggtgggcgccaaccatgcattaatcgtgcacacgtatatgttggtttccactttccaggttcagctagaatattaactggttccttggcgggtcaacgggtctgcagcgccgcgcaccctcgccgcctgcccagcagctgattcggtgatgtgcgtgatgcggcccagcggcgcggcagcgccgtggtccctggggcggacgtgcacccctaccacgaccgagacgccctcccaacaccggcgccagtcgtctcccttgcgcacagttaaaagcacaaccccccgatccacgatctcaagcgcatctctctgcagcgacaggttgaacctcaaccgtgggcgttgttagcatcgtatctcacagagcatgagtattttacggactgcgagccgatggactgcatgcatacccacccgaagtaagcccctcctctatccccccaggattggaagcaatgaacaagatcatgaagccaaatcctgctctgtatgtgctgagggagagacaaagaaagggtcatcagttgtattcaactgaacccgccgagccacatcagtctgcaccgaactaggtagggatattcccaagtcaactaatagggtttgtgcatcacacaaatgtgcatcgatttacaattcacaaaaccttcgagggtaacctgccccccatacctattaacgttgctacctttgttctcaactccgtggctatgcaactacatcggaatctagcacgacccactgtttgggcaggacaaaaaagcctaggacagctcgccaagtgcaaaactgcaggggcgctggccgcgttacttcggggtgttcatgtagaagaggagccatggcaaatcatagtgggaaagaagggtatgcttgatgtagtggaagtcaatctgcttgatttccccaacattgtcttcaatggcagtgagttgaagctgccattccaagcttgcttgaagattgacaaggatgtgtgatctttgacgcgaaggcttctgtgtcgcagatggtccctcatgacatatacgatgactggtaagacaccttctcgcacggcaccgcattctctcgtcttgtgcttatattacgagcattacatgtcaataatgagaaggccaagatgttgctgaagcctgacaagacaattgttacggaaccacatcatatctggccatctttgactgacgagcagtggctgaaggtcgaatgtgcactcagggatctcattctttctgattatgcaaagaaaaacaacgttaatacttctgcacttacgcaatctgagattcgtgatataatacttggtgctgaaatagctccaccatcacagcagaggcaacagattgctgagattgagaaacagtcccgagagacaaatcagttaaatgcacagacaacaaggacaactaatgtgcatggagatgaactcatcgtcacaacaaccagtccgtatgagcaagcagcgtttgcatcgaagacagattggcgtgtcagggccatctctgctacgaacctgtatctccgtgtcaaccacatttatgttaactcggatgatataaaggagactggctatacttacatcatgccaaagaatatattgaagaagttcatatgcatagcagatctgcggacacaggttgcaggtttcctgtatgggctgagtccacaggataatccccaagtcaaggagatcagatgcatatccattccgccacagcatggaactcaccagatggtgactttgccagcgaatctcccagagcatgagttccttgctgacttggagccgttgggatggatgcatacccagccaaatgaagctcctcagctatcacctcaggatttgacatcacatgctaaaattttggagaacaacaagcagtgggatggtgagaagtgcatcattttgacctgcagcttcaccccaggatcgtgctcgttgactgcatacaaactgacaccaagtggttatgagtgggcccgtggcaacaaggacaacgggagcaacccacaagggtacctcccaactcactacgagaaggtccagatgcttctcagcgaccgcttccttggattctacatggttccggacaacgctccgtggaactacaacttcatgggagtcaagcacgacccgctgatgaagtacagcatgaagctgggcacaccccgcgacttctaccatgaggaccacaggccgacgcacttcctggagttcagcaacattgaggagggtgaggtcgccgagggggacagggaggacaccttctcgtagtcatagccatcatagcacgcccctccgccctatgctagcatatcgaaacctgcaatgagatcggctcagttttggatggagatctctgtgacctgtaaactttgacgtgacatgttgtatgttgttctccgtctctcaagactaatactttgtgttgtaagcctccttcaagcacggtgctgtacaagtgcatcatgataaacagttaanac

SEQ ID NO: 14374 - DNA, 1273 bp, Triticum aestivum
  unsure (1)..(1273): unsure at all n locations
  Clone ID: PAT_TA_14374
cgccccgtgattgatggtttgggtgttgctggctggggagttggtggtattgaagcagaggctacaatgcttgggcagccgatgagcatggtgttgcctggtgtggttgggttcaagttgactggaaagctaaggaatggtgtcactgctaccgaccttgttctgactgttacccaaatgctaaggaagcatggtgttgttggcaaatttgtcgaattccatggtgaaggtatgggcaaactgtctttggctgacagggccacaattgctaacatgtcaccagaatatggagctaccatgggcttcttccctgtagaccatgtgacattagattatctcagattgactggccgaagcgatgaaactgtgtcaatgatcgaagcatatctacgagctaataatatgtttgtggactataatgagcctcaattagaaagagtttactcttcgtatcttgcgctggaccttgatgaggtagagccttgcatttctggcccgaagaggccgcatgaccgtgtcactttgaaggacatgaaatcagattggcatgcttgcctggacaacaaagttggtttcaagggctttgcggtgccgaaggaacaacaggataaggttgtgaaatttgactttaatggacaacctgctgaactgaagcatggcagtgttgttatagcagcaattactagttgcacaaacacatcaaaccccagtgttatgcttggtgctgcccttgtcgcaaagaaagcttgcgaattgggtctcgaggtcaaaccatgggtaaagacaagccttgcccctggatctggggttgtcactaaatacttgctaaagagtggccttcaagaatacttcaacaagcaaggattccatcttgttgggtatgggtgtaccacttgcattggcaattctggtgaactccatgaatctgtatcagctgccattacagaaaatgatgttgttgctgctgctgtgttgtcgggcaaccgtaactttgaggggcgtgtgcaccctttgactcgggccaattaccttgcttcaccacctctggttgttgcatatgcacttgctggcactgttgacattgattttgagaggaccattganttggaaggatggaagaanttctcaggatatatggccanactaagaaccaagtgtcatcaagtntgccgaattcaaacaaatcaggcacaaaaggaccattggacactcntcaaanacncaccnganaancataacaacncactagnagcanccncgcaacggaaacatg

SEQ ID NO: 14375 - DNA, 781 bp, Triticum aestivum
  Clone ID: PAT_TA_14375
ccaaggaccccgcctcggcgcctccgcctccgcctccgcaggccccctccccggacaaggagaaggcccgccgtcccacggatggcggtgccggaggcggttcgccccagcgcccccctcagcccccccggatcctccgcgcccgccgcgcccccacggccgcccccggccccggccggccggcggccgccgccgccgcgccgcccgagcttccgccgccgcgccctgcgcttcccgaccagcgcggggtttccatcgtgctgcccagggaggagatcgcccaggactttgccttcttccgcggcacgcgacccccgcgccggccccaggaagcgctctcgcccggtgcagcgccagctcgacttgctgtgcccttggattgtccctagaggatttgacgccggactcgtaccaagatcggaggagaggtgaatgctgatatggcggagattcaaatgggaagggattcaggatgtggtcatctcttttgttctccgatgttcttgatcgcgtttctttcttatgtgaatggctaaaaatctcttgcttcataactcagaactgtgttatggtggaacattttagatgaagttcagtgtactatctctttagatgatgtgttgccatggagttggtgagtagtttaaagttaaagaatttggttattgggcttgtaggattgctaattgtatcaaggttatgatccttagtggggtgtacttgtcctgttatgtatacatgggtaatgatctatgaaggtctttttatatgaaaaaaaaaa

SEQ ID NO: 14376 - DNA, 1172 bp, Triticum aestivum
  Clone ID: PAT_TA_14376
gaattcggcacgaggcgaactcgaagattatcttcagagattatcaaatctcccaaagttgtttgaccgcaatcctatttctatgactgataagttagttgaactctatctggagcttctgtgtcagtatgaaccaaggtcagttctgaagtttctggagactttcgatagctacagattggagaggtgtttgctcctttgtctagattatggagttacagatgctgctgcatttctgcaagagagagttggtgatgttgcgagcgcgttggaacttgttctagctggactagatgagaaagttaaccagtttatcgcttcggtggaaaatgcgttctctcggacatcgtcaaagagtatctctgaaattgagcaaccagacattgttctaaacatgagcgaggctcatccagtgcttgatgtgttacgttcctccattggattgtgccaaaggaattcacagcgtttagatccagaggagtctcagttactttggtttcaactggttgactctttctcagatccactgaaaaagttgtatggaagcaaagttgtaaatggaaaaggttgttggtccgtgggtggtgaaacaacaaatggacatcaaacaggcaaaggattctcacaaaaaatggtgaattcagcttatcaaaggtgtttgaatactctgcggagagttttctcacaatttgttggagagataattgaggcaatggctgggtatatacccctgccagcaattatggcaaagctattatctgacaatggaagtcaagagtttggtgattttaaacttgtcatacatagaatgctgtctatgtatctctacgaaaaaagaatactgtttgaaatactgaacaatctccagaaaggtcagaagtcttttcatattgagactgtacccccgttgaaactttctccgccagccatatatcatgaaaagatacaaaagagagtaagtttggtgggagaatccagcagacattcagttagaagtgaaaaaccacagaaaatatggcacatgaaggagccaaaatcaaagaaatcagggaattggcttccaccaaagtcaagcatattcagttctgacaagaatcaagtgcggtagactactgattgtacgccagactatttgccactacgcctgtcgaagcttcaaccaatctgatgtg

SEQ ID NO: 14377 - DNA, 918 bp, Triticum aestivum
  Clone ID: PAT_TA_14377
ggccgtgcgcactaagtttatctcaagccctggtccgcataccaatcgcctatcattcacctacgaggagctgaatgcggcgacattgggcttcccacgagatcactttctgggagagggtgggttcggaaaggtttataaaggtgtgctggacggcaacgaggttgctataaagattctcaaccccaatggattgcaagggaacagagagttctgcacagaagttatggtgttgagcaggatgcatcacccgaatcttgtcaagcttgttggcttctgcgctgatgatgagcggaggcttttagtctatgaatacatgcctttgggttcattggaaactcatatttttgatctcccccctgataagaagcctattgactggaatacaaggataaagatacttgttggcgcagctcaaggcctgaagcatttgcatgtgaactgtaaccctcctatcataaaccgtgacgtgaagtgtgcgaatattttgcttggtgaggaatatcatccaaagctggccgactttggcttggcaaagctaggtccgactggcgacgatactcatgtttcaactagagtgatgggtacacctgggtattgtgcaccggagtatcttgagagcggtcagttgaccatcaagtcggatgtttacagctttggtgttgtcatattggaggtaatcacaggaagaaaggctttagatcagagtcgaatcaaagctgagcgtagtcttgctgaatgggccacccctttgatcaacaggagggattttgcattgttggcagatccagcgcttggcaatcagtacagcatgacatcattgtaccaggtcctttccgttgctcgaatgtgcctgaataaaacagccagccagagacctcagattacagacgtagctgccgctctcgctcacatctc

SEQ ID NO: 14378 - DNA, 866 bp, Triticum aestivum
  unsure (1)..(866): unsure at all n locations
  Clone ID: PAT_TA_14378
gcaggcgggcggccgtcttcgcccccgtcctctccaccccccgcagacgctctgcgggctgctgccnaagctgagggggcttgaaggcctatcagaaatggtggataaagtctggtcagatgacacagctactcagctggaagccacagtccagttcaggaaacttctctcggacgggaagaactcaaccatgataaaaatcattagagcggatgtcctgccaaggtttgctgagttcctttcaagacaaagacctcctcagctccaaatggaagcagcatgggtgcttaccaacatagctgcgtctgattatacactgctagttgcagagtgcggtgctgttccaaggctggtagagctcttagaatccccagatgctaatatcagacaccaggctatatgggcccttggaaatatagctgcagacatgcctagctgcagagagactgttcttgatcatggcgctgttacgccattacttgctcaatttaaagaaggcatgaaagtttcagttctgaggactgctacatgggcactgtcaaacctttgttttgggaaattaccagctgaagtacaagtgaaaccaatattggaaataatcagccttcttatccattccgcagatgagaagatcttggcagatgcatgctgggctctttattatatatgcgatggtgtggaaggtggcatccaagatgcattagatgcaggtgtatgccctcaacttataaaacttctgatgcatgcgtcagctaatattcttctccctgtcattacgtcactcgcgagaatttctgcgggagatgatactcaagtgcagttaactgcaacaacgagatcagaggaaccgactatgtagttggctg

SEQ ID NO: 14379 - DNA, 630 bp, Triticum aestivum
  Clone ID: PAT_TA_14379
gcggcccgcccgcacacccacacacagtcgcagcgaacagcggctcccgaaattcccgggtgagaagggcagagcgatcgagccatcactccgtcggcagcagatggggaggcagccgtgctgcgacaaggtggggctgaagaaggggccgtggacggcggaggaggaccagaagctcgtcggcttcctcctcacccacggccactactgctggcgcgtcgtccccaagctcgcagggctgctgaggtgcgggaagagctgcaggctgaggtggaccaactacctgaggcccgacctcaagcgggggctcctctccgacgaggagcagcagctcgtcatcgacctgcacgcgcagctcggcaacaagtggtccaagatcgcggcgcagctgcccgggaaggacggacaacgagatcaagaaccactgggacacccacatcaagaagaagctccgcaaagatgggcatcgaacccgtcacccaccgcccgctgggccaaaaggcccctcctccgccgcaacaaccgccgccgccgccgccgaccaccaccgcgtggcagcagctggacggcgccgagcgctcccagcaagcggaggacgaggacgtgaaggcggtcccgctgatccagccg

SEQ ID NO: 14380 - DNA, 729 bp, Triticum aestivum
  unsure (1)..(729): unsure at all n locations
  Clone ID: PAT_TA_14380
ccacgcgtccgannnattcatattactgaggtccttgaagaagattgcagtgagcatccctttactaaactcaaaatcgggcaaaaggtccatgcaagaattgttgcacaagcggaacattcagcaaaaactggcagaaatttgaaatgggaactatctattaagccatccttgcttaaagcagacttggaagaattaactgcatctgaagctgaattgaatcattcaattaatgacattgtgcgtgcttatgtcgtcaaggtggatacagagtggatctggttaactgtatccagaaagttcatggctcatttatttattctcgatagttcagttgagccgagtgaactaaaagagttccaacagcgttatagtgtcggtcaagcagtgaaaggacacattattggggtgaacagagagaaaaggttgttgaggctgaaagcatttgataaccaatgcatgctcgaggatatagatgacacacaaaaaacagcatcttccattgctgaacacacgaaggaaggagatatcattggcggacgcatccaaaggattctacctggtgttggtgggcttgtcatccagattggacctcatcttcatggaagagttcattatactgaaattgttgattcgtggggtaccctgaaaccctatcctgggatccatggaaagtcaanttgtaaagtnnaaagncctgggctgttaaccccccaanctgaaaggtnt

SEQ ID NO: 14381 - DNA, 1099 bp, Triticum aestivum
  Clone ID: PAT_TA_14381
cctgccgctctcccgcgcgccaccccgcccacctctctctctgaacaccccacccagccgaccaaatcgccgcacgagggcgcgccatggagccggcggtggagaggaaggtgcccgagcaggaggagcagctgcagccgtcgcacgcccgggccgaggacgcgccgcccgccgccgtcgaggaggaggacgaggcggaggcggaggagagcgagcgccgcaaccgcgagctcaaggccggcctccatcccctcaggcgcaagctcgtgctctggtacacccgccggacgcccgggacgaggtcgcagtcgtacgaggacaacatcaaaaagatcgtcgatttcagcactgtcgagtcgttctgggtttgctactgccacctcgcacgcccgtcctccctcccgagccccacggacctgcatcttttcaaagagggtgtccgtccactctgggaggatcctgcaaatcggaatggtggcaagtggattatacggttcaagaaggctgtttctgggcgtttctgggaggatttggtgctggttctagcgggtgatcaacttgattatagtgatgatgtttgtggcattgtgctaagttgtcgtttcaatgaagacatcctgagcgtctggaatcggaatgcatcagaccaccaggctgtgatgacattaagagactcgattaagaggcacttgaagctgccacacacctatctgatggagtacaaaccacatgacgcctctctgcgagacaactcgtcctacaggaacacatggctgagaggttaagctttatgtcgtcaaaactagtcatggccctcgttccgaactacagtaaatccttgtggatttccagttctgacgtttcaacccagccatgatgtacgattactctttgtcatgctactatgtactctccaaatttcaaatgctgaagtatcgactttcatgatattggcctgtatgcctgtattggtcgacttgttttggcaactatttaggtgaaacctcggacttgctctttggattctgctgataaatatggcaaacattacaagtactcaaaaaaaaaaaaagaaaaaaaaaaaaaaaaaaggccccta

SEQ ID NO: 14382 - DNA, 688 bp, Triticum aestivum
  Clone ID: PAT_TA_14382
gaagcgacgaggattcttctttggttgaacttctcttccaatatggtcgatatctgctcatttcatgctctcgacctggaacacagatatctaatctgcaaggaatttggaatcaagacctcgggcctggatgggactgtgctccgcacctcaacataaatcttcagatgaattattggccaacacttccttgcaaccttactgaatgccaagaaccactacttgatttcatagcatctcttgcagttaacggaactaagactgcaaaaatcaattaccaagcaagtggctgggtaactcaccacgtctcagacatatgggcaaaatcatcagcttacaatgaagatgccaggttctcagtgtggccaatggggggtgcctggctttgtacgcatctttgggagcactaccagtatttattggacaaagactttttgaagaacactgcatatccattgttggaaggatgtgcgctgtttctgactgattggttgattgagggacctcgaggtcttttggaaacaaacccctctacttctcccgagcatgttttcattgctccagggagtggtggtcagcaagctagtgtaagctattcaactacaatggatatcgcaatcatccgagagatattctcggcagtcatttcttctgcagagattttaggaaaatctgatactcctctggt

SEQ ID NO: 14383 - DNA, 856 bp, Triticum aestivum
  Clone ID: PAT_TA_14383
cagctttggggttctgctgctggagattgtcagtggcagggggcacactgaccccagattgcctctccaagatcagttcctcctagaaacggcttggacactctacgagtctggtgatcttgggagcatcatcgacaggaccttaaaagatggtttcagcaccgacgaagctcataagtttttgaaaataggacttctgtgcacccaggatagccccaaggtcaggccctccatgtcgacagtcgccaagatgctaaagggtgagtgcgccgtcagcgacaagatcatgaggccaggcctgatcacagatgtcatggacctgaaagtcagaacaatcgagcctgctcttcagttaagtgtgtctccaccaatgtctccactggataaccactcactggtgtctaaccttgcattcgctggtagcactgtgataagggacagcccctaatgacaagttaaaaaggcacatgaaggagaatatgctcaggcaacaatggctgtaaattggagggatgacgaaaaacatgtcaagagaggcatttgatttcgttttgtgtttctggattgcttagatatactgttagttgtttgtatatgttgcatctgagcttttggtgatcaacaactgaagaccctcagtgtcctgtggagcatggtttataggtgaaggaagaagggcacagctacaccaggcacccaagcagggagcgctggacttacagagatttgctagttagcacctttcctaagttaagcaagcaagccagggttacctttttttgtgtgcacagaaatactgtagtagctacaatgtttagtcaagtatacagtacaaatctcacacggataaaaaaaa

SEQ ID NO: 14384 - DNA, 834 bp, Triticum aestivum
  unsure (1)..(834): unsure at all n locations
  Clone ID: PAT_TA_14384
ccgcgagagagtggggagggggctccacgaaaaaaactcccccttcccctcccgcaggcgatagggagggccaccccagcgccgccggtctctacctctccgcccacctcgtccgctcgccttcgccgggcaaagcccggtcggcgtcggtggcggcggagcgttctctcccctcggttggcggaggttggcgcgggcgggcgtcctccggctggtggccgcgcgcgacagcggtgggggctcgtgcgtgttccattcccgtggctgcgtctggatgtggtgtggagggctgtgcggggcccctctagagtggccgtggtggccggatttggtttgtccagatctggccgtcggctccttggggggcgcggagcttccctttggtcatggtggcggcccctggatgggatttccctccggtgacgggtactgatgtcgagctaggagtagatggtgtgtcgtcactcttcctaccgtggttgagtgcgttgtgatgtgagcggtgcacgctatctcgcnacagggatgccggggcggcggccccggatggtggttcgcatggtggcggntttcctcctgggttgtgtgggcaacaggaggtgttgcgacgggtagctcggacgtgccctctctctctcggangggcggcgtcctgatccggatctgaggactgacattgtcgcnttcctcatggcagctcntggtggcacagatgattgccgngcganaatcatgccttggcgccgatacgngaaccgttggtgccgcgctctcttgaagagttgttgtggtctcctcgttaaggtccggtnaaatnttgtcntgtgactcgga

SEQ ID NO: 14385 - DNA, 1186 bp, Triticum aestivum
  unsure (1)..(1186): unsure at all n locations
  Clone ID: PAT_TA_14385
cgtccggagtggtccaccagccaaagaccatgtggcgccgagccggaccgatctncctgggtctgtgcggaattgccggccggcgcgtccgacgacccccacagcctcctgctcccactgccacctgctctacctccgcattcgcttcatcctctttccaccacaatcttggaacctttcgggattccatcggagttcctccctctcgaagcctatcgaaccaggcaggaggtgatggcggcattggcggcgagtgctggagttgtggcgccaagggggcattcctctcctgcgggtcctgcaggagtgtgcagcccgttgatcctgcggtcgactacttccgaatatttggcctggacagaggatacgacgtaaaggataccaacttagaaggaaagtacaaagactggcagaagaagttacatcctgaccttgttcattctaaatcagagaaagagagagattttgcggccgggcagtcagcacttgtcattgaggcatatcgcacactgagcaaacctttaccaagggcattgtacttgctgcaacttgaggggatacacgttgatgaggagaagactatcaatgatccagaacttcttatggagatgatggagatacgtgaagctgttagtgaagccggtgattctgaaactctgaagaagatccaatctcagatgaagaggaagctcgaaacctggtccaaagccttccaggaagcgttcgacaagagggacttcgacggtgcagtggaagctacacagagaatgagatactacgaacgtgctatggaagaaactgtgaagaagctttgatcttagccccgactgggagctatgtaaattgtacgccttcaagaaaactagacgggtacgggcgctccaccgcgccgggagtctggtggctgacatgttgcaggtcggttgagtgaagtcatcgtgagaggcaggtcgtaccacgcagtttggctgaataaagtgactgtttttacgttgttttccttgtgttgtatgctggtcgactggtgtggccgtgggaaattactgcagacaaaatactgtgcagttgcttttcngtgcgcatgtaccgaaggcagatcgaactgtagctccccctgatttcgcttcgtatgtcagaggatctggataaatctgatcatatgcagggccgggccaggttttggctc

SEQ ID NO: 14386 - DNA, 675 bp, Triticum aestivum
  Clone ID: PAT_TA_14386
ttttccaccccgcagagccatccgttcacatactcaccacagccacaccgcaacttcatcttcatcaacgagaagcagcagcgcccggcgaagagacgagacaaggagtgttgccatggccgcggtggagagcaagagccggaggttcgcgctggcgtgcagcgtcctcagccagtacgtcaaggcggagcagaagatgtcctccgccgtcgccgtcgccccgcgcgcgcccccggccaccacgctcagcctcatgcccggcgccgacgtcgaccaagccgccgcggccgctgatgaggcggggcctgccacggccacgcccctgaccatcttctacggcggcagggtggtcgtcttcgaggacttccccgcggacaaggcggccgaggtcatgcgcatggccgccaccgccggcgtcgagcgcgcggccgtcaccccggccccggcccaagcggcgctcgcggacctgcccatcatgcgcaaggcgtcgctgcagaggttcttcgagaagcgcaaggaccgcctcggcgcgcgcgcgccctacgcccggcccgccgcgccggcggccaacaaggagtcggaggacaagtcggcgtcggcgtcggcgtcgtcctcctcgtggctcgggctggccagcaccgatggcgccttcgccctgtgatccggcggacggac

SEQ ID NO: 14387 - DNA, 720 bp, Triticum aestivum
  Clone ID: PAT_TA_14387
cggccgccgaccggccgggccggcctcccgcccccccccacagtccgtccacagagtcaccacagccgcaccgcagctccatcttcaccaccgtcatcgtcaacgagaagcagcggcgagcagcagcgcccggccaagagacgagacgagacgagagaacaagtgttgccatggccgcgatggagagcaagagccggaggttcgcgctggcgtgcggcgtcctcagccagtacgtcaaggcggagcagaagatgtcctcctccgccgtcgtcgccccgcccccgcgcgccccgccggccaccacgctcagcctcatgcccggcgccgacgtcggccaggaccacgccgcggcggccgctgaggaggcgggcccggccacgccgctcaccatcttctacggcggcagggtagtcgtcttcgaggacttccccgcggacaaggcggccgaggtcatgcgcatggccaccaccgccggcgtcgagcgcgcggccgccacgcccgccccggacctgcccatcatgcgcaaggcctccctgcagaggttcttcgagaagcgcaaggaccgcctcggcgcgcgcgcgccctacgcccgccccgccgcgccggcagccaacaagggctcggaggacaagtcggcgtcgtcctcctcgtggctcgggctggccagcgccgacggcgccttcgcgctctgatccggacggacggacggacgggggcaga

SEQ ID NO: 14388 - DNA, 588 bp, Triticum aestivum
  unsure (1)..(588): unsure at all n locations
  Clone ID: PAT_TA_14388
ccaggagagccccgagccggtcgtgtcgcggccggccagcgtgaggttcatggtcgtgtcgcggaggaaggcgtcgacgaccgtgctcgcttcgtcgtcgtcgtcgatgtaggaggagagcaggtcggccgagtcttcgatgccgcctctcgccttcaccgcctcccgccgcccggcgttcgtcccgccgatggtccgggccctctcccgccgcccctcggcccccctccgctcctacccgcccccgagccaccgcaccagcttcccacacacngacggagggacgcaacgttgcggacgaggangcacgtccaatggcgtcgtccatggcngcgagcgaacggcnacctcccgggaacccgatggccaggcagcccggggtcgacgccgaacaccagcgtggtcgtcgtgtcgaacgtcagcctgaggaacacgtcctgcaggtcgcacacgccggtgccgccgccggcgacgtgggcgagcagcgggagcaggtcgcgctcgaccttgcgccggctgcaccgtgtcacgaaggcccggaaccgggggccggacatgagaagctgcgccttggcgcgctggcggcgc

SEQ ID NO: 14389 - DNA, 598 bp, Triticum aestivum
  unsure (1)..(598): unsure at all n locations
  Clone ID: PAT_TA_14389
gacgggggcaagaaggggcaactagtttgtgcgattgggtggtgatttgcctctcagctagcttgacgtccatcatctacccggtgaagacggatctgcgagtaacccaacatccatcagcgcttcattggagaagcagcaagcaaactgaagctgtagctagctctggaggccatgcatgcatcaatgtgcatttcattttactgcctgctgcttgttacccttttttgttggtatctgccagatttcggtgatccaaaagggaatttttgctcctgctttagctcttgggtcgcggtagcggcggctggttccattgcatcgcatgtagatgtagtagtagtggtggtcaaagtaactcctctctctagtctctagtctagctgtagtggctctgaatgttttgtatcggaggaaggggccagttaaatgcactagcagtatttattttttctccattgcatcgcatgtagatgtagtagtagtggtcaaggtaaccctctctatctctagcctcnatctctagtccaggtgtgggnccnaatgttttgtatccngaggaaggggcanttaaatgcantagcagtattnatttttc

SEQ ID NO: 14390 - DNA, 1312 bp, Triticum aestivum
  Clone ID: PAT_TA_14390
ctcaagtctccaaccaaattcccttccgattcctccactcctctcgccccccgaggcacactccccaaaccctagctctccccccttccgcgcaaaccctagctctccccctcccgcgtcgtcgcccccccgcgccgagctccagcgccgaattcgcgcagcaggatgggctccgactccaaggagctgctcgggatcgagcccctcgagctccgcttccccttcgagttcatgaagcagatctcgtgctccatggagctcaccaacaggacggacgactacctcgccttcaaggtcaagacgaccagccccaagaagtactgcgtgcggcccaacagcggcattgtgccgccgcggtccaccagcagcgtcgtcgtgacgatgcaagcgctgaagcaggcgccgcccgacatgcagtgcaaggacaagtttctcgtgcagagcgatgtggtgacggagggaacagcagtcaaggatatcaccggacagatgtttaaaaaagaatcagggaatgtggtggatgaggtgaggctgaaggttgtctacgtgcaaccaccccggccaccatcgcctgtgcgggagggatctgaagagggttcgtcacctcggccttcatggtcagatggggcaaacataaattatcaagatatgcaacacgggaatctgatgagccaccattgtcctcagcgcacaaggaaccatctgggatacccactgagacatccccgttgatttcaagattaactgaagagagaaactctgctattcagcagaacaacaagcttcgtgaggaactggaccttgtgagaagggagatcagcaagcagaatggcaatggtggtttcccgttggtgttcgtggttgccgttgctctgctgggaattctgctgggttatctcatgaagagatagaggatccctgtgtaatcctgcccgcgtcttgttaggctcctgtcctcatcaaaatggagcagtgttgtcatctgcattctgatgcgctcatttacatgtacggcactactacttaacagcacaatatcttagggtatgatgtcgcctgtagtcgcaagcgtcagattgggttgaccatcatacccggtcgagtagtcgtcacggttaaccttatggttgtttgtcatatatggctacttttagcttgggcgttagtataacttggtataattgttaaaaatgactttcgcctatctagtgctgattccctcgtggtatatttgaagtaaactaacgacttggagcggacatttctcaagtttggcccaaaaaaaagaaacataggtggctgtgctaaatac

SEQ ID NO: 14391 - DNA, 1909 bp, Triticum aestivum
  Clone ID: PAT_TA_14391
cgaatatgcaccctcagtttattctgccagcggcaagaaatgaaaaccaaatgaatatctaggaatcgggaggcaaattaaggaacacatgataactccttgggttggaggagataatgatcagaaagccgggaactcgatcctgttgccacagggcctgccgccgggctggacggggcactcgacgaagcgggaggcgtcggcgtggacgcagaagtagagctggaagagctggctgttgccggactcgtcgcggttgcagtcgacgtgaggcgcgaacccggtcccctcgccacaccatccaacttctgcccccacttccgcctccgagcgccctcccttccaaatcctccactcctctcgccccccgaggcacacccccccaaaccctagctctccccctcccgcgtcgtcgcccccccgcgccgagctcgagcgccgaattcgcgccgcaggacgggctccgactccaaggaggtgcccgggatcgagcccctcgagcgccgcttccccatcgggtccgtgaagcaggtctggtgctgcatggagctcaccaacaggacggacgactacctcgccttcaaggtcacgacgtgcagcccccagatgtcgcccgtgagggccaacagccgccctgtggggggagacgcccgcggcggcgagggcgtcgaggacgcggcgctggtcgcggaggcggcgggccgtcggtgcaaagccgtgctcgtggaagagggtgcgggcgcaggggccgtgcttctcctcaagggtagcgccggacagatggttgtaacacgaatcgggggaggtggtcggtgagtccatgctgagggtgctctgcaggtagccaccctgggcgggatcgtcgtcgcgggagggatgcgcgttgtggtggttgcgcccgtagtcgcggtcagaacagaactcgtgggcccagaagcgggggccgtcgttagtcgggcacggcagcgtccgccactgcctgcgcaggctactaagaatgtcgctcacccggggagtgtcagaagcactgatgggcctccgcctgcgcggcagcgacccagcgagccccttgggcaaccgcgcgtggttcgaggagacctcagcaggtaaactggcccttgcggcgtaccaacggtgttcgtggtcgccgttaccctgcgggcactgctgcccgggggactaatgaagatagcgcgttcccctgtgtgttcctggctgcgcctggttagcctcgtgtcctgctcaaaatggtgcagtggagccatctgaactctgaggcgcccattcccatgcccggtacgactccttaccagcacaatatcttagggtatgatgtcgcctgtatggcgcgcgcctgtacatgttcggcactactacttaacagcacaatatcttagggtatgatgtcgcctgtagtcgcaagcgtcagattgggtcgaccatcatacccggtcgaggagtcgtcacgattaaccttatggttgtttgtcatataggctactttttagagggatcgaaggcgttggcggggttgcagttctgcgggtaggagccgtcgtcgcggttgggccagaggccgtggatcccgaagtccgccgccggcttccccgaccgcgggtagcagcagctctgcttcgtgtcgcagtacgaccccggccactgcagcacgaggtagaagaagtcgtagtccgccgcctgcgccgcggcgcacccggcggcgctcagggcgacgaggagggcgagggagaggcaggatctcatcatggcttgcttggatcgatctctttgggactcgctacagagctatctgtgtcggtttgatgcctcttgggccggctaagcccggatttataggccgctttaggcaggtgtggatgccgtccgtgtaaccggcaacacgggtccgcgt

SEQ ID NO: 14392 - DNA, 1094 bp, Triticum aestivum
  Clone ID: PAT_TA_14392
cacagcggggtgcgtgtatgtgtgtgcgcctctgcggggcaccaaacaccagactccccacaccccccctctccccgccgcctcctcctcttcgccgccgccgccgcacggtctccacccccaagattagtatgtggtaggaagtgcatggggagaaaggatgccagagttgcgtagtggagtccgacaatcccggttgaagtcgaggaaggctgaggatctcgacgtacaggacccagcagagaacttggcagtggcagcgcctacggtggcaggaaagcgtggcagaggaaggggtgggagaggtggagggcgaggaaggggaagggcaggaggaagagggagaggtgttcctgtgattgacttggatccagaccagccttttgaggttcttcctggagctggtgttggtggaggtgctgtgggtggtccacagcgcattgaggaatttgctgataaggctgtcaagatggatggcgcgagtcctgacaagatcggtggtggtgaagatgatgcatctccagtcccagagaaggttcaagtaggccattctccacaatacaaggtagagaggaaattgggcaagggtggttttgggcaggtttatgttggcagaagagtttctggtggaacagagcgcactggaccagatgcttatgaggttgctttgaaatttgagcaccgcaacagtaaggggtgcaattatggccctccatatgagtggcaggtttatagctctctgaacggatgttatggtataccgtgggttcactacaaaggccgtcaaggggactattatgtgctggtaatggatatactaggccctagcctttgggatgtttggaattctctagggcaaacgatgactccaagtatgggtggttgcatcggtggagaggctatatctatccttgaaaaacttcatgcaaaggggtttggtcatggagacgttaagccagagaattttctactcggacaacctggatcacctggtgaggagaagctttttttgattggccttgggttagcatcgagatgggaggagacatcatctggacaacatggtgactacgatcagaggcctgatattttta

SEQ ID NO: 14393 - DNA, 1678 bp, Triticum aestivum
  unsure (1)..(1678): unsure at all n locations
  Clone ID: PAT_TA_14393
ccgcgccccgactgcggcccgcgccctcctgccgcccgccccccccggccctctcgccccccttgccgtcgcaggcacaaccgagcccgtcatacagccctacaagcccgcacactacctctggaggacctagcccagattacagcccgacatctcgtcaggaaggaatgatgtcaccattgttgagtccaaatttcagggcttccccgtcctccaatgctcagttctcaccatatgttgggggcatggcattctcacccatcccgtcaaactacagcccatcctctggaggaggttacagcccatcttctccggtgttcagcccagggccaggacatggctacagtcccacttctccatcatacagccctgcatcgcccagctacagccccacctctccatcatatacgcctggctctccttcctacagcccgaccagtccatcatactctccgaccagtccatcatactcgccaacatccccgagctacagccccacatctcctagctacagccccacatctccgagctacagcccaacatcaccaagctacagccccacatctccgagctatagtccaacatcaccggtttatagtccgacctcgccagcatacagcccgacatctcctgcatacagcccgacgtcgccatcttacagcccaacgtcgccatcatacagccctacttctccctcgtacagcccgacatcgccctcatacagcccgacatcaccctcatacagccccacgtcgccctcatacagccccacgtcgccctcatacagccctacctcgccctcatacagccctacatcgcctgcatacagccctacatcgcctggctacagcccgacgtcaccgagctacagccctacttccccgaactacagccccacttcaccgagctacaacccttcttcggccaagtacagtccttcacatgcttattctccaagcagcccaaggatgatgagcccgtacagtcagacttctccgaactacagcccgacctcaccgacctactcgcccacctcaccatcatatgcgcaaccaagcccgtcatacagcccgacaagcccgcacactacctctggaggacctagcccagattacagcccgacatctccaaactacagccccagcgcaagctactccccgactgcaccgggctactccccgtcatccaccggcccgcagacaactgacaaggacgatgagactgttgactagaaatggctgctgttggcttgatgcagattcttgtttcctcgtgtccggaacaggccttgttgtaagctgtgatgctaatagcagcactagaatttgcggccgtagctgggctgatatttaattgtgtgttatctatcggattgttatgctaatgttaacattgccgcttttctctcattgtgttggggccaatttgcgattgcactggtttgggtcttctggatcgcatccagctaccgagggcggtgttgcccggcttgtcatggtcctgctgccttcgcaactccgctttatttgcttctcacctcattgactcnanttcctggcaaggataatactcagacacaagtgcccacaactaatcgaaagacgaancaagtntnacatctctcctttcaagactcctcttcttgatcactgangggacacactcagnanagggacaa

SEQ ID NO: 14394 - DNA, 822 bp, Triticum aestivum
  Clone ID: PAT_TA_14394
ggcgatctctactgcttcccaccccctccgacgagctctgctgcctcccctccccactagcgagctggcctgacgatggccgaggctcctgatgcagttcgtttcgtgggttgtgatgtgcagtgtgtgcggcatgcagcttggagcgagtgggcatgcagcctcagagccagcgatgatattcccatgtgttggccgtggcatgcgccccatcctagcatgctgacggtcaggccgcgtttgcttgaggcagtggctccggaccatggacacagccggatgcaagaccctgcatcccacatcgccgcccttcgacttcttcctcgcaacaaggcgtgctgtgagcaagcgtgtgagagtgcagcttgccgttgcggatgcagtccgttgtcccggccaggtgctgcgccctgtcggtccccctcctacggccctgtgtgcgcgcgagccgcgaccctgggcgctgctgcgctgctcctgcctggtacgacgccgggcgcgtcggccgcccggcgctcgggaggtcgcccaccggcggcgtgcagttcgacaaaaacaaattcaccggtggtgtggccattgcatttcaccggcgagccactagcggctggagcagcacggacgtgcagtttgctttttgttttttggccgaggatgcagtgcctttactttttgcagtcgttcacttgtgtgccatggggttcacttgtaattatttctttgaaaactcaaaattctccttattttgtttctaaaaaggaagtacattttgcactagtaatccgctgagctggagttgaaggtcaacggccgccccatgca

SEQ ID NO: 14395 - DNA, 685 bp, Triticum aestivum
  Clone ID: PAT_TA_14395
ctagaacaaattcccccaagatccagtaggaggagcatggcagaagcggccgtcggcgggcctcacctccctgaggagatcgtcacctgggagattctcatccgcctgccgccgaagcccctcgtccgctgccgcgccgtctgccgctcctggcaccgccgcctcacctccgacgccaaattcctcttcgcccaccaccgccgccagccctcgctcccgctcgtcaccaccgaagacacccatgaaagaaggatcgacgccctcgaccacagcaccggcgagcggcgccccgtcgcgcgggcggcccggaccgcagccgacgagcacttcgatgtgctcgcctcctgcgacggcctccttatcctcgtcgcctacggcggcgtctacatctgcaacccggcgactcgccagcacgcgcccctcccgctgcttcacgtctactgcatcgccgggttatactttcaccgcccgtcggggtcctaccgagttctgtgctgcttgaagacaaccgaggacgggcagttccgtgccgtataccaggtgtacaccctcgggtccggcgacctcaggtgcatcgggaaggctctcgagccgtggacgtccggagatctagcgcgggcgatgccgatgatggtgtcatttcaaccgcacggcctggcaggcggcaggctttactggcagccca

SEQ ID NO: 14396 - DNA, 575 bp, Triticum aestivum
  unsure (1)..(575): unsure at all n locations
  Clone ID: PAT_TA_14396
gccaggtctccccttgatncaacccccctctgccttcctgtccgttcttgatcgaaggcccgagcgagaagagctcgctcccgagccagcgcactcctcggctcctcaccgagccctgcctcgtcgccggaatccagcgttgtttccaccagcacctccggcctcctctgcttcacggccgcccacgcgtccgcccacgcgtccgcgaccagctcgcgtcgccgccgccgtgccggagatgagtgtcccgcgtccatctcttctcccttcttccattcttcttcccctccctcacatctctctccctctgtctgctcgtaccagggagctccaacgcctcgaagctacagcgccgccatcgagtcgccactgcctcgaactctcgccgcgcccgttgactgcccctgatcgacgccctctttcgtgcgtggcaccgcgccagaacaccactcgcctccgaccgttttccccgccgtcaggtctagcaccgcgcccccactacatcactgcccgcgtcggcccttctctatcttgccttcgctgtgggccgcccgcccctgcttcccctcgttctc

SEQ ID NO: 14397 - DNA, 666 bp, Triticum aestivum
  Clone ID: PAT_TA_14397
cggcgcggggcggcgcccacgcgccctcggcgcgccgggcgtcgcggcgctccgcgaagcagagctgcgcggcgatggcgacgaccagcacagggcccgggcgacaccgcgacaacaaccaccgggccatggaggggctcacgcagcgcgcggcggtgcgcggctaggcggacctcacgctgcggcggcggcaggtgcgtgctagccctggccatgagaggggctttgcggcgtgactgcggcttgcggcggcggcgcgccccccacccgcccctgcccccccccgcgcccggcgtcccccgcagggcccgcttgctgctgcccctgcccccttccggcggccgccctgtcccccgcccgcgccgccggggcctcccccgccccccgtcctccaccgcggccgcgtgctcgggccccccccccccgcctgccccccgccactccgcccccggccctgccgctgctcgtccaggtgccggtcaacgtgggtggccgcgccctcgccctggcctcctccggcgcgccgctgcccccccctccgctggcttactactaatgcaggtggagttcaacatggaagagcatggcccaagcatcattctgggcgtagctgcccacctctatgtgacgactgctccaaggcagaccaagtgttcgtcgtaatgt

SEQ ID NO: 14398 - DNA, 694 bp, Triticum aestivum
  Clone ID: PAT_TA_14398
gggagatatagccgcatcgtgggcgttacaggaggagacccgtcaaggggagacccgttgccgcgaggaggccgagaatacgaccgaggccaaggacgtcgagctgaaggcggcccttgccaaggtcgccgatctggagaaaggcactgcaggagcgtgaccgcaccatcgcctgggagcggcgtggtacgtttctcaaagcgcagcacctggaatagtccttctccagggccttccccggagacgcgctacctggcggaggaggccgtctgctttcagccccacccccagggagtcatccgctcccggacccacccccaagtggcctgggcttccccggagttcgtccccccccccgtccctcgcctgcgcggcatcggcgacccggtggcgcggcccccgccggccggcgcggtggcctcggccgccccctggccgcgctccgttgcaccgggcagcgtcgctcggctcgcgccgtcgctgggggcgggtccgaaccgtctccacgactagcgcgtttccgccccgctcgtgccggtgccgagatggcgctccggttcacgatgtcttggcatccggacctgtcgctggatgcattgatgtgccagcgagccggctcggagaactagctgcaggtggaggccggacggatcgctgcccgggccagctacatcatcgggttagccttccatga

SEQ ID NO: 14399 - DNA, 544 bp, Triticum aestivum
  Clone ID: PAT_TA_14399
tttcaattgacagcttattttcattcaagcaaacatgtccgacgcttggtagacatgaccgtgcattgtcccggggctgaactaaactgcgaggagattggtcattatgattcatggcttgaggatcttcatgctgtcaagacaaattattttcctggacttaaaaatcttagtactcaaaacgtgcgaccgatagtgttcgtattgaactacggtcacatctatttaggaaagatggtaacatttttaatatttgtcctcggtgcatcttttgcatacattattttttaagctaaacttcattgctaattatgttactatacgatgttcttcaacagggactctcgatgatagttgtgcctcagtggatcgatactaaaggtcacatgtcaatggttagattacgaccaagacatcctacattgcacatgagtgcatttaggatttctaaaaccgaggaatgcttaatagtgaaagactagagcagaattgtgaatgatcgcagagaagtactaaggggcaacaatcaaaagcccaacccaag

SEQ ID NO: 14400 - DNA, 1944 bp, Triticum aestivum
  Clone ID: PAT_TA_14400
cccacgcgtccgcccacgcgtccgcccacgcgtccgctagctttaacttaatcatgtgccgtatatcataatagtctacccatccgtatgtttcatactgatgattaatgttatgtgccttatggtttttgatgatttgttgctcatcagaatttttaaatcatttctcactaccaaatgtaggcaagttgtaccttttgagttttgaaatgtatgttttgctgtagtttaatagttcttgttatcaaatatttgattgaatgtctgtggtgaatttacagagctgaaacatctctgtccgagaaggatcagaaggagagggctcagaggagtgcatttgcccgtgggcttgtgctttccacaatatttgatgatgataccatgtaagggagatcgactttgatagtggttgcatgacatagtccagggcgctcagcacaagataatttatctagagcgctgcaaccttgttcatgcagccactgccgctcacaggcgttaacgacctaccggaggtccatccagttatgaatgtatatgtatttatgtatgccttgccgagagcgcatcatgagaatagtggaggaaggcccttgtgttgcagctttccacaaggaattcggcgagagaaaaaggcgaggctagggtttcgtccaattccgccgcggataacggaaaggcgagagacccctcccgctcctacgctttcaccccggaccactggagaggccggcgcggcctgtaaaggctggacatccacctcatccgccaccaccaccgcggggaagggagagaggtacgcgaggcgaggctagggtttcgtccaattccgccatggattccggtgacgcgtggggccgctcctcctccagctcctccgccgccgccgccgcgaggcgcctgcagtcccgctacgatctgtacatggggttcgacgacgcggacgccggcggggacgaggtggaggcgcgcggggcggaggcctacaactgccccttttgcggcgaggacttcgacttcgtcgggctctgctgccacatcgacgacaagcacgccgtcgagcccaagagcggggtatgccctatctgtgctacaagggttggggtggacttgatatgccacatgacaatgcagcatggaagcttctttaagatgcaacgcaggcgcagagtccgaaaagtatcttctgggtccctttctttgctgtcatttgttgagaaaggatttaagaaacggcagtttgcagtcctttcttggtggatcatcctatgtatctaatcctcccgctgccgcccctgatccatttttgcaatctttaatttgtagtttgcctgtggctgaaccatcgaaagattttcgttccgactcatctgacaaaacatttttgctaaataaattcccagatgaaaagatcgtagagagagctgaaacatctctgtccgagaaggatcagaaggagcgggctcaaaggagtgcgtttgcccgtgggcttgtgctttccacaatatttgatgatgataccatgtaagggagatcgactttgagagtggttgcatgacatagtcaagggcactcaacacaagagaatttatctagagcactgcaaccttgtcatgcagccactgccgctcacaggccttaacgaccaaccggaggtccatccagttatgaatgtatatgtatttatgtatgccttgccgagagcgcatcatgagaatagtggaggaaggccttgtgttgcagctttccacatggaataaatggggatactatccttagtggcattgtgcatatacaaaagaggggcgagctactcgtcatgtattagattatattctgtttcatcaatgtaataagtgtgttgtaaactcatctcatccttagtatgtgagattgctttgatgttttctgtatatattcgattgtggtacatttgacatttga

SEQ ID NO: 14401 - DNA, 771 bp, Triticum aestivum
  Clone ID: PAT_TA_14401
cccacgcgtccggaagagacgggaggtcggttccttctgcctcgtactaccgccgtaaccctaaccctaacccctagagcagatccagctagccgcagtacgagcgtcaccggcgtctcctccgccccctacctcaaaaaagataaagccggagaaactggaggtaggttctttccgcctcgtcgtaacaccctaagccatacatcagatctagcccgccgcaatgcgagcgtcgtcgggatctcctcctatcccgacctcgaagggggagggtgtgatggaagttgaatcggatcaagatcaggatgattgtgatgtgatgattgagcctgccgctgccctcaggggtctctatgcgatgatggtctcatggtgtgaccaattccttgatattgatattgatattgaggaggaaggggatagatccgttcctcccttgttgatgatccactttccccgtctttttgagagagcatggggaaataatcgcctatatcctcaagctttagatgactgttgtccgtatcgtgcatacctccagaagttctgcgatcataatgctcctcgttatcatgatcccgatgcctacaagttgtgtatggatcaggaaattagattgaagtctgagtggctgtacaagcacacccatgtcccccatgatgagatcagtctgagtgacaatatccaaaactgcgcttatgaacttatccgttccaacagcggtgaaggagattctcctatttccatgatcgctgccacatgtgttgcgaa

SEQ ID NO: 14402 - DNA, 632 bp, Triticum aestivum
  unsure (1)..(632): unsure at all n locations
  Clone ID: PAT_TA_14402
cggacgcgtgggngaaaaagtaaagcacaaaaaacgcgcagcggtgggagagccatggagatgggcggcgacgagatgatgatgacctcgggcgccacgggccggatcgtgcccgtcttccgctccgtgctctcccgccgcgcgctgctccgcctggccgtcgcgctccactcgctcttcctctggctgctcctcctcgtcggccgccgccgccgccccgacgccgcgagcccggcggagcccggccgcctggggaaggccaggagcaggcgcagggccgcggaggaggaggacgtgcgccgccgccgggcgctcgcggaggaggtgcccatggtggaggacgacgcggacgcggacggcaggacgtgcggcaccttcgtcatcgccggggccaggcggaacgcgctcttctgccgcgtctgggcgccggcggccggcgcggagacgaggggcattctgctcatcgtacatgggctcaatgagcatagtgggaggtatttgcattttgccgagcagctaacatcatgtggctttggagtatatgcaatggattggataggtcatggtggcagtgatggtctgcacggntatgttccttctctcgattatgtcatagaagacatggaagtact

SEQ ID NO: 14403 - DNA, 1533 bp, Triticum aestivum
  Clone ID: PAT_TA_14403
tttcttttttggctcgccatgcgcatggataccctgccggcggagaatggtgcaaagcattaacaaaatagcctggttgaaatggcgtcgctgtacgctcacatcagaaccagactggaagggatcatcctgacttcaccagctgtgcgtgtaaaaccagcgcatccgattgttggggccgtggcaccgatattctctctgatagcacccaagttccaattcaagggagcaaacaagcggggcattccggtgtctcgcgaccccgccgcgctgctggcgaagtactctgacccactggtctacaccgggccgatcagggtccggacgggccatgagatcctgcgcatatcctcctacctgctgcacaacctgaagaaggcgactgtcccgttcatggtcctgcatggcaccgcggaccgggtgacggacccgctggcctcgcaggagctctacacggaggccgcgtcgaggcacaaggacctgaggctgtacgaggggttcctccacgacctgctcttcgagcccgagcgcgacgagatcgccgccgacatcatcgggtggatggaccggacgctcggtctgcaggctgtatgagtggtagttgttgtctgaatatggggaggagatgggcatcatgtgtaggccgctcagatcgcggcaatgggattgcagtcatgggcttcatggcatggcatggcaaggcatgcatgatggctttgatctgattcttgccagtgttttctgaaagtggtctgctcattgcctgtgctgttcttcccgatctaccgatgcatccgattgtaggggccgtggcaccgatatcctctctgatagcacccaagttacaattcaagggagccaacaagagcggcatccctgtgtcccgcgaccccgccgcactgctagcgaagtactctgacccgctggtctacacggggccgatcagggtccgtacgggccacgagatcctgcgcatctcctcctacctgctgcacaacctgaagaaggtgacggtcccgttcgtggtcctgcacggcacggcggaccgtgtgacggacccgctggcctcgcgggagctctacacggaggccgcgtcgaggcacaaggacctgcgtctgtacgaggggttcctccacgacctgctcttcgagcccgagcgcgacgagatcgccgccgacatcatcgggtggatggaccggacgctcggcctgcaagccgtatgaagggcagctgttgtctgaagatgggggaggagctcaacactcatgtgcagatcgctccagtcacagccatgggattgcagccatgggcttcatggcatggcaagacatgcatgatggctttggtctggttcttgattgtattctttgccgtgatcctcatcttacgatgctgccggtgcagaccggtgaactgaaatgccagtggcttgtggtttgtatgaatgctacactatctataataacaaaaggggtgaaaagaatgacgcgtactgctggcctgcaaaacctttctcgatcctgtaaaggttgg

SEQ ID NO: 14404 - DNA, 1120 bp, Triticum aestivum
  unsure (1)..(1120): unsure at all n locations
  Clone ID: PAT_TA_14404
tgttgtctacctactaccaacatgttagtcgatatgattactcgccgccttcagggttcccccgcgcccacggggtcaagccctgcagcgcccccgcggtcccggccgctctcgtgcgagtggtgccctccgccggctggcagattcatcgccggtttgatcttaaaggttcatcatatggccgaacggcagacaaatttgaagaagagatcgatgagacaactactcttaaagacttggacctcaactttgtatttcggttgcggcggtcttggtacagagatctccatgagcaactccagagagattgcgaatttttggagtctgaaggtattatggactacagcttcttggtgggagttcacttctgtgacgatgtctctgcctcgaagatgggattgtctacttttaccgcttctccaaagctatcaatgaagtgcgagacatttcaagttggtggtggtggcatgccagagctgtgcttctcagataacgattatgataggatacctgactgccggaagccattgattaggttgggtgcgcacatgccagcccgggcagagcaagcatccagaagaagcgagttcgacccgtttctcctcagtggtggggggttcctggccccgaaccagaccggcgaagtgcatgacgtgattctgtattttgggataatcgacattctccaggactatgacatcaccaaaaggctagagcatgtttacaagtcgttgcagacggaccccaattcgatatctgcngtggacccgaactctacttccaagaaggttcaaggatttcatcggcaggaatttttgtnggaagatggctnagaaattttggggtcnaaaagaatccaccaggaaattccattgggaagtnccaccggattgaattcccangngggttttgggcnaaacnttntggcanttggcnaaaggaacctccantggttaaaannccaaccaacgatcattaatnaanccncttggancttccgggaaaaattaactttgntnnanccgggtnaatcacccgttgaaacgaaaccttnntcngccnaaaaangggggaccaatttttccaaaaccaagttncaanggncccnnaaattnggcct

SEQ ID NO: 14405 - DNA, 435 bp, Triticum aestivum
  Clone ID: PAT_TA_14405
aacgtcatcgccgtcatcaaagagtctgtgaagacattcacatatgagacattgaacaacattgcgagattgataaatggaatatcagcactcttgttgacactgttacctggaaaagccaacattttggaaggggtcagtggctgggaacttaggccagcatttcgcgggccacgtcttcctcgttggatggaaagtggggtctcttcatttaacgagttcattcacgaactttctgccgattcggagtctgaatcaattgctggctctgtccctggggatgatgacaatgaagagtttgtctgccctccttctccgttgtcccaaagttcacgattgtcacacacaagcagctttggtagacatgaccgtcgattgagaaggcctatcaaatatgcagtttcctggattaattgggctgtgaaaaatttccct

SEQ ID NO: 14406 - DNA, 809 bp, Triticum aestivum
  unsure (1)..(809): unsure at all n locations
  Clone ID: PAT_TA_14406
cgtccgccccgggcttgttctggacaatgtaaacactgccttacttcggggatacatacagatggcttctacgagggagaaaggtatacatgatacaaggaaacatattaaccaccaccaacaccacttatagcgaaaaggtttctgctgctaaaagtaacaattgctgaattgcatcaattcgtacaggtacccaaacatcatcaatatatacatacgcctatttactactgtagcaagcagcgaaggcaaggtctacggcaatatgcatactgcggctcaccgccagttctcgcataaaaccaactggcgacaaaacgtcacgaaatgccagaatgcctcttccaggcattccttgctgacacaggaccaaacccaccacagtccacagcaacgcacacaatgtcttttgtccgtgaagcaatcacgagtagctctcctgagtagagtggatgatcatgggcatttgccccaaatgatcaaaggaagaaagagcgtaattaaagcaaagttagcaacttagcattcagcaatctgcattggcaaacgaggctggatattctgagccactctgcggagtgacggattcatgtgatgagttcacacggctgagcttggtggcctttggcgccaattgcttggcctcctcatatgtataaatgtatattcttttcgccatgctgcaaaactcgtcccaaggatcatccccaacaagcatcatatcatcctcttcatccgcgtaaacaacctgccatttcttgagtgtggaacatagctccccctgtatatcaaacatctcctncaacttg

SEQ ID NO: 14407 - DNA, 749 bp, Triticum aestivum
  Clone ID: PAT_TA_14407
gcacgaggagtatagtttatatgattttatcttcctcttggtttctttgcttgctactctcatccatcctttctgtgtcacgcccagtaccctgccgagttcgccgcgtaggccgctgccgcagtcgggcataattctgcaagaacgggagactactagttagccacaccacagtgaaacctgcagccgagaagaaatggaggtgaactccaggacgcgagcaagcgagcgattcggcgcacgcgcgtcggtggcgtcaacagaagcgggcgatctccagctcgatttcctttttggtttctctccctcccgtttcctcaatctctcctctcctctcctctcctctcatccggggcacagctgtaccttggctggcagccgacgccgacgccgacgtgcgggcccatcggtttccgggacagcatgtagtgaactgtggataggcggctgggcctggaaagaagaaaaaaaatgccgttggttttgtgcgtggcgagggcgcgaggcgatatgacgtgtgtcggggaaaggatgagggagagagaaagggtggacgtcactctcgctccgctccagtgccttggctcggctcggcagggctcctagtcctaagtgaacagtgacaaccgctgagtgctgatagtggtagtacaatccgaggtgatttttttttcaagaattccaaaagaaaggagataagggacggatgattagtcagtgagaattgctaaacgcacatgagtcgcata

SEQ ID NO: 14408 - DNA, 611 bp, Triticum aestivum
  Clone ID: PAT_TA_14408
tttgcttgttgggctcttgatgatatatccactttcatcaggggcttaagggtatggtcacttggagaagacatagctatgactagaaagatctgttttttcaggtatgcgtcgtacaagatggatttattcttgaccgattggaagcataccgcaacacggcgtacacaagggctagcctaagcatgcagatacagaaggtttagttcagtggctgtgctggacaggaggggccagggaattgctttaagttgttccaagagatgtgagcctgataaaacgatgacatagcagatttccactgtggtctccttgcaggaccactctcagtggttggccctcctgttcacttcgagcggccgcccgggcaggtgatgatattggccctgctgttgagccgcaaacatagaatgttgctttggcaggtcaaaggaagaagcaggtcgaaggaagaagtttagactaaagacatggtcaaaggaagaagcaggtcaaaggaagaagtttagactaaagtggagagaagaattttacagctgcgtgtatccggctggctgcgacgggcagggcggattgtacctcggccgcgaccacgctaggatgccacgctg

SEQ ID NO: 14409 - DNA, 798 bp, Triticum aestivum
  Clone ID: PAT_TA_14409
caacacaccagattcctaagagaatcaagatcagcatctgtgcaagatggagcacggccaggcgaccatccgcgtcgacgagtacggcaacccggttgccggacatggcgtaggcaccggcatgggcgcgcacggaggcagcggcaccggcgctgccactggtgggcatttccagcccacgagggaggagcacaaggccggcgggatcctgcagcgctccggcagctcaagctccagctcgtctgaggatgatggcatgggcgggaggaggaagaagggcatcaaggataagatcaaggagaagctccctggtggccacggtgaccagcagcacgccgatggcacctacggacagcagggtactggcatggccggcaccggggcacatggctccgcggccacaggcggtacctacgggcagccaggacacaccggaatgaccggcacggggacgcatgtcaccgacggcgccggcgaaaagaagggcatcatggacaagatcaaggagaagctgcccggacagcactgagcccgtcccacggcagctacttgagagttgaggtgccgatctggccacctttgcagaataataagatggagatgcagtaaaacatcccgaaataaagtgagctagctcacttgtaatatctgagttctgagtttgctgcactagaatttgggttgcttgtatgtgcccgggacgttttgtactctgtacttcgatgtgtgattttttttttggtttcactgtgtatgtatggggatgtgtatcgtggtataatacaatatattttgccc

SEQ ID NO: 14410 - DNA, 1541 bp, Triticum aestivum
  Clone ID: PAT_TA_14410
ggcacctgcacgagagagatctaagagaatcaagatcaacaactgtgcaagatggagcaaggccggacgacggagcacggccaggcgaccaaccgcgccgacgcggacggtagcccggtcgccggacagggcgtccgcaccggcatgggggcgcgcggcggcgggggcacccgcgcggcgcccgctgggcaggtccagcccacgagggaggagcagaaggccggcgggagcgtgcagcgctccggcagctctgaggattacagctcgtctgaggatggtgagatgggcgggagggggaagaaggggatcaaggacaagatcgagcagcaccaccagcagcacgccgctggcacctatgggcccccgggcaccgccgggatgcacggccccgggggacatggcgcagcagccgcgcgcggcacccacgggccgcaaggacacaccggagtgaccggcaccaggacgcagatcaccgagggcacgcggcgaaacgacgggcccggcggaaagaatgaaggcatggccgacaggacagaaaagaggccggcccgccacagctcctgaaggagtgcggctgctgagctggtcagctgcgcatattgataagcttgcggtataataaaaattagaggaataaagacagctagctcactcgtaatatccgagttctgagtttagtggacttgaatttgggttgcttgctgtttgccgtacgtactgtggtcggtacgttgttgtttcttcttcttgtggatgggcgtatagaggcactaattcacgtagaaagtcataaggtgccagataaggaggcagaaactcagagaatgcactagtgagcaagatcctcatgcagcagatgctaacggagaaggacagttccaaaaggcagcagcagattgataatgaaatgtttcttgcccgagagagagcccttgcagatgcaaactattacaggattacgaaggaagcagaggctaacaaactaaaacttacacctgagtatcttgagctgaggttcattgaatcaattgccaataacacaaagattttctttggtgaaaagattccgaacatgatcatggatcaaaggttgattcgaaatcaccttgattctgctccgagcaaggaccagttagaaatatagtatcatctcttgtaaatttgaaggaacgatggttgttttgtaatcctgtatggaggtttggatttccctgaagcccctcggcgcatgagaatcaaaaaaggatgtaatagtaggaccgtttagccttgtggacctttaccttttaaggaagcatcgaccgtcttgcccggcggaatacttgtagttgaaggatatgcacgcccttttgacctgcaagggaaagaaatgcagagctcataactgtaatgtgttgcaactggttgtgatttgttaggacttcctcaacatgctagtagtactattactgaagagctataaatgtgtttcacggaattggaagtaaaaaaaaaaaaaaaaacctcagggggggcccggtacccaattcgccctatagtga

SEQ ID NO: 14411 - DNA, 1335 bp, Triticum aestivum
  unsure (1)..(1335): unsure at all n locations
  Clone ID: PAT_TA_14411
cggcacgagggatcctggagagcgagcgaggctacctcagctcagctgcctgcaataagaaagggaaacacttgtagtatacgtactacactagtctcatcgcacatggattgatcccagccacagccgccgagcagcttccgccccccttccgcagctcagatgccgacgacgccgacgggccgccggccgcctccggccgccgtcctcctccgttgctgctgctgcctgatcttgcttatgctcctcccggcctgccgcgccttcccgctctgcaccgacgccagggcgccgctgccgctcaacgggacgctcgccttctgcggcaacgcccccggcgccacctgctgcgacgccgccgacgacaaggccctgcggggccagctccaagccgccaacgtctccgacgccgcctgcgccgccgtcctcaagtccctcctctgcgcgaaatgcaatccgtattctgctgagctgttcgacgccgggccaaagatccggacgattccgttcctgtgcagctctgcctcctcggcgacctctgctcatcagtccaaggaatcaacagtacaggactactgcaagctagtctgggacacctgcaaggacgcgacgatactcaactcccctttccagcctcccctgcaaggtggtgggagactgcctagctcatcgtcgaagctcaccgatgcctggcagtccgagagcgacttctgcacgtcgtttggtggcgcgcccggcgaccggtccgggggcgtcagcgggggccccgggtccttccgcgcctcccacgancctngggngtgcgtcccaaaggggtatnccnagaggggatcgacaaccggncctacgcctncctcaacatggttcctcaccctnatgggtcnggnggggtcntcctggggaccgcaagctggggnganagnggngggcaaccgtcccngatcaggggtccggcgggcaccctgggggttcagtgaggngggcctgnttggcgaccngacngaccaggngnatntcnantccacgtgggggctaatggggntggcgtttcanncccacttcgcgnggnncgggngnttcttcgcatcctanaactntgngaggngaaantcagncaggtttnctggnaggngttcctgcaattctgatgtggggtgtnatccctccaancttggnaccnataatngcccccaaccgngncaatatcaantcgttgtgtcagnatattctgntaaaggctcatcntcaaangtttctcacgnaacttctncagatccaactggagtcaaaaggatttttactatnggggtgccttatacaaataaccatggaggt

SEQ ID NO: 14412 - DNA, 696 bp, Triticum aestivum
  Clone ID: PAT_TA_14412
cttctccgcaacagtcaggacaatggcaacaaccgggacaagggcaatcagggtactacccaacttctccgcagcagtcaggacaaaagcaaccagggtactatccaacttctccatggcagccagaacaattgcaacaaccaacgcgagggcaacaaagacagcaaccaggacaagggcagcaactaagacaaggacaacaaggtcagcagtcaggacaagggcaaccaagatactatccaacttcttcgcagcagccaggacaattgcaacaactagcacaaggccaacaagggcagcaaccagaacgagggcaacaaggccaacagtcaggacaagggcaacaactaggacaagggcaacaaggtcagcagccaggacaaaagcaacaatcaggacaaggacaacaagggtactacccaatttctccgcaacagttaggacaagggcaacagtcaggacaagggcaactagggtactacccaacttctccgcagcagtcaggacaaggacaatcaggatactacccaacttctgcgcagcagccaggacaattgcaacaatcaacacaagagcagcaattaggacaagagcaacaagatcagcaatcaggacaagggcgacaaggtcaacagtcaggacaaaggcaacaagatcagcagtcaggacaagggcagcaaccgggacaaaggcagc

SEQ ID NO: 14413 - DNA, 663 bp, Triticum aestivum
  Clone ID: PAT_TA_14413
cgtccgcgcccgcgtgggcgtccgggcgggctttccaggaacggcccgcccccgcagctccactgtccgtgaccgcgaccgccaggaaccagagtaaagcagaggcgctcgtcgtcgccgctattccctactagacaactcgcattgccagccgctcaagccaagcgagcccctccatgatctccccgggagccagatcgcagctttgcctaatctaatcagagagagcatctccctccccatcatcgtctgacgagatctcagggccggagcaccggcccgcccatgcgcgtgccagccggagcggatgagcggcggcagcatggccatgggcgcgaggagcaagcaccatcccaaatctctggccctgcgctgctactgctacgcggcgagccaccgctccctgaccctgctggtgtggggcctggcggcgctgctggtcctctctgtctcttacctgatttgaccccacggcccggatgaccagggattttggccaaatttccaaatccgatctctttacagtgtgataaggcatcatttcttccttctcctgccgcagcgcgtgccagccggagcggatgagcggcggcagcatggccatgggcgcgaggagcaagcaccatcccaaatctctggccctgcgctgctactgctacgcgg

SEQ ID NO: 14414 - DNA, 1130 bp, Triticum aestivum
  unsure (1)..(1130): unsure at all n locations
  Clone ID: PAT_TA_14414
cgtccgcggacacttggcgcagattctcctcgtacgaagatatgtctatcagtgggacagttgttaggaatcaaactgaagaagcagaaacgccacgatcttcaaggtcaaggctggggactcaagaaaaaacatcaaatgcttcacttgaggatagtgctaccaaccttgcggaggcaaaggctgctctacaagctgggttcagaaagggaaatgctcgagaaagaccagccaccaacaaacatgaaaaggaatcacatgaacctagattttctggggtaaacagtcatgaggttcgaagtgagaatgttgactcgcaaaaaggtcgcaaatcacggcagccatccgatgggcaatcagccccccgagcttctgcagcttcacctgcactctcatccttgataattccttctctgaaagaggcttctggtgacaagtttgaaggacctgttgttcatgcagtcctcagttctctgatggatctagagcaagaaatacctggatcctgtggggtagttggacggcagaattctgcatccgccccatttcccgaaggatccgccgctgcaaagcctgcatgagacggcaatatcgatttttacaaagaaacctgagcccccctcggaagctggaagcaacaagaaacaagctagtacgccaccattggctgctcctaccgtaagccccctggcgagggtccttcttaccaggtggaagaaccaagtttcccaagacctgaactccgtttgatcgaagatcctccgatgcgtcggtccactggatagccggaccggactgtagacaaacccttccgggaatccccaatctgggagatgttctcagcggccagtgctgcccccatctggatggtctacgtggtttggtttactaaaacaacatatctgctgcccattttctaatgtaactgctaccgccaaacatgcatgacagagatgcacaaataacatatccaaattttgctcgttaagtacttntagagcgggncgngggccccttcgatttttccccccgggnggggganccaaggnaaagnggnccccaatttcnccctattagggnggnngnattaacaaattcactgggccgcnggttttacaaacgnngggact

SEQ ID NO: 14415 - DNA, 739 bp, Triticum aestivum
  Clone ID: PAT_TA_14415
ggtcgtccgcgcgaattccttcgaccccacggcggcgttcctgtcgtcggccgcgcaccatcggatgctgtcggcctccggaagactaaacggcatgctctccgacaccctgcgtagctacggcgcccccggcggcggcgtcggcatgggtctcggcggacaccatcatcatctccacggcgcgcagcccttcgggctggggtcccggttcatgcccaagctccccgccaagcgcagtatgcgcgcgccccgcatgcgctggaccagcaccctccatgcccgcttcgtccacgccgtggagctcctcggcggccacgagagggcgacgcccaagtcagtcctagagctcatggacgtgaaggatctgacgctagcgcatgtgaagagccatctccagatgtatcgcaccgtcaagagcactgacaagcctgccgcctcaggcccgaccgacggcggctccggcgacgacgacttccccagcgccggtggccaggccgggtccggcggcgacaacaacatgtgcccgaggccgttcccggagcaccggtccacctccgagggcgcggcgagctccgtcggcggcggcggcggcgacatggaccagtcctcggcggggaacgccagcactaggtggagcaactcctcgagcagggacccatggctgtcatctaactcttgcaacatggatgctcatcgctccattggactgtcttctccaatggagaacatggagccctgc

SEQ ID NO: 14416 - DNA, 1221 bp, Triticum aestivum
  unsure (1)..(1221): unsure at all n locations
  Clone ID: PAT_TA_14416
cgtccgctgagagagagatactagaaatgctggatcatccttttcttcctactctttatgcccattttacgacagacaatctctcatgcttagtcatggagtactgtccgggtggtgatttgcacgttcttcgtcaaagacaacccggtagaagcttcccagagccatctgcgaggttttatgttgcagaagttctccttgcgctggaatatcttcacatgctgggagtcatataccgtgatcttaagccagagaatatcctcgtccgcgatgatggtcacatcatgctatcagattttgatctctcgctaaggtgctctgttagcgccgtgctcctccggtcatcctcggtagcagcgaatcaccaaccaaagaagcttacaagcccttgtgcagagagctactgcatcaactcgtcgtgcctccagccctcttgtgcccaaacgtcttgtttcaggccacgcccctgggtaccgaagcctaggaagcctaaatcttccctgaagaggctgcctcaacttgttgtagagcctacagaagcacgctccaattcctttgttggcacacatgagtatcttgcaccagaaatcatcaaaggggatggtcacgggagtgctgttgactggtggacgtttggtgtgttcctttatgaacttttgtatggtaggacacccttcagaggtcctgggaatgatgaaacattggcaaatgttgtttcccagaatctccggttcccggataacccggttgtcagcagcaatgcaaaggatctcatcagaggattgctagtcaaggagccggagaacaggctgggaacgttgagaggagcagctgaaatcaagcagcaccctttctttgaagggctgaactgggccttgatacgatctgctgccccaccagagacacggccttgcgatgtcgtgactcttgcgacggtgcggaagaagaaagaaggcaaatgtctggacttcaggagccccgaggagctggagtttgaagttttctagtgaggtcttggtacagtttagcacaatttctgccgatagtctacaatttttctgttgagtaggtaaaggttggggctgtctgtacattgtagattcttgtatgctcagttgctgctatattcctgtgaatagatcacttttcttaattgaaaggaacaatcagagcccatggtatcattgccnnnnnnnnnnnnnnnnnnnnnnnnnnnnnnnn

SEQ ID NO: 14417 - DNA, 1033 bp, Triticum aestivum
  Clone ID: PAT_TA_14417
ccacgcgtccgcggagcgtggcgtcacggctggataccaccaccacatcggagatggcgccgcgcagctcccccccgagctcctccaccacccccgcagccccaaccccagctccaagtcctccagcaacgtcaccgtcgccaacttcccgtcgctcgccagtccgcatggagtagtggggtcgttgggcatggcgacgccgggaatggcatttgcggcggcggagggccggttctgcacgccgagggcggccgtgcagcagctcgagaactggggcgactccctctccggcatcgtcgtcaccagcccgctcaccgagacctccacggacctcgacgacagcggcgacaagcaccacgccctgatgggcggtggtggcgccggcggaggggcgcattcccaacgacgggtggggtgtgtcgattcctctgaaagaacaggagatgagaagaccgcacggaggcttgcacagaaccgcgaggcggcccggaaaagccgcatcaggaagaaggcttacctagcgcagctggaaagcagccgatccaagctgacgcaccttgagcaagagcttcagagggcaaggcagcagggaatcttcatcgccggtggtggctccggtgactgctcaagccgaggcgccttggcgttcgatttggagtatgcgcggtggctcgacgaccaccagcgccacatcaacaacctgagggtggccgtgatcgcggacatgggcgacgacgagctgcgcatcctcgtcgagtccgtgctgctgcactacgacgagttcttcatgctcaagaacctggcgaccaagtccgacgtgttccacgtcctgtcgggcatgtggatgagccccgccgagcggttcttaatgtggctcggcgggttccgctcgtcagagatcctcaaggtactggccagccacctggagccgctgacggaccagcagctgatgggcatcttcaacctgcagcagtcgtcgcagcaggcggaggacgcgctgtcgcaggggatggaggccctgcaacaggcgctg

SEQ ID NO: 14418 - DNA, 604 bp, Triticum aestivum
  Clone ID: PAT_TA_14418
caatttagtagcagttttgctctcgctatgctctgccgccttgtgtccctgccttgccgtttgtctcgccatgggctgctcaggcgctccgcgtcgcgcgactagtcgtcgactagtcgacgagtcgcagttccagggccgactcagcctctcggactcgactcctgggttgagtcgagcggactcgcgcgactagtctcgactagtcacggactagtcgcggtttttgggtcgaacgacttcgaggcagcgctggatctggagcactctcccgccgccgtgctgctgctgctgctgtgctgcctcgctgctgctgctgcgcccttgccgccgcgctgctgctgctgctgaagctgaagcggcaagaggagcaggctgggaggaggagcggtggcaagagagctgctgcgggggggttgagagatccatcgctgggaggagtggtggactggtggcaagagagtggcagcagaatgtgtggcggctgtggtgagggaggagggagtgtggatggtggattaggtcacaggaggagtatatagctactagatgggcttttcggccacagggaagtgcataactagtggcccatctctcagttggc

SEQ ID NO: 14419 - DNA, 902 bp, Triticum aestivum
  unsure (1)..(902): unsure at all n locations
  Clone ID: PAT_TA_14419
cgcacttcttccgctgcccctggccgcagattccttccgccccggcgagccggagttggaagtcacatagtactcgccctaacttaaaccagggcccagttattttgttcgttctctcaaagcccaaagccgacacacacccactatcccccgaaccccatggaggcacggacaagctcgccggcggccttcgccgcgccgcttccccacggacgatctcctccgggagatattcctgcgcctcccgcccgagccgatccacctctttcgcgcctccttcgtctgcaagcactggcgcggcctcgtccacgacgcccgcttcctccgccgcttccgcgatttccacggcggcacgcctcccgtgctcggcttcttcaaccaggaagggcctcccttcttcgtccctacctccggcggcttcgcgccctccgccgccaccgtgtcccccggtgactggtgggccctcgactgccgccacggccgcgccctcctggacagctgccgcaccgggacgctgctcgtctgggaccccgtgaccggcgacaagcgctacctgccgccccccgcgcaggtctctcctgggtgcttcggcgccgttcccgctgcgccgggccccgccggccaccccgaccacggcgactgccattcctgcccttttctcgtggcgttcgtgttcagtgacgacaaagatttcatcacttacgcatgcgtcttctcgtccgagnccagtgtctggggtgagatcgcttccattgttataccagatgcattagttcagcgannnnngacagctctggttggaaacacaatctacttcgtgttggatgacgatgtcatcattaagtttgatttggataagcannnnnngggcctaactgnnnncttcccatctgacactctnn

SEQ ID NO: 14420 - DNA, 631 bp, Triticum aestivum
  Clone ID: PAT_TA_14420
acataagccgccgcaaagtaagctttcaagaaatggggacagtggcaccaaatagtacttggaaaacattgaggtaccaagatcagtttgtgcattctccagcaaggaaaagatattatccatacccacccgagcattactacagtccccacacaccagctatgaggagtcccctggcgccaagtaaaacgccttttacaggtaaaacacctttgtccgcgacaaccgcgaggcgcaagatggtcttctggaccgaggcagaggaggcggctctgagggaggcagtggcgaagcttgccccgaagggggaggccgcgaaggagaagaggtcgatctcgtgggtgcgcatacacgattactgcagggagtcgatccaccccacacgctgcccggacgacctgcggaagaagtggaaccgcatgaagaacaagctgggtgtgtgtcctgaagacggtagcgtaggaggagacagctgcttctgaaacacccctcctcatcttgctgttgtaggtggaggggaagagaagtggccgggtcctcagcgctctaccggcgaaacgtctctgccctagaggcctgtttcgccctctgttgtatatgtggcgcggcggcgattgtctgtctatattta

SEQ ID NO: 14421 - DNA, 691 bp, Triticum aestivum
  Clone ID: PAT_TA_14421
gaattcggcacgagagttcagcccagtaaaacgatgataaaactgcggtgcaggtggacggacgacagctagtgtgaacggaaggggccccgccccgtcgtctccgcgcagagagaggcgtgtgaatgggcggaaaagtatgaaacggcaggcagcggctgcaactgcagcggcgtccaccggcgagggcgagaagaaaacgaagcgaaaagcggggccaggccacgggccggacgccagaggaaggtcgcgtggcagcgcacgccacccaaatccaagccaggccagaaagcgagcgccgaccgccgcgtcagcccgcgcgtgccgtcgtcgttgctaggcgcgcggcgggatgagggcggcgggcgggatgatggaggcggggggagggggaggagggttcagggacgagcgggtgccgcagtggggcgtgcaggagacgcgggagctcatcgcggcgcgcggggacctggagcgggaggccgccgccgcgggccgcagcgccaagacgctctgggaggcggtggccgacgcgctccgggcgcgcgggtaccgccgcaccgtcgaccagtgcaagtgcaagtggaagaacctcgtcaacagatacaaggggaaagaaacatctgacccagaaaacggtagacaatgtcccttctttgaagaattacatgcagtcttcactgaacgtgct

SEQ ID NO: 14422 - DNA, 664 bp, Triticum aestivum
  unsure (1)..(664): unsure at all n locations
  Clone ID: PAT_TA_14422
ctcgcccaatttccntgcgacgcaacgtccgcgaagaacatgctcaagaccaagatcaagcatgaatctttctcgagcgaaacgttggatgtccgtcctgcctcccttgcatcagatccaaggaagctgccttattcagggagtagttctttggcacgtactctgaaagatcatctctaccaatgtccaagcaagatatctgaagaaatggttagatgcatggcctccatatactgtcttttgcgcacggagtcaccagaaaagcctgaaaaggttcgctcgccgttcttgtcaagatcatcaacaagtgtcattcttcctcggaggggtaacagtgaggagactaatacatcaagtaacaaatgcattgtcgaagtatgttcaatctcagtcgaaaagaatcagacgccagatgtctcctgtgcaattacccactacaggttgcttgtggagcagcttgaaagggttgatctgagtatgtcagaaaccagtatcaaactggccttctggatcaacgtgtacaattctcttgtcatgcatgcatatctagcatatggaattccaaacagttctctgaaaagaatggctctatttcacaaggctgcctacaatgttggtggatatgctgtgacggccaactccattgaacactccttgctgtgtt

SEQ ID NO: 14423 - DNA, 557 bp, Triticum aestivum
  unsure (1)..(557): unsure at all n locations
  Clone ID: PAT_TA_14423
cccgccccgagcggtttcccccgccgcgccccagcctccggtgccgagcgcctcccgccccagcccccccgcgcaggcccgcaatcccccgcactcccagcgcccccctgccggtccaaccccatccccgccgcgcaggcccgctcgccccccctggccctccgcccgcctttccgcgccccccggccgcgctggccgagggcgccgccgccccgccgcccccctgggcgggggacggcgccgcccccccctcgcgccgcccgccgcggtccgtggtcgcgccggccgcggcggggccgccgcggccccagcgcgcggcggcgccgccggggcagcgccaccaccagcccacgctcgcccccccggacgagccctccggccgctccgggctccgcggccgctgcgccgccgcccgccgccgcgccgacctgcgcccccccgccctccccccccccccccccgtgcgccccccccccccccctccccacgcccccgccggttggctacggcggcggaangcgtggacaactnaaggacangggcaattcggganaagc

SEQ ID NO: 14424 - DNA, 750 bp, Triticum aestivum
  unsure (1)..(750): unsure at all n locations
  Clone ID: PAT_TA_14424
tccttatccaactccggccgccgccatggccaggccgacggggtggtgcgcctccgtcacccatccatccaccagcatacccaccaccagcagcctccatccaccactccactagcgccaccatctccagccactgccgccatcagcaccaagcgcctctctcctccttgctgccccgatcttgctcctcttctctctcaacgtcccctgctgctgctccttcttccatgcaacctgctgctgctccttcttcctatgcgccctgctgctcttcttgcgcccaagctactgctccttcttctatttctctgctgctgctctctcaactctccacgctgctgctgctccgaactccaacctcctgctgtctctctctctctctcaaccccttcgctgctgctcctcccctcgtccctactgctgctcctcctccgctcaacttcttctacctgccgctgctgctgctctcaacctctctccttgcgcctcttcttctctcagcgcccccttgctgcttctctattgctacaccccctgctgcttctccttctccaacaccctctgctgaatctctctctcaacctccctttgttgatgctctctcctcaatcttgctgctgctatctctctttctccctctaatctctgaattttctgaaattggagacgtgtagtacatgtaatattcagattggataaatcttgcaacctgatattgttcaataatcgtacttggtnaaaaaaaaaaaa

SEQ ID NO: 14425 - DNA, 691 bp, Triticum aestivum
  unsure (1)..(691): unsure at all n locations
  Clone ID: PAT_TA_14425
tgttcttagtgattctgatgaagagaatgacacagttgtgggcccaccaacggtctacaacaatactactgtaaatggcggtggttttccttttgccactagtggtgctggatttactggaagataccaggaagatgctggcgtcggtactagtggccttggtttattaagcaacaatgctgatgattttgagatgactaattggcaaatgccctattcccaaccggagcaaggctaccagtttttcggggatggcaccgccgatacttatgttggttcgcacaattcctttagcattacaccaaacgactattcccttgattgtaatgttggcattgaggaggcttctgtagctcatgaccttccagtttaccgcagtaataatgaaatgcatggaagtttggttgataacccattggctttcggtggtgacgatccttctttgcaactttttcttccaagtcagccttcttctgctccccttcaggaagaaccaagtgagcgtgtaaatgcatcaaatggggttcagtctgatgattggtctccttacgctcgcagctgtggangtgnaatgaaagctgcaacgcaatggttaaatttcaagacaatacgtcaatagacagatggacataatgacgcgctcgtcttcaacaaacatgaaggagaggngcaattaaaccaganggntacn

SEQ ID NO: 14426 - DNA, 656 bp, Triticum aestivum
  Clone ID: PAT_TA_14426
ctcgtgccgaattcggcccctgctcccttccggtctcctcgccgccctcaccgccatgtccaccgccaccggcgcagccgcctcgaactccctctcccccaccaccagccggcgatcatcgccgtcttccaggatcctgacgacccctcgcggatctctttcttgcagactactatcctcttccccatcgcagtctcccctcgttccggtctccgccatggcctccccgggcgctgctggcgaggcggcttccaggaagaagcttctcatattcgacgccgagaaggacctggcggcgtctctggccgagcacgcggcgggactgtcggagaagttcgccgccgagaggagcgctttcacagtcgtgctctccggcggctctctcatcaaagctctgaggaaactggctgagccgccgtacctggaggcggtggactggagcagatggcacgttttctgggcggacgagaaggtgggtcccaaggacacgcggacagtaactacaaactggccatggatgagttcccccctaaggggccggttcctgctaaccaagtttacgccatgaatgatgcactgtcggttgaaggagctgcggatgactatgaaaattgtttaaagcaactcatcaagaatggtgtgattgcggtgtcacc

SEQ ID NO: 14427 - DNA, 1648 bp, Triticum aestivum
  Clone ID: PAT_TA_14427
tgcggggatggaggcggcattcgggtctggagatggcatgagaagcagagctctttctgccactatctctacaaaggtgatgcttgctcccattcatggcttggtttgcgaaattagttggagttgtgattaactagcagttattaaatatatgtgctttcattaagaagaataagctaccatgctagattagttgatccagggcttaagttccgagctcagagttttttattacaccagtttaactttcatgtagttttgtgtattaccgtattatgtagcagcagtaagcagagcgcttatctctaccttctttgtgcagagaaaatagtctcggagtgaatcaaatctggctctagtttgtagacatgctgcaccgcctactaggaaatatatccgtgcttggtagtttgagactactggtgtgaagatcttgctccaaattcacatgatctaattagtgttctatacagagtaacacttttgggctttgggttgccgctggatccggacaagataaggcttgccttacctggtgaagtactggctaggaagagtgcaagctgccgcccacacataccagatggtccccgtcaaggacgttgttgtactgactgccgatgatctacagctcaagccatttttgtcgttgtatgacaaggctgtcgatgtcatcactgagctgccttctttgcttcagaggcttattgtgctgctatagttctttgtctcttatccactcacccattgtagtgcagcaattgcaagctccacattcccatggctgctcatcctccgtaactttctctagctgagctcacgccaccactgcggcacaactctcttgtagctatcgggtgaccgcgtgtgtcgttgccaccactagcgagatctgggagaaagaggaggcaaagagggagatggagcggcaagaataaaggtaaaggaaggaggaagaggagacaccctaagcatgccggtgacctccaggcccgctactacgacttctccaagcaacaccaatctacaacagcaagtgtctcgagcaagatgaccaagtgttggtgggtgggcatcaacaaggtgggctgtcagcacggtgttcgagttggtcagtagtggtgcacctgcgccatgtatggatcaatactctaggaggttctgtcgaggcccaatccatccaggtcggtgcctttgccactgtggtgaacacccgccttttggcctgggcccttctccacccgtgtatcacgggatgtttttgctgcccttctaccttcctccctgtccctacttttccccatcgcgtgctgggccctctgaagtaaaataaacatgaaactacatgctaaaaagtgggtgataaatatctagttactaaattcactaaatttgtgatcccaaaactgtgagcaaaatagtgaaatgtcagggtttactctactgcaaatttgcaatttacttgaactttgttgtgatgagcaattcagtttctttgggcaaaacgcctggctaaacaaataaatgcatgtgcttttcatgttttgttcccagtaagaagctgattctgtatcttatgtacttgttgtgagctacttttaactctgataaagaatgtacattggattaaaaaaaaaaaaaaaaaaaa

SEQ ID NO: 14428 - DNA, 767 bp, Triticum aestivum
  unsure (1)..(767): unsure at all n locations
  Clone ID: PAT_TA_14428
cacgactccgccctcgccgccggcgccgccttcgtgtcgggcaacccggcggccgtgcagagtgtcactctgatcgacgccactgccactttgccggctttcccggcggccgttctcggcgtgccggcgctggggaggctggtgctgcgggtgccggcattgttcaaggggctgatgcgtctgtcctgctcccggggggtggatgcagaggaggccgacgcgctcagggcggcgatgcgggggcaagggaagagggatgcggtgtttgaggcctggaaggccatgaaccatagctttgacctggcagagtggaggagctcttcagaggaggtgaagaggctgccgatgatggttctgtggtcgggttcttggtcggatatgtggatcgatgaggggaagaaggtgaccaaggcgttgccggacgccaagttcatctaccattatggcggccgatggcctcaggtggatgcatatgacgaaatctcaaacttgatagcagattttgtgaccatgttaccaacaactgcgacagagcacaggtcgaagaatatggaccaatcatccggcgagtcagtagatgctcacagcgatcatccagtttcatgaaaaccaagaactatctgattcatggttaaaaaatgcctcgcgagcatccatattgttcgaccaatcgatttcgtctgcctttgacaatcctaactngtccgcctagaanggatgatggctcttcnttanaatcgcccgttgcaaccgtttccccgannccc

SEQ ID NO: 14429 - DNA, 901 bp, Triticum aestivum
  unsure (1)..(901): unsure at all n locations
  Clone ID: PAT_TA_14429
gcgccgcgtccgccagctccacacacgacagcgagaaggggaatttttctagctagggttttagacagcgcgggtcggagagaggcgatgggcgcggcggtcgacgagacggcggcggcggcggcggccgcggctgtggcggcggagggcggcgccgctgccgccgcggcggaggccgactccaaggacctgcagcagcagagcaaggccctcgacaagctcaccgaccacgtcgaggatcgccagctcgactcctcccgcgtccaatccgccatggcagctcttgcttcatctaaagaggctgactggaatgccatgagactgagggagaaagaattagctgctgtcaagatcaaccccaccgacgttgaaatcatcgccaacgagcttgagttggacaaggaagatcgcagagaggacgctccgagagcacaagggcgatgctgttgccgcggtccggttcttgcttcgctgatcttgaacacatgccgcctgcgtgcgtgcaagtgatttcgtttgatcagtaaaccatgcggatgggcctgtactttgccttcctgtatcacagtgaaactaccgtttttgtcgctcatgcagaacttatatttccatggttgctgcagactggtttctgtccccttgaaaaagaaagtcagaaagttgctgcgtaaaaaaaaagaaaaaatatccgagtgcgggtccggggcgccccatcgatttttccnccccggtggggggtaccaagntaagnggtacccaatttccccccttatagggaggnccgtatttacaaattcactgggccgncngtttttacaaacctcgtgacttgggaaaaacccttggcggttaccccnccttaantcnccnttgggaananattcccctttttgccaggtgg

SEQ ID NO: 14430 - DNA, 723 bp, Triticum aestivum
  Clone ID: PAT_TA_14430
acagagtttgcgagtcaactcgcgccaccgcgccaccgccaccgccaccacgcgcgcggagacctctcccccccagggcggcgccgacgtggcgtggtctggtctccgcgcggttccgctccggcggggcgggccgatttggcgggtcaagggatgggagatctggcggcgggcgggagatggtgagcgccagcactagccggggcggctcgggtcgcgccgctcggcggggcggcggcggaggcggcgccctgcccgggagcccgcgggtgtccgcggcggcggcggcgcagcgcaggtggtggggggcctcgggcccgtcgctggagcgagtcgccctcgccttctgcgtcgcctccgtggcgctcgcgctctcctgcgcgctctacctctacgtcctccgctacctggggcgggggcaggccgtggccgggttcgtcggggaggacctcggggcgtgcgacgtgttcgacggcaactgggtccccgacgcgacctacccgctctacaacagctccgagtgccccttcgcggagaaggggttcaactgcctggccaacggcagggaggacaccggctacctcaaatggcggtggaggccgcgccgctgcgacgtgccgaggttcaccgccggcgccgcgctcgagcggctcagggggaagcgtgtcgtcttcgtcggtgactccatgagccgcacgcagtgggagtcctttatctgcatgc

SEQ ID NO: 14431 - DNA, 1007 bp, Triticum aestivum
  unsure (1)..(1007): unsure at all n locations
  Clone ID: PAT_TA_14431
aggtcttccagttccttacctagtgaccgcggtcaaagtagacattgctccaagagatggtagaagagttagcagtggaaatcttattgatgttgctcgtcaatgggttgacaagcaaggcctacttccatcgagtgaagaacttccacttgtggatagcttccctggcaattctggtctgctcacggctgcaaaagaggcaagatatgataaagaagctgtggttaagttcttccgcatgttgataaggaggaggtatttctcgaatgaacttcctgcccctagcccatggtctctcactcccagaggggataccattcttcctgtagaaaccacgaatgacgaggagttgttcaaaaggaaaagctatggcgggcagaggtacaaatacaacggtgtcgccccactatctgcacagcagaatgtaactctaccactcactccctctccgcagcagccaatgtcctcttccgcggagaactacagataccacagattctcgtcatcggcaattcctgacaaaaacagtagtaggacaagccgactagacatcaatttatgatacatgggctcataatcaccacgaaatacaacttgcgacctggaaaaagcacatactgccgggaaaatatttgaatctgactttctgtattcttgagaagttctactactgtcttactggcaacacgtgcatgtcgtcggatatgcctctttttgtttatttttgtctatcattgtgggatcagcagttagcatttcttttgtatcttgtccaatatttgttgaactgtgatcgtattgggattggagacaatgaacatgtataaaatcagtagaaacattttagagggcccatagtgtcggatctgttccatccatgatctaaaagccacctggnaacaattaggaaagggacttaagattggactgcaactataatggaaatggtccgggataattttaanaccggangccacccaaattnngttaattgnaaaaaaaaaaaa

SEQ ID NO: 14432 - DNA, 1073 bp, Triticum aestivum
  Clone ID: PAT_TA_14432
ggcacgagcgctcctctctcgctcgtctctccctctcccccgcaccacttctcgccgccgccaccaccgacggcgcccgatcccgcccgattccagcgtcctccggcgcgcccagcacaccaccgtgcccccctctcaacgctccttcctcccatcgggccagatccggcgcgcgcgtcctccagcggccaagcgcgaccctgcccagcagctagggtttgggccagcacatcgccggcctggctcccgcctcccgctggcgcctttcgtctgcccctcctctcctcctcctctcgtcgtctcctcgccctcgctcatcgagcgcaccgcaacccctcggccggagagagaggagctgctcctagtataggacgccatggaagtttgtcctagttctgttcttttaaatttttttgtttctcttcccgatctagacatgctgaaggctctgttttttgcaggtgttgctctaatgaggagaaactgctgctgcaggacgtcctcctcccctcctacgcccacctagggctcccgcccgcgccgccgcaatgggataggcacgtcatgaagggctgcatgggagatatgtccatcgattgcctcaggttcttctttgatcgtagatcgttttcctatgatgccgacgacagaatcccataatgtatgtccattgccaatctatggattttacaaagaagattgactaattaagagcttagatgtgtctgcagaggcataaaaaaacatggtgatcagaaggatttgtacgggtaagatgcaaacagtgctggcctatattagcatgcagtttttttattggttcttataatttatctgtttcccagcatatatccctgattctttccatcaatttagcggcgaatcacgtcatccgattgactcatattgcaacagggaaaggcagatatgccatggcctttgcctccatgtgccattggcctttgtgtatttcttttatttgggggaaaacgagattgagatatagactatgaacatcgcaggctgataatgtaattggccttctgcccagattttacaaaattggataatga

SEQ ID NO: 14433 - DNA, 1246 bp, Triticum aestivum
  unsure (1)..(1246): unsure at all n locations
  Clone ID: PAT_TA_14433
gccccgctgctgtagctcctgcccccggcccacactcgctgtctcccacccgccgagccgccgcgtctgacactagctatctcctacccacctatcccccgtccgtccgcccgtctaggtctctggagaagcggcgatggcggcgcccgtgacggtgtacgggccggcgatctcgccggcggtggcgcgcgtggcggcgtgcctgctggagaaggacgtgccgttccagctcgaggcggtggacatgtccaagggcgagcacaagtccccctccttcctcaagctccagcccttctgccaggtccccgccttctaagaccacctcaccaccgtcttcgagtcaagggccatttgccgttccatctgtggccagtacttcgagcgtggcgaccaggcctctcccccgccggaaaaaagactaagctttaggctgccatgccatcgagcaatgggtcgagtccgaggcctggccatttacctggccgaggttgaccagcacgttccggcgcatgttcgggccccccaagggtgcgtggagacccacatggccgtggtggatcaaaatgaggcggagctcgccaaggccgctcttcgtgtatgacccgcggctgacggacatccaagatttcgcgggcaaccaggtctgactagccagactaggaatctggcccgatgttgggatgcgggctacgaaggcccgcaatggggggatgttgtccacttgcagagcgtcctacaacccttttaacgtggtggcgcctcttccgttatcgactaaggatcttgtggtgccaattggtcaagttctgttatgtgttgccgccactcttcaatgttttttgtgtggtgcaagtcccgggctcactttgtacaatatgtgttctggcttgctatcactgcctaattgttattgtgttgtgaaagactcgggctgctttgtacaatatgttatcctgctatctatctctgtggtattattgagtttgcagagctcaatacgctcgccccgtattccgctcgaggggggggtggttcactaccctgttactttcagcgggtcactgacaatctctttccctaccaaaaaaaaaaaaaaaaaaaaaaancaccnngccgncgagcggcngnccgggcaggtacgacgnccgtcgagcagctccgtgcgaaccgtgtgtttcatgtatntttttttttctccaatacaatcgtgtgttcncctatcgtatccaagaataaaatggtgtgt

SEQ ID NO: 14434 - DNA, 720 bp, Triticum aestivum
  Clone ID: PAT_TA_14434
aatcaaccattttactgtcaaacacaacaaccatttccccagacccaacaatcgttccctctgcaaccacaacagccattcccctagcaagcccaacaaccatttccccaaccccaactaccattcccccagcaaccagaacaaataattccccagcaaccagaacaaataattacccaacaaccattccccctgcaaccccaacaagcattcccccagcaaccccaacaaccatttccccagccccaacaaccaatccccgtgcaaccacagcaaccattcccccagcaatcccaacaatcacaacaaccttttccccgaccccaacaattatttcctgaactccaacaaccaattccccagcaagcgcaacaaccattcccccaacaatcgcaacaaccattcccccagcaaccacaacaaccattccccctgcaaccacaacaatcattcccccaacaaccacaacaaccattccctcaacaaccacaacaacctttccctctacaaccacaacaaccattccccctacgaccgcaacaaccattttcccagcaaccctccatcctgcaaccacaacaaccacaacaaccatttctgcagccccaacaacaattatcccagcaactaggacaaacaatttcccagcaaccccaacaaccattcccccagcaaccacaccaacctcaacaaccatatccacaacaacaaccatctggg

SEQ ID NO: 14435 - DNA, 608 bp, Triticum aestivum
  Clone ID: PAT_TA_14435
cggacgcgtgggcggacgcgtggggtcatttacactgattttttttgaaaaagctgatccctcgagcactttcttttcctaatatctttcagaagactattgtgttcgcgtttgtaaagttcgcaactcttttcctgagcatacttattgtatgcgggtaatgatggaaaaggttccggatggtgattggttttgtgaagagtgccaaactgaagtagaatttgaaaaggagaagttagaaaaacctcaggtgaagcttgtcacttcaaaggaagaatctgttcaagggaaaattagtaaacctttcaatgatgcaaacagcagaagtccttgtgagaatgaagtggaggatgaaactgttggcagaaaagaacggaatgaagcaaatcaaggcattgatatggttgaagatgcaaagattccgcctgtggctaaacaaaatattcctgaacccggtggtttatcaatggagtcttactccagaaaaggaatacctctgctatgcgagagctcattcaagttggatatggagaaaggaaagcaacctacttcccaagtgccaccttactggggtctaatgctagcaagaatcaggcaccaccacttac

SEQ ID NO: 14436 - DNA, 834 bp, Triticum aestivum
  unsure (1)..(834): unsure at all n locations
  Clone ID: PAT_TA_14436
cgtccgcccacgcgtccggtgaagagtgccaaactgaagtagaatatgaaaaggagaagttagaaaaacctcaggtgaagcttgtcacttcaaaggaagagtctgttcaagggaaaatcagtaaaccttacaatgatgcaaacagcagaagtccttgtgagaatgaagtggaagatgaaactgttggcagaaaagaacggaatgaagcaaatcaaggcattgatatggttgaagatgcaaagattcctcctgtggctaaacaaaatattcctgaacctggtggtttatcaatggagtcttactccagaaaaggaatacctctgccacgtgagagctcattcaggttggatatagagaaaggaaagcaacctactccccaagtgccaatcttactggggtctaatgctagcaagaatcaggcaccaccacttaccggtcaactctccaagtccacttctttcaacagctctaaggtgcccaaggtgaagcaactagtgaatgaagttcctcaagaagaccaaaactttgaaggatcagttgtcctgtagtatgaagaaaagaggggccaacgagcttttcaaccaagtcaagcatcattcaaaaagcccaaaacttgtgagccagcaaataagcaaatcttccatcataccacttctggaggagctaagtgtgatgaatttaccaatgagccgaatgttagtaatgatagaggactctatattaaggatgcccctcaattacnggacacggcttttcaattcaacaaaaccganctgcactcaacgctcactacanggaatacattntggactacaatcaggcaattaccaantt

SEQ ID NO: 14437 - DNA, 1065 bp, Triticum aestivum
  Clone ID: PAT_TA_14437
gccggccgagtgaaaataagctcagagcattccgatccagaccagccgccccccgcatctcgagtaatttccagctcgccggagaagtagaaagaagatggccggaaggaagggcggcgacaggaagaaggcggtgacccgctccgtgaaggccgggctccagttccccgtcggccgcatcgggcgctacctcaagaagggccgctacgcgcagcgcgtcggctccggcgcccccgtctacctcgccgccgtcctcgagtacctcgccgccgaggtcctggagcttgccggtaacgcggccaaggacaacaagaagacccgcatcatcccgcgccacctgctgctcgccgtccgcaacgaccaggagctcggcaggctgctcgccggcgtgaccatcgcccacggcggcgtgatccccaacatcaactccgtgctgctccccaagaagtcccccgccgccgctggtgttgcatggaagtcgcccaagaagaccgcatccaccaagtcccccaagaagaaggtcgccgccaaggagtagaattgcccatagcatagcctagccagtgttgcctcgttccatttctcatggacaagacgagcagtcttttggttatttagatgagtagtatctgtgatttctgtaggaatggttaatcatgcaatcattcagatcttgttccccaattgagctacctgtgccgttttatactagtagtggattctcacttctatcaactaaaaaaattaaaaaataaatagcgtcttacgcaaaaaaaaaacctacaccgacctagctcgccgcaagaccgtcaccgccatggacgtcgtctacgccctcaagcgacagggacgcaccctctacggattcggcggctaggccccgcgaatcgagcccacgccaacagattagttgctgtagctagctatggttgtgtagtgttcatggtctttgatgtggtggccgcatctcgctgctttgatgtgatttttgtcagatgttactaatttcagattggtctctcgctctgtaatttgtcgcctcctcaaatcagtcgtgttggcttc

SEQ ID NO: 14438 - DNA, 960 bp, Triticum aestivum
  Clone ID: PAT_TA_14438
ccacgcggccccgctccctcaccaaacacgagaccccagcgccgagccccgcccccccttcccctcgccggctccacacgatcccaccgcgtgtcagcggcgatctgctgccgatgacgcagaagaagcgcccccgccgcagggaggtctcctcgcgaaggaccctcccgccgtcgccgcggtgaagaaggcgcatcgttgtctggatcccttgtcgaatcggatagcagcagcacgacatccagcgcgccgccgtccggatccttcgacaagccggccgggcggacttccagcgcgccgccgtccggatccttggacgagccgccggtcgcctggccggcccgccagtccaggtaccatgagatcctcgcctcgcgtctcgtccgattgcagttacaagcgggcgtcgccatcgacagcccaaatcttccttccgatcaaattgtccaagtcctcgctcgttctaatttctatgatgatgagctgcgggctgctctggtagaatatcaagtccaaaagttcttgagcgtaccccacggaccagatgttgaagatacatactttggagaggagtcgggcgatgatatcactgcagaggaattcgtcaagtactccggacagctaaagactcgcagacctgctgaaattgatactgagactggactggatcaagagcagttggacagcctccttgccaagtataaacgttatcgcttcaaagcttacctgttgttgttaggaaagcctgtcgacgagctagaagaagctgcattggaatccaagtaccctatggagcttgccttggagaatgacttcttctatccttgccatcatgatagcgcctttggctggtattttgactccgacctctgtttacttgcaaacttgagcgactaccagcggctagtccttcctaaccgtggtgggaatgagtatgaatatgacagatggagtcagtac

SEQ ID NO: 14439 - DNA, 582 bp, Triticum aestivum
  Clone ID: PAT_TA_14439
ggaagatctctcgcctcccggcccctcctccagacggaatagctgattggccgcgctccgctccgctcgctctccgcgatgctcttcgccgccgccgccgccgacctcggcctccggaccctgatcgccgccgacaaggacgtgaaccgcaaccacaacgttgccacgcgcaccatagccgcctcgcgccgcgcggtctgctcccccggtggcggagagcgcgatccggaggtctttcagggggaggatggctgggatgagcccgagaggggagggccgcgggtgttgggtgacgtacgggtggcgccggcgtcgcctccaccgcctcccgccgctgatcccatcgctgcgccggccgggcagctcgccgtgggcgctgacgcgcacgcgcaccgcggacgggcgtgtcgtggtcctgcgggagtccgccccgcgccggggccgcatcgtcgctaggaggatggacggccgcctcatcctcgacctcgtcgacagcagcccggtgcccccgcggccgagacagcgcctggcgcatccttctatcgtgcaggaacccgacaacgtgcccaacacagacgacgc

SEQ ID NO: 14440 - DNA, 646 bp, Triticum aestivum
  Clone ID: PAT_TA_14440
ctgagagctataggagctggagatgatatggtcgtcggggccgggcaccgtctcctccgccaccgcgcgcgtccgagggtcgagctcgcctccgatgtgccgctctcgctgcgccgcgaccgcgcaggtgaggggcgggcccgcctccctgttacgccccgccctcagtacatgccggtactggtcgacgacacgggaggagctggtcgacgggggacgtcgtcgaagtcgactgccctgcgatcatggtggccaacagcgacgaccccgtggaaccgcctctgcctcccccgccggtccgacgccgagctcggcagcagcagcgaagctactgtggtttgggctgaatgattcagcgtgggatgactgcgacgaccggaaccccagctcgagcgcgcccaccacggctatgtactgcaccaggccccagcgttggctgccttccttgcaggtagcaattcgcctaacccctttccgtcaattcattggaggagaggcacaacactcctgcaatggctagataggagtagatgacaactttttactgtgtttttttggtcatggcaatcttcacagtactttgtgtagctagtgatggcagttttcatttttttagtatcactgatgtcatcattttttcatcaaa

SEQ ID NO: 14441 - DNA, 484 bp, Triticum aestivum
  unsure (1)..(484): unsure at all n locations
  Clone ID: PAT_TA_14441
cgtccgccctacactgcccccaccaggattgcgctgccttgccctgcccgatcgacgccggctacatcgctacactccccatggccaggtaagcgcctaggccaagtaacaagttatcacatcttcgtgatccaattaaatgtgccaatggacaagtacgtaccatcctacagatattgttttcattgcacttctattaagagtacgacaaaaaaattagaattcaccaagtccacgcccaatgccttagtgcacgatggtgatgtgtgtgtgtgttttgctaatgttcaagtgaaagatagtgcacagtaccggcttttgtggaaccctaataaaactgccttaccggatttttgtcacctctagtgggaactgtcgttctgagtgttccattattcaagatgccacgggaattcagtgaccctttgaaacatacctgggataanggntantttggaacccnaaaacaaatnaaanggaattc

SEQ ID NO: 14442 - DNA, 986 bp, Triticum aestivum
  unsure (1)..(986): unsure at all n locations
  Clone ID: PAT_TA_14442
ggnctgcaggnaattcggcacgagggccgcgacggccgcctcgtcgtcgaggccgtccccgtgctgtccaacaccctgttccgctcgcagcgccgtggcgggcgcctgctcctctccttcgccgacaccgccgcccccgccgaggacgaggggaagaaccacgcccaggaagccgatcagcagcaggccgacgagcagacccacgaggaggaggaggacgatgacggcgaggaggaggtccaggtcgtggacagaggcaccgtcgtcgaggtcaaggtcagcacgcagccccaggcgcacaacagtggggcgcgggtgcaccgctcctcgctcgtcatcaacaagttcgtcggcgccgagcccgtcaacgcctccgagatcaatgacaccgccgctgcaccgcagcagccacccaagcctccgagcagttcggaggccggagctccggctgtaagcgcgactgcgacactgcctgacccggaagatgacggcactgctgccacgccctgcgagggcaaggtgctgatgacgatgaggaggcggcggagcaagcaggagctgctcaaccacatgcgccggtgcggccagctgagcgggcagctcttcatatgggagccgcgcgtcgccacctcctcctgagccgatcgtcgcacacggcccgccggcgccgccgcctcctgattccgtccgattccatgcctcccacgagtgccctgtttctgtttgtttgtagccgttgctgctgccggtgtaacgtaagcgtgcgtaatatatggatgtttgtgttagtagtaagtgataatcacgtgcttggcttagccgtatgagcgagtgcgagtgagagcgagagaggttgattgctttggttatccacgtgcctccgcgcacgtgttgtatctacttgcgtgctatccagtggtcataatttaagataaacacggaatgtttgtgtgatttttttttaaaaaaaaaaaaaaaaaactcga

SEQ ID NO: 14443 - DNA, 656 bp, Triticum aestivum
  unsure (1)..(656): unsure at all n locations
  Clone ID: PAT_TA_14443
ccacgcgtccggcgcgcgcccgcacccgccgtccgcccacgcgtccggcgtcccccccctcaccgacgttagggtttcgatccgtgccggcgtccgcgggaggcggaggcgtgcttgccagccggagatggaggagcctcactgggagagggagcgtctcctggacctggccgtcgactacggcttcgaccgcgacttcgccgtagccgccctctcccgcctcgtccacctctacggagaggatggccaagatttcattactgtggagaactgtggcgatgattttattgctgcattggctgatgcaacacaacttactgatgactgggatgatctgaatgcaatagagactgaagcttgtggcaatttgaatgaaatgatgaggaagggtgtaaatgatgaaaaaggaggagttgttctggatacccctttgttcaaaagggcagactcctccagtcaacataatccgaggggtttaaaatcaccgagctccccctctgttgattcggattttggcatatttgatgaaacaaacacccaccgtgataataacgtgggtacccagaagaagccacaaacaagaaactctaaagctcagacnagaagctcaacaaaatctactgtgacnnnannnaccaagagatatgaatcatcnn

SEQ ID NO: 14444 - DNA, 662 bp, Triticum aestivum
  Clone ID: PAT_TA_14444
cgtccgcccacgcgtcccccccgccgtcgccgcgacgacgaagccgaccaaaagtaagcaacgccgccgacccctcgagtaggggtgaaacaaggcaaagggagagtaatgtggcgtcgctgcatttgttgtcaagccgctgagtttgatgagaatgaaaatgggcgtgccaaggccaaggccccaacaaataacgtagatggaatgaaaaagggtttgaaagattctgctactgtgaaagccgagccacaagattcagctccctctatcaatattcctgttctatctttggatgaattaatagaaaagactgatgattttggggcaaaggctttaataggcgaagggtcttatgggagagtgtactacgctgtccttgatgatgggacaaaaatggcagtgaagaaacttgatgctactgaaaatgagcccatatcagaattctcgactcaggtttccttggtttcaagattgaaacatgaaaacttcgtagatatattgggatactgtatggagcgtaaccttcgcatagtagcctatgaatttgccaccatggggtctctgcatgatgttctacatggaagaaaaggagtacaaggtgcacaacctggtccaccacttaattggatgcagcgaatgaaaattgctgttgatgctgccaa

SEQ ID NO: 14445 - DNA, 1140 bp, Triticum aestivum
  Clone ID: PAT_TA_14445
attcggcacgagggttgtgacaggaacaggaacaactcacctttcattaacttccaagggttgctggtttccagtggtctgaccaacgaccacgaagacatgatcggcatgttcgagtcgtggtggcaccacggcctcatctccgacgagacccgggacagcgggctcaaggtctgcccgggcacctccttcatgcaccccacgccggagtgcaccgaggtgtggaacaaggccctggccgagcaaggcaacatcaacccctacaccatctacacgcccacgtgcgacagggagcccagcccgtaccagcgcaggttctgggcgccccacggccgcgccgccccaccaccattgatgctgcccccctacgacccctgcgcagtcttcaactccatcaactacttgaatctccccgaggtgcaaacggccttacatgccaatgtcagcggcatcgtagagtacccatggactgtatgcagcaataccatatttgatcagtggggacaggcagccgatgacctgctacccgtctatagggagctcattcaagctggactcagggtctgggtctacagtggtgacacagacagtgtagtgccggtgagttcgaccaggcgctctcttgccgccctggagcttcctgttaaaactagctggtacccatggtacatggccccaaccgagcgcgaggttggtggctggagcgtgcagtatgaaggcctgacctatgtcaccgtccgtggcgccgggcacttggttcctgtgcaccgtccggcacaggcgttcctcctgttcaagcaattcctcaagggcgaacccatgccggccgaggaaaagaatgacatcctccttcctagtgagaaggctcccttctactgagcaggggagcactgcctgcggcggcgtggctcgtgtgcttgatggcgacgattccgtggtgatccttgagtgttttcatgaataaaaggttaaaagttgttgagatgtatgtggagtagtactatgttgctggtttttttctccgagctatgaataatgtacaaggcaaacagttggcctggcgatggatctagtgtatgtttctcctggaagccatatatgaataatgcatgttttggttgtgcctaaaaaaaaaaaaaa

SEQ ID NO: 14446 - DNA, 2072 bp, Triticum aestivum
  Clone ID: PAT_TA_14446
cgtccgagcaaatcccccatttataatataaaaagagcattattttatttttctactgtattttactcctgatgcagtgctgccagtaaccgctgcgggtggtaatagtagtagtaaaagatccagcaaatatccatccgatggtttcagagcgccagtgcggcggcgccctgtcaagcgcgagataaaatccgccccccgcgaccgcgatttcccccacttcgcgtttcctctctcgatttgtccaaatcttttgttcctcctcctccaccagcgattagtttgttgtttccggcatcactccgcactaggccgcccgcgctggcctcgtcgtatccttccccaattccgccgcccctccgcgcccgatatttatttcctgcctcagcatccatttccgttgatagatttttccagcttttgctgcctcgccgtcgctgctaatatccgcgctgggatatttcttcttttgctccggaggcctccggatctttcgatcgcggcgagcggtcggctcaaggtagttcgtgaataggaaggctgataggcaggttattagggttttgggagttgtttttgtctctgctccaatacatagatgatgaaatccggggaggaagttagtcagggtcagcaaatgaacgatttttcggaggagaaagctgctggggaatcgggggatggtcggaagatcgagaggagcccttctatcaatctgaattccttgcctgcaatagcccctgccactacggagattggtgtcttgcacggcgcagtggagtcagaggccaacgatgcaagcactcacaagggagacgagtccagtggcactgatcagaagaaggtcccgaagaatgaggaggttgatgaagctgaagttcaggcctgtgcagatgtgaaagagccacccggttgaccctttgaacagcgagaaccatgccggggagaaggatgctttggtaactgtgccagaaaatgaggggtgtgccgatggtggcgataatcataagggagttcaagttctcagcattgtcaaaaaggatgagtctgaggaaattgttgattctattaatcctgtgacggttgcggagtatagagaggagaagggcaccgccggttctacttctgcaattactgcggtgcgagcacctggctcccgctcatcttgtttccatggtgtgaccaggcataggtggagtgggaaatatgaagctcatttgtgggacagtacttgcagagtagaaggacggagaaggaaaggaaagcaagtttatttaggaagttatgatactgagcaaaaagctgccagggcatatgatgttgcagctcttaaattctttggactaaatacaaagctgaacttctcaatttcggaatatgagaaggaactggcggacatacaagacatgtctccagaggaatgtgtgacatacttgagaaggaggagtagttgcttctcaagaggggcgtctatttacagaggagttacaaggaggcagaaagatggtcgatggcaggcacgcataggactgattgctggaactagagacatttaccttggaactttcaaaactgaggaagaagccgcagaagcttatgatattgctgccatcgagatacgcggcaaaaacgcggtgaccaactttgacagaagcaactacatggacaggggcatgcattgtatagaaggcgcagggttgaagctgcttgcaaccaagccagaatagtacctgatttggtatcgtatattgaacagatttggttggccgtattttggagcctagtggtacatacagatagaagaactggttgcagcctgtcattatctgctgctgtatgattcgtcagattatatatagttctttcagagagaatttcagtaatttagcatgctttgtgtccagaacaagattttgaccatgcattactgttatagtgtttgtaggctagagttgcagtggaagatgttgcttcatttcacatgtctaaaacggagaatacattttacttctaagttttgatgcttggtttaatgaaatattcaagtgtatattcccatgaggcagcttttt

SEQ ID NO: 14447 - DNA, 626 bp, Triticum aestivum
  Clone ID: PAT_TA_14447
cttgccctcactgttgagaacttcctccagcgccgcctccagaccatcgtcttcaagaatggcatggccaagtccatccaccatgctcgtgtcctgatcaggcagcgccacatcagggtgggaaggcagctcgtcaacatcccctcgttcatggtcagggtcgaatcagagaagcacatcgacttctccctcaccagccctctgggggcgggtccctgccgcacgggggctgcgcccgcaccagccactcggcctcgcgggccggcggcgcgggggaggccgaggagccagagggcggcctcaggcggtcgccgtccgcgcgtggtcgacgtggggtgtggccacgttggttcctgcgcctgcgtgtggttgttctgtgtgatggactctttaggtctcctggcggtattcttgtgggcttcccctctgctgtccctcctgggtagacaattttgcaccgcactactgacactcttaatttcaagcattggcatcgtatctggacaccatgaattgtgtattctagtttcggtggctatttgctcgtttggcatcctatgtttaaaactgaatgtctgaatcaaattggtattccaaaaaaaaaaaaaaaaaaaaaaaaaaaaaaa

SEQ ID NO: 14448 - DNA, 878 bp, Triticum aestivum
  Clone ID: PAT_TA_14448
atccgggcgggggccagctgagggcagagcacgtacgggttccatagcgcacgcatccgatcgatccatatccatcactcgcatcgcatctgatcatcatcatcacgagagcaccatgggcggagggcacgacatgcacggccacaacggcggcgtgaagggctacgtgtccaacctcgtccacggcggcggtggcggcggccatggccacggctatggcggcggccatgggcatggatacggcggccatgggcagggctacggccacgcgtaccctcctccggccgccgccggcgcgtaccctcctccgcacggcggctacccgcccgccgccgcctaccccgcgcactcggcgcactacgggcacatgggatcgtaccacagcagccacagccatggcggcggccaccacggcggctacggcggcaagcacaagggcggcatgttcggcggcggcaagttcaggaagtggaagtgaagctgaaagccatcgatcgaaacaacacgacacctacctctacggctctacgtacgtatctgccagccggcagccgcgtacgtacgtacgtacgtatcctgccagccgtagctaagcatgcactgcacacagttcctataaataaattaaataaagtagtgcaagcaggcaggacgcgtcctacgtgtacgtacgttcaatacgagtgccagtagtcgttatttgtatacggaataaagtgagacgtgtgtttctggtcatgttcatgtaacgtgctcggcgtatgtaccaccatgcatgcagtgttgtataccagtcgtatatacagtacaagccgagtataatacagtactgctatgtgcatcattccctggaaattgctacaaaaaaaaaaaaaaaa

SEQ ID NO: 14449 - DNA, 586 bp, Triticum aestivum
  Clone ID: PAT_TA_14449
ctcgtgccgaattcggcacgagcaagagcgtggacttcgggtggggcgaggccgtgtacggcgggccggccaagggcggcgacggcccgagccccggcgtgaccaactacttctccaggtccaagaaccgcaagggggaggagagcaccgtggtgcctatcagcctgcccaaggacgccatggacaagttccagctcgaggtcgaaggcctcaccgccgagatctagctgcgcgcgatcgagcatctgcccacgtacgtactggtgctggtgcagccgcatatactacagagcatacgtcgtcacgtatcacgtgtgcatctacactgtccaacaatttgtatgtaatttccatgcaaaaaattgtagtacttgtatgtaatttactggatctactattaaggaatgaaaggtgtcctcctgacaaaaggggggaaaaggaagatgaaaggtgtgttactactccctccggtcctttgtagtttgcatataagatttgtctgaaatcaagtctcgtaaagttcgaccaactttatagaaaaaaataccaatatttacattgtgaaattaaaaaaaaaaaaaaaaaa

SEQ ID NO: 14450 - DNA, 635 bp, Triticum aestivum
  unsure (1)..(635): unsure at all n locations
  Clone ID: PAT_TA_14450
attcggacgagcgcctgttgtgtgtgagatggaagtcgcctccctcccttccaccactaccagaactggtcgaacgtcgccggtcgcgtcccttcttccttcttccgcggtgaacgaagcattgggcgggttccccaccattggctttcctcgccgccaacggcgagcgcggtgcctcctctccacgctcttgtagaatccgtcccggtggaaactcgatgcaggttctatcagtgaaaggattggagactggttctagtagtggtggtttgtttgatgaatttctagtgcccatgatttgcaaagggtttcagccagtactggcgtctagcaaccttgaagcccacagttgacctgcctcctaatttgtgtgatgagcaaatgtgtagattgtgtgtgtaaatcggagatgccttgggttatgccctcggagaagatggattggtcttggtgaacgaggntgggagggtgatcgaagaggcaatatgcttataaatcatcttcacatcgggtatatttctctcggctatgggtgtacatgatatgtttgccaaaacacttgcaaattatggcacacttactgtgttgcaagatgtcctataaggctattaaggcagatgatcttattttctcca

SEQ ID NO: 14451 - DNA, 595 bp, Triticum aestivum
  Clone ID: PAT_TA_14451
tctttgtgaagaccttgactggcaagaccattaccctggaggttgagagctctgacaccattgataacgtgaaggccaagatccaggacaaggagggcatccccccggaccagcagcgtctgatcttcgctggcaagcagctggaggatggccgcacccttgcagactacaacattcagaaggagagcaccctccatctggtgctccgtctccgtggtggtcagtaagccataggtcgtttaagctgctgctgtacctgcgtttgtctggtgccctcttgtgtacctgcatatggaggttgtcgtctattaagtatctgtggtttgttttagtcgtgactgagttggtttgaaggacctgttgtgtcttgtgtcccgtgtgtctacccaaaactattatgccgcagtatggcttcatcatgaataagttgatgtttgaacttatataagtttgtgctcagtatgttttattttaggttatatctccttgaaaactggcgcggccttgccgtgccccatctcaataggccagttccatcgttgtagaacttaatataaatagtgatactaacaaaataaaaaaaaaaaaaaaaaaa

SEQ ID NO: 14452 - DNA, 562 bp, Triticum aestivum
  unsure (1)..(562): unsure at all n locations
  Clone ID: PAT_TA_14452
gcgacctctccgccctcgcgtctccgtaattgctccgcaactaccccgataccattcccaaatcctccgtcgacccctctacaccggcgatcggcggcgaacgatggggtgggcgacgcggttcctggcggcggtgtgcttctttgctgcgggcgtcctcttcgtcccagaggctatcggttccccatccggcgcaggagccgtcaccgccgccaagctggcccacgtcctctcctttgccacctcctggggcgccgccctctgggccaccttcatcggcggcatcataatgttcaagaacctgccgaggcacatgttcggcaacttgcagagcaagatgttcccggcctacttcacgcttatatctgcatgcgcagccatctccgtcgccgccttcgcgtacctccacccgtggaagacggcgtccactgtgcagcgctaccagcttggattcctcctctcagcgctcggctgcaacctctccaaccttctagtcttcactcccatgaccatcgagatgatgaagaagaggcacaagattcagcgcggcctgcggnaagga

SEQ ID NO: 14453 - DNA, 930 bp, Triticum aestivum
  Clone ID: PAT_TA_14453
tcccgctcttgctcgcactcgcggagatcgaagagaagcgcaggaggccccagcactagcgccgccccgccgccgcatcagacatggcgctggccgctcgcctcgtctcgcgctcccgtcagctatattcggttcaagccactttggggaaatggaggtgtcactcaaagttcgctcctttgccaaggatgcagctccacgctgaccgtcctcctgtcgggtgggggatggtatctccttggaagggcatatgcttttggaggtaaagaagaactttagagacagctccttgggtgttccttaaaaatggaaaagttcactattgcataccatgatgacccatccggcagtttctctcgttatgccccagtcgatgaaagactgtaagggaaaagcggatcttctcatcctgatcctcaaaaggatgaaatataccattagagacttccacctaaggcaaccctgatacacggcttacttaaatatcctcaaacagatcaagaataatgactggctcaaggatgaccttgaattggacattgccaaaagcgagctgagtgaacttaagaaggaatgtgttgacgcaatggagactcaactcaagagggaggagttccaagatgaggagatgcctgatgtcaggaaattggacatccgaaacttcctgtagacctgatcgacgataacctttgaggcattgcaaatcgcccaccccacctgtgatttttctttggttttggtttcaagttgaccggtgctgtaagctacacctatgaatgctgcttcttcccttttttggtaataaaaaaactgcaccgaggtacacagacccgtcgagttggatttcttcttgcctttctgttgctctggactctggtggccacagcaacaatgagatgtccttgtgttataaaaaaaaaaaaaaaaaaa

SEQ ID NO: 14454 - DNA, 826 bp, Triticum aestivum
  Clone ID: PAT_TA_14454
cgacggacgagcacacaagcacagctctagcttagcttagggagaatcttggtcttgagagaaattattaactaaccaccaaattaaagccgtgcagcatggagtacggtcagcagggacagcacggccacggcaccaccggccgtgtcgaccagtacggcaacccagtcggcgccggaaccggtggcatggggaccgggaccggcggcatggggcagctgggtgagcacggcggcgctggcatgggtggcgggcagttccagccagcgagggaggagcataagaccggcggcatcctgcatcgctccggcagctccagctccagctcgtctgaggacgacggcatgggcggaaggaggaagaagggaatcaaggagaagatcaaggagaagctgcccggaggccacaaggacaaccagcacgccacggcgaccggcggcggcgccgcctacgggcagcaagaacacaccggcgccggaacctacggtaccgagggcaccggcgagaagaaaggcatcatggacaagatcaaggagaagctgcccggacagcactaatcgtccgtggctgcgttggctctctctggcgtgtgaaagccgtacttaatcactgtcgtcataataggatgatgagtccatgaataagtgtcccttatgtcgtgacatgcacggggacagtttatacttttgttgtgtggtgtgacttgcgagtgagagtttgtacgtacgaaacttgggtctgtgtactgtttacgctgcatcgtttgtcttcctgaaagtatatacagtacagcatgtgagtggctttaaaaaaaaaaaaaaaaaaa

SEQ ID NO: 14455 - DNA, 786 bp, Triticum aestivum
  Clone ID: PAT_TA_14455
ttggcacgaggctatcactgcattctccagatggtcggatatgctcttcaggctgccgatatactggccaaggaaggtatcagtgctgaggtaatcaatcttcgctcgattagaccgctggatagagctgctattaatgcatctgtgaggaaaaccaatagattggtaaccgtagaagaaggtttccctcaacatgggattggtgctgaaatatgcatgtctgttgtagaggacagctttgagtatcttgatgcaccagttgagaggattgctggagctgatgtccccatgccgtacgctgccaaccttgagaggatggctgttccacaggtggatgacatcgtccgggcagccaagcgtgcttgctacagagctgcagtaccgatggcagcaacagcctaattcacacagaaccctgcctgttgcatttctttgtctaatgtccatactccagaaagacaaatgttccataatggtatgacgagtacccactgccgctgcaactcaactagcatgagctgattttgtagagccaccaagaggtgtccagtactccagtcccgttgtcttcgccgccgcagccggatggctgcgcattactctgcgtctgtttatggttcacgaatgattgcagcctctggagatgaagttttttacatgaggcgaggtggtgtgtcaataacatgtagtattcggaagtgggactctcaagaggtccccaaatagtggttctggttgcgccttttcttgataacgtcttttctatgctagtgctagaaaaaaaaa

SEQ ID NO: 14456 - DNA, 1078 bp, Triticum aestivum
  unsure (1)..(1078): unsure at all n locations
  Clone ID: PAT_TA_14456
gtaagaaattaatatattctagccaagttaggtcacgtgcaagctgatgatgcttttattgaggatgtgaacagaacttgcttctcttctccaacctatacccgtacttgaatgtcttcactcatcttctttccttttaggtctcacggaaacttgtgctggatcttttgtctcgctaccaaatcaaatgtccatgataggaactgttggccccccagtgccaaacatcgatgttcgtctggagtcggtcccagaaatggattacgatgcactggcgagcacgcctcgtggagagatatgcatcaggggagaaacattattctcaggatactacaagcgcgaagaccttacaaaggaggtcctgattgatggatggttccacactggtgacattggtgagtggcaacctgatggatgtatgaaaatcatcgatcgcaaaaagaatatattcaaactttcgcagggtgaatatgtggcggttgaaaatttggagaatgtttacggccttgtttctgcttcagactcgatatgggtatatgggaacagctttgagtccttccttgttgctgtggtcaatcccaacaaggaggctcttgagagttgggctgcagcaaatggaataagtggtgattttgagtccttgtgcaagaatccaagagcaaaagaatacattttaggagagctgtcaagaataggaaaagagaagaggctcaaaggtttgaattccgtaaaggatgtgcacctgngaaccaataccgtttgacatggaccgtgatttgatcaccccgacatacaaaaagaagcgtccgcaactgctcaaagtactaccaaggcgtgattgacaacatgtncaaaagtgctaagtgaatcactctacagtacacatcccgatgaagatcccaacgttgaactgtttgacancanaantctgcttggaaaagccntaattgtancaaaatcntccggtacaattttcanaacantgcctgggcanaataaacaaacgnaantggcacacaatgggnacgttcaatgntgaccagggaatacnatgcaaanggaggaactgaccttcagt

SEQ ID NO: 14457 - DNA, 765 bp, Triticum aestivum
  Clone ID: PAT_TA_14457
cggagaggacagtatgccactaacctaagagagacgacggaggcgacaccggagccatggaggaagggcgagacgagaaagaggccacgtctgagaattcagaagaccggggcaacactagtgacagcagcagatgcgacggcagcggcctgatgtccgtccaattcatgcagaagattcttgccgaaattctgggcacctacttcatgatcttggcggggtgcggcgccgtggtggtgaaccagagcacgggcggcgcggtgacgttcccggggatctgcgtcgtgtgggggctcgtcgtcatggtcatggtctactccgtcggccacgtctccggggcgcacttcaacccccccctcgccatcgccttcgccacctgccgccgcttcccgtggaagcaggtgccgtcctacgtgctggctcaggtgctgggatccacgctggcgagcctgacgctgcggctgacgttcggcggcgcgcacgggcactccctcgggacgacgccgtccggttcgagcacgcaggcggtggcgctcgagttcatcatctccttctacctcatgttcgtcgtctcgggcgtggccacggacgacagagcggttggtgagctggctggtctcgcagtcggtgccaccgtcgtgctgaacgtgctctttgccgggccgattacgggggcgtcaatgaaccctgcgaggagcctagggccggcgatcgtcgcctgccagttcggcagcggtgtgggtgtacatcgtcggcccggtgtgc

SEQ ID NO: 14458 - DNA, 389 bp, Triticum aestivum
  Clone ID: PAT_TA_14458
gcacctcatccacgccaattcggcccgcggggcgctcaccctcgccgtcctcggcggagccgcgctcgcgcaccactactccggcagcagcgccgggaagcagcggcaggaggagctggtactacggcttctactcccagctgccgccggccaccggcgccgacggacaacgagaacgagcgctggagctggtagctagcaaggaggaggagaaggagcgacaagaaagaggaacaaacaacaataaattagtagcgataatttggtgggtggcctggttagcaatcatgcgtgacgtggcttcgtcctaatcctaatcctaatcctaatcccccgcccgtggtttacattatccatccatccatccatccacatcaatgaatgaatga

SEQ ID NO: 14459 - DNA, 916 bp, Triticum aestivum
  Clone ID: PAT_TA_14459
agaggttattatgaatagcaatggttacagcctttcagtagacatttggagccttggctgcaccattcttgagatggcaacagcaaagcctccttggagtcagtatgaaggggtggcagcaatattcaaaattggcaacagcaaagacataccagatatcccaaataatctttcttctgaggcaaaaagtttcctgaaactctgcttgcagcgtgatcctgctgcccgccctacagctgctcagctgatggatcacccttttgtcaaggaccaggctacagtcaggagttccaggtccagtatcacaagggatatgtttcctaattcaactgacggaaaaaacagcagggtgaaaattgaaacttcgtcatacagaagtttatctcctttaagagatcctgatatccttggaagaaacttgccaggaccaacatcccctattccttcgacatcaagtcgcaggatcgcagcattgaacacatccaatgttcggatgaacatgtcgctgcctgtctctccctgctctagcccgctacggcagtacaggcagtccaaccgaagttgcttgccatcccctcctcacccagcctattcagctggagcagccaactacagtcctatcaacaatgcactctacccgatgcgaccaagcagcggtctcacagatccatggctcgaaatctctcagccgaaaacacaaacttttgattctccaagaagattgtagagattccaaaaagaatactttgtaggcagggaaaaagtgttccataatttatgttgttagaggaacaaaggaactctttttttttttttcgccctttctgtatgtatcttccacccaagatgcaggtgcatcgcctttgtgcaaattcagagaagagctagtgaaaaagagtagcatttcagatcgcac

SEQ ID NO: 14460 - DNA, 750 bp, Triticum aestivum
  Clone ID: PAT_TA_14460
gattcggacgaggctctattcgtctgtggaatgttgtggagtaaaaaaggtttcgctgccttattggcaagaagtttgttgaagtaaaaagaaaggtttcattgtctcattcgcagaaagcccagtaaaaaagtttgacgaaacgcataccaatggcattctggacatttcgtcactggcacaaggctggatagttgtgagctttgtgttcctctttctgtccaggcaacctaatgaagatggaaaagggtcacccaggactccagaatctgccatttatagttttgtccccttaaatcttctgtaataacaccaaacattgtgttaacaaatgtggtaggaaactaggaacggtttattttccagagtatgtagagatttccagttcaaacatatacagcagtataaagcaggtcagcaacaattcggcgtagacatcgagacgtggactgtgctgactaaccttcatgaagctaataagttatatcaaagtgtttggtggtagaaacagagaagcattcttcagtggtctttcaaagaagttaacaaaattttgaatgccggagttatcactgaaccagtctttttctttgacggggcagtccttccagaaactgaggtgccctatcatctgaaattttatctattccctacaggcgttatattgttcaatgtgtttctcgagctgtacaagagttcagtctacccaggagaattggctgctgggcagcgatctgtgtgactgtcatg

SEQ ID NO: 14461 - DNA, 738 bp, Triticum aestivum
  Clone ID: PAT_TA_14461
accggtccgctccttccggctcgaccctcccgtcccctgcaacaggcggcccctgtggctccgctgccccgcccagacagtcgtggtcaccgctggttctgggtgatgatgggcttccccgagctgtcgtgctgtgccctatcctcggaagacgccttccggccgcatgccgcgctcccgtgcttcctgctggctgggggttttcacggcctgtcaccgcctgggtcggccttccggcggtgattgagctgcttgggtcccccggccccttctactgccctgccttccccgttgctcggtatggctctcgtggcgcgctcccggtgctccttcatggcgttggcacccaggtcctcgggtccctgcgtttgtctttgccgcggtttccttccttccctggcctgttccccccatctcccgcccggccgcggccacacgcctgctttggcctctggcccccctcttctgccttgccgagccctgttctcggctcatgcgtgccttgccacgcgcccgttggtgcttcagagctttcatttgttacattaagagttcttgaattagtttcatgttttgcatggcaagttagcattggttcttccatatatagtttttggtgtgcaaaagtaggttgttgttccaggatcacacacttgtaaactatggaaaccaggaaggtgcagctggagggcttgtatgtatgtatgtaactggcattcctgaaccctatctggaaac

SEQ ID NO: 14462 - DNA, 974 bp, Triticum aestivum
  Clone ID: PAT_TA_14462
gtcgaaaggaggaaggagaccatggagctgttcccgcagagcgtcgggttcagcatcaaggatgctgctgccccccctagggaggagcaaggagataaagagaagcctaagcagctcacaatcttctatggcgggaaggtgctggtatttgacgatttccccgccgacaaggcaaaggatctgatgcagctggccagcaagggcagcccagtggtacagaacgttgctttgcctcaaccctctgcagcagctgctgtcactactgacaaggccgtgctggacccggtcatcagcttggctgctgctgactaagaagcctgctcgcacaaatgcttctgatatgcctattatgaggaaggcttctcttcaccgcttccttgagaagagaaaggatcgtctcaatgcaaagacaccatatcagacttctccttcagatgcggcgccagtcaagaaggagcccgagagccaggcatggcttggattaggaccgaatgccgtgaagtccaacctgagcctgagctagtacacaacaacaacacagccaaataagacggcacagcaacctcaccaagcccttctgcagaatgatctgaaatttgctttgccactagaccgagtaccaaaatcataaatatctctcgttgtcgtgttttagtatttcgtttaggtcgtggttttacgccctcttgtcacatagttctggatgtaaagaaaagtagccagccagtcatgaccatcaccgttgagtccgagagcagtttttgtgggggtgttttaacacacggcagactctgaattggccatgctaagtaaaatgatagcgcaaagagaagtatatgtattattttctgaaagccagatccatttggctctagccttgatgtattcagaacaagtgattgtaacggatcgtgagtatcctcatcttaaaaaaaaaaaagttttctgatcaaaaaaaaaaaaaaaaaaaaaaa

SEQ ID NO: 14463 - DNA, 968 bp, Triticum aestivum
  unsure (1)..(968): unsure at all n locations
  Clone ID: PAT_TA_14463
taagctgcagcacaggaatcttgttaggatcgtgggtgtttgcttggaggaaggcgagcatttgcttgtgtatgattacatgcccaacaaaagccttgataccattatctttgatcctgataaaagcaggcagcttgactggggggcgcgattcaaaataataaatggaattgcccgaggcatgcagtatctgcacgagcattcccagctgaagatagtccaccgtgatttaaaagcgagtaatgttttactcgatgcagacatgagacccaagatttcagattttggtctggcaaagatttttgaggacgatcaaaccagacatgtcacaagccgcatcattggaacacgaggttacatgtccccagaatatgccatgcgtggacagtactcggccaagctagacatatttagcttcggtgttctagtcctggagatagtgacaggccgaagaaacaactacgcagtggcccctgggcattctccaaacctcttctgtcttgtgtggaagcactgggtggagggaacaatcgcacagatagcagaccctagtctgggcaggcactaccccatggccgaggttctcaaatgcatcaatattgggctgctttgtgtccagcagagccctacggaccggccatcgatgtcggcgatcgtagtcatgctcagcagcgacaccgttgccgtggaagctccctacaggccagcttatgtcgacaggagcaggagctacacggagatgacagtagagcttatcaaggaaaaggaagagctgtgttcgcctcagtcgtccatcacagagctcatgccaaggtagacagagaatttcccagagtaaatatccatctgcaggaacatatataagcagcccagcaggcantaactatatttatttcataaattccaatcaaacaattgcacgatcggcataggcgtatactgtattcagtgtgtaactgtgtatactg

SEQ ID NO: 14464 - DNA, 534 bp, Triticum aestivum
  Clone ID: PAT_TA_14464
tcggcacgaggccacccaaaagcttctggaaggtcccagaccctgagatgagaaggaggctgaggaaagccattgtcgataaagttattccagtgtttacacagttctgggaggatgaccagattgccacacccccaggattcactcccatggaggtagagaagatgctgggagagttattcgaaggatgacgaactagtgcaccatagaagattagaaggcaagttgccatatgtgtagcattcctttgttaatcctgcttccatttgtgtccactattatgcttgtgtttcgtaataaaatgttgctgtttccatgctgtttcgtaataaaaatctgaagcaccgcaagtttgttagtagttctcccccaaattgatcaaaaaaaaagtttgttagtagcccttccccaaattgaacctttttctttatgtcgagtatctggaacagcagtttcacataagaaaaagtccggaacagcagacatctgatctgtacaccctgcccctgccttgtaatagcagcagtgaatgaa

SEQ ID NO: 14465 - DNA, 666 bp, Triticum aestivum
  Clone ID: PAT_TA_14465
tctttaccgctggaccttcgaggatgtccaggtcaacgacatctcgctgaacgactacctggcggtgtctgcgacgaagcacgcgacgttcctgccccacaccgctggccgctactccaagaagcggttccgcaaggcgcagtgccccatcgtagagcgcctcaccaactccctcatgatgcacggccgcaacaacggcaagaaggtcatggccgtccgcatcatcaagcacaccctcggcaccagccacctgctcactgacgccaaccccatccaggtggtcgttgacgcgatcatcaacagtgggcctcgtgaggatgccacccgtattgggtctgctggtgttgtgaggaggcaggctgtggatatctcacccctcaggagggtgaaccaggccatctacctcctcaccactggtgcccgggagagcgctttcaggaacatcaaaaccattgctgagtgccttgcagatgagctgatcaatgctgccaagggctcttcaaacagttatgccatcaagaagaaggatgagattgagcgtgttgccaaggccaaccgttgagtggagcttgtatcctggtgcacttgcactggaactattatgccgctggcagtcgtattagttcttgtttttgccaatgtttaagactttttgagacctatatc

SEQ ID NO: 14466 - DNA, 538 bp, Triticum aestivum
  Clone ID: PAT_TA_14466
taacagccacacttgccctttcaattcgcgaccgacgacaaccggccaccatgagctccacggcagcggcggcaccggagtgcggcggcgccaagacgtcgtggccggaggtggtcgggaagagcgtggaggaagccaagaaagtgatcctcaaggacaagcccgacgccgacatcgtcgtgctgcccgtcggctcgccggtgaccatggattaccgcaccaaccgcgtccggatcttcgtcgacacagtcgcccagacgccccatgtcggctgataagctagctagctgcttctgctgctgcatgtctcagtgctgcttccttcgctcctcgctccagaacatcaataaaatacgatgatcgaataacgcgcggacatgccatgtatgcatgtcagtgcatctgccgaaaaaataatggatgtatacgtgtttctttcgtactataaattatcactacataatgacatcgttcttatataaataaatgtatcagaatgtcgttcatccttgcacgaaaaaaaaaaaaaaaaaaaaaa

SEQ ID NO: 14467 - DNA, 644 bp, Triticum aestivum
  Clone ID: PAT_TA_14467
cggcacgagcatagctctaactctctattgacccccttccgactatcaccgactagcgccacatcatccacaaagagcatacaccatgggatatgtccttgtatatcacttgtgacctcatccatcagcaaaccaaaaagataagggctcaaagctgacccttggtgcagttctattttaaccgggaagtcattagtgtcgccaccacttgttcaaacaattgttacatgtccttgatgagggtaatgtgctttgttgggacttggttttctccaagggagacatgtataaccatcagacttcctatgaacatctggactatctataatcactttattcaaagctaataagccaaaatccagagtcaaacctgttaaggtagtaggagtacttggttgtgggcttaaacctttcctcgagggcagacaaataagagcaagattaataatatagccgactgctagctctatctttgtgccacctcacttatagccaacctaaaagcccattcatataatagttgttgactctatacactatgtagttaatgcttgaccccaccttctctcacaaagtgtattggagttcgtgctgcagccggatacaagtttacagcccatccctcttctctctcctctcccctc

SEQ ID NO: 14468 - DNA, 557 bp, Triticum aestivum
  Clone ID: PAT_TA_14468
cggcacgaggggtgttcgtcgcggaggggatgaagctcggggtggtgatggagggttacgacgaggccatggtgaaggcggaggaggtggaggccaaggtcaggctggtcatggagtcccagcagggaaaggagctcagggacagggtggccgtggcgaaggatgaggccgccgccgcgctggagaccgccggatcgtcaaaggcagcgttaggtgactttatcatcgacatggaaatttcgacgcgtcagtgaacctatgaacctattacctatcagacacgctcacgggagcagagtttcactatgacacagtgacacgaattcttcgtttctctttctcgtgtttcactctttatatttaatgccctatgcataagccgttggaatgtgctgttcttttttttggctaaaagagctggattgtgcttaacctaatcttgaccttttcgtgtgatggctaactccgagagatattttgttagcaacggggtagttggtttgtatattctgaatatttgatcgatattgcttcccctccaaaaaaaaaaaaaaaaa

SEQ ID NO: 14469 - DNA, 706 bp, Triticum aestivum
  Clone ID: PAT_TA_14469
gcttcctcttcctatcaagttgcctttggcttcttcggtttgctcatctttgccaagttatcatccatcgagttaggcagtttagccctgggagcatccgtcgagttaggcagtttagatcttggacgtccggagacgcgtgcgaggacgcgtggcggagaagacagagaagttgaccgggctaaagtggtttggagctcctggctgggcctttgcttttggcgacgacatggcgaagctccacttcttcctcctcttgctgctggccgccgcccaagccactcacggcgaagatggggcgtacatcggcgtcaacatcggcacggccatgtcatcggtgccggctgccacgcagatcaccacgctgctccgctcgcagaacatccgccacatccgcctctatgacgctgacccggggatgctgtcggcgctgcccaacaccggcagacgcgtcatcatctccgtccccaacgagcagctcaacaccatcatcaactccaacgccacggcggccaagtgggtggcgcgcaacgtggccgcccactacccgtccgcggccatctcggccgcccccgtcggcgccgccctcctcccctccctccccatcgcggccccccccgtcggccccgccgtgcgctcccccctccccgcccccgcgccgctcatcatgcccgccatgcgctacctccagaacgcgctcgtggcc

SEQ ID NO: 14470 - DNA, 838 bp, Triticum aestivum
  Clone ID: PAT_TA_14470
gaaagagaaagagaaagaaaggaaggtacaaagaacgcaaagaaaaagaaagagaccaccgggagaaggagagagaaaaggaaaaagggaaagatcgatcaaggagagatgaaatggatcttgatggtgctgatcggcacgcccatggttcaaaagataagaaaagagataaagaaaagaaacataagagacgccaccatgacacagatgatgtaagctctgaaagggatgataaagatgattctaagaagtctcggaggcatagcagtgatcgcaagaaatctaggaagcatgcacatggttcagactcggatagtgaaaaccggcacaaaagacataaaaaggaccgagatagtagcagaagaaatggtggacatgagctggaagatggtgaacttggagaagatggagaggtcaattagtatttccgtttgctaccaagattgtcagtaattactgccccttgtcatgttctccattgctcctattcttcttacttttgacatagtgcttcgggcttaacaatcattagtgttatagttatttagtcccatatattctgaaatattttctttaatatctacatttctgccgtaacacttgttgtttctttcctttttgcataatcaatgtgcgggttttggggtagttgcacatattattctctggaaaaggtgcagcactttaaccatgtggtttgcttcatgtggatggtatgtcctggtttgggatggtgtgagtagtaacttcttttgtctggatgtgcgaattgtagccatgtatttttgtaacgttaacaaaatattttgttgccttcctagacacttctttatctctg

SEQ ID NO: 14471 - DNA, 735 bp, Triticum aestivum
  Clone ID: PAT_TA_14471
aatggtcttccctgtggttgacgagccaccgttttcagatactcctacattgtatggtctaattcttcgagaccacctgcttgttctattgaggaagaaggatttcatccatagttgctcagcttctacactgaaagcttcaaaccatttctcacatgctgagtttgctaaacgtggatcaggaaaacatgacaggattgaggacattgaattatgcccagaagaactggaaatgtttgtagacttgcatccattcacaaacacatctccatatactgtccttgagactatgtctttggctaaggctcttatacttttccgtgaagttggattgagacatcttttggttctaccaaaatcttcaaagagggcgcctgttgtcggcatactaacgaggcacgatttcatgcctgaacatatattgggccttcatcctttcctctttaagagcagatggaagaaggtgcgacttggcaaggtgaaagtcgccgacatattttgaagcttgctggtgactaatgatttggggaggtcacacaaggatcatctaatcaccggtgtatactttggcgtctcactccaaaaaatctcattgagctggaatcgtatattttgcagagaataactcaacttcaatactagtggactttagtcaaggaaaataatttcgttgtaaatgctaacaagaggatggaacatactcagtagctgctaagtgctaacaagttcttttcc

SEQ ID NO: 14472 - DNA, 795 bp, Triticum aestivum
  Clone ID: PAT_TA_14472
gaattcggcacgaggcaaaagataagtgacccaaaaagtattcaagatatactcaaacaagtatatgctgaccattcaacaaatgtggacaaagtattctctcgtattgtggagataacacaacacccagcagctgcagcatcatttgcctccattatgtttgctccaaggggtcagatatccttccaagaggcaatctctaggtgccaaagccaaggtgttcctctatctctcatgtatggaagagaagacccttggattagacctttttggggcattaaagtcaaacagcaagtacccgaagcaccttattatgaaattagtcctgccggtcattgtcctcatgatgaggtccctgaggttgtaaactacttgctccgagggtggttgaagaacctcgagtctgagggttcaatcgacctgccatttctagaagaacccagctatgctgagcatggtgtatccagggaactggagtttgtcagagaaggatcaaggaaatcagttagtgtgcggctctatggtaccaaaatttccttatggagccaactaagctcattcttgaacacacgtgttcccaactctcgggtagtcttgagataatccatccttacaactcctatagatcttactcttagaagctttgattcaaaatattgtatttattactttattaaattggccaggtcatctatttgtaaacagacaatgtcttcagaatttctagtgcatgtaaatagtggcactacagtgatagtttcaaaattaatcctgattcatatccaaaaaaaaaaa

SEQ ID NO: 14473 - DNA, 628 bp, Triticum aestivum
  Clone ID: PAT_TA_14473
ctccgccgtttcgcctctctccactttccccgtccttcgccgccgccgccgccccctccgctgggccgccggccccccgcgccgtccgccccgtccggcccccgctgttcccgccgttcgcggcgatgggcgtggccgtcggcatctgcgggtttcagctcttccggaacatcaccggcaacccggaagtcagggtaaacaaggcagggagggcagctggtgtgcttgagaaccatgaggaggggaggcgttacgccatgcatggcctaagaagctttgtgcatgaaaagacccctgagatcatgcctgctattaacaagttcttcactgaccccaagtgaagcatgttgatggttctactgctacttgccattggggattgtacccttttctggcagttcgatgtgttgtgccgtccataaattggaagacatctcttactcttattaaaagtaccgtatgagtgcttggtaatggcttgctatatgtatgatggtgaatgagtttggtcgtccctctttgatgttcatactccagtcatctgtcatgtggatttgctgtgcttcaatgataaaactgtcagccaacgttcatttggataaaaaaaaaaaaaaaaaagtccaggaca

SEQ ID NO: 14474 - DNA, 753 bp, Triticum aestivum
  unsure (1)..(753): unsure at all n locations
  Clone ID: PAT_TA_14474
ggcgcagagaatccccaagcaaacggtcaggggagaggacaggggaggggaggggaggggggggctgggtcaggatcgctccgatgaagctgtagggggcggtgacgttgaggaacgtgacgaggtgcgcaacggcgctggaggaggctggctccgactacgagatcgtgcccatcaacttcgccaccgccgagcacaagagccccgagcacctcgtccgcaacccgtttggtcaggttccagctctgcaggatggtgacttgtacctcttcggaatcacgagcaatctgcaagtacgctgctccgcaaaaccaagccaaagctgttcgagggaacggaaacctccaaggaggcatcaaatggtggatgttttggtattggtggtggtaggctaaccaatacaccggtgcactgaatcccatcctccttcaatcccctcatcattccggatgcttggaggcaaccaccgacaagaaattgtggcatgaaaaccttgagaaactgaagaagggctagagtggtcgaagaccctgacgaaattctacccttgctagaattcctcaactccctgactgaccctgccgccattccccctgcctctgccgctctctgcctgttcgctcccccctacgcttcggggtccgtcccttacccgcatgaggccgccaaaggccccccctaaccgcgccgtaacggccgtaaccgtagtcgttctctcgtcggtcccctcatagttctcagcaantatgcatt

SEQ ID NO: 14475 - DNA, 743 bp, Triticum aestivum
  unsure (1)..(743): unsure at all n locations
  Clone ID: PAT_TA_14475
gattcggacgaggcgtttacctgctcatacatctgatgtcaatacaggagcatttgctgatgaaactggccatctcatatattctggaagtgacgacactttatgcaaggtctgggacaggcggtgtttgtccacaggacaagctgccggagttctgactggacatttgcatggggtaacacatattgatagtcgtggagatggccgaagtttcatatcgaatggaaaagaccaagcaatcaaactgtgggatgtcaggaaaatgacgtccaatgctgatagacggagccccaagttgggactacagatattcgaggtatccgcagcagcataaacagttaaagcatccgcatgatcagtcattagcgacataccgtggacatgcagtcctccggacattgatccgttgctacttttctcctgcttacagcactgggcaaaagtacatatatacagggtcgtatgattcctgcgtttacatctatgatgtgngtaagtggatcgcaagttgcgaagctgaaatggcatcaaatggcgattcgtgactgcagttggcacccatttgagcccacgcttgtgagctcatcctgggacggccaggtagcaaaatggaccagtgcacgtgatcaacaggcttctgatatagattgagtcgaccgtgcagcgagtgatcttttactgctcgtggttctgggctacaaaaacatacgtatgcagtctaaagtaagcacagctcataaaaa

SEQ ID NO: 14476 - DNA, 803 bp, Triticum aestivum
  Clone ID: PAT_TA_14476
attcggcacgagggcagagcagaaaagaacacctagctaggaaaaatcccaagcagctgttgcaaccggttcctgcgaggagaaacaagcatgaggccccaggtggtgctgctcgtctcgctggctgtcttcgtcgtcctcgtagctctgccacccggcaaagcgaacgaggagaaggaggccgccgccgaaggggttgacgcgaggaggtggaggtggccgtgctgcgacgagtgcggcgtttgcacgaggtcgcagccgccgatatgccagtgcctggacacgtcgacgagcggctgcaacccggggtgcaaggcgtgcgtcaagtccatcagcgacggcctctacgagtgcaaggacaggatcgtcaacttctgcaagcgccgctgcacccgtcctcctgctgctgctgctgctgctgatgcgtgatctgcgcggtcgtcgtccgatcccagagccggcaaatgagctttgccaataaataatttccgttcggacttcggagttccctttttgcatctttctcaagatgcagacagggtttgaataaggtgatgcttgctgttttctgaaataaagagcatggatgtgttatgctcggagttctgtagtcatgggaggtagagaaaatgtaataatcgctttgtttatgtgcatctttagatgccatagaccgaggcatgactagctaataagcgcatggctacttgcatctctttgatgcaaaggccgtgatatggacatgtctatttcacataattcccacaaatatcacaaacattttaaaaaaaaaaaaaaaaaaa

SEQ ID NO: 14477 - DNA, 553 bp, Triticum aestivum
  Clone ID: PAT_TA_14477
atggacagtgccgattctgacctgaataacagaaatgatgaagcaagtgaacagcttatagcagatcttaaagctcagaaagaggaactagaagcaacacttagcagggaacagctgcaaactgtgcaacttaaagaagacatcgcgcaagcagagaccagaaatgcagagctgacaaaggaacttcaagctgtccgtggccaacttgcttctgagcaatccagatgtttcaaacttgaggttgatgttgcggaacttcgacaaaagcttcagagtatggatgcgttggaaaaggaggtcgaactgcttcggcgacagaaagccgcttctgagcaagcagcgctggacgcaaagcagaggcaaagttctggtggcattgtgggggttggcttgctggaagcccaccaccaacagtttagttcgtacaggccgtgattcatatattttacttgtaacattatatatcatttgacattctctacaattttttgtcacttatggcattcgtgttcattttgaccacacagaataaggtgctctggcgtgttcttat

SEQ ID NO: 14478 - DNA, 909 bp, Triticum aestivum
  Clone ID: PAT_TA_14478
tcggcacgaggacaaaattaagttttcaaggtggaatgctgattggaaaagcgccacttccttgtatgagcaagctgcaattgcttataggttcagaaaggacaatgagaaagcaaaagatgcgtttgagaaggcctcaaaaggacaggaaatgatctcctcaccatgggacgctgctaagcatatggagtctgctgctgctttagcaaaggatcttggacgctggaatgaagtatctgatttctatcacagagcttcagaattataccgtgaatgtggaaggtcacaacctgcatccgatgctctagcaaagggtgccagtgcattggaggagaaatctccagaagaagctattaaaatgtatgatgaggcttgttcagttctagaagaagatgggaaggaacagatggcttttgacttgtatcgtgctgcagcagctttgtacatcaagatggagaaatattcagatgctgctgccttctttttaagacttggttcagctgccgataagtgcaatgccatcaatagccaatgcaagggcttatctgagtgcgatcatcatctatctttatgcacatgactttcagcaagctcagaaatgctacaatgactgctcagaggttcaagccttcctcaatagcgatcagaatcgatgcgcaacaaaactattgtctgcttatgaggaaggtgacgctgaagaaatcaaacgcattgctcaatcaagtgccttcaatcaccttgaccatgtggtaattaggcttgcacggaagctaccgaccggtgatctgcaggccatcaagaaagctgatgatggcgaggaatccttggacgaggatgacctgacttaaaacgatcttcctgagccaaaaggtgcagagagcaaacgagtgaggggacactcatagtttg

SEQ ID NO: 14479 - DNA, 732 bp, Triticum aestivum
  Clone ID: PAT_TA_14479
tcggcacgagggtaaagttcaaaagcaggttgtagaattgttcccatcttcccggggcttggaagtacatggtccagtgtggtaaagattggacaatcgttgtaccgcgaggctcctggaagtgatccattcagacctgatcagaagacgcctgttaaaaacttcttcctctccggatcttacacaaaacaggactacattgacagcatggaaggagcaactctctctggcaggcgaacagctgcctacatctgcggcgccggagaggagctgctggccctccgaaaaaagctagtcatcgacgacagcgagaaggcgctggggaacgtccaagtcctgcagactagctgaacaaccaccccctgcagacaagtttaacctttccaaccacacatgctggaatggccaaatcatgtcttttctcgcttcagggtgctggcgattcccgcagcgacctcctgtatatccaatttgagcattagatctgtccccctgcaggcgtttcctatccctgaattcgaaaagcagggtgtctaggtggcatacgggattacatcaggcagtgtgtaagttgttgagctggaactcgattggtcattgggacgattgattggtgatatgatacatacatagcgcacactgttcttgcgtcttgcaaagaaatatagcaagcgatgatccggggtcaattgccggaacattttaccaaaaaaaaaaaaaaaaaaaaaaaaa

SEQ ID NO: 14480 - DNA, 624 bp, Triticum aestivum
  unsure (1)..(624): unsure at all n locations
  Clone ID: PAT_TA_14480
agggcttccttcaggcgacgacaccagcaacaagagatcatcagtggagatggcgacgacgctggcgaaggttgggcctttcggtgcgggtggcacccctgtcgacattgaccacaccttgccgccagatcacctcaagagtatcaaaatctggtacgacgaagatggaatcaacggcttaaagttcagctacctccacgccgccaacaaaagaaagctcaccaccactcgcgtttggggcgacgatagcggtagtagcgatgagattaatattgaagatgatgatgattacgtgaataagctggagggcaggactgacggccgtacaaaaatcaagtctctcagaatcacgacgaaaaacaataataatcccgattggctcggggacaaaaccaaggagggcgattatttcagcgtgccggtggaggatggccagatcgtggcgttcttcggccgcaccaaccagtacatcaacgctctgggcgtctacatccttggtaccccttaccagcaatccacccccctagatcgatcgatccatccatccacacacatatattaatantaagtaaatgtctacatacatgtgtgcattaattacgacaataatcgtaaatgcacgca

SEQ ID NO: 14481 - DNA, 770 bp, Triticum aestivum
  Clone ID: PAT_TA_14481
cggcacgaggatctgtccacatcccaacatacggcaattttctgatcacggtaaacgttcgaaaaaatcatcatgaaattcttggtagtgctagtagctgtcatcgcagcagtgtctgcagccacacctaaggaagctgtcaaagctttcccttacagtggattcccagccaaccaggcctactacccaggtcaacaagcatactacccaggataccaaggttaccaaggctaccaaggttacaacttcggattccgtaacggatactacccaggacaacaatcgtactacccaggataccaaggttaccagggttactacccaggataccaatctggttaccaaggttactacccaggataccaaggttacaataaccgtggtttctacccaggcgcccccgctgtctaccccacagtcagtgccgtcaccccggccccaatcattgcacctgtaccagttgcccccaaggttgttccacaagtgttcaaaaccgtagacaacaaattgccagctattgtcagacaatcgcaagaagtgaacgttgacggtaacttcaaatacggattcgaaaccgagaacggtatcgccgcacaggccgccggatacgtaaagaacgctggaagcgaaaacgccgctcaagtaattgaaggttcatatgcctacatcggtgacgacggtgccccagtcgaagtcaaatactacgccgatgagaccggttaccacgcagccggaaacgtcgtcccgaccatcccctcagaaatcgccaa

SEQ ID NO: 14482 - DNA, 596 bp, Triticum aestivum
  Clone ID: PAT_TA_14482
gatccgcacgagcgtacgtctgcctccccgcccattcatccttcccttccctccctccctccgtcgcgttccatgtttcctgttctactctacgattcgagaaattacatacagtatactcgatcgattgtggttccgcgcttgcaatgcgcgaactggttgacgcctcacgcccttcgcgtgcacattacgctggagattgggtggggcaacgcgatggatttagtaggaaatttcgtatttattagtagtactctaattatggagtagcgtattcccctttccaagtagcagcgtcgctattcctatttggagaaacttgctgggcgtggttttaggcttataccagggacaaaattgtgcacccatttaatgtaattttctgagcgctggggtccgtctgggggcaatgatggtgcgaataagatttgacgttctgagaccagcatgctctatgccattctgaaactgtaggaacttcgtttaattttggcaatgctctatcatggcagcattctgggttgagtattggtctgtacttaagatggatattggctgttagcagtggttaactaagaaataatcttagggataag

SEQ ID NO: 14483 - DNA, 763 bp, Triticum aestivum
  Clone ID: PAT_TA_14483
cggcacggcgcgagggtcaggcatactggtttggaaatttgtaggctgttagctgctcctaattagttgtgagggaaatggctgggaggaacattggagtcgcagtggacttctcgtcatgcagcaaagcagctctgcgatgggcatcaacaaaccttgccaggaacggtgataagctcatactaatccatgtgaacaattcctatcagaatgagcagggcgctgttcatctctgggagcagagtggttccccactcatccctctggccgagttctcagatgtcaccaggacatatggtgtatcaccggacaaggagacaattgagatcctcactcaagtggcaaatcaaagagggattgaagtctttgcaaagatattctacggtgacccggcaaagaagctctatgaagcagttgacctggtttcccttagctgcatggttatcgggagcagaggactaagcacgctcaagagggctctgatggggagcgtgagcacctatattgtgaactacgcggcatgccctgtgacggttgtgaaggagcacatgtaggggcagtcagcccgatgaacactgctgtttacaagcttcactccaaaagaacaatacgtatatgtgtggtagccagattaaataagtgtacttgacatgcactgatcaggtggatcttgctacctagaaaataataaaatctgaagatacggaatcttgtgcttgaaattcactcagctaggactggacagaacatgacttggcactgt

SEQ ID NO: 14484 - DNA, 1071 bp, Triticum aestivum
  Clone ID: PAT_TA_14484
cggcacgaggcgcgaggaagccatcctgatacctctctcgtcagcccatcctagtagcttagaaaccacctgcattttcattttgatcttcctaaaatctctctggctagttgctttccagtgaccaaaagatttcaagaaaccactccctgtcttcctcccccggctgtctgtcatcttgctctgaaacaatggctgtcctgcaagttgctgctgctgcccctccccctgtctcagcgattgggtttgagggatatgagaagcgccttgagatcagcttctctgaggcacctgtcttcgctgatcccaatggaaggggattgcgtgcgctctcacgtgaccagattgactctgttcttgaccttgcacggtgcaccattgtgtctgagctctcaaatgaggactttgactcttatgtcttatccgagtcaagcctgtttgtctacccatataaaatggtgatcaagacctgtgggactacaaagcttctgctcgctattccgaggatccttgagcttgctaaagagctctcgttgccactttctgcagttaaatactcccgtgggacattcatattccctgatgcacagccttccccacacaagaactttgctgatgaggttgccttcctgaatcgcttctttggtggcctcaggtctggcggtaatgcttatgttattggtgattctgcaaagcctgggcagaagtggcacgtctactatgcctctgagcaccctgaggagcctgttgttactctcgagatgtgcatgactgggctggacaagaagaaagcttctgtcttcttcaagacatctgctgatggttacacatcgtgtgctaaggagatgaccaagctctctggtatctcggacattattccagagatggagatctgtgactttgatttcgagccctgtggctactccatgaatgctgttcatggccctgctttctcgaccattcatgtgaccccagaggatggcttcagctatgcaagctacgaggtcatgggcttcaacccaggctcttcttcttatggtgacctgactaagagggtgctgaggtgctttg

SEQ ID NO: 14485 - DNA, 656 bp, Triticum aestivum
  Clone ID: PAT_TA_14485
tcggcacgaggtgtggttcggcaacagcagcacaagaggtacccgagcgagtcgttagaggcgtgcgtgcgtgcgtgtgtgtgtgctagtgctacggcgtacggcgcagcagcagcagcggcagccatgagcaccgggcgcgagagcaccaccagcagcaggtggcccgagctggcgaccctgcgggcgctggcgcgcgacgccgcggagcagctgcagctgccgcgcgtcggcatgtcggcgtcggcgggtgcggcgggcgggagggagccgtcgaagcggcagccggcggggtggcgcggcgggcgagaccgggaggaccacgtccacggccacggcaagacggccaaggtgatgcacctgctgctctggggacccaagtgaaggtgaagtgaggccggccgggcatgtcctcctccgatccagtcctcagtacgttcctcaccgaggtcggtcttcgatctctgccgcgccggtgtttctggcgatcccggccgctggccgcacgtacggattgggattgtacctatactacgactgctgtaccatactagcagtgtacagtattattgtactagtaggaaaactgctgctgcttcttcttcttgcaccactttgctgtttgctcgatcgactgctcgtcgcatcggtcagtt

SEQ ID NO: 14486 - DNA, 431 bp, Triticum aestivum
  Clone ID: PAT_TA_14486
gacgcgcatctcgatcacatcgtcgtcctcaagaagcctgaccccgggctctgggacagggtaatctttcgtgccacaccattcctttttcttctcttgcattgcattgcatccaaataaactgtccatcacatgatgcattgccatttagagaggacagacaactagccaatgcacaaaactggctggcattgctggacatagcaaaactcttttaaagcacggaatcaacaaaactgtgccgtagactggtagttcgcttggattagagtacgcagccatctactccgtaagaggcaatcttatctttatataagacaaaaaaaaacactggcaagatgtaacttttacaaattctgatgctactgctgatataaaaagctggacctggatagtattagtttaggctaaaaaaaaaaaaaaaaaaaaaa

SEQ ID NO: 14487 - DNA, 376 bp, Triticum aestivum
  Clone ID: PAT_TA_14487
cttggtcaggttgccacctcaaacgcaactaggcgccgccgtgctggttctgccctgtagaagctgcagcgtataaacgcaccggcatactcaataaacatcgaccacttttgtgcttgaaaaggcctccggtcgaggttagctttttggagttgtaggccttctgttgtcaagtatataggcaataatgccgtgagaacaccacaccgttacaatgtaaaactgttatgggtcatgactctgctggtgtacaccccttgcgttctctatgacttttcccttaagatgaatgaaaaggtacgatcaagttcctgggtctaaaaatgttcttgcgttgaaaaaaaaaaaaaaaaaaaaaaaaaaaaaaaaaaaaaaa

SEQ ID NO: 14488 - DNA, 384 bp, Triticum aestivum
  Clone ID: PAT_TA_14488
cggcacgagttgagcttctacaactagtatcccgtgagcgtttttcctcctcgtgtgtgtgtcttgccttgcactagtgagtgtgtgttactagtgagctgagtgcaagtactatcagtagcgggtagccacgaccctctggtctcagtagttcgggccaacagtcgtcaggtgggtgcgccattcttccggtctccacttctctgtggggaaggcgccctgacgctggccgagttgtcctttggtcttgcttagctgcttcgttcaggactctatgttttggttcgcctgtgctgagcccctgctgaatcgttctcctgtgcggggcagctttgctttgatgtcctttgtgactctttcctaactcatcttgcagactgtcta

SEQ ID NO: 14489 - DNA, 573 bp, Triticum aestivum
  Clone ID: PAT_TA_14489
gagggagagagagagagagaactagttcgagtttttttttttttttttttttttggcttcttaaatacgtccatccatcatatcaacaaacatatcaatataaataattacacatttgtaataatcacccccaaatcaaaaacaaagaaaaccccacattacaaatgtacacagcaaggtccatccatcgaggtgacagtagagaaaagaataacaaattatgccaagtgtgtgtctgatgacttaatcacttaattttaactcgatctacgcatctacgtggttgacaagcagtgatgatccagtaactttttaatctcacggtaacttaatttaatttaccagcagctttgctccatcaatcggatcggccggatcacttctcctcagtagcagctgctgccggtggcgccgcctcctcggcagccggcttcgcctcctcctccttcttctcctcctcctcttccttcttctcctctgccgccggcgtctctgccggcgccggcgcggcctcctcggcggcagccggctcggcctcctccttcttctcctccacggcgacttcccgggagg

SEQ ID NO: 14490 - DNA, 712 bp, Triticum aestivum
  Clone ID: PAT_TA_14490
cgcaatccaagaagagttgtaacgtctatgaggctttggggaaacatattttgagtaaatgtcccataggtcctctggtctcaggttgggatcaggaagctctctgactgcttcatcccctcgtgccgaattcggcacgaggtccaacgccggctcctacgctggctctaacggcggaggcgcgggctcgtacgcgggctccaacgccggctcctacgctggctctaacggcggaggatctggttcctacgcgggctccgacgccggctcgtacgcagggtccggcgctggccctcactgggggggctctggtgctggctcgtacgctggctctgaggctggatcctacgctgggtctggcgctggcccgtatggtggtggctctggcgctggctcgtatgctgggtctcgagccggctcctacgctggcagtgggcacggcaagtgagccgtgaatcgaccttggagctggaggacgcggtgctcaactgctcatgctagttgttctgtagttgtgtgtttgcgctagcgtttaccattatttgtgtccgtgagtaatccattatgtgtgtatgtgtgtacttgtactaaaataaatggagatgcgaaggacgatgaataaggtgattattacagtgtataagaacctattgatgtaaacatttatattaatgcataattcggcatgtacacttaataaaaaaaaaaaaaa

SEQ ID NO: 14491 - DNA, 610 bp, Triticum aestivum
  Clone ID: PAT_TA_14491
gcgccgcccctcccgcctccagcctgcgtactcgccctccaggtgagatcgtccaacacttgggtagcggaatacaaagtatcaacattaatcgttggtgtggctggctgccggatttgggcacatcagaatcgttgtattgggtggctggggaatcggttgaaataagccgcgagtcatagcacgattgaggtccggaaacttattctacgcggatttagatctcgacttgtttggtactcctaggttttaagtctcaagaaacttccatatactgtttaaaaatattatcaatgcctagcagagcttacgtgccacttaagtgtacactcctagatcctctataatattatgctccctaattttagaagcctcacaatcaattgaggtctccaattgaaattgagtcacccgattataacgggtcaataatttctcaaagctctcccatttaattcttttacactgtacactatgctttctaatttttaagacctcatcacaattaattgaggtcttcaatttagaattgggtcacccgattctgaccggatcaacagtttctcaaggggatcttccattcaattattttaattcactatgttcccta

SEQ ID NO: 14492 - DNA, 597 bp, Triticum aestivum
  Clone ID: PAT_TA_14492
cggcacgagtctagatcgagtaggtagaagcccactgatctactccacttagcattgtactccatccttgtccatggaaactcaccccaacttccatgctagtccattcgatgggtctgtggaaaacactgagtttaagttcagtagcttgtacctgcaccacattttcagtggatcaaacccaacccaagcaaacatcatagttggagatgctaccactaagttgggcaggacatcagttcacgactgggccatatatgtatggggttggcaccgacgccaagctagtgggccgtgcacaagggctgcatatcaacgctggtagttggcacaatacgttcaccattcgattcgagattgaaaggttcaagaagagcacacttcaggtaatgggagaatctgtagcccaagaaggtgagtgggctattgccggtgggacaggtgaactcgcaatggcatgtggtgttatacacaaaacatggcatcaggaaacaagatggtggtaccataatccaacttaacatccatggattctgccgcatgaagctacccattctcacaaagagtggcccctggggaggcaaggagggttctgct

SEQ ID NO: 14493 - DNA, 1910 bp, Triticum aestivum
  Clone ID: PAT_TA_14493
cgtccgttacaatagctcgatctgctgggaccgttagccagtctgaaaggggtggtgatggtttaggtgagcgagcattgaatatcagatcaaagcccgtgggatgggatatgttgcctgaagatcagaggcactctcgagattcaagagacagagttgattcttctaacctgtgtgttttaggtacattagaggcagctgaagcctgtgaatcatttcgaccaatgggattaccaaatagagacgtgcaatcacgacttgatcggcctagatcatttgacagaccccacagaaatgagcactgcagatctgatgatggctatggttctggctcaaaagctgaaaggtctgttgataggccacatggcaggggcggagcatctcggcatattcaagcaaacatccgaggggagcagtgggctgaaaattcaaatagttctcgttcttcccagcgaagatcacctgattataataattatggcccagctggtccaagaaatgctgctgaagctgctgttgcaaagatggagagcagtggctttgttgttgcagctgatggcactttggtaagagctgttgatgcagcaaatacaagtaccatgtccagaaggatgagaaacaaaagtagcttctatcaccctttgtctagacggtgttccccagttgacagagatggaagtcgtgggttgtccagagaacctgcacatgctagggaagcacctccagaacgatgctttggtgctagtggcaaccggtctggtcgatatggtcctcagatggataaagatcatgccattgatgaaaatttgagttcagttcatagctcactgtctaatagacaacggaggttcccagcgcatagagcctcactcgacctgtcacgtgctcacagcagatctccttcaggatctagatctcgatcaccacatgcttggacatccaacggaggctcaagtatacggaggcatagtagatctcctaattacatgactggagttagaattggtagaatgacttcacctcaaagacaacatcgattcaatgatcgagttatgcgtggtagtccatcaagaaattccacttactctcaacatgattcaacatgggttgaaggaaggagctgctcaacactagatatttcttatcacaagaaacggtattctcggaggagcccacctctgagaatcacctcaagaaatgacatgttcgatttaatggattcccaaggacggtcaggatctcgagaattccaccgcccaacacgtgacttcaaaaggggaaataagcatgatgggaatggtgatgataaaagatgtaatgatagatatggaactgtcaaaccatatgaacataatggtgctgtgaagcagttcaggaatcatgctggagataaacttcatccacacacttctgcacccagatcacctgaaccgcaaagaggaagccctcggcgattttgacgaggactttcagaggaagctggttgtgtatttgccttgttttggaactaaagcagataagaatccttgagttttgattgaactggaagggaccgtactgcaaatccatgatatgagtcattactatttgccaaagggatgtctgttcaagccacataacagctgaaattatgcacctcacggagtgaaatgcagattaacttcacaattttccagttttcccttgtaaatatttatatcagtagtaggaccacagtttcatgtttcagccttttggcattttttttttgatatttttttctcactttgcaatcttatttaatgggcattatccctgtatgagattcacttaaacaggttcaatcaattgaagcgtctggcatcacttcaaaaaaaaaaaaaaaaaaaaaaaactcgagactagtttctcacctcggccgcgaccacgct

SEQ ID NO: 14494 - DNA, 727 bp, Triticum aestivum
  Clone ID: PAT_TA_14494
gaggcttgcaggcacgggggtcatgctgtgtattagaccaggggaacatggaagtacattcggtgggaatccattagctagcgctgtggcagttgcatcactgaaagtggtcagagacgaaggtcttgttgaaagggctgcaaagttaggacaggagtttagggaccagttacagaaggtccagcaaaaattccctcaaatcataagagaagtgcgcgggaggggtttgctgaacgcagtggatttaaacaatgacgcgctatctcctgcttctgcatatgacatctgcatcaagttgaaggagagaggcattttagcgaaacccacacatgacactataatccgacttgctcctcccctctcaatcagtcctgaggagcttgcagaagcatccaaggcgcttagtgacgtgctggagcatgacttgccacagttgcagaagcagataaaaaagccagaatctgaggcagagaagccagtctgtgacagatgcggccgggacttgtacggatgagtgaagcctccgaacagagatagctgcattttcgtaggtacccatctcgccccaaaagaaataaacagagcaggggattctagctacttaggtcactgtagtgttatgcgacttgttgcatcgtatatttaagggtatgagctatgctaccttgatgaatatcaaataaatgggtagcattcccttgcactgtgaatgtaccgtcaaaaaaaa

SEQ ID NO: 14495 - DNA, 746 bp, Triticum aestivum
  unsure (1)..(746): unsure at all n locations
  Clone ID: PAT_TA_14495
gccgctccgcccctcctcccccacccgtccatcgcccctccctccggtctgcgctcccacagcctcacccctgcgcccccgccgattcgcgtcgccctttgttggaaggaacgatggagcagaccttcatcatgatcaagcccgacggcgtccagcggggcctgatcggggacatcatcagtcgcttcgagaagaaagggttctacctcaaggggatgaagttcatgaacgtggagaggtccttcgcgcagcagcactacgctgacctttccgacaagcctttcttccccgggttggtggagtacatcatttccggccccgtggtggcgatgctgcgggaggggaagggacatcgtgttgactggccgcacgctcattggggctcctaggccttgggaggcagcccccggtaccattcctggggactacgccgtggaagtcggcaagaatgtcatccatggaaccgactccgtggagaacgggaagaaggagatcgctctctggttccctgaatgtgtggcacagtggaagacaaacctgcttcgcaggattggatgacccttgccctgattactgaggatcatttgcgttatctattggaaaccgttattcgcttaaatcttattaccccgttttgccattatatcgctatttagcgcccgtgtgttccccccgccgtttcgccctgttacgcgctttgtttgttctccaccgcggcgnacaatnccnaggttttcccccgcttt

SEQ ID NO: 14496 - DNA, 901 bp, Triticum aestivum
  unsure (1)..(901): unsure at all n locations
  Clone ID: PAT_TA_14496
gagggtttatattttctcattgaaatagtaaacatttatactgattataattgttcttaaataggttcaaccaagagtagatcacttattagtttctttccttgttctcttaacccgaaataatctgcagatatagtctggttgtcttaagtggtgtaccgtgcagttctattggtgcataatatccagtaatgacctccacctgaggtctcgtgccgcgtccgagtcgtcgcatcaggtcccctcgattcgccggcggcgccaccaaccaagctcatacatctgaattgactagtcaaactcagtgatctctttggggactaatcaaactcaagaactaagtttcatgtctgatctcgacgtccagcttccatctgcttttgatccgtttgcagaggcaaatgctgaggactccagtgctggtgctggatcaaaggactatgtgcacgtgcgtattcagcagcgcaacggaaggaagagtctgacaactgttcagggcttgaagaaagagtacagctacaacaagatcctcaaggatctcaaaaaagagttctgctgcaatggtactggtatccaaggatccaagagctaggccaaggtcattcaactgcaaggtgatcaagcgtaaaaatgtcgctacttttctagtccaggccggattcctgaaaaaagatacatcaagctgcacggattttagattggaacgttggagtgctgtgcgtgctaacatatggtacacctagtacacctcttgctcgtgccccttcatagtatcggatccagtaacgtatctgcgactgggccacgattggctgtgaccggatgggtgggcctgcanaagttgtagngtactgntaagtacntggcgggaangcacacggatntacaagnaatgcgtcgn

SEQ ID NO: 14497 - DNA, 423 bp, Triticum aestivum
  unsure (1)..(423): unsure at all n locations
  Clone ID: PAT_TA_14497
attcggcacgaggggaggccgctgggactgaggatgcagaggcagacgcggagtatgatgccgccctcaaggaggccatacagggcgtgcaggaggccgtgaccagcataaacgaacacatggaggaggtgcgctacgagattgacggactcgaggcggacacgatcggtagcaagtggagcgaagtcgaggaagcattccctggtaccctgtctataaaatagatagatgatttgttttctttggcaccgttcagttcattctacccgtgttgttcttttctttaaaactatgtgcccgtgttattcggctcagtgtactcctgttagtggagcctgacgctgaggaatttggtgtaggttaacttatgttttagtgttgcttaaaagaaggattgaaattggaacnaaaaaaaaaaaaaaa

SEQ ID NO: 14498 - DNA, 427 bp, Triticum aestivum
  Clone ID: PAT_TA_14498
tgatgtccctcataaggttgggactctggaggaagccaagaaagcactacacaagataatcaaagacaaagctgcaaataaagtgaaggttgcagaagcaagctttactcatttttctaatggtgcaaggtttcattgcaaccgccaactgatgattcggtaatgtagcaggtagcatgaacaagtgaaaacgatggctgtcttttaataatgagaatctctccacatgtggtgaagattgtatatatgctcgtgttgccatattaataattattagtgtgcggttgctgctagaggaaattggacattcttcttgttggcaaacatggcatagacgaaacagtctatttctggcttctggatacctgggtaacgtggttacaggctaccagcgtagacttttcaacgtaaaaaaaaaaaaaaaaaa

SEQ ID NO: 14499 - DNA, 706 bp, Triticum aestivum
  Clone ID: PAT_TA_14499
attcggacgagggagaactagtctcgagttttttttttgctttgttttttttttatcaatctgacattttattaccacaggcagggcttgttttgacaacaggtattactaactgcaaatttctttaaacatttagtgtacacaacacaactatgccctgaaacttatcaaagaatgggttttgattgtatatataaggttacaaggagagaaacaaactattgtacaaagaatcctatccagctagttcaactgaagatggcccggaactctacagttgtgtgttaacaaggagacacctctaatcttccaaacagaattttcgatggcttaccatggtgggttttcctgcagccatggttgagatgttcaatgctgcacttttgtggcgatctgttgccatgtctccgtaattgagaagcacaacactgcactagatgaaaacttagtcattatccatcatcagaaggggtttcatgtgaaggctggggatgctgcaatccatcctcaggcatatcaaattcaaccaatggcttcaattgttctctaacagcatctcgttggagtttcatctcttcgatgaccatactctctgcaaccttacaggactgctcgtcactaaaagcaagggtccatctcccatcaacaagatacttctttgtcttcgctttatgtttttcagtgtccaaaaaaggcacgaagcctc

SEQ ID NO: 14500 - DNA, 779 bp, Triticum aestivum
  Clone ID: PAT_TA_14500
gattcggacgaggcccgtcactatcgcggtcgtcgcggcttggatcggattcaactcacctaccccaccccctcgattccttccccagctctgcctacttcctacgccaccaccgcccgcccactccggctcctcaagcagagcaagcaagctgccatggcggccgccgcgctgagggagcagctcaacgccctcctctcctccatgttctcctcgggtctggtggacgaccagttccagcagctgcagatgctgcaggaagacgggggcacgccgggcttcgtcgccgaggtcgtcaccctcttctgcgacgacgccgacaggatcatctccgagctcgccgccctgctggagcagcccatcgtggactttgataaggtggacgcctacgtgcatcagctcaaagggagcagcgccagtgttggcgctcagaaagtgaagtttacttgcatgcagttccgtcagttatgtcaggataagaacagagacgggtgcatcatggcattggctgttgtgagaaacgagttctatgatctgcgcaataaattccagactatgcttcagcttgagcagcaaatccaggctcaacaataaatcgaagcagaaagaagcgtagctgcatgtggcctcacatgataagtgtatctttaaagatgtagaccatgttctctgtgttcctacaattgtgacaaaatcatcgtcgttgaggtccggctcacatgcatgtaactgttagctataacaattattgtctaacgttgtccttggtactccaaaaa

SEQ ID NO: 14501 - DNA, 2112 bp, Triticum aestivum
  unsure (1)..(2112): unsure at all n locations
  Clone ID: PAT_TA_14501
gtcccgtgtgcgcctgcctccccgtagtcccactcccatctcttctcctgcgccaacaacagcaggcaggctacttccttgtcggcggtcgccggggggcgcgagcgaatcgttgggtagaggaggagggaaaggccgggggcggcgctgggtgcccaccgcaggtgcatggtggaagccgccgcgggacgccggtcgggtaccagccctcggcggcctagcggcggaggggagcaccagctgccccttgtcgccgtcgcgctcgccacgcgcgtcgtcatggtcacgtccgctccggccgcggggggcggtgtgggaggaggtggagcggccgctggtggccggtgtctcgatgaccttctcggctgcctgctcggcgtgctccgcgtgcttggcttcccgtgggccgcgtcccctcagaggcagccgcgcccagtgccgccacgcggggccatcccgtcgacagcggacggccggcgcttcgcggcggagctgangcggatccccggccggattgctggcaatggcgcctgcgctgttgcgtcgctttacacgatgcagggcaagaagggcgtcaaccaggacgcgatgatcgtttgggagaacttctgttcaagagatgacaccattttttgcggtgtgtttgatggtcatggaccttacggtcatttggttgctaagagagtgagagatctcctacccgtaaagcttggtgcggatatggggacagataagggtagagagacacccgctagcaacatggaaggcaacacaaatgaagtaggtttacccgtaaacccagagagaaaagaaaccaccacttctgttgcagctgagcaggatagggaatacccagagatattcacaacattcagaacttcattcttgcgggcttttcacataatggacagggatctgaagttacacaagaatatcgattgctttttcagtggaactacagcagtggcagtgctcaaacagggtcataatcttataataggcaacttgggagactcaagagctatcttaggcactagaaatgaagatggtcagctcattgctgtccagttgacggttgatctcaaacctaacattccaagtgaagcacaacgcatcaggcaacgcaggggcagaatatttgcacttcctgaggagccagaggttgctcgtgtttggctgccaaagtataactcacctggattggccatggcaagggcatttggagacttctgtcttaaggagtatggtctaatttctatgcctgaagtctcctgtcaccgtgtcacagagaaggatgaatttattgtgttggcgactgatggggtgtgggatgtgctgtcaaacactgaagttgttagcatcataagcagagccacttctcgggcttctgcagcacgcttcctggttgaatcagctaatcgtgcctggcgtactaggtaccctacttctaaaattgatgactgtgctgttgtttgtctcttcctgaatacacatgaagcagatcaaccatctagttctgcagccaacaatttagcaaatgctctagaagttagtggtgataagcactcgacagttgtccaactgagcactggagtatctgccgatgtggttaatgcacttgtgaaagatacaaatgagctatctcttgttgatgctgttgcgaagccagttactgtctcagatttgacaaaggatggttcaggcacaaagcaaagcatcatttgagcttgtgtgttgcatgagattgaacatttgttgggcgatttgtgctgtgttgacagtgcgctcccattctcccattcagaattctgagcctgatgcctatttttatgagcgcgttgaaattcactgcttgctattttctacatgcaagtccgagtagggtcttgagttttcgtcatttgtgaagtaccacttcggttttggtgtgacctgccatatttctttgtaataattttgttcttaatgtttgtttagtctcgtaacaataatagtatccctataggaagaagccttccgtgttttcacagttctgtaatattcattcgattgccgtccattacagtggtgttatgcatttcaattttgtcttcaaaaaaaaaaaaaaaaaaa

SEQ ID NO: 14502 - DNA, 1526 bp, Triticum aestivum
  Clone ID: PAT_TA_14502
attcggcaccaggcacggcgtgcgcggacacgctggagttcgtcgacgtctccgccaacctgctcatcggggcgcgacccgcgtgcatgcggtccaactcgtcggcgcgcacggtcctcgacgcgggcaattgcttccgcgacgccaagctgcagcggccgagcacctattgcagcccgggggcgctcgccgcgctgctgccgccgccgcaggggagcggcgccgagcagggtgggggcaaaggcggcggggtggggatggttcttggcatcgtgggcggcgtcgtggcaggcgcattgctcatcgcgctggtgatggtggtggtgctgaggagggcgaggaggcagcaccccggggtgacggtgatggccctgccgaagtcgccgttgatagcgccggcgaagaaggcggtcggcgcgaaggctacagcgaagctggcccagaagatcgctacccccgccgataagaggcatgcatcgcaagccgcgatggtaaatacgctggaagtaccggcgtatcgcgtatataccaccgaggagctccaagaagccacggacaactttgcatcctccaacctgatcaagaagagtgcccttgcacagcattacaacggccagcttcaagatggcacaagagttttggtgaaatgtctcagactaaagccaaagtattctcctcagagcctgtcccattacatggagataatttctaagttccgccaccgccacttggttagcatcattggtcactgtgttgtcagtgatcaggaaaatcccactattgctagctcggtatacctcatttctgaatgtgtaacaaatggatctctaagaagccatcttaccgagtggaggaagcgcgaaatgctgaaatggccgcagcgggtttctgctgccattggtatcgcgagagggatccagttcttgcacaatgcgactgccccggacattgtacagaatgatctcaacattgaaaatattctgctggacaagaccctcacttcgaaaattagcggcttcagtctcccgatgatatcgaccagcaagaatggcaagctattctctgaaaaccctttcgctgtccaggaagaaaacgaccattacagtgctcaatctgccgaacaaggggacaaggatgacatataccagttcggccaaattcttcttgaagtgatcacaggcaaaccgacggcgtcccaaagcgagttggaatccctgagagcccagctaagcgaggccctggccgaagacccggacatgctgaaagacatggccgacccgacgatccgcggcacgttcgccgtggactccctcagcaaggtgaccgaagtggccctcaactgcacggctggtgacccgagcgagcggccttccgtcgacgccgtgctctcgaacctgcagtactccatgcgggtgcaggacggctgggcgagcagcgagagcttaagcttgagcgtgaaatcacagggcgtgagtcagtgcaatgctctttttgtagcggtgcacccttatggctggccttttgct

SEQ ID NO: 14503 - DNA, 603 bp, Triticum aestivum
  unsure (1)..(603): unsure at all n locations
  Clone ID: PAT_TA_14503
attcggccgaggccgctttccccatttttcctgcgtattttattgagtctcgagctcctcgcccgggggctgttgcgcaggggcggtgctcgttcacgtacaaccgccgccaaccgcgcgcgcgcgctgcccggagcgacgacgcgcggcgcggcccggccgaggagagcgcgccggattcgtgcggtggcctgacctagggtttcgccgcgagatggacggccgggctcagccgcagcagcagcagnagacgcccgacgccgctgccgctgccgctgccgccgccgccgcagcagccgacgccgccgccgccgccgcagacgcagacgccgcgcgtgagctcgccggccgccggtggcccccggcgtcatgatgccgcagcacgcctacggcgcgatgccgccgggctccgcgagcgtcatgcacgggatgccgctcgccttcaaccccatggcgtcgcccggcgcctcgcagccggcattgaagcccgcggacatgccgccgctcgccatgtaccggcccgattccaccccgccgggcatgccgcagtccgtcggcggcggcggtggcgccctggtggtcagcgtcagcggcagcggcagn

SEQ ID NO: 14504 - DNA, 1105 bp, Triticum aestivum
  Clone ID: PAT_TA_14504
gccggccgggccccgagattcctcggttttcccctttggctgcctgcctagccgaaaccgacgacgacgctaccactctccttcctccccttccttcaccgcgtctcctcccagaccaaatccaacccggaatcaacttctccccctccgatcctcttcctcccccttccctgccgcctccgccggcgagaatcgccgtcgcgcccgtcgctacgacctaggagccctccttcacgggcggacctcttcccggagccaccggagggcggggacggccggccagtctcgtcttgagccggtatgcagagccagatcgtgtgtcaccgttgccggagggtgctggcctacccttcaggggcgcccagcgtgtgctgcgccatgtgccgggccatcaccgccgtgccacccccggcgccagcagtggaaatggctcagcttatatgtggtggttgccgaactttgctgatgtacacccgtaatgcagacaccgtgagatgctcatgttgcagtactgtcaatcttgtcagaccagtcaataatatagcccacgtgaactgtggtcggtgccggacaactttgatgtatccacatggagcaccttctgtcaaatgtgccatctgcgattatatcacaaatcacaaatactggaataaataccatgtcaccagcgccatgtccaaggcctacatcaaatgaatctgcatataatgcctcatcagcttctgttcccacacctcaaccccagaatgtaaccgtcgttgttgagaaccctatgacagttgacgaaaagggtaaactggtcagcaacgtcgtagttggaattacacctgggaaaaattgaagggttgtttctcacctgatgtatacctgttttgtgttctatataagaacctggaaagacccatgtactggtatttccagcctttggtgattggttgctgcctgacctggaagaacaaagacacatgaagtgtttttttggaatttcaccaaggaaagcatgcatgtcgaaagctgtattctggatatgttgattcttttgtctgtatatgagttctgtcagacttcactctgggcatgacaaaatggtattatacatattttg

SEQ ID NO: 14505 - DNA, 1200 bp, Triticum aestivum
  Clone ID: PAT_TA_14505
ccgacgcctgggcgcggttttcccctttggctgcctagctgaatccgacgacgacgctaccactctccttcctccccttccttcaccgcgtctcctcacagccatccggaatcaacttctctccctccgatcctcttcctcccccttccccgccgcctccgccggcgagaatcgccgccgcgcccgtcgccacgacctaggagccctccttcacgggcggacctcttcccggagccaccggagggcggggacgggcggccagtctcgtccagagccggtatgcagagccagatcgtgtgccaccgctgccggagggtggctggctggcctatcgggcgggcccaccctgcgtgtgcgccaccatggccgagccatcaccgccgtgccacccccagcgcccaccgggggaaatggcccagttatatgtggtggttgccgaacttttgctgatgtacacccgtaatgcagacactgtgagatgctcatgttgcagtactgtcaatcttgtcagaccagtcaataatatagcccacgtgaactgtggtcggtgacggacaacttttatgtatccacatggagcaccttctgtcgaatgagctaccttcgattatatcaccaatactgtaataaataccatgtaaacatacgccatgtccaaggcctacatcaaatgaatctgcatataatgcctcatcagcttctgttcccactccccaaccccagactgtaaccagtcgttgttgagaaccctatgacagttgacgaaaagggtaaactggtcagcaacgtcgtagttggaattacacctgggaaaaattgaagggttctctttcacctaatttaaagctgttttgtcttctatataagaaccttgtaatgatctatatacgggtcttgcaagactatggtcttgtgttgctgcctttcctggattagttgcggcccgtcctgggagatcttggactcacacagtggtttttttgggaatttcaccaaggaaagcgtgcatgtcgaaagctgtattctggatatgttgattcttttgtctgtatatgagttctatcagacttcactctgggcatgacaaaacggtattatacatattttgaaactttccatactcttattagttgtatgacatgatatcttttttggtgaaaaaaaaaaaaaaaaaaaaaaaaaaaaaaaaaaaaaactcga

SEQ ID NO: 14506 - DNA, 648 bp, Triticum aestivum
  unsure (1)..(648): unsure at all n locations
  Clone ID: PAT_TA_14506
cggcacgcgatccgaactatcttcaccagttagctcaagtcttcagcagtggctgtggtgccagtgctcaaagatcaaaagagaggttaatagaaataagaatgggcaaactagttgcagcaataggcaagttgctctgctgtgtacaagtggaccagtcaacagtagccatcaaggaaagatttgggaaatttgaggatgtgcttgatcccgggtgtcactgtgtgccatggattatcggaagccgtgtcagtggtaagcttacacttaggcttaggcaaatggacgttcgctgtgagacaaagacaaaggacaatgtttttgttacaattgttgcatccattcaataccgagcaatggaggacaaagcaaatgatgcgtactataagctgagcaacccaaaatctcaaatccaatcttatgtctttgatgttatcagagcaagcattcccaaactacaactggatgatgtttttgagcaaaagaacgacatagcaaaatctgtggagcaggagcttgagaaggctatgtttgcttatggcatgaatgtcagacactaatgttgatatagancagtnaaaggtaaaaggtatgatgaaataagccctgcaaaatctgttcgcaatanaggaagnagaaagtntcaan

SEQ ID NO: 14507 - DNA, 675 bp, Triticum aestivum
  Clone ID: PAT_TA_14507
cggcacgagggtttacgcttacgtgctcatgaatgagtttggtactcaaccaaatgacttcttcgcagacgccactgtacagattaatgcttatgtgcatgtgcgaggtgctaatgtggatggggtcatcactgatttccctgggactgctcacagatacaaattgaactcctgcacgagcatgggaaagaacgcaccaccctttatgtcgcctccaaaacctggtgacctccttacaaccatgcccccatttgcacaaccaccagcagcggcgccaatgccgctcttgacggatgctgacgtcgcagaaccagccctacctccagtcagtaacaccaccacgcctgcatcgccttcggatgctgccctcatgatgcggactgatgtctcgatcctcatcacattgctgatgctatgtgcttccctcctcatctgaagatagtcctgctcaacatcatacgcggcgtggcgcattagagctgaggattttcacattgagctgctaatagcaattctttccaccacctttatgtagcgattctttttcttgttctgtccggtgttttggaggatggatggatgttcagcttgatacctcaaaggtggcacttgagcgtgctgccagctgtctctaggtacattttggtacatacgtgtggtgataaaaaaaaaaaa

SEQ ID NO: 14508 - DNA, 922 bp, Triticum aestivum
  Clone ID: PAT_TA_14508
ctggtggtccccatatgccaaattatttcgttccggttgtccaacagggccaacagggtccacgcccaggtatgaggcgtggagctggagcccagggccagccgcccgtgcccccatttcagcagcagattgttccgcgcggacggatgtaccgttatccaactggtcgcaacatgcctgaagctccagcgatgccaggggttgctggaggtatgatccaggcatatgatatgggaggcttccctgtgagagatgcagccgtatcaccggccgcccaaattgggactctgacttctgcccttgcaaatgctaatcctgagcagcaaagaacgatacttggtgaaaatctatacccactggttgagcaactggaaccaaaccaagcagcaaaggtcactggaatgcttttggagatggatcagactgaggtcctgcacctgctcgagtcccctgatgctctcaagtccaaggttgctgaggcgatggatgttctacgcaatgtggcccatcagcaaaacccaaacaccccgaccaatcagcttgctgcattatcactgaccgaaggcattatctcctaactttgaaagccataacaaactatctccagtttgcaattgagtgtggtgtttccaaaggttatctggcacatgagagtattgctccttttttttttcttccatactatggttggacttgagagtgtcgtttccatactggatgttaagtattattcgtgctctgcgatatcctggcgataaggcaaagcacttgtttgcaagtttgagtactattgggggctgttgattacatacctgtccttttcaccttgtcggaagttttgccactcaattgaatgagtgagggaacttattgcaccttatcaagtgttttgtgatctgatgtcgagtaattatcaacatct

SEQ ID NO: 14509 - DNA, 690 bp, Triticum aestivum
  Clone ID: PAT_TA_14509
attcggacgaggcggtgttggcgtcgccgtctttgagattggcgatgcgggtgcgttgtaggatcagcatagtccggccctcctgctcagtacttatcacacaaaatcattgcaccacactacattgtcaatccaaatgaccctgcatggcagctcattgtatggctcaccctcaaagggaacactggtgatgaagaacagacaaaaaccctcgccatgaactgaagaaccaaatgaaaattcagaatccaaaataagcatgtagagtcgcagatactaagatagacatccctagcatggtgacgagtaatagaatccaaaattaagcatgtgtagtcttgatacagcttgccatgggggcaagataaaatattttctcaaccatgggtctccagcagactaccccaaactccattaggattctattaccactattattcgacactgctactacttgaacacctgattagccaagggcatgggtttgtttttgcagctacctaagtaaaaacctagctttcctgccagttattctactgggcaatgcccttgcatccttagccctgaaatactccctctgtaactttttataagacgtttttagagtccatgacagtgtgaaaacacgtcttatattaagtgttacagaggttgatatctcatttttttttctttttcgcttgactgaac

SEQ ID NO: 14510 - DNA, 1295 bp, Triticum aestivum
  Clone ID: PAT_TA_14510
ctttggcaaatttccttccaaatgttagatcaggcggttggtcagatattggaagtcgccagtacatggaaagatacccatgtgtgcgccgacgcgtccagctaaaaactttggttatccaacagtggataaagaagttgtttccttttatggggtctttgatgggcatggtggaaaagatgctgcccatttcgttcgcgataatctgccaagggtcattgtggaagatgctgattttcctctggagcttgagaaagtagtgagcagatcctttgtgcagattgatagtcagtttgcggataaatgctctcaccagcgaactctgtcgtccggcacaacggcacttacagcaatgatttttggaaggtcccttctggtcgcgaatgctggtgattgcagagcagtactttcgcggtgtggcatcgcaatggagatgtcgatggatcacaggccctgcagcctgagcgaaaagctgcgggtagagtcactcggtggctacgtggacgacggctacctgaacggtctgctgggagtcaccagagccctcggcgactggcacctcgagggaatgaaggaggccagcaggcccgggggaggccccctgagcgcggagccggagatcaagctgaccacgctgaccaaggacgacgagttcctggtgatcggcagcgacgggctgtgggacgtcttctcgaaccagaacgccgtggacttcgcccggcggcgcctccaggagcacaacgacgtgaagcgctgctgcagggagatcgtcgaggaggcgataaggcgcggagccacagacaatttaacagcagtgctggtctcattccacctggtggcgcctcctcagatcagagtgaatcagccacgtagggtggcgcggagcatctcggccgacgggctcaacagcctcaggatactcctgggaagccaatgacggcgctcttctcgtgccgccgtgatcaggcgccgtgccggtgcttgctgagctctaattgtatgtagtcgtgtctgtatgtcgtcgtgtaggttgttagctgttgttatgttaccccattgttgttgagtggctgttattcttgttggtaattaagccaacgaacatgtgggctcacagttgtgagcatttcttagctgctggagactaggcatgtcctggagaagaggctgtgtgccttgcctgtatcatacatttccctgttttcatctgtaaataagattgtgggggcaactgaaattcggtcatgcaactccatcgccgtgaatctgtcggtcgaaaaaaaaaaaaaaaaaaa

SEQ ID NO: 14511 - DNA, 1087 bp, Triticum aestivum
  Clone ID: PAT_TA_14511
gagggagagagagagagaactagtctcgagttttttttttttttttttgtatagcactaaagccgcagccaaagttattaacgagctcaatcaaacttttttttttttttttttcagttctgtttttgcgaacaaaaaccttgctcactcttctctcatttcatagcggaaagtaaccaaagcggacagtaacatcatcgaacacgggggtaccaacacctaatccaaaggttcaacggacactaacacatgggtaactcagaatccaacggaacggtaacacgatactatagatagatagatagctaggataacttggccgaagccagggtgggcccacacaatcagttcctccagttgccgccggagtcaccgcggttgccaccgtagccgccgccgccgccatagccgccgccgccctcacggcgaccgccgtagccgccgccgccgccaccgtagccaccgcctccgtagccgcctcctccctcgcggcgcccgccgtagccgccgccgcctcctccgtagccgccaccctcacggcggccgccgtagccgccgccaccgcctccgtagccaccgccgccgccgcctccgccgcgggactgggcctggttgacggtgatgttgcggccgtcgagctccttgccgttcatgttctcgatggcgtcgagcatggactgctcagaggagaaggtgacgaagccgaacccgcgggacctccccgtctcccggtcggtgatgaccttggagtcgatgacctggccgaagttggcgaaggcttgctcgagggtctcgttgttggtggcccaggcgagcccaccgacgaagcaacggtactccacgtccgccgccgccatatctcccctccacaaaaaccctaacgaaccctaaaccgaggacgaggacttgttagggggggaggagaagcccacccccctcgccgtcgcctcgaaccttttcagggcaggggtcgtttggaattgcgtcaacactgaagcctctgtgcttttcgtctcaatgatgtatatgaaataataaagttgcaaagctgttgttttgttttcaaaaaaaaaaaaaaaaaaaaaaa

SEQ ID NO: 14512 - DNA, 648 bp, Triticum aestivum
  Clone ID: PAT_TA_14512
gattcggcacgaggggagtgcggcatcatggttccctacgggaactggccctgaatggcacagacaggggtaaaagaaaggcggtgcagctccttgagcgaatgagcagattccttgttatgcaacatgaggatactgtttcccaacaattggacgagattgaacgtcaatttgccgccttaggacctaatgttacagaggctgatcttgaacaattgggtgaacaattgggatatctttaacctccacatgctatggttgcatgatgatgatgaatctatcgtcgccacaatactaccaaatgttttttttggataagttaccaaaaggacgagcaagctgtatccgagtcacttggcttctggatccatggtttatgctgaacgagagttcttgtatggcaatgttcaatcggcactgaaatctgtgatgatccgtctggcttggcttcttccatgcttgtgtgctgaagctcccatcgctccatatctgtttctgggtacgtaagctagcccagaatgttgagatgtgtacagtctacttagtatgccgctccaaacgtcatgtatggctatgttttgactagaatatgtacatttttcactatggtactagataaatggagaagttctagcggcagacttgatc

SEQ ID NO: 14513 - DNA, 1710 bp, Triticum aestivum
  Clone ID: PAT_TA_14513
ggaaggaagcctagcatctgggaaacattcacacataaaggatattctattgacggtgcgacaggtgatgtaactgcggatcagtatcataagtacaaggaagatgtaaagcttttgcatgagctgggtgttgatgcctacaggatgtcgattgcctggcctcgacttattcctgatggccgaggagctgtcaatccgaaggggctggagtactacaacaatctgatagatgaactccttagctacggaatacaacctcatgtaacgatctatcatttcgattttcctcaggctcttcaagatgagtacaaggggctgcttagtcctagattcatagaggactacacagcatacgcagatgtgtgcttcaagaactttggcgacagagtgaagtactggagcactgtcaatgaacctaacatcgaaacgattgggcggatttgaccaaggaatcctaccaccacagcgatgctcagcccccttcggcttcggttgtgatgaaggcaactccaccacagaaccgtacatagcagcacaccaccttgtacttgcgcatgcatctgcagtgtccctatatagagagaagtaccaggctgagcaaggaggacgaattggactaaccttgcttggttggtggtatgagcctgcaacggagactcccgatgatattgcagcagctgcaaggatgaatgatttccacgttggatggttcatgcatcctatggtgtatggagactaccctccagtgatgaggaagaatgttgggtccagactgccatccttcacgaatgaagaggcaaaaagggtaaagggatcttttgattttgtcggattcaaccactatgttgccgtctacgtgaaagctgatcttagccgactagatgagaaagtgagagattacatggctgatgcagctgtggcatatgacatgccgttcctcaagtcaaggaaccagttcccgttcgggttggggttgacggctgattttacgacgcccaccccctgggctctcaagaaaatgctgaagcatctccaagtgaaatacaagaaccctgcagtgatgatccatgaaaacggagctgctggacagcctgatccatccggcgtgaacacctacgatgacgaattcaggtcacaatatctccaagattacatcgaagccacgcttcaatccatcaggaacggatcaaacgtgcaaggttacttcgtgtggtcattcctggacgtgttcgagtacctgttcggctaccgcctccggttcggtgtctgtggcgttgaattcaactcgacggcaaggacaaggtatcagaggcactcggccaagtggtactccagcttcctccgtggtggcgagctgaggccagtggctctacctgagggagcatattcacagtgatcaacaacacgctccagctcaagggggatatctggtaaatttttttgaatggcaatgtatggtaaattggtgatcaacactcttggggtggaaagaatagagaatgtataagcacggttagttgggtggtatatatagcagtgcctaaatatgatttccttgggtaaatatggtacgagttaaataagctggttttagcgtgtggttgggtgcttattggggttttaagatggaaaagtcagccgtttataggaaaaaaggacaaaagactgtgataatgtaatggtactgttggcacataaaattatccaaaa

SEQ ID NO: 14514 - DNA, 958 bp, Triticum aestivum
  Clone ID: PAT_TA_14514
cggtccggaatcccgggtcgacccacgccgtccggcggaccgcaccgacccgcgagagaaaaggagaaaagaggaagaagaatcggccgttcgatcgcgggccgaaaccctaggccgcagccccccctcctcatgccctccccgccgccgccatgagcctctccgccctctcccgcgcgctcgcgcgctcctcccggtcgcgccagggttatctgctcgggggccatggcgtgctccgcgcaccgctgccttcgccttcgccgccgccgtcgccgctgctgcccggcggtgagggcgccgggctgcggctcgtgcgtcgctacctgacgtccgctctggggagccgggctgcggcggccaatgcggccgggaaggtccgagacgggaggtccctgctcgccaactcgcagtcccggcggctgttgtccgaccagtcgaaaaagaatttccccaaggagaaggaggtgccgcaaggggatgggagcaacaagtctgaatcgaagaaggaatccaattcaggtggtcagccaaatgtccaggagaaacttctgaagctattccaggactctattggtcctgtattccttcttggcctattactagcaacattatcgggttcatcagagaaggagataagctttcaagaatttaagaacaagcttttagaacctgggttagttgaccggatcgttgttataaacaagacagttgcaaaagttcatgtcagaagttcaccctcaaccaagcaaaaccagcatagtgatacaagtattactaccagtcatcttcctggtcaagaggctcctagcaaatacaagtattactttaatattggaagtgttgattctttcgaagagaagttagaagaggctcaggaagcattggggatagatcgacatgattacatccctgtaatttatgctgataagataagctggttccaggaaatcatgaagtt

SEQ ID NO: 14515 - DNA, 429 bp, Triticum aestivum
  Clone ID: PAT_TA_14515
cggcacgaggctagatgatcttgtccgaaagaggtaccagagctttgacagtgagattggcgccttgattgaggctgggaaaggagactttgagacgctagaaaagaaggttctagagtggggtgagcccaccgttccatccggcaagcaggaactggcggagattctgttccagtctgctctatagatggtgccatgtccatagctccaggaataagcacaagtgtgtgccctccgaacacgcagtcgtcctcaccacaggaagttctagttccacgcgatgaactatgtacaatacagcgtggaactgaaataatttaggttgtagcctgtcagaatttccagaattgttgcctcctttgttcggagcggaatcaaactgaacttggttaagcttatcctgcattccatcaaaaaaaaaaaaaaaaa

SEQ ID NO: 14516 - DNA, 879 bp, Triticum aestivum
  Clone ID: PAT_TA_14516
ggagacgctgtacccggggatctcgcgcggggagagcgccctccgctggggcttcctccgcaaggtctacggcatcctcgccgcgcagctgctcctcaccaccgccgtctccgccctcaccgtcctccaccccaccctcaacgccacgctctccgactccgcgggcctcgcgctcgtgctcgccgtcctgcccttcatcctgatgatcccattgtatcattatcagcacaagcacccacacaatttcgttttcctgggtctgttcactttgtgcttgagcttcagcattggtgtggcttgtgctaacactcaagggaaaattgttctggaggctttagtattgacagctggtgtggtggtttctttgactgcctatgctttctgggcctcaaagaagggcaaggaattcgggtatctggggcctattctgtcttctgcgcttactatccttgtcctaactagctttcttcagattttcttcccattgggaccagtgtctgttggtttgttcggtgggctaggagcgttggtcttcgcaggcttcattctgtatgacaccgagaacctgatcaggcgccacacctatgatgagtacatctgggcatcagttgggctataccttgacatcctgaacctattcctttccatcctaaacatgctcaggagcatgcaatccgataactagtgggtcaaacaagatgtaccctgtgccaaccttgtcagagcgtcgtgatgttttgaacacagtatacccctggcaatgtggtcctgtactctagttagaggttgggatcaaagtgcaacgtaatgtatagtttgtctgccaatttcacactgtctcgtacctgttacctaatatgttctgcgatactgccaata

SEQ ID NO: 14517 - DNA, 740 bp, Triticum aestivum
  Clone ID: PAT_TA_14517
cggcacccggcatctatcagcaaagcacactccaggcggaaaaaggaagcaacaagcagcgatggcggcctccatgatctcgtcgtcagctctggtggcgccgccgtccagggcgcagggcctgccgtccctcggccgccgcgcctcctccttcgccgtcgtctgcggcaccggcaagaagatcaagaccgacaagcccttcgggattggaggtggcctgaccgtcgataaggatgcctccgggaggaaggtcaagggcaagggcgtgtaccagttcgtcgacaagtacggcgctaacgtcgacggatacagcccaatctacaacgagaatgagtggtctcccagcggaaacgtctacgtcggtggaaccactgggcttctgatctgggccatcaccctcgctgggctcctcggcggcggcgccctcctcgtctacaacaccagcgccctctccggctaaggatactcatttccaatcatgatatatccatgcgcttcttcttgatgcggttcatcatgtaaaatcatgccagggtgtctgtctgtaatctagcctccttcgatgcccactgtaatgcaagcttcatcatgtaacaatgctactctactactacgacgtactcttcatacttaattttgggacaggtattattatatcattaattgatgctatatatttagaatattattaataactgtagtaataacttcgttctcgtgaaaaaaaaaaaaaaaaaaaa

SEQ ID NO: 14518 - DNA, 622 bp, Triticum aestivum
  Clone ID: PAT_TA_14518
ttcggcacgagccagagtacaccgccgtcgtcctctaggtccggatctacaccacccgccggctcgccggaccgacaacaccgtccgccttggtccctccatccgaacaagatagtttttcaggcgatctagtacaacaggatttaggatgcctcgacttggagacccagaagcatcttcggtcttgagaattgcagcagagtttgggtacctcgcttccatcgccgcaggatgctggtttgataacaacctatatagatatggaatgagctatatgcccaccttcttatattggagcagaaccatgcggtgtatcggagatcctttcatggcatggaaccttctctggttagttcttgacgaaatcgattcacccatggcgcggccctttacttgggggagaatttaagtgatgtaaatgtaacaatttctcaaaaccgcaaccaaattgtgtcgtactctctccattccacacttaatgaagttctatctttgtcctaactcaagcttgtttaagtttgaccgggtctatagaaaaatataccaatatatctagaatgccaaattagtttctttaaattctttagaacttcatatatttgatgttgtagatctaaacatg

SEQ ID NO: 14519 - DNA, 596 bp, Triticum aestivum
  Clone ID: PAT_TA_14519
cggcacgaggaatcctgggggattgtcggcagaagttgtttcatgtccggtcaaaaaggccaagacctcatttggatgataaggttattgtttcctggaatgggctagcaatatctgcttttgcaagggcttcacaaattctgaagtcaggaccatctggaactttattcaatttccctgtaactggatgccatccagttgaatatcttgaagttgcagaaaatgcggctaactttataaaggaaaaactttatgatgcaagctcaaagaggctgcatcatagctatcgcaatgggccatccaaagcaccaggatttttagatgattatgctttcctaatcagtggcttgctggatctatacgagtttggtggaaagacagagtggcttctgtgggctgtccaactgcaagtcactcaggatgagttgtttttggataaacaaggaagtggctattttaatactcctggagaagacccttctgttctcttgcgtgttaaagaggattatgatggtgcagaaccttctgggtaactcagttgcagcaatcaacttgatcagattatccagtaatattttgatgtgtcaaaatctact

SEQ ID NO: 14520 - DNA, 1105 bp, Triticum aestivum
  unsure (1)..(1105): unsure at all n locations
  Clone ID: PAT_TA_14520
ttcggcacgagggaaggttgtaaaaatttgctgctgctgaacctttcttccaaaaagttattttggaagcatcctgtcagaactcttttccatttcaacactttctaaaggtttggatctttcctataaccaactcagtgggaacatacctactcgcataggtagtttgatgaatttgaattcacttagtatatccaacaaccaattatcaggtgagattccttccacactcggccaatgccttcttttggaatctctctctttggaggcaaatttgttgcggggaaaaattccanaagtctcttgggactttaatgaggaatcaatatgttggatctatctcaaaacaacttgtctggtgaaataccagattttttggagtcatttacctccttatttattctcaacttatccttcattgactttgaggggagtagtccctaaagggcggtgttttcgccaattcaagtgcagtgttcgtccaaggaaacaaaaaattgtgtgcaagttctccaatgcaacaagtgccactttgcaccaccttagcttccagaaggaagaacactgcacatgtcgtaactatactggttccacttactactattgttgtaattgccctggcatgccttgtattcattcttctaaagaataaaggtactaaaactgaggggcacgttacccagtttttcagggagcataatagatactcatacatggatttatataaagcaacagatggtttctgtgcatccagtatcctggttcaggaagctttgggagtgggtatacaaaggcaatcaagaattcaatccaatgccattaaagnattcaagcttgnacaacttggagcatcaaagantcctcnctgaatgtgatgcactaagaaacatccccaccggnattgatagagtgattatccaagccaacactgatcaagaggaatgagtcaaacactatctgatcatgggacatggnaaccaaaaagtggctaccagaagaaacaagcaaccaaaatacatgggttggccaaggtaagatactangcanactcnnataatacncanancagtaccccattgtatggattaacacatgnctttggaaa

SEQ ID NO: 14521 - DNA, 435 bp, Triticum aestivum
  Clone ID: PAT_TA_14521
cggcacgagcgaattcaaggaagatccctccattcgcggcggcggcgagtgcgttgtcaccaacgtagtcaagtgcgacgccgggttcgaattcaagaaagacaacccccctaccggcggcggcaagtgcgtagcggtcggcaccactgtcaggacctgagctagctcaccgctggaatggaatggcgcctcatctacgttcttttcttcgggttcccattaatggtgcatgcgtctgtcctcgtcatcgtcgattgcctgtttcctttgttccttcattcctctgtgtatggtgtgtcgtatgttttgaacggagctagcgccctctggcgcggctatgcggccgtccgtcggttttggtccctcggtccgtttccttgcgttgtgttgatgtggcttaaataaatgcaagtcctcgaagggggggcccggtac

SEQ ID NO: 14522 - DNA, 724 bp, Triticum aestivum
  Clone ID: PAT_TA_14522
tgcagcgcatcggggtcggcctcggcaccgtggccttctccgccgccgcccccgccgccgcccgccgccgccgccccgccctctccgcggccgggcggccgctctccgtcctctggatcgcgccgcagttcctcgtgttcgggctgtcggagatgttcaccgccgtggggctcatcgagttcttctacaagcaggcctgcgccggcatgcagtccttcctcaccgcgctcacctactgctcctacgccttcggcttctacctcagctccgtgctggtgccgccggtgaacagggtcacggcgaggcacggcggcgccggctggctcggcgacaacgacctcaacaaggacaggctggacctcttctactggatgctggctgcgctcagcgtgctcaacttcttctgctacctggtatgtgcaaggtggtacaactctggtgccgatggctctgatgctgcctcagctcagattgcagcagagggtgatgccaaggagatcagctgaagacctacatggagattgaacctgtatatgcgtatagatatatgtagaaatgcatgaaaaatagtgatggggaaagaagtgctaggttaagaagaaggtttcctttgataaggaatagaaagtacattagcttgcctagggttgcacatgtgcttaggtatgcttgtgcccccgctaggcaccgccgccgcgaccccgctttcgccaaaaaaaaaaaa

SEQ ID NO: 14523 - DNA, 686 bp, Triticum aestivum
  Clone ID: PAT_TA_14523
tttcttttcgctttctcgcccccccgcccctgccccttcctatttttccagcggcggatacctcggtgagttggagatctggagtcatggcgattttgattgggagttctccttcgatgctcgcttgagggcttggtggtcaggcagccggagttcttctctccccgtcgctgcatctctcctctgttgctatttccctttcggttccctgttgctcagatctgtgggttgctcgggtgttatgatctgtagggttatgtgatgttgtgctttggggatcgagtgttgtgatctgtgatgtggatgtgttgggctcttgtgatgtttcccctttggttaggcgcccgtgtgtgtttgcctgatcgattctgtttgcgtcatagtgattcttcagttagttcatttggatcctagttgtagctgctatttttcgttagttggtatcctgagttttgtttagttatctccggtagtagctgttaatttttagatctagcatgctttggtacgagttgagtttgattttggtctctgaggggaggggttggtctcccatagtacgttgcgctgttgtattgcttggagaattataggtcctcatagtacttggccagctcatgctgtagtttttgctgctggggagtagtacgtggcgctgtcgtattctcatttgtctctgtcatgca

SEQ ID NO: 14524 - DNA, 759 bp, Triticum aestivum
  Clone ID: PAT_TA_14524
attcggcacgaggcgagcgctagcagcaatccattgtgtgtaattaattgtaacccgggccggcccgacactgcacgagatggccgactactaccacggcggcagggccagcatgtacgacgactgctacgacgccggcaggcacggcggcggcagcatgaaggcctactcgcgcaccgacgagtactatgacaacgtgcaggacgaccgcatcaggatgaggcccgtgtacgccgacgacgactgtactggctacaacggcggcggctacggcgccggcaggcagaccgccgtctacactactgacgagtactcccgcggcggcggctatggcggctacggcggcgagcaggagcacttcaagagagaggagagggagcacaagcacaaggagcgcctcggcgaggtgggcgccctcgccggcggcgcctttgccctgtacgaggggcaccgtgcgacgaaggacccggcgaacgcgcagaggcacaagatcgaggccggcgtggcggcggcggcggcgctgggcgccggcggctacgcgtaccacgagcaccgcgagcagaaggcggcccactacgagaccaagcagcaggcgccggagcacagccacagggtgccgcacggctactactgcaactgaaactcatccgatcgatcgatgcatatgcagatgcagatcatgcagatggacgatcgaacgaatgcatcagcatcaactcgatcctatggactgccgtacgtacgtacgtacgtactata

SEQ ID NO: 14525 - DNA, 779 bp, Triticum aestivum
  Clone ID: PAT_TA_14525
cctctccaactcgcagccgtgatggtgaccatgcagctgcagatgaggaagaggatgatgatgatgttcagtggcagactgacacttctatcgaggctgcgaagcagcgcatgcaggagcagctgagtgcagcaactgctgaaatggtgatgctgtccactgaggagactgagaagaagaagaaacaggcaacccatgctaatggttcagcaaaagaaatccctgttgaaaaacctgccgtcccgcacccgggtccatatgaagaactggttggagacatcaaggctagcctaggaagtgctcctacccctacccagctcaaggctgtgcttgcctcctcaacccttcctccccaggatgtgatgaatgctctcctcgaggctctatttgatggtgtgggcaaggggtttgcgaaggaggttgtcaagaacaagaagtaccttgcagttgctgtgccagatgaggctgcccaggtcctgctggttcaggccattgaggcttttggtggcaagtgcaaccctgaggcgctgaaggaggtcccagttgtcctgaaagccctgtatgatggagatatcctggaggaggaaaccatcgtggactggtacaatgctgctgttgcagctggaaaggactcccaggttgtcaagaacgccaagcccttttgttgagtggctccagagcgccgagtctgaggaagaggacgatgaagtgaaaggggggcagctctgctctactgctgcacttaatagtattatatatttcaatttagtttcttttgc

SEQ ID NO: 14526 - DNA, 738 bp, Triticum aestivum
  Clone ID: PAT_TA_14526
cggacgaggcccccttcacctggtgctccgcctgcgtggtggcatgcagatctttgtcaagaccctcaccggcaagaccatcaccctggaggttgagtcctctgacaccattgacaacgtgaaggccaagatccaggacaaggagggcatccccccggatcagcagcgtctgatctttgctggcaagcagctggaggatggccgcacccttgctgactacaacatccagaaggagtccacccttcacctggtgctccgcctgcgtggtggcatccgcacctgggtcaagaccctcaccggcaagaccatcaccctggaggttgagtcctctgacaccattgacaacgtgaaggccaagatccaggacaaggagggcatccccccggatcagcagcgtctgatctttgctggcaagcagctggaggatggccgcacccttgctgactacaacatccagaaggagtccacccttcacctggtgctgcgtcttcgtggtggccagtaagtcctgggccatgagcagccgtccttccagggttcacatgtctggtgccttcctctgtccctctgatggagattatctgcatgtcgtggtcgtgtcttgatcgagtcggtgaagagtccctatgtttccctttctcagaaaatcgtcctatgtcagtctggttgtgttcgtgaacatttctgctggtgcccagcagtttggttggaactgtgcaatggaataattgaaccctg

SEQ ID NO: 14527 - DNA, 991 bp, Triticum aestivum
  Clone ID: PAT_TA_14527
ttcccgatacgaaaggagagcacgaatcaaggaccgagtttcaagttccaacatggaaaccgagttccaggatggtaagcaggaggttattgaagcatggtacatggacgatagtgaagaagaccagaggcttcctcatcaccgtgatcccaaagaattcattcctcttgataagctttcagaactgggaatcatcagctggcgcctgaatcctgacaactgggagaatgatgagaacctcaagaaaatccgtgaagccagagggtactcttacatggacatttgtgatgtatgcccagagaagctgccaaattatgagattaagataaagaatttctttgaagagcacctgcatactgatgaagaaatacgctattgccttgaagggagtggatactttgatgtgagggacgaaaatgaccagtggatccgtgtagcagtgaagaaaggaggcatgattgttcttcctgcagggatgtatcaccgcttcacattggacaatgagaactatatcaaggcaatgcgtctctttgttggcgagcctgtttggacgccgtacaaccgtccccatgatcatctgccagcgagaaaggagtatctggacaagctcctcaagccagaaggccaagctgttgaagctcgttgagacaatttgaaagctacctgttggcctctttccaccctgcgtcctgtgtcgtataacctgaataagatgttgtatgtccctaatctagtactagtgtcctggccaatttgaagtgaacactgtaactactgtctatcaggatcaggtgaggtcatctggcttaaatacctgcaatatatatactgtaaacatatatctaataaatagaaacgggtgcatctttctatgaagtattgaagtggatgaaggtgcgttttaccaaaacagtttgtaactttattctaataaagcttcctcttggaaatgcttgtgcacactaaaaaaaaaaaacaaaaaaaaaaaaaa

SEQ ID NO: 14528 - DNA, 527 bp, Triticum aestivum
  Clone ID: PAT_TA_14528
tcggcgccacggccacatcttattgtcacttccatctcattctcctaatttgtcatcactagcttctagctagcttcaattaattaattagccatggcggaggagaagcaccaccaccacctgttccaccacaagaaggacgacgagccggccaccggagtagactccctacggcgagggcgtctacacgtcggagacggtgaccaccgaggtggtcgccggcggccaggacgagtacgagaggtacaagaaggaggagaagcagcacaagcacaagcagcaccctcggcgaggccggcgccctcgccgccggcgccttcgccctgtatgagaagcacgaggcgaagaaggacccggagaacgcgcacaggcacaagactcacggaggagatcgcggccacggcggcggtcggcgccggcggctacgccttccacgagcaccacgagaagaagaaggaccacaagagcgccgaggagtccaccggcgagaagaagcaccacctcttcggctgatcgacctcatcaca

SEQ ID NO: 14529 - DNA, 557 bp, Triticum aestivum
  unsure (1)..(557): unsure at all n locations
  Clone ID: PAT_TA_14529
tatacganccactatagggcgaattgggtaccgggccccccccgccgtcgccttcggctgcggcgacacgaacgagggcgacgggttcacgcagggcgcggggctcgtggggctcggccggggccccctctcgctggtctcgcagctcggcctcaagaagttctcctactgcctcacctccctcgacgacacgagcaagagcccgctcctcctcggctctctcgccagcatctcggagagcgcggcggccgcgtcgtcggtgcagaccacccctctcatcaagaacccgagccaaccgtccttctactacgtgaacctcaagggcctgaccgtcggatcgacgcacatcgccctgccgagctcggcgttcgccgtgcaggacgacggcacgggcggggtgatcgtggactccggcacgtcgatcacgtacctggagctgcaggggtaccgcgcgctgaataatggcgttcgccggcgcagatgaagctgcccggcggcgggacggggtcgggggatcgggctggacatgtgcttcgaggcgccggcgagcggggtgg

SEQ ID NO: 14530 - DNA, 838 bp, Triticum aestivum
  unsure (1)..(838): unsure at all n locations
  Clone ID: PAT_TA_14530
agcaacggggcactgcttcagctgctagtgggaagctacttctcagaaaagataccaaaggccaacgctattgtctcattcaacaataggccggcttcggaggctgtgccttactttgaacagatagggcccctttttagtcaactgatgcctatgatggaggcctcacctgtttactcggtggccagaaatgcatcaggagatgcatggaaggctctatttgatttagctggaggtttgatacgggagtacgatcgagaagctatggtatccgtaagcaaatttgtcgatcagttaccatcagtaatgaatcaggttacagaaggcgtatctgaattcaaaccaacaccacctgagaaccgtgaattctgcaagaattcttacagtgtagctaatacattattggtcaaattcagcgttgatgctattgatgatacagacataattgaggacatcttgagaccccgggtagactcaattggtggacaaataaagaaggtcgtactgtcaggaacacatctaactccgtgtatacagggatgtttaatggcangttgggtcagaatgacactccagcggatgctctgggcgcagggcttaaaatcattggctccccatgaggccagggcccccccagaactatcccgggctacttcagccccctttagcccccttgatatttttcccgggccatggaggtcaaaggcggctataattgctgggtgtgggggttgcattanaggcacacgggtaatattacaccagacccaaagcattnttgaccattnatcttgacggaggctnacacaagttataaattgngtggcattttggccac

SEQ ID NO: 14531 - DNA, 460 bp, Triticum aestivum
  unsure (1)..(460): unsure at all n locations
  Clone ID: PAT_TA_14531
ttcggcccgacgagggatctctcgatctccatcatctcttcgtctaccaacaaagttataatatcaaattaaggtgtatatatatatatagtagctagcttcaattaatggcgagttcgtcgagcaggttatcctgctgcttgctggtgctcgcggcggcggccatggcggcgacggcgcagaactcggcgcaggacttcgtggacccgcacaacgcggcgagggccgacgtcggggtggggccggtgagctgggacgacacggtggcggcgtacgcggagagctacgcggcgcagcggcagggcgactgcaagctggagcactcggactccggcgggaagtacggcgagaacatcttctggggctccgccggcggcgactggacggcggcgagcgccgtgtcngcgtgggtgtcggagaagcagtggtacgaccacggcagcaacagctgctcggcgcc

SEQ ID NO: 14532 - DNA, 1452 bp, Triticum aestivum
  unsure (1)..(1452): unsure at all n locations
  Clone ID: PAT_TA_14532
ctttgcttatgaccggttgggggcgcgccgcgaccggccggccagcgggtggacgtctgcggctctcggctcgccacgcggagaccgcacgagccccgatgccgccgccccgccgcgccggcgcgggcgacacgagcgccttcttcgcggcgacgctggtgctgtgggccgtgtcggtggggttcgagatcggcgcgcggggacgccgcgagctggccgccgtggccgccggcttcgccttcttccaggccgccaacacggccgtccgcgccgcggtctcccgcgacccgctcttcgtcaacaccgccgtctcgctgctccactcctccctcacctccgcctcagttatctttgttctattgtgccaatgggcgtaccaagggccttgagaacatgtttcagcatgaagaattagttggtagcagttggattggagcatattctgctctgtgcttttcatgtggctactttgcttatgaccaattggatatgctccgctaccggggtgtactgtggatgggattcctgggatcctgatggttcgccttagttcgttttgattagctttatgctagtgtgtgtatcggaatgtccacattgactatcctaaattgcacactctccgctacggacctgtacagtggcttgcaattcctggaattctgctgcatcaccttattctgctcatttgctttacgctagctctgcatcggaatgtgacaatcaactacttaattctcactcttctatgcgaggtccaccctcgccgtggccggtctctgatatctcacttctgtgggtcagttgtaaccatcccccccctcctccctgcacgtcttcgttcgcgtccatcgcctgccgcagtaccactccatattcttgcacgtacggaaattgaggaggatggctggattccgggatttcaacagaaaacttgtgaaactggaatgggtactcaactggactacctttgtgacagcaagggtgatctgccacatattgatcacatacaaactgatcaccgacgcacacaagtttgataaaggcattgagctgccactagctctttctggtatggcaggaatgaatgtgctcaatgtatctttagggcttgatctatttaaagcgttcgcgcgagagagaaatcagcagacgcatcaggactgaatgttcttgacagtgtagtgtaaattttggtaaggttatagtcacaccaatgtaaatcagaagacagaggtatgttctaagtgttgttagcctctagactgtagtgacaacctatatatgtaatcttatgtatgatgaatttgtattaagatgcctcgcggaaagattctctggcttttgccagcattagtggaattacatagacaacccaacctggatccagcatttgtgcagattttttaaagcattacctctgtccgaaaaagcttgtgttagattnactgt

SEQ ID NO: 14533 - DNA, 827 bp, Triticum aestivum
  unsure (1)..(827): unsure at all n locations
  Clone ID: PAT_TA_14533
ggcacgaggcacctcacgatcgagcaacagtagtcggcaccctggcccgcgcacagttggtgttggtcgccgtcggggcagctctgctcctcgcccccccgcacgccgccggggccatcccctgcggccagctctgctccgccccgcccccctccccgccctgcccccgacccgccgccggcccgtcgccgccctgctgccccggcgggacgacccccacggcggcgcccggccgcacccctccacaggcgccccccgggcaactgcctcggggacgcggcccgcggcctcaaggggctcaaccccggcaacgcccccagcatcccctctaagtgccgcgtcagcgtcccctacaccatccgcgcttccatcgactgccccggggggagctgacctacccatcggctggatcacttctatgcatacagacgcgcggcgctgggtcgtcgtgtggagccgatcgaattctgtatccaatattgggagtatctctacgtattctggaataaataggtcagcttgtggagcccgatctatctccatgcaaccaggtgtgtccttcctgggttctgcggcccggccggaccggcctgcgggctcgctccttcaccatgcatgcatgcgtgtgcatccatggttgatcggcccggtcacgctagctagctttcttcttcttgtgtgatcgtctcgtacgttttgctccttttcgacgggctcgtgttccagtgtgacccagacattctgctcgcttgcgctgcaactccttgtactacgtgcttgttttggattattacacatacatatagctctttttcgtacnnaaaaaa

SEQ ID NO: 14534 - DNA, 625 bp, Triticum aestivum
  Clone ID: PAT_TA_14534
acgcactgcggttggggctccaccgtggagagcttcgcgtttgggcacccgctggtgatgctcccgttcgtcgtcgaccagccgctcgtcgcgcgcgccacggcggagaagggcgtcggcgtggaggtggcgagggaccagaaccgacggcccgtccgacagggacggcgtcgccgcggcggtgcggcgcgtcatggtggacgacgaggggaaggtgctcgcgagcaacgccaagaagctgcaggaggttctcgccgatcaggagcggcaggaacggtacatcgacgacgttgtcgagcacctgatacgttacaaagatgaataatttaggagtaaatagcataaaactatcacttttcgcgttatggttccaaaaaactaccgaaaatttatttgtgactgatgcctacaacttttggcctcggctgtctcaaaaaacccaaatcgccgtgtgctttgcaattgatcgcggttatgacagttggggcccactcctaaacaaaccatttgtttgaccgtttagtttgaccattaactgacatgtgggacccacatgacagtatctgtaaatattttttaaatgcaatttggtccctgcaaatatttcaaaaaaaaaaaaaaaaaa

SEQ ID NO: 14535 - DNA, 628 bp, Triticum aestivum
  Clone ID: PAT_TA_14535
tgatccaagaaccccactagacaatccaatagccctgaggacatctagcttcccaagaaccccactagacgatccaatagccatgaagggacatctagccttcctcctcatcatacgttgttgcgttcctctatgccatcggctcacctgccataggctgtggggaacggatgggcaaccaattgtggaacacggcaatcgagaatggatgggaaccaatcggaaacatcaacgaccaacacatccaggagctcggccgttgggcggtgttggagttcggcaagcatgtgaactgcgtgctcaagttcaacaaggtggtaagtggcaggcaacaacttgtttctggaatgaactacgaactgatcatcgaggcatcagacattggcgggaaagaagacaagtacaaggcagaggtgtacgagcagacgtggactcacaaacgccagctcctctcattcgccaaggtgaaataggcgggtagcaataacttcggtagtaataattgtgatgttgcagatttgttaactgttttttatcgactaataatttatcctcttgcattgaaaaaaaaaaaaaaattcaaatagcatacatctacaacttgacaatgataagagcaaaaaaaaaa

SEQ ID NO: 14536 - DNA, 817 bp, Triticum aestivum
  Clone ID: PAT_TA_14536
gaggcgctagctagcattccatcccttttcttgagaaaaaaaagacaagtcaccaccatgtctggcatcatccacaagatcgaggagacgctccacatggggggcgaccacaagaaggacgacgagcacaagaaggaggagcacaagaaggccgaggagcaccacaagaaggacggggagcacaaggagggcatcgtggagaagatcaaggacaagatcaccggcgagcacggcgagaagtccggcgagcacaaggacaaggaccacaaggagaagaaggacaagaagaagaagaaggagaagaagcacggcgagggccacgaccatgacggccacagcagcagcagcagcgacagcgactgatctcccccctcgccgcctagctacgccgtgcgcttccatacgcagatgcaggtgatttgggctgggctctggccgaacaccatgcacatacttatacgcctagattattgctcttgaacaattaaaagttctttttttttgtttggttttgatctttgctggatcgatctcaagatgttgacgatgttggcttgaaagcaggtggaacagatgcctggagtaggatacataccagttgctgatgtaatgtttcacgggtgtcatgcatatgtatgtgctacataatcaagggtgaaaaacgatgaaaaaagaaataacagagagtcagagatagcatgtatggtttgtttgccatgtgatgtgtactactaaaattatggctgcacggtgctagcttgcaataaaatgttaatgcagaaattgatcggtcaagggaagaaaaaaaaaaaaaaaa

SEQ ID NO: 14537 - DNA, 649 bp, Triticum aestivum
  Clone ID: PAT_TA_14537
cattttgttggatgacaaattggttgctaaggtttctgactttgggctgtcaaagactagtccaaatgtcgataacacccatgtgagcacggttgtgaagggaagctttggataccttgaccctgagtacttccgacggcagcagctcactgagaaatctgatgtctactcatttggagtcgtgctgtttgaggtcctctgtgcacgccctgccctgagcccctcgcttccaaaggagcaagtgagcctcgccgactgggcactgcactcccagaagaaaggcattcttgggcagatcatcgacccatatctgcaagggaaaatctctccccaatgtttcatgaagttcgcggagaccgcagagaagtgtgtggctgatcacagcatcgatagaccatctatggccgatgtcctctggaaccttgaatttgcactccagctgcaggagagtgcggaggacagtagcagcgtcaccgacgggacatcttcaaacacgtctccacttaccatcctcaggcttcactcggatgaaccaacgacagacaccaccaccaccacatcaacgagtatgagcatgacaggacggagcctcgcaagtgtggattcagatgggctgaccccaagcagtgtcttctcgcagctcatgcat

SEQ ID NO: 14538 - DNA, 630 bp, Triticum aestivum
  Clone ID: PAT_TA_14538
agatcctcaagatcgtcaaggagaacttcgacttcaggcccggcatgatcaccatcaacctcgacctgaaggatgccggcgacgggttcatcaagaccgccgcctacggccactttggccgtgacgacgccgacttcacctgggaggtggtgaagcccctcaagttcgacaaggcatccgcttaagattgggaagccaaattggacatgaagaagactgtgtgtctccgtgctgtatcttcctctggctctgctgatacctgctgcaagcattgctgctgctgctcctgctcctgctcctggatgtgtgtttgatcagtgactggctgctccatagaagagaagaaaagaaggctttggcaagcaagccatgtcggcgccgccggcttagggattggtataattttggtgtggcagcaaccaggattatgcgctgatctttatcttttagtttggtcgtccggtattttttttttcttccccttttcgagtctgtactgaaactgctgagagatttgcagtttttaatctatcaatattcgtatgttactgttaccctttacgtgccccctgtgtaaccaagcgcaattacaagttcacatttctccgtccaaaaaaaaaaaaaaaaaaa

SEQ ID NO: 14539 - DNA, 447 bp, Triticum aestivum
  Clone ID: PAT_TA_14539
gagggagacatatgctagtgtttgtactgtttcagagcttgctggtcactgctgtgctagggaagcacaccaaaggcccgacatgggccatgctgttaatgtgctgtctaccctttcggaagtttggaaaccaaccgacccagactccgatgacagctatggtatcgacctgaacatgaccctgccacaggctctgaagagatggcaggcattcgaggatagcagccactttgacggtgcaacctcttcatttgttgcaagtttggataatactcagaccagcatccctacgaggcctcctggattcgcggagtcattcacctctgctgatggaagatagacagttagtttgctagggtgtgcaaaaccttatgcttccgttgaaatagaaggctcaagtgatccttgtgttcattcttttagtcaaaaaaaaaaaaaaaaaaaaaa

SEQ ID NO: 14540 - DNA, 839 bp, Triticum aestivum
  Clone ID: PAT_TA_14540
tctcactgaagccgctcgtgccctcccaggcttgatatcctgccgcagcgatgagctcctgtacatcgccgaagtcccctcccggctcaacggcaccagcacgaggatgcagcagctaggctgaaccccaagttcgtgcctcaaaggtgcaagttacgcggaaccccttgcgaggaggttctccggtgcgccaagtattgccggcagcgatgcctgcttacgtcttcctcggtatgattcgccaaggccgcgtcctcctctgagataagaagagcgacaaggaggtaaaaggaacaccagatttttacaaattctgcagatgtagtacgtatttgccattttgccaaagcagtgagtctatgtgctgatgtttctcttgtcttctcttggatgtatttgtcgatggagagcacggtctttttttcgtggagctggcgctgctgcagtacggcctagtccagtctaaggcctccatggttgctgctgctgtttccgcaaccaggctaccccgaagaagacccctatgtgaattgacaatctaaattatagtatgtgttttttgtttataattgaagttcaaaaatatcattggcaggggtacagaaatgattatagtcgttatagcaaaaaaaagtgcagaaacttaaagaacaaaattattgatacacgtaaacaaattggatttatgtgttatgtagtattggtacttaagaacaaaagttcagatttcaaactttcaatagtttagtgctacgtagaaaggaacataagtccaccctacaaaaaaaacccagtaaatgcatttctgttatgatctaaatttctggtctgtctctttt

SEQ ID NO: 14541 - DNA, 755 bp, Triticum aestivum
  Clone ID: PAT_TA_14541
gcggcgcgcggcccccttggagtctcggtttttgtttctggtgctccctatttctctccttcattttagtgttcggttcgttgaaaacaccagctgctaaggttctttagaccgttgtgagaaagcatccatacttccataggaaaaatcttgcacttaccaaatagaagtctcaaagtagagagtgcaaggaatatttgatcattggccagatgtggtgatgtgcatctgctgaatgaaccgtccgtccggtcacctctattttattttgtgctgattattggtgagtttcaaacttccaatttgatagatcctgcagaagaagagcatggagaacatctccctcttcctatatatctcaaattggacttacaggtgatcgatccatggagttgaagtgtttgtcaaattgcttgccagggtgattaggattttataggtcactatttgatttctgtcataatatttaaactactactgatcttctaaaatgttatttgttatttctttcagctatcagctggtcagttttgatgtgttttcgacattacgagcctatcacttttgatgtgttggtattacaatgaaacggagttgccatttcagtttgcatctacactctactatttatgcttttgaagtacatgtcattgcacaactattgatatatgattcatatagaacttgatgaattgcagagttatactttcacaattttataagatactgaaaccagttcgccttctttttgatga

SEQ ID NO: 14542 - DNA, 612 bp, Triticum aestivum
  Clone ID: PAT_TA_14542
cggcacgaggggagattgaggagaaggctgctgagatatctagggagagggggagattggaggaggaaatggagaaagacgaggtgattcgccggctcgaaagagagattggggagaagtctgctgagatttcaagggagagggaggcccatcagcggctgagacagcagctggagttgaaggataaggatcttcttcttgagcagaataaattcaatcacgcgacgacacaatacaagcatctcaagtctgagcacaactatcttcttggaaagattgcggagatggaaggctccaagattgaccagaatgaaggctccaagattgaccagaatgaaggctccaagattgaccagaatgaaggctccaggattgacctgaatgaaggctccaagtccccctgtgaaccggaaggcctctggaagtcctccaagtaagagaaagctaaaagatttccaggacacgaaaaatgagagcattcaggtagtttctaagactgaagaccaaaagaattctcctagttcacgtgcgaaggcccaaaatgctacctctgccaggagcgtgttaagtaactcgcgcctttgtttaccacctcatgcaactaaccctccg

SEQ ID NO: 14543 - DNA, 301 bp, Triticum aestivum
  Clone ID: PAT_TA_14543
attcggacgaggtgcggttcatctatcgcctgcctgcctaggcgccatatctccctcgctagctagctactacctttatgatcgaggtgcggtcattactgcggcaactgcgctgcgtcgcttggccgccggcactccggccggaggtgcctccggtgttgccatcaccggcggggtgacaagacatgtgttcgaatctgccgtatggagcatgtgcacatggcagtgcggatgatgctttttgtacatgaggattttatgtataaaaattatatggactaatttgattgtagatcactgc

SEQ ID NO: 14544 - DNA, 633 bp, Triticum aestivum
  Clone ID: PAT_TA_14544
gattcggcacgagccggcgagctccttccccctcgagcacggcgcgtcgtcgacagcctccatcctcttcttccctcttccatcagccgagcacaactccggtgagcttgtcgaccagcgagtcctactatctctgatgctactgttgttcaccatcgcgtggttgtagagcgtcaatggcagatcgagtaaaattgtcatggcaggtcaagtaataatggcagcgagaacacagctaccaatggctagaaatgcatggtgagaattgaaaatctgagcgtaagaggattttcgcagcacatgttctgtgttagctggaatctctgggtgaactaacaaaggtttactttgtgaaaattctaaaagtggtggtttggatgagatctgaagttcaagttgttggctagctgaagatccatgaacaggcaaacgcctgtagtgaacacaaggttctcgaggataggcctccgtgctgtgctctaaacttttcattcctcaaacgcacgcctgtagtgaacatcttgttccgctgctgttatactgtatctagatcaagcgttgataactccccctgtccagttctgtattttttctaagtaattttgatgtctgaagttcagctatatgtgcagg

SEQ ID NO: 14545 - DNA, 714 bp, Triticum aestivum
  Clone ID: PAT_TA_14545
acgatcagccttgttcctgagtccagttcagatgtcctcgatcatcacagcaaaggaaagttcagttactcgcggtatcttctactttcacagctgaccggctttgttgtgccattagatgggcgagctgaagaagctggtgggggagggcaagataaagtacgtcggcttgtcggaggcctccgcttccaccataagaagagcccacgccgtccatcccatcaccgccgtgcagctcgagtggtctctctggaccagagactctgaagaggagatcatccctacctgcagggagcttggcatcggcatagtggcatacagtccccttggcaggggattcttcggttcaggagcaaagtccgcagataatttctcagaacgcgatatccgcaagaatctgcctcgtttccaggccgagaacctggagcacaaccagcggatcttcgagagggtgaacgagatggcgacgaggaaaggatgcacgccgtcgcagctcgctctggcctgggttcaccaccagggaccagacgtgtgcccgatcccggggactaccaagatggacaacttcgacagcaacctcgcggcgctcgcactcaggcttacgccggaggagatggctgagctagaatcttacgctgccgcagacgctgtcaaagggttcaggacctacaatgcagctaacacgtggatgagctcggatactcctccgctcga

SEQ ID NO: 14546 - DNA, 1399 bp, Triticum aestivum
  Clone ID: PAT_TA_14546
gtcccatgtctcctcccctcccgctccaccaccctcccctacgcgcccgttcctctgcgcaccattcagaacggcaccatcgcaagcggaaggttcggaacgctcgttgcggacgtcgccgccgtcgccctgcctgtcggagccgagaaggcggcctcgtccgacgaatccccgacaactactaagtctacttctgagagcccacgcaatgccattgtgggctgcgaagcgcagcatctggtttccaccgacttcaccggtgacagcatgcggagcctcttcgacgccctgcccgggattgccctgaacgaccccttcgtcaagcgggcctcttggggaggacatcgagtgggggtggaggcaactgcgtccttcagtcctaaggccgccacaggggcaagccccaggggagggggcaagtaaggtgttctttccgcgccacgtaacgatgcgcccctgttcgttggtggcgtcaacgttgattgttacacctcagaaataaactttcactccaatgctagccactgaaccaactgcctggcgccccttgccatggtcttccatgacagctttggtttcttcaagggtcttatgacaactgttcatgccatcactaccacccataaggctgttgatggaacctaagccaaggactggagaggtggcagggctgctagctttaacatcatccccagcagcactggagctgccaaggctgttggtaaggttcttcctgatttgaatggcaagctcactgtgtatgtccttccgggttcccaccgtggatgtgtcagttgttgaccttactgtcagaatcgagaagggtgcctcctatgaggatatcaagaaagctattaaggctgcttctgagggcccactcaagggtatcatgggctacgtggaggaggatttggtttccacagacttcgttggtgacagcaggtcgagcatcttcgatgccaaggctggtattgccctgaacgacaacttcatcaagcttgtctcgtggtacgacaacgagtggggctacagcaaccgtgttgtcgacctgatccgccacatgttcaagacccagtagagatttttctgctttccatagcatcccaatggccttggtcgctgtccatcccgctgcttgtctatgctgagaataaatgtgaatggtgcctctggacgcccgctccatgctgggtctgaacatgttttgtgtttccatttctgctaccatcctgtaacaaattcactaatatgggacctgagtttagttttttgcttgtgaagaatataaacagtggggttgcaattttgctgtgctggtttggttgcatagatgagctggtctttgggaataatagtttcttgattcgtcaaaaaaaaaaaaaaaaaaaaaaaaaaaaaa

SEQ ID NO: 14547 - DNA, 675 bp, Triticum aestivum
  Clone ID: PAT_TA_14547
accgcgagttcagctacgtaggtatccaatcctgcaatgcacactgctcaatgtgatcgtgaattcgtgatgaggaaattgggtcacactggatatatagaatgtattcaggagaaccatgcattttggcaggtgtgggagcaagtcttgtgttctgagagagcagcaacaattgtggtgaggcaaaagaacatgaagcgatgatgccagaacagcattgcgtgatgaggaaattgggtcacactggatatatagaatgtattcaggagaaccatgcattttggcaggccttatgggatctaactcctgcctgctacctaatctgttctctcagggtgctagaagactggatgcctattgaggtcagatcattttaggatatggagaaatttcagcaacctaagctattcactcaagctcctgacaccaaaaacacctagctgccagcacctgttgaactattagtgtggtgactaatgtcacttgtgagatagggcatgtgagatttccatttgtttaaattatctgagataactttgtgactaagttcacttattgaactataatttggtgttcgtgatgaatgtaataaatatatttgatgaatgacttgtgaacctggttggtttggtcatgaatggaatatatttgttggacaaaaaaaaaaaaaaaaaa

SEQ ID NO: 14548 - DNA, 847 bp, Triticum aestivum
  unsure (1)..(847): unsure at all n locations
  Clone ID: PAT_TA_14548
ctagannccctgtnaancnctaagntgggatggggcctctnatggtcttgatgggacttatggcatgantnctatgntttggaagaactccnnctnccacggggtacaattttgnantcttggggaatttngtnccaaaagggactgctgatttccccaagtccctgccccaaacggctggcctgtgcctaagccatattggtgctatccggtgtggcatgaacggaaggaaggaacagacttgctggaatttcttgaacaagaatttcgctatgactaatgtgaattttattgccatgcctatattgtcaacctgctgaccgagtcgcttgtgaagctgatcatgtgcagcaagcatcagtcgagttgctctgtaaatttgaatccctttactgggcactttcatgtagtatatgttgtgccagctagtcgaggcacttacacaagacctcttgttgctttatgtggtaaaccacatgtaatctataaggtggaaccgtgcatccaattagccaaatcactagttgccggcttctagtaaatcaacatttggtgaaaaaaaattaaatccaaaagaattatcgcgtttgtgcatcatgtgtctttttaaatataaaatgtaaatggggctcgacctgaattgaatcctggtcgcgaggggaagcaaaggcatagctaaccaataagcctgctttcagttaatggttnagtagtaggatcgcgacctactaggggcgatcaggttttctctgttttctttccctttctcagatttttttccatttttttgggtttttctttggttttttttcattccacattcttttatacatgattaacatttttt

SEQ ID NO: 14549 - DNA, 556 bp, Triticum aestivum
  Clone ID: PAT_TA_14549
aagctgaacctccatttgaaaaaagagcaccccaaccactaccaggatggtggcccacgaggcgctgccccttcaaagcgcaacatctcgaagagttcccacaggagcaagccagacgtcaccccaaggatgccaacagccaagatccccaagcacaaaggagggtacgtagcaccgttgccagctgtgaacctccctgaggagcagcagtggccaaggaaagggatgtacgaggttgacagcgaggagaccgaggaagagggggacaacaatgtcgaagatagatggaactacaacagggctgttagcagcgacgacgaggaaaccgaagacgaagaatgagctgctagcagggcattcgttgtactgtagttgtgcaatgtgcatatataccataatttttaaactttgggggggttatagcttttgcatacatgtacaattttaaaataaggctagcttatagtagacaacagaggtagctggcctgccccttcttctttagtagacatgccacgaattgagaaaagataatggatcgttgttccggtaaaaa

SEQ ID NO: 14550 - DNA, 683 bp, Triticum aestivum
  unsure (1)..(683): unsure at all n locations
  Clone ID: PAT_TA_14550
ctgcttattttgatctttgtaataataaaaaaaaataaaaggtcaaaaaaacatatttatcacataacaaaaaactgatgttttttcccagcgccgtttactgtttgctaaaagtagtaaaaaatgaactaaaaacaaacagtgaccatcagaatgctccaaaataaggtgtagggcggcccgtgccattcatactccctctgttcttaattataagacgtttggctntttctaaatatataggttttgctatgcacttgagtacagtaatttggaatggagagactaatttatataagtcagattgcttccttcggaacacaaactaaacttgaaaaacttggatatgcatctgttaagttcagaatgcgcagattagaatagattggatgcagtcttatcttattgtgagcttgatagttttcatgaatgtgaccctataaaaaacgttttcatgcatccttgtacagttgaggttcggatttcatagaagcttttagaattttccattgttaacaatatattttcaccaaggttgtagctacgtggtctatatgaccatgaattttatctgattgatgtggtttcctaagttggtaggtaccattctgccttacctacctatctggttcatgagcttctgtgttttaggagtcataataaaaggatactcagatttggcg

SEQ ID NO: 14551 - DNA, 592 bp, Triticum aestivum
  unsure (1)..(592): unsure at all n locations
  Clone ID: PAT_TA_14551
gagggcgccaccggccccggaaacgctcgttcccggagctcaatgggacgaacagtagtagcaagtcggcagaggccatggtgaaaaacgtgagcaaagagtcgttacagtgggggctcgcggctggggtgcactctggcctgacctacggcctcacggaggtgcgcggggcgcacgactggaggaacagcgccgtggccggcgccatcacgggcgccgcggtcgcgctcacgtcggagcacgcgtcgcacgagcaggtcgtgcagtgcgccatcaccggcgccgcgctctccacggccgccaacgtgctctccggcatactctgagccgcccggaagccgcagccgtgctgtgccggcgctcgattcagaggatcgccgactagtcctgtcccctaaaatcgtttgggggcaccgtcaccctcgcatgtcgcgcattgttatgcttcactaggcccttgtgtacgataacttggngacgttgtattcatgctttgaactgctggtactatcgtgtaattgaacttcagttacaaattatgctctaagcttgctgcttgatttgttgtgtgagaaaaaaaaaaaaaaaaaaa

SEQ ID NO: 14552 - DNA, 751 bp, Triticum aestivum
  Clone ID: PAT_TA_14552
ggagatgataacgaagcaggagcaggcccagctggctgcctcctccatcgatagcattgtcaatggcggtgacggcgggaaaggacctgtaattgctgcatctgtaaatgtggcagttcctcaagttgcgcacgaggctattgttgtgcagcccatgcttgtagctgaaaccagcgaggctgctgctgtaatccccaaggccaaggaaggcccagaccggtgcgcggcctgcaggaagcgtgttgggctgacgggatttagctgccgatgcgggaacatgtactgttcggtgcaccgctactccgacaaacatgactgccagttcgactatcggactgcagctagggacgcgattgccaaggccaatcctgtggtgaaggcggagaagctcgacaagatctgaggcgggcattggggagcgaggtggttgcaatctgcaagaattcatcatgcatctttgctgctttatcattgaacttcccattcttgtctgctgtcacatcctctgaggttcaatactgtgatgcacacagcatcctggcagctgcaagaattcgtccccactcgagtccaaaatggtttgcgtgttggctatgtcgtgtaagcttattcagttattcatggtggtttcggtcggtattgtggcattcccatttaggtagctctgtaatgtactattgtctcatgcatgttaaattccaatcagtaatagtaatcagcaattgtctgccataaaaaaaaaaaaaaaaaa

SEQ ID NO: 14553 - DNA, 484 bp, Triticum aestivum
  Clone ID: PAT_TA_14553
agcgtccaccgcccgtgccctatctcttcgcgccgcaggttccagcggctccacggcacagacctaccgagttttctcccgttttcaaccattcaccgacaaatggcaccagcgaatccaccaaccaccactcccaagagaaggggattccaactttggttacatggagtcaaggaggaaatgaggtgttcctggaaggatcatgggataactggacatcgaggagggcattagagaggtctggcaaagatcacgccatcttgttggttctgccatccggagtttatcattaccggattattgtagatggggagctgagatacatccctgaactacctcatgcaactgatgaaagagggcaagtggccaacctcctcgatgtccatgattacgttccggagagcctcgacagcgtagctgagtttgaggcacccccatctcccgaacacagttatgacctgcaatacccaggtggttgaggaat

SEQ ID NO: 14554 - DNA, 767 bp, Triticum aestivum
  unsure (1)..(767): unsure at all n locations
  Clone ID: PAT_TA_14554
gaggtcgacgcaggggtttcagtcggtcccgtatgtggtggcgctcttcagcgcgatgctgtggatctactacgcgctcctcaagtccgacgagctcctgctcatcaccatcaactctgccggctgcctcatcgaaaccatctacatcgtcatgtacctcgcttacgcgccaaagcaagccaagctgttcacggcgaagatcctcctcctcctgaacgtgggtgtgttcggcctcatcctactcctcacactgctgctggccgggggcgagaagcgcgtcgntcatgcttgggtgggtctgcgtcggcttctccgtcagtgtcttcgtcgcgcccctcagcgtcatccgcctcgtggtgcgtacccggaagcgtggagttcatgcccttctccctctccctctctctcaccgtcagcgccgtcgtctggttcctctacggcctcctcatcaaggacaaatacgtcgctcttccnaaatcctcgggtttgccttcngggtgatcaaaangggctctacgcctccancgcaanccacnccaagccggcgcaaaaggagtggacgcaccctgcntgacacgtatcnagtcctaactcggccggnggtgcatcagctaanagcaagtgcgtcagcacgacaagggaantnttttgtgacngaaacaagnantacgcanaagtnaaggaacattcanattcagcagnnggggaattctacnatgaangtttaggacacgncaattgttccaacttcatagccggaggagntt

SEQ ID NO: 14555 - DNA, 1016 bp, Triticum aestivum
  unsure (1)..(1016): unsure at all n locations
  Clone ID: PAT_TA_14555
cccacgcgtccgcccacgcgtccggggcgcagccagcagccatccctctccctttccttcccctctctctctcgctcgtcttccttgccccctcgcgcaacagcagcgccacaacgcagtgagtggcacttccgtgatttcgccgccgcgggggcggggggaggaggaggaggagggaaggaggccatgggcaacgccagcggcagggaggaggacgccgccgcgcccggggaggccgacgccgccgacgtcgacgtcgaggacggaggcgacgactcctcggcccgcggcttccctccctacggcggaggcgccaaccacgtgcgccgtgcgtgctcggtgggcgtcgtgggggccagcggcgggcccggatcgccgcccgggagccccggccgctccctctcgccgcggatgttcgtgccccagacacctgtacctccattgcaaagacctgctgatgtaactccagtattcaatgaaatactgatgaatgaacaagaagaagaatttgatggcccccctcaaaaggaaatacctgctttgattgtgtggactcttggaggaaagaatgtatctgttgaaggatcttgggataactggaaatcaaggaaaccgatgcagaaatctggaaaagatcattctcttctgttgatccttccttctggagtttatcgttatagatttgttgtagatggagagaggagatgttttcctgaccttccatgtgaaactgacgccatgggcaatgctgttaaccttcttgatgttcatgattttgttcctgaaagtgttgaaagtgtatcagaatttgaggctcctccatccccagaatctagctacagtttccaggcacctgaggaaaaggactttgcgaatgagccacctgctcttccgtctcagcttcacctcggcgttcttaactcacagaactcggaggaaatatgtgcacggccccaacacatcgtcctcaaccacctttccaanttcagncatattaangncnctttaaccataag

SEQ ID NO: 14556 - DNA, 960 bp, Triticum aestivum
  Clone ID: PAT_TA_14556
cgcccggggggccgccatggtggcgtccgatctggagagcaaggccaaggaggccttcgtccacaactacttccagctggccggctagctctacacccaggccatctgcgcggggccctgcaccggcgacctctacgccgaccgcgcccaggcgcacatcaagctcggcagctacactgaggctggggcggatgctaacaaggcaattgaacttgatcctacgatgcataaagcctactaccgggaaggtgctgcatgcattaagcttgaagaataccaaactgcagaggctgctcttgagttgggttcttcctatgcatcaggcgattcaaggtttactcgtctattgaaagaatgtgaagagcgcattgctgaggaatctagccaggctccagcaaagaatgttgagcctcctgtggctgctgctgctgctactgttgaggacaaggaggatgtcgcaaatatggagaatacaccgccagtggtagaacccccaagcaaacctaaatacaggcatgactactacaacagtgccacagaagtggttttgacaatatttgctaagggtgttcccgctgatagtgtagtcattgattttggtgaacagatgttaagtgtgtccattgaagtccctggtgaagaaccataccattttcagccccgtctgtttgctaagattatccctgagaaatgcaaatatcaagtcttgtccaccaaggtcgaaatacgccttgcaaaagctgagcaggtgacatggacaaccctggattataggggaagaccaaaggctgttccccaaaagataagcacgccagctgaaacagccccaagaccttcatacccatcttcaaaggcaaaaaaagactgggataaactggaagctgaagtcaaaaaggaggagaaggaagaaaaacttgatggtgatgctgcattgaacaaattcttccgtgacatctacaa

SEQ ID NO: 14557 - DNA, 655 bp, Triticum aestivum
  Clone ID: PAT_TA_14557
cggcacgaggaacgttacaagcaagtctttgctatagctgaagttttgctgaagttttcctcgtacttgcttgaccgtctctgaaatctgaggcttgttttcatagcgtccaatggatcctagctactgtcgcagatcaaagagtgaggatgagtttgctctttttgttcttcctactttaggagaacactcatattcctcaaggagacctatgcacacttcaatactcacaggcgcacggcgtgtaaatgaaattttaaatggacatgaagacctatgcaaaaggcacttcagaatggagactgttatatttcaagctttggttcagaaattgcgcgagaatgatcgccttgttgatggaagagatgtctcagtagaagaacaagtggctatatttttgtatgcattatctaagaatgcaacaaatgatactttgggcagattggtttcagcatagtggacaaacaatcagttactatttttggtgaagtgctcagtgcaattaccgaactctattctgtatacatacgtccaccttccctacacccgcatccaatcttgagtaaagaaaagttctaccctttctttatggattgcatcgacgctatagatggtacacatattccattgaaactacctgctgatgagcaagaac

SEQ ID NO: 14558 - DNA, 509 bp, Triticum aestivum
  Clone ID: PAT_TA_14558
gtgtggggcgcttagctgcagcactcctgcgttgtcaccccctctactgcgtggtttcatgtatgtatctaggcaccgaagaatgcgcttctctacccggagcttcttgttcctcttggcgaagtggattcttgctgttcttggctttgctctctgactctgtttgtagtcttgataatttggaggtctacaggcaccgttttatttagtttcttttatttgatttactccgtatatttaattatacgttttatttacatgtaagaaggacgttgaccttgaccagcttccctccaagtttatctttgttcattcattctttcttggtgccttgggtcacctgcctctcccaatgaactcagtttacatattcacttgcgtcatttgaaaaggttcctttttagaaagcaaaggagttttaccgtttgaaaatcgttcattttttatgtactttgccccttctcgttcttccattcatcagtgtttatgtaaatcaattagcaaaaata

SEQ ID NO: 14559 - DNA, 885 bp, Triticum aestivum
  Clone ID: PAT_TA_14559
gaattcggcacgagcaaagcttcaacaagctgtcaacgaaaacatgaagcttaaggtaaagcagactgaggattcgaagctctggcaggggctagattcaaaagtttcctcaacaaagatgctgtgcgatcagttaactgaaactctgcagcagttagcaagtcaggcagaaagagctgaggaagataagaagtttttcgaggggatgcttgggaagaactctaaagctttagatgaattgaactgcttgctgcatgattcctcggcaaagctggaatgtgcagaacaaagcatcatgtcaggtaaacaggagattttgcggatcaaacaagagaaagaagaaatggatcagagttacaaggaacagctttacgcaaatgatactaccataaaggaaaaagattctctcatcaaacagttggagggttcagttgaagaaaataaatcccgcttattgtgtgctgactcccgcttgcagtgcatggagcaagagttaaagctaaagcaagatgtttgcatttgcctgaaagaaaaccttgcatctgctgaaaaagaaaagaatgacttggagcttaggaaccagagatacagtctggaagtcgaaagactgtacaaggacaataaggatgctaatgaattgcttagcagttttgtggctaaggtagctgagctagataaagagcatgcatcaatgtcaagtcatgtcgctagattgctttcttcatttgataagtactatggaatggtccaagaggagaaactgctgataacaagatctgctaaggacaaactggaacatcttcaaaaccagtttgtagatttgacatcagaaaaatagtggtctcaacagtgaaattggagaactgaagtccagaatcacagagt

SEQ ID NO: 14560 - DNA, 610 bp, Triticum aestivum
  Clone ID: PAT_TA_14560
gattcggacgaggcttactttatgtcactttacctgcatgcatccaacagctctccggattgcagaccttgacccttttaaactgtggaccagtgcttgagaagagatgcaaatctggagaggataagaacaagttggcacatattccaaatgtgactatattatagcggatgaaaataatggaaagtatcaactgtagtatagactgagataactccccaccatcatcggcgtccatggatgcttaatattcgaatccggaccttgagttgagtcggagggatgccatgggcttcattcctgctcagttactccaagccggtgagcggtgaggaccctctcatttctttccccctgttcacggtgaattgaaatgttcagttgataagagctgaacgcttatattgaataaagatcccatatagagtatatataattcgctgtagatatcctttctttgtgctcatgtttgctcctcctgttgttaatgagttgcaagtgtaggtttgtttgcatccaatcatgaatcttggccctcctgtcctatatatgattatttacctgttcacaatagtgcttgtaagtgtctctcatcactcatggttgatga

SEQ ID NO: 14561 - DNA, 578 bp, Triticum aestivum
  unsure (1)..(578): unsure at all n locations
  Clone ID: PAT_TA_14561
gattcggacgaggatgatctaaacttatcatggaaccaattgagtggaaaaattccagataggattggagctatggaatcacttgaatcgctcgacctctcaaggaacaacctttctggtgaaatcccaacaagcttgacagatttgacttatttaagctccttggacctgtcatataacaatctcacaggaagaattccaccgggacgccaacttgacaccctctacttggagaaccagtccatatacacgggcaatgttggtctgtgtggccctcctcttgaaaggaattgctcacgaaacaatgcaccagagcatgacaatcaacagaaaatcaagaaggtttctgagcctgtgttgttcttttacctttgggacttggggtcgggggttggtgctgggcctctgggtcgtgttttgtaccctactgttcaaaaaagtgtggagacttgcctatttccgcctcttccacaagttgtatgacaagggcatgtattccnggtgttacctgggggcaagataaaacacaaggagacaaaantngaatgcggtgctcaataaataatgcaanctnggng

SEQ ID NO: 14562 - DNA, 1248 bp, Triticum aestivum
  unsure (1)..(1248): unsure at all n locations
  Clone ID: PAT_TA_14562
gcccgccgtctttctctccgtactccccacccgtggcgcacttcccgaccgctgtcaaagagttcaagtggaggaacggttggttctactcgctcaccgagaaggccctcccgcagcggaagcgtgaaccgcgcccccgccggcggtggtggtgggcggcggccgggtgggtcaggcgctgcgctccatgggcccctgctcccgacgggacctactgctccgccgcggcgaggcgctcccgcccgccgcgccggccggacccatcctggtctgcacccgcaacgacgacctcgacggcgtgctcgacgccacacccaaatcccggtggcccgacctggtcttcttccagaacgggatgctggaaccgtgactggagagcaagggcctggccggcgccaaccaggtgctcgcctacttcgccgtctccaagctcggcgagccccccgtcgacggcatcaccgacgccaacccggaggggctcaccgccgccttgggcaactgggcacccgccgtcgccgcgcgcctccagaacggcggcctcacctgcaaggtgcttgacaaggacgccttcgagaagcaaatgctggagaagctcatctggatttcagccttcatgctcgtcggagctcgccatccaggggccactgtgggtgctgttgaaaaggaataccgatccgaggtatccagcctcatcgctgaattagcttctgccgctgctgcagagcgggggcttactttcgacgagggcatggaagagaggctctgcgcctactccagagccgtggcgcacttcccgaccgctgtcaaagagttcaagtggcggaacggttggttctactcgctcaccgagaaggccctcgcggaagggaagcctgatccatgcccgctccacacagcttggctcaaggagattaaggtcatatagacaaggatttttgtttcatgtgcaaacaacacgatgcggtctcgggttaaatcttgaagcagtattttaagtgtttaaccgttgatgttgtgtatagactatagagtatagagaactctctgcgcatatattcctccatgtatgcccatcgaaaataaccttatgtatgtatgggaaacacaagtgctgtgtaatttatattattggcagcaatcttttggngaaacaaaaaaaaaggggggccgtaccaatcncctanatgatcnatacccgtnangcctcgtttaantctacngaaaccnggtaccaataaccctgaanac

SEQ ID NO: 14563 - DNA, 579 bp, Triticum aestivum
  unsure (1)..(579): unsure at all n locations
  Clone ID: PAT_TA_14563
gattcggacgagggctgcccctgcccctgcttctgccgcgggcacgcagcgcgtcggcggcaagctgacggggctggcgccgtacctggccgtcgtctccttcgtcgccctcctctgctacctcgtcctcaccacgtatgcgccgctcgagagcgggcccgacggcgccaactccaagtacccatgaccaagctctccttgattgatgtctgcgtcgtgcgcatgcgcgccggcgccggaagaggaaggtggctctggctgtcgaatgtcgatgttcctgcgccggcgctgttcacngtggtgtggtggccactggtgagtgctgacgtaccggtacaggtaccgcgtccgcgtaccactactgcaactgcaagtcttcagaagtagtaccttgttaatagtatgttacgatactactatggaagtgtgatgtagctcatccaaaaattgcaatttgctggtcgcgtttgtgtgtacggtgcacctgcgctgcaggtcctcggatctcggtagttactacgtactagtagtacaaaatacttctagagtacagatacagactgacagatgtatactagt

SEQ ID NO: 14564 - DNA, 749 bp, Triticum aestivum
  Clone ID: PAT_TA_14564
cacgaggtgctgctgggaggaacacgccgttctctgagaggcgggtggcagagataacctcaaatgtccttcctgggatttcatcaattgtagaaggtgtgaaagtgcataggaaattctatacagaggaacaggaggtctcttctggcgttttagcgatagcagtttcctagccatcatctcaaccttgcagaaccatgactgatctccttgctggattgggctatgatggattgggttgactcctgggtttggcccaaacggctggaacggttccagatggactacctcctccaagatcggcactgtgatcttcttgtatgagactacgccaaccaattcctgttctttaactgatgctgcaagggcattgtccaatcatcttcacaggagtaggaatggttggtggggcagctttaatgggagtgattcgagcaagctccttgttgcagctgaaacagctggctctgtgtcgggtggattatcttctccgagtgctccactgtcaccaccttatcgtccaccttttgaaatcccccttcaacctgattctggcgccggatggtctcatggtggttcaaaggtttaactatgagtttcctatttcttgcattatccatacatctccaccccaatgggaatgggtggcgggcctccttccctggggctgtttcgggcaagtcccttggtccttcgggtaccgttgactctttgttgcgtgaatgttgttggatgaatgttcatctgac

SEQ ID NO: 14565 - DNA, 903 bp, Triticum aestivum
  unsure (1)..(903): unsure at all n locations
  Clone ID: PAT_TA_14565
gattcggacgagcaacccccgcacttccctttcgccatcgtcgactccatgcatggcgctcgcagcagcaacccttgcctcctctccgtgcgtatctatctccgtttccgccgctgggatgaacagcagcggcctgtcagtgtcgttgggggcgcgccgtgtgccggggatttctgtgcaaattcattcccagcggaggaggatggtcgcagcggcggcagcggcgagaggggacgaaggggccggtaagaccttcgtggaggagatgagggctgcggcgatgcggatgcacaccaaggaccaggccagcgaaggggagaaggagcttgagggaccgtcactgaacgagctggagcctaaccttgaggcctacctgcgcttcctcgtcgacagcaagctcatcttccagacgctcgagaacatcgtcgaccgcgccgccgtccncatggtatgcggagtttcagaatactggggttagagagatcagaggcactgaagaaagatctgaaatggttcagcgaacagggtcacacaattccagaaccatctgcttcagacactaaatatgcttcttatctggaagagttgtctgagaaggaccagcaagcatttttctgtcacttctataatatgtactttggtcaatctgctggaggtcgactgaccggcaaaaaggtaccacttttcagcacaaaaccttataccaaaacgttcatgtgatgtaaaatagtgtgtgtgtttgaatggcttcccatgttgttgttaacaatgtgttgttggcactggttcttctcaatcttcttgttttgctgattcaaattccaaaagaagatagtatgcatgctattactttatgcactccgttgagggtcactttatatacggatctgtttcataaaaaaa

SEQ ID NO: 14566 - DNA, 731 bp, Triticum aestivum
  Clone ID: PAT_TA_14566
gaggagtttcaaaggttctgttgcttctctcagcgtatcttgaccacaaggttcaggagaatgaagagttattagattccagtaaaacaaaggcggcacgaggtatctttcatggtcagagggtgcctgaacttagtataaagctctatgcagaacgcattttcaagtatgcaaagtgcagcccatcttgctttgtgctgggacttatctacattgagagatatctacagcaaccaaacatttacatgacgtcatttagtgtccatcgcttgcttattgcaagtgttgttgttgctgccaaattcatagatgatgcttttttcaacaatgcatactacgggagagttggaggaattaccacgagagagatgaatatgcttgaactggatttgttgttcagtctggacttcaggctcaaagtggatatagagacttttggaagctactgcttgcagttggagaaggaagctctggttcttgttttggagagaccaattcaggtccaagcagccaacgtgactaaacacctgatttgtaacagcagtgccgatgagacttgcaaacacgagctcgtgcgggaaaggtacagcagtcaggctgtccatggttgtagctggtaaatctgatttgacagaatagttttgaaaaagtgtgtgggaccaaggactgataattcttttatttgacatttaagaagttcaattgttctggttaaaaaaaaaaaaaaaaaa

SEQ ID NO: 14567 - DNA, 907 bp, Triticum aestivum
  Clone ID: PAT_TA_14567
attcggacgagggtgataacagctgcttcccctggccgaccgttttgggtttcctcatcctcagcttcaacgcggcaatggccatcatccgatcccaaggcgatgtgatggccatcgccttcgtcggttttgcctatgccatcctcgtcgcgctttttgtctgcctgaggatgtacgagcgtgcccgtgctgggtcgtccaagagggagtggctcaagatcgctgtatggatactgactactctgctgacgttcagcttctcctacaaagttgccgccatcatgccagcgcccatggccgtggtcgtttggctgatggcctttgcgaccgttgcaggaggcttcgtcgcgttctttgtctacaaagagaagtgatcatcggcttctcggtctctgaattaataaggcaattcaattgtcattgaggcggaatttctctatggcgaatcatcgactctttatccgactgtcttggaagaaattgctttgtagcaaatcatcaattctttatccgagccgtctttttgtgtgtagtcgattgtatgaacaatttatgccattgcagagccaaaaagcggaaacatcaggtttttgaacagtcagaacaagccttcttttgtaataatgtgttcagctctaaagactgagttagaactatgttagatccaaatcctattatttgtgtcaagtattgtgtcttgtatttatgaagtctgttacctatctagatgagaaccttgccagctcttcagatggggctgactgcgagttaaaatttctggcgcgcgtgaactttagtagcttccaatgtgttatatgttcctagagattgtaatagagcggttcatggattagctgctagtgggtatgaatgtgtgggcaggctcgagcaattataagctcccccc

SEQ ID NO: 14568 - DNA, 514 bp, Triticum aestivum
  unsure (1)..(514): unsure at all n locations
  Clone ID: PAT_TA_14568
attcggacgaggctcggtttcgcgtctacgcggcaaaggcggagacggtgagcaaggtgatggacatcgtgaagcagcagctggcgctggcggcggacgtggggctgacggcggagtccaagttcgcggacctgggcgccgactcgctggacacggtggagatcgtcatggcgctggaggaggagttcaagatcaccgtcgaggaggacaacgcccagagcatcaccaccatccaggaggccgccgacctcatcgacaagctcgtcgaccagaacccagcggcggcggcgccgccggcatgatgagacgagacaacatcgaaacctctatacatgagcattattggttgatcgatctctagctagagacaatctggacggatggaagagctgatcgttgccaggattttttttgtttcatctgtattccagcattagctagncgtcgttgatgttcgacgacagacattatagccagctctcctttcaatttccgcactttttagctgtgtgtg

SEQ ID NO: 14569 - DNA, 636 bp, Triticum aestivum
  Clone ID: PAT_TA_14569
tgtttgaatgacaataattctgagagagcttccaaagatatggacctagtccacattatggataatcagcagaagcataacacacagagggaggtggatactatgagaacaacatctaggggaaatgatgagaagggctccatcccagcacaccagttggaactttctcttagaagaactgactacggaaaattggagaaccacgataaaaatgatagaagaacactgaaccattcaacttcatctgcattttccttgtataattgcagggctgtgtccacctcaggaaatgctggtgatggtcaattatgcagcacctcagaaacactaatggatgttgaaaataaaaatggagattcggcagctccctctcaagacatgactgaaacaaatcgtcctcctattagagttgtaccatttcctgtccctgttcaaggtctcacatttgatgggcagccattctggaatggtacaccgatggcatccctattctacccacagtcagctcctcccatttggaatagcaaaacatccatgtggcaagaatcaactcaagcaacttcactgccacaaaaatcgcaacagaatgagccaaatgaaatgggtgctaaaccagttgagaatgcagaggaacaa

SEQ ID NO: 14570 - DNA, 392 bp, Triticum aestivum
  Clone ID: PAT_TA_14570
attcggcacgaggtttgcctgatttacttgacagagtgaaagatgaagggaaggccaaaattcacctgcaacaattttagcagaaaagttatcgtgtggccggttagagatataataagggtgagagctaggaacacattaaaagctaagtcaggctaaatgaatggcaaatcgacaaatttgttactggagcagcggcccaccccgtgtaacgcttacttatatgcaatcgaagcctagacgagactgatgagaaaccaaaggcatcgttgtctgccgccaacacactcccttttgcctacgatgtcctcctcctctatgtgcaacggatgatggttctggttgtgtactcaataaggtgagttcgctgttgcttgatttaaaactgggac

SEQ ID NO: 14571 - DNA, 784 bp, Triticum aestivum
  Clone ID: PAT_TA_14571
attcggacgaggcggatccgtcctgcaaaatctcctcccccaacttctccgccggatccctgaaagattcccggagatgtcggactccgaggagcaccacttcgagtccaaggccgacgccggcgcctccaagacgtacccgcagcaggccggcaccatccgcaagaacggctacatcgtcatcaagaaccgtccctgcaaggttgttgaggtctccacttccaagactgggaagcatggccatgccaagtgccactttgttggaattgacattttcactggaaagaagcttgaggatattgttccttcttctcacaactgtgacgttccacatgttaaccgtgttgagtatcagctgattgacatttctgaagatggatttgtcagccttttgactgagagtggcaacactaaggatgacaccaagcttcccagtgatgaagctctgcaagcccagatcaagagtggatatgatgaaggaaaggacatcctcctgaccgtgatgtctgccatgggcgaggaacagatctgtgctgtcaaggagattgggggcaagaactaaagctgctgcttcgctccggctgtttgtgggcaatacctgttgtcttgtgcttggagttgagaagccaagttgagatacatacataggcgtttaagttatctgtggttttgggtttacctggaatgtgttgagatggtgcgagtacttgtggtacttggttattgatctctggtatctttttgaactgagtaatggtgtaactctggtagtgcatcaatggga

SEQ ID NO: 14572 - DNA, 939 bp, Triticum aestivum
  Clone ID: PAT_TA_14572
ctttcctcctctggctcaccggcggcgaccactgctccgtactcagcggcctcgcgttcgagatcggtccattcaagttcgtcgtagagccttacaatggcaccataccgagcctggaaatcaatcccaactcatggaccaaggttgcgcatatcctcttcgttgattcgccggccggggcaggattttccttttccaaacaacccaaaggctaccatgttggggaaatatctacctcactgcagttacatgagttcctcatcaagtggcttacggaccatcccaagtttctctcaagtcctttctctacccgcggggactcccctcatctcgcaaacattctactccccgcccaacagaccactgccctagggaactggacgagcccctgcccactctcctcgccatagagggggaatcgtatgctggaaagatcacaacagtcagcgtccacaacctcccccaggctatggaccaaggttcccgtacccgactgcatctcaagggccatcttctaggtaacccggcaacaggtgaaaggatcgacgaaagctccaaagtgccttttgcccacggattcggtataatatcagatcaattatatgagaccatattggggcattgccaagggcaagactacaagaatcctacaaacgtgctgtgtgcaaaagctctgggtactttccatagtctcctctctgaagttatgtcgccgcatattttgttgatcaaatgcgtttattcatctgctggaccgcatgcggagatggacgattcggctggtgctgacaggaagatcttaagcgaggaagcagctggaatcaaaatggggaaacggctggagcatccgccagttcgtcctccacttgactgtgttgactacgcccactacctgtcgtatttctgggcgaacgacgagcgcacccgagatgccctcgg

SEQ ID NO: 14573 - DNA, 561 bp, Triticum aestivum
  Clone ID: PAT_TA_14573
cggcacggggtccgacccgtcccggggacggtccgtggtgcgtgccctggagctcgcctaggcggcctgcctcggctagcataccatgttcgcgtgtccagggccgccaagccgccgccccgcgggcgctaggcggtgcccgaccgcctcaccgacgcgcttctggctcggtaccgccgccccccagccggcgcagcgcggcgctcggcatggacagcgcgcccgaacaccgccgctgcgcccgtcgccgagcctgagctgccgagctgtccgctcccaggtgcattcaccatcgccgccgcccgccccgcgcccccgcggcgttcggtgcccctcccggtcgtttccgtgcagggcgcccgtctcccgcccgagcgggcggtcgcgatcgccccccgggccccctggcccggtcccccacgtgatcccagtgcggctcctgggcgtctccctgcctgcctctgtaatttattttacagagagcgttggctatatcatgtccccaagggccctgacctcatgttgataccatttgagagcatctcctctcgctgtgtcgtc

SEQ ID NO: 14574 - DNA, 978 bp, Triticum aestivum
  Clone ID: PAT_TA_14574
gagggagagagggaagggaccgggagagggacgaatggcgagctctcagtgctgcgataacccgccggccctgaacccggcctgcggggagggcaaggtcgtcgacagcttcggcgggctcaaggcctacgtcgccggccccgaggactccaaggccgccgtcgtcctcgtcgccgacgtcttcggattcgaagcgccgattctgaggaagatagccgacaaggttgcttcgtcacggtactttgttgtggtaccagatttctttcatggggatccttatgtacctgagaatgggaagcccatccctgagtggctaaagtcacatactccggaaaaagggtttgaagaggcaaaaccagttattgcgactctaaaggagaagggagtgtctgctgttggagctgcagggtattgctggggtgcaaaggttgttgtggagttggcaaaagctcatgagatccaagctgctgtactgttgcacccttcttttgttaccattgacgatatcaaagaggtcaaatgcccaatttctatactcggagctgagattgacaaaatgtccccaccagagttagtcaagcaattcgagcaggtcctttctgtgaactcaggggttggtcactttgtcaagatcttccctggtgtggcgcatggatggagcgtgagatacagccacgacgacgcagctgccgtgaagagtgctgaggaagcctttgcggacatgctcgactggttcaataagaacctgaaatgaactctgcaattgcatcctgccttgtaataatgcatattccaatgtcctgagatcgaatctgctgtgttagggcttgcgtggtcaggccattcagagttctcatggtcttagggttgtattagtagattggttgtgctaaatccataataaaacgaggtaaactattttagagaggattaaggcttttccccgtttgttattaagaaaaaaaaaaaaaaaaaaaa

SEQ ID NO: 14575 - DNA, 849 bp, Triticum aestivum
  unsure (1)..(849): unsure at all n locations
  Clone ID: PAT_TA_14575
gagggtgacactaaaaaaatctggtgtcgtgttggatttggtgccgccactaacaaaggttaacaacctgatatttggacgcacttgggttgatactcctggagagatggtcatgacaaacctgacaactggagacaaagttgtgctatatttccagccatgcggctggtttggggctggccgtatgaggggatgggtatgtgtacagtgcagcggaagaacccaaaataatgattacagggaaatggaacaaatctctgagttaccaaccatgtgaccaagaaggcgaccctcttccaggcacggagctgaaggagatctggagagtcgcccctgccccacagggcgacgggtatcagtacacacactttgcgcacaaaataaacagcttcggcacggcacctaagaagctgttggcatctgattcccggctgaggcccgatagatatgccctcgagaagggcgacatgtccaagtctggcccagagaagagcaggctgggaggagcagcagagacccgagaaaagaactccaagaggccaagggcgagcaattcactccgcgatggttcaacatgacggngcngcccctccacccgtggggtgacctggatttgtgantacagcggcagtacacnganaccgggtccatagacantccaacanaccgacgacacacaaataactcatncgtcgattcgaccatggatatgtggtaccctcattcccaatgatctccgtcngaactcgtgcttctctgntaaaaaaatctcagcggctgcctcctgnttnttgacacgttcgtcctgatatatataccgccctcttcctataccaaattatcagaggg

SEQ ID NO: 14576 - DNA, 692 bp, Triticum aestivum
  unsure (1)..(692): unsure at all n locations
  Clone ID: PAT_TA_14576
attcggacgagggcccggcgagccggactgcccgatgagcgactcctcctccttgtcgactgtaagcatcaccactcctccttcagaaaacaaaagaagcatcaccgctccggcaggtgacccctccgatggctccgccgcaccgccggccgattcagagaccggccagaagcagccggagccggagtacccgctgcggcccggcaagagcgactgctcctactacgtcaagttcggaagctgccggtacgggatgaattgctggttcaatcatcctctctacatgcgtggtggccgtgggcttcagcgggataattgggttggaaggaacagcagccgagcatctaactcatccgagtacaaccagtatattttcgacaaagcatgcacctacaaccgccatgaaggaaaaaccaaagtcaagcaagtgaagctgaatttccttgggcttccaacttcgtccaggtacaataccatgttcgtactatatgaatccgcggaacctgcaaatttggcaccaagctgtaagtttcaccatccagatccagtatcaagaagacgcgatttggaatgcttcgcagcatactactcaaggatcatatcaaatgaactttcaacaaagcattccaacgagcactgaaggggcattcngntcccttaagtacacaccaactattggacatccgaaatat

SEQ ID NO: 14577 - DNA, 1080 bp, Triticum aestivum
  Clone ID: PAT_TA_14577
cccgccggcctccgcgcagcactcggtgaacgccgcgctcggtcagttcgagcactgcttcgtcgaccgcggctgtgctgtcaacacccacctcttctccatgattaacgacatggatcgaattcttgaggtaataaagcaagcagcaaaggaaggggcactggttctatatacccttgctgatccttcaatggctgagtcagctaagaacgcctgcgatttctggggtgttccatccactgatgtcctccggcctactgttgaagccattgcttctcatatgggtgttgctccatctggaattccacgaagctctcctagtcgaccgtgtcagctaacagaggattactttcgacggattgatgccatcgatgtggccgtcggccaggacgacgacgacgacgtgtgcgaggccgagagggacgatgcggccgggaaggccatctacatagtgtccgacgggaccgggtggaccgcggagcactcggtgaacgccgcgctcggacagttcgagaactgcatcgccgaccgtggctgcgctgtcaacacccacctcatccccttgatcgacagcatggatcaacttcttgacgtaataaagcaagcagcaaaggaaggggcactggttctatatacccttgctgatccttcaatggcagaggcagctaagaaggcctgtgatttctggggtgttccgtccactgatgttcttcggcctacagttgaagccattgcttctcatattggtgttgctccatctggaattccacgaagctctcctagtcgaaagggtcagctaacagaggattactttcaacggattgatgctattgattttaccatcaaacaggatgatggggctcagccacaaaacctcaaacgtgcagacattgtacttgccggtgtttcacgtacagggaagacaccattgtcaatgtatctagctcaaaagggatacaaggtagcgaatgtgccaattgtgatgggagtgaaacttccaaagtccctttttgagattaaccaggacaagatttttggattgacaataaacccagtggttcttcaagcaattagaaagac

SEQ ID NO: 14578 - DNA, 600 bp, Triticum aestivum
  Clone ID: PAT_TA_14578
gattcggcacgaggctgatatagttaatgctctaatggagaataggaactgtatcacattagatgtttgcgcttctctcttatgtcttactgccagtcttcttgaaagcacatatgacaggcatatgagcattgccttggggatgattctcagtctcgtcgagagctttggttccaccatttcttcagctttgtcggctacaccacctgttggggtagaccttgaggcagagcagaggttggagcggtgcaatctatgtttccaagaactgaagaatgtgagcaccagcctcaagtttctgacaaggcggcaaggcgaggttgggagatcagctcaggagctcaacctttttcttcaggatatctttcaattgtcatcaagcgtgtaaacagtgaccatagcacaacctgcaaaatattcacgcactccatttcctttggtcataacagatatagcatcataggatttacagctagaaagaaagaaatatatagaaatagaaattacatacatgtgtacaaaatcaagggtcaattaaatactatatagagtggcttacagggatttttttctccatttttaaggtatatagagaattca

SEQ ID NO: 14579 - DNA, 596 bp, Triticum aestivum
  Clone ID: PAT_TA_14579
gaggactgggccgactcctacacgctcttcgtcttcaacatggcgctcatgggcttcgccgagcaccgccgcctccaggactggtacaacccgggctccatgggcaagcagtacttcctcggcctcgagaagttcctcgccggctccggcgacccgtcctaccccggcggcccactcttcaacccgctcggcttcggcaagaccgagaaggagatgaatgagctcaagctcaaggagatcaagaacggcaggctcgccatgctcgccatcctcggctacttcatccaggggctcgtcaccggcgtcggcccgttccagaacctgctcgaccacctctccgaccccgtcaacaacaacgtgctcaccagcctcaagttccactagaacgtccgttggttgctgcatcatacctgttgttcatatgctctggcttggctgatgcatggaaaggagcctgaagcgttgcatcaggactcatggccagcctgctgctgcttgtaacaaattagtattgatcttgttgagaccacaaactatattgcacatggtaaatcaatgtacaattccctccctagacactgaaaaattgatcttaa

SEQ ID NO: 14580 - DNA, 1976 bp, Triticum aestivum
  unsure (1)..(1976): unsure at all n locations
  Clone ID: PAT_TA_14580
gcattaggcccccgccccctactaacggcaagatcagttcagacacttatgggccgccagatattctcgtccgctcagtcttccggaccaccgcctgcgctcgctcgccgctgcttagtggagtagtataatcagtacagataattattggcagccagatattttcgtccgctcagttcagttcactacccgcggtggccgcgagaacccggatcgccgatcgacagatggacgcggccatatccgccgcccacgaagcgccgcccgctgtcgtcctcgtctccgccggcgccagccactccgtcgccctcctcgcgggcaatgtgctgtgcacgtggggcaggggagaggacgggcagctcggccacggggacgccgaggaccggctcgtgccgacggtgatcagcggcttcgacgcgccggggatcacgtcctgccaccgccgggtccggaccacaccagcggctactcggcaggacgaggatcacggactacaagctgggggtgggggtatctgccgcgcacgaaccggggccagtggtcttcctcgtctcggccgtcgccagacagtccatcgccctccttgcaggccatgtggagtgcacgtcgggcacaagcgactaggctttgcgaggagactggggtgtcgacgatcgccttgggccccgcgaatgcacccgcattgaggggggatggataacgcccggcatgggtctggggtactacccgaagatttgctcctcggacgaggagatgccagcttgttgggggatagttctgttaagaggatggcgggaagcgctgtaacgtggaagggcggtggctccatactggcgaaatctacggatggggctgtgggtcgatataggaaacttgggtctatggtgatccggaatgaccgactttgttcctgaaaaagtttcttcattggagggaaagaagatggtgcttgttgcatgcggatggcgccataccattactgtttcctcctctggtagtttgtacacttacggttggagcaaatatggtcagcttggtcatggcgattttgaagatcatctagttccacataaagtggaagccttaaatggatagctctacatcccagaaatcaggtggatggaggcatacaatggcacttacatcagatggaaagctttatggatggggatggaacaagtttgggcaagttggagctggcgataatgccgatcactgttcccccgcacaggttaattttcccgaggaacagaaagttgcccaagttgcttgtggatggaggcacactcttgctttcacagaaaagaaaaatgtgtttgcatggggaaggggtactagtggacaactcggtcatggggaaatagttgacaggaacacgcctgtgatgattgatgccctaagcccggacggtcctggctgcaagaagttggagtcttcagcagctattccctttgcagctaaaatttgggtgtcaccctctgaaagatatgctcttgttcctgatgagaaggttgccaaaccaggcgatgtcagcgcacgtggcaatggtgcggatgcgagtgtgcccgagaacgatgtaaagaggatgcgcgtgtcatcctagttcgatgacatatcatctatgtacctcattaaccctagcactactatcaaaaacccttgcgcgtcgttcaccagtttccacctagtggtgtccagttcttgtgcattccgttctgccgaagtactttccagaagaggaacctcctcctggcgttgagatgatgtatcagcacctatgggctgtggtgtataattcacctcttagaggtggctagtagaatcaacctggacctgtgttctgaatgtttcggtagctgcatccgacactttgtttggacggcacaatcaataagctattcgttcttatccctaaatttcatagctcaatctgcactaaattgtgcttttttngaaaatatactaacgacaatttc

SEQ ID NO: 14581 - DNA, 397 bp, Triticum aestivum
  Clone ID: PAT_TA_14581
gatccgcacgaggcatggaggctgttgcattagagaacttccgcgcaagagcattttcattgctgtcgatcgctggactatctgggttttgccagctgagcattccactgggcgtgcgcggtggtgttccggtgtcagtctccctagtggcatgccatggtgcagaccggttcctcctgagtggggctcaggagctgtatgagactctcaaagaggagaccaagaaaggctggagctcaccagactcctctctctgagccatcaatcatttgcaaagttcaggtttcatcggttctcaatcgccctgtgtcctgcacaactgcttgtggatctagtagatattgtttgtggttcaggcgtactggatccgtgtgaagagaaaatatgtttttgccac

SEQ ID NO: 14582 - DNA, 697 bp, Triticum aestivum
  Clone ID: PAT_TA_14582
aagccacccggttctagccaagatgatgatcagtggcgtcgtctactcccttggtgactggattgcacagtgctacgaaggcaagccaatctttgatttcgaccgtgctcggatgttccggtctggccttgttgggttcacgcttcatgggtcactttcacattactactaccatatctgtgaggcgcggttcccattcaaggactggtgggttgtccctgcaaaggttgcattcgatcagaccatctggtctgcaatctggaacagtatctacttcgggggcttggggttccttcgggtggaatcacctaccactatctacggcgagctcaagtccacattctggcccatgcttaccgctggatggaagttgtggccttttgcgcacttagttacatatggtgtggttcctgttgagcaaagacttctatgggtcgactgtgtggaacttgtctgggtcacaatattgtcgacttactcaaacgaaaagtcagaggcaaggaattctgacagtacctccacaccagctgcttcatcaaaggacaactcacgatagcagccccatagaccttggaaagctgcttggcccttcaggggttatgtaaattgtacaattagctgcagcaactctgcaggtgtaaccctttttttttgtagatatatattcatgaaacatgaattgtgcagcatgtgtcaa

SEQ ID NO: 14583 - DNA, 684 bp, Triticum aestivum
  Clone ID: PAT_TA_14583
ccaccatccacgcactcctagtaagcgagcttagctactgatcgtcgtcaagcactctcgagctcgatctctcgaagcggctagctgctagcagccaattaatggcgaagccttcgcaggtgctggtgtcggcgctcgccgcctgggcggtggtcctgctgctgctgtgcgccgccgcgccgcggggcgccgacgcggccacggcgtgcgacgccgcgcagctgaccccgtgcgcgggcgccatcatcagggagctcgcccgcccaccgcggcgtgctgcagcaggctcacaggagcaacagccctagcctgtgcacgtaacggcgcgcgaccccaagctgcagcgctacgtcagctccgcccaacgcgcaagaacgccatggccgccttcaagctgcccgtgccgtcgtgctaattgaaactgccgttatcgccgccgactgccgcgcgcgtaattacgtactcgtgactcttcaggagtactgtgtcggtacatcatggtccagctggccatggatacatgtggctcctttttctgtttaaactacccttcttgatccggatccatctatcttttggtggtgtgagaacaggggccgttttgatacccctccccagccaactctcgaaaaactaattaatatttaacgcacccggccacaattaactcaccagaaaacttat

SEQ ID NO: 14584 - DNA, 737 bp, Triticum aestivum
  Clone ID: PAT_TA_14584
cccaaacctagttcgtcaatccccttttcctctgccgtcgacccctgctggaggtcgccgccgctagggttaactgaaaaaattgggcggatcactatatccctctccctctccctctccctctcctgtatatcttcctcttcgctttcggcgttgaagacgaacgcccaaagatcaaatcatgatgtccggcggcggctcgctgccattgtgtctctgtagcaacgtggggttataactctttggatcgacgataaggctgcataggagagaaccattgtcctttacagctcaaggatccaaggtctattggtagcaggatggcagtcctgcagcagtgatgtaaactttgacatggcccatgcctgaagttcgagaaacctcaaatggacagtgcaatagactgacgtttgaaatgtatgaatctctactgcttttcaagtagcagcgttgctctgttgaagattgtataggatggcttgtgtcatcttcattacatttgtttgggccgagcttctgttccaaaccatgcatagcacctgagaaattggcaagttgtgctcttgtatcagttgttgtaattgttgtgtgattgctcattactgacttttggggaaaatgcaaaattttcatgtaatttattctcgaacagttgaaaagctcaacagttattactatgtaatattaagtatatgagagaaatgtatttataaataactgttgtgaaaaaaaaaaaa

SEQ ID NO: 14585 - DNA, 881 bp, Triticum aestivum
  unsure (1)..(881): unsure at all n locations
  Clone ID: PAT_TA_14585
gaggttctctttccctctgaggagcaaagcttgaggttgcagagggtgtgctctagcccaggtccttactttgcaaaggatgcagggctagccggcgattccaatccacggagcgtatctttcaaggtcgctggagatggatcaaagccgaagaagagagcgaaatcccccatcccgacacgcgtcatctctgacgtttttagggaggcgaaagctgccagcaagaggttctcctctccacagcggcaaaggaaatctagctctgttcggttgctggatgatagtccccctttcgccttctcttcgacaagagcagcgaccaaattggtaaccaaaagggcctcttcctggccaaggaactccgaagctagagttgcaaaggtcgctgcgctggatgtacttgagaaatggacggtcgaccgctcacagctactcattggccacagatttgcatcaggagcgtatagtcgtctgttccacggaatctacaaggagcagcctgttgctgtcaagtttatcangctacctgatgatggngaagatncgnaantggctgntngccttgagaagcanttcactgtccgaagataccattttggctaggctcncagcatcntaatgtnattgagctggttgtggcatntagnctntgcacctgttttctgtgtcatcactgagttcctgcctggggncnttttgaaagctnatctncncaanctggaaggtcnancaacttcntttggnanaagnnnaattnccctntcncttgnaacatttncaacgtggtttgggaatacttttcnttttntnaanggnttaanntccaaccntttcacataaaatccaanaaaaancattnntntttcnactcnataannntt

SEQ ID NO: 14586 - DNA, 684 bp, Triticum aestivum
  Clone ID: PAT_TA_14586
cgtgcgcccggcccaaacctctccaaacccacgcggaaaaaatcatccactagcaccccgtggaaggaatccccgagcgaggcgctcgtctcatctctcccgagcgacagaagcggcggcaaggaggcggcggggacgagtggacggcggcggcgcaacctacccggaggaggaggatgccctcctgcttcgacgacctgccacgaagcccgccggaaccctagcctctgattgtcccatctccccggccgcccccttgccgcggccggaacccgctagctccggagaagtggttgctgcaggcgaggagatctctgatataggctagcttcgtcacctcacagctgcagcaagaccctgaattgggcagcatcgtgaaggacaaggagttctacataagaatgctccagaagaaggacgaaggtgccgcgacttggatctatttgtgtgtgcttttcagtggaaggcttcatatctattcgctgggttttggccaggtaatatttgtagagaaactaaacactatttctgaaacgactgactgtagcgtggaagaatttgggaggaactgataattaagctcttgtggtctattcaacatattatatattatgtatgctccaaattgctattatttttgttagtatttgtgccctgttcaaatcttagaattgttgttattgt

SEQ ID NO: 14587 - DNA, 502 bp, Triticum aestivum
  Clone ID: PAT_TA_14587
ttccaacgatcggtgcaaggaaaacatggtggaggatctgcagggaaggaggtttcggccgcggggaatatatatatgatgaagcttgtgtgaagtgtggtgacgttggttctttggagacggtgtcttgctctgttggtccgagcttgcagtctggtgatgctacaaggaatcaaccatggagggtgccttctgttggtcaggagagcttaagtaatatataatcaactagcatcctattaatattgagtcggtgccagagtagtgtggtgaataaagtgcctgtgagacaggcggtcgtgttggccaagtcgttaaggttggtttgagcggctgcgttgccgatgcagctgtctttttttatttgttgatgaatttcttgaactgaggtcgtggtgtgcttgcactctatagtcctggtgttctacattcccagtctgcgttgcatgttcgctttatgacgtgcgtgatatctatgaagtgaacctgaacctgccttatt

SEQ ID NO: 14588 - DNA, 718 bp, Triticum aestivum
  Clone ID: PAT_TA_14588
gattcggacgaggtggagatcgccagggacaagcaaccgcggagcaggcgcgccaatggcatcttttggatcttgctgctcaatttcggcatctacgtggccgaccacttgctccagatacgacaaataaaatcactgtacctgtatcatgcattccctacatggttccagtttgtgacatcaacattttgccatgccaattggaatcatctttcaagcaatttattctttgtgtatatctttggaaaacttgttgaggaggaagagggtaactttgctctgtggatgtcttacattttgactggtgctggggcgaacttgatttcatggttggttcttccaacatcctctgtgtcacttggagcatctggtgctgtttttggccttttcaccattagtgttctagttaagatgtcatgggattggagaaagattcttgaggtgcttatcctgggacaatttgttgttgacaaggtcatggaagcagcacgtgcaacaacaatcacagggcaatcgtttcaagtgaacaacattgctcatgtatcaggtgctttgataggtgcctgcgttgggtgtttctggtcagcagaatccctttttcatccaatgatgataatcccaaggcaacaaaaagagagtaaatagaaaataaatatatttatcaacaacattatcagcctaacatattattgtcaatttttcattcattatcatttct

SEQ ID NO: 14589 - DNA, 625 bp, Triticum aestivum
  Clone ID: PAT_TA_14589
gattcggacgaggccccgattgtctggggccgccagctccgaccggcgctcctcctccccgcggcactgctcccgtcgtcgcagcccgccaagaagcacaatctgcgcccggccgccgcagccgccgagtccgcaggggaggccaagggtttcctggagaaatacccggccctggtcaccggttttttcttcttcatgtggtacttcctcaacgtcatattcaacatcctcaacaagaagatctacaactacttcccctatccatactttgtgtccttgatccatctagtagtgggtgtcgcatactgcctcgtcggctggagtgtcggtctccccaagcgagcgcctatcaatgccaatctcctgaagctgctctttccagtggcattgtgccatggtattggtcacgtcactagcaatgtgtccttcgctgctgttgcagtctcatttgcccacactatcaaagctctggagcccttcttcagcgcagctgctactcagtttatccttgggcagcaagttcccctctctctgtggatgtctcttgcccctgttgtcattggtgtttcatggcatcccttactgagctttcgttcaactggactggctttcatcatgccatgat

SEQ ID NO: 14590 - DNA, 2505 bp, Triticum aestivum
  Clone ID: PAT_TA_14590
ccccccccgatccacatccacccatcgccacggcgactttcccccgcttcctcctcccgctcctcctcccggcctctgccgagacccgcttcgcccccgcccaagtcctgatccttcacttcagctcgttccactcgcgctccctcgccggcggaggtcgactcaccggcaggagggagaagcgctgccatgcgtccccccgactgtgacgctgctctgtgcgcgcccgccttaaacccacctcgctccagtgcgagaccgcgctgcacatcccccagctcacccgcgagtacgcgttccaccccgccggcttcaacgccaacaaccccgactcctccgacctcttcttcgccgagatcgagttctccgagtcgcagcacttccttctgcccagttcggcctcaactccctcccccacgtccggctcatccgcccggagcactcccgcctcgccgactcggagcagatggaccagtcccacttctcccgcctcgccgactccatggtcgagttcgtggaggcccgcaccggcctcgaggtcggccccatcgtccgcccgcctctcgtctcccgcaaccagatgatcctgctcgtcctcctgttcctgatctccatcccgttcggcatcaagaggatcatggaaggggacaccctgcttcatgaccgcaagctttggatggccggggcgctgttcgtctacttcttcagcgtctcagggggcatgtacgggatcatcaggcatacgcccatgttcatcacggaccgggaggatccaaacaagctcgtcttcttctaccagggttcagggatgcagctcggcgcagaggggtttgccgttggtttcctgtacaccctcgtggggctgatgatagctgtggtgacacacttgctggtgaaggtggagagcctgcagacacagcgatttgcgatgctggcagtcatggccatcgggtggtgggcagtcaggaaggtgatttacctggataactggaagactgggtacggcattcataccttctggcccagtagctggaggtaaatgttgtctcaaccggcgatcgatgcttatttcctttggttgcagaggacgtggagtcatccatccagatcgaccatactgagatagagcatcattttggttgtaacgtcgtactaccaagtttagcatttcaattctctggtgctttattgtggaatatagagaaccgagtcattttataccgaggattttaacttgcagtattacttgaacaatggtaaatcctatttagctgatatctctgataacgcttgatgccccaaggaaggggatgtactaacagtcgggcgcaaaacagccgtttaaccagtccaaggaaggacttcatccaagagagttaatttgagccctagcaagagatggctacgggaaaaagcgaccctaacaatcaagcatgaccctagggagggttcgtgctgatacaatccaaattggacaaaactgacatgtagacaaccaattgagctagcatgccactccaaaacttcatcagtggaattcatactgtatttagcttaggccaagtgcttctggatgaagcatgaggcatttagcagatcctaatattctattcacgggtgttatctagagcaaataaaatttgacatctgaccagtctataacttcatttccacgcatactcacaccccccctcccatcaccaccagcaacttcacaacaacatcctgtgataacttcttgtgtaaccaaccactctaacttttctatgcactgagtagatgcaccaactaacagttctttatccttcagtttatagctttgcatctaggtggctcaggctctaaggagagcctgtgcccctcatcagagacaggttcaggagtgctaatgttagtttttggcacttggcactacctcctgccatttgtaacacagtgatgggactccaaagaaggctttggagataccaaagcactgctgtgcaactcaataaccccaatggacccaggcatatttttattgtcttgggtcacccactcatctagatgttcatcttccccaatgtcattaccatggttaggtccaggacccactctctttctctctctgggcagagaggctttgatgctttttaatgtaatattatcggtcacggtgattgtaataataaagtagtactatgccacttctagggcaggaactctttactgttttatcagtcggatctagctaaatattctgtcaacctataatcagtaccttctctatcgacatggtagctcgccatataatgcaatgtaaaatctacctgttctgttgcacatttcttattcaatgttcttttatctaaaaaaaaaaaatttataccgaggattttaacttgcagtattacttgaacaatggtaaatcctagctgatatctgttctcaggcagtaacaccggccaaggatattaaccgtggacttgtctgggtaatcttatgatagtatggtgggctatagct

SEQ ID NO: 14591 - DNA, 951 bp, Triticum aestivum
  Clone ID: PAT_TA_14591
ttttcggtcgtgggtgtgtgtgttccagcctcccgtttgccttttttcttcttaacgggggacggggtaaacataaagtattaattaaacatccatattacgacaatcataatggtttgcatattgtcaatacataagccaaattgcttaaagatggcaatcatgcaggttgcaatacacacaggtaataacataaccaaagatttacacgccaagtcttattgatactcagcagagcgccgagattgacggtcagctcaaccggttgggagcttgcagtagtcgatgcagattgatccaagcaccgtgcttccaagaaataccagtcattgtttgcttggttcagaagagcagcagacaatttcatgaggcctggtcagcttggttcagaagagcagcagacgatttcatgcacccaagtatgacatcgatgacgtccccaacatccaaggttcgtaaagagttgtagtagcaacagagaactccatgacaattggaaaccaatcatgagaaagggaactgcatggttgggtccatgtagttggctaccacatctgtggcgaggactccattattggaaggaggaaaagcatcgaaaatgctaggcattgttggttccaaaggacctgacattgtagggacatcataatgtccattgaaatgagcaagaggatactgcatatattgactgtcctcagcaggaaattcagtggggaagcttggatcaggagcaaggagatcagttagttccatgtaatcatcagcagacagtcctctgtcaggtggcagctggtaatctgtagtttccacattgctgttgttatccacgcctcctaacccaacaagccctgataattcattgtagaggccaaaagagctgacttcaaaagcatgagcctcagcttcagacatcggaggaagaccagagcactgtgaaagacatcaaagcta

SEQ ID NO: 14592 - DNA, 508 bp, Triticum aestivum
  Clone ID: PAT_TA_14592
actgcaaagcagcaagctctactcttcttctgtactgaacgtgtgactagataacaataagcgtgaaccatggcggacgagtacggccgcagcggctacggcaggtccggcgccggcgacgactacgacagcggctacaacagcaagtccggcactgatgactacggccgtggcgaaggtggctacaacaagtcgggcggcgatgacgactacggccgcagcggcggcgatgggtacggcaggtccggcggcgacgactacggccgtggcaccggcggcggtggctacaacaagtccggcgccgccgacgacgacggcgggtagccgcgacgacgaccccagccgcacgagcggcggcggcggcgacaaggcccccggcaacaccgccactcctgcggcaacagcccggacaccggcggcgccgggtacgccggccactccgctgccgaccaccccgcctccgccggcgtcgggtacaacagcaagtcctctggcgacgacgcataca

SEQ ID NO: 14593 - DNA, 2068 bp, Triticum aestivum
  Clone ID: PAT_TA_14593
cccacgcgtccgcaacgcgagacgcatctcctggccaagtgaaccaagattcgtcacaggagtttcagcctagaaaaataagtttgcttgccccattttcactcagttggcgtgacaagaacaagggcaaacaagatgagtcaacaaacggcaagcttaataacaacactgagcaaagtgttgagacaccaaagacagaccatggaaatcaggaggcgacgccaaaagagggtgaacagcaagtagaaacacccagattggagacggccaagatggacggcgatgtgccaactgtcgagacgaccacggataaaatgaacgggcaggaagaacatttagaagaagtaaaactggattgatccgtcagccgatcacatttggtggtagatagtgccttctcattttgaaaggaagctgaagtcacgacattcggctccaatttttaaatcgtgtattgttgtagttttcccccctattcttccctgtgtccagcttgtgtcacttcgtttaggttcatagattcaacctttccaaccatacctcgccaaaagataataagttatgtttttcctgttcattgttaagatggctgtaagagtgtaagttatggatatgtatacatgaaagacatacgacgtgaatgaaagaagctgtagatgaagcaaggcttcaagatctgagaaataaacaccggccatctgttttgtcttcgatggaaaacagagcaaaaggtcttcttgcctggaggagcaccaacggtcttgcatcaaagctatacaatttcaagcgtgacactgaaccattggtgtcaatatcaacagaacagttgaatgactcaacagatggggatgctaaccaagaaaccagttctggaaatattgatgatatgtatcatggcttgactgtcaacacggagattgattctatgcctgatcccaaagatcaggttatctggctgaaggttgagctatgtcgattgctagaggagagaagatcagctgttctgagggctgatgaactagagacagcactaatggagatggttaagcaagataatcgacgtgaattaagtgcaaaggtagagcagttagaacaagaattatccgagctaaggcaatctctatcagacaaggaggaacaggaacaagcaatgcttcaggtcctcatgcgtgtagagcaagaacagaaggttacagaggatgcccgcatctttgctgagcaagatgcagctgctcagaaatttgcttcacatgtccttcaggaaaagtatgatgaagctatggcttcactcacgcaaatggagaacagagcagtcatggcagaaacaatgttggaggcaacacttcaataccaatctagccatcagaaagcacaactaccatccccttccccttctccaaggacaccaacgcgagacacatctcctggccaagtgaaccaagattcgtcacaggagtttcagcctagaaaaataagtttgcttgccccattttcactcagttggcgtgacaagaacaagggcaaacaagacgagtcaacaaacggcaagcttaataacaacactgagcaaagtgttgagacaccaaagacagaccatgcaaatcaggaggccacgccaaaagagggtgaacagcgagtggagacacccaagagggatgaacccacattggagacggccaagatggacggcgatgtgccaactgtcgagacgaccacggataaaatgaacgggcaggaagaacatttagaagaagtaaaactggattgatccgtcggccggtcacatttggtggtagatagtgccttctgattttgaacggaagctgaagtcacacattcggctccaatttttaaatcgtgtattgttgtagttttccccccttttcttccccttgtccagcttgtgtcacttcgtttaggttcatagattcaacctttccaaccatacctcgtcaaaagataataagttatgtttttcctgttcattgttaggatggctgtaagagtgtaagttatggatatatatacatgaaagacgtacgacgtgaatgcaaagtgcattttttgt

SEQ ID NO: 14594 - DNA, 660 bp, Triticum aestivum
  unsure (1)..(660): unsure at all n locations
  Clone ID: PAT_TA_14594
gattcggacgacgcccggccgctcgggccgcaggcgggcgcgccgccggggcggctggcaacggacatggcggcggccggcggcgagaccatgatgacgagggagcagctgctccacctcttctcccgcttctccttcctcacctccctccccgaggtcaagcagcggattgccgacgccgtcagggacaagcaggaggccgtggccgtgaccactgaaatacaagaggagattcttcgcgagatgggagtagatccaagttttggcattggttgcctaggaaaggtcaatgttgtttacaaaaatgacaaggacttgatgattaaattctatcaatttgttgccaaagaagaaatggctattgatgaagctgagcttgaacccagagaattggctgccaaactacatgctcaacaaataatgcaagaacagcaactgaacatgctagttgaaatgaggaaatatagcccagagagccaatctgtcatacttgggactttgcacagagaattggaagaagctaattttcacctcaacacttcggtcctgactcctcagcaatcccagaggttgttcccacgtggtgtttttccgcctgctctgggggcgccctgcctcttgnnattcaaatcacanccgcaataaatnacgtaataccgt

SEQ ID NO: 14595 - DNA, 628 bp, Triticum aestivum
  unsure (1)..(628): unsure at all n locations
  Clone ID: PAT_TA_14595
attcggacgaggttccccttcttcgggcccatcaactccgccgtcggcgcgctgctcgtcagcttcaccgtctacatcatcccggcgctggcgcacatcctcacctaccgcacggcgtccgcgcgcatgaatgccgcggagaagccaccgttcttcctgccgagctggacggggatgttcgtgctcaacatgttcatcgtggtgtgggtgctggtggtcggcttcgggctcggcggctgggccagtatggtcaacttcatcaggcagatcgacacgttcgggctgttcgccaagtgctaccagtgccccaagccgccggtgccggcggccgcgcagtcaccggcgccgttgccgcaccactagagcgccggctggaggcgaggcaaagagcaccacgccacccccacacagtctcccgcggccggcgcgtcgcttgcttgttaattntctagggttttggtcgccttgtaatatacaagcctcctcttctccctcccctactaagggtagtagaactcgatcagcagcagagtcacgcaaggccgccggctcgttccccgtcgtccctgccatcagaagatctcacctcgcgttgctttcgcccaccccgcccgcctccgatcgatcg

SEQ ID NO: 14596 - DNA, 1022 bp, Triticum aestivum
  unsure (1)..(1022): unsure at all n locations
  Clone ID: PAT_TA_14596
gattcggacgaggcttgaacttggactcatgtaagattggtgatgagggtctatttcacctgaaaggcctcatacagctaaaaagcctggagctttcagacactgaagttgggagcaatggacttcgtcatctgtctggtctacgtaatttgcagagcatcaatctctcttttacattggttactgacattggtttgaagaagatctctggcttgagctcactgaagtctcttaatcttgacaatcgccaaatcacagatactggtttagcatctcttacaaatctcactggattgacacaccttgacctatttggagctcgcataactgattctggcatgaactgcttcagatttttcaagaatcttcagtccctggaggtctgcgngtgggttgattacggatgccggtgtgaagaacatcaaggacctgaaagctctgacgttactcaacctatctcaaaatggcaacctcacggacaaaaccctagagctgatctctggcctgaccgcgctggtgtcgttgaacgtgtccaactcccgggtgtccaactcaggcctccaccacctgaaaccgctgctgaacctgcgctccctatccctggagtcctgcagggtgacggcaagcgagatcgataagctccggctggtcgccctccccaacctgatcagtgtccggccggagtgataggaccagcacttccacagcgacctgtaactgtaaagcaactgctgcttgactagagcaggtcgccttgtacatacttttgcaagaacgagatgtctgtacatattgttctttgtgtcgcgtcggtgtgcctgatggcaacggatacctccgtgtcaccgtgtgcacggtatcccacggatcctgtgataggaaggaacaattgtaaatatgtcgtgcttcctccatgtggggtgctcctgtgtaaatagattggtgcattgctaaatacctctccttggctgctgtgtaaatagattagtgcatttctaaatacctctacttggtatcggtta

SEQ ID NO: 14597 - DNA, 532 bp, Triticum aestivum
  Clone ID: PAT_TA_14597
gattcggcacgaggcgcgtcggcggggttcgtgccggtgcaggccagcacgttcgccgagtcgcaggccgaggccctcctcaagaggatggccctcatggggttccgcgtggagaagcgcggcggcgcgctctgcctctactggcagcgcggcgagctggtgtccgtgtcggcgtggcggtgctgaccgccggccggccaccgtcggccagccaaccgtgaaaattcctaccacaagcccggtttagctaggactaatgatcctactgcgagcaaaaaaatacttttcaccgtcgtcgttgtaatgatctcatctgatctggtcgtctgcttattagtagtatgctatgtcctagtaccttttaatcggagtaaaaagccgtccgttgcctggcttgcagccccggtccgctctgctcatgttgatttgcagagtaggattgtggtttgcatgttgtaaaacgtaggcgtggtgcagagtaaccagcgcattctaccgcccgtgctgctactctctttttattgctgtgaat

SEQ ID NO: 14598 - DNA, 635 bp, Triticum aestivum
  Clone ID: PAT_TA_14598
gaattcggcacgagtatggtattagctaccagggcatctgtttcaaccccacccagacccactgaaattcagaaatcaggctcccatgtccctgccaataccagatttgcagtgcccgacccgaggaaggcctttgcaactaacgtatccaccatttcaagtcgaatccccgctgtgccacaagctccgacgcactccaggagcgcgccgtcaggctaccaaaattacactccagctccgacgacatcttcagtcgcaccatcatcagttgttcctccggtaagtcgagcatcttcagcgcaacgaccgatgcaacaagcatcttcagttgccgtcgcagaacctattaggccaatagctgtccgtcaatctcggaaagcatctcttgcccgattcttggagaagcgaaaagaaagagtttcaagtgccacgccataccagttgtcaaagagcccgctagagagcagcggcagcttgggcagtgcgagcactccaagcaggttatctagcgcagacaatgctccacccaacaacaactgccaggagtctatgagctacgttagcaatgacgctatgttggcaattccccatagggtagttatagagttggaatgagagagagagagacaaaaaaa

SEQ ID NO: 14599 - DNA, 554 bp, Triticum aestivum
  Clone ID: PAT_TA_14599
gagggcgcggtggtctgcttcctcggcgtcctctcggcggcgctcggattcgccgcggaggccacccgcgtcaaggtttcggatgttcaaataagcagtactcctggtgaatgcatatacccaagaaccccagccttagcacttggtttaatatctgccgtctcccttatgctcgcccagtctatcataaacacggtcgctggatgcatctgttgtaagaggcatcctgttccctcagacactaactggagtgtagccctgatctcattcatcatatcttggtgcactttcataatcgcattccttctcttgctgaccggagctgccctgaacgaccagagaggcgaggagaacatgtacttcggtagcttctgctacgtcgtgaagccaggggtcttctctgggggagcagtgctagccctcgccagcgtggcgctagcgatagtctactacgtcgccctgtcatcgtcaaagggtcctccgccgacgtttgcaaccccgcagaaccatggcatcgcgatgggccagccctgtgatcccgcagcagagcagcg

SEQ ID NO: 14600 - DNA, 619 bp, Triticum aestivum
  unsure (1)..(619): unsure at all n locations
  Clone ID: PAT_TA_14600
cccccggcaccagggaaatctaggtaagaccaaaatctcagctagccatccattagatacaaaataatagtaccagcagccatggctaagttacacacattggttgcggcactgttgcttgtcatggcagtatccctcgctgcactagagggtgttcatggcgtctgcggcatgtcaaatgatgaattcaagctttgccagcccgcggcggcagtgaataacccgacggacagtccatcggctgagtgttgcgctgcccttgagaaggccaacctatcatgcatctgccgctacaagggcatcgccggcatatggctgagaatgtaccacattgatgcaaaccgcgccatggcgctacccggtaagtgcggtctcaccatgccaaacaactgctcttgatgatcggatgtactacccataagcatctagcaagtgttaatcgctctacataagcttcaacactgatatggctaaataattggaggttcacttggaaaggtattgtgctactcggtctatgttgtatatgattggatgtgatacaacaaaatgcagggataaaaatgtatacgcaaatgtaccctcatggaaaatgccgccaggttgtccacantttagt

SEQ ID NO: 14601 - DNA, 592 bp, Triticum aestivum
  Clone ID: PAT_TA_14601
ggccttgctcgccgtgccatcgtccaggtctcctacgccatcggtgtgcctgagcctctctccgtctttgttgacacgtatggcaccggcacgattcctgacaaggagatcctcaagattgtgaaggagaactttgacttcaggcctggcatgatcatcatcaacctcgacctcaagaaaggtggcaacgggcgctacctcaagacggcggcctacggccactttggaagggacgaccctgacttcacctgggaggtggtgaagcccctcaaggcggagaagccttctgcctaaggcaccctcactttttcagaagaagcttttggtctgctgcgctttatcatgttttatctggcttctatatgttgtgattcttgatctgccccttgcttatcatttgtacttgtactgtcctaataagtggtacttgtgagggtcttattgtgtctgcttatttacctagaggattatttctggttttactggttatgtaatgcttaaaacaatgaaagaagctacaggctacagccactttgagaagtaatgggacctcgtgcattttggttacaaaaaaaaaaaaaaaaaaaaaaaa

SEQ ID NO: 14602 - DNA, 875 bp, Triticum aestivum
  unsure (1)..(875): unsure at all n locations
  Clone ID: PAT_TA_14602
ngccggccgggggactgtcgcacccgtgcaccaccaccaccccaccaccaccaaaggggaacgagcgccgccgagcgaacgcacgcacgcccgcctccccccaccggagcacgcgcgccgccccgaaatcccctctcgcatccgtcgggcggtctcctccccgtgctcctccacttttctggaatggcgtcgagcggtgacgcagccggagttgtcgtgccgaggaactttagactgctggaagagcttgagagaggagagaagggcattggggatggaacagttagctatggaatggatgacgcagatgatatctacatgcgctcctggacaggaacaataattggtccccacaacactgtccatgagggccggatttatcagttgaagcttttctgtgacaaggactatcccgacaggccaccgactgttaggtttcactcaagaatcaacatgacctgtgtaaatgccgagactggattggtggaccaaaggaagtttagcctgctgtccaactggcgccgtgagtacacaatggagaacatcttgatacagcttaagaaagagatggcgacatcacacaaccggaaactagtgcagcctccggaggggacgttctactgaacgagcgctcatcgcgtcgaacgtgtcattcccaagaaccctcgcggttctcattttagatatcgcataagatcgcaacatttggtgcaaacgattatgtataactttgacggtgtccttcacatggttttgtgtgtcttgtcttgttatatctcctgggtaagcctgtgttgtaatgatacgctggagcttcagctatgtttttaaaagtaccattacgttgcttcgaaaaaaaaaaaaaacaaacaaaa

SEQ ID NO: 14603 - DNA, 1432 bp, Triticum aestivum
  Clone ID: PAT_TA_14603
acttttttttggttttattatggggtatatgctacccaatacccgacaacaaaccaacagtaatatgcacagataaataaagttttacaattttacccagaacccaaaacacaggtgcacaaagcttacacagtatctttacaaagcaacaggcggtcagctgtacgggaaaaacactatacgtcaagcttccttaagataacacgcagtcggggttgtggtttaaaggaaatttacatagctggaagagcttgagaggggagagagcggcattggggatctatcacttagtatggtgatgttcgccagtttttactttcactggatgtgcttgctattattcatccatgtctcctggagcgcactgctcaggaggagtcgtgagctgggctgtccgaatgcatgtccatggatgagcggtttgaagccgagggatacggctcgcgcgctaagccgttcgacaaggtaacatgcagaccctaccttgatccacgatggtatggttgcaggcccgggcgcacggggcctggatagtgcgttagaaaagaccgcggagttctttgggctgcgtcaaccctgggtttcctagtgcaaataagcttgcagatggttgctgggttgcttgtgttgggcatatgcacagtaacatgattgctttggcttgcatattgtgactcttggagagggcaatggattgtcgcctccatacttgaagctcatgcttggacgtgcgaggctatatcaccaactgtcagctctcgaaaccattttcatgctgtcttaacggtctcattcatacagcttttccatggcgtggcgttcgcctggcctgagaaggagagcttctgcccgcccaagggcgagcgtgtagagctctggagagcgagttgccggcgcccgaggaacgcgccgtagatggcccggaccgatgctggtccagccgcgcccgctccgtattgcgccccttgccccgtgacctctcccccgagctcccccttgccctgttgcaccggtgcgtcccccagaacccccccggtcccccgctgggacaccgcacaagatcgcaacgctcggtgcaaacgcgttatgtataactgtggcggtgtgcttcacatggttcttgtgtgtcttgtctcgttatatctcctgggtacgcctgtgttgtaatgatacgctggagcttcagctattgtttttaaaagtaccattctcctccgatccgccgcggcgccgtccaattcggcccgaatcgggcgccggaaccctagacctgggcgagtgagagggggggggggggcgagatgcgcgcgaggtcctggcaaggagacgaggggggcgagaagaaggatgaaggtcgggagggcgtcgcgtcgacacgaagcggcggctttacgtctgtaggtctcctcggacgcgtgggcggacgcgtggg

SEQ ID NO: 14604 - DNA, 785 bp, Triticum aestivum
  Clone ID: PAT_TA_14604
ccacgcgtccgcccacgcgtccgctcctccttgccagaaacgcaaccggccccaaatccctcaaccccggcgtagctgggcgatagcgagcttgccgatggtggcggcgggccagatccggtgcctagctgggcgattgcgcccaggggaggtccagatccagcacccccaccgtcttgctgccggcgtcctcgctgccccagcagatctcctcgcggacaaatactctgctccatcgtcctgccccggcggaccgtctcgaagatgcatggtactctgacacgcggaagcatcaggactacagatggatagaaaacgcttttatcaaagttccccctttctgacaattgagagaatttctctgcaacttgactttaactctgttgttgatcaggcatctgtacgtgtctgtgctcaactgaatcgggttttcctggtgtgatccctcccaaaacaagaagcttgatgaatgatgaacaaggagtagtagaacaggagggaaatgctagagcatttctgttatgtaccatcaagatactagagcttataattttaaataacaacgcttgttggatggtggtcagattagtccttaatgcctgttgctggccatgtcccaaagatggtgctaccatgtctcatccagatatttcccctggtgattctggggtcccccaatgcttgttgaatggtgatcagattagtccttaatgcctgttgctggccatgtaccaaaaatggtggtaccatgtttcatcaagatatttatgcttgtgatatgctcc

SEQ ID NO: 14605 - DNA, 942 bp, Triticum aestivum
  Clone ID: PAT_TA_14605
attcggacgagggagagactagtctcgagttttttttttttttttttttaaatctagaaaaccatttgttccctagtttgtcacgagagaaagcactgataagctcaatctgtcattcgttcactaatatttctctcaaacaataaatcagcaatatctatcagagaaaaagagaaagacatttgacattttttcccccatctcgaattgtccctcggatcatcaggaatcaggagccggcaggtacagcttcagcatcaccacccaccactccctacgggctacctcagtgcagtgcagcttccaggtcgctcttcccctaacgccagcgcccccagctgttgcagtacagcaggcaagacgaagggatggagccggcgacgcagccgagacgaaggcgcgggcgcgggcgcccgcatctgccatcgcgcactcccattgtcggatgccctacagtaggcatctccttcctctcttattcctgatgacacacggccttccttgcggagctcgacgatggaccggccaacctgtcaaatgtcaatgcactctggggtttcggcgccgctgatcgatgccgccaatggatctccacgcactcgatgcacctggtcgtgtgccacagctatccatgattctttcagggacgaggctgctggcgtcgtggcggtaggttcctccagcgatgcgatgcgatgcgatgcgatgcgatgcctctgtcagtagcacgacgtcaggcaggcatttggcctgcagcaagtttcagagaataatgtggtatcaatttcagcaatagcttccacttacgcgcatgtctgcctggattaatttcaaatgctcagcaagagatgactagtcccactacctgagtgaagctgctcagcaatcgcaagatgctccttgtcattagccatgctgataacaagcgctggaagcctgtta

SEQ ID NO: 14606 - DNA, 671 bp, Triticum aestivum
  Clone ID: PAT_TA_14606
ttgaggacttctttaaacgctactaaccggttgcagagaagaaaaagcgtgtaactgatgaagacttagaagcgttattgtcagatgagatattccagcctttcgggcacgaggcccttgctgatgtacaggcaacatgtggaacacttggcttatctacagcaacagtgaaactgatagcaccagatggagaggagaaaataggatgttcagttggaacaggtccagttgatgcagcttacaaggctgttgaccaaataatccagattccaactgttctccgagaatatggtatgacttcagtcacagagggcattgacgctatcgcgacaactcgagtggttgtcactggagatgtgaccaacaactccaagcatgccttgactggtcaatctttcaaccgctccttcagtgggagtggggcagctatggacatcgttgtgtccagcgtcagagcttacctgagtgccctgaacaagatgtgcagctttgctggtgctgcgaaagccagcagcgaggtacctgagagcgcaagcgttcaacgcacagagtgagcttggcgctcctctttgttctcatgcgggcttggcgacgtaagagcttgagcaactgttatagagtgatatgtcgtttcagtaacaggctgctcaatattggggttttcccttgtc

SEQ ID NO: 14607 - DNA, 521 bp, Triticum aestivum
  Clone ID: PAT_TA_14607
ttttttttttttgtttttgtataaatataaagatagtattgaaaatgagcagagagataatataaatcggagagagtacataatcatgttttctgtgttcgaagataggtacgatatgtattaattcatagtatgtagctgtgtaccaacgcgcaatacgcgcgtcaaccgatcataacataattcgtacatacatggcacatgacgcccgcaaaaaataagaggcgggaacacgactacagagtgccggtcgacgcagctcagcagaagaggtacccaacggcggcggcgacgagcgttccgacggcgaaggccggggtggtcgtggcggctccggtgtccgggctgggagccggcgcctcggcagccatcgccatgcccaccacggacgaggccacgacggcggcggcggcgaggatcctgagcttgagggtggccgccatttgcgctagctagcttctcggtttgatcgatgcctgggaattacagacgtctaagcactaagaacagcaaggtagcga

SEQ ID NO: 14608 - DNA, 678 bp, Triticum aestivum
  unsure (1)..(678): unsure at all n locations
  Clone ID: PAT_TA_14608
gccggccgggtcgggattttcgcgtcggagagggagagaaggaaaccctaggtagcccagccgccgtcctcgaatttgtgctcgtccagatctgcttggttggtggtggcatggcgatgcgcacgatggccgcgaacctgaagcagaagctccccgtcgccgtccagcgggtgttcgcgtcttctcgggctccggcaacctccaacaatactgctgccgccatcgacagccttgatccagaattacgccgccgggtgctcaacgatgttgataagctcatcaggaggaaccgcaggaacgacctcttggtcgctggtgctggcttaagttttggagggattgtcatgtcatatttggctcatcgactcaccagtcgaagtgatgactggctcaccaagtgaaatgatgaatgtaaatctatcctgcactgcaagtttaactgtctatcctgcactgcatctttaactggccagttgtatgattcctggcttgtcttgtgtgagagcactctatatatgatgagggttctatgttcggtggaatctacttgtgatgagagatctaagttctgtgatggcatgtgagatgtaagagcactcatatatttatgtggatcctatatataaccgggtgatttatctattgtgttctgcaaaaaaaaaaaaaaaaagcccctan

SEQ ID NO: 14609 - DNA, 1744 bp, Triticum aestivum
  unsure (1)..(1744): unsure at all n locations
  Clone ID: PAT_TA_14609
ccacgtgcatcaaccgccccgtccgtccccgacccgattaaccctaccttccgctcgattccactccccttccctcctcttctccccccgcccgctcgtcgggtccggagccagcagcaccgagatagcaatggcggccgcgctgaggagagccgtcgcgcagcgctttgcggcggcgccgcagcaggcctacgggatgccccgccgcttcatgcaggagcgccccgcctttcgccccgcggtgcctccggacgtgggattcatgcctctggccgaccggatccgcgaccacctcggcgtctccttcccgcgcatcaacctcgacggcctcgtgccgcccgcccctgcccgcccccagacccagccgacgagggaggccgccgcggtggtgggcagcctcacggtggaggaggcgcggaaggtgctgcgcgccacgcagatggaggcggcgcgcgcgcgggtgcgggcctcccgcgagggcaccgtgccctacgccgagttcctgcgcctctgctgcgacgccgcgggcgccgacgacgggccctccgtcgcgcgcgcgctcgacgagtccggatccgtcatcgtgctcggcaggactgtcttcctcaggcccgaaatggaaatgaaccaaagaaacggcggtgttctaaaacaatagagcagttgtgacaccaaaagtttgggggattttacttgcccccccgttccgttccgttccaagatgggagtttcctttcttctctcaaaaccagaaggaaaacaacaaatctaatttctacccctcgatctaaatctgaggagggaagaaactaaatgatgaaatgacagtcttgctaaaattacaaaaaaaaaaatctccgatgaatgaaacatgaggagaacctagctgccattggcacccaaaaaagaacatgcctgattattttctatattcagattggttggcgtctagtaccgcgctgatgatagtggctccactattttgggaattggagcacatgttttcaacttcatcattttcattggtagtcatgtagatgttcatactgaagtacttcaccggattttctactattctatagtttaaaatacacattagtgaagcaccatttcacttgctgttgtccgatctacaattacatagcagtgataagcaattgatagtatgaatttgctgtttgaattgcataattgaagattcaaatctacagtacaatcatatgttattagtggtggtgctgggttgatttgcctttgagcatgtcatgcatcccaacgatttaattggtcatatagtggaagatgtagtagaactactacaatttgcgtaagaagtagtggcatgagatcatccctttttggcaattgtgacaccggaatagcccatcatgtgatgtctttgtcacttgttccgttcgtttgttagtgtgaaagctatttacttacaaaaatatcaattttatttagacaattcaatctattacctgcatcttagctgcaacagtacagaattgatcttgttaccactatttgttttcatgagatattaagtactaaaaaatgctgttgtcatttcctgctgaataaataagctgcatcctttccaatttgaaaaacaggaaactaatgcagggctaacaagtcaatgacaaatctacttctcttatcttcttggngacctccccccaacccaanaaaaatgtcctgggtggacctaaacaaagtttgggaacatcatcacatg

SEQ ID NO: 14610 - DNA, 524 bp, Triticum aestivum
  Clone ID: PAT_TA_14610
tcggacgaggctctttgccgttcctctcgtcgcacacacattcgatttggtggatggggatcgtgattctttcagatttttatggctggtgctcccccttgcatttgcgcaggagttcgacaagcggtacggcgtggggtggcagtgcgtggtgggcgccagcttcgggtgcttcttcacccacaccagcggcaccttcatctacttctccctcgagcgcctctccttcctcctcttcaaggccgccgccgccgtcgccgtcgccgcctcctaatcaaaaccatcatcaatctccggatcctgcccggcggcgcgccgcggacacccgttcgtcctcgaattcgttcatcagaacagaaatggaaccctgcactttcgtctagtagctagtataatttgtaatgtccgttactaccagaagctcaaatcagctgtatgcctagcatcctgtaaatacaccgcaccatgatgctcgctcgttcctggaatcatttgcctccattaccaaaaaaaaaaaaaaaaaa

SEQ ID NO: 14611 - DNA, 539 bp, Triticum aestivum
  Clone ID: PAT_TA_14611
attcggcacgagggtccagagagagagagagcatggccagcaggagcttcctgatccggtcccccaaggaggaggagtccaacgccgccgtcagagaggctgtactactgggagcaaagaacggtgcgatagctggtactgtggtggcggttcccacgttggttggctgccgtgttcttccttgggctaaggctaatctcaactacactgcacaagcactcatcatatccgcagcctgtatctctggcttcttcatcactgctgacaaaaccattctacggaatgcacgacaaaacaccattgggaagcttgacaagtcaacttgatgcagagatgtatctgagaaggttctctggttgatagggtaccttttgccccatatgcagtgtcaccatttccctttgtggacaagcaaattttcggtgtttagctactcaagccaaaggttgtgttgtaaagacatgctacctgatggacccaactattgtatccagtttactcccaatttgaatcagaataaaagatggtgctatgggttg

SEQ ID NO: 14612 - DNA, 559 bp, Triticum aestivum
  Clone ID: PAT_TA_14612
aggtgtaatcaatggaactgcacctaatcctgtgcgtttgtcggagctatgcgaacggctggggcgaatcgtcgggcggccctcctggttgcccgtgccggaattcgcgctcaaagcggtgcttggagaaggcgcttctgtggtgttggaaggacaaaaggttcttccggcgaaggcaaagcatctgggcttctcctacagatacccctatgttgaagacgctctcaaggccattgctcgagacttgtaggttggcgacagtgagcaatttaatttaatttctctctacaaaaattaaataggacctttaatttgtgacgacacgcatgcatgcatgtgtatagagtttacactccgatcctccggcctcgtttgcatgcgcgtgttatgtaacacttgctctcttttcccttcttttgacatcatcaaatgttgtactcctagtagagtacttcttaatacaagtaagagttcacctttcataaggacagaaaccaaagaagcacttttatgatgaagccaaataatgcaagttcacgctaaaaaaaaaaaaaaaaaa

SEQ ID NO: 14613 - DNA, 478 bp, Triticum aestivum
  Clone ID: PAT_TA_14613
tggacgggaattacaatcaatgaaaaaagtgagtctttagcattagacttgtctacatgtttccctttgatgaatcactgtttgtttgagttataaacactcagttataaactagttagcaataatgtgttgtcacgatataaccttgtatggttctagcaataatcaggtgggacttctgatcagtgttttcctgtaattgttacagattcacaaatgtgtagccattggcagacttgtttgcactaagttgagagagataagtaggatatgcagttatcaatgtattagctatgccattaggtcatgataaacatgggaaacatagtaggcatcatagtataaacttgctaagtgcatccatgtataaactgatttatgtccctcttacctaatatttcagggcaacctagtggttctaatggtatatggattttttccactattgagcatggtttgaaagctctacttgaatagt

SEQ ID NO: 14614 - DNA, 663 bp, Triticum aestivum
  Clone ID: PAT_TA_14614
gatccgcacgaggggagacctggtgttgctgttgttgaactccagacagttgatgtagtggtagaacatgtgcttaagcagatattgtcacaggaaactcagtatcttcctatcacaaggggttgcaatgctgttctcctagtgaatggattaggagccactcctatcatggaacttatgattgcagcgagaaaagcagttcctgagttgcaattggtgtatggcattgctgttgacagagtctacactggcacacttatgacatcacttgatatggcaggattatctattaccattatgaagtccgatgaaagcgttttgaagagacttgatgctcccactaaagctccagcttggcctgttggttctgaaggaaaacgtccaccagcaaagtttcctgttcctctaccaccatcaccttcaatgaaggatgacgagattcttgctccatctcaggagctgagcaagcaaaggtgtatcctggaggctgctattgaagcaagtgctactgcaattatcaatgtcaaggatagcctaaatgaatgggacagtaaagtgggcgatggtgactgtggaaccacagtgagtcaaatagtgtttaccaattcaatgcttatttgactactgttattttaggatctagtaattcactgctgttctttc

SEQ ID NO: 14615 - DNA, 491 bp, Triticum aestivum
  Clone ID: PAT_TA_14615
gattcggacgagctcgctacggcggttgctgccggcggcgcatctggtgtcacgaacatcaccacctctcgccggtagccggccggccggccggccgtccatgcccgtggcgaccaccggcatcagcagggcaagcacgggcacggcggcgactcccgcttcatcctgcgctgcgacacatcagcctcgtcctcaccttccgcacacttcccctccgcctctcgaggagcgaggtgaataagaggctcgttgacaccgaagttgattgccttcagtgctgtgaacaaatttaaggaggattgcgagatgctggaacaaacatttgttccttacctagcctggttggattctgcagcttcgaaccccacacacaacccagaggtgtcttccaggttgaaactgatttaccgtcagagtgctgtatgtgtcttctttttcattcttcatgtttcgagtttcctaacctgtttgcgaaaataaatgtctcatac

SEQ ID NO: 14616 - DNA, 492 bp, Triticum aestivum
  Clone ID: PAT_TA_14616
cggcacgagggacgccgccactggcgcgagatcgcccacatctggcggccagatgttggtgttcgtcccgccgcacccgctgataaagcattgggtctccgtgctgcgcaacgaacagacaccgtgcgccatcttcaagagtgccatggcagagcttggtcggctgctcatatatgaagcatccagagattggttgcctacaatcacaggagagattgaaacacccgtagctgtagctagcgttgaatttattgatccaagagagcctgttctggttgttccgatactgagagctggtcttgcactagctgaacttgcttcatcagttctgccagcaaccaagacttatcaccttggcctccgtagagatgaagaaacacttcaaccttcaatatacctgaacaacctgccagacaaaattccagaggggactcgtgtactagttgttgacccaatgctggccactggtgggacaatggttgctgctattga

SEQ ID NO: 14617 - DNA, 639 bp, Triticum aestivum
  Clone ID: PAT_TA_14617
attcggacgagggacggcgaacaccgcgttgtccctgttggcgatgacgacgaggatcgtgtccgtcgcaaccagcatcgctccggcgaccgcgatgaggacggtgaggtccctgcacctgcgacgacctcgcgggcgatctcatggtggtacgtgtagaactcgtacatcatcaaaacagccgcgcatatgaaggtagcaatcatgcagaacccctcgatgacaaggaggttgctgaggtgaactttcttgtgatttgcggtcgagtagagcggcttcatgtccattgcatcctgacagcgccgccacgatgaacacgacaatggccgagaggaccgtctggtaaaaggcttttatccggtctgactcggatttcgccagcgccaggtccggcaatgggttctctgggttctctctggctgcgcctgagccatttccatggtgcgacgacccttcttcctcgtctcttcctgtacttggtacagaatctggggcctgcaaacagtacgggaatgcatggaaagtcagcacatcaacaaagggcaatccattcaagtcttcaaccaacttcagcaaggcattagactagcgagttgagacgatgcgcaactgcggacagtgcaagaaatcgacaggaga

SEQ ID NO: 14618 - DNA, 607 bp, Triticum aestivum
  Clone ID: PAT_TA_14618
atacggacgagctatctatattggacatatcatgctattgctatgagatattgagatccatgcgtatgaggttacctgtagtctgctcactggtatgctagctatgccggtgtcttgtgttgcctatgttatacatagtgaagtgacatcagatgtactaaatggtcatttaagcgagttaatgaaggatgaaaccaacaccacttatgtggaacaagaatatagctagagccagggagaaccgaaatatttcttccagagagcactcgcgccaaggtgcatcgctccctcatttattcttagaaaatttcacaactcactacatataggcatcccttacttatatgaatccttcaaaaccatggacagaagtttgcgcacctgattgctaacttttccaaactggtatttagaagaataaagtgatgggagtgaacatttaaatcggtgagaatgactaaattaagcctgagcatagaagttatttactttgtggtaaactgggaactagaaagcttcacataattggaattacgttgggagttccttctcgtttggtgagcagggatgccgaaagcaaatgctcttgatgctcggtatagtttac

SEQ ID NO: 14619 - DNA, 252 bp, Triticum aestivum
  Clone ID: PAT_TA_14619
gattcggtccgggcggcggccagccctacgcaatcctgaggaagacaagtgcatgcgctttggaaatactgtccctttaattttctatacatactatccataagacaatgtagaggtacccatgcctctccgggctccaggatgggtatctcgtaaactctggcgtgcgtgtatgtatgggtggtgagagttgtcggcatacatttgaaaagtggactttctggttgtaattctagtcctgtctcttttttc

SEQ ID NO: 14620 - DNA, 1007 bp, Triticum aestivum
  Clone ID: PAT_TA_14620
attcggcacgagggttcagaaatccagggagcagtaccccacgtaaattgcaagaggggccttcactgagaaaatcagccagtgttggtgattggtcagtgaatgataagacaacgtctactaatcatcaacggaaggaactctgcaatagctctgtatctacatcaattctgattccccatcttcaaaaccttgtgaagcagactgcattccagcaagatctgattacgaacctactaagtagcttgcagcaaaatgagagagtcgatgctcagtcaagagttcagagcacagggagtgatacagtggttgaagctgctactgctgagagagaacactcgttacttgttaaaatttttgagttacaatctaggatgatttctttaaccgacgaattaattgcgacaaagctgaagcatcggcacctgcgagaagagctaaatgcactgtactgccaagaagaaatcgtggacatgagagaggacgaaaacgaagaagcatgatgtggtcaagcctcccttaaatactactaggagggggcctaaaagccacattgtcccgggcccatgcaagtgaggcctgattaactggctgcgtacaaggacttgaaggagcatttggtgcggagccagacaactccgagcgcaatcgaagaacctgcagtgagttttgaaggagcggggagacctctgcctctaaggggtttatcatcgttggccttagattgaactgttatgtatattcactcgacccggtgcgttcgagtttggtttgttgggtgagttttttaggcgtcttgcgatgtgttttcgttttgatcgcattcgcatctattattaagatggctaggacgccagcttctaatatagtagtagtttagacgtatagtaccattgtacttgtacttcagaagtcagaaagactgcaacaaataattgcatcgcgtctatagacagcggaatgcatgtgtagctactgtataaaaaaaaaaaaaaaaaaaaaaaaaa

SEQ ID NO: 14621 - DNA, 706 bp, Triticum aestivum
  Clone ID: PAT_TA_14621
gagggtaggtggagcgctggtggctgtgtcagtatggctctataagctttatgacagactagtagaagatgaagatcttccacagttagcatctgttgttgtattgagaggtgaaatggagaaaagcacaattacaagaggactgccaaccgccaaagttgtctactcttttctaaatgatacactatcagcatccttccacttcccaaaatggaacaagggacgaatcatatgcttgaagtcccaattgaaaaagctgcagtcagccgtagattcctcaaatgggtctcctgcagctggttttgtccccatgacgaactcccatttgccgtctcccgattccaagatatatacaagggaggaccaattgggaaatggtaccggccatttgcctgacgaaccgttggtagaggaaaaggagtcagagcttctcgcattgtgagttctaaggagctgctgccctttgcatctacagttgtgatgacatcacatcggtctgaacaaagggagactagatccagaataacagccatattttttggggagtttgctcattcagatctccgtctgagtactatggcacacgtccatacgcttttttgcggagtgtggctggcttcagttatcctggtcctcgtgggaaaggtgagttcagtatccacggtggatgctactgcagattcacatcttgcctgaaacttgtgag

SEQ ID NO: 14622 - DNA, 597 bp, Triticum aestivum
  Clone ID: PAT_TA_14622
ctccggcccagcctccgtcccagctccacaggccaggtccccatcgccgcggcgcttgccccacctctcccccgcccggtagtagcctcgccgccgttgccgagatggggttcgtgtccttcgtcgggagggtgctcttcgtcgccgctttcctcctctccgcctaccaggagtttaatgaattcggtgctgatggtggaccaggcagctaaggcccttcggcccaaattcaacgtgtttgtcaaaaatgtatctgctcatctggcagtacctgtgccacacgtggagctgtgccgcgcagtgtgctgctgcatgtgggtcctgcggcacttgggcttcagcctcttggttgtctcccttttctctcgggcgcctctctccgggctgctctcctgtgctttgaccttgccttgctccctcctctccttcatctccgctacggcgacggtatggagtacgcgctccttgcccagctcttcccgaggttcgccctggttggggccctgattggtgccctcctctgccttcccgccctgaacggctccgccccgaagcggccccgcggggagaacgccgccgggccgaagacgcaccccg

SEQ ID NO: 14623 - DNA, 561 bp, Triticum aestivum
  Clone ID: PAT_TA_14623
tttcggcacgaggcacaaataaacaccatatatccagctcgatcgatcgacgataaacaacaacacatggcgaagcagcagcagcaggcgatggcgctgctgatgatgctggtgctggctgcggagacggcgtcggcggcttcgtgcaacgcggggcagctgacggtgtgcgcgtcggcgatgttgtccggggcggcgccctcggcggcgtgctgctccaacctcaaggcgcagcaggggtgcttgtgccagttcgccaagaaccccgcctacgcgcgctacgtcaacagccccaacgcgcgcaagaccgtcgcctcctgcggcgtcgccctgccgcgctgctaattactcttacggtatatgggcgtatctgcgaggaataaaggatgggttattcgtccatgcactttgccgtctgcctggctgctcccatccctgcttatattatatatgctctcgtatatgcacgtttgtgtaatgtgtgcccatcgatataaatatatttatatatatatatatatataccggtccagtttgtaaaaaaaaaaaaaaaaaaaaaaa

SEQ ID NO: 14624 - DNA, 841 bp, Triticum aestivum
  Clone ID: PAT_TA_14624
ttttttttttttttttttttttttttttttttttggccgtgaactcggcccatgcatgctacttattattcttcacaagttcacatgtataatatgttcataacagttcatggatctctcggacacacgccagtttacaagccttccaacgtcctcggcgggtttaacccttggaaggcactgccgacgctttgcacactggacaccagttcttctgcctaagccactggccaatgcagcacacatggtaccagtgctcgcacggcagcctcccaacttcttcgccctccatgtactcttcctgacatatgctgcatttcatgtcatcaacggttgatttgctcacttctgaagcgacttgactatatatgcttcttctgaggcatttcgtgaactgctcttccgaaagagctgtgcttacagagcctattctctcttccagggccaataattcctcataggacatattatcaatatccatccgcatgtctctatgccgatcataggaggcaaaagcaccaaaaaatagattagtctccagcaccagcaattgcctttcagctcgagtattcgagcaacggcgacgactagatgagaaaatgttattatcaaattccacaaagaatggccttattgaactctcagtggagacttcttccaatgaaagatgttcctgagctggctgtacatttcttgtgggtgactcatgcagagaaagcataccatctgctctttcatcaggaacactcatcctagtggcatgaggagaaggccgtctcgtcctaactgaaactgctggttcctgatggtttctgctgcttctttgtggtatttgttgaga

SEQ ID NO: 14625 - DNA, 773 bp, Triticum aestivum
  unsure (1)..(773): unsure at all n locations
  Clone ID: PAT_TA_14625
tcggcacgaggggtcaaagaacatgaactcacagaagacttcccagatgttagctatttgtataaagagagtttagtaaagaagttggctgagaaaggatgctgggatattgcagaaactagggccaagaaggaaacaaaactcctggaatacctggtatatttagcaatggaagctggttatatggagaaagttgacgagctttgccagcgatactctcttgaaagttatgttgactctttggtcccggagaaggttttctgtgtatctgattacttggatctgaagaaattggatgtggaagaaattgtctgggttgatgagatcaatgggctgcttagtgcaacaagtaatattgaagcttgtaaaattattggcatggattgcgagtggagacctaatttcgagaaaaatactaaacctagtaaggtctcaatcatacaaattgcatcagataaggtagccttcattttcgatctgattaaactctatgaggatgacccaaaaacattggacagctgcttgaggcgtattatgtgttcatctaagatactaaagcttggctatgacattcaatgtgatcttcatcaactaacgcaatcctatggagaattggattgttttcagtcctatgaaatgctacttgatatgcagaagctgtttaaaggggttactggtggcctctctggattgtcgaaggaaatattangagctggtttgaataagtcccggcgtaatagcaactgggagcaacggccactaacccaaaatca

SEQ ID NO: 14626 - DNA, 921 bp, Triticum aestivum
  Clone ID: PAT_TA_14626
cctacgggaaggggaggctgcggggatgttagctgacatggttgggtcaagaggacattccttcgtgcgtagatggggttatttcgtgcgtcaatgtggctactggcggggagaactctatatatgctgcgagaacttttttgttatgagaatatcactttcaaacaatacgtaccaagcaattaggatgcccacagaagatgaattttatctgggaaaatcaatcaatgggatatactgtgcatccttatttcagggatcacaacttcaggtttggttccttaacgaccaatgtgttcatggtcagacagagtgggtgttgaagcatggcagagacatcttccccttcctgccaaatctgaactatgacgaacagtgtgatggtccttggatcttacaagatttttactattgccgacaagaagaacataatgcttgtggtgaagcttatgatgtggtgtacaacaacgaagcaatacttgaagagaaatttgtgtgggactctgacaatgataatgttctggaaccaggaagtaggtgcaaggattcttatatctattttcttggatttcatccgtacaaagaggttgtcttcttgagtgataaattcgaccgggtgttagcctataattggagtagctcaagggttcaagatttgggcaaggttttcccaaaattctatatagactggaatctccatttccaccatacactggtagcagcgtctttcccatacactccctgctggttgggagagctccctgagaaactgaatttagaagctcagctggaagattagaatgtgttcccttgcaagcaatttgaagatcctgtctgttcttttgatatttgtgtacacacattgctccctgcaaaactaaatttatatatctctagtttaaattaaaaaaaaaaaaaaaa

SEQ ID NO: 14627 - DNA, 678 bp, Triticum aestivum
  Clone ID: PAT_TA_14627
tccgcacgagcgcttctcccgtgccgtgaccctcggcgagaccatcatccccttcaaaggttctcctcgtcttcctcctgctctccctcccgctcgctgcaccgctgctagctggggcactaggcgacgcatacctcctcacgtcccggctcgcggggggtgccgctgcgctgcccgcagcgctccccgccccccccctcgtccccgccgacgggcctccgttcgcgccgccggcgccgccgccgcccccggcgccacccccgcccccccgccatcgcccccgtgagcgcccgcgggcgccgccggcgtcgccccccgcgccgcccgcgcctccgcctgctcccccgcgccatcacgctcgcccgccggctcaccctgcagggctccctgcgtcgcgccccgcgctcctcccggcgatcgggggtgtggcgacgatgttgcaaaccacgcccgcatatggccttttttttcccgtcaatctcgttgaaattgtatcgtttcgtgttaatttcgcgctttttatagtagcgcatgcttcctttcagctcaaaaccaccctaccttaatcatcgtttgcttgtccatgatttgcctaagccaagagatttttattttgttgacaattctctgccgccactttttgtaaatttcagtgaactgtaattttttatatttttt

SEQ ID NO: 14628 - DNA, 466 bp, Triticum aestivum
  Clone ID: PAT_TA_14628
cacgcgtccgcggacgcgtgggcgtccgcccacgcgtccgctccctcgctctggcgtctcccatcgccatcgcgtccaaaccctagccctcccaaactccaaaccctaccgccagtggtccaattcgctgcgccggctcgcgaatcgggcgtccgcgtgtcgcacccgcgctcccgattcagccgccgttcgtgcaagatctggcggatggagaccgcggcgccgaaggaggcgccgccgccccagccacagcccggggtggaggaggacgggacgctctccgcgacggcagctatggcaagggacgccgccgtgctgttccagagccgccggtacgccgagtgcgccgatgtgctcgcgcagctcctgctcaagaaggagggtgaccccaaggtccttcataatatggctatcgcagaatcgtttgtggatggttgtcctgatccaaaaaagctgcttgagattc

SEQ ID NO: 14629 - DNA, 466 bp, Triticum aestivum
  Clone ID: PAT_TA_14629
gattcggacgaggctcttccgccgccgctgacctgccccctcgccccgacgccggtgactaggagcaggagcaagagagattcgggatggccaagtcgaagaaccacacggcgcataaccagtcgtacaaggcgcacaagaacggcatcaagaagcccaagcgccaccgccagacctccaccaaggggatggacccgaagtttctgaggaacttgaggtactcaaggaagggcaacaagaagagtggtgaggctgaggcagaggagtaagatgggtggtggctgagtttgtggcgacaaatgcggctcttgtatcgctagagttttagttgtgaacttatttctcacttctgtatgatcaaaggagacctacagttggtacaatagtgtttttttcgatcttgttgcctatctggaattaattaaaaccatcagttgtccttttgcgaaaaaaaaaaaaaaaaaaa

SEQ ID NO: 14630 - DNA, 617 bp, Triticum aestivum
  Clone ID: PAT_TA_14630
gcgggtaaagaaacagattacgctcgaggccccctcgtcacaagcatcacctgcttcttccttcgcctgtgatccattcaaccgagagcatgtcttgctgcagcggcaactgcgggtgcggctccggctgccagtgcggcagcggttgcggcggctgcaagatgtcccctgacatggagaccaccgccaccgtcggcatgaagcccatggtgctcgctgcaccgaccaccaaggccagcgccggcgggttcgaggcggccgtcgagggtggcggctgcgactgcaacacctgcaagtgcggcagcagctgcggctgcagctgctgcagctgcaactgagccatcccggcgatggcgcacgaggaggaaggaggagacaaagacaacaaccacccccccagcgtactaaactatgtagcggcgtctaaataagatcctgtcaactgcgtgcgtgcaccgccattattcatgcatggtcgccggcctcttctccgtctccgatcctggggttgttcatctccaacgtctcgcggtttgacgattgccgtcgtcgtcgatcctatgtccgcctcgtgcctgatctaatatatgtgttttgctctgcattacctgtgcttt

SEQ ID NO: 14631 - DNA, 696 bp, Triticum aestivum
  Clone ID: PAT_TA_14631
gaggccggagcgtcaggataagaaaagagcgcggcggcaggcagctcctcctgcggctgcgagcgcccgtccatggcgtccctctccccttccctccacctcccctgcaattcaagaactggtttccttggaaagacacatgggattcgtcctcgtgttctccctgctggaagagtcggatttgtcagaacagtagtggaatgcaaggaatctagaattggaaagcaacccatcgaagtcccatcaaatgttactctcacattagaggagcaatttgtcaaagctaagggtccgcttggggagttatctctaagctttccaggtgatgtgaagattgtgaaagaagaatctggtatgctgagagtttataagactgcagagaccaagagggcaaaccagcatgcatggacttttcagaacactgacagaccacatcatcgttggtgtgtccaaaggattcgataagaagcttcagttagtgggtgtcgggtatcgtgcagcggtggagggcaacgatctcgtgatgaacctgggattctcccaccctgttcggatggccattcctgaaggcctggcggtcaaggtggaagagaacacgaggatcaccgtgagtggctacgacaagagcgcgatcggtcagtttgctgccactatcaagaagtggaggccacctgagccatacaagggaaagggtat

SEQ ID NO: 14632 - DNA, 704 bp, Triticum aestivum
  Clone ID: PAT_TA_14632
gagagcaagtcatgtataaagcaaaaacaaaatattggtctgctatcaaatggtacatttatttgaactctaaaggcaggttcagggtctcatgaagagggcatgtgtttgtattaggtgagatctgaactgattctgaccaatgtgaaattaattttgttgttgatggatctgcaattatttatgtgcacagaagtgccgtagttgagaagcctgagaagaatatatcacttaggtacagattcgagctagggtttttcattttgtccttccaatccatttatcatgcgataatttgcccataaaagacatacatgatggtcgtcgttggacatactatatttgtttacttctacccataaatttaaagtcctgaacatgtatattacacatctcttgcaggatatattaatattaaactatgtgtgcgttccactgcattcatctatttaaggcatgatatttgtaagcttggttcaggctgccacacatctatctatataatgcacaatatttctatgcttggttcaggttgtttccgacaaccattggcaatctgtccctatgtcattcctcttatatatacataagaactgtctacacagatcagagtgtgtgtatgaagggtcgtttccatttgtgttctgttccctttattgttttatcaatgtaaaacccttgacaattatccattcctttttcac

SEQ ID NO: 14633 - DNA, 667 bp, Triticum aestivum
  Clone ID: PAT_TA_14633
cggcacgagcttcgtcggcgctcgcagggccatcgagtgggacgaggaagaggaccacatcgagatcaccttcgacggtgaacccatcaacatagacacctccaacaatgcacggtgggtctccaggaccctagctggtctatccgtgaagcgcacggacgctgtcaactctgtcaaggtggatctcgcgggcgtgttcagcatctcggccagcgcggtgcccatcaccgacgaggactccaagatccacagctatggcaagaccatgaaggacagcctggtgcaccttgacctccgcttcaagtttcattccctcacagacgtcgtcgacggtgtccttggccaagacctaccggctggactatgtcaacaagatgaatgtcactgctaagatgcccatcatgggcggcgctccaaagtatctctcctcggggctcttctcgacggactgtgctgtctccaagttccaccgtagcggtggcgccaaccatgttcgtgccttggcagcataattgtaccccccagggggtcccgcatatctactctaccatggaataaggcagtgagtgacgccagcatcgtgtgagtgtaacgatctcacgatgataaaaatgataaataacccctatgaagctattattgtaaaatgaatgtgaaccgttaaaaa

SEQ ID NO: 14634 - DNA, 690 bp, Triticum aestivum
  Clone ID: PAT_TA_14634
cctcgtaagaaaccttaatccacaacagaagctttcgattcgatcccaccgaggagggaggaggaagaagaagaagacggaaatggcgtccgaggagggagtcgtgatcgcgtgccacaccaaggccgagttcgacgcccagatggccaaggccaaggaggccggcaagctggtggtcattgacttcaccgcctcctggtgtggtccttgccgcgccatcgctccactgtttgtcgagcacgccaagaagtacactcaagctgtcttcctgaaggtggacgtggacgaactgaaggaagttactgcagagtacaagatcgaggcgatgccgaccttccacttcatcaagaacggcgagacggtggagactatcgtcggtgccaggaaggacgagctcctggccctgatccagaagcataccgcgtccgcgtccgcgtaagaagatagtcagtcgtcgtcaataagggccagcgcatcgcatggctgtaaatgatgtcgttatcagtttggtttgtcatttgtgggcgattgtgaaccaatagtatgttccgatctgaataccttaaccatggatacttgttgtgagttgtgattttgactggtattggaatttggatgtctggcttcattttctgttggagtgcgactcttgaataaaccacattggtgatggcaaaaaaaaaaaaaaaa

SEQ ID NO: 14635 - DNA, 510 bp, Triticum aestivum
  Clone ID: PAT_TA_14635
gattcggacgaggcttgacggcagtcccatcgttcgcgtgtatgtctgaagtgaggtgcctggaggatctgcgcaagaaagagacgccctacaagaagatgaagccatccaggagttatgtggcattagacgaagagcaggactgtcatgtgccgcgcccggaccgcaggggttcttgcgcgaatctggtggctcggaagaacagcaaaaacatgctctacagacctcccgcaatccctgtaaacaagagtggataccatcagtaggctctaggacatgactgtgtttctatccagggtttcacctctgttcttttttttttgtcctttcatttagagggattttgttgacaagcgtattggcctgtctcagttgtaagaggttttccttctctgctctcaatagagtatctcctgtcttgttcatgagacattgattcatgtaaataactgtgatcctgtagccatatcgcaagatccaagtattttgtgatcggagtaaagaagagac

SEQ ID NO: 14636 - DNA, 819 bp, Triticum aestivum
  Clone ID: PAT_TA_14636
ctgcttctggtgtagagacagtagttgtcttccccaaaaatgctggcaaaattgtaccagcacggcacgaggctgaattactagttggtttgcaaaatgacggtgaatcaactttgaatgttgttgctgttcattcaactctccatcttccttttgaccatcgtatgtatggccagaaccttactgttcagaatttcttcaatgcatcagttcctgtttctgtgcaagcaaccttcccctataaatttgttgtgagcaagttcttgcagcctggagcctatgatctggttggttacatagtgtatgagatcgaccagcacccttaccagaatgtgttctacaatggcactgtcgaggtcgttgaggctggaggcttactcagtgttgagtcggtgttcctcatcacccttggaattgcacttcttggtctctttggattgtgggcatatggccaggttcagcagttctcgaagaaaacaaagaaggccccaaaggtggagctcggaactggaacaactgatgccaacatcgatgagtggctggagggcacttcgtttgtgcagagaagcaaatccaagaagaagcagacctgaggctctccagactagctaatccttttgagggtctagaatgaagcatttgagggtagcccttcacaagtgacttctgcagaaagatagatgcctaaggaggtgctgaaaactgtagtttcgtggtcgaacatctttgttgacaccatttttcgaccttgtgtacttcacatggaacttttcttcaaacaaagttttgttaaaaaaaggtaaaaaaaaaacgcacgag

SEQ ID NO: 14637 - DNA, 1159 bp, Triticum aestivum
  Clone ID: PAT_TA_14637
cggcaaaaccatgcaagagaggctgccgttccgtgtgattcggccgagcaaaggtgccctagccactctctcttgggcaaaggtgacatggccattagtcaagcggcaaggctcgccaccatgcttatgctactgccgttgctgctcatttcttgcggagtcgggagcatcctctgctcatcaatgacgacagtccatgataacagcacggacatgatctcgctgctagatttcaagcgggccatcaccaacgactcaagacaagccttgacatcttggcacgccagcgtccctctttgcagttgggagggcgtccactgcagctcggggcgagtcactaagctctacctcagccaacgagggttgttgggccggatatccccctccctgggcaacctaacgttccttaggacactggacctgtccaaaaatggcttcaccggtgagttacctcctctcaaccgtctccacagactggaataccttgacttgggaaagaactcactgcgagggaccattccagatactctcacaaactgctccaagctatggagcctagacctatctgccaacttactaatgggtgaaattcccctaggtataggtcgcctatccaatctaaggaaagtatggctttcctcaaataatctcaccggaacaatcccaccaagcctaagaaacaatagtcagcttgaagacatcgtgcttactgataataggttcatgggaaccattcctgatgagatgggaagtttcccatctcttgtttatttaggccttgctggaaatatgctatcaggtggaataccagaaaccctgtacaaatacaatcagtcttctctccaatatttatacttatattccaatatgcttgggaaaaacactgccatcgaactttgggtgacaccttcccagatcttaaacatctctgtttgggacaataacaattttgaaggtcatctccctgcttcactaggcaatatttcagggctaagactgttaaactttccttccaacaatttcattgggtcaagttccaggttctttgggtaatcctgaacagttagaatacctaatccctcagcgaaacaattttgggggcttcatcccaatagagcttggcggcttaaagcagctcacccatctggatctgtctgat

SEQ ID NO: 14638 - DNA, 1075 bp, Triticum aestivum
  Clone ID: PAT_TA_14638
ctactttctttatacaagaaattacagttttcagttcaagcattcgcctcaaaattggcctgacaaagttaacaacacgagagggggtaaaaatagtcccacagcttatcgaaaagccaatatcatgggcgatgatgcaaccaaagaaaaaagagtattcccacgtcctccacacaaatcaatgaacagcccatattcttctttagtcgaggatagtacaaacaatatctcgtgaagagtcagatatcctagcagcctcggcaatcctgagagccatgatggatttgtatgccgcgagctctgcgtttgtcatgagagactgggctctgttgcgcagtcgaatagctgtttctacagcctgttttgctgcacgttcagcttgggcaactctctgcaaagctgcctcctcttcagcattgtctcctcgtgccgaattcggcacgagggagagaactagtctcggagaaggaggcggcgctcgccgccgtgcccaacgacagcccaaccatatttgacggcaccagccaaaaggaaataccttctactgtggtttatgaggatgagaaggtactggctttcagggacataaaccctcaagctccaacacacatcctcatcatccccaaagtcaaggatggactaactggcctgtcaaaggctgaagagaggcacatagagatacttggctatcttctctatgttgccaaggttgttgcaaagcaggaaggacttgaagatggctatcgcgttgtcatcaatgatggcccaagtggatgtcaatctgtctaccacattcacgttcatctcctcggaggcaggcaaatgaactggcccccaggctaagaatatcttgttgttgatcagtcttcgtggcaaggattgctactccatttctccagaataatccctgtaatttccataaaagctagtgccaccttgtgctgtatttgtggaattaccggaagcatcctgctgtgatctatgaatgaacacaagaaacttgtacctggtatcatggattgacttatccttattgatcagctggaggttgtccactggccttgttagtctgctc

SEQ ID NO: 14639 - DNA, 889 bp, Triticum aestivum
  Clone ID: PAT_TA_14639
gcacgaggagagaactagtctcgctggccaaggggatcgaggcgtcgctcgatcccatgcctcggatcattaccccgacgcagatgatcgccaatgcaactggagttccattggagaatattctgtatctgggaggccctaacattgcatctgaaatctacaataaagagtacgcaaacgctcgcatctgtggagctgacaagtggaggaagcctctttctacatttctgcggcagcctcatttcattgtgtgggacaatagtgatctcatcactcatgaagtcatgggtggcttaaagaacatatatgccattggtgctggtatggtggcagcactgaccaacgagagcgcaacaagcaaagcagtgtacttttcactttgcacctctgaaatgatatacatcacccacctcctagcggaagagcccgagagactttccggaccactattagcagatacttatgttacactgctgaaaggtcgtaatgcttggtatggccataaattagctaaggcagaactgactctggaaatgggggacagcatcaaaggcaaagggactatacagggtgtctctgcagtcaatgcattttatgaactcctgagccaaggcagcataagcgtgacgcacccagaaaccaagaagcatgttgctcctgtcgagctgtgtccgatactcaaaacactttacaaaattttaatcaagagggagcttggtaccaagttccattcttgagggcgatacgccgatgaatcaatgtcctgatccacgggacagaattgagatggcacagcgccaatccctctaccggccatctctcctcggcctgcctaaaggcgatatcaagctgtagtagttgcagcctttatttacgcagaaatgctgtg

SEQ ID NO: 14640 - DNA, 892 bp, Triticum aestivum
  Clone ID: PAT_TA_14640
gccgctgccaatgacaaggacgaggcaaagaagagcgacaagcccaaggacggcgccggtaagcaggcggagccagccgccgtgacgacgacggagaggtccctgccttcgccgccggcgccggcgccgaagcgcgcgtacgagcaggagtaccggcagccgtactacgccccgcagccggtggtgagctaccacgcgtcgcacccgagctcgagcgtgtcgtacacgtacttcgcgccgcaggcacagccggcgtactccatgcagcaggcacacccgcagcaagcgtactactccacgcaccagccgcagccgtcgtactcgtactccgtgcagccgcagccgcagccggagaagcagtggtcgccgtcgtacctgtacatgccgtacccgcactcggcggcgccggagccttactaccagcagcaggaccactacagcccgcccgggatgcacgcgtcgccgatgcacgactcgtaccgcatcttcgacgacgagaaccccaactcctgcagcgtcatgtgagatcgatcgatcgcgttgatcgccgccggccgccgtggccagcaagtagttggggaggcggcgccgctaccgcaatagagacctctctgtggttgtaggtggagtagcctgttactgctctcttccactaattagtatagaggtcaaaccactctccatgacagagcttttcttttcgtttccttttaatatatttttactgttctaatcaagtaattagagcatgtaaatgttcgcctttacctgtagttactgttcaccgcgtctatatatgccggctactagctagaattttgtatatgagctaccacaaatacatacagtatataacagattatacataaaaacagttttctatagatagaga

SEQ ID NO: 14641 - DNA, 637 bp, Triticum aestivum
  Clone ID: PAT_TA_14641
gatccggcacgaggctccaatcgcgagtcttccggcaactaccaacgcacgacgagttttcttggcaagagaggaactaggagaaacccttccgcgtcccgttccaccggcgccgtcgactccaccggtgcacgccgtcgcgagctcctgtccgcgtcctcgttctccttgctgctggacccgctactggagatcgacctgattcctcccgtgctgtcaattggatattagccaggctttcaaggtagagaaagaagctttttgttccatcatggccttaccaactccggcacctgttttgtttaatgagaacctacagataaatggaggtaagagggctgatggactaagggccaaagggctgaagccatccgagaatcctggcaagcaagggaggagagctcttcagaatttgtccaacatttctagaggcactggtttgaaggacacttccaccctgaaagagaagtccaagcagaagcctcgtagtaatgtgaccaacactattaaaggcactgctttgaaggacaagcctatcctgaaagagaagtccactcagaaacagaggtcagaagctcttaagaacccactgaaaattttaactgatgaagagatcaaaatgtgccatgagtgggct

SEQ ID NO: 14642 - DNA, 717 bp, Triticum aestivum
  Clone ID: PAT_TA_14642
attcggcacgaggaaagtttcaacagaggttagtttcttcggttcatataattatataaaaatttgaaatataataaactaacctcatgagttacattaatttaatttctaaccaactgtacatgttcatccacttcatctgaatttttcagcacctgcacatttttttaaacaaatttatttgtattctttttttgcttgaaaatgccagattggaaagaaatgccagctagtaaatttttaaccttttattttgcttaccgtgttatcttgttgtatatccatattgtctgtctttgttgtcgattatcttgtgcaaatttacgtgcctgaaaatgcaaattcaatattgttcatgagcatgttcctggagctgtcaaaaataagttcaacctctattgcttgctcgtaaattatgagaactttcatatacatatgtttcatatgcagatgtttcatatctaaagtatgacaacttcttttaggcttccatgttgtagcatgataccatagttttaccaatgctcttttatgttgcttctaattcctaggtttaaaatgctaggttctaaatgtgtactttctgatttctgggaggtgttctgcataaactgtagttcaaccacctggtgaaaatgctaggttctaaatgtgtactttctgatttctgggaggtgttctgcataaactctagttgaaccacctggtgaaaatgct

SEQ ID NO: 14643 - DNA, 471 bp, Triticum aestivum
  Clone ID: PAT_TA_14643
cggcacgagggtttcctccgccgccgccgccgctgcttccgtcgtctccgcccgccgaagccatgccgtcccacaagacgttccggatcaagaagaagctggccaagaagatgcgccagaaccgccccatcccctactggatccgcatgcgcaccgacaacaccatcaggtacaacgccaagcgcaggcactggcgccgcaccaagctcggcttctgagcggtcggagagatgctagccaacgatgcttggggaggattagggctctgcaagctaggaagctcttgtttaagattttgcttgtgttattaaagggatcttatcagttgtgcttgtagtagcattctgagaatatcatgtttgtctgatggttaaagaacagcctttatgttatgctgaatttatttaacctgcagtgccttaattaattgatctcgagccaattatttcgccaaaaaaaaaaaaaaaaaaa

SEQ ID NO: 14644 - DNA, 560 bp, Triticum aestivum
  Clone ID: PAT_TA_14644
cgaggcctccagcaaatgtaggcaccatgcgtcctggtttggttggatattctggccctctggtttcaagacgaccgatgcctaatgtatccacccatgtctcacccccatcacacacagcatcgccacttccacgaccacctgctgccatgactcgcagttattccataccttcaaatagtcaacggactcctattattactgtggacaaattgttggaggctaggcatagcagggagagcagcgaagtttcctcacccccagtaacacctatatctctggcagatgtttctcgaagatcaacaacagaaacagttgttgacaagaaaaggataaaggaatccttgtgagcagttgagcaactgaacatgttgataatcttaggaaattttgtatgtagttgattgtgtattctatgatcccctctataatctctcgtgttcactgtgaaagaaaaaaaatgtaaataaggttagcattatattatctccttgatatgcttgtccgaactctattggatatagtgtattagtctgcaagagatcgtttgagaaaaaaaa

SEQ ID NO: 14645 - DNA, 621 bp, Triticum aestivum
  Clone ID: PAT_TA_14645
ctcgcatatagggtttatcttctcccctcctctgcccccatctcgcttctcgcacacggcagccggattccgaagcgcaccccctcggccccagccaaaagcatcgcagtttctaatcgtttggagagcacacaagaatgtcgttcgtgcagctctctggtgctggagtcgctgcagtggccttcacgaacaagagcctagtctctcggcacgcagcgctacgggtctgctcgtcgaggcgctcgatccgtagcctggtcgttaaggctgcaactgtcgtcaccccaaagtacacttcactgaagcctctgggagatagggtgcttgtgaagcttggctgccgcagaggagaagacagttggtggcattttgcttccatctactgcccagactaaaccacaaggaggtgaggttgttgctgttggagcaagaaggacatcgggggacaagaaatacttggtataaaaggcgccagagcaaatgcaaatatccaggactggtggatctggggcaaacgtctatctctaaaaacatacactggttctggaagacgatgtcgtcggtccccttgacgctgccgctgcgaaggccatgaagccccgcggtgaccgtgttctcatc

SEQ ID NO: 14646 - DNA, 989 bp, Triticum aestivum
  Clone ID: PAT_TA_14646
gctcaaagtgcgataaatgacttgaatgggaagtggcttggcaaccgtcaaattcgttgcaattgggcaacgaaaggtgccaatgctggtgaagagaaacagattgtggactccaaggttgacctgacaaatggcacatcagaatctggaaaagagaatccaaatgaagatggtcctgaaagtaaccctcagtttactactgtctatgttggcaatcttcctcacgaggctaccaacaatgatgtgcacctgtttttccattcacttggggctggctcaattgaggaagtccgtgtaactcgtgataaaggctttggttttgtaaggtacagcacccatgaggaggctgcgcaggcaattcagatggctaatggccaacttattggcgggaggcagataaagtgttcctggggaagcaaaccgactccaccggggacagcatcctcgcctctgcctcctccagcaccggcaccattctccactggagtgtcgccgacagacttcctggcataccagcgcatggccctgaacaagatggccacgaacccatccctaatgggtcagcacgccttgaatcaggtcgcactggggatgggtggccgagccagccagtccatctatgatggcggcttccagggcatcagtactgccgccgccacaacctccgcccagcaacagcagcagcagcagcagcagctcatgtactactagagtactactactccatgaggcaccagctacctatctcttaaagaggaaggcgaggatgaatggatgatgccccttgctacacccttatacatatagtagatgatgtactaccaggaccttttttataatcttttaagacccatctaagtaacatgtcctctctatgctagctatatatatctatatacaccctataacgtatgtatttctggatacatgaacaccccaaggttcttagtataatcttctgtgtttgaccaaaaaaaaaaaaaaaaaaa

SEQ ID NO: 14647 - DNA, 657 bp, Triticum aestivum
  Clone ID: PAT_TA_14647
gcggcgcgccgccctgcctttcgtggggtgtcttgtggagttttcctgagacccagtcacatcttcttgttactaccctgggcctgagctgctctgcctcgccgttcatcagggcctcggtctttggctggatgggggcgcccggctttgcgccctcctcgttcgtttgcctctggtcctccgcccttgccctcctgttccctgctcctggctcccctcacgtgggccggttcttcctcgccctgccgtacatggcgccatcggaggcctacgcgccgtggtggccccgcgcatgcaacggttccggcggtctcgtcttgccggctggtcgtcccctcctgttctaggttccaggaagcccccacatgtaccgttacatgctctcacagaggaagaaggcactatcaaaggccaaagcggcttaatgctgctcaagggctctgtagatggtttgtgtgatgtcgaaatgtgcctcacggctcaagttttcgacatttccggtagaatctagtgattggggatattattagaatggagctcttcatatgaactcccccgatccttcctcctctcggccggtgcctcgggttcttcgtacttggtccgaagcgccctccggcgggcgagttcccgccttgattatatggcaatgtgttt

SEQ ID NO: 14648 - DNA, 680 bp, Triticum aestivum
  Clone ID: PAT_TA_14648
ctcctccccacagcagcccggcgaaaaccctagtaagcaaaccaccggcgccgcggcgcttgcgcgggcggagccatggcggacgacgattacaacgacgtcgacatgggctacgaggacgagcccccaccaccggagattgaggaaggggctgaagaagagcctgagaacaacgaagatgcccctgatgacgtcataggtggtgagggtgaagagaaggagcaggaaaagaccaagcgcgagcgcaaaacatcgaaatacatgacgaagtacgaacgtgcgcgcatcctgggtactcgagccttgcagataagcatgaatgctccagtcatggttgagcttgagggtgaaactgaccctcttgaagattgcgatgaaggagctgagagcgcgcaagatacccttcacgatcaagacggtacctacctgatggaagctatgaagactggggagtagacgagctcatggtggaggactcctggaaacgccaggttggtggagactgaagacccggctctacttggcatttaaacgatatgtggtgcagcaggactttcctgtagttacaagtctttgttgcctctatgagtggatgctgtagtcaatgaaccaagatgaagtaatgctatgttaccttaacgtctgtggttgtcttgaactctgagaccgtaatgttagca

SEQ ID NO: 14649 - DNA, 489 bp, Triticum aestivum
  Clone ID: PAT_TA_14649
attcggcacgaggtgaaaacccaccgcaccatttcacctctcttccctaacctccccgcggcacagcggtttcactgctcccctcacctccgctcccgaacggccggtctttgcatggcagcagcagctagttccaaggggcgggcgatcgctggaagcttcgtcagccgcgtcctggccggcaaggccgcctccccgaggtactgagacgacgggccacaagcgggtttcagttttgccctccgattatggttttttgttcacctgctactgctactactgtgtttgaggatgcttgttcttgttcagttcgtccaagatctttggggtagtttagttgtagttgtagcagagcgatctgtttgcttatcgtagcttttgtggataactctgattcagtgtgctgctggtggcaagattttgctcagcagaaaatatactagaactcaggaacagcagaaaatctactagaaaaaaaaaaaaaaaaaa

SEQ ID NO: 14650 - DNA, 1338 bp, Triticum aestivum
  Clone ID: PAT_TA_14650
cggcacgaggccctcccataacccacacgggatcccggcaccctttccactcctccaggcaccagcggtcatggcggtggcctcagcctcgcccctcccctcggcgccgtcagccaagcccgccacggccccctcgcctctcgctccctcgtccgggttcctcgctctccgagcccgccgctgcggcgcaccgcgcctccgccccgccgccgccgcgtggaggaggcttcgcgtggaggcaatcaggacgcagcaggagaagcagcggacggaggtgcccgtcgaggagtccgccccagtcaggggcgccgccgcgcccctcgacggagtcggagcggacgaccccatggttgcttcctcggacgagagctgggtggtcaggctcgagcagtcgttcaacattttcgccacggaatcgatgattatgatactcgatggcgtgtaccgtgatcggaactacgccaggttttttgtgctcgagacgattgccagggtgccgtatttcgggttcatatcggtgcttcacctgtatgaaacctttggctggtggagacgagctgattatataaaggttcactttgcgcagagctggaacgagttccatcatctcttgatcatggaagaactgggtggcaacgctttatggattgatcgtttccttgcacggtttatggcgtttttttactacttcgtgactgttgcgatgtacatgctgagcccacgaatggcatatcacttttctgaatgtgtggagagacatgcctattccacctatgacaagttcctcaagctccatgaagaggaattgaaaagactaccagctccagaggcagcattgaactattacctgaatgaggacctttacttatttgatgagtttcagacagcaggagttccatgttctaggaggcctaaaatagataacttatatgatgtattcgtcaatgtacgagatgacgaggcagagcactgcaagacaatgaaggcctgccaaacacatggaaatcttcgttctcctcactcaatgcttgactgcttagaagttgattccgaatgtgtgatacctgaacctgaagacgattgtgaaggttttgtggactctgtcaaaaagtcccttacaaagtaaatagtatgtaaagcgctctttcgtgtgttttcaggcatcatggtatacaaagtacaaaattttgatgatatcctctattttttctttgtaactttttttaagtaaaatccaggtcatatatcacagaagtcattgtagatacagttgtgcaacattaatcaaatatctaacactgcatagatgagaacattgccaaaaaaaaaaaaaaaaaa

SEQ ID NO: 14651 - DNA, 843 bp, Triticum aestivum
  Clone ID: PAT_TA_14651
gtccattctccagataatacccctggtgatcttccacttactgtaaggccatccaaaattcccgccgcgggtctgaacatcatgccaaacaactcacatgcaaaatctgctccccgagaattgtttactgtcgcaactaaggaagacatcagcccttgctcaagttcaacagttggttgtgttgaaaagatcgaccagtctgagatatctgaacctaacccaccagcctgcttgatttcatcgcacacaagctcggtgcctgatgctgctgctgtgccagaagacaatggccttacagccataccacgttcagaaattaacacagaaaaatcgcagaggagtgcggttagtaatgattcaagcctgagctctgctttgggtccatccattccgagctttgaacaggagtttgtttgcaaggatgatgtgcaatccagtaagcatgggcagaatatggccacattccaaagtggtgaggataaatttactgtccaagagcttctctcatcgatgctaccatacgatccttcggtctcaacaccagaagatacgatgttggataagggacccaattctgttcagtctgtgaacatcctcacgtcgatgaagggtccagcaggtcctcatttaaacccactggttgatgatgccatgcggcaaatcaatttcaatgtcagcaatgagcagccaatatcagaaaatgttcaaggggagactcagaacatggatgtcagcaaacttctgaatgtggtaagagaagatctggaagtaagaagcagctcatgctcattaaactcactgccttctacacctcttccctcagttgcttccgaacagcatgct

SEQ ID NO: 14652 - DNA, 679 bp, Triticum aestivum
  Clone ID: PAT_TA_14652
ccgcgcgtcccccagccccacctccacacgcgctccaaccggcagcacccatggcacccaaggcggcggagaagaagccggtggccacggcagagaagaccaccgcggggaagaagcccaaggcggagaagcgggcgccggcgaccaaggaggccggcggcgaggggaagacgaggggccggaagaagggcagcaaggccaagaagggcgtggagacgtacaagatctacatcttcaaggtgctcaagcaggtgcacccggacatcggcatctcctccaaggccatgtccatcatgaactccttcatcaacgacatcttcgagaagctggccggggagtccgccaagctcgcccgctacaacaagaagcccaccatcacgtcccgggagatccagacctccgtccgcctcgtcctccccggcgagctcgccaagcacgccgtctctgagggcaccaaggccgtcaccaagttcacctcatcctaggctagtctgccgtgtccgtgaactgatggcggcattctgtatgtagtttagcagtaccatgttacaacctttgtaagaattgtgctgctgcctatggttctgaagaaacagtgatgtcgtttgaatcgccgttcatgtctgcctttctccgccacttcaactaagaaaggcacaaggctattgatgaaagaggt

SEQ ID NO: 14653 - DNA, 576 bp, Triticum aestivum
  unsure (1)..(576): unsure at all n locations
  Clone ID: PAT_TA_14653
gtcatgctctgggggttctgggagctcttcatgagccgcgactccgcgcacctcgtcaatgccgagggggacataaacgaggccggacgccgtctgctgcagctgaagaaggagtggctcacgcacgcacacggacacgctgatgagaatggagagttcaagtttcgggggcatcacggcgcgtaccacgtcgacgtggtcacgcccaccggctgcaagatcacgcaggagttcaccgtcgacaaggatgactcgcccatggtgctcaacatcaatgtgtgagcaacgcacgcgcgttccatcgataactcgatatatatatatgacagggaattaagccccagatactctatgaagcaatgctttatagcatacatgcaaatctaagcccggatcgatgtccgagaaataagggtttgtggaaattcttatgttcatcaacttgaatgtgctatatacacgcaaatatgtgagttttactgcatttttactgtgtgcttgtaagaaaataaagtgctagcgaaattaatatgtttgcctattanaaaaaaaaaaaaaaaaaaaaaaaaaaaaaaa

SEQ ID NO: 14654 - DNA, 856 bp, Triticum aestivum
  Clone ID: PAT_TA_14654
attcggacgagggccctccagatcataccgaacacctgccacttcagtagaacacacttgatctcaggcacaggaagttgatatcagaaaatgcaggctgccgctactgccgttgggttctcggccgtgctgcctgtcaaggcccggccggcggcgaggagcacggcggtggcccgcgtccctgccacaaggaggagcgtccgtaccgccgctgccgccgtcgtcgtcgcggagcctgcggaggtcgactacagctcgagcttctcggtgttcccgatggaggcctgcgacctgctcggcggcgacgcgtgcatcgggaagatgttcccggaggccaagctcgccgcggcggcgccggaggcgagcaggagggtggacgcggtggagagggactacctgtcctacgacgggccaaaaacggtgttcccaggcgaggcgtgcgacgacctcggcggcgagttctgcgaggcgccgtacatggacggcgtctccagggacgcctgaagcctcaagacctgacctgatccatccatgtctgtctgtccagactccacaaacaaaattggcctcactgtcgagtagatggatgatctcatgatccgttcacaccatgtacggtattgtgtataaacttacgtagttacacgtagtagatcccgggggagctagcgtgcgtgtgcgtacgttggtactctacagaataacagcagccaggcaaggccaaagggtgtatatatgtatgtcatgtatatatgtatgtatatgtatatatgtatgtcttggcctcttgggttttgtcagctgtgaaaaaacaaaaaaaaaaaaatggaacttacactacaaaaaaaaaaaaaaa

SEQ ID NO: 14655 - DNA, 571 bp, Triticum aestivum
  Clone ID: PAT_TA_14655
attcggcacgaggaaagatggcgtggcaaaactcgtttcaccctgccggcagcaagacttacgtgagagaatacagccattcaccaccctcgactctcctggaaggcaggggcactcagagcggtgcacatgttgatataatggggaactttgctctgattgaggacatcatcagaatagctgctggggcaaccggtgaggaaattggtggcgaccaggtttattcagatatattcaaatggtcagagaagatcaaattgaaattgtaacccatgggaagttaaagaagcgccaactcattgattgcgttccaaagtgattgcctgagtgcaactctctggattttgcttatataaatattgtaatttttcacacttcattcgtccctttcgcaaatttacattgacaggacgctgatgcgatgttgtaccactatttgggaaacgtacggcattgtatattaaaatgtacaggtgtaagttacatttgctagctgaaatcatgtagcccttttctttatggttaaagttcttatgtatttgcttggttaaaaaaaaaaaaaaaaaaaaaa

SEQ ID NO: 14656 - DNA, 686 bp, Triticum aestivum
  Clone ID: PAT_TA_14656
ctcgtgccgattcggcacgagcgccgctcctctccgcttccaagatgtcgaagcgaggacgtggaggttctgctggtaacaagttccggatgtcactgggtctaccagtggcagccactgtgaactgtgctgataacactggagccaagaacctttacatcatttctgtgaagggaatcaaggggcgccttaacaggcttccttctgcctgtgttggtgacatggttatggcaactgtgaagaagggaaagcctgaccttaggaagaaggtgatgccagctgtcattgtgaggcagcgcaagccatggcgccgaaaggatggtgtctacatgtactttgaagacaatgctggagtgattgtgaacccaaagggagagatgaaaggttctgcatcactggacccatcggaaaggagtgtgctgatctgtggcctaggattgcagcgcggcaaatgcgtttccaatggaaaatgttgtagaattcttaaatatattgtttgggttgcttggaattctttgttacttaattttcgacgtcgatgaacatttttgttttccggtcttttgtgcgctcccctcccttacttcctcccatccaaaccttccacctcaaccagtttttgcttagtcgaacattaaacaaaatttaagtgttataagttttgataaaaaaaaaaaaaaaaaaaa

SEQ ID NO: 14657 - DNA, 619 bp, Triticum aestivum
  Clone ID: PAT_TA_14657
agatggcgacggcgaggcgagcggagtggcgtacaagcggacgcagtcgatgccgacgaccccgacgacgccggtgacgccgtcgtcttcgtccccgacgacggcgacgacgacgacgccgcggggcagcaacgtgtggaggagcgtgttccacccggggagcaacctcgccaccaagagcctcggcgccaacctcttcgaccgcccccagcccaactcccccaccgtctaccactggctgtacagcgacgagacctggagcagccatcgctgaactgaataatcccattgatcggaggctggtcgatctctctgtcacgccatgtttgctggtccttgtggttatctaatacgtaattaattatctagtatgttgctatcttatcttgttactctgttcctagtagcttgctgtctctggtagtactaccagagaccggtacctgtcactctagcctgctggctcctatcaagggctagcgacaacccaaagaagagtgtttgtgtgtaaacatcttccatgtgtaaatactgccgagtgtttccctactttcatcgtttaattacctttgatgtgataataccaataccagcttgagataaaaaacagaaaaaaaaa

SEQ ID NO: 14658 - DNA, 596 bp, Triticum aestivum
  Clone ID: PAT_TA_14658
attcggcacgaggatccatccacattcataattttgcttgggtgagtgcgtgagggagaggccgcccaagcatagatctgccagttgcgttgttctccactgcacagttcgtcgtcggcgacggatcatcggcatgaagctcctgttccagtgcccctgctgcgcatgcttctgcttcgtcagggccaagaagcagagcagccaaggcaagcagggaggcgctggagatgacgggggcaaattccaagggaaacccacagatgtgtagctctggttttggttcttaatctgcaccactttgctcgcgtgcacgctggtcaagccagttcttatatatcttcagttctttcagcatggctagctttgctgttctacatgctcatgttagttgcttccttgtagcacgccctcatcatctgtctgttcaattcgccatgtagctactgtctttgtaattcatgacttgccaatcagaatgtttcgtgccttcgtattgtgattgtgtgtgtggtctgctctataaagggcgtagtaattatgcaatttggtggattccccctttgttagtctgccttttcaggttacattttctcctc

SEQ ID NO: 14659 - DNA, 361 bp, Triticum aestivum
  Clone ID: PAT_TA_14659
ggcacgaggcgatgtgcaggctcttgcatcccgatgctgtgaaggcatatgtccacataccggctaccaccgtatgttatcatatcatggatgatgctttaaaacatttgaatactttaatttgtctatggagttatggaccttaagcctttgctgatgttcggttgttcctacatcatgatgcctgcctgttttgtggatgatttctgattaacgtcggcagaccagtgaaatcagacattcaccgtccacctagacccgttagctttgttcggttatcaccgttgttgatacctgtctttttaaacctacctgattttatttgggtacctcgtcaactcaaaaaaaaaaaaaaaaaaaa

SEQ ID NO: 14660 - DNA, 603 bp, Triticum aestivum
  Clone ID: PAT_TA_14660
tcggcacgaggaactgggtaccatcctcatccagaagaacatacgttgtgccacacttcagatatcctagcgggagtactggtttccgtagataagacagtctggttgatgccagctgcattttgataattgcattggtgaggatgcgatggaatactgtgctaccattgacttgattgagtgaccactgcgattgccacgtgagggcctatgcataagaatataagatggataagaaaccaatatcagggctttgtatgcttcaaacgggaaggttaggaaatattaccgtctttttgtcgaatgagttcatagctggaattgtcctgcaagattgaagcgagatattcccagaagggacataggtttctgaaatttgagctaggccttgtttagttccgaaaaaatttcggatttcggcactgtagcactttcgtttgtttgtggtaaatattatccaattatagactaactatggtcaaaagattcgtctcgcgatttagagtcaaactgtgtgattagtttttgttttcgtctatatttaatgcttcgtgcatatgccgcaagattcgatgtgacatggaatcttgaaaactttttggg

SEQ ID NO: 14661 - DNA, 629 bp, Triticum aestivum
  Clone ID: PAT_TA_14661
ctgcgccatccacgccaagcgcgtcaccatcatgcccaaggacatccagctcgcacgccgcatccgcggcgagcgcgcgtaggcgtgtccggtaccaccagcgtcgtcctgaaggaggcggcgaagagggcggagatcaatttggaaccgtctggcttgttgatctccgccccgcgtttagtggatctgatgatgaagaacttagctcgctaaagtctgtattagcgtcgtcggttggtttggttagctgtgtaaaaatagatttacaagtctattttgtgccgtggttattttgtttgggtcgcttcgtcctgaagccatcctgttataaagactattagttggttattataattcgtgctgcaaatttttacactgttttgaatttgccatagtggcgtgtttggtacgaattggtttattgtggtggtgggtcgccggaatctgcggacgtggaacctggcgtcctgctttttgcgtggtttctaccgtgtcacgggcgccgccatggttttactgtagacaggcgactagtgcgaatctgtcatgtattgccctcaggcctttagctgtttggttttgggttgacggcagtttaccggcgtttgaaaaaaaaaaaaaaaaaaact

SEQ ID NO: 14662 - DNA, 1013 bp, Triticum aestivum
  Clone ID: PAT_TA_14662
gattcggacgaggcggtgttaattttgctcaagctggatgttcaatcacaccagcaaagccaacatcagtcagcccattttcatttggtctccagattaagcaattctttgccttcaaggataaagttactaagctcctgtctaaaggagatatgtacaggaaatatattcctcaggaagattacttttcagagggactctacatgtttgatattgggcaaaatgatcttgctggtcaattctattcaaaaacagaggaccaagtcattgcatccattccaactattttgttggaatttgaaaatggtctcaagaaactatatgaccaaggtgctaggaaattctggattcacaacacaggtcccctcggctgcttacctcaaaacatagccttgtttggcaaagacccatcccaattggatgagcttcactgtgtagcaaagcacaaccgtgctgcaaaacttttcaacatccagctgcatgcgctttgcacaaagttgagaggagaattcgctggagccagcataacttatgtggacatccacacaatcaaatacaacctgatcgccaactactctcgatatgggttcgagcatgccactcaagcatgctgtggatatggaggtccacccctgaactatgatggtaacgtaccatgtggacagacagtgtctgtgaatggtaagctggtaactgcaaaagggtgcagtgacactactgaattcgtcaattgggatggaatacactacacagaagctgcaaacttccatattgcatcgcagatcctgaccgggaaatactctgatcctccgtttgtggataagatgccattcgtcctaaaacctagattctgattagcatacacttacctttttcccctttactcaaccactttaacagcattggttgcagatacgatgtactccgtagttattacttgtcaataaccatatatagcatgatgtcaaaaataaaatcatatatggcttggtttcaaaaaaaaaaaaaaaaaa

SEQ ID NO: 14663 - DNA, 684 bp, Triticum aestivum
  Clone ID: PAT_TA_14663
aaatgatcacacacagaaccaacaaaaaccttagttccatatgaagctgcctaacagaatccataacatacatcgactaataaagcttcagcctgcttcaatttaatagtagagcgcgttcaggaatcaaaatcatgcaaattggttatttattgtagttggaaaagaactattgttaaagcagagcctgcggttaagaagttcataagtcttagacgcttctttttggcgtattgaatgtgcaggaattgatacaataaagtttcaataagatgtcatcattatatccattgtcaatttagctgatcattttttagcaaaaattctacgaaacttgtaacgtatcgtgttgaaaatctgtgaggaatagttaatgaccctttgacccaatacactttgatcattgataaatttctatgtgttagttgtcccgtgacacggatcacttgttcctggaacttccctagctgaaggagaaactggagaagtacattgacgaggcctcggcgactggatcatggagcccaaacgtgcttcgcaccaccacggatgcttgattgaaagaagggttggagcctcgctgcatcaccagggatttgaaatgggacgtccctgtcccacacgagaagtacaaggataagggcatgttgagctatacatggagtatatatctattgagttctg

SEQ ID NO: 14664 - DNA, 633 bp, Triticum aestivum
  Clone ID: PAT_TA_14664
gtgcggcccgtggccggctcgacctgagaattgaatactcctcctatcagagatgggttctctgatggctggctggaactcaccagttcttggtgatgagaagaaaggtacatgcaacaaattaacaatatgatcgatcgacgataacgaactgaatgggaagattatttccttagttatatatacgcacacaaataattcaatatgtattgatcggtcaatcgatctgtaattaattaatttgatctgtttttgttgagtatagttcggatgatgaggaaccgctcgctgaccagggaggaggtggacgcgttctggaggcgccagcaacggaagcagccaccgtcgtcgtcgacgtcgtcggagcccaacgccaccacctcgccgctcgcctctccccgcgccgccgccaacgtcgtctcgccgctcgcatcaccccgcgccgccggcgacatctcgcctttcgccgcctctcccggccgcgcgcagcaggagatgagtagtagtcgttgcacgttggcgttgaggaggctggagaggatgaactccatgccgtcaccgctggcgcgcaccgtcatgacgagggccgacgatcacccgtaccagtcgtactcccacagcgagccgccgtcg

SEQ ID NO: 14665 - DNA, 695 bp, Triticum aestivum
  Clone ID: PAT_TA_14665
tcggcacgaggatcacgaaacaaagcaaagcaaagcaaactcatttgccatggctaattgtggtgctcccatcatgctcatctccctcctcctcctatccctctctctccaacaagctcaaggtacgtaccagtacaaatcgactgtccatctggttgcatgtgttcttgatccacatgtatattaatccaataaggtcttgtttggatgtagtcggattcgcatcaatccacaagtgttgggtggattggagtggaacttaaactaaatttcaccctaatccactccaacacatgtggattgaggtgaatccaataacatccaaataaagcctgaccatgaaacgaacaacaaacaggaggcacgcagctgaagcagtccaacagcagacgaccgtcggcatcaccggaggaggaggaggaggaggagtacgtgccggtgaagagcgtggtgtaccggcggccatcgtcgtcgtccgtgctgccggcaacggcaacggcgacggaggcggtgtcgtcgtacgagccgttcgagctgtgccaggggtgccgttgctgctcgtcgtccaacgcgagcagctgcgtggacacgagctgctgctacgccatcgactgcgacctccccggcaagcccttcggcacctgcgccttcacgccccacacctgcggctgcggtaccggcaccggcaactgcac

SEQ ID NO: 14666 - DNA, 211 bp, Triticum aestivum
  Clone ID: PAT_TA_14666
cggcacgaggcctagctacacattgggtgacagggtgaggtagctcactagaaccgtgctctctttcggccccaaccaagtaggtagaagttcgcaggtgctctggagatgcttaaggacttcatttgtaaatacggagagttggaatggttcagctaaattattactaatttctagtaaaaaaaaaaaaaaaaaaaaaaaaaaaaaaaaa

SEQ ID NO: 14667 - DNA, 684 bp, Triticum aestivum
  Clone ID: PAT_TA_14667
gcacgaggcttgcgtctgttgcttgcgttctccgctcgtgttggtcagctacacgctgggtttttgtatctactatcacggagatctacacaacacgtcggaattttttgcatcttatacggagatctacaacgaagctacagcgagaatcccaaggtacaatcgttaattaagttgaaacaatcttttaagtcgtttcgtgttccttctattccacacgaagcctatgttcttattctgcgcttgcatgttcaaaatatgctgaaacaaccatgaatagccatcgaactgaagatcctaaaacaccctaccaacaacttccactccatcaacttccactttgcccagcacagttgaagttagtcttctataattgaagactggcatgaactcaacgaatcacgcgttattaatgattcaatgaacttcagaaggtgtaaaagtttaggttgcatctgcaaattatatttctgctgttgagcctgataatatcattcgtgtattatctgtaaaacccttttgtctgatggcactgcgtttctatttcatttgtatattatattttctgcaattttgtctggcctacttgctttggacttcattagaaatttatctgtaagcaactctatatttctgtatcttattattatcatgtctcggaaaaaaaaaaaaaaaaaaaaaaaa

SEQ ID NO: 14668 - DNA, 918 bp, Triticum aestivum
  Clone ID: PAT_TA_14668
gtttacctggactatcctttctttgaacaccagattcactggttctccattttcaattctttcatgatggttatttttctcactggtttggtttcaatgatattgatgcgaacactgagaaatgattatgcaaaatatgctcgtgatgatgatgatctagagtcactggagagagatgttaatgaggaatctgggtggaaacttgtccatggtgatgtatttcgtcctcctagaagcttgacacttctttctgctcttgttggtatcggcacccagctggcagctcttatcctacttgtgattgtattggccatcgttggcatgttatatgttgggcgaggggctatcatcacaaccttcatcgtgtgctatgctcttacatcttttatttctggatatgttagtgctggtctgtactcgaggaatggcggtaaaaactggataaaggctatgatccttaccgcacgcctctttccattcttgcactttgcaattggctttgcactgaatacaattgcaatcttctatgggtcattagcggcaataccatttggtacaatggttgtcatttttgtcctttgggctttcatatcttttccactggtgcttttgggaacggtcgttggtagaaactggagtggggctcctaacaatccctgccgagtaaagactattccccggcctattcccgagaggaagtggtaccttacaccttctgtcatctcattgatgggtgggctgcttccctttggcagcatcttcatcgagatgtactttgtgttcacatcattctggaactacaaggtgtattatgtttaccgcttcaatgtcgctggtctttgtcattcttctaatagttacaatctgtgtcacaattgtcggtactttatttttgctgaatgctgagaactatcattg

SEQ ID NO: 14669 - DNA, 2442 bp, Triticum aestivum
  Clone ID: PAT_TA_14669
gcacgaggccgcggtgaaatcgcgaggcggcagctctctcgggccaacccgaccgaaggctcgcgaccgcctcctcttcatcctcagatctcgccgccggcggaatgctcccctcctcccgcggcggcggccgcagacgcttcgtcctcctcctctcgctcaccgccgtcctcgccttcgcttctccgctccgcgcgttcgcctcagagtctgaccacaagtacaaagctggagattcagttaagctctgggtgaataaagttggaccttacaataatcctcaagaaacttacaattatcacagcctcccattttgtcaaccatctgagaaccctgggcataagtggggtggtcttggagaagtcctgggtgggaatgagttgattgatagtcagcttgacataaagttcttaagaaatgtggaaaggggatccatttgcacactggaactagatcccaagaagactcaacaatttgctgatgccattgaaagctcgtactggtttgaatttttcatagatgatctgcctctttggggttttgttggagagactgacaaaaacagtgaaaacaagcactatctttacacgcacaaaaacattcttgtaaagtacaacgataacaggataattcatgttaatctcacccaagagtctcctaagctccttgacgctggtaagaagttggacatgacatattcagtgaagtgggtaccaacagatgtttcatttgcacgccgttttgaagtttacctggactatcctttctttgaacaccagattcactggttctccattttcaattctttcatgatggttatttttctcactggtttggtttcaatgatattgatgcgaacactgagaaatgattatgcaaaatatgctcgtgatgatgatgatctagagtcactggagagagatgttaatgaggaatctgggtggaaacttgtccatggtgatgtatttcgtcctcctagaagcttgacacttctttctgctcttgttggtatcggcacccagctggcagctcttatcctacttgtgattgtattggccatcgttggcatgttatatgttgggtggggcccaagccgcactcctacctctcacctccttccgtgctggccttgcatgcagaacacttggcttgaaatacatgacaagctaaaaaagtggcatggtcgaccctattaataatacgtaaaaagatgaatgaagggcaggaatagctcgaggtgtgccggtccaccgttcacagttccagtcctctacgggtccgtggcggcctcgccaggtgcctccctggtcctcttctttgccctgtgggccttcactgcctttccactggtgcttttgggaacggtcgttggtagaaactggagtggggctcctaacaatccctgccgagtaaagactattccacggcctattcccgagaggaagtggtaccttacaccttctgtcatctcattgatgggtgggctgcttccctttggcagcatcttcatcgagatgtactttgtgttcacatcattctggaactacaaggtgtattatgtttacggcttcatgttgctggtctttgtcattcttctaatagttacaatctgtgtcacaattgtcggtacttatttcttgctgaatgctgagaactatcattggcaatggacctcgtttttctccgctgcatcaacagcgctatatgtgtacctgtactccatctactactatcatgtgaagacaaagatgtccggctttttccagacaagtttctactttggctacacattgatgttctgtcttggtctgggaatactttgcggtgctattggctatgtagggtcaactcttttcgtgaggagaatctacagaaacatcaaatgtgattaatttcctgctacacatgtggggtgggggtggagcagtatcagatcaaatcatatacgtggaagcgaggccttcgaaattgattaatgctagttcctgattagggtttcagaactacgtcaccattgcttattccatcacaccccttctttttgcatacttatttgttccctggagctggtctcatagtgtatacatctgtggtagctgaggagttcagtacaagtggctggtgcaggttcttatttttatttgtttcttgccttttttttgttgcattcctccttttcaaatgagaaagaaataggaagtgagtatccatgcggcaatgtctggacttcccctctgaatcgttacgtccaattcaaggatggcatgtactacgtgagatctgtgtatttatatacatatatcaacatttaatgcatgagagtatgtgtgctctctgacatgttcgaaaaaatcggtgaaaatccttccgatgttgtagtgcttttgtatctgcggtatttaatatttgcaacttttgaggtgacttgtgtgacaaaaaaaa

SEQ ID NO: 14670 - DNA, 1033 bp, Triticum aestivum
  Clone ID: PAT_TA_14670
tcggcacgaggttataaaataatattagttttgaaatttaattcgttatattatatttagttatttaagatttaaatttaatttaaaattttgaaagttattttaatttttttgattaatatttcaaatttaaattattttagggataagcttgaaatttttatataataatttatttattttaataatttataggaatagaaatttttatttaagtttgtaaaaatttattatttatttatttttaatttattataaattatttattattaatactgcagctgctccatcatcagccgatgaagtggtgctctgcttcccctcgccgcgtccggactcctcctcggcgtcctccgccgcgtccttggcctcctgcttgtcgtggtcctcgtggtacgcgtagccgccgctgccctccgccccctccgccgccacgccccccccgttcttgggccgcgccgcgggcgcctaataattagtcttttaattgaggacttgaatgaaagatttgatgagaaataaactttattatttatataattaaaattttatttttaagtaaaaaagcttaaattttttaaagggacgataagaccctataaaactttataaattttaattttaatttttttgggttaataaatattttatttttaaaatttattttattggggtgataaaaaaaattaataaactttttttaaaatttaacattatttaatgaattattgaattaaaatttttaattaaaggaaaaagttactttagggataacagcgtaattaattttttaagttcaaatttaaaaattagtttgcgacctcgatgttgaattaagattaatcttaggtgcaaaattttaagtattaggtctgttcgacctttaaattcttacatgatttgagttcaaaccggtgtaagccaggttggtttctatcttttaaaaattaatttattttagtacgaaaggattaaataattaaattaaatttttattaaatgaataaaattaatttaaaaaaaaaaaaaaaaa

SEQ ID NO: 14671 - DNA, 577 bp, Triticum aestivum
  Clone ID: PAT_TA_14671
gattcggcacgaggaccaagtcttctatttttcttgatgtgcaggtgtgttcaccgtttctggaatcatagattcatttgtataccatagtcaaagagcaatcaagaagaagatggaaatcggcaaattcaactgatgttgctttcccgattgctgcaattaagtagctccttttgcagctccaagttccagaaatgggtgaatcaatgcacagtggcttttgctctggaactcttggcacactagcatagtttacaaacaattgctcatcagataagtcttggtgagctttccaacttgcttccggcaaagataccagcgagcaagatggccatcgtgtacacttcgatatgttattcacacaagaaaatggaacaattcagaagtgctccatttttgtacgctctagtctaacaagaaaacattgtacttcagtgagctgcagaggtgttcgtgtactgttgtaaatttgtggtaggggggagcctatctgtattatttttctttttcttttttacaattattatgtgtctgtaccggttttttttcttgaaaaatatattaaaaaaacaatttt

SEQ ID NO: 14672 - DNA, 1150 bp, Triticum aestivum
  unsure (1)..(1150): unsure at all n locations
  Clone ID: PAT_TA_14672
gcacgcgtccgcccacgcgtccgctcgttccccacaccaacgcagccgccgccgcctcctctgctcgtttctcagcctcaccggatttggggagccaccgacgcgcaggacgcgccccgccgcgcctcccttcccacccacgcagctgcgggcgaggggtcctccagatccccagctgccgaggaccctgtcctcctcggcgtcagcgacggctacatgtccctcaagggcgtcatccaggtcgagagggccggccataccgacgcccagtccaagctcgtcttctacgttaatcctctcacccccacaggagagagagaaggagggagggaggccagcgagcaaggagagggagagagcaaagttgtctgctttgcttcgtgtacacccaatctccctcaacggagacctctccctctccccggagattcttctctctctcaatcccgatggaccagctggtgaatttcatcatccgcccgcccagagctgactacagtccagacgatgatctactggagcaggagtttatgctcaagggaagatggtttcagaggaaggacctggaggttgtatatggcctgggcttccgtgttgcgggggtagccgcttcactcctgctgcggttcccgatggccctgctcctcttgtgttgctttcggtcgcgcgatacactggaggcagagccctcccctgcggtcctcccggccgccttctaccatcaaatttacagtctttacactggacttttcagggctggtctctctgaaggagagcatgtcaccttggctggaatgaaaaaaaagatctgaaagcttgttgttaattatttgcggacagatgggaacatattttgcattgcttntggggggccgctaatggggggcggcacaagtntaatgttggangggnggatccatcaatgtggaaagggtcttggaagncattcttaccttgtgnttgatgangaactaagtgatcctacaannccctgccaaattacgggaaacttgnatcaccatgcggaaaatggaaaaaaacccctttcntanggttttgtcnttaggncaagcannttntctgnttnttggacnccctggggnnnttttctcccntntnaaaaattggananttgtgggaaaaaattnaa

SEQ ID NO: 14673 - DNA, 670 bp, Triticum aestivum
  Clone ID: PAT_TA_14673
tgcggcgccggcacgcggctttgtacaacgccctttgatagatatttgttcttgagcttcttcgtttttgcaccaaaagacaagcaggatgtcttgcagctgcggatcaagctgcaactgcggctcaagctgcaagtgcggcaagaagtaccccgacctggaggagaagagcaccgcggcgcaggccaccgtcgtcctgggtgtcgccccggagaagacagctgctgccgagttcgaggccgcggcggagtccggcgccgagacctcccacggctgcagctgcggtgacagctgcaagtgcaacccctgcaactgctgatcgaccgacgaccacacatggggaacgaagaccgacgatatgcatgctgctgcttatttgatggtgatatcgatcttgtgccggcgacgtacggtactactagctactacactacatgtagtgctctgcaattgtgttattgtgtgtgacgtatgtaactgatggttgaacaataaggacgagctagctatctgctatgtatttcgatctggctcgccagcatgcatatatatgcgatctatatatctgcccttgtgtgcctgatcgagagagagagtatacctcttttgcttaaaaaaaaaaaaaaaaaacttgtgctcttgcatttaattatgtgcatgtgtgtgtact

SEQ ID NO: 14674 - DNA, 759 bp, Triticum aestivum
  Clone ID: PAT_TA_14674
cggcacgaggctggattggaaaaaattcagccggcacttatggatggaaagcctgctagatcggtcgatttggctgaccatgagaaagaagctatccaacacctttgtctgctaactatgaaacctgtcatttatgttgccaacgtgactgaatctgatcttgctgaacctggtagcaaccctcatgtcaaagaggtggccaaaccagcatcagacttgcagtctggcatggttacaatatcagctcaggttgaggctgaactcgccgagctgcctctagaagagagagtcgaatatctaaaatcccttggtgttgctgaaagtggactaggaaatttggtaaaggcaacatatgaccttctggggttgaggacttatttcacaaccggagacaaggaaacaaaagcttggactattcttgcaggcatgactgcgcctcaagcagctggagttattcacagtgacttccagaaaggcttcattcgagctgaaactgtatcctatgatgatttgggcgccgcgccttcgcgtggcgtggcaagggcgctgggttggtgggggttgggtggcaggggtgtcatcctgcaggcacgcggtgtcatgcttttccggttcaacgtttgacaacaactcaacaataatagcagcagcgagaagtttcaatatatactcgaattttgcacaagagagaaacagatcatgggatttttttttgtctgagacattaactgtacttgcgtcattggaactttgcggcat

SEQ ID NO: 14675 - DNA, 552 bp, Triticum aestivum
  Clone ID: PAT_TA_14675
ttttttttttttttttttttgacagttcttctgtttctgtttgcctgaatggctgggtaaataatcgtgagaaatggccattcctttgttatacatggggaacaaatttactaattcgatgaaaaaataacctcagaaatagccatgaatgtaaactcaaaactgatgaatttccttaagacaacctcttgcctgacgatgccctaaatggcactaccgccaatcataaaaggaaggattatgccttgactacaaggaatccccagggatctgcgaagggtatatccttcaaaattgaatcataacggcttcatcttccttgtccataagtattttcaagcactggaacagcaggtccatatattctaaaacaacggtcattaagtgagctcactagtcgtgaaacaacttccttgaagaacatcgatgcaacctgacgataaagtggtgattgaaacttaaaatcgactaagaagtagaggtcacatgtccctggaacaggaccaggcttaaattcccaaacgtttatcaaatgatcaaaaagtccacttt

SEQ ID NO: 14676 - DNA, 543 bp, Triticum aestivum
  Clone ID: PAT_TA_14676
tttgagccacagagccacttgcctgagaggagcaataagaataatacatcatccatttggggccaacagtgatgcggcacgaggcttgcatttctgatgtcttttgctcggagacaaatcgttgaggctcccgtccaccacaaaatgaaccacccagaggatcattgtcctgaaacagatgcacttgcaattttgccttgtctgcagtgttagcctcaaatggttggcgtcacatctatctggattcaaagctgcaatgagctccaatgctcagaccatggggacttggttcagaatgagcgagctggtcctccagaatttagtgcctgatattagtggttaaaaacatataaaaaaagaaatctgcattgtaaatggcatctgcatttttgccctttgcttaggtccgacaattagatggtacaaagctcgagagaattgctggtgtttgatcgctattgatgactgttggtcgtttttgttcctttgtttctctaagccatgaattttctgtaaaatttgcactaaaaaaaaaaaaaaaaa

SEQ ID NO: 14677 - DNA, 791 bp, Triticum aestivum
  Clone ID: PAT_TA_14677
gcaggttcccgtgcaagcttcccacccgactcggtgaccccaatttcccaatgcttaccgacctgttcggcacgccgccccgtacaccctcacctgcgtcgctgcctcccctcgcctcgccagcccctcgccccctccgccgacccgccgccccctccaggcgcctccagatcggagcgaaggaaccccctgtttgcttcggggcaccagttcaccattcccatcaggagaagcaatgtcggcagtaatcacaaagttcgccgtcacatctatggtgatgtggatggccccagttgcaatcatgtatgggtttatctaccagatttttccaggtgtcggtcagctttccccctcggcgcaaactatggccagtggattccttgctgtcatctcggtcaatctggtgatcggcttttacatatacatggccatgaaggagactccccatcaagagccacagcctgatccaacctttctggcaaacgccaaagcaagcattaaccagccaacttcttctcaagtgagtgatgattcccatgggaagggggaggtggaggaggccctagcgtagcttgggttgggttttatgtccatgatacacatgctatccagagtcagttgggttatgtgcttttgtaatattacgtccttctagtttgatgtagttgctggaaactttcagggtgttggaagctatatgaagatgaatctatgtacccattatcagtagatactgtgttcaacctatttaattttgttatgatgttgagaaagactcttgatcataattc

SEQ ID NO: 14678 - DNA, 716 bp, Triticum aestivum
  Clone ID: PAT_TA_14678
gagggacgcgacaagcgcgaggagagagaggaacctgagcgaggcgcaccagtttcaattcaagcaatccctagcccgtggcgacgtggtgggaagtaattcgaatctgcggtgaagcctaggtgacggcgctgttactcgcctctcggggcgggccggcttgtccgatcggtttggctcggccatggcgactaaaaaggttctttgcaagttcttcatgcatggagcttgcttgaaaggagaatactgtgaattctcccacgactggagtgatcaagcaaataatgtttgcacattctaccagaaaggtgcatgctcgtatggtagccgttgcagatatgaccatgtcaaagtttctcgtaaccccacagtgccaccaccaccctcaacgtcaagtgctgcaagacgtgtcacatctaattctcttcaacttttaagttacagtcatgcacctcacacgggacaccaaactgattcaagcaaccaaagacatcagatatctgtggatgtgctggcacattctgccagtaagcctgcatggagaaatgattttcaacatgacattgtttctgatgatggaattgactggtcctctaatcgaaatttgctaaacgaaacatcattgaaacctgcggatctgcctatttgttcttttgctgctgctggtaattgtccttatggggaagggtgccctcaaatgcatggagatctgtgtg

SEQ ID NO: 14679 - DNA, 1001 bp, Triticum aestivum
  unsure (1)..(1001): unsure at all n locations
  Clone ID: PAT_TA_14679
gaggggacgacggagcggaatgctggcccggcacagcagctcgccggcggggttcttctccaacctcatggtggatgacggatatcctggctcgagaggcgccggagtagctggtggcagcagcggcggcgaagcccaccgtcacgccagtagcagcacgaagatgaagtcccagctgagcttcacggccggcggacaacagaccactgcccacctctcgcgtatctccgagggcgcctccttattccccagcgccgacgccgtccgcgctgccgcgcactcgggcagcgagcaccccgtgtcgcgttccttctcggccagcggcagtagcgggggcttctccatcgtagggccgtgggatgagtcgagggagatcatcggcaccctcgacctcggcggttacgagtctcagttcagtggcatggcgagctcgtcgtcgctggagctggcggggatggacaagtacatgcaggcgcagcagcagcaggaccaggtggcgttcaaggtgcgggccaagcgcggctgcgcgacgcacccgaggagcatcgccgagagggagcggaggacgaggatcagcgacaagctcaggaagctgcaggacctagtgcccaacatggacaagcaaacgagcacctccgacatgttggacctcgcggtggagcacatcaagggcctccagagccagctgcaggccatgaagcacgagcaggacaaatgcacctgctgcaacaagccttgaaggggaccaagaactgatcagcacaacgcaaaggatgacaccacctttacacgagagaaatgtacatgcatgcatgggtaatactaaatgagtacatggagctaaacggttcatactttcccaaccggcaaggtactggccgctcttcggccgcacccttccactcgtgccagtcttcggccctgtgttgcctatagcacgtccctgccacgaaantgattggacaattttgggtgaantttancatttganaaaaaaagan

SEQ ID NO: 14680 - DNA, 639 bp, Triticum aestivum
  Clone ID: PAT_TA_14680
tactacaggggtgcagttggagtcttgttagtatatgacataaccaagcgccagtcctttgatcatgtggctaggtggcttgaggaccgcccgggccatgctgataagcacattgttatcatgcttattggtaacaaatctgatctgggaacacttcgttctgtcgcaactgaagatgcaaaagagtttgctgagcgtgagaacctcttctttatggagacctctgcacttgaggctgtcaatgttgaaaatgctttcatgactgtactgacggagatttaccgggttgtcagcaagaaaaaccttgttgccaatgaggagtctgattctagtggaaactcgagtttactgaaaggaacaaagattgttgtccctggtcaagagccaccccctacatccaaggcaacatgttgtatgtcctcctaagcatgataatgtaccatgtcctctctggtagtcagttcctgattacttctgccatatctgcatgatgaatggctgggattcttggaagtaaagatgagaaagtctataggaacagttaactcatatacactgtaactatctggacgtcctttttgtatctgattatgtgatatagtgcattcattaagaaaaaaaaaaaaaaaaaaaaaaaaa

SEQ ID NO: 14681 - DNA, 729 bp, Triticum aestivum
  Clone ID: PAT_TA_14681
ttcggcacgaggcttgtttatatacacttcggtattcaccttatttcaagagatgcttcacctctccaatgtgttgggcctcaaaaatgtttagcattcagcactgatggtgctaagtttgctgttggtggtgaggatgggcgtctcagaatatttcattggccaagtctcaatgtgattttggacgaacctaaagctcacaaatccttactgtgacatggtacatctacgtaaaagaaatggggaagcatgcttatgttgctattacataaaaaatatccctatttcctgctgaattgatgcatgcattattaatttattacctcatgctttgtgttggctacttacatataggattctggtacaatgcacataataaaccttctagctgcctagtatcatggtagttttaatatagcttttgtcttaaaattccttgctcagaagagagggttactacacattggttacttttttgcaagccacagagcctaaattcatttctttaaccttacatcctgacacagtgcttgtccccttctcatgtagcttagactcaaagtttttagtttcatcatccattgatggctctgcaagaatatggaacattgatgagggggctccactaatcaatttgacaagatctttggatgagaagattgagtattgccgcttttctagggatggagccaaacctttcctgttttgcacacttgtaaaaggtcatga

SEQ ID NO: 14682 - DNA, 1104 bp, Triticum aestivum
  Clone ID: PAT_TA_14682
attcctctctgctttaaagcaggagaggatgccgattcactcggcctcaccggacgtgagcgctacaccatccacctccctaccagcaccgccgagctcagtccaggccaggacgtgaccgtcacaacccacgacggcagatccttcacttgcactcttccgcttgggacacacaggtatagtgctgcccatggggcccgtgcccgggccggcccgccccaagcccatcgtgcttccgtgccaaacgggttcgggcaaagaaagcccaaacaattttcgggccgtgccgtgccagcccgaagtgtcaaaacagttggcccagcccggccctaaaccacgccgtgccctgccttgggccgtcccggcccaagcccaggccgtggtcttgatccccggtgctgcgtatggctgtggcagctctcgtgcctctcctgccaagggaccaatgctactcggtgtcacgtcggtgattccaatgagcctcgtgcggctccaccggagccacttggttggaatggggatcattcctctctgctttaaagcaggagaggatgccgattcacttggcctcaccggacgtgagcgctacaccatccacctccctaccagcattgctgagatcagtcctggccaggacgtgacagtcacaacccacgacggcagatccttcatttgcactcttcgcttggacacacagcttgaggtgacatacttcaaccatggaggcatccttccctacatggtccgcaacctggcagcacagatgaaataagttaaagtttattggtgggaataaattaaaaggtagtttaatgccacgtatttggcgcatgtctgtaaataagtggcacgtgcaaatcttcacttgcgctcttcgctctggcattgaggtggatcggaactgccatatactttctccgcagcacatgggcatgaattttgttttagcaccgattatttgtactcttgattctttggttacatgccctcttcggtcctcctgatgttaatttgctttgcaaacaatatcagcgtgcctttgtagatttcgaaatagatatatatgtcctattgaaatttgctgtctattgttaaaaaaaaaaa

SEQ ID NO: 14683 - DNA, 851 bp, Triticum aestivum
  Clone ID: PAT_TA_14683
ttttttttttttttttttgataatcaataatcagatgcaccacacacacacacacaccaactttcctccaaggatcagaaagccaaatgctctgaactctctgaagcagctagacaagagagagaagatgataacctgatgatggttatttacaacgagctagcatagcactccatccaatataacaatgaataattgtgtatttgccggtcctgatgaccgatcgcgatcgataaatcataagcagaagaactagaatagcttgatgtgtttctgcatgcatgtatctactcccacaaaagggatgtgcagtacgtgtgtggtggctacactacactagtaccacatcaagtacgcgctagctagctagttcattcgcccacatgtatggatggatcgatcttgctttgatgagctagctagctgaggccattttgctttgttcttgtgagatcagcctgacttgagtgtgtcgatggcatgcgctagctcctcgatcttggcgccggtcacctccttgacgaccttcccacccttgaggatcttgaacgttggcacaacctttattcccagctcctttgcaagcggcttgttgtcctggttgcagtcgagcttgaggaagacaacatccaggttcttctcagacatctcctggaacttgggagccatcactttgcaaggcccgcaccattcggtgtacatgtcgaggacgacgaccttgtcgccggcggcctcgacgatgggccagaaggtgtccttgttgacctccgtgacctgcccggtgacggcctcagctcccaccgaggtgacgtctcgatcccgctcgacatcccggcgcgaggactccagct

SEQ ID NO: 14684 - DNA, 865 bp, Triticum aestivum
  Clone ID: PAT_TA_14684
agtttgttggggaggaaaaaatgacttgctggactatttgaggtcactaacaccagagaaggttgctgaactatcagagtctacatgtcccggcgtgcaagaagcaattcattctgtggttcatggtctgcttgccactctttctccccggctccacgcgaaggcccctccactgctagataacacttctggtggtgtcctaaaccttgggggtgaggatgatgaccgtgcagaacttgttgagaatgcttccctcccatttcagcccctaatatctgttccccgtgattaccttgcacgtttgctgttctggtgcatgctgctgggtcactacattcggggtctggaataccggttagagcttactcagcttctgcgaatatccagtgacgtgggttctttctctggtggtgatgatcatgttgtttgagggtaccacgtttactgatcttcctcaccgggaagaatggaaagacctggccaagaaatggccaaatggcagagccgcagaggtggccgttacactgcgctccctgtcaaaaggatgcccctaatacaagggggcactgctgagctatatagttctagttcctgtaaattcagaaaacagtagctcgggtgtaaagctagtgttacatatgcacgtgaactactttctttttcttcctttgatgttgtgccgtataacaaagaatctggtggttcgttggtgtttatctcgtggtagcatgataggcatccttgtattgtagttgtatgtatctggtggttgtgattgttgtccaatgtccatttaactcttgtgtctcttcttgattcgaataaagcttaacttttcattttttgcaaaaaaaaaaaaaaaaaa

SEQ ID NO: 14685 - DNA, 604 bp, Triticum aestivum
  Clone ID: PAT_TA_14685
gcgtgttgccccatcggtctatgagaaactaggaaagatcggaggagattcagcattgaatgactacctctcgactcatccgtccagcaagaagagagcgcagcttctgtcgcgagccagtgtcatgaacgaggcactggaactgtacagggaggttagtgccggccaaggcactgaaggtttcctctagattctcgtaattgctcctctgcttgtttcaaacgcctcacaaagctgcactagtgacgacctgtgcattgggcgttctcagtggttcagattcctggaagattagactgtactcttgctcctcgtaatttccagtcgttgtgaggccgaacgggccctcgtcgttccccaagcagaagcgtagctgcttttcatttgtgattagtgaggccgaacgggccctcgtcgttccccaagcagaagcgtagctgcttttcatttgtgattaggagaaataaataaagcagtccatattgttaataattgttagttgacagccgcttctgtttccagtgtggttttggtccgttcatgctgatggggcgatggctgaaccgggaaatgattggttttcagcaaaaaaaaaaaaaaaaaa

SEQ ID NO: 14686 - DNA, 575 bp, Triticum aestivum
  Clone ID: PAT_TA_14686
tgctggcctactccatttggttgtgaacatgctaagtttgctgtttattggaatccgccttgagcagcaatttggatttgtccgcattggtgccatatacctactgtctggttttggtggcagcgtgttgtctgcactcttcctacggaacaattacatctctgttggtgcttctggagctttatttggcctgcttgggtccatgctttctgagctactcatgaactggactatatactccaacaaggcagcagctataataacactcctgtttattgttgcactcaacttagctattgggatattacctcacgctgacaactttgctcacattggtggcttcgcgacgggtttcctcttgggttttgttctgttggcaaggcctcaatttagctggatggagcgccatgagttgccacagactaaccaacctcccaagtacaaagcgtaccagtatattttgtgggttgtggcactcgtcttgctgttagttgggtttgtggtttcactggtgatgcttttcaaagggaagaatgggaacgatggctgccactggtgccactacctgaactgcg

SEQ ID NO: 14687 - DNA, 1022 bp, Triticum aestivum
  Clone ID: PAT_TA_14687
ccgcctgcccgcccccgcctccaccgcctcccgcctggacgcgctcgccaccccccggccccccgccgccaccaccaccaccaccaccacccacgatcaacccgccgccacgccgcgaggccgcgacggcggggagcagcggaggagggggcaacaacggaggggggaggtggggcggggagaagcggaacgagcagcggcggggaggcggcggcggcgcgccccccctcgcggccttcgccaacgccaactccaggaacagcgggctataccccggcacgcagctcaagaagcaagaagatctctacaagtatgctaaagagattagcaagtacaaggaggcagaggcgcaccaaaatcagtcaaactatcctcctcaatttccaacccttgggaaaggaggtgctgatacaacggatgtgccaaaaccacatgataaggaggagaagcgtacttagcaaagcttgaatgtggagtacgagaagaaacgtgtagaggacgagaaggcagagaaggagcgggatgcgatgatacaggcaaagaaggaggagcgagagaggtctgaagcgaagagaaaggagcttagggagaagatgttcaagaggacgcgatccgggcagcctgtgatgaaatataggatcgagcatctactcgacactgcactagaaagctcagaccagagccaaggctagcccttgagagggtgaggagccaagaattgacgaagaaccataagatacttgagcagctagctgtggaggttgctactacataacactagccttttctttccaggtgaagagtatcaaggcaaatctagaggataaaggatatctatatcaagacatattctccattcttaagtgctgtgatgtttgcgtcaaaactgcagtttttttttggaaaaaacaccctggtccccctggtctggctttccggactttctgcagatgcttgtaccaccatacatgtagcaactgtgtggtgtcacatgcaaaaaaaaaaaaaaaaaaaaaaaaaaa

SEQ ID NO: 14688 - DNA, 1221 bp, Triticum aestivum
  Clone ID: PAT_TA_14688
ccgcttatcttatcccatcacccatttcttcctctttcctccctctctctctctctctctctctcttacacaagttgctgctgagttggtgttgtccttgttcctggacggacacatccgacatgtcgacggcggtggcgcggcccttcggcgggttccctggatcggggagggccaagggggatgagctgctcggcaagaagatgagcgacgggttcttcatcgaggaggaggaggaagaggaggcggaggaggtgctgacggagagctcctccatcggcgcgccgtcgccgtcgagctcttccatcggggaggactcctcgtcggaggttggtggcgaaggggaagacgaggaggtggagagcaagctcaaggaggagcccgggctcgggtgcctggacgccctggaggactccttgcccatcaagaacgggctgtcgagcttctacgccggcaagtccaagtccttcaccagcctcgcggaggcggcggcgcgggacgccgtgaaggagctcgccaagccggagaaccccttcaacaagcgccgccgcatcctggccacctggtcccgccgcgcctcctgcagctcgctggccacggccacctacctgcccccgctcctcgcccccgaccacgccctccccgagggcgacgaaggcgaggaggacgacgactccgactccggctccgacgagcagcaccgcggcaagaacgggtgggaggcgccggcattgccgcccccgaggctcagcgtgaacacccagaccggcgcatcggcggcgaggaggggcggcagcttcaggtcgccgagatcgtattcactgtcagatcttcgaaacggcggtgatgctagttataatcagtagctgcgaattcgcagccattgatctctcttgtgtcccatagatctgtcactactacttactccttaattatatataagtaagcaatcgcaagagcatgtgtaagtgtctaagctaaattcgttgtgttcttgtatccatcagttggatcccgttgacctcgctcacccgaatgtacgcagacatgtatgaactgctccggcgaactgagttcaccgaactgatccaacaccccggccatcattaactaatgatgaaccgtcctcaagataagattagttagtttaatggcattgctcccgatccctttgtgtacaaacatatatacaatttgttgatccaatttgatttgctggat

SEQ ID NO: 14689 - DNA, 790 bp, Triticum aestivum
  Clone ID: PAT_TA_14689
attcggacgagggggagctatagatgattcaaccatgatagtaactactgtgcatgacaagcagttagtggatgacattccagtggagaagctgctagttcatgatgtgccagttgacgttatctgcaccccaactcaggtcatcttcacaaagactacaatcccaaagccacaagggatttactgggagaagttgtctccagaaaagttgggccaaatccgaattctaagagagctgaagcaacgcatagagcaagagacaggaactatacttccttgtgggccttcagagaagctaccgccaacagctcagagaaggcagaggtggcggcggcgacgatgagacttttctgcccatcatcagcccacaactttatcgtgaagaaggtgctcaacgtcaggtggtaggagcaagcatcacctaaaagtttaaatgagggagcaaaatattccaaaccactccaatcctgtgttcaaaacactttgtccgaatttcacatgcattcttcagcatgaagccaacattctttggaattggaagttcaaactgcatcccagtcacacatgcctttgtaagttctcagaaaatcaatgctgctcgtgtgcaaagaggacagaaggtcatcaggcatgtatatattttcgatctgccattgtataacttgcaggagtcgtatacgtgacggtgtagacgtgtagctgaaactggaaagtgtaagttggccgtcatctgtaattctgtaaacaaacagaaggaactgttatacagttgggatactttatctttctc

SEQ ID NO: 14690 - DNA, 850 bp, Triticum aestivum
  unsure (1)..(850): unsure at all n locations
  Clone ID: PAT_TA_14690
accggtccggaatttccgggtcgacccacgcgtccgccactacttcagcagacacagttgataagctgatcaaagagaccaccactacttcaccacacacagttgacttgcgcaacagggcgggacaacataggtcagcagaaaatgttaagatgcaaagcacctccagtggccatgagaacaaaggaggtggcctcagtaatcacattgtagtggctttgccagcggtgagttatactgtccgccaagcgcggcgcgagtctctgttcgtgccccaaggaagactaagacggctgttaaggcatcatcggtggattcaagacangtgtaccacctatctcgccaagtggtaaacagtgaaccttcaatgcataaagcagagtctaatcctcatngtacgnacctagcaagtatgatcttgaccctgacaactgctggccatcgtccgcagtggcgtggggtggtattgtaccgtgcaatgcggggttgatgagtgcggagtcgcacgtggtcagtgagatgccccaacaacatgatggaaaatcttctaagcctccaagggcaaagagggcgagggtatcgacaggtaaatgctcgtcaaatttgaagaggacagagaaaaatggtggctcaatttgccaatcgccaactgtcacaatgatgccagatccgaacaacagttccaaagtcatcatggataagaaattggttgattcggaaatggtggatagtgttaatggatcctgttgttttgtgggggaggcagtgccggaggaggaggctagacagaggtggcctcaccgctacgagaagaatcatcactttgtggagaaggataagaagagcgata

SEQ ID NO: 14691 - DNA, 413 bp, Triticum aestivum
  Clone ID: PAT_TA_14691
cccttccaatgccgttgcttccatgacctacttcaaataggggagattagtttgcctattatcatcaactttggaccctctttacgtggcattttttccaaagcgtagctgtataaaataaaccgtgttggttttcagttttatatttgtccatggttttgctcacatcacaaattttgacagctagacagttcctgagttcggtgcaaccgaaacacttataatccagtccaacatagatagtttacccctattggacatgcatttatcttcctcgatgagtatggcagaatccaacatcctttcgtcctctaaattggggctccgtggctgccaaccgacggagcaagaccggagaccaccctctcctcctccaatttggagctccatggtcaccattcgacaggcacact

SEQ ID NO: 14692 - DNA, 624 bp, Triticum aestivum
  Clone ID: PAT_TA_14692
ttttccccaacacgcggacgcccaggaatcacccctaaaccctcgtccccccgccgccgaagccgacatggccgtccaccacctcctccgccgcgggatctctggtgggtctcccttccaccctctgcggggcctcctcctcgtatcgcaggagctcgggcggcgtcaggctagctcggcggcggccggggacgcggtggctgagctgaggggcgcgcgggaggacgtcaagcagctgctgaaggagaagtcctgccatcccatcctggttcgcttgggttggcatgacgctggtacttatgataagaacattagtgagtggcccaagtgtggtggagctaatggtagcttgaggtttgaaattgagttaaagcatgcggctaatgctggtcttgtgaatgctttgaaacttattcaagccatcaaggaaaaatatgcatgtgttacttatgcggatctgtttcagcttgccagtgctacagcctgtcgaggaagctggtggccccaaaatccccatgatctatggaaggggcttggatgttttcttgccccctgaacagtgcccaccagagggggagacctccctgctggtggtcccggcttcacctgctgaacatttgcgag

SEQ ID NO: 14693 - DNA, 1133 bp, Triticum aestivum
  unsure (1)..(1133): unsure at all n locations
  Clone ID: PAT_TA_14693
ggnagcacacacacttggacgatcaagaccagagcgcagcggctggggtaaacctgaaacaaaatacactaaaaatggacctggtgcacctggggggcaatcttggacatcacagtggctcaagtttgataacagctatttcaaggatgtcaaagaacgacgagacgaggacctcctagttctgcctactgatgctgtgctctttgaggattcatcattcaagatttatgctgaaaagtatgctgaggatcaggatacattttttgaagactacgctgaagctcatgctaaattgagcaatctggggtctaagtttgaccctcctaagggtgttttcttgcactatcactagactagctgatatttgctgctgatgaactgcattttggtgagtgaagatgacaaggctatgtttcttgcaactattttcgaggtgaacaaattcggatccaccgaagcagtattttgagttgtgtgctctattaccagaaataaaagcagcattggacagttcccggaccgaacatttatgatacttacatgttgtatgacacttcaaggtgatcaaatataaaacaatactatcaggctgttgcccctttgcgatatgtctggaacagaacggtacctagcaagcacactatgggatattttatttatctttttgtttgatgtttgatcatacaacataccaaccatcctgaagaggtgagctcatttccctcttgggaaccccaggatagcctgaatcatgtctcccagcttgccttcaagcactcctttgaggatcttgagccttggtgccgagtagggcgggtacctagccctggcctccccggcgaagcctcggttcatgactgccttcctgtggctgaaagcatcaaagctgaacttcccatggtaggagcctgtgccgctctccccaactcctccaaatggcaggtatgggtttgtgagatgtatgctggtgtcattgaagagcattcctcctgcagaaatggccccctcgaactggttctggagctcactgtccctggtgaagaggtaagctgcaagtggcttaaccattgagttgatgagaccaaagctttcatggatcttgtcaaccgtgatgatcggaagcaagggcccca

SEQ ID NO: 14694 - DNA, 2274 bp, Triticum aestivum
  Clone ID: PAT_TA_14694
ggactcaccactcacccctcgcccccacgccccctaaaccctcctcgcccacccgccgaagccgacatggccgcccacccctcgctccgccgccgcccctctggtcggtctcctcccccccctcctcgcgggcgcgcgctcggatggcagcgcgttcggcggcggcgggggactcggtggccgagcggaggggcgcgcgggaggacgtgaggcgcgcgggtggacgagaagtcctgccatcccatcctggttcgcttggggttggcatgacgctggtgcttatgacaaggtacatcaatgaagtggacccaaagtgtgggtggcagctaaggggtagcttgaggttttgaaatttgaggttataagcattcggctgatgctggtgttggtgaaggcatttgaatgcattattcaaaccatctaaaacacatatgcagatggtatttatgcgtatctgtttgatcttgcctgtgctacggccgatgaggaatctggtgacgctgaaatccccctgatctacggaaggagctgatgtatgtgcccctgaacaatgccccccagaggggagactccctgctgctggtccgtcttcacctgctgaacatttgcgagaaatattctacagaatgggcctgaatgacaaggaaattgttgcattgtcaggagcacacacacttggacgatcaagaccagagcgcagcggctggggtaaacctgaaacaaaatacactaaaaaatggacctggtgcacctggggggtaatctccgccggcacagtggctcaagtttgataaccgctatttcaaggatgtcaaagagcgccgcgacgcgggcctcctagttctgccgactgatggtgtggtctttgaggattcagccttcatgcatgattctgaaaattatgctgaagataaggatgcagtttttcccaagttaggcgaacgtgctactctccccaactcctccaaatctcagttatggctttgtgagatgtatgctggtgtcgttgaagagcattcctcctgcagaaatggccccctcgaactggttctggagctcactgtccctggtgaagaggtaagctgcaagtggcttagccattgagttgatgagaccgaagctttcatggatcttgtcaaccgtgaggatcggaagcaagggcccgaatatttcatccttcatgatggcggaatcgagagggacatctaggaatattgtaggggcgatcttcagctgctgttcatccctctgcccgccgaacacgatcttgtcggagaccatctcttcgtccatcaagcccttgagcctgccaaaatggctggcattcacgacgcgggacaagtccgctgatagcagtggatccttcccgtagaacttctccaaaacgttcttcaaagactcgagcagctttggggcaaaagcctgtgtggttatgatgaaatcaggagcaatgcaggcctggccattgttgcaaccccacttgccagcagcgatcctcttggcagcaatgtggagatcgacgtttgaatcgacaaccaccgggcatttgccaccgagctccaagacggccggcgtcagatgcttggccgctgcggccatcacgacgcgtccgactctactgttgcctgtgtagaagattttgtcccacttctggtttaggagcgcggtggtctccttgacgccgccctcgatgaccttgatgcaggtgccgtccacgaaccgcggcagcagctcagccagcagcgacgacatggctggtgccccctcagacggcttcagcgcaacggcgttgccggcggcgatcgcaccgatgaccgggtccagggacagcaagagagggtagttccaggcggagatgacgagcacgaggccgaggggctctggcgtaatcctcgccgtcgaggggaaattcatgagctttgcaggaaccttctggggtttcatccatttcttgagattcttcaaggcaaacaagcacgacgacttgatcagagatagctcgtggacgtgtgcttcggtcttgggcttgccgaggtcggcgtggagggcgtcgcatatctccgcctccatctccgtggccatccgcagaacccctcgcagctgcgccgcccgccactccgccggccgcgtctgccccgccgcgaacctcgcccggagctcctgcacagccgccgccggggactccaccatgttatatatgtaatctagctagctcctggtgaattacctgcaagcaagccagtaaggtcggtgatatggagggaaggaggaggc

SEQ ID NO: 14695 - DNA, 727 bp, Triticum aestivum
  Clone ID: PAT_TA_14695
gagggagaagtgtgatcgccgtactggtaaaactactgaagctaacccaaaggcaatcaaatctggagatgctgccatcatcaacttggtaccatccaagcccttgtgtgttgaagctttctcagaattccctcccttgggacgtttcgctgtgcgtgacatgaggcaaactgttgctgttggtgtcattaagagtgtaaacttcaaagatccatctgccggcaaagtaacaaaggccgctgaaaaggcccagaagaagaaatgaataggcgtagcagtagcgcacacacgtccttcagttaggtcaaacgaaagttggcataggtgtcagataccatcccaacttctaatactatccaaatggctgttacaaccttgttttcaccgtaaagaatttcgcaggaaaaaatcgtgttgtgctactcaatatcatgataactttgttttttattttttattttcaagaatttttaaattttgttttggttatgtttaactgagtgatagggatgacataattttaaaaatatttttttctagttaatgtatttatgatgcattataatttaaaaaatattttttttgaacttagtttatatcattctatgaagttataatttgtatcttttacatttatttttttaacatgattttaattactgcatctatgactacaatccatttggcccaactgaaagcattagccgccgtctatactttgtgttta

SEQ ID NO: 14696 - DNA, 875 bp, Triticum aestivum
  Clone ID: PAT_TA_14696
cggcacgaggccctgttctacaacccggcggcgacgaagatggccccgaacgacgtgttcggcgtggcgttcagcggcggcttcaaccagcccatcatgtgcggcggcgagccgaggcagatgacgctgcaggtccggggcaaagccgacccgcccatctacaccatcaggatacgcgtgccgcagcacgccgtaagcttgatcttctccttcaccaacggggccgagtgggacgggccgtacacgctcaagttcagggtccccaagccatggcagaacaagccgctgagcttcttcaacgagggcctggcggacgagctcaacagggagggcgcctgcgaccgggccatctacccggacgagaacatcgccatcaccagctgcgccatggacggctacctcgcaggaagggggggatcggtgcaagctggacatcgtgagcgggtgcatggaccccggctccgacatgttcgacccgctggccaccgtcgacgacggctcctgccccctcgagtctgattccgaggaatgaagccatgaaggagcttcagttcaatcctaggacacaaatgtctgtgattcatacagtttatcagcatacaaatgtctgtgatgtttgtcatcatgtgatacatcaagcatattatacgtgtatatgtatttaaccagactaccagagtaaacaaaaaaaaaacgcattgctgagcaagatgatctcatacttgcactagtggagttgtggatacttggtatcaatctttgcaaactctgatacaaaccagtctaaacagagcaaaatgtaaggccaaatatgccatgatctgatctgcatacttcctgctcagctacgctgtgaactacccttctgaatttgt

SEQ ID NO: 14697 - DNA, 846 bp, Triticum aestivum
  Clone ID: PAT_TA_14697
gtcttgagcagttcatacccatggattgcaagaaaagttctcactgacaactcacctaatcttcggtcaacattgtacacgctactttataaggatggcactttccagattgaccgtttggagtctttgttaaccgagtcgctccgcgccacgacgggccagccctgggtcagaactcaacaagatgatggtgacagttcgagatttgcaattaagcaagtcctgtcattcacactcgctgaccagggtgcctttgtgaaggatttacttcttcaggagattgctaagggactagatgcacttgggagtggccacattaagctctgcaacgtctgctgcagcctccagattgccattcgctggtgtcccatccccatcgccctcactggacgacgaggaggccaccaacttgagaaacctctaccgcctgctcctacttgtagctaaggctcctcagaagggaacccctcccccctgcccggcatgtaaccctgccgtggagggggatggtggcgccacggttggcctttcgcttgcgcggtatgaaggctcctctctgcctggctggcttccccgccttccgggctttcccgagctccccccggggtcccccccccgcctgcggcttctcccaccggttttttccgctcgggttgtacctcgggctgtcgcgtgtgccgttaggcgcctggccgggtttagcctaacgtccgcaaggtttccgtccctgcctccccattttgctttggcgattctttccgccccacctcttgaagaggcggaccactttggtctccctcctctccggatggtagcatctaatctagaacccaagatcaatctttt

SEQ ID NO: 14698 - DNA, 488 bp, Triticum aestivum
  Clone ID: PAT_TA_14698
cggcacgaggctgaaggaaacttagcattgtggacatcagaactaaccggaggtgaagcatccaaggataatgatgtcgacatggagggttgattgatatgtgctcccggaacacagaacacacgcaaagtatccaatctgcgctgctagcgaacccgggtcctcaagtttttctgcatcggaattcggaagatccccacttatttttctgaagttttctgttcctctgtttcggccatcgtttggccctagagtcagtgtccctactaagtgtttctcagaggtctggactggtgaccatccaacaagctttggtcatattttgtgagcttgtgctggtgaccacccagctctgatgttatgttgcttctttttttttcggtgcttcagaggcatctttgtacaccgatgacaaaatgtatctcttatcaatacattaaaagactgtcgctgtcgttattaatctagctaaaaaaaaaaaaaaaaaa

SEQ ID NO: 14699 - DNA, 1097 bp, Triticum aestivum
  unsure (1)..(1097): unsure at all n locations
  Clone ID: PAT_TA_14699
ctgcagattcggcacgagctcacatcctctagcagatgttgtatcctcagattacgcccatatgcatgaagaggaagatgagctcagggcacatggctctggcagtgatacagatttggatgatgaaagtccatcatgtcatcaagtctttctaatcccccgtctggggcctactgggtccctactgcctggtcgggagcgtcgtgaggacccagggaactttgaggcaccaggtgactcccttcctattgccggctctccaatgctctcgtcttctggccacccgcttcacccgatccgccggtggtgggggccccgtgccgcggtccagtgttctcccagggtgcgggttttcgcccttgctattgcagctgggttgtctcggccacgtggaccaccgcttctccaccccgcggtggtgcccaaagcatgcagtccacgagctagatattggccatgcctttaaagaaagatacacacggcaacaaagatcttggtcacgactaaatgtctcagagttggctggtcctattttaactgaaaggaaacctgatgctaggtgcatctgctggaagatgctagtacttgtcccaccaggtgccatgaaatctcaagagcaacaatgttgcctcaaagatggttactccaaaaagctcatgggttctggaaagttgaaagataatggattgcttcctacttccagcagacctcctccaattttggagaacgtggctcagttctcccgagtgtatgctgcctacctgttggccaaggccaatngaccaacaanttattgggnaacgaantggctggacanacaaactgtatatatttggggnaacctgaaanattccctggggaaatgcannaggnacatttacatccngttacctccatactcctcaactgtctcctcctcccgattttaatgggngccatatatgaaggnaagattaagcctcccaaatgccatgntaactgggtcaacgncgatgaagaaaatgctcacctggtgnttcaaccggaactgccnaagttaacaaaggttctnacatnnaactcaaaggttaatggngnaanatttcccacccgnnccc

SEQ ID NO: 14700 - DNA, 720 bp, Triticum aestivum
  unsure (1)..(720): unsure at all n locations
  Clone ID: PAT_TA_14700
cggcacggggcattgcgtcccgcctccccagctccccgcgtctccggcctgagcttgcgaacgcgcccggacatggcgatcaggggggtaccttcgcagcgggagatgacggtggcggagttcaaggagtggctgaagcagttcgacgcggacggcgacggccggatcagcagggccgagctccgcgaggccatccgcagccgcggcggctggttcaccaccctcagggccggccgcgccgtccgccgcgccgacagggacaagagcggcttcgtcgacgacgccgaggtggagaacctcgtcgccttcgcgcagaaggatctcggcatgaggatctctgcctggtagccgcctgcctaggctggctccatgggttttttatctgctgtgctatgctcgacctactgaatgaaaactactcaagtaaccaccatagtacagtacctgcctagcgtcgtgtgatatggttgagcttgacatgccaacttctcctgaataatattctttgtgtaaaatcaggaggcttaattaatggttcgcccctaagaaaaaaaatcacaatgggaaaattaataaggcacacgagggggccccaaaaaaattgcggggggcactaatatttttcgaggcgaggaagtancaagcaaccaccatagtacagttacctgtctagcgtcgtaagaanatgggtgaacttgacaatgccaacttcncctgaan

SEQ ID NO: 14701 - DNA, 742 bp, Triticum aestivum
  Clone ID: PAT_TA_14701
cggcacgaggctctactactactccccaccaagctggctgcctgactgcgtgctatggcccccaccgtgatggcctcctcggccacctccgtggctcccttccaggggctcaagtccaccgccggcctccccgtcagccgccgctccaccagcgccggcctcggcagcgtcagcaacggtggaaggatcagctgtatgcaggtgtggccgattgaaggcatcaagaagtttgagaccctgtcgtacctgccaccgctcacggtcgaggacctcttgaagcagatcgagtacctgctccggtccaaatgggtgccttgcctcgagtttagtaaggtcgggttcgtctaccgtgagaaccacaggtctcctgggtactatgatggcaggtactggaccatgtggaagctgcctatgttcggatgcactgatgccacccaggtgctcaaggagctcgaggaggccaagaaggcatatccagatgcatttgttcgcatcatcggcttcgacaacgtcaggcaggtgcagttgattagcttcatcgcctacaagcccccgggttgcgaggagtctggcggaaactaagctagttggcaagccagcaagctcactcgtgagctctatacagaggagactcgattgatctattcggatttggcagctttgaacgttcgtatcgggccaccttgctttggtttcccctttccttatgtaccatctcaatggcctctgctctaacacatat

SEQ ID NO: 14702 - DNA, 725 bp, Triticum aestivum
  Clone ID: PAT_TA_14702
ttttttttttttttttttgaagaaactgatgtgtatttactgtatacgtataaaatgttacatctgtacggatacagccgtattatttgcactattttcatacgagtacagcattcagaatttcagatccacagaggtccccatggctcctttggcatgaaatcaggtagctggacttgccattgccagtctgatgactggttctgctgcttccaagagaagcaggggcacttagcaacggtgctgttatgctgcgttttttccacaaagttcaagctgcgtgacattctgcgagactggctttcttagaatagggaaatcagatcttcaaggttctcgagatggaaatggttcttcttcagccttctgcggcgcgtgctgcttgtccaatactggttatgaaacaccacggtgtctgctggaacaggattcccatcatgatttctgttccactgatagacagcatgagtcctgtttttcagttgtaaaagtgaatgaccataactggcctccctgaacgctgagtagtctggctgggggtcataaaaccttgaagcaagtccttcctggttgcctccatcaccaactgttatgtaaacgggagcagatttgtttggcactggatatcgatttcccgatgttatgttgtagttgacattagaaatgcggtatgatctctcataagcatgaacatgccctgcaaataccaagtcgaccttgtactt

SEQ ID NO: 14703 - DNA, 350 bp, Triticum aestivum
  Clone ID: PAT_TA_14703
ttgtgcgagccagttcatactgaaatcagatatcttgtttttcttttccgaaggaaaggccttgcatattttctttgcaaggctactacactagaatcatcagagttctaacgaaaagccgtctgcagattttatcctgttccgcgtgccatttgtagatgccccacccttaccattctttttttttctgacagacactgccattgttggagtgacagaaatcaatagcaattcaggaaattattttgctccagaatacatgtatgcgtgtcttaagacctgttgacatggttgtgattttttgacacatacatcacctttttgaagtcaaaaaaaaaaaaaaaaaaaaa

SEQ ID NO: 14704 - DNA, 742 bp, Triticum aestivum
  Clone ID: PAT_TA_14704
cggcacgaggcagattctgcacacctgagagctgcccgacaatgacagctggcccaaagtacgagtacagatgggctgatggtgtgcagataaagaaacccatagaggtatcagcaccaaaatatgtggagtatctgatggattggattgaaggccagcttgacgatgaatccatatttcctcaaaaacttggcacgccatttccacaaaacttcaaggaagtagtgaagacaatattcaagcgcttgtttcgtgtctatgcccacatctaccactctcatttccagaagattgttagccttaaagaggaggcccatctcaatacctgtttcaagcacttcattctgtttacaaatgagtttggcctgattgacaagaaggagctggctccactccaggagctcatcgaatccatcatcgttccttactgataatacactactaaacatggatgcagagctctcaacgctgatggctgtgaaatttagtctattttcaacaatacttcactggctcattgcatagagcttcttgatccagttattagacataaaaggacatgctaatgctatatgtgcgtgtacctgtgtgtttcttcctgatcctgtattggcctgtgtgtttcttcctgatcctgtattggccatgtaagtgtgcctgttatcagctatagaacggtggtgatgtactgcagaaagaaaaacacaagaaagctgtgttggattaaaaaaaaaaaaaaaaa

SEQ ID NO: 14705 - DNA, 996 bp, Triticum aestivum
  Clone ID: PAT_TA_14705
ggtggcgctatttggtgtattcgatggccacggcgggaaaaacgcggcagagttcgctgctgagaacatgcccaagtttatggccgaggagttcaagaaggtaaacggtggagagatcgaaggagccgtcaagaggggttacctgaagacggacgaggagttcctgaagagggacgagagcgggggcgcgtgctgtgtcacagccgttctccaaaagggtggactggtcgtctccaatgctggagactgccgtgcggtgctcagccgagcagggaaggcggaggcactcacctctgaccaccgggcctctcgggaggacgagaaggagaggattgagaatttgggtggatttgtggtgaattaccgtggaacatggcgagtccagggctccctggcagtgtctaggggcattggggatggacacctaaagcagtgggttgtggctgacccagacaccaggacggtcctggttgaccagcagtgcgagttcttgatacttgcttctgatggcctctgggataagatcgataatcaggaggcagtagacctcgcacgacctctctgcattaacaatgacaagacctcgcgcatggctgcctgcaggatgctcactgagacatcgatttccaggggctcaactgatgacatcagtgtcgtgatcgtgcagctgcagaatttttcaagttcctaacctaattggagaaactggaccaaaactctagccagtagcgcactaacagactggtggaaagcaggataggtagacatcatgttacttcgctggcgaaagttttcattagtcggcattattttgtggggattttaacatccattctttatcgtagaaccattcggttcattatttgattcattctttatcgtagaaccattcggttcataatgcggggagatctctcgcttcatggtatcttactgtaaaaggcgatttgcctgtgtacaatgatatattcatagattaaaaaaaaaaaaaaaaaa

SEQ ID NO: 14706 - DNA, 316 bp, Triticum aestivum
  Clone ID: PAT_TA_14706
ttgggttgcaaagcacattgcaggcaactatcctgggcagtaagggtaagttggatgcttgggatggttcttttgttagtaccacatagaactttatatttgtggtctaagtatgcttgtaccttgctatgtggacgtcttgaacttgctatatattgtgtaagacttgaacttgatgcattgtgcaagcatcagacttgatattgctatgtgtaatgtgcctatggatatggcctaagacttttattgctaatatggcaagactttttatgtggttatattaaaaaaaaaaaaaaaaaaaaaaaaaaaaacttca

SEQ ID NO: 14707 - DNA, 769 bp, Triticum aestivum
  Clone ID: PAT_TA_14707
ttttttttttttttttttttttttttgttagccaagccaatatagatcggcattatttgatagttctttttttttctttggtttctttgccgggattatttggtcatatatacagaggtttctttgctctcttacgacaggtaatatactatgtacaaaagatatatgtacccagctatactatcatatacatcgcagccatgtcactgtagctaccttgcagccgtttcactgtagcttgcgtttgatgaacttatgggagttgctacggctgcagcgcagcgcagccacagccacagcaagttgatccgaacggaactatcaaatctccacactctcaatcagcttgatgcctgacgactccaagatctccaatgctggaatgtagatctccggttgcagaggcctgatcactccttttgtctggaccttattctgtagcaatagcagggctcctactgctgctggaataccaacggtcagggccatggcagtggtggatctgccattttcaaccttcccgaactccagtagcgtcgcttggtgcttctcggtgggttgcccgtctgggtattccacctcaacttcgtggtggagcagtaccatgtcttgctcattgtggccataggccatcctctgttcctttcgttggcaaatcacatcaaatgcacttgaacaacccttaggaatttgagtctcttcatgtagtcccaagaacttgatggttttgactgtcttagcagctatttccttatctctgcaacacccg

SEQ ID NO: 14708 - DNA, 625 bp, Triticum aestivum
  Clone ID: PAT_TA_14708
gtgcagaccatatcaagttactgtgaagacacgtcggctaggactagacctcttcagacttcaagggagattcgcaagatggaggggaagagcaggctgccggaggtgaccatcgtgccggcggcaaggccgttggctggcgacggcaccatcgacgcggcgaaggcagcggcagcgccgggcaaggagcccatcagccctggtactccgtcctcggcggacgccggccgccgcggcaaagagaggcgcgcggtggaggccgtcccgctccctgggtggaagctcgacgccctctgccaggagtcttgcccgtcgccgaccatgagggcgcgcttcccctacttctgaagcttcccgttgcagtcctgcatgagtttcgtttcgagcggcaacattgcatcttgtgctttggacgtctgactgatggcgttcttgggtgtttgcttgctcaggatttttctttcgtgcatcagtgtatccacatgcatgtattatgtatatatatgtattatgagtataaagatctgtgagctttgtgtcagattgcacagcacagatgatgaaccatcagttgatttcttgtatggttgtatctgacataatttgagcagtcccaatctaggaa

SEQ ID NO: 14709 - DNA, 758 bp, Triticum aestivum
  Clone ID: PAT_TA_14709
tcggcacgaggctcgccccctctcgctctccgacgactgttgggccaccgccgccgccctaaggcaggcgctgaggctttagttggtctcttggccggcgacgagcaaccaccaggtatttgatcgacaagcctcctaacttcgaagtttttgcaaaaagtattggtgtgcacccatgtctctttactggatccgcccctgattcagcaccactaactccaagtggcgatcaccggggcagagcaatctggggcccagaatgcttgggatatgctatctgatgagcagtcacagaaacacatcactactggtgctggtgacctcaatgacatacttggtggcgggattcactgcaaagaagttactgagatcggtggtgtcccaggggttggtaaaactcaactggggattcaactagcaatcaatgtacaaatcccagtggaatatggtggccttggtgggaaagcagtttatatcgatacagaaggaagtttcatggttgaacgtgtctaccagattgctgaagggtgtatcagggacatactggagcactttccgcacagccatgagaagtcctcttctggcaaaaaacaattacagcctgagcatttcctggcggacatctattacttccgaatatgcagttacaccgaacaaattgcagtcataaactacctggaaaagttcctcggagagcataaagatgtgcgtattgttatcattgatagtgttactttccactttcgacaagattttga

SEQ ID NO: 14710 - DNA, 974 bp, Triticum aestivum
  Clone ID: PAT_TA_14710
gaggctagtttggtcggtagttttgttcagtttctagacgggttaagttaatcccctgtcatctaaaactatttttttttaatgtttcctggagtcgtagagcactggataacacaattatgaattaaaacaaggtcgtagccggggacccacactgtcatggacgctatcatactctagaacatgcttttgaaaactgtcgtcttagcaaactaggtcgctcttagatggcaccgtgtctaatgtttttttaataaaaaaaatactgatatactgctttggtaattaacgctacaagagaatcgaattatatgcgtcgtgaaaagtgacatttaggtggcagtatatacaatgtgaataccccgacgacttataacgaagtagtagcacaactaatcagggccttatcacttatcagcacttgctgctttggatgaaagcaatttaagcttgtacattataatctccgtcgtacataccatcatttgttaccaaggatcactaaattaaaatttggtggttgctcctatcagctcttcctggacgacagcgagaggaacatcaccgctgggaaagcgctcggcctccgcaccgccctggttggcaagagggtgaggagcaaggacgcagactacgcgctggagaacatcggcgcgctccggcgggtcatcccggagatctggggcgtcgtcgccggcggcgagagtgaacgatcggaccacagcattgacaagatgccgatgaggtccgacctggactccatcatccagcccacgtccatccaggcctaataacctcatcccacccaacttcataaataatcaatcagtcagaatcatgggatgccactaataaatcaaatctccatcgtctctctctctctcaccacctaatcgatcatcatgtacattattctgattcctgatgtgcgtccgtgcgcgcgtgtgtgtgtgaatatctatctgtacctatct

SEQ ID NO: 14711 - DNA, 755 bp, Triticum aestivum
  unsure (1)..(755): unsure at all n locations
  Clone ID: PAT_TA_14711
agnnngngtgtttttcatcgcccgaaattaaccctactaaagggaacaaaagctggagctccaccgcggtggcggccgctctagaactagtggatcccccgggctgcaggaattcgtccgcccgccgccgtcgccgacgccctcgcgcccctcaccgacgtcacccacgtcttctacgtcgcctgggaccctcgccccacgcacgcggagggccgcgaggccaacggcgccatgctccgcaacgtcctctccgccctcgtccccaactgccccggcctgctccacgtctgcctccagaccggccgcaagcactacgtcgacccgttcgagcccctcaccgacgtgcccctcgcgctccgcccctactccgaggacctcccgcgcctcgactaccccgacctagaggatgtcctcctcgacgggctcgccagcaacaaccgcgtcacctggtccgtgcaccgccccaccaccatcttcggcttctccccacggagcgcaagaaacgtcgtcgccagcctctgcgtctacgccgccatctgcggcaaggagggcctcgtgctgcgctggccaggatcccgtgtcgcctgggagggcttcagcgacgcctccgacgcggagctcgtcgccgagcacgcactctgggcggccatggaagcccaatgggcaggaacgaacccttcaactgcagcaacggggaccctcttcaagtggcagcagctatggcccgatcctcgccagccaattggccaaatttn

SEQ ID NO: 14712 - DNA, 943 bp, Triticum aestivum
  Clone ID: PAT_TA_14712
tcggacgagggctagcagagaatatagagagatagagagaagctagggcaataaggtcgtcgttgatggctccgatgaagctgtacggtgcgacggtgtcgtggaacgtgacccggtgcgtggtggcgctggaggaggccggcgccgagtaccagatcgtacctatcgatttcgccaccgccgagcacaagagccccgaacacctcgcccgcaacccgttcggtcaagttccagctttccaagatggcgatctccacctatgggaatcgcgtgcgatttgcaagtacgttgcccgcaagaacaaggcagcagagctgctgagggaaggcaacctccaggagtcagccatggtggacgtgtggctggaggtggagtccaaccagtacaccgccgccctgaaccctatcctgtacgagtgcctcgtcagccctatgttcggcggcaccaccgaccagaaagtggtggaggagaacctggagaagctgaagaaggtgctggaggtgtacgaggcgcggctcgccaagcacaagtacctcgccggagacttcctcagcctcgccgacctcaaccacgtctccgtcacgctttgcctgctcgcgacgccccatgcttctgtgctcaacgcgtaccctcacgtcaaggcatggtgggatggcctcatggccaggccgtctgtccagaaggtcgccgcgctcatgaagccgtctgcttgaaattagtgatcgagtcttccttcgttcactgcttggcttaatataaataagcccatcgacccctgtgtgtcctcgttctcgatcggcatgtgtcatccaggtgttgaataagaagctagctagccgatcgagttgcatgcatgttttcgtgtctttgagaataatattaagctatgtgtttggtataaaaaaaaaaaaaaaaaaaaaaaaaaaaaaaaaaaaaaaaaaaa

SEQ ID NO: 14713 - DNA, 973 bp, Triticum aestivum
  Clone ID: PAT_TA_14713
cggacgcgtgggctacatctcgacgggagatgacctgatcgccatcaagagtggatgggatgaatatggcatagcctacggtcggcccagctcagacattaccattaggcggatcacgggctcctcaccttttgctggcttttctgtcgggagtgagacctctggtggtgtggagaatgtcctggctgagcatctgaatttctacagctcagggtttggtgttcacatcaagaccaactccggcaggggagggttcatccgaaacatcaccgtctccgacgtggtcttggacaatgtccgttatggtctaaggattgccggtgatgttggaggacatcctgatgagcgctacaaccacaatgcgctcccaatagtggacagcctgacgataaagaatgttcttggacaaagtgtcagggaggctgggcagtgccggggcattccgaactcggcgttctcccggatctgcctgtctaacgctccccatcgtggcagcgctcccgttaaagaatggtcaagggcagaagtgcaaggtggtggggctgatcaagggcatcccaaactcggcattctcccggatccgtccgtctaacattaagctccatggcagcgcgccagtccgcccatggaaatgcgcggctgtgagtggtggtgcactcgacgtgcagccctccccgtgcacagaattgactagcacgtccgggatgagcttctgtacaaattccctctgatgctgaatcaagtcttgcacttcagtttcggtgtgtcaatgcccttgattcctccaatgagatgacatcaaagggtaggccaaacaatttttgttttgtttattacgtattatatcactggaatctagtagttcaacaagtgaaatgttatccggtggttcaatacttgtccacaaaactgttcagtttgtgttagcgaatcatgtttagttctgcatttcaaccgttggcgttgagctgat

SEQ ID NO: 14714 - DNA, 637 bp, Triticum aestivum
  Clone ID: PAT_TA_14714
ctgtcgatcgatcgatagattattcgattatacgatcgcccggctcggtgggccgaggctctaattaaccatctctcgacctcacctcacgctccctaactaacaatggctcactaccaggaggtggactactgctcggaggaggtgaggtcggtgacccccaccggcggcttcctcggccgcggcggcgtgcagcagcacgtcgtcaaggagacgttccaggagatcgacaggtccggctccggccgccaccaccacgaccacaaccacaaccacaaccacaaccacggcaacgactacctgacggtgcgcgagaccaaggtggaggaggacttcaacacctgcaccggcgagttccgcgagcgcaagcagagcttcctgctcaagtccgactgatcgaacctgctgtgtgtacccgtgtacgtacgtacgtatatgtgtgcccgtacgtagtcgtggtggtcatgtgatggcttagctctacgtgtatatcatgcgtgcgtgtgtacgtgcgtacacggagcttagctaattagcaccttcttctctgtgcgaacggaggaggggtatgaaaaataaattcgtgacctgaatataataaagcctgtcctaattatcaccaaaaaaaaaaaaaaaa

SEQ ID NO: 14715 - DNA, 357 bp, Triticum aestivum
  Clone ID: PAT_TA_14715
agtatgtcattaaaagacctttggctattaaggaaggaaagacaaaacaacattttaaggccccaaaaatccaacgtctcattactcctgtccgtctccagcgtaaacgtcataatttggcattaaagaagaagcgttgcttaaaacgtaaagaacaggctactgaatacgccaagcttcttgcacatagacaaaaggaaaagttggcaaagaaacgtgctgaacaaagccgtaaacgtactatgtctcaatcatctgtttctagttctggcacaaagagcagtaaaaaatagaaatggttaaataaaacattttttttatccataaaaaaaaaaaaaaaaaaaaaaaaaaaaaaaa

SEQ ID NO: 14716 - DNA, 902 bp, Triticum aestivum
  Clone ID: PAT_TA_14716
gctctcccctggccaagaactcttaacgaaaatgtcagaggccgacgtgcgtgtgatcgggctatggccgagcccgttcgtgatccgcgtcctgatcgcgctgaagctgaagggcgtcgagtacgagctcgtggaggaggtggtgggcaagaagagcgagctgctgctgaggtcgaacccggtgcacaagaagatccccgtcctgctccaccacggcaagcccatctccgagtctctcatcatcgtccagtacatcgacgaggtctggtcctccgacacgccggccttcctcctccccgccgacccctacacccgtgccgtccatcggttctgggcacagtacgtcgatgacaagctgcctccggcgatccgcatactgaggggaacggacggcgggggcatggaccaggcggcggggcagctgtccgccgccctgcagctcctggaggaggctttcgcgcagctcagccaggggaagcgctacttcggcggggacagcgtcgggtacctggacatcgctctggtgtcgcatgtcggctgggtgaaggcggtggagaagatcgccggggtcaccctgctggacaaggccaaggtcccgaacctggtggcgtgggctgatcgtctgtgtgcccacccggccgtggtcgacgccatccctgacgcggacaagttcgttgagttcagcgtcacctatggctccttctccaagcctatcaatgctcccgccaagtgagcaaaaagggtccgtgcatgcttcgtcattttcactttcactgcgccccttccaaggggaatcgacgcatacactagtggctctgtattctttagtgcaaagcttactgttctgaactcagttgcagagttcaataacttttcaaatgtgactaaagatataaacaaac

SEQ ID NO: 14717 - DNA, 470 bp, Triticum aestivum
  unsure (1)..(470): unsure at all n locations
  Clone ID: PAT_TA_14717
cccctgctggctagcggcagtgcacaacgagctacagagcactgtctccaaccttttctccagtttggatttgaaccaggcgagtccctttcttctaggaactccaacgaaggtggagcagcaagtcaccttggggagcattccagctgacacaacaacgacagggagctgacgctgagggacttcaggaagatgactacctctcaaagttaacatatatttacagatgcactgaaagttcaaaactgtatggacaagtttcattgagtttgttgtactattttgccaagaagtttcatgctttcttatgggacctttgcagatgttgtaagtttagttctaaatactcctggtgatcttgccattatccttactgctagcaactcaataagttgagaagacatgctcaaattttatttggttacttggcatgtttancaaaaaaaaaaaaaaaaaaaaaaaaaaaaaaa

SEQ ID NO: 14718 - DNA, 711 bp, Triticum aestivum
  Clone ID: PAT_TA_14718
ccgcgtcaggtcagcagcttggttggctcgtagctttcgtcctagctagctactgtagtgtaggttgcttggtcagtcggcagaggatctggtcgcaggctccaagtgcgaccatctagatgctgtagctgctgcatttcctcgttattgacgcatggtgcttgcgatgtgatgtgctgcaggtgcgggtggcaacgcggaagatctacgaccccctggaggaggacgccttccgccccatcctccaccactacgacgggcccaagttccggctcgagctctccgtcaccgaggccctcgccctcctcgacatcttcgccgacaaggacgacgcctgatccccgtccctcctctccgcggcccccgcgactcgcggctgcgcgcttggatgaacgaacaataatggcgggtcgggtgtcccggcctaccggccggcgcttgtcccccccgcgccggggggttcccgcgggtttagtatttattattcgtatttatccacctgtccttgatgttatgggctatgtatgaggcacgcgtccaattgttttgtttttataacacttgtgcgatgattgcagagaactagccctcgtttttgtaagatatactcccactaagatatctgtattgttcgggtctaactgacatgtataaacatctgtgaaataatctgttcttgtgcgaaaaaaaaaaaaaaaaaaaaaaaaaaaa

SEQ ID NO: 14719 - DNA, 599 bp, Triticum aestivum
  Clone ID: PAT_TA_14719
gaaaggaaatcaaacatgttggatgatccatgacaatataactttttagatataagaaaacataactcattacgttgtcttccttgtccaacatcaaccttttagcacgtcatattttaatgagtgctcacaattaaaaaagatgtccaagatagtatatttatatgtgaaaacctctctttctttcttacttcctactaattgcaacaatgaccaaaactatgttagtcaactctcaacaacttttattcatcatactgtttatatgtgaagtcattactctccataagatcaatatgatctttttatttctttttattctctctttattttataccctcaagatcatagcaagataataaagccctcaactcaaaactactctttattatatagctcacggactcgattacatagagggagcataaaacaaaactcacaactagatcatgctaaaactttattctactagatcaagatattatcaaaggatcgaactaagaaaaacagtaaagataaaagtgatggtgatacatatcgggggcactcccccaagctggcagttgccaaggggatgccatacaagtaccagttctcct

SEQ ID NO: 14720 - DNA, 550 bp, Triticum aestivum
  unsure (1)..(550): unsure at all n locations
  Clone ID: PAT_TA_14720
cggcacgaggcaggttttgctggatgctgcaagaaaggtgggcatagaaggggccgaagaacttcttgaagatcccagcaaaggagtcgacgaggttcaggaagaacttaagaagtactcatctggcatctccggggtcccgcattttgtgatcaataataaatatcaactcagtggtggccagcctccaaatgtattcatgagggcgtttgagatggctgcaaaagatggagcttaatggtgttttaaaagagctcctctagtagtcttcacatatgttcgaaaggaataagagcagaatttaagaataaagttccagttatggaaccagttgtatttccataattttgatgtggtgacaattagtggtgaagatggtgtggatgttcacttttgaataaaaatctaggtgattggatatggcatatggtttagaatgtcccataaatagagcccagtctgtacttatatttgatttggccagtctgtatttatatttgatttaaaaaaaaaaaaaaaaaaaaaaaaaaaaaaaaaaaaaaaaaanaaa

SEQ ID NO: 14721 - DNA, 903 bp, Triticum aestivum
  Clone ID: PAT_TA_14721
cagagatcaaggcgcacccatggttccaggagcactacgtccctgtccttcctccgtacgacgacgacgacgaccacgattcagtgaagcaaatcggtgcgggtagtaaaaccactcatcacatcaacgcgtttcagttgatcggaatggcgtcgtccctagacctctcagggttttttgaggaagaggacgtgtcccaaaggaagatcaggttcacgtccgcacaaccgcctgaggatttgttcgccgagatcgaacgctctgcgactgacatgggacttccatgttcacaggagggcatagtaagcttaagctgaacgcgaaactgcgaccggtcgaagaatcaagaagaaccctatgtcgtcgtcgtcgtcgtcgtttctagtctgcaccgaggtttttgagcttagcccctctttgtaggtcgtggagctcaacaagtcccatggcgaccctgcactgtacaggcagctctgtcagaggttctgcggtgacctagtgtgctcatggggatcgtgcttggtacaggccgccctctccgaggatctgcagtgacctaggtgtgctcaagatggatcagatctttgggacgagaccgactgccgatgatcttgcatgcttggacaaacgatctgcgacgcctttggttgcattgtgaagaaggctgtccccctgacgtggtgcggcgtgagatttagtgacaacgaagcagttcagctgcaacgcagctaggaacggttgtattgtaagtaggatcataatcccgcagaaatagaggagaagataaaagagtgttgccgtgtaggatcatacataaataaagcagtagtcaccgatgtaaaacacaatgtaaaatctaagaaataaagtgttttcggtggccaaaaaaaaaaaaaaaaaaaa

SEQ ID NO: 14722 - DNA, 911 bp, Triticum aestivum
  unsure (1)..(911): unsure at all n locations
  Clone ID: PAT_TA_14722
tggcatttcatacatcatgtttagctctaaaatatgtgctaagtgctactgacttgttgccttaacgaacaatgattttttgacaaatgagatgagatgaacttgccgttcttgcagacttaactttgatcttgttcctatcctcattattttctttgccattttacatctccagtcatagcctgttcacatacagtttcaccattgttcttccttctgcacatattcaggcaaacaatgattacacacttatgtatcatctgtgtgtgtagcatgagattcagtatggaggtgacaatgcatcagcctctccgagatcacaataccctagccaaagcactgcacctacagtgcacatccccaacacaagcagccagcaaccatcaccaagtttatttgctccaggaaaccctgggttgacacagtccaagaattccatggtcttttcgaacgcattatctagccccatccggcggagcctgcaaccttaccacctagagcagggtggggacgcagggtactttgcgaatggcgcaagccgtgacgtgaaccccacggcttcgaatgattcgtccatggacatgcactcggacagcccagctcatgactcctactgagcagctctctccatggaaccggcctcaagaacagcacttcaagtggacgaaagtctgctgtcacagcctccccaggcctagtaggaatattcaatttaacaccttccgtagcctctcttacactaagcgtgtgatgtcttgtgttgttactactacttaccacttgttgctttgcgagaattatgtatttgcatgtactatactatactgtacatttgattatctgtgcatatacggcgttggtacntgacaagtgcaggaaacaacaatgaaaagattaanaaaaaaaaaaaa

SEQ ID NO: 14723 - DNA, 706 bp, Triticum aestivum
  unsure (1)..(706): unsure at all n locations
  Clone ID: PAT_TA_14723
cggcacgaggcaaagaatactcaaaaggtacctgcattggcaagctaagatcaaactntcttgggaacaaaatttactgtctatgatgcccatccaccttgtaccggggctgtggtttcaaagggtccgtctgcacacatgatcggttcagcccaagtttctcctggggtgcctgctgggaattatccaatttcgcacatttcttatgaagcgacttttggttctaggtatccaagaaagatgaactgtgtcatggattccatccctttatcagcaattaaagaaggagggactgctcccacgcagactgaatttccatcaattaactccaactcttttgcttcagttccattcttcaggaaatcaggtcgtctggatagttcaggtgttcagctagccactcagaatgaagctaagatggtgctgaagaacaagtcccccaactggcatgaaccactgcagtgttggtgcctgaatttccatgggcgggtcacggttgcatctgttaagaacttccagttggtggcttcaggagagagtgatctgaataaccagggtgatgacgacgtgatactccagtttggcaaggtcgggaaggacttgttcaccatggactaccgttatccaatatctgcattccaggcatttgccatctgcctgagcagctttgataccaaaattactcgcgaatgagtcaaggtgcgag

SEQ ID NO: 14724 - DNA, 560 bp, Triticum aestivum
  Clone ID: PAT_TA_14724
cggcacgagggggtgagctgacatgggagacccgagctgctgttcatgtaatatttcctcctttccctccctccctttctagcatgccatggcctctgagttctcagcatttgttcagttgttcgggcagaggagacacttttttgaagcatcaagtgaattgaaatgtgcaaatgctcttggtgtccattaattctgtgtgtgactaagaaatcgttttcttctccgtagctgagaaaccagtaaagaaattatgtgtcaggagcaagaatctttttcgatgaaagccgctacctttcatatataaattgtcttccttttcaagaaagaaatccgtagccttgaatcaatagatatacataagttttatgctgatgttatctataataagagtacttgaaattgatagagttgccattagattttccgagaagaggcagacattatatcacctgtccgtttaatctttctctgtttattatgttgcttctctttttttgtcttattcttattccaatcattgcattaggattcattgccaatttattcggtccttattt

SEQ ID NO: 14725 - DNA, 359 bp, Triticum aestivum
  Clone ID: PAT_TA_14725
cggcacgagggcccttctaagactccggtgaagccacgtgtaaatcgagtgggacctaactgactctgcgtaagctgaactggatttgttcacgggaaggcatcgccataagatgaaggcttccgcggtccagtgcatcatgatgcatttgcttacatccttacaaacattctctttgtacccttttgcaaacctgctggaagggaactggttagatcaggcccttttatagccaacattcggttctcttgtttcattcgacatgatggaaccattgagaatgactattcggcaatcagccatcaacgtaacttatgttaatgctgttagactaaaaaaaaaaaaaaaaaaaaaaaaaa

SEQ ID NO: 14726 - DNA, 693 bp, Triticum aestivum
  unsure (1)..(693): unsure at all n locations
  Clone ID: PAT_TA_14726
ctgcaggaattcggcacgagctaaacttgctttctgtaatcaagagaagaagcagaggaacgaggagagcttgtcgggcgcatcacactggagaagtatcaaacagcacgtgctgacccaggcttcttcgaagcccttctcccgcaagcactccttggatgcctcttcgagcgattcaagggagacgtcgtcaagcatgccagcggagagcggtgcaatgtccgcgaacaatccaagagcaggggaggctgtcgagtacgggaggcaaccacccgtgccgtcgtccaccctggttgagctgacgaccagactagatttcttcaaagaacggaggtcgcagttgatggaacagctccacagtcttgatttgggacatggatccgcgccgcatggttttcagtacaagtcttcgtccccttggaacagtccgagataggaggttttggttttttctagttccacgtttgtatattctttttaaaggatattcgccccttctttcgttagttgtagcaagctgctagcgagaatgtatattcctttttcttgtttactttttggctgtgcagcaacctcatccgagtgtgattttgtaatgcttttgtaatgtaatttatgtacgtaacgatttgttgacacctgtttgagaacatcncgacagatgatgcataaacnccgctgcgccanaaaatg

SEQ ID NO: 14727 - DNA, 398 bp, Triticum aestivum
  Clone ID: PAT_TA_14727
gaggagagatgtgggagccaaatgaacctcgcatcaacaagattgtcttcatcggcaggaacctcaataaagaagagctggagaaggggttcaaggattgcctactgaagaaatagactgattccaggatacagacgggatggatctccagcttcatgattttgagctttgtggctgcagaacttatcctcgataactgacatgacatggaacgcaagatgtatcgaatcgatagcattattgcaaccttgcatcctcacgaaacaacagcagtagtctatcatagtgtcattgcacggtgttgcatgtaaccaatagagattgtagactgtctttgtctttgtgattcaggaaaatcatatcacatggtataataaaaaaaaaaaaaaaaaaaaaaa

SEQ ID NO: 14728 - DNA, 717 bp, Triticum aestivum
  Clone ID: PAT_TA_14728
agcacacttgctacagaggtcactagcaagcttgcagccttaaagggacccgctcgagggcttagggagatccgaagctatttggatcttgtaattgacgggaagctcccactgaatcatgaaattttataccatttgcaggatgtctttaatctccttccaaatctgaacgtaaatgagctaattaaagcctttgcagtgaaaacaaatgacatgatgttggtgatatacctgtcttctctgatccggagcgtcattgctcttcacaatttgatcaacaataagatgctaaacaaggagcacgagaaggctgaggattcgaaaccgaccgccattcctactgctgccgggagctaaacatgcttttgatcactgattggtggctaagaaaagggatgaaacttgtgatgacatgttatcacggtcggtcgtgctcgaaccaattgtcttgaccttgaatggacattttgatgtttatttcatgtatgataaggtcaatggcaagagaaaccaattaaattgtacgagctttagatcatacctcaagttttctgtagatctcggtgctatttcatctgatgcatcatgtttcatgatgtagaatttcgtttcttgtgattgatttatagtgaacctgtacgttgtacgtcatgcaattcatctccgttcatgattgatttgtagcaagtcttaaatactaaaaaaaaaaaaaaaaaa

SEQ ID NO: 14729 - DNA, 706 bp, Triticum aestivum
  Clone ID: PAT_TA_14729
cggcacgaggcctaccccgctcagccgcagccgcagcccgtcgccgccccgaactccggcgcgtgcccgagctccaccagccgctgccgccatgtcgctgatcgcgggggaggacttccagcacatcctgcgtctgcttaacaccaacgtggatggcaagcagaagatcatgttcgccaggtccgcccgcgggggtgttggccgccgcttctccaacatcgtatgcaagaaggccgacatcgacatgaacaagcgggctggtgagctgtcatcagatgagcttgagcgcctcatgactgtagttgccaaccctcgccagtttaaggtccctgactggttcctcaacaggaagaaggattacaaggatggtaggttctctcaggttgtttccaatgcccttgacatgaagctcagggatgaccttgagaggctgaagaagatcaggaaccaccgtggtctgcgtcactactggggcctgcgtgttcgtggccagcacaccaagaccaccgggaggcgtggaaagactgtcggtgtgtcaaagaagagataagctccttgaggcatattggtcttatcttgagtttcttttgtatgcagacatttgtgctttgatatgccacaggatgtttattatctgtaggataagatgagagttccgctttacaagacttctatatattgtagcaatcttttgctgcctgtgttc

SEQ ID NO: 14730 - DNA, 921 bp, Triticum aestivum
  Clone ID: PAT_TA_14730
ggtggcgctggggacgccgaacgtgacgttcctggtggcgctcgacaccggcagcgacctcttctgggtgccctgcgactgcatcaattgtgcgcccctcgtctcccccaactacagggatttaaagttcgacacatacagccctcagaagtcgagtactagcaggaaggtcccatgcagtagcaatttgtgtgatctgcagagcgcatgccgatcaccgcgcggcggctgcccttacagcatcgaatacttgtctgataacacgtcgtccaccggtgtgctagttgaggatgtcttgtacctgataacggagtatgggcaaccaaaaattgttacggcccccataacgtttggttgtgggcggattcagacgggttcatttctaggcagtgctgcacccaatggtctacttgggcttggtatggacagtatatcagtccctagtttactagcaagtgaaggagttgctgccaattccttctccatgtgctttggagatgatggtcgtggtagaatcaattttggggacactggaagctcagatcagcaggaaaccccgttaaacatttataaacaaaatccatattacaacataagcataactggtgccatggtgggaagtaaatcctttaacaccaattttaatgctattgttgactctggcacctctttcacagctttgtctgatccgatgtactctgaaatcactagcagcttcaattcacaagtacaagataagccaacccaacttgactcttctctgccctttgaattttgctactccataagtccaaagggttctgtcaatcctccaaacataagtttaatggcgaaaggtggaagcatattccctgtcaatgatccaataattaccattacggatgatgcatctaatccgatggcatattgcttggctgttat

SEQ ID NO: 14731 - DNA, 452 bp, Triticum aestivum
  Clone ID: PAT_TA_14731
attcggcacgaggattggttaggtcagtggttgaacactaaattgaatttgatgtgtttaatccttgtttgaattgtatctggacaatttttaatttatttaagattttaatatctacctattatagaaaaaatctgaaatatttattttttattttgtttaatctcattttgtcccaatttgctaactgtttgggtaaaaatgaatccaaatctctttattagacttgcttttgatctctaccttatattactcaggttagaagtggtttattttctagggatgatggaaaggaaggacctggtattgctactttggtttatgcatagttgaataatgatttctctgtaaccattaataacatttatagtacgtgttgtcattgcaagctgtataaattgcttcattttgtcaaatgttattcatagtattttaaaaaaaaaaaaaaaaaa

SEQ ID NO: 14732 - DNA, 800 bp, Triticum aestivum
  Clone ID: PAT_TA_14732
atggagccaagcagtttcacagcttgaggagaacattactgcaatcgaatcactgtggaaaaaccgggaaaggaacagaggaagcaaattctcttccgaggttgaatggttctgcacaggatgctttgcagctgctcaagtcactgcagttccggcttgatcttctagcacagcagcttcccacttttgatgaagtgcagtctggccaagcaaccttgaagtcatgggatgaacaatacaagaagcttcgtgttagcctgaggaatgctaacttacaagcaaaagataacattagacaagctgctcaagaggagagggcacttcttctgggtggtggcgaagagtctaccatccgtaggcgtaatctccagacaaaggctggaatgacatctgctgctgaaagtatcactgagagcctccgacggtctcgccagatgatggttcaggaagtggaaagaaatgctagtaccttggcaacatttgacgaatcaacaagtgttctccggaaggctgaaggtgaatatcaaggacaccgctctttgctgatgcgtacccgtggtttgctctccacgatgcaacggcaagatgttcttgataggatcatcctgactatcggcttcatcatcttctcctcggcgggtctttatgtcgtctcaagacgtattggcctgttgacgctgcaaaggaaactggccaacgccatcacatccggttcattatcagctgcggacatcgtagcgaaagcccaacatgtccctgccccagcaaatgtccctgctcccatttacaatgaactgtga

SEQ ID NO: 14733 - DNA, 515 bp, Triticum aestivum
  Clone ID: PAT_TA_14733
gttgtttacctcattcacgaggaccgcgtggaagaagttgaagacgttgtatcaaaagtacaacgactttatcagcgtccggaaaggaaggatttggagggtgaacaactggggactgcgcagacttgcttacaagataaagaaagcaacacatgccaactacatcctaatgaactttgagatacaggcacaatccataaacgagttcaagactctgctagataaggatgaaagaatcattagacaccttgtgatgaaacgagatgaggcgattactgaagattgccctcctccaccagagttccatgctatgcgatctcaacagttggatggcgagtatattgatgaggaatatgggagggtggacgatctcgatgatgaggctgaactagagtcttctggcaatgttgatgatgacgttgaagatggcgatgaacctgaaatcattcttgttgatgaagttgacgatgacaatgccgaagacctcagaagaagaaataggaaggtgaaactgg

SEQ ID NO: 14734 - DNA, 783 bp, Triticum aestivum
  Clone ID: PAT_TA_14734
gcacgaggcaccgttccgccgcgcacaggagagcacagcccccgcgcccaggagtaagtttgttcttttaccaacatgtcgagggaggagaatgtttacatggccaagctggctgagcaggctgaaaggtatgaggagatggttgagtatatggagaaggtggccaagactgtagatgttgaagagctcactgttgaggagcggaacctcctgtctgtcgcatacaagaatgtcattggggctcgccgtgcttcatggcgcattgtctcttccattgaacagaaggaggagtctcgtaagaacgaagagcatgtgaaccttatcaaggaataccgtgggaagattgaggctgaactgagcaacatctgtgatggtatcctgaagctacttgactcccacctagtgccttcttctactgctgccgaatcaaaggtcttctacctcaagatgaagggtgactatcacaggtatcttgcggaatttaagactggtgctgagaggaaggaatctgctgagagcacgatggtagcctacaaggctgctcaggacattgctctggctgagctggcaccaacccatccgataaggcttgggcttgctcttaacttctcggtgttctattatgagattctgaactccccagacaaagcttgcaaccttgcaaagcaggcgtttgatgaagccatctctgagttggatacccttgcggaggagtcatacaccgagggcactcccttcgtgcagccccggggggtctactggaccctcccaagttcagcagaa

SEQ ID NO: 14735 - DNA, 1178 bp, Triticum aestivum
  Clone ID: PAT_TA_14735
cggcgccaggcgcggtagatcgtgagtcgcgctcgtctcgtgagagctagcgagggccggggtgcattccatttccatatggcttcctccaggatcccactcctgtgcctccttggcttgctgctagtagcttctcccgcaattgctgatgactcctccggtatctactaccagcttgctcttctgtggccaggagcatactgcgagcagaccaacgctggatgctgcaagccgacgaccggcgtctcgccggcgcgcgacttctacataacgggcctcaccgtctacaacgcgaccaccaacgctgcactgacggagtgcagcaatcaagctccttacaaccctaacctgattaccggcatcggcctggagcagtactggatcaacatcaagtgccccgccaacaacggccagagaagctggaagaacgcctggaagaaggccggcgcctgctccggcctcgacgagaaagcctacttcgagaaggccctctccttccgtagcaagatcaaccccctcgttcgcctaaaacaaaatggtatcgaggatgacttcgagctgtacgggttgaaggcgatcaagaaggtgttcaagagcgggatcaacgcggagccggtgatccagtgcagcaaggggcccttcgacaagtacatgctgtaccagctctacttctgcgcgaacggcaacgggacgttcatcgactgccccgcgccggccaagtacacctgctccaattccgtcctcttccacccctacaagaagtggatgctcaagcagcagctcaacgacgagtccgccgacttctacgattcagccgaccctttcgtgctgcctggcctcgccatggacaactgatctctgatgcgatcgtcgatccctctgcattttcgtgagtttgcgtttcgtcgtcgccggagccaccgcccgccgacgatccatcatccatgatctacctcgtctttaatttcgtcagtttttgcgtgcgttcagtgacgtgcgtatggaataataatgttttctgccttgatcctcactcgctcgatctgggcaatgcacggtgatgcccagcgaataagtgtggcggctttgtttattcgaccttttttccacctgtatattaaggaaataaaccttgagagctacccggtggcctttccaataaaaaaaaaaaaaaaaaa

SEQ ID NO: 14736 - DNA, 906 bp, Triticum aestivum
  Clone ID: PAT_TA_14736
cggcacgaggttgattgtcccccctgagcagggatgtaccaaccagggatattctcatgtatgcagcgccgaagtcttgctagaatgaagtttgcattgtcttcatgcttgtactgcacctctgacattggctctgaagtctcacaggggtccatgaccaacaatgtcctctcctcgacatccacgacatatagtgagtagctatccatcattggaactggtagcatgagctgcatatccgaagtaataggcaatagccgagcgcctcataactcatccttgtattcatgaattcgaagtccaaatcgtatgacctatacatgagagcaagctgcccgaagacgcaacaaattattgcaagcaccgcaatttatcatttaaaggagcttcgatgatgtcatgttgtactgaaatattatgatttccttccacatccgcctcatcatatgtgtcatactctggaactggaaagtcgctccccacctcttcaacaacataaccatgagtccagacagcaatttgcaaaatttctgattgatgcgctggggtcgcattatttccaaattcagtcccagagaccatggcttcttcatgccgagtcaccgtgacttctccatctgctctttcagcatcttcgacaactctgtgaataatgcggctcccaaggcgtccattgccatcgtcaggtccaaccaatgcatcttcattatcacctgcaaacaactgaaagtttggcattcaggattcagttctcatcgccaactcacatggattaaaatgtatcacatatttatactacgcacagcgtcatcattagagggcacatcatatccgcacagtgccacaggctgtcgcatacattccatttgaacatgtagaggtagtagcatatactcaattaggagt

SEQ ID NO: 14737 - DNA, 1559 bp, Triticum aestivum
  unsure (1)..(1559): unsure at all n locations
  Clone ID: PAT_TA_14737
tccagccagacgaccccttcgaagcgacgcgacagattccagagcaccaccaccgtggtcgccgccggctccgctcgcgcaacagcacacgatgctgcgccgcgtcgcgccgccgctccgccgagccctcgcctcctccgccgtcccgcaccgcggaggcgcgcgccttcccgacccgggcctctcgtctccccacgccctacccccgcaatggcgccgctgggcttccgccgccgccgcttcctcgctcccgccgcctccgccgtctcctccccagggcccgccgcggcacgcgggcgggggatccgccccgcccgcgctgaaccccgccgcggtggccaagttcgccgccatcgccgagacctggtgggattctcaaggtccattcaaaccattgcatttgatgaatccgacaaggctgtcttttatccgctccacactctgtagacatttcaggagggatccatattcaagctaagccactccgaggtcttaaagttattgatgttggatgtggaggtggcattctctcagagcctcttgttcggatgggagctacagttactggtattgatgctgttgacaagaatataaagattgcgcacattcatgccgcatctgatccaacaactgcttccattgagtattgctgcacaaccgctgaggatttggtaaaagagaacaagcaatttgatgctgtaatttctcttgaggtgattgagcatgttgccaatcctttggagttctgccaatctctatcagctttgacagttcctaatggtgccactgtgatttctacaatcaaccggtcaatgagagcatatgcggctgccattgttggtgctgaatatattctcagatggcttcctataggcacacatgagtggtccaaactagtcacccccgaggagctagtcctagcactgcaacgagcctcaatctccgtggaggaatggcagggttcttctacaatccgttgaccagagggtggtccctgtctgatgatactagtataaactacattgcttacggcatcaagaaaagcgaagcaccctcggcgacgccacagtagcaagattagctagtcgtggttggagaggatggatcggttgtgaattactggaacaatttttgggaagcaaaacttatgccacttaagatcttggcagggatcacaatcaagcagcggcaaagaaaggttgtaatcctggagtagtcttgttttctttgagaagttgatgggagagaccggctaacaagtagggctagtttagtttccactgtttgtaataaatgtatgcttcatacaagttcatcaagtttggggtaatcccctgatctacattacataaacagaaatatactgcccctgggcaagcgggaactgtcaggtcaagtgaaggctaatgttttttgctcaaaaaaagcctcctttanagtcngacggnaaaccngggtaccactaannccttganaaacccccttcncangggggtatacnaaaggccgcncgtnccntccaaaantgncccctanngnaatggacccccttncggntg

SEQ ID NO: 14738 - DNA, 632 bp, Triticum aestivum
  Clone ID: PAT_TA_14738
agacatggccgtgacggcggaagcggcggcggagatggggttggagcggcgggcgtacgcgcgggtggggctcctcggcaaccccagcgacgtgtacggcggcagggccctgtccttcgccatcgccgacttctccgccaccgtccgcctccgcccttcgcccgagctgctcatccagccgcacccgcaccacgacctcgtcgccttcccctccctccctcaactcgtgagccgtttgcaaagtgaaggatattatggaggcgtccggctgctgatggctatctgtaaagttttctacaaccactgtgttcaaaataacatcagtttaaaagctgaaaatttcaccttatcatacgatactaatattcctcggcaggctgggctgtcgggttcgagcgcgattgtttgtgctgctccaagctgccttcttgacttctatgatgtcagacatctaataaaagttgaaatgagacctaatctgattctcaacgctgagaaagagcttgggattgttccggctcttcacgaccgggtggctcaggtttatggaggactggtttatatggattttagccaggagcatatgggcaagctgggtcatggcatatacatgccattggatgtgaatctgc

SEQ ID NO: 14739 - DNA, 804 bp, Triticum aestivum
  unsure (1)..(804): unsure at all n locations
  Clone ID: PAT_TA_14739
attcggcacgagaaactctacagcctttcaccctttggctatcagatctttcctcccttacaaaatctgtcataaactgtccaaatttgagtgaactctcgctgattttttcccaacaagataatgattctactgacctgattagtatgatggatagtctgggccgcacctgctcaaatttgagaaaattgcacatctcctcaattcacttgtgcaatgaagctgtgtttgctcttgggagtgctaatctcaggggtttgtgcatgctgtccttgcttctaggtaaaaaaataacagatgcagctgttgcatctattgttcgttcttttacaagcttggagttgcttgatttaagcggatcttgtatcactgataatgggcttgggatggtcagcaaggcattccctgataccctaactagactgctccttgctatgtgcccaaatatcacctcatatggggtccaggtggccacagcgcagttgccacttcttcagctcatggactgtggcaagagcttatgtgccaatgtgcagcctgaagcaccccgatcatactttggtgatctcaatggagggattaggttttgctcgaaactacaaatcacaaggaagcagcaaccaacttaccaaaagttgattataaagcatgctaatctgaaagaaactcagtctttggggctgttctggaatagatgccctatgtgtaaattgtccagagctgaatgatctgaacctcaactcctgcataaatctgaatccagaacggntgcttctcantgtcaaagcttgaaagatggtcang

SEQ ID NO: 14740 - DNA, 635 bp, Triticum aestivum
  Clone ID: PAT_TA_14740
tagcgggctcgcgcccgaggggcccgcgtcatcgggctcttggttagcgtccgtgccccccgctctggcagcgcttgggcttgctccggtggggtccccgatcggctgtggttgcttgctcgctcgtttgttatcgggttcctcgacgtggtccacgagggcgggttgttcgcgcgctttgccgacttgggtggctgcatagcattcgccccgcttccgggttcccctgtcgccccgctgttggtctgcgacgttgcggcccaccgcggcaggtcgcgcgggtgctccgggtgcctccccgggcggccgctcgaactttttttttcctttttcaatgggtatgtacaagttgttccaggaggtcagtttttacttgttgttaagctagttgtgttgctagatagcattagcagctttactgtgttcgactgaagcaccaatttttttcttgtacgaatatgtgtaacgctgcaagatgcgcgtgttgtcgatgatgtacatatttagcacgtggtgctggaagtcctgggggtacagtaaaaaaccgaagttgttgtaatatggcacttttgttttccagaaattgaacagttttggaagttcgttctttctattcaaaaaaaaaaaaaaaaaaa

SEQ ID NO: 14741 - DNA, 1249 bp, Triticum aestivum
  Clone ID: PAT_TA_14741
cggtggtggtcgacgagagggtcgcctcacacgtggacccgttcctcgtcgaggcgctcgacaaccctcgccatcgcctccggctcctgcgaatggaactggatatacaaaacttcatgcagaaccctcagctgcaggagtttgaattccagaactatccgacttcttacctccgctgtgctgctcatcgtgttgcacaacattatggcttagagactatagtagcagatagtttagtagaaggctcagttagcaggattgttgcaagaaaaacaccagaaagcaggtatcctgcaattgctttatcagaagttcctagcagacaagcaagaaatgatcatgaagcggcagagaagcttaagtttgtcatctatcaaaggcccaaagcattccaaaatggaagcgctgattctagaaacatgaatggtgcaccaaaaactgttgaagagagaatagaggaatataataaagcacgagcacgcatcttcaatggttctatttctgcagattctgatgctgcaagtgttttgggaactctttccactggcagagatgaggcagtgaatgttgagccttctgttgatgaaatcaaaatcagcacaatgaacagccgctccagagttgctgttttcaaggatactgaaaaggatcgtagtgacccagactacgatcgaaactacacaaggtatgttaggaacccagtgcctgacttcaacttgagcccaggtgccttcaactttgttgtgccccagtttatgcagtacggtgttggttatatgcaatctcctggcatgtccacaaaccagcctactgtgtactttggccagcctgatctagcaatggggtcttcttctggagctactgtctacccacattggccaacgccagcaatgatgtatccccattgctatgataatgttggtccaatgatatctcaggttcctctgtaccaatctttcaaccatggttaggagattctttctgcttgctggaaagttgggaacactctctgttgaacttgctatgttgtgctgtcctatgttaagtggagttactttagattcgagccatttctattacaaaaaattcatgtagcgtcgaacgtagtctgtataaggagtcctaattcgttgaaactattatcgtgaactagtctggaactgtgatgcttgtctaatgtctagttctcgtctgcaatttgctctcggtttagggttcaaaaaaaaaaaaaaaaaaaaaaaaaaaaaaa

SEQ ID NO: 14742 - DNA, 560 bp, Triticum aestivum
  Clone ID: PAT_TA_14742
gatccgcacgaggggaaggaggaaatcaggaagaatccgatccatccaactatccaagccaagcaaaagcaggactacagggaggatcatcggccggagtactgcgtccgtccatcgatcgagtttcaccgaagctagcaaagcagatcgagaaggcaggcagccatgtcggaggggacggccaactgcgtggacatcctgatcgccatcatcctgccaccgctgggtgtgttcctcaagtttgggtgcgggcaccagttctggatctgcctcctcctcaccttcctcggctacctccccggcatcatctacgccgtctacgccatcaccaagtagtcgtcgtcgtcgttgctgctgctgctgtttgttgatgttcctgcttgctcttgccgatcgatgaatatatgccgattctaatacctagtagctagtggtatgtagcatcgatgtactcttcttaattgtatctctatatgttcatatgccccgttccaacggatttgtgtgtcagtgtgtgataaacagttattaagctgctactaaaaaaaaaaaaaaaaaaa

SEQ ID NO: 14743 - DNA, 693 bp, Triticum aestivum
  unsure (1)..(693): unsure at all n locations
  Clone ID: PAT_TA_14743
tttttttttgaacaaatgaatggatggccttaatctgacaaatcaataattaaccaccgggaaacaaaaccacaactactattgcacaagcatcattcatcatagtgtacaacgccaactcatcatcccgacttgccccctgaaatgcaacgtgaaacaagagacacacatgcagctaattaactttgcagcatcaatcaatccacgtacgccctctccgaaaagacaatggagttgcatagccaactgagcagcttttagttgccggggacgaagttggtggcgtaggcccaggcgttgttgttgactgggtcagccaggtggtcagcgaggttctcgagcgggcccttgccggtgacgatggcctggacgaagaagccgaacatggagaacatggcgaggcggccgttcttgagctccttcaccttgagctcggcgaaggcctcgggatcgtcggccaggccgagggggtcgaagctgccgccntgggtagagcgggtcgacgacctcgccgagccgccccccggcttggcgggcgcccccggcggcgccctcgagctcgcccccggcggcccagatggcgaggatgctctgcgcgtggatcaggctggggttgcccaggtagtccaggccgccctcgctgaagatctgggagccggcctgaaccagacgacctcgccgaacttgacgccg

SEQ ID NO: 14744 - DNA, 690 bp, Triticum aestivum
  Clone ID: PAT_TA_14744
gaggggcgcggttctcgccgactcgctccgtccgcggaccgggctaacgagggagtcctcgcccttcgagcttgcccttgacaagtacggcctccacggagagaaggcgtccggcgagctcctgagcttttccgattccaatggctctccacaggtgtccatttttgttctgccagactataagccccctcttgcagcgtgtgttgtaaatgaggtcttggaactgatttcttctgaagctacctccactgagcgaattctaattgtcccattcatcacaagatcgtcaagctatcatcgtggaatggaacatgcgacaaaagcatcgcctgtacttcatggtgctgaaataggggcaacaactgactatactcacttgtttgttggtgggaccactaaacctcctacattcttgcaaatacgtagtgaaccaatattatgtttgctggaaatggtgcgcgtgttgaggatgcctacagttcttcttgtcacttctggtgggcagcaacaaggcaagagctctacagtttctgatcttgaggtactgcaatgcttaggagagcacttggccaagcacatggctttggagttctccaaagaaactgttctcaagagaggtatcgaaaaatcaccaattgatcaggaaccctggcgcgagctgtatgggtgacggtgccctcagacagtcag

SEQ ID NO: 14745 - DNA, 608 bp, Triticum aestivum
  Clone ID: PAT_TA_14745
cggcccgcaggactcgacctcttgcgccgccgccatgaccttcaagcgccgcaacggcggccgcaacaagcatggccgcggtcacgtcaagtacatccggtgctcaaactgcgccaagtgctgccccaaggacaaggcgatcaagaggtttcaggtgaggaacatcgtggaacaggcggccatcagggacgtccaggaagcatgcgtctatgatggctacgtcctcccgaagctgtacgccaaggtgcaccactgcgtctcgtgcgcgatccacgctcacatcgtccgcgtccgatcccgtgagaagcgcaaggaccgcaagccgccggagcgcttcaggcgcagggaggatagcctgctggtggacaaggaggcccccgccctggtcctggtgctgctgctacagctccatctccaacaccggttgctgctcgcccataggtttagcttttcgaccgtgttatcctctccccctttttccggttcccccttttctctgatgaattattaaataatcttaatttctcataccgtaatatcgattattgatattggatttgaatgttgtccactttaatatttgtcttagacataatgatcacttaaac

SEQ ID NO: 14746 - DNA, 375 bp, Triticum aestivum
  unsure (1)..(375): unsure at all n locations
  Clone ID: PAT_TA_14746
cggcacgaggcgcctccctcccccacctcgctgctccgatccagcaagagcagcaagtacagctccatcttcgcgcgcagggccagggaggtcagatggagttcgtgctcatcatttcactgccgctgctcatcctgatcatcatcgtcgccgtcgtcctctgcatcatctgccgttaggctgaacatgcacatangaaaaatattcatcagccccgtctctgctgtgatgatcatatcatcataccatgtgctagtgctaaattgactttgtataacatgacctgataaaaccctttttttctctgcattaccatgtgattaatcggctgtagctctatacattgtttcttttttcaaaaaaaaaaaaaaaaaa

SEQ ID NO: 14747 - DNA, 1200 bp, Triticum aestivum
  Clone ID: PAT_TA_14747
tggaagtgccactgcagctagtgcgggtgcggttggggccatgggcgacgatggactggatgaggaggaagacggatttgattgcgaaattgggacattggagaactttgagaaggctaagggcactgtaaatatctcagcaacttacaacaccaggcccgctcgcggcgagagttcagtagttgcacgaggagacctttggaggttagagtcatcgcgtggcaatttaaattctggaaatgatagttcacctcttttccttgttcaactggggcctttactgttcgttcgagactccacgcttcttttgcccgttcatctatcaaagcaacaccttctttggtatggttatgatcgcaagaatggaatgcactccctatgcccagctatctggtcaaagcatagaaaatggatgctgatgtcaatgatgtgcctcaaccctgtagcttgttccttcatggatgtacaatttccaaatggacaattgacgtatgttgctggtgaggggataacagcaagtggtttaatccctttatttggcgggttactccaagcacatggaaagtgtcctggtgatacaagagtgagcttctctttcaagaacaaacaaggtactaggttcactccaacgtttcagtggcctgacaattccgtttcacttggagttgcacaagctgtagcatggaagaggtctggccttatggtgaggcccagcattcaaatcagtgtttgccccactttcggaggaagtgatcctggaatacgcaccgagtttgtccactctttgaaagacgaactcagcgtaatgtgtggtttctcttgctcacgacatccctcagcattcacatctctctctcttgggcgatccaaatggaatggccaggtcggcagttcgggactagtaatcaccttggagacaccccttgacaacatggcaaggccttctttatctgttcaattgaacgggggttttgagttctgacgtcccccgtcgtgagctctggatacaactgtatataccgtatctcatttcgagaagatgataccactgtatatattgtacgatccccgtagacatatagctgtgtttcagtagatatcttcccaacgagtgaagtgtatagtccaaagaaaacagaaaatggcctactgttttggtccactatgaataaatttgaaggctcatatgtcgtgcgttaa

SEQ ID NO: 14748 - DNA, 766 bp, Triticum aestivum
  Clone ID: PAT_TA_14748
ttcggcacgagccgccctcctttccttcctcacgccgccgccgccgccgctctcctccacataaatggatccatcgccgctcgccgtccttcctctgacctccaccgccactcgtctctcacctccttcacggtactccgggtcaatctgcgacagccaccgacgtccgccttccatctcccccgccgtcagccgccgttctatctccacccccgttcgccgccccggcccacctccctcggctcaccgcgtaccaccccacccccaacagtaccgccatgtacgcgttgcctgcaacccatcctccctgctccagatccggattagttcctgtggcgcatcgagcaagccactgcctcctcccctgacgtggcaaccgtcgcctcctcctctccttgtccaagcaagctgctccattctgctgtgtagcacgaatctgatgtatcatcgaatcattgttgaagatgcagcccacctatacagtctctagatatagcatctttttacaaatcattttggtggtattgcttcacatctttataaatcttcgtggtggaaggaagccatatatcatagatgcagtgaagagcaaggcaaaacctatctcaggtacctctcacactttggtaattatctcacaaatactacgatgtgttggttgtgaccttattatttgttgatgtattatttatttgacgaatttcttatttactatgggaagtgtaaagtgttttggaagtgtccaccatcccatccctgacactaa

SEQ ID NO: 14749 - DNA, 981 bp, Triticum aestivum
  unsure (1)..(981): unsure at all n locations
  Clone ID: PAT_TA_14749
cggcacgaggtcacatgcaattaatatgaccctggcagtacagtaccttgtcatgcagggccacgagtaatataagactattgttttgttgctgataattagaacgtttggatgctcgttgtttaggttctgcgtccagtttggtagtagtgctggtgtgtgtggcttagttactgatgttttgaggtacccctggagggggacgaacttgagatatgtgatgttttcagtaatggaaattgggagatatgctcctaagtagatttttaaaaaaagaatcgggtcatggggctagctgacgaccatgctcttttctcctatatgtaattcttacaaactattccctaattttcatttgatgctttcactgaaataatattttggattgtttgttttgtgatcggtgtgcatcttgtttgtcctctccaccaagcagcgtcgactactccatacaagcacataagcttatgcccttatgaagtatgattatatatttaccaatgactattatggttgatagctttaaagtctttgcttctatatatgcagctgagaatgacttataacttcatggcaaaagcagcaacatcagtacgtaaccacaagcaagctgaggggttacaaatctgggtatctgactctcatctgcagtgctttgccggtgcgtgacatgcaccttggaacctctttcctatgtccttgcccaactgcgccatcaaatcgatcccgatgtccgccaggaggtggtatccccccgcatgcgggtggcatcatggctgggagatcttgtgtgctactctctacatgatgtttcttctacatgatagcacttgacgtctacatgatagcacttgaagtctacatgatgtttcttgtattcatagctcaaaccatttgtttagcttagtttgaacaaaanatattattgtcttacatgtaaatnatgtttactaatgtagctggatgctactaancgcatgc

SEQ ID NO: 14750 - DNA, 549 bp, Triticum aestivum
  Clone ID: PAT_TA_14750
gcgacgactacgcgaccgccggcgccagcgccagcgccgccgttcgccaggtttccggatctccatcttcgggttggagcccttcaccggcgacgagcagccaccagtgttgcgagtcccgatggcggaaccagcgaagcccgaggtgacggaggaagctaagatggacctgctcgaggacgacgacgagttcgaggagtttgagatcgatcaagagtgggatgacaaggaagaaggcaatgaagcacttcagcaatgggaggatgccggggatgatgacgatgtcaatgatgacttctcgctgcagctgaggaaagagctggagagcaatgcgcccaagaactagctagcatttgcattttgcaactgttatttgttctggaccttggcatggctactttgatgtagtcgctgcatttgctgttgttaataccttgattactgaaagatctattttccgagttatattaacctgctttcatcatcatctaataataatccaaatctgatcggtctattcagaaaaaaaaaaaaaaaaaaaaaaaaaaa

SEQ ID NO: 14751 - DNA, 786 bp, Triticum aestivum
  Clone ID: PAT_TA_14751
gcacgaggatttctttcttcgagagagggcaaatcggcaaggggagcgcagcggagcgcaagggagcgggtgacgtcatcgtcctccagggtttctcgatcggcggcgatggcgaccagggcggcggcgaggttcctgcagcgcaggctcctgtcttccggcggcaaggtcctcagcgaggaggagaaggccgccgagaacgtgtacatcaagaaaatggaacaagagaagctggagaagctcgcacgcaagggacccagttcaggacagcaagcttcatcaaccacaggctctgcagcaaatgatgtgaaggttggcgctgggccaacagagtcagcgtctgcaagtgtgtcatccgacaagaacaggaactacgctgtcctggcaggcacagttgctgccctgagtggtctgggttggtatctattgtcaaagcctaagaagtcggaggaggttgtggactgaagaggggcttgtgaatgcaaactgcggatggtccttattcaccttggtttactttctgcgcatagactgcaccttctggaaataattgttgaaatgtactctgcactacttctgttttgaggccagtttcatcaccgaaccttgaaatacactcgagacgttcagtagtagccctcgcttgacagattgcaatgttgagtgatgcttgtaatgctgcctacattgtttgctggagaggtttttgggtactgatgttttgaatgtaaacttgttgccactggcctggcgtagtgcatccaaaaaaaaaaaaaaaaaaaaaaa

SEQ ID NO: 14752 - DNA, 578 bp, Triticum aestivum
  Clone ID: PAT_TA_14752
cagccagcgatttgagcttctagttcagggtcgatcgcgagaagataggcatgccttcagtatgacttccttcaaagaggggctttatacagtcgaattcagatcatccattgcgttacttcaagcttttgcaatgtgtatagtgatgctccatgggaggtaccctagcaggatgcaagttggttcgcaagcagcgcaggagcatgatctccttgctggtcatgagctcaaggccatggcagccagtcaaggaagagctccgaccagctatgtgccacaccggccacctctttctcctgtaggccgagcctagcttattgcgattaaatgtatgttctttctgtgtctgtcctctttcttcagttgtgtagtgccggtgggatcgatataccatggtcctcaggtccatatgcaatacgcatatccaaaatgacaatctctgtgcaagagtctttagaggtagctacctgtacatgttgtaatgtggatgttgtatgactgtactatgatgtggctgcaaggcccatctcactgcttagttaccctttatatgttctcctaaaaaaaaaaaaaaaaaa

SEQ ID NO: 14753 - DNA, 526 bp, Triticum aestivum
  unsure (1)..(526): unsure at all n locations
  Clone ID: PAT_TA_14753
gtacaatactgttggtctagccggcggcggccgcgtccctcatccagtcatcccctttccgcgatcaaaaccgagctagggttttaggtgcgggggagagggtgaggagcggacggaggngcgccatggacaaccccggcacgcggcggttccttctgcaagagcagcaaaaggcgatgatgaacgagatggttggcaagctaacgagcgtgtgctgggacaagtgcatcaccagcgctcccgggagcaagttcagctccggggaatcaacctgcctgaccaactgcgcccagaggtttctcgacatgagcgtgctgattgccaaacgctttgagatgcagtgaggcgtcgtcgcacgaaagctgttgcctagtcaatcgccctgaagtttttaaccctttgatttgaggttccattgagcacttcgaacgattcaacagagagtttaatgtacttcctattgctcactgcctcctgggcaaatgttaaaatgtaattaancgntnaaacaannaaaaaaaaaaaa

SEQ ID NO: 14754 - DNA, 560 bp, Triticum aestivum
  Clone ID: PAT_TA_14754
gcgctttccctttcctccccgtccccctcctcctcccgctcccgccgctccacccatccaagcggcgatggacggcggcaagaagagccggaacccgcacaaggcccccgcggactaccgcagcgaccgcaagtcggcctccgggatgagcggcgaccccaagaagggcggccgcggcggcaagttcacctgggagggcgccgacggctacgccgacgaggacgtcggcctcgtctcctccaagaacgccaacaccaaccgcgccaccaagggtggaggcgccgccggcgccaagaaggacgaccacgacgacgagtaggccggcctctcgccgcctcggcccgccctccccccgtcgatctccagcaagaaccaacgagtccttcctacctactagtttgattccagtctcagttcgattctcgtgttgaataaatcatgatcgtgtggcgccgcgcgtcgtgcgcgcgcgtgactctcgccgcggtgcctctgggtgtcccacggcccctgctgggcctctccatggcctctccgcttcatattcgaaaaaaaaaaaa

SEQ ID NO: 14755 - DNA, 547 bp, Triticum aestivum
  unsure (1)..(547): unsure at all n locations
  Clone ID: PAT_TA_14755
cccgcgccgcccccccctccgtcgtctccgccgcagcgatgccgtcgcacaagaccttccggatcaagaagaagctggcgaagaagatgcgccagaaccgccccatcccctactggatccgcatgcgcacggacaacaccatcaggtacaacgccaagcgcaggcactggcgccgcaccaagctcggcttctgagcgcgcggattggccggctcctgcgtcggaattctagggtctctacctttcctttggttttatcgatgtctcttgtgtttctgcaagctggcaaacagtgccacgaaggcttttgttaagattttggatgacactaagaggattgatacaacattgctgttcccgtggagtccacgctgcttcgcgatgctattttaagccaactcaattaccctaataaacttataattatatataggtttttgcagaaactgaggcctaactgggccatttcccaagcatggattgtggtgcccccccttggacnacgccnggnatgaaatgaatacataanccattccctnttaaaaaaa

SEQ ID NO: 14756 - DNA, 1000 bp, Triticum aestivum
  Clone ID: PAT_TA_14756
catccaatgctgtccaatcaattccttacttcgcttctggcctgaagggagttgcgaggagcatgccaacatcagctgcacttgatgtagatgcaaagaatctaaatctcaagttctttgaggtgcctactgggtggaaattttgtccgaaattttttggaaacctgatggatgctggaatgtgctcagtttgtggtgaagaaagctttggcacgggttctgaccacatccgtgaaaaggatggtatttgggctgttctagcttggctatctattctagcttacaagaacaaggacaaccttggaggagataagcttgttacggttgaagacattgttcttcagcactgggctacgtatggtcgccattattatacacgatatgactatgagaatgttgatgcagaagctgccaaggaacttatggctaacctagtcaagatgcagtcgtccctgtctgacgttaacaagtcgatcaaggagatccagcctactgttgcagatgtggtatcggctgatgagtttgagtacaaggaccctgttgatggttctgtctccaagcatcagggtatccggtatcttttcggagatggttcccgactggtgttccgcctttctggaactggttcagttggtgctactatccgtatttacattgagcagtatgagaaggattcttccaaaaccgggagggcgtcaagcgatgctctttctccactggttgatgtggccctgaagttttcaaagatcaaggagtacaccggccgatccgcccccacggttatcacataaattttgacctagatatgcgccgaggccgcgcatgaagttcagttcaggcctcatgttcgatagcctttttttacatctccatttacacctgaataaatgtatgtgccagaccgtctccgtttctttgcctatacttactctgctgccggtacagtatatggccttgatcttgtcccagtgattgtaatcaagagtgcgttttttcgtgc

SEQ ID NO: 14757 - DNA, 1234 bp, Triticum aestivum
  unsure (1)..(1234): unsure at all n locations
  Clone ID: PAT_TA_14757
ccgaatttccctaaaaaaataaggaaaaaaaggaggagcgaaggcgagcaaccgaatgattccgctgtgcgcatcctcctccccgtccacacccgctataatagcgccacgccctcgtcgccttcgtcaccgcaccaccactccctccctacctcactcccgatctccccaccgccacctcgtcctcgcctcgtcctcgcccgctccgaccccccggcccctcgcgcgcgcccaccggcccggcgccgtggccacggcagcggagatggtgttctccgtgacgaagaaggagaccaagccctacgagggccagaagcccggcacctccggcctccgcaagaaggttacagtattccagcagcctcattacctcgcgaatttcgttcaatcaacatttaatgcccttccagctgaccaagtaaaaggtgccaccattgttgtctccggcgatgggcgctatttctcaaaggatgctgttcagatcattgcaaaaatggctgctgctaatggagtaagacgtgtctgggttggacaagacagtctcttgtcaactccagctgtatctgctatcatccgtgaaagaatttctgcagatggcgcaaaggctactggtgccttcattttaacagccagccacaacccaggtggtccaaccgaggactttggaatcaaatacaacatggggaatgggggtcccgcccctgagtctgttaccgataagatcttctctaatacaaagacaattactgaatacctcattgcggaggaccttccaaatgttgatatttctgtgataggtgtcacttccttcactggacctgaaggcccttttgatgtcgatgtctttgactctgctacagattacatcaagctaatgaagacaatctttgacttcgagtctattaagaagcttctggcatctccaaagttctcgttctgttttgatggccttcatggtgttgctggagcttatgcaaagcgcatgtttgtggatgagctcggcgccagtgaaagctcactgttgaactgtgttccaaaggaagactttggaggtggtcatccagaccctaacctcacctatgcaaaagaactggttgatcggatgggtcttgggaaaacctcaaatgttgaaccccctgaatttggtgccgcagctgatggggatgctgaccgcaacatggttttgggtaaaagattcttcgtgacaccatcagattcggttgcctttannnnn

SEQ ID NO: 14758 - DNA, 941 bp, Triticum aestivum
  Clone ID: PAT_TA_14758
gtactatgtataaagtttacatggcaattccttatttcagtactgacgtagttcaactcacagtttttgacataaatacataaccacagcaaaccagggggggcaagggaaaactgaaacctctcgtgcacagctcatcacagaaaggaaaaaaaagcacaacatcaatccatgtttcagcagatgaaagccacatgaacatgctcatcactgcagtagagcccaggctgctgagtgtatccttgcttggacagcgctgcacgcgctttcatgacgagatccttgtttgttatctttccatcatcgctcgcgagaatggcctggatggcattgctcatcgcgccaaaggacgtaccccccggtatggttgcatctgctgatgtctggctggtttggcacccactgatgaggatgccgttgttaggcgcccatgacttggtcccggcatacgcctcctcagcactgcccatatcttgttctatcgccggcttgaaagtctctccctcggtgccttcaaggcaagccttcaggaactggtgagctagcgaaccaaccatgcccatgacaccgccctgctcacctgatccaccttcatggaacttatcaagcatgactttcatgaacttcttgatctttgggctggcatcgtccccgaagacgttaaacagagtcagccggattgagccctcctcaatgtcatccttcccagtttgctccttgagcatctcaataagtgttgagagtggcagagagcgatttttagtgaggccatccccagttggttgctcatcctggtcctcacctccgtggcggctatgagactcaaacgcgtcacgaacggtctctttgaggaaggaccggaacccgccgccagaatgagatcgctcttcttcgggttcacgagactgggtctgattctgcttggtgctattgcctatctg

SEQ ID NO: 14759 - DNA, 2812 bp, Triticum aestivum
  Clone ID: PAT_TA_14759
cccacgcgtccgaccacacgtacaccacttactaactagctgacaggtgagaggagacgtgggcacgaatgagtagcaaaggcaggaaaaaacgtgactccacgttcggtttttttttttttctcttttggttgaaactaaagaagcaactttatgtgtacctatgtaccaaatgtcccacccggcccctcccccattcctccacctgacccccccgccacctcgcgcgcgcctaccggcccgactccatggacacctccgcggccatgcagtactccgtgacggagaaggagaccaaggccgacgagggccagctgcccgctacctgtgcacagcgcaagacggttaaaggaaaccaagccgccaccttcaatcccaagtttcgatgaagcaacaattccacctcatcctgctcaccacgtcaagtgtgcaacccatgctgtctcgggcgtatcgttgcattgaacagagcagccacgttcattcaatggcgaaatgcgctgctgttaattttacaaagaccgctctggctaaggacatggcccagtcacttgactgctcatcggactcctaaatggtcttgccccccggtatagtgtcttcttgctgatgtctgcgctggtttggcgacccactttgatgaggaggccgttcgtgcaggcgccaaggcttgtcccaccccgaaggactcttggactcctaccacaacattggttctatcgggggcttcgaaagactattcttcgcggtcttaaagtttcgtcatccagaactggttagttagtacaccaactatgcccatgccaccacacttctcaactgctccacttgcagggaactccttaaccatgactttcatgaactttgtgatcgatgtccttgccttcgttccagatgacgtcaaactgagtcaggacgatttttgacttcgtgactgttaacattctgcttgtatttccaaagttcttgtattagttttatagagttgccggtgtgcggtttttagtggtactgcccatgtttgggcatctcctcctggtcatggactccttcgcggcgaatggaatctcacgggtgaactgtggtccaaatgaagaaggaccagaacctcatcctggcactagaccgacctattcagaagaaccgggtgaggcgcttaggtcttgggaaaccctcaaatgctgacccccctgaattgggtgctgcacctgatgtggatcctgaccgtagagtcgttctgggaaaatgatactttgtggcaccttctgcatcagatgctattaaatcatcaactgctgtccaattcatttcgttgggtcgcttctggctccgtcgtgacaggggcctcgttgctgtgtccaccaatcatgctgccgcctagtgtacggttggtggcagaatgtagatctcaaattcggaagttgctgcggcggcgagttgctcaatttgttgggaagacctgttgggcacgtggtctgaccgcagccttggggagggtaggatttgggctggtctaggtcggctatctattctagcttgaaggaacaacggccaccttggaggttgataatcttgtcaacggttgaggacaatgttcttcaccacggggctacttatggtcgccattattatacacgatatgactatgaggaatgttgatgcagaagctgccaaggaacttatggctaacctagtcaagatgcagtcgtccgctgtctgacgttaacaagtcgatcaaggagatccagcctactgttgcagatgtggtctcggctgatgagtttgagtacaaggaccctgttgatggttctgtctccaagcatcagggtatccggtatctcttcggagatggttcccgactggtgttccgcctttctggaactggttcagttggtgctactatccgtatttacattgagcagtatgagaaggattcttccaaaaccgggagggcgtcgagtgatgctctttccccgctggttaatgtggtctctgaagttttcaaagatctaagggagtaccaccggccgatctgcccccggccgtgatgacataaagttttagacataaatatgggccgaacgcggcgcaagaagttcctttctggcttcatgttcaattgccctttcttacacgccgctcacaccctgaataaatgtatgttgccagacagtttccgtttcgtgctttttccttaccctgcagccggtacagtatatagccgtcatcttgtcccagtgtctgtactcaaaattgcttcttcgcgggtacagaattacggtgtaatccagtaccagtgacgcaaatcaagagagcgtttcttcgtgcaatgcaatatattaacgtgtttcttttttcaaaaaaaaaacgtaccaatcttatcttgaacattcaaaggaaaacacgcaccgcgtgccgtggtcgctgtagtggaagaagaggaagtccccacggcgcgcttcccccacgagcttggccagcgcgtggcggatgttggcgccggtgggctgcggccccgaggagccgcggtcgaggaggacggtgatgttgtcctcgtcgaagccgaaccggtcgacgaggcacttgtgcatgcggtcaacgtcgttgtggcagcccttgagctcggccttggtgccggggtagttgatgcccaccaggagcgcgagcttgcggcccatcgcggcgatgcgccggctgcggcgtcggtcgggcggccggaggggagggggagggggagggggtggagtaggtgcggggtccgtcggttgccggtggtactgggggataggtgcgctgcgcgtattggcgtttc

SEQ ID NO: 14760 - DNA, 1160 bp, Triticum aestivum
  Clone ID: PAT_TA_14760
agccggacgtccgcggcctcatccacgccgcgctccgactcggctaccgccacctcgactgcgccgctgactaccaaaatgaagcagaagttggtgatgcactcgcagaggcatttcagactggacttgtcaagagggaggatctgttcatcacaaccaagctttggaactcagatcacggccatgtgcttgaagcctgcaaggatagcttgaagaagctacagctagattatctcgatctctatcttattcacttcccagtagctaccaggcatacaggagttggcacaacttctagcgctctcggtgatgatggcgtactagacattgataccactatctcattggaaacaacatggcatgcaatggaagaacttgtttccatgggactagtgcgcagcatcggaatcagcaactacgacatcttcctcactagagactgcttggcctatgccaagataaagcctgcagtgaaccaaatcgaggtgcacccctacttccagcgcgattctcttgtcaagttctgccagaagcatgggatctgcgtcaccgcgcatacccccttgggtggctccactgccaacaccgagtggttcgggtcggtctcgtgccttgacgaccctgtcatcaagagcttggctgagaagtacggcaagacaccagcacagcttgtcctccggtggggtctgcagcggaacacggtggtgatccccaagacctccaagttggagaggctgcaggagaactttgaggtcttcgatttcgacatctccggcgaggacatggagaagatgaaggccgtcgacaggaagtaccggactaaccagcctgccaaattctggggcatcgacctgtttgcttagcttatttcagctgcatgcatctcagtctcagcctcccatatgtgtggtacggtgtgtggacattattcctgaaccattgctccatctgttgctcccagggcccagatagcatcaataataaggatttcgatcctcatcttccatcacgtgtgtgtgtgactctgtggttgatgttggcgttttgtcataaccacatgttcctttctctttcagctctgcttcatcaccacgtagactacgcagcgtttgccgacgattatccacagtttttcttaaaaaaaaaaaaaaaaaaaaaaa

SEQ ID NO: 14761 - DNA, 960 bp, Triticum aestivum
  Clone ID: PAT_TA_14761
ttatttatcccgtaggacgctgcttgcctcgattcgattcccatgggccgttcctcgtgatgctctgctcagatttgtgcaggaaggaggatgtgccagtgactgtcatgtgatctgcgttctggtagtccaggggatacaggatgctttttttcagatccactcgtccatgtggttatgaaatcttcgtatatccctctcctccctgttgtccgctttatgatttttgttcattcttcatgctatagaagtagaactaaaatttgtttgcacattctttattagctagtgtaggttttatatttgctttttctcccatcagggctgccgctaatcactggtcgattgctaggttccatatttatttatgtaagtttctctcaacaatggtaatcacagtatgctgcatatagttttatcacgtaggagtaaactagaaacctgaataacaggtggacaaatgtgaaatctggttgttccttcacgtttgaaatgtagttgcgtcatgatttagtgatataaatgaggtggaatgcacaaactttatctgtaagttcagtagaactgtatacatgttcgtaggtgattagctgctattattcactctgtattgaatctaatatactgctaagtatgctaatttctgtcagccgtgttactttattgtaactttttgcattattttgcatttcttgttgctgtgatttgaggttgacatcggttgagaagtatttgtacatacgagcaagttgtttattagttgtctgcaaatctgagtgtgtttctatgaacttatgttcagtttgctgccatgagcatgtttatatgagctccgaacatgcttctgtgatattaaaatgggttaatgcattcttggtagtgtgggaatctccatttcaaagttttaatctgaacacctaattttatgagatcagcagattatttaattctcatattatt

SEQ ID NO: 14762 - DNA, 772 bp, Triticum aestivum
  Clone ID: PAT_TA_14762
gattcggacgaggccgaggcggagatcggccaccgcgtggaggacctctgggaggtggcggagccgcagctgtcgccgtcggagaagctcaactcctgcttcgaggacatccccgtcgcgtccttcccgcgcacacacccgtcgcaagtcattgagattccttcggacgcgggtcttgctgaaactgtagaaatattatccaaaaacaaaatcttgagtgcacctataagaaatgttgaggctccagaagacgctagttggatggacaaatacatcggcattgtggaatttgctggtattgccatgtggttgctcagtcagtctgatgctgcggttaatgggacagttggttcgggagcaggatcacctgtctccaatctagtttctaggctgggctcattcacattcagtaggacatcatctggccgggtagaaactgctactgattctgaatcagatgaagcagcgtcagttggtgggagcttttttgaaaccctaacttcctctgagttctacaagaatacaaaggttggcgatatctcagggagcttccgctgggcaccatttcttgcactgcagacatctgacacattccttaccatgttgctgcttctatccaagtacagaatgaagagcctgccagttgtagaagtgggaggagataagattgagaacattatcacacaatcctctgtcgtacacatgcttgcagagtgtgttgggctctcctggtttgagagctggggaactaagaaactctctgagctggggc

SEQ ID NO: 14763 - DNA, 619 bp, Triticum aestivum
  Clone ID: PAT_TA_14763
tttcagattgaaacgctaccgagatgttcagaaatcttataacaagtttggatacagagggccgctaccttctgttgaatgcaatcgctaaccaactgcgttatcccaatagccatacgcactacttctccttcatcattctgtatctatttgctgaggctacccaggaaattatccaggagcaaataacgagggttcttctggagcgtctcatagtgaaccgccctcatccttgggggttacttattactttcattgaattgataaagaatccgcgttacaacttttggaaccggtcttttacacactgtgcacctgagattgagaaactgtttgagtcggtggcaaggtcctgcggtgcaaaagctgtagacgaaggaatcagtgtgcatgatggcagtcactaaagttatttgctttgttgaagtgttgtttttgtactatttcttctgtctggcactgtaaatatttgcgtgctgccctatctgtgcttgtacagatcgtctgaatagtaaataaggctggaaaactgtagtgcgtcttgtcagcgatttgggtgcctgtgcttttgcctggcagctatggaattactattgattgcaaaaaaaaaaaaaaaaaa

SEQ ID NO: 14764 - DNA, 717 bp, Triticum aestivum
  Clone ID: PAT_TA_14764
ggcggcgatggagagggcgcgggcgatggggccgtgggagtgggcggaggcggctctcccgtgcttggcgtggatgcggagctacagatggaaggaggacttccaggccgacctcgccgccggcatcactgtcggcgtcatgcttgtgcctcaggcaatgtcatatgcaaagctggctgggcttcacccaatttatgggctctacacaggctttgtcccactatttgtctacgcgatttttgggtcctcacgacaattagcagtaggtccagtggcacttgtctctctgctagtgtccaatgttcttgggggtatagttaattcatctagtgagctgtacacggaattagccatattattggcattcatggttggaatactggaatgcttgatggcattgctaagacttggctggcttattcgtttcattagccattctgtaatatctggattcactacagcttcggccatcgtaattggtttgtcccaaatcaagtatttcttgggttacagtgttacaagaagtagcaagattataccacttattgagagtataattgctggaatagatcagttctcctggcctccatttgtaatgggatcagcgtttcttgttattcttctaataatgaaaaagctagggaaaacgaataaaaaattacgtttcctgagagcttctggtccactaacagctgttgttcttggaacattgtttgt

SEQ ID NO: 14765 - DNA, 656 bp, Triticum aestivum
  unsure (1)..(656): unsure at all n locations
  Clone ID: PAT_TA_14765
cacccggagcagccgcagtcccaccgaccccgccgccggtcgccctccatctcctcgccgctgcctctcgtttctcttttcaataatcaagatgagccgtggtggtagtgccggtggtggtcaaagttctctgggttatctctttggaagcggtgagccccccaaaccagcagtggcaccagctgcaagtgctccacctgttgagaaaccatctgctgcaaagactgatgcggccaagcaggttgctgctggggttaccaggccaaaccaataactaccacagggctgatggtcaagaacactggcaacttccttacggaccgtccttcaaccaaggtccacgctgctcctgggcggtggctcttccctgggctacctgttcaggtggcaactgatgcccgtgctgggtgcgctcaacaaaagttatcctcccctgcctgctgcgtgctatgtctgaatcgtgaacaaccgttgtcatttcatgtgtgtaccccgtgcaatgctttgtgcgcatggttgattccccggggcaaattccgtcgtgcatgcggtggtaactgtctcaaattaagggaaatctgtgccgacacttatcgaagggtggcgttcccacaactccatccttgtatggcttgggtgtacattntnacatcgnn

SEQ ID NO: 14766 - DNA, 521 bp, Triticum aestivum
  unsure (1)..(521): unsure at all n locations
  Clone ID: PAT_TA_14766
tgatattcgtcaaccaacaataccaggtccattggggttcttgtcttgctggttcagcggtaggaagtgttcttcacttcaacaggtggttctctgattgagacccctatttgattctcactgtatccgtcattcgcctttgattgtcatctcccggcgcagaaggtaatcaccaagcagtgcattgctgatcgctgatcgttacggcgactttgtatatgtcgtttgcagcagctgtaattgtaaatagtgtactgtgcagccctaggactgagagataccttgtgttattctcatgtgtaaagtaaaccccatatgacctcaatatatgaaaccttgtcaaatgtagtagaccatagcgttagagtgccaaacagaccaaccaggtagcaggtaacaaccagccatttacgtgaagacaagaagacaatttcttttcttttttcttttttcttctttcttgtgagctgtctgaataagaaaaaatccnnnaaaaaaaaaaaaaaaaaaaaaaaaaaaaa

SEQ ID NO: 14767 - DNA, 605 bp, Triticum aestivum
  Clone ID: PAT_TA_14767
cggcacgtcatggtgatcctcaaccacacgacgtcagccacccggacgttcaagagggtcctgaccaacgtcgccggctcggcagcaaagtacagcatgtcggtgacggctccggcagggatgaaggtgacggtgacgccgtcagcactgtcctttggaggcaaaggcagcaagcaagggttcagtgtcaccgtgcaggtcagccaggtgaagagagcagtagatgactacagctacattggaaaccatggcttcttgacctggaatgaggttggagggaagcatgctgtcaggagtccaatagtctcagcatttgctcagtgaggagaaagacctgccaacatagcaggagcagaaataaaggatgaccatacgaaaacaataaataatataatactgaccagaagaagtaatacatagactgaaagcaaaggagaaaaagcgcaccagggtatggtactgatgatgtcaagtgtatttagcctctataataatttataaatttgtacacattttcctcaacaaatcacatttggcctaaaatgagctagtaacacatattcgaccagtttgatttacttcaaaatatgtaaatctctaaatgt

SEQ ID NO: 14768 - DNA, 596 bp, Triticum aestivum
  Clone ID: PAT_TA_14768
tagcgtggtcgcggccgaggtacctcctaatagccaatcgtgggtgttgcgttcaaccaccgagtatgcttctaaggtaatagaaagtatgggtccccggaaaccttcagcagatgcccttgctaaggttgcagaggaccgctccaggggatttcaggctacaggactgaacattccacagccaatctttatgaaagctcatagatggggtggtgctttcccagcaatttctatcggcggtgatgataagtgtgtctgggagaagaacatgaaattggctatctgtggagatttctgcgctagtccaagtgtcgaaggggctgtccttagtggcatgagtggagcttccaaaatccttggatgtttaaacttaccatcagggttgtgacttgtgagttttgactgacatcaattcttcttgattcctctctggtttgtatctatgcgtgcatttgtcgtttaaagagatgcaatttttttgtacagaaataattggcatggccctatagggaggatattgtttgttgaatagtattacgtgaaataagaaataattgctgatttggtggcaaaaaaaaaaaaaaaaaaaaaaaaaa

SEQ ID NO: 14769 - DNA, 376 bp, Triticum aestivum
  Clone ID: PAT_TA_14769
cggcacgagggttctgggcatcaacgatggaatcaatgaggacccatccaagccgtccgaagaagccactactgaaggcggtgggcctgcacccgaggaagcacaatagcattctttttcacacaagctaggcacacataggcgtaccattccgtatgcttagttgccgtcttgttgggaactgcttgtacgtgtatttttgttagacgttccccactggttaggctgtgttttaatattgctgttttggctttttgatgttgagatcgtactactttcgattattatattatcttataattgttgtaaacatactatactttttgtcaaaaaaaaaaacatacaatactggttaaaaaaaaaaaaaaaaaaaaaa

SEQ ID NO: 14770 - DNA, 353 bp, Triticum aestivum
  Clone ID: PAT_TA_14770
tcggcacgagcgccagcgcatgatcgatcgagctgcatgttagttctggctgccctcctgtcctggtatgggttccgtccacgctgccgcggcgaggcttccggctcagttttattgtgtggccggcggcgaggcacgccgcggcggccgtgggatcccaccgcgacggcggcgtagaatgatctgtgacctgcaagtagatacacgtacacctatgtcactatattactcatatatgtgtagagtaactgtgggggttcatccgtgtaataagtcatcggcatgtatatcctctccgtctctgttcatcaatatacatttctatatatttcaacaaaaaaaaaaaaaaaaaa

SEQ ID NO: 14771 - DNA, 560 bp, Triticum aestivum
  Clone ID: PAT_TA_14771
cgtccgcattgacagagttagttctcaaaaaaagaccatcgacagttcaggcaccgacagttcagtcatggggcatcaatgggactccctcaaatgaaacggcatgtcttgagttagatacaaagctggtcatctatctaattgcagcgagatctgctgccccatgagtccgacacaggagatcaaaagaaacatcagaatctcctttccctgcctcgttgtccgcaagatggatgtaggagtatgaactctggaggtttttcctacgcaggagacatcttgtgctggtggcacaacaaacagcagaagattatcatgggatgtagtatatgtctgtcgcaattttgtagagcgactcatgactgttgtgcttccttttcccgagaagacggtctgagactctggcctgtggtgtttgctgtatcggcagttttcttgattagtgtggttttgtactgacttgatgctggattaccgagcatctgaacatgcccatacagatgtggcaatgtaatatatgctgattagatgattgtatagttgtgtccgtctttttcttg

SEQ ID NO: 14772 - DNA, 993 bp, Triticum aestivum
  Clone ID: PAT_TA_14772
cggcacgaggccacagggagagtgatcaccaacagtccccttccatccatccatggcatgcatcaacagcaccttccagagttgctccattgccagaggagcaaagatcagcacaagggctagtaggggcagtagtggggggaaggggtcaccgacctttcagtgccggcccgcggctttcgtgaacgctgccagcctccggcttgagctcgacgaaaaccctgaggcaatcatctccagggtgtggcctgagaacgtctcccttctgagctacgacgatctccgcgcctacctcgagtcgcaggagacggtccaagtagaagatgatcagcacgtggcgctcttgggtgaggccatgtcaacacctgtgctaatggccacagcagatcagacactggaggaggttgaatgccactttgaggccgtgtcagggcttccagttgtagacagcagcctcagatgtgttggggtggtcgtcaagaatgaccgggccagagcttctcatgggtcaaagacaaaggtctcagaagtgatgacctctccagccatcacactatcttctgacaaaactgtgatggatgctgcggttctgatgctcaagatgaagatccacagactaccagttgtaaatcaggacgaacaagtaataggtatagttacccgtgctgatgttcttcgtgtgttggaaggcatgctgaaggtttaggagcgcagcaatccatgcttggaagtcagagcttcttgtaaatatgtagatgtgtccatggtgcttttgagtagcagcatggagatctatagtctataggagtgtgctgtgccatcagtaacaataagtccggaagggttgagagtttttccttgtaaataaaagtagcacgccaggagactccatctctgttttgtactgctcgcgcaaccaaatgctgtaaactagccaaatacttccacagcaatataaatggatatacctaaaaaaaaaaaaaaaaaaaaaaa

SEQ ID NO: 14773 - DNA, 618 bp, Triticum aestivum
  Clone ID: PAT_TA_14773
gcactttaagaacacacgtgagactgcttttgccatcaggaagctgcagttgagcaaggctaaaaggtatcttgaggatgtgattgcccacaagcaagccattcccttccgaaggtactgtggcggtgttggacgtacagcacaagctaagtcccgccactcgaatggtcagggacgttggcctgccaagtctgctaaattcattttggatcttctcaagaatgcagagagcaatgctgaagttaagggcttggatgtcgatacgctctatgtgtcgcatattcaggtgaaccaagctcagaagcagcggcgccggacttaccgtgctcatgggcgcatcaacccttacatgtcttccccatgccacattgagctgatgctttcagagaaggaagagccagtgaagaaagaggctgagacccaaattgcacccaggaaggcctagaagatatgaagccttgtttagtatcagttaagagtggaccgatcgcctgtatctccttttttttctgtactgttggtgcatacttcatcgatccccggaatggaacctttctttctgcagttgtgaccacatcccaagaatgagaatgttgcctcagtagtttttcttattta

SEQ ID NO: 14774 - DNA, 888 bp, Triticum aestivum
  unsure (1)..(888): unsure at all n locations
  Clone ID: PAT_TA_14774
cctcgacgacacggcggctccgaggacttccaagaggtgatcacggccatgatggaaggcttggggaccccgaacgtgtccgacttcttcccggtgctcgcgccggccgacctgcagggcatgcgccggcgcctggcgcggatcttcgcgcggctgcacgccgtgttcgacgccgaggtggacaagaggctgcgcggccgccacgccggccagcccaggaagaacgactacctcgacgtgctgctcgacgtggcggcgcgtgacaagggcaaggacctgctggaccgtgatacgctacgctcacagttcacggatttgtttgctgctggtagtgacacaagctctagcacagtggaatgggcaatggctgagcttcttcgaaacccatcatcaatggctaaggtttgtgacgagcttgcacaagttatcggctctagaagaaacattgaagaagctgacattgttcggttgccctatctccaagctgtcataaaagagacttttcggctccaccctcctgctccactcttgttgccacgccaacctgagacgacggtcaaaatagctggttacacaatacctaaaggttcacgcgtgttcataaacgtatgggcgataggtcgagataaagatgtatggacagaacctgagaagtttatgcctgagaggttcttgggttcggcaattgactttaagggtgtagattttgagctccttccatttggtgcggggcgtcgaatccgccctggaatggnttggcaattaagatggtgcatgtgatgctcgctccatgttaaacaatttaagtggagtctcccgttaactggaacgggatgggantgatatggaaataatttggcctgacacantgaaggcgtncccttggcn

SEQ ID NO: 14775 - DNA, 868 bp, Triticum aestivum
  Clone ID: PAT_TA_14775
gtttgatcttctatcattgaatgatagctcatcttatgaatcgaagccaaccaatttacataattcatttatccatgcaaaaagaattgtagtttttggcagtttgttgagaaaggagatggagcctgacacatcaggggggataatgagaatgaaaagttatttagacagatcaccgcccttgggggagatttaggatcccagttgaagctgagaggctgagagataatgatcttgtccttgagcaataccccttagctaattcacctgggaatagctggatcccggcttgatccttccagtgtttataagacctcgtgtgacccattcaccttcctcatccagagttgggcatgaggaagtttccattgacacgaatgggggatagttttgtccctcctgccggtctttctgcccaggtctcaggtcccggggagtctggcaaggtgcctgttccggattacccttccccacatgttgatcccatttcaccacggtgccctgttttcccagtgctgcgactccgtcctccctgtgtttcctctagatctctcggcgatctccctgccggtggtgtggacatttctgtccctgcgaacttaaacgtgcggactcttcctttggcatccggactgtctttgtcaaataagatcaagttgtactactatgctgatacatatgagatgggaaagattggcagtctctcagctgtataatgtatgtgaggtcgtacatgccaacctgggatgttaaccgtcgtccctagaagattgttgtaacctattgtttgtacgtgttgatgtggaagtaagagctgttgctacaaatacatgatgtcttttttagtactttttttttgcttacccga

SEQ ID NO: 14776 - DNA, 511 bp, Triticum aestivum
  Clone ID: PAT_TA_14776
gaggctctcatcttcgggttcgcatcgcagcgtcttccgcccaggctaccaccatgccgaagcagatccacgagatcaaggacttcctgctgacggcgcggccgagggacgcgcggtcggtgcggatcaagcgtgccaaggacgccgtcaagttcaaggtgcgctgctccaagtacctctacaccctctgcgtccacgacgccgacaaggccaacaagctcaagcagtcgctcccgccaggtctgactgttcaggagatttaagtatcaagccacaaattgtgctgtttgtggtatcgaggatgtttgctccagtattactctagtatgtaggtgatttcatgctatgtttgaatggattatgaagttgtgtttgggagatgtaatattggaagtggatgtgttgaacctatgagcctgtggtgtaatgctactccccaccaaaaagatggctatcaatcataagttaaactgaattcggatatatttgctgccaaaaaaaaaaaaaaaaa

SEQ ID NO: 14777 - DNA, 581 bp, Triticum aestivum
  Clone ID: PAT_TA_14777
cggcacgaggcagaatcccccattccaagcgagggttttgctgctgccccggtcaagaggaagcggcgcggcgcggcgcgatggcggtgggcgacctggcgttcaaggcgctgacggctgggctcggcgtcgccacgctctacctcgccgccaccttctccgtcaacgtctaccgcggcctttcgtggcactccgagcaatccaagctagaaaaggcgaaaaatgaagattgacaaggatcagcaggcagatttagatagcagatgaaaagagcggagggggcctttttgttgatgtcttatcatgtcaattgtgtttgcttgtgccgcagacctctcgagatatccggactgtatcttctagtatgtgatataccatagtccatatacgattcaagaatctgtttgggatggttattcatctttcagcatcataaatggcttttgaaacatttttactttccacctttgcgtgtgtatcctttgcagccaacttggcgtctatagcacctcaaatagtactgaaatatggctaaatgataaaatcagaagttttctttcctcaaaaaaaaaaaaaaaaaa

SEQ ID NO: 14778 - DNA, 1521 bp, Triticum aestivum
  Clone ID: PAT_TA_14778
ttcggctccgcgcccccccccccccgccacgctcctcgccagcacgccacccacctccgctgcccacctcgccgccgcccccgcacgctcctccgccctccccgcctcccacgcctctctcctcgccgcctccgctcggactctccggcggcttccacgctcgccttcctcaggccgtccgcgccgagcccggcgaccaacctgagggcgccggtcagatctcgggtctccactggagtgtccgtcgggtcggcagtcgcagcgggcgccgactcgctcttcggccgactacaaacccaccaccgcattctgtttccccggacaggttgctcaagatgatggaatgagtcaacagtgatcttaaagttcgatatatatgctaccagccttgcagatggcaaagggtatccctcacgataacttggcgaatctgtgattaaatgggcagatatgaaatgtggtatcagctcaggggtatatacagcgcttgcatttgctgtagcattcagctcagactatgatatgtagctcgtcaagcctagaggagaagccatgcaggatgcctcagacgctgcctaatagtgcgatggttagtgtcattggtctagattcagaaaaggtgcaacaattagtgcgatgctgcaaatgaggatgtggatgaaaaggaaagagttcaaatagcaaattttctctgtcctggataactatgcagtttctgggtggtgtgaagggtattgaagcagttgaagccaaagcacagtcttttaaggccagaatgacggttcagcctagctgttgctggatgctttccacacaagcttcatgcaacccgctgtctccgagattggaagtctgcattggctgctacatgagattagatccccgagaatcccagtaatctccaatgttgatgcacagccccactgccgattctgtagacaaatccaagaagattttaggcacaacaaagtaagcttctcctgctgcaatgggagactacagagacaacactatttgggtagaggccttgagaagtgctatgcaactcggacctagtaaaggtaatagcaggaatcatgaaacggatcaacaaaggtgcctgcatcgagaacattggcgcatgagacattgaatcgccaatattataagggcaaataataaagcaaggggggctgcttagatttaagcaacactcctaactgtactaccagggcacgagagcaccacagggtctggcaatttcctgtcatttgtgaagaacatagatagtgttgtccaattatgtttcattggctagagctaggtttctcggcggttaagcttgccctctatattgtgaggaccagaatgaaatttcagttatagttctgagttgtatcagtaatttcatcacaattatgtttcattggctagctaggtttctcggcggttcagcttgccctctatattgtgaggaccagaatgaaatttcagttatagttctgagttgtatcagtaattttaaaaaaaaaaaaaaaaaaa

SEQ ID NO: 14779 - DNA, 702 bp, Triticum aestivum
  Clone ID: PAT_TA_14779
ttcggcacgaggaagtccttgcataagtcatatgattagctcttatgaaggaacttcttctccttgaacaaattagttagtggcttggtgtactaggagatacatatggaatggaggtagcgagcctatcaaaccatagcatacttcgtacatgcatgactgacttgggatggtaccaggggaaacaaaaacaatccttctcgaactcacggtggcaacttgcaccaaatgcacgcgaatcagagaaagtcgcttctttcatccaacatatgcttcatgaacggaacatgaagataatgcttatataagtttccaacactagttggatgttcaacacgaatcatggaggagacaaaatgctgctaatgggctcaacaacaagtcatcgagatttccatatggatggaattccacaattatgtgaacaaagtgatagcattggtcagaagaaaagatataacggtgtatgctcaaggaaaaaccacgagtatgacaacattatgaacatcgttgattctaatttgaattgaggatagcccacgctcaaataaaagttttggcaagacaatagatccaacaactgatcagaggaccaatcgatgaagatatcacctttcttccacacacacacaagtgcaaagatatcccttcagaatgaactaaattcggcaaagcttttatcttccaactctccaagttgtt

SEQ ID NO: 14780 - DNA, 661 bp, Triticum aestivum
  Clone ID: PAT_TA_14780
tcggcacgaggtggacatgtatgttatcacatcatagcagctggtttgaacggctacatggccactgtgaccaaccttaagagtccagtaaacaagtggaaatgtggtgctgctcccattacttctatgatgaccgtgaagagatggtcacgtggtcctgccacgagtcaaattggtaagcctgctgtccacatggcgagtgttgacttgaaaggaaaagcatacgaactgttgagacaaaactcttccagcttcatgatggaagacatctacagaaaccctgggccacttcagttcgaagggccgggtgctgatacaaagccaatttcattgtgcgttgaagatcgggactacatgggaagaatcaagcagttgcaggagtacttggagaaggtgaaaagcattgtgaagcccgggtgctcgcaggatgtccttaaagcagcgctaagtgccatggcttctgtgacggaaatgctgaccatcctgtcttccccgtcttttagtagccaggcgaccatctgaaggccaaactgaagatgtcgtatgcggggctctcatgtcccagacatatttctgttcttattgctgcattatctgcctatctgaaactaccggaatgataggtccattgctcaatatctgcttagttttcgggtcaaaa

SEQ ID NO: 14781 - DNA, 605 bp, Triticum aestivum
  Clone ID: PAT_TA_14781
atggttcgcccccttggtttggccccattcgggcaaaattgcgttttctgttgtgccttgcgatgccatccctggttggattcgtgctggcagttttgcttactcaacaggcgcccctttgcttcccaaaaggtcgcggtgctggcgctgcgcactgcgcagtattttggctggcgcacggccgctttgcacggccgctccgcgccgcccccctcagcccctgtgcccccggtgcacgctcgcatccccttctcgtgccggcggcggcggccgcgtcgaagagcatccagatctcgttgaccctgccgctgaactcgaagggcgagttgtactgcgcgacggtgtagggcgaggccgggtcggccctgcgcgcgtcgttgacggcggcggcccaccgggtgccctggaggctggcctcgagccgcgccgcctgctccccgacgtcggcgtccgccacgaagcccccgaagcggcgcacggccgcgtacctggccccggcccagcggtccacgcgcaggccctcggccggcggcgggtccgcctggttcttggccggcacgtagaagctcacggcgaaggcggaggcgcagaagggcccgtcgctg

SEQ ID NO: 14782 - DNA, 718 bp, Triticum aestivum
  Clone ID: PAT_TA_14782
ttcggcacgaggattttagccgccgccgccgccgctcacccgcgccttcgacgagctccagcccgtagacctcgccggatctccccgatggccgtgaccttcaccgacctccacaccgccgacgggctcaaagccctcgagcagcacctctccggcaagacctacgtctccggaaacgcgatcagcaaggacgacatcaaggtgttcgccgccgtgccatcaaagcctggagctgagttcccgaacgctgctcgctggtatgataccgtcgctgcggccctcgcttcaaggttccctggcaaggcagttggagtgaatctgcctggaggaggtgcggcatcgtctgctgcagcggctgcgccagctgctaaggatgctgatgaagatgatgatgacctggatctttttggtgatgagaccgaggaagacaagaaagcagcagatgagcgtgcagcttccaaggcctcttcaaagaagaaagaaagcggaaaatcatctgtcctgttggatgtcaaaccatgggacgacgagactgatatgaagaagttggaggaggctgtccgcagtgtgcagatggagggtctcacctggggagcatcaaagcttgtgcctgtgggttacgggatcaagaagttgcagatcatgttgaccattgttgatgacttggtgtctgtggatagccttatcgaagaacatctgactgaagagccgatcaacg

SEQ ID NO: 14783 - DNA, 543 bp, Triticum aestivum
  Clone ID: PAT_TA_14783
gattcggacgagcccgacgcgccctccccctcgcccccatcgcggggctcggccgcggcgaggcggccgcggtcccggtcgccgatggggatgtgcagaggtgggaggaagggatcgcgcggggccgagaccttgccgatgtactgaaacttctgccagtgaattccctatcttgtaagcaaattgagaggcgatcatgcatttcattggaggcatttatacgtgattactttttatgtgagtcccctgttatactcagtggatgcattgagcattggcctgcaaggacaaagtggaaggacataaagtacctacagagtatagctggagatcggactattcctgttcaggttggaaaaaattatgcatgtactgagttgaaacaggagcttatcacattttctcaatttcttgagaggatgtggtcaagtgattctgcaaacttggcttgtttagcgcagcatcaattgtttgaccagataaaggagctccacgaagacatttctgttcctgagtactggttagctggcgggggcaaactcc

SEQ ID NO: 14784 - DNA, 639 bp, Triticum aestivum
  Clone ID: PAT_TA_14784
gaggggagtcgaccctcgacttcgacggttctcttcttccgcggcagcgctaaaccaaaggaaatggcggcggcggcgaagagcgtatgcgtgaccggcgcgggcggcttcatcgcgtcgtggctcgtgaagctcctcctctcccgtggccaatacacggtccgcggcaccgtgcgcgaccctggtgctagcaagaatgctcatctcaaggcgctggaaggagctatggaaaggttgcagcttcttaaggttgatttgttggactacagcagtgttgcatcagcaattgccggctgtgagggtgtcttccatgtagctagtcctgttccttccggtcggtcctccaaccctgaggtggaggtcataggtcctgctgtattaggaacaaccaatgtgttaaaggcttgctatgaggcaaaagttaagcgagttgtggtggtgtcttctgttgcagctatattcagtaacccttactggcctaagggcaaggcctttgatgaagactgttggtcagatgaggattactgcaggaagaatgaggtgatacagttgttccttagtaaagcaatggtgttggcatagagaaaaagaatcatcttgtactataacaagaattaacttttgacattcttgcatgaa

SEQ ID NO: 14785 - DNA, 760 bp, Triticum aestivum
  Clone ID: PAT_TA_14785
ctgtgcggcgctcgaggcggccggtcgggaaaaacccgttacgccagaacaccagcagaacagacaaaccaactcacacatacttgctcccagtgctgaggagtggaacatatcaacaagaagtgcagaaacaatgagaccaggggcaggtttcaatgcgacggcggcagcaacgaaggctgcggtagctcctctggccgccggcgccgcgcactccgcgtggcactcgccggtgccgtacctcttcggtggcctggccccgatgctcggactcatcgccttcgcccttctcatcctcgcctgctcgtactggaagctgtccgggtacctggagggcagcgccggccgcggtgacgaggaaggttccgccaccgacggcgccaagccggtggcgtcggacctgccaccagcagcgtgggaggagaaagtactggtggtcatggccggcgacgtggagccgacgtacctggccacgcccatgtcaagcagagaccgtagcagcaagggagaagaggaagagaagaaggtgtccatggccgccatggctagcaccaaggatgctggtaatagtgagcacagtcagaatcggagagaacgagatgaccaccacctcccctaggtgtgagttttgcaccctgttcctttttaggcttaggtgagctggcggtgaagccttttgattcttccaaataggagaaagttcatctgcagttctggactatgcagggagagcgtaaccccggtcagagccatgtttttt

SEQ ID NO: 14786 - DNA, 945 bp, Triticum aestivum
  Clone ID: PAT_TA_14786
agcttcagtgaccagaccgccggcgtcctggccctcggcggtggcgctgggtccctccttgcgcagaccgcggagaccttcggcaacgccttctcctactgcgtcccgcacccgagctccgatggattcctctcgctgggcgggccggtggggaactcgtcgcagttcacgagcacgcctctgatcaagaaccaacacgctccgacgttctacatcgtccgcctggaggcaatcaccgtggccgggaggcggctcgacgtgccgccggctacgttcgccggtggtgcggtgatggactcaggggcggtcgtcacgcagctgccaccgtcggcatacgcagcgctgcgggcagcgttcaggagcgccatgacggcgtatggcccgcttgcggatcccgtacgcaaccttgacacgtgctatgacttgacccgcttccccgaggtcaatgtccctaaggtgtccctagtgttcgtaggcggtgccaccttggagctcgagccggcgtccatcatgctggacggctgcctggctttcacggcctcccctggcggccacggctccatcggattcatcggcaacgtgcagcagcagacctacgaggttttgtacgacgtcggcagcgggagcgtgggattccgcagtggcgcgtgctgatgtggcaagctgcaggccaaccacggccacttgtacgtgtgatgcatgattgcccccctaatatatatctggggtctacaagctagcttgctcattgggatggagctagtttgtgagtataaataaatgcaagaaagaagattgatgtaatacttatatatgcatgtaattttatatagttttatatatgcatgtaattttgttcaacggttgtatgattgtaaaccttataatataaccttacagattgtcaaggaattcaaaaaaaaaaaatactctaaaaaaaaaaaa

SEQ ID NO: 14787 - DNA, 1065 bp, Triticum aestivum
  Clone ID: PAT_TA_14787
gcttcagggcgaccagcccatgggcttcgcgctcttctcctccgcgcaccaggccatcgctgccaaggccgcgctccaggatatggtgttcgatgctgagacccaggtggcgctgcacaccgagatggctaagaagaacctcttcgtcaagagaggtgtgggaattgatgcaaatgctgtggatcaaagtaaacggttgcgaacaggtggagattatactcattctccttatgctcctccatttcatccacctccaccagctgtttccatgtggggaaccccaggatatatcacagcgccgcctccttacaatccctatgctgcctatccgcacgaggctgtagctatgacttcaccttctcctgttactggtccaactgcctatgctcctgtgcagaacacaaaggataatcctccctgcaatacccttttcattggcaatctcggtgatactgtagtcgaagaggaattgcgaagccttttcagtgtgcaacctggatacaaacaaatgaaagtattacgtcaagataggaacactgtttgctttattgaatttgaggatgtgaatgctgctacatctgtacaccaaactctgcagggtgctgttatttctagttctggtcgtggtggaatgcgaattcagttttctaagaatccctttgggcgaaggaaggattcagctggtggccttgcgagcgttctgaatggagctcctgtgaactgattgcagcctgaggggggatgtatcttgaactttagcatgtcatcatggatttcatactaccacatctaatttatgatctgcatacttctgctgaatgcgctctctctcatgtgacatcttcatttgatggagcatctgggacatgatcatcatctatcatcatctttattaggtggaggttctggggcatgatcatcatctggtagacattgcattgtcaccaaaacatgctggtgttacttttttttaatctttgtagtttgtgaaggccatcctagatgtcttgtagatgtgcatttggcatttgtcatggacattactctttgtagtactattattat

SEQ ID NO: 14788 - DNA, 604 bp, Triticum aestivum
  Clone ID: PAT_TA_14788
tcggcacgagtacaagcttaccagagagcaagggaccagcaaagcacatcgaaatactgagcggagcgctgcagggcttgaccactctccgtccggcggaagaagatggccaaccgcggcggcgcgtccgctgctccgtgtggaaatggcgaaggatcgggacgactccgacgacgatgcctgccgaggcgggggcagatcaaggcgaggatagcgtcctccgccgtgcactccgtcgcctccggtgctcctgagagctgtaggaagacgccatcacaagctagcatcttccgccggcatcctccggttctgaggcgtggccttggcccgcccagtccccctgtggggtgagtgccccccctctgtttctcccccccttcttttcccgcggggaagggctcctcccccttcgttgtaagacgggggggtagtttccgccggggtacagtcctctttgcgcaaaagttttttggggcccccgtctgcgccttgctgccggggtcgtggccccctgactacagagagtgagggagagagtggaccgaattccatgttaattgaataagcaagtgggctgaattgctgcacgctctgcaatgcaatg

SEQ ID NO: 14789 - DNA, 718 bp, Triticum aestivum
  Clone ID: PAT_TA_14789
cggcacgaggccatattcctaactcattctacttacttggaatccatgtccatcctacaggtcattgggatgtacgttgggattgccacagtgggagtgtttatcatttggtacacacatggctctttcctgggaattgacctggctggtgatggtcactctcttgtctcgtactcccagctctcaaactggggccagtgctcctcatgggagggtttcaaggtgtcaccattcacagcaggtgcccgtacattcaacttcgatgtgaacccatgtgattacttccagggcggcaaaattaaagcgacaaccctctccctgtctgtcttggtggccattgagatgttcaactcgctgaatgcgctgtcggaggatggtagccttctgagcatgcctccgtgggttaacccttggcttcttctggcaatgtcggtttcattcgggctgcatttcttgatcctctacgtgccattccttgcccaagtctttggtattgtgcccctaagcttcaatgaatggcttttggtgatagcagttgctttcccagtggttctcatcgacgaggtccttaaatttgtggggcggtgcttgacagcccgtgccagaaaacaatcatgaaagcataaggaagattagatgctagtcatcagtgttttacatttctacttatgtcacgaggaaccaacacctgatgtagcacaaacattattttttctcg

SEQ ID NO: 14790 - DNA, 737 bp, Triticum aestivum
  Clone ID: PAT_TA_14790
cggcacgagggaggcatttcccgacactttgtcacgacacggacaccgacgcaggtggccagccatgctcagaagtacttcctgaggcagaacagcctcactcaaaagaagaggaggtccagcctctttgatgcggttgaaggtgccaacaaggcagcactccgcaggacagcatcagtatccgagctgcaattccccagcctgtcgccggtggccgtcgacgcaaggacgacgaagggagctgtgccgctgccaccatgcctgaacctgatgatgagcagcgcatcacagtgtgctggtagtgatagtggtagtagtgatgcatcacagacacagaacccatcttccctctacctgatggcaaagccgcatcaggcacaactccagatgcctgatctggagctgaagatgtcgacatcccggttatctgaacagcctggtggtgcctcccggggaacgcctctttttggaactatcagagttacctgatcttcttctatcctcggttctcatcaaaaagaaggatgggaatcggaaactggcgtctaggagataaggaaacagaagcagcaggaagctatactgtaatttcctagcatgatcaatcacgccggctgaaaaaaaaagaacaaagcaaagagaagcaataaattatgtatcttgttatcatatttctcttatcatcttagctttatgttgacacaaagggatggcaaagtagtttcccgtcatatttc

SEQ ID NO: 14791 - DNA, 677 bp, Triticum aestivum
  Clone ID: PAT_TA_14791
gaggggggaataaggtgtgcttcggctcgttccccaccccggtgtgttgatcaccggcgagctggaggccggaccttcccgcggagtggcgggattgatctgctttcggggctcctctctttgtgcggtggttgctcgccgtggaggtgggtgacaacggcgccgatttggtgttcttccagatccccttcgacggggtgctctttgtcggccttggatctatgtagaggagcggcggtgcggggctgtcatggcggtggcggtggcctcgtggatgcttttgtgccggtgctctttccccgcttcactggtgcacgctccggtgccgacgaggagctctgcggctggttgtacaagggcggcttcagatatttcttcctttccttcgttggcgaaggagaagatgaggtggtgccggtgatgcctgctggctgcctcagctccggcgtattggtccgaaaggacctatgcctgacgacttcctgcttgcaaaaaatccgtccgcggattcgaaggtcacgccggccctggaagggagcggcggtggtagcggcggtgcgccatcagcttgcgccagagtgtgggtgtggtcggctcgggacccgagtgtaatttcttactttgctgggggtcgtggtatcactggcatttctcaatagatctggggtcttttccgc

SEQ ID NO: 14792 - DNA, 636 bp, Triticum aestivum
  Clone ID: PAT_TA_14792
aaacccaggacccaggtttatcggtgaggcgagccgcgagtggaactgtggaagcgtcgagcttttttcttctttgtcttgctgcgcaagaagaagggaaacgagaggagggcggcgatggcgaagaggctgctcccgtcgctgaaccgggtgctggtggagaagctggtgcagcccaagaagaccgccggcggcatcctcctcccggaaacatccaagcagctgaatgctgctaaagtggtggctgttggccctggtgagcgcgacaaggcaggcaatctgatcccagttgctctgaaggaaggcgacactgttcttctgcccgagtatggtggatctgaagtcaagcttgcggctgataaagagtacctcctcttcagagaggatgacattttgggcacacttgtggactgattcaggtcgccggcaagcggctgtgggtgacgtccgtggtgcttgggatcggctccaggcacaatcgacccgcgccagccctgaattgtcgtgaggccaggcacgcggggcagcagctgcattggggcaaaattggtcacttgccatttgccgtcgccaaaaaaaaaaaactttcgcttttgaagtggttcccttattttgttcaaaaaaaaaaaaaaaaaa

SEQ ID NO: 14793 - DNA, 653 bp, Triticum aestivum
  unsure (1)..(653): unsure at all n locations
  Clone ID: PAT_TA_14793
gtccggcctccccttccccccgcccaaatcccgtgacggtcgccgcccccgccgtgctctcgcccgcgcgggagacgacgcagcacccccccgcgtaggatccgcggcggtcggcaggatggtggtggccacggaggaaatggtggtctactgctttgacaccctccgtcgcctatttcaccggcgagcggccgccgcctcccgccttcgaggatggaaaccacccattgtttgtgacctggaagaaggctgccaatggttcaaaaccacgcctccggggatgcataggaactctggagtcccgttcagattgtcaagcggttttagggactacgccctaactaatgcgctgagggaccgacgctttcccccaagtacaatcaaaggaactcccaactttggagtgcacggtatctatacccacggattatgaaatgcagaggactactccactgggagttggtaacatgcttaatgattgaatttacactccagatccaacacaaaaacagtgcgactattgcctgaatggcggcatcaaggtggcacatgtnaatcatgatcccctgaggaagangtacaaananatatgatctnagaaaaataatatccncaaanactgtacatcnnagnaaatttcttcnaaaaaaang

SEQ ID NO: 14794 - DNA, 1353 bp, Triticum aestivum
  Clone ID: PAT_TA_14794
ccacgcgtccgcaccaccttttccttgcccgtccctcgggcggcccccaaaaaaacaacactagctgaggctgcggcggcgacccacttctttctttcttgtctggttgcggagcggccggcggcgaggatggtggttcgcctcctcttcctcctcctccccctcgcttgctccctcctcttcctcgagctcccctcggtctcaggcaaaccaactgtccatgatgacttggatccagctcaggtgaccaacccgacgacgcccatcacagtcccatccacgaacccagcaccaacaatcatcaccgtgccatccacgaaccctaccatcacaatcccttcattaaaccctttgcccacacctatcacaaccccctcaaacgacccttcgaccacattaccattgccaaccccttcgacatctgcaccaaacacgccagtcaccattcctgttaccaccccttcgacattccccccatcggcaccactgacaaacccagcgacgaacccaatggtgcctactgtcggcactacaccgcctactgctccgaccactactccagtcacagctccagttgtgtcagggcagcaagcctggtgcgtggccaaggccggctcatcagaaaccgcgctccaggacgcactggactatgcgtgcggtattggtggagccgattgctcaccgatacagccatcagggagctgctattatccaaataccttggaagcccatgcgtcatacgccttcaacagctattaccagaagaaccctgcaccctccagctgtgactttaggggtgccgcagtgcttgccaatgctaatccaagctcaggaacctgtatattggcatcatcaatgtcttctccaacgagctctactgctggatccactgctcctactacatcatccactagccctgttactagttcatctggttctgatccaggatcatcagtactgaactcgagtggctcaggcatttctggatcatcggactttgggtcggacttcccaggagaggctaacactggcaatggttggcactcaatcttgccctctggctggtcctgggcaggtttgttctcaacgcttgcattgccatacgtcggagggatattttgaagaacgaagctgctccagaattttggaaactgtgagagttgaagtggtggcaaagatttagagttttgcctttagctgtagtggttgtatcctgtatgagtaggccagagttgtgtgctagtaggaggtaggcttattgcctgtattaaccagtggatgtagtttctaggtgtatcaaatcaaatattgattatgtgcacatctgctcttgcaagttgtcctattttgctc

SEQ ID NO: 14795 - DNA, 541 bp, Triticum aestivum
  Clone ID: PAT_TA_14795
cggcacgaggccgccggcggggtacctgaagcgggcgctggacacgggcatcttcgagcgcgtccacgtcaggatctacgacgacgccgactgcgaggcgtactggcacctggcctgggacaggtggacggcggcgtacccggccaccaggttctacgtcgggatgacggcgtcggagacgacgcacgggtgggtgcaccccaagaacgtctactacgacgtcgcgccgtcggtgcagaaggcggacaactacggcgggttcatgatctgggaacgctacgcggacacgctctccaactacaccagcatggtcaagtactatgcgtgattgatttctgatcgattcagttcagacatgaatgctgcgtcagcagcatcactagtggtgtctctgtttgtataataatacagtcatcactgtggtggtgtgtagtgtgtttgcattttgcaagaaggaataaagtgacgaataaaagatagtctgatacacggctgctacacaaatgatttttaagttaaaaaaaaaaaaaaaaaaaaaaaa

SEQ ID NO: 14796 - DNA, 730 bp, Triticum aestivum
  Clone ID: PAT_TA_14796
aggtccaaagaattttgcagaccaaaactttattcaagaacctgtatagagttttcccctcagacccccggcatgtaaaatggcattggtgattatggtaccctctgtaagattacgtgttgatgtatcaatcaaattggattgaatacaattttttattcggtatcgcctttattcatagactatgttctgtcttttcagttgtctcatgcaaacacctcggcacaaattgctaggggctctatatggcaacataggtattgccaaacaaaagtccgaacaacttttcagcacaattcggcatcccgagcttggcactatatgcaccacctctgaatcatgtctttggtcaatagttgggttgcccggctcctatgtttgctaccttacgttccgtttgttcggctagggtagtaaagggagaactactgcggttgtgtttatggttcatctagtcaagcacctcagtagagaaagccgaaaactgactgtcatgatgcggcgagagctggtcagccattcggtgacttactaaatctttaacgatttttccgttttaaacgaaggactatttttccagtcatatacataacgcatccgcattcgaatagccgcatacataccaggggctattttatagccccatcatcaaactcctatggataagtgagagccgtaaagccgtatagtccgattgcctggttcgacgcactaacacctccgtcacgga

SEQ ID NO: 14797 - DNA, 454 bp, Triticum aestivum
  Clone ID: PAT_TA_14797
cagccactgtcagtgctggcgggcagcacggtactgtactccaagtatgcagggagcgagttcaagggcgctgatggcacgggctacattgtgttgagcggcacgagggtgatggctgtcctgtcttaagccttgcgtttccagctctttctgtagtttgcagccaatagttgtgaagtggtatgaaacgatcgctttgtggtgatcatcacaaaatgctgatactgttccggacaatcggctagaatttgtgtgcacacgagttacgggctacctgtgtggggttataaacgtcagcatctgatagtgaaggcactcgattgtttttacaaaggatatttagggtgtgatgaagtcacccttctttgctgtcttcttagaacaaaaaagaacaaaaaaaacacagctcgagggggggcccggtacccaattcgccctatagtgagtcgaatta

SEQ ID NO: 14798 - DNA, 724 bp, Triticum aestivum
  Clone ID: PAT_TA_14798
cggcacgaggatccgtctactgctagcgatggtgacggccgccgccgccgcatccacgtcgctccggccactgtcttcgtccccatctcccatcgcggttacactcttcaccctgttcaacccaatttgttttctccaacgaactccaagtgtgctctaatcatccgcttttgtgttaattaaccagagtttgccccgtcggtggtgttgggggatcccggtgcagtccgccgggcggagacgcattccatgcggaacggcggagacggacgactttattatgcgcagctgataaacctcctgaagaatccctcaaaaagaccgtagaagtggataggctgattgatatgctgaggaatgcaaatcctagagagcttgatcaaatagtggttgaaaatgttctgtcattcgacgctggtttctgggttcggctagcagctagaattgacctctgcaaatcagatgatgataaagcatggtttcacatatgtagacagttttgcttcctatggatgttattatcttctacctctgttaatttaactttgtgattggcttctctgttttgtgttctcagaaagattatgaagagctggcagaaaatgtcatgaacattgttgaccggcttgttcacaagactaatcaaaagattgatcagtcaacagatgtgctgaaggcaatcattagtcctgtgatgcatgagggagatgtgcagtggccacca

SEQ ID NO: 14799 - DNA, 723 bp, Triticum aestivum
  Clone ID: PAT_TA_14799
tcctgctaatgtcatgctacattatgagacaacgggtccagaaatatgcgaggacacacttggacaggttgacatttttgtcatgggcatcgggagtggcggtactgtcacgggagtcggcaagtacctcaaggagaagaaccctaatgcaaagatatatggagttgaacctgctgaagcaaatgttctgaatggtggaaagccaggacctcacctcatcactggaaatggagtagggtttaagccagacattttggatatggatgtaatggaaaaggttcttgaggtgaaaggtgaggatgctgttaagatggctcgagaattggcactcaaggagggtcttttggttgggatatcatcaggagcgaacactgttgctgctcttgaactagcaaagaagccggaaaacaaaggaaaactcattgtgactgttcttccaagccttggggagcgatacttgtcatctgcgctgtttgatgagttgagaaaggaggctgaagcaatggaaccagtgccggtggattaatttggccaatcaaaccgggcactggaatctggatctttggtgcacaataaacttgccggcagatgtgttacaactgccaattgtacttccattcccctcatccaatttctatcatctcatttatgaaccttgtgaaaaaaaaaataatgtaaaattttgaagaagagcaactttagcctctaaaaaaaaaaaaaaaa

SEQ ID NO: 14800 - DNA, 1068 bp, Triticum aestivum
  Clone ID: PAT_TA_14800
cttgaatgataaaaggaacaatatccaagtactgatggattcacatttggagggaaactactcaacagatgaggcaaccacattggttgaccttgcctctcagtgcttacagtatgaacctagggatcggcccaacactataaagctggtttccgtacttgagcccttgcaaataaaatcagaggtaccatcctatgagatgcttggcattccaaggtatgaagaagaagcatctccccctccacaaccacaacaccctctttcacccatgggtgaagcctgttctaggatggatttgacagctatccatcagattctagtgagtacacattacagggatgatgaagggagtaatgagctatcgttccaggaatggacacagcagatgagggacatgttggaagctaggaaacgcggagactttgcttttcgtgataaagatttcaaggcagccatagattgctacacacagtttgttgatgtggggacgatgatatcaccaacagtgtacgcaaggcggagtttgtgccacctcatgtgcgaccaacctgatgccgccctccgcgacgcaatgcaagcacaatgtgtgtacccagattggccaactgcattctacatgcaagctgttgcgctctcaaagctgaatatgcagagcgacgctacagacatgttgaatgaggcgtcgcagcttgaagagaagcggcagaagaacacaaaaccttgaaagaccctctcagccccggttccttttgcggctcaaaaaggtttatgttgagacatgctgctcggtccttcctaaacattgtggttagttcctggtctaggggttgggaatgtaactggggggtgtgctgtagagtcctgtgattgtcactacctggtttggcatttctgtgatgcattttttgggcccgtgtacatgttacattgacaaaggtcgaaacaggcagaatgcaagggaattttacttctggttgtcaaaatctgagcttgtttagctccagagtctctgtctggttaatggaccgtgtgctgcttgtactgacatgggaagcacatccttttacg

SEQ ID NO: 14801 - DNA, 1054 bp, Triticum aestivum
  unsure (1)..(1054): unsure at all n locations
  Clone ID: PAT_TA_14801
ggtaacgcgtgggaatctgccgaacagcgtccgcccacgcgtccggaacagggtgatgcctcaaatgctccaggtccagctccacttccccggcctggcatgccgttgccccggcctccccaaccactttccttggtcaatgttccccgatttacacccaatccaatgccttatcatgtccaaccccctcatcatatgcaaggagttccaccacatatgatgtccaacatgcaccaacctctgccaccaggtcaacaacacatgattaggatgtcaggtcccatgggtcatatgccaagtaatatccctccaccgcctccaggccataatactcagttcatgcctggtccaccacggttcgctatgccccctcccccgcacatgcagaacatgccaaccatggtcaaccccatcggaatcccccagcctccaccacctttgcctccacaaccacctgccgaggagcagccacctctacctgaggaaccagaacctaagaggcagagaacagatgatgcttctctgatcccagctgagcagttcctcgctcagcatccgggccctgctcgcatctcagtttctgtgcccaaccttgatgaaggaaacttgcgaggccaagttttggagatctctgtccaatcactctcagacacagtcggcagtctgaaggagcaaattgctggagagctgcagcttcctgctaataagcagaagctgagtgtgaggactagtttcctcaaggacaatctttctcttgcttattacaatgttggccctggggtggtcatcaatctagctctgagggagcgtggtgggagaaagaaatgagcttttcttatctcagtttactcgcaggacaatgcttacaaccaagcttcagtggctatcatggagattatttttgttggttgctgccttctggattcttgtatcatgtgttttataagtccagcactatgatttgcactatgtagttttcagacttgtctatgtttcttaatatggctacatattgttggagatgtttatccttttttaaaaaaaaaaaaaannn

SEQ ID NO: 14802 - DNA, 736 bp, Triticum aestivum
  Clone ID: PAT_TA_14802
gcacgcggccctcgcgtccgctcgccatgcgccttctacccgcgacctctggcaccaaccgccgcacagatccattgtttgcaatttctcatctgcgagcttgtatctggtggcaatctgagaaaacctggagggctatttgggaatagtagctctggaatacctgtggaagatcttaaacagctagagacgtttttctacaagctcagttttttcttgcatattttggactttacagcaacgattggtactctaactgatcttggatttctttggtttcgagagttctacctggaatcttcccgtgttatccagtttccaatcgaatgttccctcccctggatgctggtggatcatgtcattgaatctcaagatgctggccttcttgaaagcattttgataccacttgacctctacaatgactctgctcaacatgcactaacttatctcaaacagagatttctctatgacgaaattgaagctgaggtcgatctttcctttgatcttcttgtccagaagcttaatgaggtcatctttacatattataagagttgtgcagcaagtactcttcttgatagttcatttacctatgcatgtgatgatggtgagaagtactttgtcaaacccttgagatttgatgcaattttcaagctaagaagagtcatgatcttagggaggacaattgacttaagaagtctaattactcagagaatgaacaaactgttccgagaaaata

SEQ ID NO: 14803 - DNA, 630 bp, Triticum aestivum
  Clone ID: PAT_TA_14803
ttcggcacgagggttcggtgttaatagaaatttgcaacaacaaagcagtgcagtcatggtgatggctacttcgcggtaggacatatttagtcttctgttgcaagctgcaatcgcattttagaattctggttgttttgggcagttcactgcaccacatacattagtgtgcctgggtccaattcggccatctacccatgcagagggatccaacatctttagctggaaattcctcctttgcttatggatatgaagcagataattgtatggcaaatggacttttgggtggtcagtgcaaccacagcgttcctgtttcacctgccttagcagtcccttcgggcatcacaagccctcacatccgaagcccacttgatgcatttgagctccaaccttccaaggtatgccccagaaatttcatcatctttgatcacactgatgaaaaaggatgcatcatgtatcatccagccttggtgaacaatctgaaccccgcaaacatcgatttgctccaatgccatggtgaggtggtttgtagaagttcaggccaagacaatggcaatcttgaagaacagtcctcatctttccaggaggatacagaagaaatcgatgcactgctcagctctaatgatgacagcg

SEQ ID NO: 14804 - DNA, 644 bp, Triticum aestivum
  Clone ID: PAT_TA_14804
ttcagtgacacggtcaccgccgtcgtcgtgccgccatacatcgacagcgccgagatcgtcaagcacgcgtcggcgcggggcaacctcagccttggcctcggccttaacaaggtcgccgggaaggtcttcaggatcggccatctcggcaacctcaacgagctgcaactcctgggatgcctgagcggtgtggagatggtgctcaaggacgtggggtacccggtgaagctcggcagtggagtggcggccgcggcggcgtacctgtcgaattccacgcctctgatcccgtccaggatctgaaaacaaggcacgacagcacaaagaaggccggcggccggcgacgacgactacgacgacgaatggactgcggacagacaaataaacgaacaaaatgtgcagacatctccgcctctgctgcctttgcagagcatctgcttgcctgcagtaacgaactagtattggctatactctctgtatgtacagttaatttccacactcagctgttggtctgttgctaccgggtataattttgtgaagtacagctttaattaaacttcgaagtagtctccatgtatagccctgcccagatttaactatatttgatcatagtagcaatcgccaaagagcaagacaaaaaaaaaaaaaaa

SEQ ID NO: 14805 - DNA, 638 bp, Triticum aestivum
  Clone ID: PAT_TA_14805
attcggcacgaggggagattgagaagccagataggcgtaatcgttgggattcccctctttttgaattgtttccatctagagatgaaatagtagaaacggctcctgttattgctgaggctgtgtcgtatttgacaaagaaagtggattccaaaacaagagacgtaaaagttctccagcctacaatagccactcagacggttcgaacaacagaggctaattccctctatgagatggacaaagctacacaggaggtggtcaatgcaattgttgaagcacaatcttgcggtcttgggcttgctgtgaataagatctctattggacctaacttgccaactatcaaccttcagagatctgttggcctgcctgagctccgaagcctgcgtcgaactttcatcaagctggcagggcagtacagtctgagtgggccacctccaccgacagatgctgatagcgcaaagaggatgtttgtcgactacttaaaccgtgaagttggtgcatgatcgttttcctgctgtggtccatgaacatcatgtaggctgtaattaacttggggacacattttgaatctttgtcactaaacaagacttggtatctcatgctcgcgctgtcatgcaacttggaaaaaaaaaaaaaaaaaa

SEQ ID NO: 14806 - DNA, 561 bp, Triticum aestivum
  Clone ID: PAT_TA_14806
cggcccggcgggggcagggtgcggccacgagtttcctttcactcgggctaggcccagaacgctaagggcccagccggctccgaccatcaaggccttcagaagattgtcttatcacggggagcaccacacgcctgcacctagtctccgcaccccaccctcgtgtaagactcgtgatttcgctatctcgaatgcctggatgcaggattttctcggccgccctcttgcagcctctccttggccaccctcaagggtcctcgcctttccgcccctgagggcatgccggcgcggcctgttgccatgcttgggcggtgggtttccggggtcccccttggccggcgggccttgcagctccaaatttcaagcattgcattgcaagataaatgtattgctcggggacaatagttgtggaaggaattctgatttataatacaagttactcttagcatctattcatgatgtagggtactattttataagtcaaacttctgtaattctggtcaagtttatagaaaaacactccaacacctgctatgtctattgcgtaaaaaaaaaaaaaaaaaa

SEQ ID NO: 14807 - DNA, 688 bp, Triticum aestivum
  Clone ID: PAT_TA_14807
gcggtcggcaccgatcgtttgattattggcgagcttcattccattccatcagttcctttggcggaggatgtcgtgctgcggaggcaactgcgggtgcggctccggctgcaagtgcggcagcggctgcggagggtgcaagatgtacccggacatggctgagcagcaggtgaccaccaccgccaagactctcgtcatgggtgtcgcaccatcgtccaaggggcacgccgagggcgggttcgaggcggcggccggcgccggagctgagaacgacgggtgcaagtgcggccccaactgcagctgcaacccctgcacctgcaagtgagctgtataataaccccctgcactgcactgcagcccggaggaaggacggattcccttagctgtagtatagcagtgtcgtcactgtgtgtgtgtttgagtcagccagtcagtcgagtgccatggcaccatatgctagtggttctggtactgatgggaaccaataataattgtactgggatgttggcgtcgtgtcgtccttcccgtgctcctccgggggctcatctactagcagtcggtgttgtgttgtgtgtttgtgggtgcagtgcagcacagcagcaggccatgccccctgctctgtgggcacgtcgatcgtgtgcgactttgtttgtgctctgtcaccatccatctattacctataatatcccca

SEQ ID NO: 14808 - DNA, 487 bp, Triticum aestivum
  Clone ID: PAT_TA_14808
acaaagagagcagagtgtttccgagcgagtgtggtggtcgtcgtcagcagagaggctagagatcgagagagagagaggatggcggacatcgcgttgctggtgacggagcagttcgagacggcgcgggggagaggcgccggcgccggcggggacaacggcagcggcagcggcggcgagaggaggaattttggggccgtggccaaggtgtggagctcgtgggtggagtccgccaccaccgccgcgtccggggtgagggtcagcgtcgcggcggtgcacctggagcccaagaccgcgctcgccctggccgccgccgacggcctcttctccgcctagtgctctagtagtgtcgcctgcttccattgtctttcctaatcgagtcctgcaccggcaccatactatactggtgtaatctgtacagtcgtcagtcgctgcgcctgcgccgtaatctgcaacagaattactattcaaaaaaaaaaaaaaaaaaaaa

SEQ ID NO: 14809 - DNA, 829 bp, Triticum aestivum
  unsure (1)..(829): unsure at all n locations
  Clone ID: PAT_TA_14809
atccgacccagcaatggagtctaccgcgctaatgaccgcgaggttaccacttccgacctctggctcccgttccaaacccctctcccctgcctccttcactagggtggctcgccttctcgcctccgtccccttctgctccggcagcggcagcgtcgtcctgctctcgcgccggagccgcgattatgccggcgttggtcccttggtctccgccgccgcggctcccggggatacggcggacgccggatccgagtccatcctgctcagcgtccaggggatgatgtgcgacgggtgcgccgcgagcgtgaagcggatcctggagagccaacccgaggttacttctgctaccgttgattttaaggaagcaagcgcagtcgtgtggacaacagatgaggccaaggggacacaaggctggcagaagcagtatggagagaagcttgctaaacaccttgggcacttgcggatttgagtctcgcctacaagagtaaggccgacccgcagagtaccgtgacgccggtccggttgtcacctcaaatgttcaccttaatgatcaattgtaccaacatatatgttaaatatttgtctctgtggantgcaattaggagtatcccgtgcantctggtggataatacacatactaccttcacatgatcttaccaggttgttcaaaaggatatgtttgnccaaaatgtggattagcatttcaattaggatttcgtggcatgtaaccgctccntgtcanaaaaggaccacncaaaccaanaacattttacccaaaaanggggcggcaattccaaaggcttnannccagggtnttanctgggaaaccggn

SEQ ID NO: 14810 - DNA, 795 bp, Triticum aestivum
  Clone ID: PAT_TA_14810
agcatcatcatcatcaccaccgtcgtcagtagccaagtgtatttttcctagcgatttgcattgcgcgatctgttcctggccagtttaattagttgcagagcgagctgagcttcacgagcttttgagagacccctgctgcgtgccctggcttcccaccaggacaaggctagctaccaggccggcgagaccaaggctcgcaccgaggagaagactgggcaggcgatgggggcgaccaaggacacggcgcagcacgccaaggagaccaccaagcagaaggcgtccgactccgacaccggcagctaccttggccagaagaccgaggaggccaagcacaaggccggccagaccacggagtccaccaagcagaaggccggccagaccacggaggccgccaagcagaaggccgccgagaccacggaggcgaccaagcagaaggccggcgagacgacggaggcgaccaagcagaagaccgccgagacgacggaggccaccaagcagaaggccgccgaggccatggaagccaccaagcagaaggccgccgaggccgggcagtacgccaaggagaccgtcgtctccggcaaggacaagtccgccggcgtcatccagcaggccaccgagcaggtgaagagcgcggcggccggcgccaaggacgcggtgatgaacacgctggggatgggcggggacaacaacagcaagcagagcgacacaaacaccgacagcagcaaggactcctccaccatcaccagagatcactagacacatgcacacgcacttcgtcctgtaccatgatcccgt

SEQ ID NO: 14811 - DNA, 859 bp, Triticum aestivum
  Clone ID: PAT_TA_14811
atttatgtgagcacaggtgattgggcagagcatttgctgcgtcaaggaccctcttctttcaagcaatatgtagaggaatgcaaggccttagggtttgacacaattgagctgaatcctggatctctcaacctccctgaagaagctctgttgagactagtgcgcctcatcaagagtagtggtttgagggcaaagccaatgttttcagtgaagtttgacagttctgatattcctgcatctggtgatagggcctttggggcgtacatagctccggtcaaggagaagacctcagaaagagttgaagatgttgacctgctgattaggagggcagagagatgcttggaagcaggcgcagatatgatcatgatcgacgccgatgatgtttgccagcatgctgaatctctgaggacagacatcattgccaagattgtaggccggctcggacttgataagaccatgtttgaagcttccaatcccaaaacctcagagtggtttgtcagacgatatggcccaagggtaaatctcttcgttgaccactccgatgtgatgaatctggagcgcctccggggcttcaacatgctcagaagcaacttgggctcccatgttgcctcgccgttcttcctgatgtaatgggttaatgatcgttcccgtatcctgagctgtgacaagctaagtttctacatggacttgtgagcctcgcacagcttgctatggcctccatgtaaccaccatcgagcaggcatctgttatgttatgagtaacgctactgtaataatcagctctgtggtgtaagtagtgtatgggcgtttgtgttcattgcatcaatgagccagattcttggattacaaaaaaaaaaaaaaaa

SEQ ID NO: 14812 - DNA, 655 bp, Triticum aestivum
  Clone ID: PAT_TA_14812
cgtccgctcgattgtcttcaagttctgggaaaaattgttcacctaaagattctgttggcagcggcggtggttcagtttctcagcagcttggaagcaattttgatggtcaaaattcatcagcaggaaacgatgcctcaaccaaggaacttgaatgccaaagaatcaaaacaacagcaataaatgatgatagtgcaagtcagcatggaattccctctacttcgattatgcattatccatttatctcagttgatcatcaacaactagatatgacaaatgaatcatatgttctgcctacatcttctaatagttcctctggttctgcatcattgcacttaaaaaatgacagaactgagaaggaacttcctctcttggtgccatttgataatcatatagcacaaatgaattatagcaagactgttatctcaacactaaatgctccaaaaacaagcacggatcttccagtcaagttgcactatgacgagcagactagttttgaagcatcagatttccaggagtatgaatcacactctgtcactggtggaacggtagcagaaacagcaaacagggtggatgaatctactgtcggaggaccagataaagcagcagaagcagctagtccaaagaaaacaagaaccacaagaaaaaaaaaaaaaaa

SEQ ID NO: 14813 - DNA, 293 bp, Triticum aestivum
  Clone ID: PAT_TA_14813
gctatcgttcctgtgaaacacaggtctatgtagagggtcttagcactcatgctgtacaaactgcttgggcgatgctagctttgatttatgctggacaggttttatttcttgatatgacaactttgatttatgcataggactactccgcccctactataaaaacaaggcattgtatttatatgtaataaatcatcacaacatttatgaatatgcaaataccttgatgttttaggttcattcctcaaaaatattttcataatgatattggtttactaaaaaaaaaaaaaaaaaaa

SEQ ID NO: 14814 - DNA, 958 bp, Triticum aestivum
  Clone ID: PAT_TA_14814
tatgatggttgctgccagctagacattcaatattcaaatctcagtgaactgcaagtccactacaataacgaccgatctagagatttcacaaatccatcattgcctacagaacaacgtcctagggcccctcagcaaggttatcctgatccagctaatctctatgccttccaacaagctggagcttcatttgcacagatggggagggctgcaatgattgcggctgcatttggtggatctttacctcatggagtgactggtgccaatgaacggtgcacactcatagtcagtaatctgaatactgataaaattgatgaggataagcttttcaatctgttttccttgtatggaaacatagtaagaattaagatactgcggaacaaaccagatcatgcccttgttgagatggctgatgggttgcaggctgagctagctgtgcattatttgaagggggctatactatttgggaagaaactggaagttaactactcaaagtaccctaacatcacacctgccccagacgcccacgattacttgaactcaagcctgaaccggttcaacagcaacgtggtcaagaactaccgtcattgctgctccccaacgaagatgatccacatttctgccctcccccaagagatctctgaggaagcaatcctgaaccatgtctctgagcacggcaacgttctcaacacaaagctattcgaggtgaatggcaagagacaggctctcgttttgtttgagaccgaagaggaggcgactgaggcccttgtgtcgaagcatgccagcacgctcgagggtaacacgatccggatctctttctcccagatgcagagtatataagccacatcaagggaaagctcctgtcgccctcactcgcccccttcgagctctatttaggaagcatttcagactaagatgtgaatcctgtgcgctattctccaatactgatgctgtctgagct

SEQ ID NO: 14815 - DNA, 1558 bp, Triticum aestivum
  unsure (1)..(1558): unsure at all n locations
  Clone ID: PAT_TA_14815
gtaggctgctgcttcatgccggcgtctgattttgagtcagacgaagtgaaagcatgcattgtaagttgtggaggcctttgccctgggctcaacactgttatcagggagctggtgtgtggcttggcgcacatgtacaatgtcaacaacatctttggaatacagaatggatacaagggcttctattctagcaattatgttgctattacaccaaagacagtcaatgacatccacaagcggggtggtacagtccttggaacatcacgaggtggtcatgatacaaaaaagattgttgacaacattcaggatcggggaattaatcaggtgtatatcattggaggagatgggactcatgaagggagcatatgagatctacaaggaaatccggaagcgtggacctaaaagttggcatagcagcggttcccatagacaatagtcaatgacataccgagtatcgacaactccctggatgtgggcttcggtcctcgcatagactaaccagcccagttttccggcccaggatggaagcttgcaggcctgagagtggaataggcttgctaaaactcttggggcgttagagtgcgtccgttgccatgtaaggtactcttccaagccgggatttggattgcggcttgattccacaatagccgttcgagttgtttggggaacggggggaagcttcctatggttcttgtggggctgaaagagaacaagcacatggttattgttgttgctgagggagcaggccaggatattattgccaaaagcatacccgcttcagatcagctagatgcatctggaaataagctgcttcttgatattggtctctggctgactcacaagattaaggatcacttcaagagcaaaaagatggagatgacgattaaatacattgatcctacctacatgatccgagctattccgagtaatgcagcagacaatgtctactgcacactgctggctcacagtgccatccatggcgcaatggcgggatacagcttcactgttgggatggtcaatggcagacatgcctacatacctttctacagggtgacgtccacacggaacaaggtgaagatcactgaccggatgtgggcgaggctgctgtcgtcgaccaaccagccaagtttcctgaggcagaaggacatcgacgaggctagggaggccgataggctgaccaacaagcctccgctaccacctgtcgccaaccagaatgtggcaaaagcatttgaccaatctgcatcggcttcgtcgaacggcgagatatagcgatgcgctggtctgtaaccgtgtacagtagctactgctatcctgctgatgaacatgtgccacggcacgccacgccatgaagttttgcttccttacgatatcccttgtatgagtagtgcacgtatggatactgttcaggtgttctgtgaaataagcagtatattattgtgctgctacaaaaaaaaatgtccttttttttttgccctgggcatttgctttgctttccggtgaatccncaacggcttctgctggaggggnatatagttagttaantacacacaggnccttaaaa

SEQ ID NO: 14816 - DNA, 679 bp, Triticum aestivum
  Clone ID: PAT_TA_14816
attcggccgagggtgagctcggccatcgcgccctgcctgtcctacgcccggggccagggctccgcaccctcagcaggctgctgcagcggcgtcaggagcctcaactccgccgcccgcaccaccgccgacaggcgcgccgcctgcaactgcctcaagaacgccgcccgtggcatcagcggcctcaacgccggcaacgccgccagcatcccctccaagtgcggcgtcagcgtcccctacaccatcagcacctccaccgactgctccagggtgaactaaacctaaacgatgatcgatcgatcgatgatccattccgccgccgccgccgtcgtcgtcgatcggcgccggagcatcgaccatggatgagtatctatctacgcctgatatgatgagatgatgagttgtctactactgctacgtcgtactactgaataaaaatctctccgtacgtatgtacgtacgtgtcgtcgtgtacgctgtgatacgcttgcatcttagcgtatgtacgtacgtgcgtgtgtacatgtgtgtgtgagagatgtacttttgcttgttgggtttatttttgagtgcatgcactatgtgcggtgtttattatttatgtccgtgtacgtttcctctcgctcctgtggtctgtactagttcgatcactgctacatgcaaaaaaaaaaaaaaaaaaaaa

SEQ ID NO: 14817 - DNA, 870 bp, Triticum aestivum
  Clone ID: PAT_TA_14817
ggattcggacgaggaagaatttctctccttgtagaaacaagcctagagagtactatggagcagaggaaatttttgttgtgcctaattcttggcttacttgcggcttcaggacctgccaagaccgtcaatgctgactcgccctttgatttttattatctcatcctcatgtggcctggagcatactgcactgacagcgagtatggttgttgcgtgcccaagtatggttacccgtcagaagatttcttcgtcaagagcttcatgacctttgactcgtcagagaacacagctgttgtcaggtgcaactccgacaatcctttcgacattaacaagctagactcaatcgagaacaacctgaaccactactggagcaacatcaagtgtcctcgcaccgacggcgtgaactcatggaagagcgagtggaacagctatggcgtctgctccggcctcaaggagttggactacttcaaggccggtctccagctcagaaagaacgcagatgttctctctgctctcgctgaacaaggcatcaagccggactaccaactgtacaacacggcgttcatcaagtgggcagtgaaccagaagctgggtgtgacaccaggagtgcagtgcagggacgggccatttgggaagaagcagttgtacgagatctacctctgcgtcgacaaggacgccaagagcttcatcgactgccctgtcctgcccaacctcagctgccctgccgaggtgctcttccatccgttccacacctggatgctcaacaccacatcggctgccaacatcgtgatgcccactgaaactgtgctggcctaattaagagcctttaatttgctagctaagctgccatgatctacttgatcacccggccta

SEQ ID NO: 14818 - DNA, 376 bp, Triticum aestivum
  Clone ID: PAT_TA_14818
gagtcccgtaagctggtcctggatgttgtcaactgaggactaccattatctttttttatttgaaatatgttgagccgttaaggagcattcaaaataatgaatttgtgatgtacaattttgccactggggctaggttccatgcctagaagttattttgttttctttactctgctgagctgcaaaagcatttcaccaagggagtacatttcacgggtttttttttttgggtttgcaatgcctcaatgttatcagcaatattctaacttaacagctgttgggagttgataaattcttatgctatgaaatactcctaatagacctttgtattgtaaaaaaaaaaaaaaaaaaaaaaaaaaaaaaaaaaaaaaaaaaaaaa

SEQ ID NO: 14819 - DNA, 440 bp, Triticum aestivum
  Clone ID: PAT_TA_14819
aggattcggcacgaggaccagcagcaccttgggagcagtgggcctctgctttagggcttgtaggtacagtagaaaacagagtcgtcgtcgtccctgtatagctgctccatcgctggttcgtgctcctctggctcgttttgcctttgtggtttggtcatgactacacaaccttcttgtcatcttgtgccacgaatgaaattcgaccagcaagttatacggctattgtttatttctggtaccttctgatagaaagacaaataaatttgttttcatcccttttcttttgttgtttctgtcgtgcttgtgcatccaccatccgatccaaatttccaatggtgacatataatatatgctccccttcacattttggtcgcatgtaatgtaatcattccatcatttttggccctagcgattgccaagcattcgatgattgcgggtaa

SEQ ID NO: 14820 - DNA, 573 bp, Triticum aestivum
  Clone ID: PAT_TA_14820
ccaacgctgggcccaacaccaacggctcccagttcttcatctgcaccgtgccgacgccctggctcgacgggaaacacgtcgtgtttgggcaggttgtggaggggatggatgtcgtcaaggcgattgagaaggttgggtctcgcagtgggtccaccgctaaggaggtcaagatcgccaactgcggccagatctgataggtgtcgagcttgccgccgccgccctccgtcgttcgtcatcggctcgtcgtcctcccccctcctccttccatgctcctgttcaattcccttccccttcctcgctctgaataagatggcgtactgtcggtgatctgagaggtggtttgagtacttgagtctgaatttgtgtccctagtgtcgtttgtgtcatctgtccgtttaatcgttggtggtgactagggtttcataggtggccgatccgtggatctggtgtatcttgcctgcctaattatttcgtcgtcgtgtttctgctgtgtaatggtgtgatcgggcatgatgattatgctaagacaactgctgaaacttgctttaaaaaaaaaaaaaaaaaaaaaaaaaa

SEQ ID NO: 14821 - DNA, 687 bp, Triticum aestivum
  Clone ID: PAT_TA_14821
tcgcctcctaccgtctgtaactccagaggcggccacgctctcccgatggattgtccagagctacagatttcactttggggccgagctcatcaaagccgcagacgctagcagcggcgagtcggcgctcaaagccctctggcagcataccagcgccatcctatgctgctctctcaaggcgatgccggtcttgacgttcgcgaaccagtccgggctggacatgctggagacgacgctggcggcgctccgggagatcaccatggacaaggtgctggactacgaccaggggaggaagagcctgctgtgcgcggacctgatggccagcgtggcggagcaggggtacgcgtgcgtcgagggcgggacgtgcgcgtcgagcatgggccggccggcgtcgtacgggaaggcggtggcgtggaaggtgctcgacgacggcggcgccggcgccgcccactgcgtctgcttcgccttcatggactggtccttcgtctagtcgagggaccgatcgtttgttgtagctgttgctccagcgcgcgtccgtccggggtgggcgcggctctgtggggctgggtgcggggctttggttcggcgtggggggggcccgggacgggtggtgcgggtgccgcgagtgctgttgctgtttgcttggtctgtaccgcttacatttcctcctttttatccaaaaaaaaaaaa

SEQ ID NO: 14822 - DNA, 1041 bp, Triticum aestivum
  Clone ID: PAT_TA_14822
cgaagccgttcgagtccaagctctcgtcgtgacatgcgcaactagaaaccctagccatctacccacgccgccgccgttcccctccggcaaccatggctgggatggcatcacgctgcgaaggcaagacaaccggcgacaaaggctactgtagtgtgatttattcaccctatccacagtcgtcgcctcttcctcctcgcctgaccgacctgttccaacactttggtctggacaagatccgcgcgatcatgaacagttctgatggtaagacgttcgagcaaaagatcgacaagttacgagaggaaatgagtgctttcgaacgtgctcgtgatgtattctacatcgtcgagggcgaggatggcgacgaggacgacgaaggcgacgaggacgacgacgtggatgtggacgagtcggatagaaagctcttagatgatgaaaagaaacccgatatcacgaaacgaccacacactcctattggagatgaggtggaatgcaagaagccaaagatagcagaaggctcaaggtgccaaggagaagaacctgaggctggagggataaagaattcctcctgggtctgatgacaggggaatgcagtaaacaccagaagcatcaaaactatgatctggaacagtatcctgaataaactattttctggattatgaatgaattctgaagcatggggctataagtgaattatgtaacatggatttgtaactatggtggatgttaagttaacgttctatcagtgcatcgtgaatgcgtgctgaatatgcttctgttatggtttcgtaacttcgagactgagcatgtggtactgggttgccgtaggcctgtagccgctgtacctacgtttcatactgtaggtatgttgtccgaggagtgccctttgggcaactcgaatgctgatcacgtaagggcaactccaactggccgatgcaaatgaacttggtttttgttcgtttggattggtttggtgttggggtgtttttgtttactagcaaatatgctcgtgcggttgcaacgggagaaaataatgttcttttc

SEQ ID NO: 14823 - DNA, 767 bp, Triticum aestivum
  Clone ID: PAT_TA_14823
ctcttctcctcctcgcctcctctccctagtctccacgacgcaagggagagtgacggaaagcgacgcggcgcgagcgaggagggccaaggcgaagaggggaagcaccgcaccaggacccttgttcgccgccgccgcctctgatctccgcgaggttgtcaggattcaatatgtcgaccagcacattcgctacttcctgcacgctgttgggcaatgttagaacaacgcaggcctcccagacagcggtgaagagcccttcgtctctaagcttcttcagccaagttacgaaggttccaagcctgaagacctccaagaaactggatgtctccgccatggctgtatacaaagtgaagcttgtcgggcctgaaagtgaagagcaccaagtttgatgctccagacgacacctacatccttgacgcacccaggcctcccggtgtggagtttgctatacgcgtgccgtgctggggtgctccacccgcccgggcaacaaacagccaggtgtggttggctagtcgcacggatccttccttcatgacgaggggcaggaggagggctatgtgctgacatgcgtctcctacccaaagtccgactgcgtcatccacacccaccaggaaggtgacctgtactagggctagggcttttcaatttggcaagggaccaattgctctcaaatgtgttgtcaagcaaagctccatctgccctaccacttgtgcaaactgtttggcatcaaacttttgtggctgctgtcttctgtgttctgctagtttatg

SEQ ID NO: 14824 - DNA, 540 bp, Triticum aestivum
  Clone ID: PAT_TA_14824
ggattcgcacgaggcaatggttttggtggtgttgttctcagccctgttggaacacaatgtgtatccaaggaagatcatcctattgtgcaaagaaaaggattggctgtggttgattgttcctgggcacgtttaagtgatgtcccttttgtgaaactacgttgcggtgctcctcgtctcttaccatggttagtagcggcaaatcctgtgaactatggtcggccatgtgaactgtcttgtgtggaagctttatcagcagccctcataatatgtggggaggaagatacagcacatttgctgcttgggaaattcaagtggggtcacgcattcttgtctctaaacagagatctcctgaaagcgtactcccaatgtgaaaatggatctgagattatcaatgtgcagaactcatggttatcgagtaactcaagtgttccaaagccacccgtaaacgggacagaggaagcacggcaaagcacggaggagggatctgaaggtgattcagacgatgacttgccccctctcgagaagaatctgaaccacctg

SEQ ID NO: 14825 - DNA, 519 bp, Triticum aestivum
  Clone ID: PAT_TA_14825
ttgggtggtttttcttgttttacctgctccatatactattctgtgtctggtcagctgtggctcctccatttccattcaaaggaaaatctttggctgggattttgccggctattgatatcataggcaggagtgctattgtggggatattttacttcattggatttggaatgttctgccttgaatcactgctcagcatcgttgttattcagcaagtatacatgtacttccgtggaagtggaaaagctgcagagatgaagcgagaggcagcccgtggtgctatgaggaatgccttttgatagagcggcctaggtgactggaagagacagggtgtgacaatgggtaactgcgtcatgtacatatgctgttcgtctctgagattacttatactagcttatagccttcttcccctcatgcaatatataccacctacccaccagagtttgatctcttatacctagggtcagatgtgcttatagataactccttttttttttgggaatacattttcctacctgattt

SEQ ID NO: 14826 - DNA, 798 bp, Triticum aestivum
  Clone ID: PAT_TA_14826
attcgggccgaggtaaggctctgcatcagtatgactgcctgagagccaacaaggcgacatcggcttggggcctggaggctcgcgtccccttcttggacaaggacttcatcaatgaggccatgagcatcgatcctgaatggaagatggtccggcctgatcttggaagaattgagaagtgggtgctgaggaaggcatttgacgatgaggagcagccattcctgcctaagcatatcctatacagacagaaggagcagttcagtgacggcgttgggtacagctggatcgatggcctccaggctcatgctgcatcaaatgtggctgacaagattgcttgtcgaatgcaaagttcatcttcccacacaacactccgaccacaaaggaggcctactattaccggatgatcttcgagaggttctttcccacagaagcctgctatcctgacggtgcccggcgggccaagcgtggcgtgcagcacggccaaggccatcgagtgggacgcgcagtggtcagagaacctggacccctcggggagggcggcgctgggcgtccatcttgccgcctacgaacacgaacaagatcctaaacatgttccggacaccattgcagcaggaggcagcaagaagcctaggaccatcagggtagcagcagcgccgccgccgcctggcgttgccatcgaaggatagatagcttgcatgcatggcatgctatcgtttctccggccggcttcctcatccggcgttgcccccatgcatattgtcagtgtcactgtttgcaacaaataatcaagcgagcgagctg

SEQ ID NO: 14827 - DNA, 569 bp, Triticum aestivum
  unsure (1)..(569): unsure at all n locations
  Clone ID: PAT_TA_14827
acattaacgagggggcctaaacttttatgtgactttacaggaagccataggcaaaataaagcagcagtgcagtgacttcataatgacccgaaacattcaatgccgtgaaatgatcgaagatgtgcagaggaagctagcgggtttcagcttctcgtcttcttccggccacgcttccttgcagaggaacgcttctgtgccacctgatcagagcagcccatcaccaccgccgccggcgccgcctcccccccccgctccgcccccggatggtgttccacccggaggcgattcaaagacccgggtactctcaagccccgagcaaagacctgcttactcacagcatacccgccctaatggcgcgccaaccgcaacacctccaatatggtgcgccgtcggcaacacctccttatggcgcgccccacctggtcactaccagaaccaccagaccagaacttccnaaccatgantagggccaacaacatatcctgnaggatgcccgggcatnntacatccacatcancaaaccgnagcaaaacggccattcccaaccaacgttnatgccagggtttacc

SEQ ID NO: 14828 - DNA, 372 bp, Triticum aestivum
  Clone ID: PAT_TA_14828
tcggacgaggcgaggactttgctctccacgcacaggtccacgtagtcgtccaccttccctcgatgatgccctctccgcaatcacgctccctggcaccggcaagtagatgctatggtttctatgatgtatgatgcgtagatgcaagaggttcaaacctcggagcaccgcagatagttaacatctgcagcaaaaagaggttggggtcgactctgatcctcttttaaacgagagcccccttgcaggtataatcgagcccctttcagatttttattttccaaaaaccatcacaaatcgacgctcaaactatgcaatcggatagctcttcaggctgttgttgttaaaaaaaaaacaaaaaaaaaaaaaaaaaaaaaa

SEQ ID NO: 14829 - DNA, 1585 bp, Triticum aestivum
  Clone ID: PAT_TA_14829
ggcaagagaagctagataagccaatcgtcaaccctaattcgcagcctggacaccaccgcctcctcgagcccctttacctcgaaacccacctaaatcctatccctcccggccgtcatggcgtcggcggacgaagcgaatgcggcggccgaaggtacggaggggaagaactggcagcggaaggggaagcacaagaaggagaagccgtgggacgatgaccccaacatcgaccgctggacggtggagaagttcgacccctcctggaacgagggcggcctgctggaagtcagctccttctccaccctcttcccccagtaccgagagaagtatctgcaggagacatggccgatcgtcaagggcgcactgaaggagtttggagtctcatgcgagctcaatttggtggaaggatccatgacggtttccaccaccaggaagaccagggacccctacattattcttaaggccagggacctgataaagctcttgtcgcgaagtgtccctgcaccccaagcaattaaagtgctcaatgatgagatgaactgtgatattgtcaagattggtagcatcataagaaacaaggaaagatttgtcaaaaggagagaacgccttttgggccctaacctgtccacccttaaggctatagagattttgactggctgctacatcttagtacagggaaatactgtggctgccatgggttcctttaagggactgaaacaagtccggaagattgtagaggattgcataaagaacataaagcatccagtgtaccacattaaggaactccttattaaacgtgagctggctaaaaatcctgccctagccactgaaagttgggacaggtttctaccgaactttaagaaaaagaatgtcaagcaaaagaagcccaatactaaggagaagaaacaatacacaccctttccgccgcctcagcagcctagcaagattgatcttgaactggagagtggtgagtatttcatgagtgacaagaagaagtcagctaagaaatggcaagagaagctagataagcaatcagagaaatcagaagaaaagaaaagaaagagagaagctgcatttgttccaccaaaggagaacactgctggtctatctgaatctgccaaaagtactaatgacaacgagattgctgatatcacaaaatccttaaagaaaaaggcaaagaaattcagaaatagtgaagctgaggaaaatgtgaaaatcgagtcatatgttgcgagcaacgaagaatcacgctccaaaaagaagcgcagatcgtcatccaagtaaccgcaatatgtcagctactgggatgacaattttaattgtttcaagtagttgaacacctgccattgaagtaggttttcaagcttcaagctttagtggtgaaacagacaaaccttcaaccttaagtggtgaacattgtagtctgtttgttggctactgccgtctgattactccaggagtattgcagctttcctgcatagtccacggcttctaatttacaagatcagatccgtcagcagtctttttagaaacatatgaagagcagttaatgataagtccgttaattgtcgacgcggccgcgaattcg

SEQ ID NO: 14830 - DNA, 1126 bp, Triticum aestivum
  Clone ID: PAT_TA_14830
ggcaacgagggacagtagcaatgcttcctgccttttgaagagcaaagatgattttgtacgtctttgcattatcatcaacagtgcattagccggtgaagaggcagagaaggctccattcggtttctttgaccgcgatggcaaatatattgagtgccttctgtcagtgaacagaaaagtgaatgcagatggcgtcgtcaccggagtgttctgtttcattcatgttcctagtgatgacctccagcatgcgctacatgtgcagcaagcctctgagcagacagcactgagaaggctgaaggctttctcgtacatgcgacatgccatcgacaaacctctctcaggtatgctctattctagggaaacactcaagggcacaggcctggatgaagagcagatgaggcaggtccgtgtcgcagatagttgtcatcgccagctaaacaagatacttgccgacttagatcaagataacattactgacaagtcaagttgcttggatttggatatggctgaatttgtgttggaagatgtggtggtgtctgctgtaagtcaagtactgataggttgccagggtaaaggtatcagagttgcttgcaacctgccagagagattcatgaagcaaaaagtttacggggatggtatccgactccaacagatcctctccgacttcttatttgtttcggtgaagttctctcctgttggtggctctgttgatatctcttccaaactgactaagaacagcattggggaaaaccttcatctcatagacttcgaacttaggatcaagcaccaaggagcaggagtcccagcagaaatattgtcacaaatgtatgaggaggacaataaagagccgtcagaggagggtttgagccttcttgtttctagaaaccttctgaggctcatgaatggtaacattcgtcacatcagggaagctggcatgtcaaccttcatcctcactgctgaacttgctgctgctccttcagcagttggacaatgaagccatcacatgctctctcagagttcattctgaaagccacggtggtttgcggagaatgggaaatgctgcagcgcgttgcatcaccgaatgcataagaaataagattgacttgtatggttatttgttaaggggggg

SEQ ID NO: 14831 - DNA, 854 bp, Triticum aestivum
  Clone ID: PAT_TA_14831
ccggctcctcgcttcctcccgttccgtcgccgccgcgcgcctcggagaagagatagaggcggccgctgcatcgaccccgcgccacccccgcctgcctcccccggcaccgatcgggtttgatcgatggcgtcgaagaggatcctgaaggagttgaaggacctgcagaaggacccgcccacctcctgcagcgcaggtcctgttggtgaggacatgttccagttggtcaagcgaccatcatggggcccgttaggacagcccatcccgcagggtggccatttgcaggggtgaaaattctcttgcccatccagtattaccctttctatccctccaaaggtctctttgcggctttacggttcaacactttcaacaccaaacttgacaccggcggcatctttcgcctagacttccttaaggaaaagttgagccctggcttaaccatatcgaaggttctcctgtcaatctgttcgctgctctcggacccgaaccatgatgatcctcttctccctgagattgctcacatgtacaagactgacagggccaagtatgagtccactgcacgctcctggacgcagaagtatgccatgggctagaagtgtggctacaagctggccaaactggtgaatgtgccgaccccaaaaatcgttatcacctaaataaccagtcaagtcactctgtcccagcaagtatgaatggacttttgagggctattgtgtcctgttgaactcatatgtattaccttgtgaagtccgttgtgtctggtagtctgttctacctgaccattccgttatctgatgttgcttcgttaatcatcatatttctgtaaaaaaaaaaaaaaaaaatccctcgtgccgaat

SEQ ID NO: 14832 - DNA, 603 bp, Triticum aestivum
  Clone ID: PAT_TA_14832
gttccagcaatggcaaaaagatcttctttcgtggtgctcgcttcctttaacatcgtaatgtgaaatgtgacttagtaaggaggtaaccaaaacctgcgctctaacagcattgctgtcctacaaattattatgcatccagcataaacttttcccgggggcaaaaaagacctatttcacttgtttaatgagttcctctcatcataaggatgacggacaaattttccgttaagaaaaaaaaaaatgattcgggaactaagctctcgagtgaattacacaactccaacctccaccaaatatgatctcagggaatacagaaaaatcaagcactggctttcgattcagcctctgctgctggggcagccaccgctgctggtgcaggtcctcccgttgttgggagtccaaccatcactttgaaagcatcgtaaattccccactgagcaccagtaagggtaccaatcatgacgatacgaagaggaagtcctctagtgaaaagaccccagagacccagcttcttaacagcatcgcccactgtagcacccttggcattgttcaggaaagacacaagattgtcagccgggtaagacacaatagcacagaagcctc

SEQ ID NO: 14833 - DNA, 655 bp, Triticum aestivum
  Clone ID: PAT_TA_14833
gcttccccttcttccccacctcgccgatggagtcgcttgcctcgcaagcgaggccggcggcggtgctctggctcgccggcttcttccaggccgcgcgcctccaccgcgttgtctccttctgcgctagctcgagggcactatccatcaggattgcacagtgcttcctgctgaacgggcttatcttcctggggagcttgctaaccctgaaatcggtggtcattccaactctattgtggatactacctgaccaatgcaatcaaacggggggacatctttgtgagcacacggcagccatatctatctattcattcttacgctctggccttgttgagattttttatgtactttggttttatccactttatgtcttcagcttcatattaagtacgatttggtataatgacattgccaagcatgctttggatgttgtgaaaagtaaacgcctagttttgactcgagccctggatgatcacaacacaactgaaacagaagagcagcctgaaggatttgacagggttgcacttggtattggggaacaggtctattcaatccttcttttaaccattttctttgttgagtgattggttacataccttactttggcaaggcaatgaacttcctgctcttgtcattgatgtatgcctactactgcttc

SEQ ID NO: 14834 - DNA, 627 bp, Triticum aestivum
  Clone ID: PAT_TA_14834
gtctcatgttgacaacagtgttgagctcattggaagccttctctttggctctgaggacggtccaagggttctgaaagccgtccgtgcagctggtgaacctctggttgatgattggagttgtctcaagtccatggttcgtacttttgaggcacaatgtgggtcattggcgcagtatgggatgaagcacatgcgatccttcgcaaacatctgcaatgctggcatccttcctgaagcagtgtcaaaggtcgccgctcaggcttgcaccagcattccttccaacccctggagctctatcgacaagggttttagcgcctaaaagccacaggtgaggcgaaatattacagcagctccaccacaccgaactccattacattacggtactcagggggtcttagttcttgaaacataggtgaagcagacttataccattattatagctgttccaccgtaccagattacgtagccatgcccaatttccggtgtacatacatatacatagtcggaaagttatttggcaattgtattggccgttggtgtatatattccctatagtttgttagcagatgtgtagtttgtaattccataaatgaagagcattgctgctatttctaaaaaaaaaaaaaaaaa

SEQ ID NO: 14835 - DNA, 439 bp, Triticum aestivum
  Clone ID: PAT_TA_14835
attcggacgaggagagaactagtctcgagttttttttttttttttttacatacagtacccaaagaacagtttcttttttgccgagcagcaacagtgcagaacggtcaacggtaagttcctctagtactctaccaacagcagaacaagtaacagttcacgccacctcgtaaaattctcacagactaaatgcgcccgtgaagaaaatcacccgcagaacaagtagaaagaaacagagaaaagaaaaacagttcagtgaccctcgaggaacaataacggcgttcctgcagtcgcattgcagcgctctctcgcaagcggcgacccgtccagcgccgcctactggtggtacccgttccgaatgggcggcgtcctgaagccgttggcggcgacgaggtcgaggttgacgcaggaggtggaggcgggctgcttcttggccatcatc

SEQ ID NO: 14836 - DNA, 733 bp, Triticum aestivum
  Clone ID: PAT_TA_14836
cgcgccgcctgccccccgggctgttcctggcgaggaagctgtcgctcaccagggcggtcttctacatcatcatgcagtgcctgggcgccatctgcggcgccggcgtcgtcaaggggttccagcaggggctgtacatgggcaacggcgggggcgccaacgtcgtcgcgccaggctacaccaagggcgacggcctcggcgctgagatcgtcggcaccttcgtcctcgtctacaccgtcttctccgccaccgacgccaagaggaacgccagggactcccatgtgccgatccttgccccgctcccaatcgcggcgctgcgctggctgccatctaccaccaggtgatcatcagggcgatcccgctcaagcgcaggtcttagacgagccgctgctgccgcttccaaccgctgccggtcttgaaaggatggatgcgtggctgttgcaaatgatcccatacgaggttacgtggagttcatctcctcccacgtggtccgcaggctcctcccatccgaacccaggtctgtagttaacctgctcctgttttctaatgccccccacctctgtggggtgcaattcaaagatggagagactgggagtcgtggttgatgcctaaacctacaaagttacgtggagttcctccgttcctctttcaagttcgctctgcttttatctgaactccagacttgtataatttcagtacccaattgtgtaatatgccaccgctgttatgtgaaatg

SEQ ID NO: 14837 - DNA, 631 bp, Triticum aestivum
  Clone ID: PAT_TA_14837
ttcggcacgaggcttcactctcaaaatcttcagccgaggggagcagaggagcagcaggtggaccaagaatggcagcgccaggctccctgggacttctccagcgcgccttccttcgccgcggctaagtgccagccggtggcgagccgggcatccgcgcggcgagcgccgcgggcactgttcgccgtgcgcgcctcggctgctgacgccgccaacaaggacgccgtcctcaaggccttccgcgagaacagggctctcaagataatttctgggcttcagaactttgacaggagcagtgttgcatctgttgtcacagctgcagataagggaggcgcaacccatgttgacatagcatgtgacaaggacttagtaaagcttgccatggatcttaccaaccttccgatctgtgtctcatctgtagatccttcagcgttccattctgcagtagaagcaggagctaaaatggttgagattggaaactatgattctttttatgagatgggcattgagttctcctctgagcaggtactgaagctaacaagagaaacaaggaagatgcttccagagatcaccttatcagtaacagttcctcacacacttagtttgccagaccagatgagacttgcagagctac

SEQ ID NO: 14838 - DNA, 670 bp, Triticum aestivum
  Clone ID: PAT_TA_14838
gaaaagaacctgtttcagttcaatttttcacaaaagggtgcatgcagaacagatatataaactatgccatttaaaaaccgtgccttaggtttcataaaaggaaattgtctcagaggtgccatattcacatccacattggctaatcttttagcagtgccactggagtgattgtacagtatgcagcttcaattagtgatatttgagtacttaagtccaatgcgggccggctttttcctgtcgtcggtggttgctgtggttcccgcaacttggatcggttttcactttgtgtgcctgattcaggcactggatactttcaatacagcagttgtctctcccatctactatgccatgttcacgaccctcaccatcttagcaagtgccataatgtttaaggattggtctgggcagagagcaagcaacattgcctctgagatttgtggatttcttacggttcttgctggcactgttgtgctacattctactagagaacctgatcaaactgtatcagcagacctgtatgcaccactcccgccaaaaatatactggcatatccaagggaacggcgatgttgggaagcaaagagaagatgacccccttacatgccaattcatcactgttgtgcggcaagactactttgtgtagggatcatcctggatgcttggcgttacat

SEQ ID NO: 14839 - DNA, 139 bp, Triticum aestivum
  Clone ID: PAT_TA_14839
attcggacgaggaaataatacctgtaaactaagtgataaacatcgacttattttgtgatgttacttaatataagtttgagattttgttgtattagaacttgttttcaagctatgaatctaaaactacaattattggtct

SEQ ID NO: 14840 - DNA, 685 bp, Triticum aestivum
  Clone ID: PAT_TA_14840
tcgcttatttttgagctcctgtgttttttgtctttttttggtgttttattggcattttgtgtgttttttatttttattcttgtatctttcggtggtccttagaccgttatatcgttcttataagttgaacttacgtcaataccttaccatggctcctgggaactctgctccgttggcatcgtctgctggtaagcctaccagctccaacatcttcaatagcctctaccctttggattatgacgctttggctatgagatcgtaaactaaggtgacaaagttattgatgctggaggacagttgaaagtcatcagtcgtgcttagactcatgtctcaggctcgacccatagtcgctgccttttcaaaactaaaatctggtgtttggaaaaagaatctttcaaaggaaacgaagtcacgaacaagactttagccaaacttgggtcgggtaatcggccgcgaagtcacatgccgtatgcaagctttcaacatgtgaaaaaatggttatagtcctttcgtttctcctgaagttgctcgattatttgctgtcaaatatatggcactggagggattaaattctggacaagtagcaggagcagctcttaacgtttatgaagaggaaccatgtaaattcactgagcttctggaacatcctaaggttgtctgtgctcctcatcttggtgaaaaacta

SEQ ID NO: 14841 - DNA, 341 bp, Triticum aestivum
  Clone ID: PAT_TA_14841
tcgagcgtgcggttccacgtgctggggcagaagtgccccgggtgcagctcctacaacacccgggagacgagggccgcgtgccccaggacctgatcaggcgaacgaggcaaagtcgcaaacacgccagggagatgctgttcaacgactagtggagatcatccagcagcagcaggacgttgccgcgctaagggtgacgagcgcgagaccaagccggggcagtccagtcttgagtttggtgctgtgcatttgcaatgtttcctgtactgtaatgcgtccgtgagtgctgacgaggcatacctgtggaggatggcccggcgcaagggccgtaggaaagctgcagg

SEQ ID NO: 14842 - DNA, 280 bp, Triticum aestivum
  Clone ID: PAT_TA_14842
tcggcacgaggcagatccatcacccaaagtcgtcgtcgtcgtcgtatattattggagtattttggtttgcgcctttttctttttctttcactttaatttcgtcctactatatactagtgagtcgtgagtatccatccacctacgtattgtacgccgccgtcgatctatggccacgtcgacgcgttgcttctcgtgtcctcctgctttgttctactgcaacctactactagtattgttctactccaataaaacattatcatcaaaaaaaaaaaaaaaaaaa

SEQ ID NO: 14843 - DNA, 646 bp, Triticum aestivum
  Clone ID: PAT_TA_14843
gtgatggaaacaaaccagagtttccaatatgtttctgccctggtcgagggtctgatgaagctgatggaaggcgaccatgtaggaccattcaacctgggcaaccccggcgagttcaccatgctggagcttgccaaggttgtccaggacaccatcgaccccaacgcacggatcgagttccgtcagaacacccaggacgacccacacaagcgcaagcccgacatcggccgtgccaaggagctccttgggtgggagccgaagatccccctccgcgagggccttcccctcatggtcaccgacttccgcaagcgcatcttcggcgaccaagacaccgcggctgccaccaccggaaaccagcaaggctaggacggaagaggagcacgggacttggaaatttttggtggctgcttctagctgcttgggtcgaccctcctctccttactgacaaaagctatggcatgtattcgtccggaatgtgtcgctgaaatacttgggtgatgctgtaatgctatctttctcctgtatttttccctctcaattcgctcaaccattactatacaaaaaaattcatttgaaccgttggggataaactggatgatctaatcttgttgagacatacacatatatatggatacccactttttttaaa

SEQ ID NO: 14844 - DNA, 530 bp, Triticum aestivum
  Clone ID: PAT_TA_14844
aagttcctactgacgactcaattgtccattgagggccccatcaggatgaaagaggaatacgttgagggccttatagagattcccagaatcaatgaagaatcattgcctgaacagttaaaggcgttgcttggccaaactgccggagctctacaacaacttcctagccctataagggatgctgtttcagaggggcttaaagtgccacttggtggagcatttcaacgcttattcatgatctcttacttggatgaagaaatattgattatcagagatgctgctggagcacctgatgtcttaaccagacttgaggggccacaaccgaatccaggtgatggcacagcagatgcagtgatatcagaatatgaaagctaatgcctcagtacaaactgtaactccacacctagctcctgtttatgggctcctttctccttctctttgggtattttctcaggctcacgcatatataaaggctgtagtgtggtcaacgataacgaccgcttgagtgtttttacttagtacatccctttcgg

SEQ ID NO: 14845 - DNA, 481 bp, Triticum aestivum
  Clone ID: PAT_TA_14845
gatggaacatagttggcattgaggatgaaggagagcgtgatccttacattcttgtacgagtccatgggctacatggccctttaaaggttcgctgttcaacagtggagagggtgacatatggttttgctgctggagactgggtacggttgagggaggaggacaagaagcgctctcaggttggcattcttcatagcattggccgtgacggtgcagtgactgttggtctgataggaatggataccctttggaagggtaattattcagatctccaaatggctcaagcctactgtgttggacagtttgtgcgcctaaaggcccatatttcaaacccaaggttcgaatggcagcgaaagaggggtggaggattagtcacagggccgaatttcacacatacatccgaacgggtgtctcgtcgtgagatttcctggcaaatttaatcttggtgaagtgtgccgttgcttggcagacccctatgaggtgg

SEQ ID NO: 14846 - DNA, 395 bp, Triticum aestivum
  Clone ID: PAT_TA_14846
tgattttgtgttaatcttttatataaagtcaaataagacaatatgcctttagctaaagatttgcttcatcctactgctatcgaagaacgcaggaaacacaagttaaagcgtcttgtccaacacccaaattctttctttatggatgtcaaatgccccggatgttataaaattacaactgtattcagtcacgctcaaagcgtagttatatgtaccggatgttccacaattttatgtcaacccactggaggaagagctagactaactgaaggttgttctttcaggaagaaagcttactaagatcctggctcctgtattttaatgtacaatatgaatatgcgttgaataataaaaacattaaaaaacattcattctttcaaaaaaaaaaaaaaaaaaaa

SEQ ID NO: 14847 - DNA, 777 bp, Triticum aestivum
  Clone ID: PAT_TA_14847
cctccgagagcctcatctcctccacccacttgcgagcgagctagggttccgagagccgccggcgccatgttggtctaccaggatctgctctctggcgacgagctcctctccgactccttccagtataaggagatctttgacggcgtcctctgggaggtcgagggcaagtgggtcgtcaaaggagctgtcgatgtggatattggtgccaatccatctgccgagggtggtgaagatgagggtgttgatgaccagactgaaagggttgttgacattgttgacaccttccgcctccaggagcaacccacatttgacaagaaaacatttgtgactaacattaagcgctacatcaagaacctcactggcaagctggagccagagaaggcagatgaattcaagaagggcattgagggtgccaccaagttccttcttagcaagctcaaagatcttcagttctttgttggtgagagtatgcatgatgatggaagcctagtgttcgcttactacaaggaaggtgccactgacccgacattcctctattttgctcatggtctgaaggagattaagtgctaggcgggcatgccctctttacctcatgttgcttgttatcatctttacctcatgtcgatggttatcatctatataatactatcctatttttgttctagtatggattatgtcatggatggttatggaaaaactgttttggaaaaaaactgttggaagaatggattcggattatgacgtgaaatgttttggaaaaaaaaaaaaaaaaaaaaa

SEQ ID NO: 14848 - DNA, 542 bp, Triticum aestivum
  Clone ID: PAT_TA_14848
gattcggacgagggagagagagagagaactagtctcgagttttttttttttttttttgacactgacagggattttttatttatatcatcatagagagcttacctagcggttcaaccaaacaattgattgattaaccccgcaccttcacccggcctagctaccgctccaaaaaagaccaattcaatcgacaacagacgtgtcggttctagttcgtacacgtaatcacaattcagaacacgtagccacagctctagctttcactctctttatgcaactcttttagtaataatccaaaacaaagcacgtagtactacataacatatggccataatatacacagtagctagacacctcatctctatgcaggcttaacgcagtagtacacatcaaccaagcaagctagctaattaagcaagcatgttgccggccggccggagaagtcgccggagttgtagtatatatatggattattggttttacatgatggagcaggagtcgacgttctcgtcgctgaacatggtcatgtagcggacctcgggggc

SEQ ID NO: 14849 - DNA, 752 bp, Triticum aestivum
  Clone ID: PAT_TA_14849
tcggcacgaggcaaagaagatggcagtggctacgctgaatggctgcagggatgaagacgattcctcatgctcatcagagtctagcgaaagcgaatgtgaggggcaacttgtcaggatgagccgctgcactacaatcaccacaccagaaatgccatctccaagcacaggtctccccatcatagttcctcaaattccagcacctttggcaccggaaccatctcaacctttagagccagtaaccgtagtgcaagccaccagggtcagcagcgttgcagtagctgagacatccacaaccagcagaattgaggtctgcatgggaggcaaatgcaagaaggcaggcgcactagctcttctgcaggagttcgagaagactgtgggtactgaaggtgcggttgtcggctgcaagtgcctggggaagtgcggcctaggtcccaacgtgcggctgaggagcgacatctctgcagaaggttctgcaaaggggagcccactctgcatcggtgtaggttttgaagatgttagcaccatagtggcaggtctcttcggagacgctgatctgggcatgacacccacatagacttaatcttacttcaagagaagcttctattcacagatgttgcactgaacaaatgtatagactcaagtgcaaataatagctacggccttgctaggctgctagtgctaggtttatgcactatatgtctatatagaacatgtatcatgtatggtaatcaaagtttctgatttctgatcaa

SEQ ID NO: 14850 - DNA, 744 bp, Triticum aestivum
  Clone ID: PAT_TA_14850
gcacgaggccagatccgcgcgggccaccagactcgtcgcccgcgccggcggcgtcgatgacttgccgctggtcgggaacaaggctccagacttcgaggccgaggctgtgttcgaccaggagttcatcaacgtgaagctctctgattacattgggaagaagtacgtcattctgttcttctaccccttggatttcaccttcgtctgcccgaccgagattactgccttcagtgatagatacgaggaattcgagaagttgaacactgaggttcttggcgtctccattgacagtgtgttctcccaccttgcatgggtgcagacagacaggaagtctggtgggcttggcgatcttaaatacccacttatttctgatgccaccaaatcaatttcaaaggcctttggtgttctgatccctagccagggtattgctctgagaggactgttcatcattgacaaggagggagtgattcagcactctaccattaacaaccttgccattggtcgtagtgtggatgagaccatgaggacccttcaggcattgcagtacgtccaggagaacccagacgaggtgtgcccggccggatggaagccaggggagaagtcaatgaagcccgaccccaagggaagcaaagagtacttcgcggccatctagactccccgtcattgagaagctttgctactctttatcatggtgcctgttaagtgccccagcggtaggtccttgtggagttttgcggagctcgcgtt

SEQ ID NO: 14851 - DNA, 615 bp, Triticum aestivum
  Clone ID: PAT_TA_14851
gattcggacgaggggcgtctggcaccccgacgagcacgagccgctgctccggcggctccgggcggcgtcctgcgaggccgcgccgcggctgaggggcgcgtcccggaactccgcgcgggacctgctcgagtggaccaggcggggcagcggcctccgcgccatcctcgtcatctcggtcggaacaatcactcttatagcattgactggccttctgatcttcatgttcttcctgttggttgccactgctaatgcggtcatcgtctcagtcctgatgtcactggctgctgctggaggattcttggctatcttctttgcttgcttagttgcagtttatattggagcagtatcagctgctatctttgccatttctgcgactgtcatatcagcagttgttggagttatgattgctaccggttgggttgggttcttctggatgatctggttcgccgcaaggaagagcatggacctgacgaagcactccattggcgtgacgagctcggcgatccaatcgtactcggcgtcccggcatgtgaaccagaagcctgtcgactgagtttagttggttgcatcctgtatgaagcccgccggtgtatctatgtgaattacggtttggct

SEQ ID NO: 14852 - DNA, 406 bp, Triticum aestivum
  Clone ID: PAT_TA_14852
gattcggacgagggaggccctcctcccctagctggggcggaggatgctttggcgggaagaagaggcaagcccctgacacgtccctggtgctccgggagcctctccgtcggcgtcggcagctacggcagcggtaaggacggagaaaccgttgatccgtttaatgccgtagctgcagttattctgctaccttgaactctcgggaggcattacaaggatggtatagtttatcagttcagaataaataaacaatcgaacatgatcctaagtttcctaacgaaataagcttctttcagcctaaaagaagcttagtggttttccgaaggcaatcgatgtgaacaattgagcatgttgcctttttgttgactgtaaaaacctgcacaaagtctgcaaatcgtctgttctggtc

SEQ ID NO: 14853 - DNA, 592 bp, Triticum aestivum
  Clone ID: PAT_TA_14853
attcggacgagggagagagagatactagtctcgagttttttttttttttttttggtattatgcttttgccctttttttgttttttttaccaactgatctttcacctcacaagagataaggtgtgcaggccgttactgtgaaaactccgcctgccattatacttcctatttcttgaatatatagcctccaaaggtatcgctcctcagtaaatttcttgcagacttcggcccaaaaagaggtccactcccattgctctgtaggccaccgaaggttgatgcatgataacctagactaactgaagctgctgatcttgtcaggagagcttcaccatgcattcctggcatgttggcatggtatgttgccccctcaaatccaacagaacgaaactgagatgccagagaatcaatgttggatgtcacaggggacaacgaaccagaagaactcccagcagaataattttgttttggaagcagccaattctcccatgctccacgccttcgcagtttgtcaccctgcacttccacaacgttagatagcatgactgtttccaagataaactgaatattattagtaatcttctggacttggggaa

SEQ ID NO: 14854 - DNA, 752 bp, Triticum aestivum
  Clone ID: PAT_TA_14854
cagtcgcacgagggcggcggagcaagaggagcgaaggcgagggcgagggcgagggcgcgagggagggacaggagcaccagccatggtgcacgtgagcttctaccgcaactatggtaaaacattcaagaaaccaaggcgtccttatgagaaggagcgtcttgatgctgaactgaagctggttggtgagtatggtctgaggtgcaagcgtgagctctggagggtccagtatgccctgagcaggatccgtaatgctgcaaggcacttgctcacccttgatgagaagaacccccgccgtatctttgagggtgaggcgcttctccgccgcatgaaccgctatgggctgcttgctgagggtcagaacaagcttgattatgtccttgcccttactgctgagaacttccttgcaaggcgccttcagacacttgtcttcaaggctggcatggccaattccattcaccatgctcgtgtcttgatcaagcagcgtcacatcagggttggcaggcaaatcgttaatgtcccatcgttcatggtgagggtggagtctgagaagcacattgacttttcactgtcaagcccgttcggtggaggccccccaggcagggtgaagaggaagaacctgaagaaggcaagtggcggtggcggcgatggtggtgatgaggatgaggagtgaggatgaacaagtagcatggccccaatataatattatctagttttcataaacatgttcctatcatgagtacttagctgggtga

SEQ ID NO: 14855 - DNA, 772 bp, Triticum aestivum
  Clone ID: PAT_TA_14855
ggcgcggatcgagagggtcatcttcgcctgccgcttcatgaccttcctcggcatcggtggcttgctcctcggctccgtcccttgtttcctcaagggaagcgttcatgtgatgaatgccttcgtcgactactacctgcacggcggagggaagctcatactcatgctgctggaagccattgaaatgtttctcattggaacggtcacgtttgtcttggggattggcttgtacgagctcttcatcagcaccatagactcctcttatgggtccaacctcttcggccttttcagccttccggatcggcccaagtgggttgaaatcaagtcgttagatgatctcaagacaaagctgggtcatgtcattgtcctggttctactggttggcatattcgagaagagcaagagggtgaccattacatcctgtactgatctcttatgctttgctggatcgattttcctatgttcagtttgcctctacctactttccaggctcaataccagcaaatgaggcagccatgcctgaaataagagtgtttgtatataagtgattggtctgttctgttgctgtgcaatgcctcaggttgtgttcttgcagtaattaactgggaagtgtggagatacagatttcccatgtactcatgtatggctagggagtttcagttaggcacaaccacactacattgagtatcgtcctgtatgtgtagctcgatgtaatgcaatcaatactgatattctcttgagcaagcccaaaaaaccaccaacaaaaacaaaaaaa

SEQ ID NO: 14856 - DNA, 469 bp, Triticum aestivum
  Clone ID: PAT_TA_14856
gcttcaaaatggtatggtataaattgtctgattcattcatatgagaaaagcacatgacatagtaacttaatcaacagtcttgtaggatcaaactttaaacctccttatttctaccctgagacaaacaacaataacttcagccaacctctactgcaatggccacactgtatcagcttctaagggtgggaaatccaaaccaagctccattttaaccaaactattgattccaactctatggatgctgcttggggtcgcggtacccagcatccacaaggaccttctccttcttggcaagctcgatgtcgttatcaaccatcatctcaactagctgctggaagccaaccttgggcttccacccaagcactctccttgacttggatgaatctccctgcaggcagtccacctccgaagggcgaaagtacttcttgtcaatgaccacatgatccttccagttgaggccggcataccc

SEQ ID NO: 14857 - DNA, 512 bp, Triticum aestivum
  Clone ID: PAT_TA_14857
gaccgcgggtggaagggcgtggcctcgctctgcggcggcggcgtggacccgaacatctccgaggacccggcctggtagtagcgcatgggcttggtcttggcggagaggcggacggcctcgagcaggcggagcgcgcccgtggccgtgacgtcggcggtgtagtcggggacctcgaaggagacggcgacgtgggactgcgcggccaggttgtagacctcgtcggggagcacgtggtcgagcgcgcggcggagcgaggaggagtcggagaggtcggcgtagtggaggcgcatcggcgggcgcagcgcggcggagggggtcgcgtgcgggtcgtggtagatgtggtcgaggcgctgcgtgttgaagttggaggagcggcggatgaggccgtgcacctcgtatcccttggacaggagcagctccgtcaggtagctcccgtcctgccccgtgatgcccgtcaccagcgccaccctccgcggcggcgccagggagcggggcaccgcctcggcgtcggc

SEQ ID NO: 14858 - DNA, 2468 bp, Triticum aestivum
  Clone ID: PAT_TA_14858
tttctcatctggtatcaattgtctgattcttttctatgagaaaagcacaggacgtagcaacttaaccaacagtcttgtaggatcaaactttacacctcctttcctcaaccctgtggcaaagaataagagatgcagcaaaggccagctccactggggaagctgtagtaggtcgtcgagggcggggcggcactcgaagcgtactggccagcaatcgagtcattgtacctctatgggtgcgtcctgggttcgcggtccccagcaaccatcaggaccttcgccttcttggctagctcgatggctttctttaccatccttccaactagctggccgatgcaagccttgtgttgccaaccacgcacgctcgttgactgggatgaatgctccccgctgacggtcatcctccaaagcatgtaagtacttcttcttcatgaacacagcttcttgcgaatggctggcggcagcactgataacagcctgcgggaattcctgccacagcgtgtaacactacaagcggggacaacaaaagtcatcacgacttgttgccgggaagtaagccttaccggctgcctacacctgcctaccgaactcctgttcaaaggcgtgatcacaaaaggagaaacgaagcaaggaagggatcatgtcttgctgatgccggggctcgttgctgtctcatttgctcagtcctctgtctcgttgtcggtggtatttcctaaacagcagcccgccctgaaggccatatacaacgcgggcaagagggatcctcaagcttctgatccatcagttgatcatgccaaaaatccacattttcttgttttgctgtctgggggcctcgcgctgcggcggccccgtggagccgaacatctccgaggacctggcctagtcctcgcgaatgggcaaagggctggcgcaccggcggataccgtggagcaggcggagcgcgcctgtgactgtgacgtcggcggtgtagtcggggacactgcaaacgaagacggcgatttaagagtggccggcaactttatagacaatggtttctgcacctgcattctctcatatgacacctatttcaaatgttgcttctaaaagtgtatcatcaatgcaaacttcttgaccatcgatatttcacaagaggcaaaggcggccggggtagtggtagatgtgggtcagagtcgatgagtgtttaagttggaagaggttcggcctggtggcccaacatatgttagcatcctaaagaacatctcagaaaagtagctccctttctgcccagtgatgcccgttaccagcgccaccgtccgcaacaccgataggagtgcacctgtgcaacatgatatcgagtggcatgacatccactcctgctgtcatatcttctatatctggaacagtacagccaattggtgctcaacagttggtacagaacacagctctcggttcttttgggtcaaacacttctactgtatctggtaattcaaatattgccgtatcgtcttctttggctaacatacaaagcaacatggccatgggacaatcagtgccttctatggcacaaggtggtctgatggctggtccacaatcaggacaaggtggaattggtacgaaccaaaacacgataaataaccttgggactacggctatctcttctacgcctacaatgatgccaacaccaggaatggtccagcaaacaggagtaaacgctcttagtgcgaacaacagttctgctatgaatatgcctctggcacaacatcctaatggccagcaaccatcgaagtatgtcaaaatttgggagggaactttgtctgggcaaaggcaaggacaacctgtatttatttgtaaacttgaaggttataggagtggaacagcgtctgacacacttgcttcagactggccagaaacgatgcagatcgtgcgcctcatagcccaagagcatatgaacaacaagcagtatgttggcaaggcagactttctagtatttcggacattgaatcagcatgggttcctcggacaactacaagagaagaaactgtgtgcagtgattcagctaccttcacaaactttgctgttgtcagtgtctgacaaagctgggcgcctcataggaatgctgttcccaggggatatggtggtattcaaaccacaggtctcaactcagcagccacagatgcagccacagcagcagcagcagcagcagcagctacagcagcagcagcaccaaatacagcagcaacagcagcaactacagcaactgcaacagcagcaactacaacagcaccaaatgcaaatgcagcctcaaggccagcagcttcagcagcagcagcagatgcagcaaatgcaacagcaacaacaacagatgcagcaaatgcaacatcaacaacagcagcagcagcagcagattcagcagcagcagcacatcccccgccgccagcagcagattcagcagcagcagcagatgcagcagcagcagcagcagcagcagcagc

SEQ ID NO: 14859 - DNA, 634 bp, Triticum aestivum
  Clone ID: PAT_TA_14859
gcagtttgctgcattagcagcattatcccaaaatccaggccaagttcgtgatgatgccctcttggatttctataacaagtggcagcatgaatacttggttgtaagcaagtggtttgctcttcaagctacttcagagattcctggaaatgttgcaaatgttcagaagctgctgtctcaccctgctttcgacctgaggaatcccaacaaggtctactcgctaatcggtggattctgtggctcacctgtgaacttccacgcgaaagatggatctgggtacaagttcttgggtgaaattgttttgcagcttgacaagataaaccctcaggtggcctcccgcatggtttcagcattttctcggtggaggcgatatgacaagaccagacaagatcttgccaaggcccagctggagatgatcgtgtcggccaatggactctccgaaaacgtgtacgagattgcttcaaaaagcttggcgggttagttttgggcagttccagggtagtgccgagtgccgagtggttgtgcttaactgaaaatctcttttgttggcacaggggccagttgagtaataaacaggcgtgctgaagttgcatgaactgaacaaatatagtgtgatgactgatgatgcccgctttgt

SEQ ID NO: 14860 - DNA, 501 bp, Triticum aestivum
  Clone ID: PAT_TA_14860
ttcggcacgagggatgtatataaagcacttgggaaatctaagaagtggtaatcaaaatctcaaagttggactattgaattttaatagcactgagtatggctcttggacacaattgctctcagacagccatgtttccattataagacttgagcatgccaaggacagcattacttggcaaacactgtatcctgaatggatcgatgaggaggaagaaacagagataccctcttgcccatcacttccagagcctgatgtacgaagagatgtacgctttgatgttattgctgtaaagcttccttgtacccatgtggcaggttggtcaagagatgttgcacggctccatttgcagctctcagcagcaaaattggctgtgacatcttcgaagcgcaaccacaaggtccatgttctttttgtaactgagtgctttccaatcccgaatctcttcccttgcaagaaccttgtgagacatgaaggcaatgcttggctatatagccctgactc

SEQ ID NO: 14861 - DNA, 646 bp, Triticum aestivum
  Clone ID: PAT_TA_14861
ttcggacgaggcggcgtcgccctgccgaggaacgaggccttcgtggtcgtctgcgagtccagcaggttcaggtgcatgaaagtgtggctgaaaggggagaaggccggcaaggcagagacgttcgtcgaccttccggggtgtccggataacattcgcctcgggtcagacggtcacttctggattgccctcatccagctgaggtcgccatggctggatttcatcacccgctggaccttcacgaagagagtggtggcttcgttccccgggctcatcgagtggagcaagggaacggcgaagggagccatggtggctcaggtgacggaggacggcaacatcgtccgcattctcgacgactccgaagggaaggtgatcaacttcctgacatcggtgacggagttcaacggggacatcttcctcggcagcctcgcgaccaacttcgtcgggaaattatctctggcgcaggtgatacagcaggagcagtgagcagcacatctccagcccttggagcacgaggaaagtttacgtgcctgtttctgcaaacaattggatcttgtagtaaggctttcgaaaagaattcggatttctgtactttaacatttttatttttatttggcaaatattatctaattatggactaactaggttt

SEQ ID NO: 14862 - DNA, 811 bp, Triticum aestivum
  Clone ID: PAT_TA_14862
gagagagagagagagagactagtctcgcgttttttttttttttttttacttttcaattttgccaagctcaagtttataggaagccacgaccacaagaccacgttactgctgtcaatgcatattttatggaaatatagaatagagactgggtttataaaaagaagataactgatgcatttagaaataaatatgcaacgccttcgtggactcgtggtccatgattattgctgttacttccgtgcttcggacttcctctgctccttggcagctttctcctcttcgcgtttctttgcagcatcagccctttgctgtcttattaaagcaagacgttccaaatctttccgtgcttgttctgtttttccttgctcttgaagcttcatataacgttcgtgagctttttgtttctcaagctcctctctttcacgccttgagagttcagttgtcttcccaagatcaacttccttggcctttatattcttggctttcactaagtttggattttcaatctgaataataccctcagtacctttatgtttaggtttgtcgtcagactcgtcttcagattcttcctcctcggattcttctctttcttcatgttcctcctcttcctcttcctccttcttcttaaaggtgcgtgggcggcctgaagtaccagcagcgatctcctcgggcgtggaaaagttgcggaggccggtgggctttcccttgaactttcccctccccatagcggcgccggcggcgggcgacgaggctggtgcagactagagagcgagctggaaggagcggaggagggctctcgcctaggttgcac

SEQ ID NO: 14863 - DNA, 731 bp, Triticum aestivum
  Clone ID: PAT_TA_14863
catcaggcgccacccttgcccccttcctgttgcatcatcctccgctcctcatcgccggatgtgacgaggacctcggcagtgccgacgcggaggtctgcctcaacagatcgagcggcggcatcgacctcgacggcaacgtggattgggctacatcctcggcggcggatcgagcgcacatcaatgcagctcctctctaagcgatagcggcaacaactggatcaggaggcctctccatcgtccgcccggccgtccaccttcggcatcagcttcgtcgaacaggaggcggcagcctaggcggcggcgcggcaggggggcgaccacctcatcgcgtgcctgtgatcccccgccgccggatccaggcgtcgccgccgggatggtcgaggcagcgaggcgttcttggtatcgatggtggtggactagatcttaatcatgtggtcagcttgcacctccttccttcctcacatctgaactaatggccgcctgggaggttctcgttttattgatgcagcgccatgtcggttcttggtggatgccaaatccttcaagatactccttccccgttccatgttcaccgaggacaaggtcaccttgctcaagccctttttcctcattttgataacgcttgttggtgctgtgtagttgcttgtgtgcaggttctagacaaacaacaccatgagcgattccattcgcccggcatcacctccagcttcgatatgttctgctccctttct

SEQ ID NO: 14864 - DNA, 1461 bp, Triticum aestivum
  Clone ID: PAT_TA_14864
cgtccggaaatttcaaagatacctgcaagaaggtttactcaggtggtcacaaaatctgtggaaaagctgtacggaagacaagtcttgagtcatgtgaatcttggaaattatttggcttcaaaaatacccagtctgcggaactattcaaacgggcaaaagaatggggactcaaagttttcttcattgcaagcactttctagtgccatgcagttgcttcacaagcatgaatttagagatcagcataacgagtggataaactcagcaaagtctgctgttgatgcttccatagttggtaatttgtctgatgatggtgattcaactattaatatcgtccaagatgcaagaaaggaagtgcgcttagctctcaacacacttcttaaggatgatggaattctggtcatcccaactgctctgggatgccctccaaaacttaatgccagggagctctcgtctacaagctacaatgctgagacattatgccttcaatctttatctagtatgtctgggtgttgtcaggttactgttcccatcggtacacatgacaagtgtcctatttcggtttccttcattgcgaggcatggtggtgatcgctttttgctggacaccactcaagccatatatgccaccatccaagagcaagttgagatcctagcaaaatctaatccttcaagtaaagaggcgatgaacgaagaagctgctgaagctgctaaagagaaaggtaacagtgcatttaaggagaagcaatggcaaaaggcaataaatttatatactgaagcaatcaaattaaatggcaaagtagccacatactacagtaacagggctgcggcttttctagaactagctaattatcgccaagctgagacagattgcactagcgccatcgatattgatccaaagattgtcaaagcttacttgcgaagacgcacggcaagagagatgcttggatactataaggaggctgtcgatgattttagccatgcccttgttctagagccaatgaacaagacggctggtgtagctattaatagattaaagaagctattcccgtaagtgccaagcccatggaattattcctttctgaaaatatggctgctgattttgtgcacaaacaactgtgtcttggggatggaatggaagtgcctgagcgccatggatctgtgatgcggcatatgctctttgcgcttcgcaagggtattgaatcgtcattgctggtggcaacggggttgtcattcgtggagtcattttgcatgttctcccccaagttttggataaagcaaagtaaaaaaagcataggttcgcgagacccgatcatagcagcaatgtcccctcagatgtgatctaccaatgcgctcccgtcatgttataatatcgattttgacaattattgttgaaacagcttgattttgccagtaaaatgctccgcaatgccgcaagcaccttttgccaatcaaaaaaaaaaaa

SEQ ID NO: 14865 - DNA, 488 bp, Triticum aestivum
  Clone ID: PAT_TA_14865
gccctcaacctcaaaggtgtggattatgagtacacggcttgtcggctccgcctgcgcttccaacagcagctaactccaaggcaagcatccttggtccactgttcgcctcactcccatcagctgccactgctgttgtgtctcagcaggagtcgttgcggccatggcggcttcgaagcccatcctgtacagcgcgtggatcagctcctgctccttccgagtccggatcgccctcaacctcaaaggtgtggattatgagtacagggctgtgacacggaatgatctagattacgaaaagatcaatccgatcaagtatgtcccagcattggttgatggggattttgttgtttctgactcccttgcaatcatactgtatctcgaagacaaatatcctcaacaccctcttttgcctcaagatctcaaaaagaaagctattaatcttcagattgcaaatatagtgtgctcgagcattcagcctcttcaatgttatg

SEQ ID NO: 14866 - DNA, 568 bp, Triticum aestivum
  Clone ID: PAT_TA_14866
gcttgctctgagacatggaccatgctttgtcctaccctgcagcggcggctgcacggccccccggcgagatcccataaggggcctattcccatgtactaggattattcagtttcactcccacatcgtgatgttttatttgtacttttgtcgtgctataacggatagcgctcctcgttggcgccaccggcgggtggttctgcctctggtcttggtgtgtttgtgtgtggccacactggcccagccagcagaggcgcccgcttgtacctagattactgtttccattgtcgtcatcatcggctaacattgtcataatgtcagtttgggtaatgttagattaagtaattattgtgttctgtattcttgtttgttgcccttcttttgtgtgtttttgttattgttggtctgtttccattgttgttgctttggcattgtcagtgcccgccagccctgaaaattgccgtttgggtgggtttgcgtgtacttcgtattatgatgttgggctgcacattgtagctgggaatgtttgccaaaaaatggaatgggcatgcggtggttgttggtggaaaaa

SEQ ID NO: 14867 - DNA, 732 bp, Triticum aestivum
  Clone ID: PAT_TA_14867
cgccgcgtgggcctactctctgaagacggaccgaaactccgcttccgcctgctcttgctgcggcctccgcgctgcaagtgaggtacatgaaaactcaccagccactgatcagttggcttggtcagtaccattatataccagccctcctgacagataaaaattgatcagggagacttgccatgcagcgcttcaactttgcaactgttatggaagcaccagtgatcttcttctgccgtaacaatggctgggcaatcagcaccccaactactgaacaattcagaagtaacaaaacatggtcttcttactcatccatggcagctacgagtgagcaatgcaatgccatgttaaaattcgcgtcttctggcgggaggccggtgttggttgccgcgcccacgcttcggggtgccctgctctccgcgtccgtggcttcgaccctcttccggccagtcggcgcggtccagcccgcccgagcagcggcggttcctgttgccagacccagtttaggggtgcagcgtactgaccggggggctcatcccgcggcgtccgagctctcgaccagggtcaggccagtgcttcttcaagccatccaggttgcagaaagaatgccaaaaccaccagttgctgaccttttcactgatgtttacgataagattccttccaacctatgtgaacaagagcaattgctgcgggatacaatcatgaagcaccctgcagactacccaactgatgtac

SEQ ID NO: 14868 - DNA, 923 bp, Triticum aestivum
  Clone ID: PAT_TA_14868
caagcaagctcactcgatctcgctctctcactactacctagtactacatagcagcagcaatggcgcccaccgtgatggcctcgtccgccaccgccgtcgctccgttccagggtctcaagtccaccgccaccctccccgtcgcccgccgttccaccaccagcttcgccaaagtcagcaacggcggcaggatccggtgcatgcaggtgtggccggcggacgggaacaagaagttcgagacgctgtcgtacctgccgccgctgacggaggagcagctgctgaagcaggtggactacctgctgcgcaacaactgggtgccctgcctcgagttcagcaaggaaggcttcgtgtaccgcgagaactccacctcgccgtgctactacgacggccgctactggaccatgtggaagctgcccatgttcggctgcaccgacgcgtcgcaggtctacaaggagctgcaggaggccatcgcctcctacccggacgcctacgtccggatcctcggcttcgacaacatcaagcagacgcagtgcgtcagcttcatcgcctacaagcccgcgggcagcgagtgattaaactgctagctagctcctgcgtgagctaatggcatatggctgcctgctgctgcctctcaacctgttcgttcggttttgcatccttggggtcacacacacaccttggtttctttcttcttctttttttcaccttttgctgctgttggttcctttgcttctatatatgctgctgatgtatccattgttggcatcatccatctcgatcgatctctccccctacatatacctgctagaaaaaactactgcaactagcgttgggtgaggaacatatatgtgaatgcaagctccggctatcatgtatgtgtaatatatatggcattggagattgctctggttattcacagagcaaag

SEQ ID NO: 14869 - DNA, 708 bp, Triticum aestivum
  Clone ID: PAT_TA_14869
tggcaacccatctccgcttttcttaggattggtagcagcatcatcaggtcagtgttgatcaacgtggcggtatcagtaaaacaagcagatgcatcagcaataccggaggagcatcaaagctaaaagcttgccagaatgggcacctcatgaagccactgaagggcctggtgaacgggcactattcaacaaccagcaatggcgccattcccatctagcagcacagagctgcgaggcactgcatgcttgtttgagatttctcttctaccgttttcgcttgatcttttcctttacttggagcgcgggcttccattctaccaagcaaactaagaagaagagaagggccgtttgctctagcgacacagcagccgtttccgatgttttaacctggaagcatttggcatgcaagctgtcgcatgcattaagaggcaaatttagcaggctagctagagtttgattagtagtagtaatccgatatgctggtttatttgttcgtgtgtttgctaagattacaaaggctggtgatgtgcagctagctgtagtgtaccctgccgcctcgcctcatttgtacattgtaaaataactgctactctccattgactgactgaatggatgagtataaacgtatcggaccaacatgctcagcgtgggtttagtttatcaccggtaaagactactataaatccgaatgtcagttttatcgttgaggcc

SEQ ID NO: 14870 - DNA, 649 bp, Triticum aestivum
  Clone ID: PAT_TA_14870
gaaacccccgtcgccagggttccctcctggccgccctgccattccccgcacaaaagccagtgcgtaccgacgcttcccccacagcctggactggaaccgagccgccgtacttttcactctctcgccgtctcgcgctctcctccctcctcgttcccgggcctcagctctcaactccctcccacttgcttcctcctccttcccctggcctcgcccgcacgctgctcgatcgtcgcctacctagtacctaccatacataccatcacacctaccgcccctctcccccactgcctctctcgcccgcaccgtcaaacccccccgcgtcagcgatcgagccctgcccgcccatccgaatccgaagccgccgggcaactccttccgccgaagcgaagcgggccgcctcgggctctccgccaccgcgtcctcctccgtccgcactgcgccgctggtgctggattggcgtggagatccacccggacttgttcctcctgctgctgatatcagccagactgatcagtggtcatattgaatacaaagctttctcgtatggcttttgttagcatgcaaaagatggtgcccatgggtttggaatgagggactacactacctagaaatggatgaaacaccaactagttctgggcgatcttgagct

SEQ ID NO: 14871 - DNA, 734 bp, Triticum aestivum
  Clone ID: PAT_TA_14871
agggcattggtggaggagttgtccagggtcgggaagcgggaggaagctgacagattagcgagggagatggagcagaagggcattgtgagtgctcgtgagctacgagcactgctgagttcaatccgcaatgacgatgacgacaatttggatgtggatgatagtggaaggaacacctggtgacacctttttttttctcaagagaccataactctttatagtgggatgaacacctgacctgactgacaatatttttgggcgttggattggaaatcgatgcttactatttacccaatctcttgccagcaaggtggcgacaacctcatttcttccagtcgggctggtacaggcagtcctcggcctcgtggttctagtgcctaggctctacctcatcgacattgtacttttgacagattgtggcgaccagggtgggctacaataggtgtaccaatgtgcagctctgtgcaaatcaaaaccaagatccatggctaacttgaggccacctgagcgaacttgtccatttaacactagctgtgcaaatgacataccaaagacctaccggctgttttcaaatccctgtactcttctcgcttggtacttcaaagttttcaaacttatgtgcattctaggcctatggtgcactgggagactggtgaggaagatgtgactgcaggaaggatgtttggccaatgatgggtttgacggataattctctctttagattaaaaagatgagat

SEQ ID NO: 14872 - DNA, 512 bp, Triticum aestivum
  Clone ID: PAT_TA_14872
gattcggacgaggctcggccgccgctcctcgattaacaaatccccccacccactccagatccccaaaaccctagcccccaccctccggcgatggcgaacccgcgcgtcttcttcgacatgacggtcggcggcgcaccggccggtcgtatcgtgatggagctctacgccaacgaggttccccgcacggccgagaacttccgcgcgctgtgcacgggcgagaagggcgtggggaagtcgggcaagccgctccactacaaggggtcgacgttccaccgcgtgatcccggacttcatgtgccagggcggcgacttcaccaggggcaacgggacgggaggggagtcgatctacggcgagaagttccccgacgagaagttcgtgcgcaagcacacggggcccggggtgctgtccatggccaacgctgggcccaacaccaacggctcccagttcttcatctgcaccgtgccgacgccctggctcgacgggaaacacgtcgtgtttgggcaggttgtgga

SEQ ID NO: 14873 - DNA, 501 bp, Triticum aestivum
  Clone ID: PAT_TA_14873
aagggactggaactgctgaagaagaacagggacatgacttttggcgaggttaagcttaccatcatgattgaggaccctagagatatagaaaggaagagaacactcgggatagaggatcctgatgaaattactagggatgatctagcggacgctttggctgaggttaacgaaggaaggattccagagaatcgtgttgcacttcaattgcttgccaaggagatgtcagaatggccagacattgagatagaagctccaaaaaagaagagcaaacctgggaaatctgtctatgcaaaagccacagatactggcatcgatcctgagacagctgctaaaagacttaaccttgactgggactctgctgctgacatagatggcgaacaggaggatgatgatgaaactgaagtgccatctgcagtgggatatggtgctctgtatctgttgacagccttccctgttattattggaatctcaggtggcctaattcttttctacaattctctg

SEQ ID NO: 14874 - DNA, 592 bp, Triticum aestivum
  Clone ID: PAT_TA_14874
cacacatttgagcgcaggcttcggctcggtgggcctcttctgaagaacaatattgcaactatggttcttgagagcccctattatggacagcgacgtcctagcatgcagcgtggtgcaaagctccagtgtgtcagtgacctgttacttttagggaaagccacaattgatgaagctcgcagtctcctgtactggctgcagaccgaggctggttacagcaagatgggcgtatgcgggctcagcatgggtggagtacatgctgcaatggtgggatccctgcatcctacaccaattgccacactgccatttctcgctccacactctgcagtggtacctttctgtgaaggggtctacaaatacgccacagcttgggatgttttgagagaagatgctgcagcattaactcaagatgtaacatctttggcagaagatgctgcacagaaaactgggattactatcgaacaagtcagagataggttgcggtcagtgttgtctttgactgatgtcactcgattcccagtcccaaagaacccacaggcggtcatctttgttggtgcaacggatgacggttatattcccagacattcagtcatgg

SEQ ID NO: 14875 - DNA, 518 bp, Triticum aestivum
  Clone ID: PAT_TA_14875
ttcggcacgaggtttaggttcggaattggcaacgtgaagaagatttcgaggctgctctcaaggatgcaggtttactttaagtaaccaccgaaacttgtggtgagcagcgctctccgtctcaggacaattcaccggtgattttttgctgagcctgctgcacaactttattgtgctcttctgctcatactcttagcagcaccgattttcaccggtgtttttttgctgactctgctgcacaacgttactgtgcacttctgctcatcctgttatcagcactgattgtttcgcagcacagttttgtggattatcttaaagactaggacaattatggtgttatgagcttatatgaaacagagggttgttgaaaggtgtttctttgtcaatctgcctgtactgcagttatgagcattaccatttgaaactgtaaatcttgttattaaagagtaaactgttgagatgcgtgccgttacgatcttttttacagtgatgattgtttaaagaaaaaaaaaaaaaaaaaa

SEQ ID NO: 14876 - DNA, 570 bp, Triticum aestivum
  Clone ID: PAT_TA_14876
acgagggccgaaccggtgcagcacttgcaggaagagggttggacttacaggattcaactgccggtgtgggaacttgtactgtgcactgcaccgctactccgacaagcacgactgcgggttcgactatcggactgctgctagggatgccattgccaaggctaatccagtggtgaaggcggacaagctcgacaagatctagggtttcctacggttggctcaaggaagattgcaacctgtggtacttcatcatgcggaattgctgcattgcccatgcctttccctttcatgtttgctgctacaatcttgttgttcggcattgcagtgcatggtgcgcacttccgcagcctgcctcaagaattctcgcctctgcatctggtcagttcaaatgatttgcatgttggctatgttgtgtaagcttttatttatggtcgtctcgctcagacggtatttggcttcgcatttagctagctatgtgatgtactattgtccctggtgtgttacactgcaaccagtaatagtaatctgcaactgtccgttaagtggtactgatgaccatttgcattctcagtt

SEQ ID NO: 14877 - DNA, 474 bp, Triticum aestivum
  Clone ID: PAT_TA_14877
tctctccgccccgcgccgcagccagccatggacgccgtggactccgtggtcgacccgctccgggagttcgccaaggacagcgttcgcctcgtcaagcgctgccacaagcccgaccgaaaggagttcaccaaggtggccattcggacggccatcgggttcgtcgtcatgggcttcgtcgggttcttcgtcaagctcatcttcatccccatcaacaacatcatcgtcgggtccggctgatctcgtctccgcaggtgaggggccgcaggacgagaggatggtgtccattcatggaggcggcgctggttttcttatcctcgtaccttaaagcaattcatttaggacttcattgtagaggacagttcccttgtgttttcatttgaaacagttgtattggtagacctggagcagttttgaacctgattccggctagaccgtaatatcaagcagtgaatgacaagaattgaaaccctaaca

SEQ ID NO: 14878 - DNA, 597 bp, Triticum aestivum
  Clone ID: PAT_TA_14878
cccacgcgtccgcacctccacattctgcctcccacctctccggcgagatctccctcctccccgcgccgcagccagccatggacgccgtggactccgtggtcgacccgctccgggagttcgccaaggacagcgttcgcctcgtcaagcgctgccacaagcccgaccgaaaggagttcaccaaggtggccattcggacggccatcgggttcgtcgtcatgggcttcgtcgggttcttcgtcaagctcatcttcatccccatcaacaacatcatcgtcgggtccggctgatctcgtctccgcaggtgaggtgcggcaggactagaggatgttgtccattcatgggggcggcaaaccaattcatttaggacttcattgtagaggacattttcccttgtgttttcatttgaaacagttgtacctggagcagttttgaacctgatactggctagactgtaatatcaagtagccaatgatactggctagaccctatcatttcctctctggagcattgtgctatgatgcctttactttcatcaagttctttgtgtaattgtccaaaaggtaatgacatgcactagcaaggtgcccgcgttagttt

SEQ ID NO: 14879 - DNA, 541 bp, Triticum aestivum
  Clone ID: PAT_TA_14879
gtgcggcgctcgagccggccggtctggggcacaatccaaagcagcattcgccgtcggcttccacccttcccctcacgcgcgcgacctcgtcgtcgtcgtcggctcggagatctcgccttcccgccggcagcagccatggacgccgtcgactccgtggtggaccccctccgcgagttcgccaaggacagcgtccgcctcgtcaagcgctgccacaagcccgaccgcaaggagttcaccaaggtggcggcgcggacggcgatcgggttcgtcgtcatggggttcgtcggcttcttcgtcaagctcatcttcatccccatcaacaacatcatcgtcggctccggctaggttggaggacgggatgacaggatgcggggatagtgtgatgccggcagttgagcctgcggtgtgtcgaagtaggcgcccaaagtttgttctgaagttgttgttaaagacctgttttgtgagaaattgtcaccagcttcatcctcgtaatgagtatagatcttgaaacagcgagccataaagtttatgttttgtcatg

SEQ ID NO: 14880 - DNA, 744 bp, Triticum aestivum
  Clone ID: PAT_TA_14880
agtaccgtccgaattcgccggccgggtgccattccatcctcccctcccgaccgaagccaacgaccgaacgaaccctagactccgagcgcacgaggagagagagagggagatctccaggtcgcggccatggcgatgcgcgcgctgtacaacgagatccgcgcgatgaaggtgcgcgatgtgccggcgtacctcaaaccgcgcctcacctgggagaacgtgaagaagagcaccgaccaggcggtggaccgctacatcgagaagtacatcgagaccagctcggttgacccgctcttccacgtctgcttcggcggcatggccttcgcctacctcgtgggcctgccccaggagcgccgccacctcgagcacctcgagaagcacggcggccactagatccggatccgcctcgcgcaggagagcttatctacggttgatttaggatggttttctccgtttttcttctactgatgggctacctggagttgatgtctatttgatggctggtttattttgtgtcggaaggcagcaatggactgtctagtccactgttatgttcctctgtgtcctgtcataagcaacttcaaactggaagtgcatgcattgtgattaaaaatattttcagcgaattgagtacaagttctttgcagtatactcccattgattttgtgtcaaatggttttgcattcttgtgatgccttttatgttacataaccttgtctttcagctttatccattgggctgtttttc

SEQ ID NO: 14881 - DNA, 792 bp, Triticum aestivum
  Clone ID: PAT_TA_14881
gcatcgccacgcactgcctcctaccgcccccccccccccctccgagcccctcgcccgcacgaacccgcagccctccgacgcccacgaggcagagggaggagggggtcgccgatgtcgcggccccggcggcgcgtggcctggaccaccgagcatcccgcgattgaagcgcgcgcggggtgccggcggaccgcaatccgccccacaccgggccgaacctgaaagaacggcaccgaccaggcggtggaccgctacatccagaagtatctagcagacacagctcgggtgaccctccgcttgccccggtcgccttcgtgtcggcctgggccatctcgtacccctaccgggcttgccccacggaggcgcccgcacctccgagcaccgcagataagcaaggcggccactggatcccggatcccgcctcgcgcaggagagcttatcttaaggttgattcatgattgtgttttactttttttctttcttacttgcttgggctacctttggagttgatggctatttgatggctggctttatttttgtgtctggaaggcagcaactggaactgtcatacgtccactgttatgttcctccgtgtcctgtcataagcaacttcaaactggaagtgcatgcattgtgattaaaaacattttcagcgaatcgagtacaagttcttcgcagtatactcccatcgattttgtgtcgatggttttgcattcttgtgatgccttttatggtacataaccttgtctttcagctttatccaatgggatgtttttccatatcaaaaaaaagctt

SEQ ID NO: 14882 - DNA, 467 bp, Triticum aestivum
  Clone ID: PAT_TA_14882
attcggacgaggggacgctctccgatctcggtggtggcaagggaaccgcggggtccgacgagaactccgaagacgacgatgaatgggcaccaccaccggagtacttcactggcggcgagacgagtggaatggttgttagagatcgatcaaaacgtaaaaacaacacagatgaggtattcaagcaagctaaaaggaagggggctaagcaaggtccgtttgaggctcgccggcgatctagttcgaggaactttactgggactggcagacttctgacaggtgaaactgtagagcgtgatgcaccacagccaccagaagaaattgtccataacatctacttctggaggaatggcttcacagtaaacgatggcccacttagaagtttcgatgatccagcaaatgcgtcctttttgaagagcatcaaggattctgtctgcccaactgagcttgacccggctgatgggaaatct

SEQ ID NO: 14883 - DNA, 732 bp, Triticum aestivum
  Clone ID: PAT_TA_14883
tttatccgacttcattaaaaaaaaccaactttacctgaacattatccactggctctgtaacatgtacaaagagaaagactggtatggattgaggcattgagcagagtttgtttaccttattccagactgcagtagtgtgtgttctgtacatattcagtattgccatttcgttgcaacgatctgccattaccttcatccttctgtttgaattgcaggtggttgtagctagcattaccattgccattaccactatactacccctgtttgaattgcattgcaggttgctgtagagacaattgttgaggtaggagatgcaaaagagatgatatgtgaggcagctgagatgaaaaatgttgatctgctggttcttggaagccacagtcgtgggccaatacaaaggttgtttcttgggagcgtcagtaactactgcgtacaccattcaaagcgtccagttcttgttgtgaagaaccaaggctgaaggttcctgttcctgaacaaatcaactccctggtcgtcctaattatgttcggggtatttatcaacaaatatgtaagaagtattactttagccaaacacattggcaaataaaatagcttgcttctgggagggccgaggatggcaaaggaggggttccttttttttccttgtcagtttgtcttgcttccggactggcatatatacgttatggtctcgcagggttgtaaataagaactagtatgaactttgtgcgtg

SEQ ID NO: 14884 - DNA, 583 bp, Triticum aestivum
  Clone ID: PAT_TA_14884
tcactaatggagggtttcaaggggagaagaaacaagcccaatgatacctgctatgctttttgggttggaggtgtcttgaagatcttgggtgcttatcacttgatcgatcgctgtgctctgcggggatttttgctcacctgccagtcaccttatggaggcttcacaaaattcccagatgatcggataccagacatctaccattcttactatggcctggcagccctttccttgttggaagaggatgggctcgaacccctccacgtcgatcttgggatcctgtccgctgcattatagaaactcgcatttctaccaaatccagttagtctacaatgtttgggggtaatccagtacctcatacaggctatacagctgaaactgaaagccaaggaagttaatttatggatagagtaagttggtctgtgttgtcagtgtgcttgtttggctgggcagatcatgtaacattactttgtgagttttaaagatgtgtgataatttgttgcaaaagaagtgcgatgagcatgctaaccgaactgtcttcttcccagttagttgagctaattgttgacagttgagttagctgaac

SEQ ID NO: 14885 - DNA, 552 bp, Triticum aestivum
  Clone ID: PAT_TA_14885
gaggcgtcccgcggcgggggtctcctctcgcaggccggtagcggctccgggctgacctggttcgcggcctccgcccccgtgctctccgttgcgtcgctcgtgccgctgctaaagggggacagcgccgaggccaggagcggcgccgtcatgagcgccgacgccgagctctggaacggacgcttcgccatgctcggactcgtcgcgctcgccttcactgagtacctcaccggcgccccgttcatcaacgcctagatctagatgcatgccagtgcatgtatatgcagtagtaacttcgtaggaatattttgtactatgctagtagaactgctttccgtgtacgagcatacgtacagatggacgagctagtttttatgtacgttttggatcaaaatatatagctacgaaactatttgttgggaaacaaaatgacaaatcaatttggcatccacaaaattttgccaaaacataaaaaaaaaagcctccaacagtttgcaaccaaacttaggccttgtttagtttgtaaaaattttggttaaaaaaaaaaaaaaaaaa

SEQ ID NO: 14886 - DNA, 650 bp, Triticum aestivum
  Clone ID: PAT_TA_14886
cctccagccaccgccgccacagccgccgcttcgctcttctcacggccacgccgtccatcgaggcgaggtaaggtcagcatggtgagggtcagtgtgctcaatgatgcactcaagtccatgtacaatgctgagaagcgggggaagaggcaagtcatgatcaggccgtcctccaaggttatcatcaagttcttgacggtcatgcagcgtcatggctacattggtgagtttgaatatgtggatgaccaccgttctgggaagattgtggtggaactgaatggaaggctaaacaaatgtggtgttattagccctcgctttgatgttggtgtgaaggagattgaaggatggactgccaggctgctcccatcccgtcagtttggctacattgtgttgacgacttctgctggcatcatggaccatgaggaggcccgtaggaagaatgttggaggcaaggttctaggtttcttctattgaagggagtatggcgaaagcactgatgtttccaacaagaactcatctgagcttttgttttttggtctgaatagagtgctttgttaagattgtggaacgtgttgtgtgcttcagaaattgaaaaccctgttatgagctatccctgcagttaattattatgacctaaaaaaaaaaaaaaaaaa

SEQ ID NO: 14887 - DNA, 718 bp, Triticum aestivum
  unsure (1)..(718): unsure at all n locations
  Clone ID: PAT_TA_14887
tcctctccccagtcctcgcgctctgctccgcggtccgctccgcgaacgccgtctccccccctcccgccccggccccgcccccgccccccaggctggctgcccaaccgccccccgccgagatcgagcagtagctgatggaggagcacgagcgcccgcctgagttggatccggctatggctgcgaaggaggaggctcacgcagaaagtgatgaatgccgcgacagccaagtagccggggtgccgcggacaaatagaggaggcggttgagaggaaagtgcccgaataccgtgcccagatggaggctgagtttcagaaggaggttgccgagagcagcggcgcgtccgctgcacacgtcacgcgtctcgcaggaagaaacggcggcgaagaacgagcaacaaacccagcaggccaccagcatctccccggaggacactcacatgctcctctggcatgttcccaccggcaagaactgtggagagctcttccccaaatatactccgaaatttgtaccttcaatttttttttgtttgtcaagagtgagggtaggacgttatcacgtgcccatcattatccttaattcatatggataacccgcgaattagccgccgcagccttagaggcaaacgtgactagtactgtcagaacctaccattgttatttggtacaattggtaaataatattgttttaaaaaaaaattaataaananaaaaaaaaaaaa

SEQ ID NO: 14888 - DNA, 506 bp, Triticum aestivum
  Clone ID: PAT_TA_14888
attcggacgcggggggcctggacttcaaccctttggtcttcgacaactcttacttcaaggaacttctgagtggtgacaaggagggccttcttcagctcccaagtgacaaagccctgctgagcgaccctgccttccgccctcttgtggataaatatgctgcggatgagaaggcattctttgaagactacaaagaagcccacctcaagctctccgaactggggttcgctgatgcttaaatggcccctatcctggagtgatccaaactgctgcctgtatggaatcatgtgcatctggagttagagtgaaccagcagattgtctcgtgtcttctatgtaataaatttgtcgctgttgagccctcaggctgttcttggaactttggctatggttgaacgggggggaccctttgcctatactctgatgctgtatgcaactgaaactagtagatctatgatcttatggctgcagtatgttcttgttactttgctaaaaaaaaaaaaaaaaaaa

SEQ ID NO: 14889 - DNA, 744 bp, Triticum aestivum
  Clone ID: PAT_TA_14889
tcggcacgagggtttgttagggtttcgtccgtgcggagctccgaaatccctccgccgctctcgcgttcgaggctaggtagccgccgccatgagccgctcgggacagcctccggatctcaagaagtacatggacaagaagcttcagattaagctgaatgcaaaccgtgttgttattggcacacttcggggattcgaccagttcatgaatctggtggtggacaacactgtggaggtcaatggaaatgacaagacagatattggaatggtggttatcaggggaaacagtgttgtcatgatcgaggcactggagccagttgccaagtcccagcagtgaatcattgttcttccgctgatatagcactagcagcgtgaaaactgatgtaaatgatatcagtgaaccctgttgtactttgactaatgcttttgcacagcaacataacttcggagcaatgtctatccctttttctatgtggtgcttgtggctatgtaatcatctgcccttattgctcgatctaactcaagcccgtctgctcatctacatggtttttctgaagtacaccacatatcaccttcacaacaggcctggctaccagtggtggcacctggctcaacggtgactacatttacagccttctcggcgctcatactggcaatgagtaatttcttctagtgttttacattgcccgttgccttgtgaggcacatgtattttgtgatccatcatccatagtggtgcatctggtct

SEQ ID NO: 14890 - DNA, 684 bp, Triticum aestivum
  Clone ID: PAT_TA_14890
ttgtaatgcatgtaggatgtgaagtatacaaccgggggtcaggtgcggggacttccggcctcgtgccggtggcggcacgcgggaaggtttctgggaagaaaatcccactggtgtttgctgggcgaagacctggagacgcagagatcgtctatgccgcaactgccaaggcagagaaagatctcaaatggaaggcaaaatacgggatcgaggagatgtgcagagatctgtggaattgggcaagcaagaacgattcggacgaggctggatcacaagacaacggcaaatgaatcaccgatccatgcatcctgcagtagtagcgagcagcaaactgagcagcagcagcctataccaccataattaataactcatcatatgtaatagtcactcagtcagtcagtcatctaattaggggatggtgcgatgggcctcgtttcttcattgtatagagggaggagtaggggggtccatttcatccattatcttgttattctttttttatcattcctgtaagattattagaccagcctggtattgcttcaaaaaaaaaaaaaaaaaaaggaataaactccttgcataccaaattattatagatatattatatacatgcatacactgattgtatctttatattatgttgatacttgactcgaatcagttgatgagacgaaaaaaaaaaaaaaaaaa

SEQ ID NO: 14891 - DNA, 618 bp, Triticum aestivum
  Clone ID: PAT_TA_14891
gcgccgtgccagccatactgacagcaataaaagaggttcagaatggtactgctagatcaagcaggcacgcggtgccatacatggagggtctcgtcggcacgctagtgcggctcactgcgactctgtacagcccagaagtgttgaaggcggccatggaccacaatctggcctcggtgctcactgacctgctcgatggagcagccgggagcgacgaggtgcaacgtcttgctgcagtggggctcgagaacctcagctacctctccatcaaactttcccagccaccgcccgatgagctgcagtcgaagaagaacaccatactgaagctcctgaaggactcaaaggcgcacaacaacaacaagaagagctcacaccaccagctcaacgtttgcccggtgcaccgtggaatgtgttccccagcaacgacattctgcctcctcgaggccggcgccgtggagggactcctgggctgcctggagaatgacaacattcgagtggtggaggctgcgctcggagcactgtccactctcctcgacgagagggtggacgtcgtgaagagcgtagtggcccttgccgagctcgatgctgctcggtgcgtgcttgctgcgctgaggcagcacc

SEQ ID NO: 14892 - DNA, 455 bp, Triticum aestivum
  Clone ID: PAT_TA_14892
cgccggcgctcaggcccgccaccgcatcttccacgaggagctcgtagtcaaagccttcttcgaggccgagaaggcccaccatggccagacgagggcgagcggcgatccattcctgcaacattgcgtggagacggccgtgctgctggccaagatcggagcgagcgccacggtcgtctccgccgggcttctgcacgacaccatcgacgattcattcgtggattatgatcacatcttccacatgttcggtgccggcgtggctgatctcgtggaaggggtttcgaagctgagccacctgagcaagcttggtcgtgataacaacacggcaagcagaactgctgaggcagatcgtttgcatacattcctctgcgctatgtcagatgcacgggctgctaataaagttagcgcatctcgtgtgcataacatggacaccagaagccttgcctttggtcaaacaa

SEQ ID NO: 14893 - DNA, 2232 bp, Triticum aestivum
  Clone ID: PAT_TA_14893
tttttttttggctttccatcacaggatcttttcatcgcaataatacaaacagctcaagttgctcctctccacagatcctggcaagcagaagccgaatcgaacttgaacgactcttgtcatagtatacatggttctgctctgctagtgtacacattttgcagccaaggctggtggactctccccttgcatccgggggtgatcctacagcgcctcatcatggccgccaagaattagactatgtagtctgtatgtatttacaacgaattgaatgggttggactcgaacatcatcgtacaacaggttgtttgttaacactgcggtaagcgccgcggggtcatcggcgtcttgagccaccgctgccgctgcgggtggcggcaagggcgaaaccaccgcggtcatacatgcgctggatctcctcccggtactcggtcagcgacttgtcggggagggccggggtcagctccaccacgtcccccatgctcagcgcccttcccaggtcgcttatgggctcgtggttcaccttcggccgcaggtcctccttcatcggtatgctgtaggggctccacctcgggctgttggctccaacgcggtgcatcaggtccattacggtcgagcctgctgggaattcttggacagacatcttatcatgttcgagtaagatgacgaacaagggtccgtcgtggttgcattggcgggtgtacgagtaagggcattcctccgaatgcaggggaaacgggcaaggaggtttgatggaatcgcttttcacttgggacgatgaatgttccttgttcaatgcttcgcattgccacgtaagcacccatctcgcccattccaccatctgaagcacgaaggagtgcctgcacgagccttccttgtacctccagtgcgcagcgaacccatactcggcctgtagatgcatctcctttgtgcggatctggacttcgaatgtgtgatcaccgtcgctcatgacaacagtgtgcaatgaacggtacccatttaatttcggccgcgatatgtagtccttaaatcttccggtgacttggggccagagtttatggacaacatcgagtgctcggtagcaatcttcctccttgtcaaccacgaggcgcaggccatggatatcatggacttcatccattgtcaaattcttcttctgcatcttggagtaaacactgtaaaggtttttgttccttccagaaagattgtgatatgagatgcctgcttccctaagaccttcatccagtgtatccacagcagatgcgattagcgcctcgtcacactgtccagccgattgtgccttccgcgccgggtgcgctacggggtgcatgtttccgtaacacacttgttcccgcacgtccacccggcgcgcgcgcccaaatccgcgggcccattcgacgacgcgctcctcgctccccctggccactccctgtggcggcgccggacgcaagcccccgccgcccctcatgcgcctgctgctaggcccgggaccccggtcagcgtcttctccgggatgcgccaggggtctccgccaccgcgtcccccccgcgctgcccccgccccgggccgcgtcggggcgacgtgggtcagcgtctcctcccggtcccgccccccgtgacctcccccccgcccccctcgcgcacggtcctccccgtcccccttgcgtcgcccgtctcccatcctgggcctgcgggcccggctccctggtaggctgtagggactccaccctgggcagcgggccggcgccgccgcgcagcctgggagtccgtgctccggcgccaggtccccttcaagggagaccccgtgcagggcgtgctggacgtcgtacttgaggctggtttgtaaaccgtctgcataccgtgcgtaccgtcggaccactcgctttcttgagaccccgacgcctccgccgcgggccgcgggggcgtcggcgcctccggccgccgccgtcgctgccgctggctgtccccccgctccgtgggcccgcgtgcggtcgggcatgcgccgggggccccccccgccacgtcccccagcctctgcgcccggcccgggccgcggtcggcccccccgcgtccccctcgcccgccgcccctccctcgtcgctgtgcggctgcggcgcccccctgcgcccgcggctcctcccgcggggcttcgcggccggggctcccccgcccgctgggggctcctcacgcggtgcatcaggtccattacagtcgagcccgctgggaactcttgacg

SEQ ID NO: 14894 - DNA, 641 bp, Triticum aestivum
  Clone ID: PAT_TA_14894
cggcacgaggatttgtttgggatgttgcagggaacccgttctgctctttatgcaaatgaccgggagtctatctctgttaccgtgcaagaggtaactcctagagctgttggagcactggttgcactttatgaacgtgctgtggggatttatgcttctttggttaatatcaatgcctatcatcagcctggtgttgaggctgggaaaaaggcagcaggagaagtattggctcttcagaaaagggggctgactgtattaaacgaggccacctgcgagaaccctggtgagccattgagtatagatgaaattgcagatcgctgccattgccctgaagagtattgagatgatctacaaaataatccagcacatggctgctaacgacagagcacttatagcagaaggcagctgcggctcacctcgcggcgttaaggtgtacctcggtgagtgcgatgtagacgaagatatgcaggccgcatagattcctggtctggaactgtgtaaaattggtggaataaatcaggagcagcacgataacgatgctatgcatgggtgttgctgatgtgccattagtttcttgttttggtgttgtttgcacacgattgccgcaacgatgtattttagaatttgttttttttgggtccctt

SEQ ID NO: 14895 - DNA, 429 bp, Triticum aestivum
  Clone ID: PAT_TA_14895
aactgcaatcatctgtgggtccttccactgcactttctgcaccttcagattcaaacaaaagaggaaaccagcaaatctcagcaccggcagcttcgggagctagcaattacagtcgacagaaaactggaaagcttgtttttggttcaagtgcaagcaacaataaggaaccacaaaaggctcctgttaaagaggaggaacccgcgaaaaaggacgagcccaggttccaagccttcagcgggaagagctactcattgaaacgttagctgctacaatagccttacaaatttgttgctacccttttgtttcgtgcatggtgttcttgcacctggccaccatgtagatatgactataaattgaattatgtatgatggaaatatggccatctgtccatttaagctcaaaaaattaaaacagtgctattatcctact

SEQ ID NO: 14896 - DNA, 835 bp, Triticum aestivum
  Clone ID: PAT_TA_14896
gcaggactgggtcactcggcacgcaggctagcagcacagcagcagccagagccatcccctcccctcgccactcctcgcttcgcttccgccgcttcctcctcctccccctcccctctcgtccgtccccttccggcgcgcgagctcgcccgagatggcgaacgcgagatcgggtgtcgctgtgaacgatgagtgcatgctgaagtttggcggagcgccggcgaggagggggcgcccccccttaccaccttcgatgatggacgacaagttcaaggagatcgttgtggaccagggcgggggtggcgccaccagcaacgacgacgacatcaacagcccccatgcagaaaagacctgcgctatgcgtgatattatttttgcgtccttagtgcagctgcagagcaagatgtaaaacaatgccccatggtcccaagatcctctggagccgatgagccgcatgatttacatgagctctacgcaatagtccaagagtgaactgaatggccttcagggggatcaataggatccaaatgcaactgaaagcagctgtaagcaggtcaaggatcggtcacgctaggcgcagtgcaccgccatcacgggtttcatgatcatgcatcatggtctcgcctactactgtgaatttgtacgccattatagacttggtgctgtgaaagactgcttgatgatttgcaggtttgttgctgtgtaaaaaaggtcctcggcttcccgaagaccctggcggcttggatccttcttccagctccttgttggcccccgattttgtgccggccatggacatgtgctgcgctgtccggcgggccacacctttcccatcggtatg

SEQ ID NO: 14897 - DNA, 556 bp, Triticum aestivum
  Clone ID: PAT_TA_14897
ggcacgaggaaagcataagcaacacaagggattaactcatcactcacttagctaattaaatcttcgaccatgtcggacaagtgcggcaactgcgactgtgctgacaagagccagtgcgtgaagaaaggtaccagctatggcgtcgtcatagttgaagccgagaagagccacttcgaggaggtcgccgccggcgaggagaacggcggctgcaagtgcggcaccagctgctcctgcaccgactgcaagtgcggcaagtgaagtcacgaagcaaccgaacactcgccgccggcgagtcacctaccttaattagtccacaataaaaaccacccatatgagtgtggtttgtgtgtgtgctgattattgctgaattaaacccgtgtgttatcgattaattaagcagctggtcgcttcggcgactatgcgtgtatcaacgtatgaatttgtgtgatgtgacgtacccgtgctattctcagtgaaattaatcaatcgtgtattcgtgtggtttgcctagtaaaaaggtctatcatactcaatcgaacttcaacaatttcttggt

SEQ ID NO: 14898 - DNA, 710 bp, Triticum aestivum
  Clone ID: PAT_TA_14898
ttcttgtgaagcaagacaagggaaaatctccagattatcgatgctaggaactccgacctaattgaagtcaacaaaactgagttcatgactccctcagcattcatctttctctacgaaaacaatctattcctgacattctgcaataggacagttgcagcctggaattttcgtggagagctagttacatcgtttgaggaccatgagttgtggcatcctaactgcaatacaaataacatatacatcactgctgaccaggacttgattatctcatattgcaaaatttcaaagcagagcacagattgtgctgacagtgaagctggagaagtttcatccatgggatcaattaacatgagcaacatctttactggaaagtgcgtagccaagatctcccctagtgaccctactctcacaattgctcctcgaaagagaggcggcaacagcagatctaccatccacagcactgtcccggaagctcttgaggacatcactgctctcttctacgatgaggaccgcaatgaaatctacactggaaacagcaaaggcttggtgcatgtctggtcaaactaaccttgacatccaccccctaccttgtacataccccttgcacctgtactcgtttttccttatagaacaaagatgaaattcctgtctgattatagcgggagtgtaacttcccagacatatatcattggtagaagaatctgatgtag

SEQ ID NO: 14899 - DNA, 704 bp, Triticum aestivum
  Clone ID: PAT_TA_14899
attcggacgaggcctgcctgcgctcgacccctgcggccctccccgtccttgacccgacccgccccggcgcgagcgcgagcgcggccgcgatgcgcgaggaggtacggagctcgtcggcggcgccccccgacccgccgcccgggaggtcggcctcgccgccgcccacacccgtcgccagttctgctggtgcctcgtcgccccctgcacaaactaatgtagctagcatagattggcttggcagtgaccaagtgcccaaagcgggatcctctcatattgctccgccgacatctcagcctgcgcttagtactaacgctaatggagctgctgtggattgctttcagtcatcatgcagaccgtgggaacgaggtgacttgcttcgtcggctggctacatttaagccttctacttgggcttctaagccaaaggctgctagttcactggcttgtgctcgaagaggctgggtgaacattgacatggacaagattgaatgtgaatcttgtggtgcacatcttatatttactgctttgacatcctggtccccagctgaagttgcaagtgctgggggagcttttgctgagcagcttgatgcatcacacccgaatgattgtccctggagaggaaatagctgtgctgatagcttggtccagttccacctaaccccatcagctcttgttggtggctttaaagatcgctgtgatggattg

SEQ ID NO: 14900 - DNA, 503 bp, Triticum aestivum
  Clone ID: PAT_TA_14900
ggcggtggcgcgggcgccgtcgtcgtgctcagggtccgcggctgcggccggttcggcgcgtactgctcgcggaggcccgcgaggtgcaggctggacgcggcggaggtggacttcagctacgacgacgacacggggctcgtcgcgctccatatccccgtgccggagcaggagttctacagatgggacctggagatcgatgtctagaggttctccctgcctgtcgatctgtggcaatggtgctttccgcctattcattcttgagtggttttaccattaaacgcgtgtgtggtcggtgtgtgtgtgtgtgctcgtgtgcgacatggagaggcgtgtgcaatgcatgatctgatcatgaaatggacacggtccgccattgacgcgcctctcttcgtccctagaagaataagctagcctctgctgtactgtctttgctgcatcaatatctgcatgcaataaacgactactccatctccacgtatgcaaaaaaaaaaaaaaaaaaaaaa

SEQ ID NO: 14901 - DNA, 438 bp, Triticum aestivum
  Clone ID: PAT_TA_14901
aatggggaaaaggagaaagaaactgaagttgcagagaagagatggaaaatacttgtctggaagactgctgtttatcttatcactcttggtatgctcattgcacttctaatgggactgaacatgtcctggactgcaatcactgcggctcttgttcttctggcacttgattttacggatgcacaggcttgtcttgagaaggtgtcatactcactgctgatctttttctgcgggatgtttatcactgttgatggattcaataaaacgggcataccaaacacactatgggagttagtggaaccatattcacgaatcgatagtgctagaggtgttgctcttcttgctgtggtgattctcatcctttcaaatgtggcctctaatgttcctacagtcctgttgctcggtacaagagttgctgcatcagctgctgcgatttctcat

SEQ ID NO: 14902 - DNA, 640 bp, Triticum aestivum
  Clone ID: PAT_TA_14902
aacccaaaatcttctcttcccgtacgtgagaagcgccaggtcgtcgtcgccgccatgggcgtggaggtgtgcgtcaaggccgccgtcggccacccggacacgctcggcgactgtccattctcgcagagggtgctgctgactctggaggagaagaaggtgccctacgagatgaagctcatcgacgtccagaacaagcccgactggtttctgaagatcagcccagaggggaaggtgcctgtgtttaacggtggtgatggcaaatggattcctgattctgatgtgatcactcaagtcattgaggagaagtacccaaccccgtctcttgtcacccctcctgagtatgcatcagtgggatcaaaaattttctcatgcttcataacggtcttgaagagcaaggatccaaatgatggttcacagaaggcacttcttactgaactgcaggcactcgaggagcatctgaaagctcatggcccctttatcaacgggcagaacatttcagctgctgaccttagcctggcaccaaagctctaccatctccaggttgctctggagcatttcaaaggctggaagatcccggaagacctaaccaatgttcatgcttacacagaggctctgtttagccgcgaatctttcatcaaga

SEQ ID NO: 14903 - DNA, 1129 bp, Triticum aestivum
  Clone ID: PAT_TA_14903
ggcacgtccgtgagcttagctaaatctgttctcgaggaaggtggggggccaaactttatgtgttcaagggaggatactcagaagagtattggtgttgctgttgttcttagtagcgcagagctcccatcgtctgacttatctgaagttgtcgggggccaaatgcacgttcctgtatgagtccaacccgtctgctttgttgcagagcccttccggcctgccgctgggtaggcatctcgcggagaagaggactaacggcacgaaagcttgtccaagggcgaaaaatgcgatggcgagtgcttcgtcaagtcgagtactcctcgaagggactttcgttgggatagtgcttctcatcatcctgatatcaggactcatgtgcatgatgggcatcgatactccctcgaggtttgaagctccccaggtgtcttgatctctcccttggactgcagaatccgcgggggggttgtgacgagggcacgcggcggcgttgaggggggccggtgttctgttggtgtgcactgtggatatatattgtttagcttcccatttggaagggagtacgccttgtgtatttttttttaccgagccaactgtcactcacgatgtgctagaattttttggtgtaatatttgcgtttcgcgcctatggacaactaataagctgaggcattgcagcagataaattcatgtgctgcgtgaggcaggcttgtgttgggttcctgccgctcagcatcctgatatcaggactcatgtgtatgatgggaatcgatactccctcgaggtttgaagctccccaggaatcttgatctccctttgaagcagaatctggggatttgacgaggcacagagtggagggactgatgtttgtcggtctacactgtggatattgtttagtttcccctttgaaagtgccttgtgtattttactgagccaactgttatttacaatgcgctcaaattttgtgtaatattacgtttcatgtctatggacatctagctgagccattgcaaacaaccatatgtgactgtgaggcttgtgctgtactagacatagcattgcctgcagtgttttctgtgaataacctgaaattcaggtaaaaaaaaaaaaaaaaaaaaaaaaaaaaaaaaaaaaaa

SEQ ID NO: 14904 - DNA, 705 bp, Triticum aestivum
  Clone ID: PAT_TA_14904
gaggcgtcgttcgaggaggggaggcggcaagtggaggtctcttatgacccacaagcaaggtttaaccagatagcggaccaaattgacaaggatgctggaatgacacggcttaacctattttcaccttgcaaaattaatgtgttcttgaggataacgggtaagagaccagatgggttccacgacctggcttctctatttcatgtgataagtttgggtgatacgatcaaattttcattgtcaccaagtaaaagcagagatcgcctgtcaaccaatgttccaggtgtcccagttgatgaaagcaatttgatcatcaaggcactcaacctttaccgacagaaaacagggactaataactttttttggatacatcttgataagaaggtcccaactggtgctggtctcggtggtggaagcagcaatgctgcaactgcactttgggctgctaaccagtttgctggctgtatagcttcagagaaggatcttcaagagtggtctggtgagattggatcagatatcccctttttcttttcacaaggagcagcatattgtactggtagaggagagattgtccaagatatcccaaatcccttgccggaaaatttaccaatggttcttataaagccgcctgaagcatgctcaactgctgaagtttacaagcgattcaaattggaacaaacaagtcaagctgatcccttgaccttgctc

SEQ ID NO: 14905 - DNA, 688 bp, Triticum aestivum
  Clone ID: PAT_TA_14905
gaggcagaaagctaagacagttcttgatgagaggactgttacagatgagcctgactccatgtctccgtatgaacctgattctgtaatagaaccagaaaatatttctttggaagaccttgatgacattttagatgacgatgaagaatctgatacagatgaaccagacgatgagtatccagaaccttctttggaaatcactgatgttacagatacagatgaattgcacgagaacaactccacggaaagttcagatctaacctctctgaaggttgcagagctgagagagcttgcaaagtcccgaggaatcaaaggctattcaaagatgaagaaaaacgagctgattgaagtggtgagcagcagcatggcttgatgataagcgggtgatattgtcaacctttcagtcccactttgctgattgaagtggtgagcagcagcatggctattccatttgaacccactttgcttggcctgatccgctgcctttcagtcccgtagaaaattgtaaatgagcgaggctaacattgttctggtctgtgctgatcttttgctggttctcattttgtacgcctagtttgctagacatttagctgaattgtgtgccgagtggagtaaggtagctgagagcctgagatgctgtttgtgtactaaatgaatgcaccacatctgttctaggtgttgttaaaaaaaa

SEQ ID NO: 14906 - DNA, 522 bp, Triticum aestivum
  Clone ID: PAT_TA_14906
tcgtagtaattaaattgcagctagttgtttgcaccatggcgcagtactactcggaggtggaccactgcgcggaggagatgaactggccgccgcacgccggcggcgagcactacgccgtcaggagggagtcgtacgaggaggtggacgagatggcgcgcgcaggcagggggcaccaccacggcggcggcggcggcggccacctgggctacagcggcagccgccacggtgatgcccatctgggcggccaccgggaggagcacctcgtccacggtgacgagcaccgccacggccacggcggcgggcgccagtacgactcctgcaccggccagtactacggctgagcacgtacgaggctgcagtttctgtatgactactatgtgtgagtgtgcgtgtgcacggtcgtgtacatggtgtgtgtgtgcgcgctgacgcacgtacgagcgtgtgtctacgcgcacatgcagcatcttatctatgtgctgtacgtacgagaataattgagaccgtggtacatgaataaat

SEQ ID NO: 14907 - DNA, 713 bp, Triticum aestivum
  Clone ID: PAT_TA_14907
gattcggacgaggaatcctcgtcctcgtccaggcgacaggcaaggccgcggcacccagcaccgcgtcggcggacggcccagcacggcagcatctccgcgcgccatggcctcatcccggaaccccgatgcactggcggcgccggcgctgactccggcgcccgcggcggtggcgcaggcccaaaaccctagcattgcccccggcgacccgccgtcgccggagatggagaccacggcggaggctctcacgcgggaggaggtcctccggcggcgccggcgccgcgcggcccggctagccggtgtataccgccggctctactgggccatggccgaggaggtgcgcgcgcggcaccggcagtacgtctgggacctcgcccggagcccactggaggcagagcagccgccagcccctcccggggtgcccatcccggcggctggggagccgccgaggccggcgccggtgccgaggaggaagaagtgcggattcacagggtgcaaggtgcgggccatggccacgacccgcttctgccactcccacgtcctctccgatcccaaacagctgctgtacaagccctgcgcgtacatcactaagagtgggctacaaggtgggcttgtcacctgtggtaggccaatcataaagtctgcagctccctccctctgtaatattcacttgcaaagatgtcagaaaagcattgcacaagcttataggaaggttg

SEQ ID NO: 14908 - DNA, 698 bp, Triticum aestivum
  Clone ID: PAT_TA_14908
gattcggacgaggcctcgtgccgcaagattggagattctagccaaaagggcagcacagggtctcagcagatcgtcattgagggcccactctgcgaggactattacaagatcagggagcttctgtactcgcagttctacttgctgtgagacaactgcatctctcgtggtacatttaacccagtcgtgttgtgcaagtgatgagtgcataggcaagagagggacccgggagctgttttggtggtaggaattaggatgtattggaaccggctgcactcgagaatgtactgggcagtgggcataccaagattacatttggataatgtcagaaaacctttaatcttgctgcataagtactaacctggtgtttgacatcttttgtttcccctttcacatgcttagacttgtgttggccgaaattagtacaagaatggtatatgctgtctgtggaagtgctgaactgggaagatgcactactgatgttacctgttctttggcacgggacagacgagaggactgctactcaagctgcctaaccaacttagctagaggcagtgtgtcttgcaatgtctggaagatgaaagtgacgcttggttgtctgttcagtgtcatttagggggtgtttagttcctcataaaatgtaaaatgcaaaatgccaattactttgaaatgatggaatgcaaaatggtaattttttagtg

SEQ ID NO: 14909 - DNA, 288 bp, Triticum aestivum
  Clone ID: PAT_TA_14909
gattcggcacgaggggcgggcgcgctcggcaggcagttcgtgggtggcctgacggaggagaaggcccggcagctgcgtgcgcggatggcgcagaccgagtccttccacgacgccatgtaccactccgccatcgcctcccgcctcgcccgctccgcctagaccggaagcccggccgcccggccgggaagcaagtcgccgacgtcgccgtagatctagagctccacccattgtcgtcgtgtgttgtatatacctaccagtcgtttcctttccgtttcgggggtcggggac

SEQ ID NO: 14910 - DNA, 397 bp, Triticum aestivum
  Clone ID: PAT_TA_14910
cggcacgaggcgaccgggtgcttggcccgatccagcagcatccctgagaaatctgctggtggtgtattgctaccgaaatctgctgttaagtttgagagatatctggtgggcgagattctatcggtcggtgctgatgtgagtgaagttgaggctgggaagaaggttctcttctcagacatcaatgcttatgagggggaccttggtaccgatgagaagcactgcttctgccgcgagtcagatctatcagctttggttgaatggaatttcataccatgaaaattacggacttacctatgctccaactgcatggacttatgttgttcctactttgttgtatgccatttgatatttgaatgttcgtgaattcagcttagcttctagaaaaaaaaaaaaaaaa

SEQ ID NO: 14911 - DNA, 494 bp, Triticum aestivum
  Clone ID: PAT_TA_14911
attcggacgaggatggacccaaggtaattgttagtgaatatgctgtgactggaagtgatgctggccgaggaacactaatagctgctttagctgaagctgcatttctcattggattagaaaggaacagcgacatggttgagatggcaagttgtgccccactctttgtaaatgacaatgatcaaaggtggaacccagatgctattgtctttaattcatggcagcactatggatgtccaaattactggatgctacacttcttcaaagattcaagtggcgctgcacttcatccgtccactattcaactaccaaactatgatcaattggtcacatctgctatcacgtggaataatccacatgatgggaacacttacctgaaaataaaggttgtaaattttggaagcaaagctgttaatctgaatatatctgtaactgggttggaagctgatattcagacatttggatccttaaagacggttctcacgtcaggttggcta

SEQ ID NO: 14912 - DNA, 1536 bp, Triticum aestivum
  Clone ID: PAT_TA_14912
agattccctcttctctctctctctctctcttcttcttgctctagcactcttcgctgctctgttccttccggctaacaccggctacgcccaccccacggtggatggagggcgtcgaggagatcgtcatcgccggcgccgggctcgccggcctcgcgacggccctgggattgcacaggaaaggggtgaggagcgtggtgctggagtcgtcggcgacgctgcgggcgtcggggtacgccttcaccacatggaccaacgccttccgcgcgctggatgccctgggcgtcggggacaagatcagggagcaccatctgctttacgagaggctggtggccttctctgcatccacaggcgaggctgccgcaaaactgagcctaaagatgcagggcaaaagcgggcctcacgagattcggtgcgtgaagcgcaacttcctgctggagacgctggagaatgagctgccggagggcaccatcaggtactcctccaagatcgtcgccatcgaggaagagggcaacgtcaagctcctgcacatggccgacggctccaccatcagagccaacgttcttgtggggtgcgacggagtgaactcggtggtggcgaggtggctgggcctgcccaagccgatcctctcggggcggtccgccaccaggggcctcgccgagtacccggacggccacggcttcggccccgagatgctgcagttcatcgggcagggcttccgctccggcgtgctcccctgctccgacacctccgtgtactggaactacacctggtacccgtccccggcggacggggacgcggaggagagcgtggacaagatgcggcagcacgtgctggccaggcttcgggccgccaagatcccggcggaggcgctggacgtgatcgagcggagcgagatgagcgacgtggtgtcgtcgccgctgcggttccggtccccgctggcgctggtccggggcagcatctgccggggcggcgtgtgcgtggccggcgacgcgttccacccgatgaccccggagctcgggcagggcggctgcgcggcgctcgaggacggcgtcgtcctcgcccggtgcctcggcgaggccttgggcgccggcgggcacgggagcgccgaggcggccttggccaagtacgccggggagcggaggtggcgcgccgtccggctggtcacggccgcgtatttcgtcggcttcgtgcagcagagcagcaacccggcgatcaagttcctcagagagaaattcctgtcaggattgctggccagagtgatggtcgacatggccgactacgactgcgggaagctgtagctctatcattccttcttgacggcaaaacgagaacgacgagagaaaacgaatcagttaaaacggcatcaatcaaatcgatttgatgcctgtatttcgacttttcgagttaaataaagaaaacagtttgatacctgataggattattagtctacaatatgtagatgataccctctatttcatggaaaacagtcagaaaatggcaataaaatggaggaagcacctatagcttaggtgcctg

SEQ ID NO: 14913 - DNA, 956 bp, Triticum aestivum
  unsure (1)..(956): unsure at all n locations
  Clone ID: PAT_TA_14913
gccggccgggcttcgaaaaaaaaaaaaaaaatcagaatcggatccctctcttcttcttgctctagcactcttcactaagtctccacggtagatggagggcgtcgtcgaggagatcgtcatcgccggcgccgggctcgccggcctcgccacggccctggggttgcacaggaaaggggtgaggtgcgtggtgctggagtcgtcggcgacgctgcgggcgtcggggtacgccttcaccacatggaccaacgccttccgcgcgctggacgccctcggcgtcggggacaagatcagggagcaccatctcctctacgaaaggctggtggctttctctgcatccacaggcgaggctgctgcaaaagtgagcctaaagatgcagggtaaaagcgggcctcacgagatccggtgcgtgaagcgcaacttcctgctggagacgctggagaacgagctgccggagggcaccatcaggtactcctccaagatcgtcgccatcgaggaagaggccaacgtcaagctcctgcaaatggccgacggctcaatcatcagagccaacgttcttgtggggtgtgacggagtgaactcggtggtggcgaagtggctgggcctgcccaagcccatcgtctcggggcggtccgctcccaggggcctcgcggtacccggcctgcccatgcggcccaagaccgtggagcgaaaacgagtcagttaaatcggcatcaatcaaaccgattggatgcctgtatttcgacttttcgagtctccgggagaagttcctgtcgggattgctggcaagagtgatggtcgacatggccgactacgactgcgggaagctctagttctgtcattccttcacgacggcagaacaagaacgacgagagaaaacgaatcagttaaaacggcatcaatcaaatcgattggatgccctgtattcgactttttcgagtaataaagnanataatttg

SEQ ID NO: 14914 - DNA, 636 bp, Triticum aestivum
  Clone ID: PAT_TA_14914
gattcggacgagggttcgtacaatgcttttgttgatggaataactacaccctggtgccagaaagaggctgtgtctaatgctgaatgatgtgtaaccaaggatgatgtaagaaaggagactaactttgagcttgatagatcatcataatgttcatcagttcttactgctcatttgttgcggttgcgggtcataatcttttggtggtaatgccattcatgccagaaggttcacgtttgcacctaatgatggttgcatatctgatggttttgaagatccagttattgcgtctattctaaatgaaacactcaaagctctagactacccccatagccaagtgcatattcatcgtgatgtgaaggtaatatccttattgtaatcccagtgtagtcaagcttggggacttcggtgtctctgcttgcatttttgataggggtgataggcaaagggctaggagtacatttgttggaacaccgtgctggatggctccagaagttctccagcctggaactggatatgatttcaaagctgatttatggtcatttgtaataaccgcactcaagctggcacatggacatgctcccttttcaatgtacccggctatgaagggtcttctcatgacgctccaaaatgctcctc

SEQ ID NO: 14915 - DNA, 543 bp, Triticum aestivum
  Clone ID: PAT_TA_14915
ttcggcacgaggattgtccccgccgctgccatggccaccgacggcgccgcctctgatgctgggtccaagaagaagctgctcatcttcgactccgaggaggatctcgcggtttctctggcgaagtacactgcggagctgtcggagaagttcgcggccgagaggggcgccttcaccgccgtgctctctggcggatccctcatccaggcgctcaggaagctgacggagccgccgtacctggattcggttgactggagcaagtggcacgtcttctgggtggatgagagggtcgtgcgcaaggaccatgtggatagcaactacaagctcgcctttgatgggtttctctccaaggtgccgattcctcctggacaagtttatgctataaatgatgccttgtcagctgagggagcagcagatgactatgaagcgtgcttgaagcagcttgttaagaatggtgtgatttccatgtcagcagcgactggatttccccaggttgatctccagctttctgggaatgggacctgatggccacattgcatctctctt

SEQ ID NO: 14916 - DNA, 1426 bp, Triticum aestivum
  unsure (1)..(1426): unsure at all n locations
  Clone ID: PAT_TA_14916
gagctgaaactgctggtcttttacttcgagaattggaactgcaacctccttctgaaaaatggcatagacgcaacatgtttggaggaccctggtcagaaccagatgatctcggtcgcattggataatatgccacatctgaaaataggtggtcatatcaaccctcacttgtctgacatggaagaggagggtaaaactaactttgggattcaaagtctttggccaagaaagcgccggttgtctgaaagagatgcaggaatcggtgccagggctacacgtcggatgaggtgaaggttctatttctcatattggttgacctttgtcgaaggacatcaggctggcaacacccggtccctgcttccctggctggtactaccaacataattataaggctgcacttcattgacggcacttacactgtgctccctgaggtagtgaaagcatctgttggtccccatattgcagaatatgccgcgtccaccggggagcttatcttggcgtgatggggtctcggcgagatgtcatcacagccgtgtggaaaacaggacttgatggtgaatggtataagtgcattcgatgtttgcggcaaacttgtgcatttgcacagcctggtgccccaaacatggcaaatgaacgggaggcgtggtggatcagccggtggacccaagcatgtccaatgtgtggtgggtcatgggtgaaagttgtgtgatcgccgtcttccgtgattacttcaccatgctgattcttctatatagtagttgccgcttggccaaatctgaacgagcattgttggatcctatgttggataattttgtacccaacaattagatcattggtctcatgccccagcgctgtggtttacctccagagaccaaaagcttaaagcagatacagagacttggctctaacggctatgtaaaagtatagtaatattaggggagatggcaatgtttgtattgtgcgtttcttatgtgtataaatgtatcccaatgttcgaaggaagctgttagatacacatattgctagtgctggatgtagctaaattgctaggggagtttgactgtttcgataaaaaaaactgtgcaatcttatgtaaatttttgtgaatgttatgttctgttagcgctgtcggttgcccccctgggctctaccccttaaagcagatcctcggccgcggccccgccgcctatgtaaaagtgtagtaatattaggggggatggcaatgtttgtattgtgcgtttcttatgtctataaatgtatcacaatgttcaaaggaagatgttagatacacaatgctagtgctggatgtagctaaattgctaggggagttcgactgtttcgataaaaatctgcaatcttatgtaaatttatgtgaatgttacgttctgttagnatgagacggaagctgcagttgtcactaaaaaaaaaa

SEQ ID NO: 14917 - DNA, 785 bp, Triticum aestivum
  Clone ID: PAT_TA_14917
ggccggcgcgcaggcccgcccgagggttgcaagcgagcaaaaacgaaccccacttcgacggccgactaccgctgaccgccgccttgatctgcttccggcgccactacgccggccatgggctgctcgtcttctctgccagggcttctctcacaagaagaattaatatacccccaaacagaataagtcagggtctgaagggtaaaattatctacaagaggaatatctacatgttcatgatggaggggcactgagtcagctaccttccgagtacagccgtctcttgggagttcggatcatttgatgtttgtcaagcaaacagtactggaggcttgggcacgtccgcggacgcgtgggctgcaactgactcaaagaatttgaaagtgaagttggttttactgggggattctggtgttgggaaaagctgcattgttcttcgctttgtccgtggtcggtttgatcccacatcaaaggtaactattggtgcatcatttctgtcacaaacattggcattggaggactccacaacagtgaagtttgaaatatgggacactgctggccaggagaggtatgctgcattagcacctctgtactacaggggagctggtgctgcaatcgttgtctatgacataacaagtgcagaatcattcaacaaagcacaatattgggtgaaggaacttcagagacacggtagccaggatatgatcatggctttggttggaaataaggctgacctacatgaaaaacgcactgtgtcttctcaggaagcacaggagcacgcggacatg

SEQ ID NO: 14918 - DNA, 559 bp, Triticum aestivum
  Clone ID: PAT_TA_14918
attcggacgagcgccccttcttctgtccctcgccccctccctccctccccccctccctcccatcgccctccaccccaccgcgcccccgggcgcgccgggtgcggcccgcgcgtcccgcgccgccggcacgccccgccgccgccgtccccggcctccccgcgggcgtccctgccctgccggtccgcaccggcgccgctgctgcccgctgctccaccccttctccggtgctccatgcctccctgcaggttctaccttttgaaaacaggatgatggtggagaatttcacagcacgaaagtgaaaatcttcaaatggaaggcttattgtgcactgcaacattggtgaggtgtgtgatgactacaagaaggtaaatttgagaaggccaatgaagaaatgcttttttacagatgcatctacatgttccgttggaaggcaaaatattttgatgtcagcaaatgtattgtagtctccaattggctaaaggaaatatcagtagcaggtgaattgctgctttcgagcttcagcatgatcagtagtagtactccagtagtaaacttgcag

SEQ ID NO: 14919 - DNA, 745 bp, Triticum aestivum
  Clone ID: PAT_TA_14919
gattcggcacgaggaacagatagtgcattttggagtgctgctgataatgttttgaaggttactggcccacttatcagtgttttgtataaattggaaaaggataattgtccagtgagtgtcctgtatgatgccatggatagtgcaaaagaaagtataaaaaaaaatcttggtcatgagcatggtaagtactggcagatgattgatcacatatgggacaattatttgcattccccaatccatgctgctggttatattctcaatccaggactcttttacgctgaccggtaccgccatgattctgaaatcagcagtggcatcacgacctgcattatccgagtggctagaagtcattatcatgcattgcatgtagctgaacaaatagatctatatcaaagaagatcaggtttgtttgattcagatttagcaattcaggaagctactgggacacctcaagatgtctggtgggagaaacatgggagtggcacgaaggagctacaatcttttgctgctcggatcctaggccagacatgctttggcgctactaggtacaacctcgacaagagcttaaccgagaggctgcacaccgagaagcgttccttggccgatcaagagaggttccgcaacatggagtacatccattacaaccttcgcctcgtgaatgcagtgcctcgcctgaacggtcctaagcatggtaaggtcactgctcagctcagcgactgggtgtcagcatagcacaccgcctgct

SEQ ID NO: 14920 - DNA, 681 bp, Triticum aestivum
  Clone ID: PAT_TA_14920
ttcggcacgaggtcagaacatagattccatcgccatggatccttctgcaatcgccattgtttgctggaaagggaagaccaatttgtgcgtcatggtttctcccctggatgggaaggagctgcttgagaggatttgtttacgttatgggctcaaaatccccaaagcggatgatgtaaaacccagcatgaagattgatggatcagacgagcagcctgatctcagcactgaggcagttgatccagaagctgtgcccgaaagcaaagcatctgacatggagattgcagatgctaaagaggtggagtaatcctgctgaatgctgatgctatccaaggccacatattatagctggatacaacatcgccccatcatttgcctaccggtattagttgagcgatgagccgccatttttcattgattctggcatttacgccgttttcctgtttgatttatcatattctgtttctgaagaatgggtgaatgaactcgcccattagtgaaagggcaccacgttgctctaagcccatctgtccatgtcatctggtaatcgtgcacgtattgccccctccatacttccggctggctcatccacctgtaacctatcagtatcagcttatttttcttccaagagaatgtattacagggagtcttaacctgaactcttgaacctgataaattttgata

SEQ ID NO: 14921 - DNA, 801 bp, Triticum aestivum
  unsure (1)..(801): unsure at all n locations
  Clone ID: PAT_TA_14921
gtcgcgtcgtcgttcggtaacttggggagaccatgggaggagggaaggacaagcatgatgagagcgacaaggggctcttctcaaacatgatgcacggcgttgccggtggccatgggtaccctcaccaggggtaccctccgcagggctacccaccaccacaaggagcatacccacctcccccaggggcgtatcctcctcctccaccaggggcatacccacctccacctggggcatacccaccacaacatgggtaccctcagccaggtggctacccaccgcaaagtggatatcctcctgcaggctacccaggctcatctcaccagggttatgggagcagccatggcgggagccacatggggatggggacagttctagctggaggtgctgccgccgccgcagctgcttatggagcacacaagctttctcatggccatagcggacacggtggacatggtgtctttggaggaggctatggtcatggtggctacggccacggctacggcggccacggcaagttcaagcatggtcacggcggccacggcaagttcaagcacgggcacggcaagttcaagcatggcaagcacgggcacggcatgttcggcggcggcaagttcaagaagtggaagtgatgcgccctccatggttgatcgtagctgaactcgggcgcccgcgtcctgcgctgccggtaataccttttcagcgttactcatccttcatctgtatttccagtaatccagcttnttgcgagtgacataatgctaataagtgacataaataancatttttctnaaaaaaaaaaaa

SEQ ID NO: 14922 - DNA, 676 bp, Triticum aestivum
  Clone ID: PAT_TA_14922
ttcggcacgaggcagaccgtgagggtggccgtgacgcggcccaggacctcgaggacccgccaggagaaggacgcggaggaggaggtgctggtcgtcgaggggatcgaggtcgccgaccacttctccgcgcgcggcaagttcgacgtgttcgtgaacgagtgccagggcgggggcggcatgggggcggcggtggcgcagtgcgcggggagcgtggcgatgacgccgcacctggttcggcccgggaagggtaggggctccgtgaagaccgcggcgaggttcggcatctgcgacctgctcgacagcatcggcgctgacggggacaagacgatcgtcgtgtcgctcgtgccgaggtgcgccggagacatggtcactgtcggtggcgtccggatcgagtatgttaagtgaggtccttctattacgtcctactgtcctacgagtacagtacacatctcacaagtgctagggcctagagacaactgctctacgaccaggagtatatatcaggtatacatgaataactgtgtgatgctgtacgtgtatggacgactcctgttgaactatatatgtagggaactatttgggattgtgtttgcgtgccgccgtgattatataatatgggccaatgtcaatgcgacatcaataattaacaaataaaaaaaaaaaaaaaaaaaaaaaa

SEQ ID NO: 14923 - DNA, 517 bp, Triticum aestivum
  Clone ID: PAT_TA_14923
gattcggacgagggtttcaactgcgtgtgaatccggtcaccgtgcatcagactgcccaaacaagtagatggtagagatggcgcattcttccctgccgcacagggtcaccccttttgatgatcctgatcggcttccaacaagacggctggagcatcaggacgcacgcagagcaaaaaaatccaagccccactccacctgctgatcagtatagccagcggacgttattactggctggcaacccccaccgtgcggtagctacattttttgtgtggccgtctcgtcggaacagaagattttggcatgctgactacagttattacgtccagaggagttccttgagcttattcatgtcacacgggctctactctactctataggaatatgctgtattatttcttcctccttttgtgttcttgattgaggatctcaatagaactgtaaccacacgaactgtgtacagttgctgctgctacaccgttgcgacagagacgcaatcagagtctgcattatcttgctt

SEQ ID NO: 14924 - DNA, 729 bp, Triticum aestivum
  Clone ID: PAT_TA_14924
atcactgtctttgcttgtgactgtagtaaagacactcttgagagggcaaatgaaattatatccaacacaaaagggattgatatcaaggataggttccacccctttttaatggatgtttctaaagaaactttcccagattggttattctgcaaagcctgtcaatgttcgctgggaaaagatgctgcacttttacttggttatacattttgtttcaaatattccttcatttgagtaatattttcagattaccaagttttgaactcattatatttttgctttcagatccaagtcaccatggaattagaaaagagcacccagtcttccttagagagaaccaatgttgtgctggtggcatggattttattaccatgatattcacactgtcagccatacccttcgacataatgccaactactatagaacaatgtgtttctgttctgaaaccaggcggccttcttctgtttagggattacggtctttacgacatgacaatgcttcggtttttacctcatcaaagagtagggtttcgggaatatatgcgatcagatggtaccttttcatatttcttctcattggatactgtgagagaactctttcatgctgctgggttagtagagttggagctggaatactgctgtgtcaagtccgtgaaccgaaagaaagggaagacgatgcagcgggtatgggtgcatggcaaattccaaaaaccacctacctgacaccagttag

SEQ ID NO: 14925 - DNA, 1837 bp, Triticum aestivum
  Clone ID: PAT_TA_14925
gttcgcgccctgccctctcctgagagactcgtaccagtcggctgcccaccatcgccggtccaagaagccgcctgctcgtcggctactccgccgccccactcgcccttccatcccccctccctcccccggattcaggaccggatcggccttcccctctgtagatggaaatcacaattaattccttgacgtacaaaggttcgattccagatgcaattaatcaatcaagaaggaagaaaaaactctttgtaatttacatatcaggtcaagatgaaacctcaagtagtttggaacagtctacattggttgatgaacatgtggctgcagtgataagcagatgttgcatattcttgcaactaaaacaaggcgatgttgatgcgcttcaattttcagctatctatccacagaagtctgtcccaagtatatctgtcgttggactgagtggtgctatgctatggaatcatgaggggtatattagcccagaagatcttaaggaaagcattgataaagcttgggctgcacttcaactgcaggagacagcggcaaccctgttagctgcatcacttgcttcaagaatgtctgaacctgcgaatactgcttcgacaactatgcctggtgaagacggttcatctacttcagaaaatcattccaattcatcaggtcaatcctcagagtcttctgcagtccgtgggtttgctaattctactgctttggtagcacaaccacctagtagcacaagccatgctgaacttctcaagacaagtaaaatcccaaaatcagattcagctccatgcaacataaccgctgaggaaaagctagattcagcatgtcaggctctgttgccagattttccagcaagtcaaatgtggacattccacagttccaaatcagacaggcagtacaccttcgccaaaaaggaagaatatggtggatgggaatagcactaaagttccctccaagccagcttctagcataccaactaggagtactccacagttgcctgtggaacaagataaggcaactactagcagagctattgaagtgaccacagattctgcaaagacagatgatattcagctggccattcgtatgcctgatggacctagcctgcagattaaactgacaaaagaagatgttttaaggaaggtgaagacttttgtggatgaaaaccaagatagtgggattggatcatataatcttgcaatgctttatcctagaaaagtgttcacggaacaagatctggaaaccacattgtatgagctgggtattgaaacccgccaggcccttgttgtcgttccgaatcgtcaatctgttaaagtggcaaggcaccaatcgtcattgccatccagtgatctggatcgcactggggctacagacaggtcgggtggttggggttttctgggggcagcgttatcatacgtgaatccattgtcctacttgagaggaaatcccaccccatcaaatcctgatcaactgggaaatgaaggctcgcagcagtacagaccaagctctcaatcccaacctcttcgtggtgatggaagtcaacaaacagctactcatagctctggaaataccttgagaaggcggccccaacagttcggtggcaacattcacactctaagcagtgaagaacaagatccatctgataatagaaatgtcttctggaatgggaattctacagagtttggaggcgatgaaaagaaatagggggtgaccggactgccgtttaacgaggaaataaatatgttggtaacgaactgaggtgttaaactacagtgcctctgacgtgtttgggtaccgtgcttatacatatgtttggaacaaattgaggtgttaaatt

SEQ ID NO: 14926 - DNA, 457 bp, Triticum aestivum
  Clone ID: PAT_TA_14926
ctactaccccctcgcgggctcgagcgatctgtcggacgatgcttccagtctcgaatgttcaacctgcaagaaatcctacccgaacaaacaggattactgggatcttacagtgtcagttggttcgatagagtactctgagtccatgccagcagcaacagaattgttcaggactccactggtatcatttctttacgaaagaggatggcgccaaaatttcatatggggtggtttcccaggcctagagagagaggtcatgctgcttaactatgttgtattcataaggatgttcaattgcatttctgaaatatctatcttccaatcatctctatgtaaatttgactagtagctccctttcctttccccatgaaaaaaatgtggtactcaagagctcttgaagaacctttcatcatggtattttacttatacctgatccaacaaaaaaaaaaaaaaaaaaaaa

SEQ ID NO: 14927 - DNA, 709 bp, Triticum aestivum
  unsure (1)..(709): unsure at all n locations
  Clone ID: PAT_TA_14927
cggtgtcaagtgatgggattcatggtgagcaagaagagcaggagcaggagcaagggagcaacgctaatgctgccactggttgcgatgaaccagatggagaggccaaggatggtgctttgcctctggctcacacgccaggtgctgaagaaggagagaaacaatttgttgtctggtggaggctgccgttcaagctgctgcacttctgtgcttggaaggtgaaaccagtgtggtccttctcaatcgccgcggcatttcttggcctggtcgtgctggggaggaggatgtacaggatgaagcgcaaggcaaggggcttgccccagattaagattgcgtttgatgataagagggcctcccagtttgctgatcgcgcggcacgtctcaacgaagccttcctggtagcgagacgtgtacctatgctaagaacatcatctggtgctacgcttccatggtcaatggttcaggacagatgagtgaagctgctcaaagttccctaggaaggttcctacaagcaaccattctggatgatgaacatcagtacgagcatcaggattggccttgcctaccttttgttttagatgacgcatcaaggaggatgccaatgttgatgtccgntgtctctctttctcttcttttttcttccttcaatttttgtttcttttttgaggaaccgcttggttttcattttttttagcctttactctgtttagtc

SEQ ID NO: 14928 - DNA, 592 bp, Triticum aestivum
  Clone ID: PAT_TA_14928
attcggcacgaggccccccaagccgtcctgaagcaagcccctgatcgtctcggccagtcaccactgacatggacgttctggtcgtcgtgtacctcggttcaggtcgtcgtgcaccgttgcgtgctcgaccttttgggcacagctgcgccgcatgcatggagatcgatgagggctgagcatggtggatgacttgtgacgatcatggtgggtacttggtagaggagcttgctagccgtcggatctgctggcctcggattaatctgactgtcagtttttggtcgcgtcaagtacgtagctgacaactaagaatgaagcctactcgattcaggggctgttgaattgttgttggtggcatggtgtatgtaatctagtctagtctagtctagttctagctgtacttagaattggtttcaggttaattagtggcaaacaggcaacgagctttaatttggttttgttgagtgtttatgcactataattgcaacgtcatgcatgtactagagtcgctctcagcggtcgctttctcgtgacagggccgggaagccgaaaaattttgtaatgcaattatctaataaagtgttgtaacttgtaa

SEQ ID NO: 14929 - DNA, 721 bp, Triticum aestivum
  Clone ID: PAT_TA_14929
gattcggacgaggaaaccgagggggagagctccggcttttcttttccatctcgaccttgccgccggccgtgaagacgacggccgttgccatcgccattgtgccgtggtcgtctcctctcttctaccgttccataatttcctcatcatgccgatcatcttctattttgacaccacgtcatttcatccactgcagccacgggaacgcagagctcgccgacgatgctctggagcgcgcactggacgccgtcatcgggttctcatcgtcgttccgaccgaaccgaaccaccccaagccgaacccttgcgccaccaggatcacctcgacgtcctcttcaagataccccaagaaaacccatccaatggcgcagcgatcttggagatcgacatcgtcttctccaactccattcaaccgcttccatcatcgattccattctctccgtgactccccttacagatcgagcagccgacgtcattcctggagttgtgccatgccgccatggagcttcgccgtcgctgtggctctgcagacatccctagccttgtctagcatctcgatgattgcttaaatggtgaagaagtgatttagatgctgacattttcctgattcaagggtgttaggcttgtcttggtgatgcgggtaatcgactgcttcttctaggacttggaacttaatggaggtaaacccctagtcggtgtgcttatggtttgggtagacaagcttc

SEQ ID NO: 14930 - DNA, 482 bp, Triticum aestivum
  Clone ID: PAT_TA_14930
ctggtatttcaagggatgaagttaaggacgccctccagagacttgttctgaatgacgagttcatcgatttgatatatcgtgagttgcaaaatgcgcacatgtagactgctcactagtctgtatggagtttatctaaaaccaatgatagtcttatggagctgcttgccgcgaacaaagattgtcccccttgtttttgttcttgtcaggtttgtatgatttatttcttaaaacttgtggatagcttgtcaaatgtagagtgcttataccagtgcttgtaagcatttatcctgctggttcccaaataactgtattgtcatatagtattcatgtaaccgagcaccaagaatgttagatttcgagatgcccgttctggggcatctggattttgtaaaacaggacttgtgcagggattttaaatgccatatttttcgtgtgatttaaaaaaaggacgaaccaaacaaagaaagcaaaaaaaaacaaac

SEQ ID NO: 14931 - DNA, 481 bp, Triticum aestivum
  Clone ID: PAT_TA_14931
ctatggatagtatataagggaaaattagaagatggacgcaaggtagccgtgaaactactgaaagtatcgaaaggaaatggagaggagttcctgaacgaggtagtgagcatccgtaggacatctcacataactattgtgaacttagttggcttttgtttacatggatctaagagagcacttatttacgattacatggtcaatggctctttggacaagtatatttattcagaagaaactaaaatggccataggatgggataagttgcgagaaatagccattggcattgcgcgaggcttggaatatttgcaccggggatgtaatgcccgtattatccatttcgatatcaagccacataatgtgcttctagatgaagacttttgtccaaaaattgcagattttggactggcaaaactgtgccacctcaaggatagtgctctctcgatggctgaagccagaggtaccattggtttcattgctccag

SEQ ID NO: 14932 - DNA, 764 bp, Triticum aestivum
  Clone ID: PAT_TA_14932
gggtttcgcgtaagaaccgaggtaccccacctcggattcgccgggaacggaggcgccatctccgacgccggcgagagaagtcctcgactccgtcgcaatccgccaatcttcgggaacacgactgcgtcaactcggaacaccgtcgcgctctggacgccgctgcttcgcctttgctcgtcgcccggcttccacagttcgtgacaagctgagccacttcgccacgagtttcatcaacccctgtagatcaagaatcccgaaggaatcgacgcaaggtggaccgcggcgggcgagcctcttcttcttccccaactccggccgccgacgccattcctttctttctccttctctgtagaagcctgggggtacaccgtcgatgacgaccgtagcagccgcgccgtcgccgaagcagtacaccgtcgccaagacttcgccgagccgcatttgctgcttgacatttgcagccgagtctcgaggaggcctactttgtagctgagcaaggagtggaagagcaagaattggttgcaggtgagatcactcctgaggaggatgatttggatgtgggaagtttctttcttctaggatggttcttacttgggtttaccctaatcggttgcatgaaagatcatttgggtagaagatgcttccgcgaacctaactattcggccaattatgtatctaagttataagttgtttgaacctaacctagaatctagaacttaaaacttagaactccctaagttgagatatcatgtacttggatgaaa

SEQ ID NO: 14933 - DNA, 682 bp, Triticum aestivum
  Clone ID: PAT_TA_14933
cggcacgagggtaatgaccaacaagcaggattatcatttccttaagcccagcatggcagaagatgcagctgagaaccttttattttcaaagacagctactgcaaaggtgtggttaaattggggaaggtctagatgcttctgagcagtttaaggcacataaaggggcggagtttatcccatattcacagtttccaccaagaatggcacgcaaggacacctgcacctactctataacgcctgcaatggctgtgcctaaaacactacagaatgtgcactcctgtgagaactggctgccaaggagggtcatgagtgcatggcgcattgctggaatggttcatgcgttggagggatggaacgagcatgagtgtggggacatcgtgctagacatggagaaagtgtggtctggtgctcttctgcatggattccgccctgtggctcaagtttgattctccggttgcaattgcaaggcagcgcaataagttattgaaagttatgtcatatgctcatgagaattatgctacagacatagtagtatgttgatgttctattctccatgctctgcctcttatcactttaagaccttcgctatctaaaatttaagatgaactcctttcgtgtaaaagcattctgtggaagcaggataaaaaaattacatgtctataatgataagcagggatgggat

SEQ ID NO: 14934 - DNA, 692 bp, Triticum aestivum
  Clone ID: PAT_TA_14934
cagacacaccaaaacgtacgcgtgcttctcgatcgatcgatcgaacctgcagcaggtgtccaagcgtcatggcggcagcgagcagggcgtctctggtgctgttcctggtggtggcgacgagcgcggtggtggcgagcatgctggccgtggccccgggcgcgggcgcggcgacgacggcgtgcgtcccgacgcagctgaccccgtgcgcgccggccatcgtggggaacgcggcgcccaccgcggcgtgctgcgcgaggctcaaggcgcacccggccagctgcttctgccagtacaagaagaaccccaacatgcagcgctacgtcaactcccccaacggcaagaaggtcttcgccgcctgcaaggtgcccctgcccaagtgctgaatcaagtgcatgcagctagagtagtgcctagtctgttccttgtcgatgtcgaccttgacctctcgcgggcacgcacgcactctcgtgtatggtacttatgaatacttggctgagttagtattttgcttgagaataaacggagacgtagtaattcagtactacttcgtagttggtacagtgtgagtcctctgctctgtgcagacttggtatgtcatgtatttatacgtgtcacacgtatactatgtatgatgttacaaaatgaataaaagtgttgccacttctgagttgaaaaaaaaaaaaaaaaaaaaa

SEQ ID NO: 14935 - DNA, 507 bp, Triticum aestivum
  Clone ID: PAT_TA_14935
gattcggacgaggctcgcctgcctatagaggcgattcgggaggtgacctcgctgctccgccgcgccccatctctacgcgtcgcctcctcgtcatcgattcggtgtctccgtgtcgtctgccattgccagagcttggaagcacagagagttgaataagcttatcttggagagccgctgaagcatcttgttgatagagggacattgaggtccttgtaccacagccctgaggctgagaaacgtgcagaaccaagagatcccgtggggttcaattggtgctgaatatgttgttgagtctactgttattttcactcaccaggagaaggctgcagcttacttgaagaaaatgcatatatctgaagcctaaacttgagaagttggcagcagaataccatccaaggttcgagagttttgtcccctagattggacagaactacacaggctgttttttttggacaaattgttgatccctgttacaacttaatatgcaaagtccagttatactgtttc

SEQ ID NO: 14936 - DNA, 436 bp, Triticum aestivum
  Clone ID: PAT_TA_14936
gaattcggcacgagggattcagtgaattcttgttcactccggtgagatctgatttcttgagttttcttcttcctcttgccgcacatcaaaatcaaagccaagtgaagatagtgaggaacacacaaattttcacaaatatattccaacttttccaaaaacgtagattccaactgcgtttagttcggccactttaattttgccgtcttcttgtgcttattcaaagtgtagcgcttttttgcaacacaaatcttttcatcacttcatcctttttttttgttgtatgacatcgtaatttatcaaataacaatactctcaaaatgacgacaatccggatacttttggttatctcaatgttggccactgttgccccagccgcagttaaacgcgatgaatttggaggtgcaaatccttctgctgaacatccaagcaccagttc

SEQ ID NO: 14937 - DNA, 385 bp, Triticum aestivum
  Clone ID: PAT_TA_14937
ttttttttattgacaactggaaaggcccatcagatgctgcccctacttggcatgcacccattaattcttccaggagctcatgctgtgtgaattttcttcatcctgttcagagttggttctgatggtaaattatggaattgtcctcgatgtttgttgccaatagttagtcccatttcgagtcggccgtagcgagtatcagggttatttttttgtgatcacaggggggagaagtctttctaaccaatgtttgttgggagtagggagaattctaggttcacagcttgatgcctcccgtggcttctgaccaatatttcattgtgataagactttgtagttgcttataacttatcggcattttcctgatagccaaatgtttcacatgact

SEQ ID NO: 14938 - DNA, 1511 bp, Triticum aestivum
  unsure (1)..(1511): unsure at all n locations
  Clone ID: PAT_TA_14938
gcgaagacctaaattccatagagaaaactcgcatcgccgccgctgcctagatcgccgggcgccgccatgtcgaccccgggcgccgcctactacgcttccctcgcgcgcaagcagtacttctgctaccaatgcaaccgcaccgtcctcatcgccgcctccgccgcggccgccggcgagctctcatgccccgactgccgcggcgacttcctggaggaggtcaccgtccctgcccccaccatcctccccttccccttcgccttcccccctatgatgcccaccgcctcctccccgtcccgatcctcctcgtcatccgccgccgcgcccccctccagcgacctctccaacttcctcaccagcatcctcgacctccaggagggccgccgcgttaggtccaggagcgggagcggggccgcctcggccgctggcacggccacgcctgagaacgagccggagtccttcgacccgctcgtgtttttccagaactacatccacaccctcatggaggggggcgccaacatccaggtgctcctcgacgacgccagcgtcaacctcgcccccggcctaggcggccgtgccggtgggacaagctacggggactacttcgtcggcccgggactggagcaactcatcgagcagctcgccgagaacgatcccaaccgctatggcacgccgccggctgccaagtccgccctgaccactcttcctgacgtcgttgtcaccgatgccatggttgcggcggcagagggcgccgagtgtgctgtgtgcaaggaagatttctcacctggagatggggccaagcagatgccctgcaagcatatctaccacgcagattgcatcgtaccctggttggagctccacaattcgtgccccatttgtcgctttgagctgcccaccgatgatcctgattatgagggcaataaggcctcaaacccacagtcagctgttggtatcgctgctgctgctgctgcatctgggagctctggtgctgctgaggaaggaggggaggagagtggggagactgcaagggtggtggaaaggagattcaatgtgtcattgccatggccgtttggtggatcggcaggtcaaacaccacagcaagatgggaacaatgccggtgctggcagtagctcacaggacagcggttcgcaggatggagctggtggcagtaacaaaaattgaacacaaatctgtgatcacttggaggttcccttgtcggcgatgcgtccagaggtcgacaatgttgatgcgccaccgtgagttatactacagacaatcgaaagaccaaaggaatttacagcctgtttatttggtggaacaaaacaatgttggttttagttgtcgttgtcgctgtccgttaggccgtgtacgcaaggcacagagactgccgtggcaggaagttgtgcgttgcgtagactctttgtgcagatttgttaaatcggttctcgtttatggacccccaacctagctaaaaaaaaaaaaaaaaannnnnnnnnnnnnnnnnnnnnnnnnnn

SEQ ID NO: 14939 - DNA, 577 bp, Triticum aestivum
  Clone ID: PAT_TA_14939
gctccctattggtgattctggtgatagtgctgctgagaagtcttccaatggtgttgttgacacagcgagttgttctgatagagatgagatatctgatcttgatctagatgatgatgatgatttcactgaagaagaggctgctgttgccaagttggttattagtgtggcatccgattccctggttgtagtgaaagaggcaattcgtttcattactggtttgctcaagagctcaggtaacaaagatggggctaatgaggacaaagttgagccaatggaaaaattgctgagccattgcaaggagattgccgaccaggtcaatgatctaggggcttctgtatacccaccacaagactcatctgagatgaagctcgctataaaaagactgtacaatggcatcaatgggatgcgcaaggaagtagggaaccttggcggctcacctgagagcacctttgcagcccttgaaggatttgaaaagtgcattggatctctacaggcaaagttatctgatgatgtggcgaacgagatggaaaatcttaatattagctattagcacgtaatgttcagatttgttatagca

SEQ ID NO: 14940 - DNA, 337 bp, Triticum aestivum
  Clone ID: PAT_TA_14940
gattcggacgaggccgaaatctgcgagatattggccaactacaagctcttctccatcgcggccgagccgcccaacatgcccaggagtatggttactttttttctctttccttttctactttcctttattatgtttttgtgctctatttaggtcccgtggcttctgaacactggcctaataaatatgcttatttattccattagcaattatgatgtatttatgctatggactacatggagtatagagttgttttctgctatttatgatgtatagacttgtatttattccattagcttggcatgggcatttcggctgtgtaaaaaaaaaaaaaaaaaaa

SEQ ID NO: 14941 - DNA, 620 bp, Triticum aestivum
  Clone ID: PAT_TA_14941
tcggcacgaggaaccttcgcaacctgcagctctggactccatcaccttgccctgcgacaacctctcggctgacggcggcgcgccggcgcccgtcgctcggactccatcaccctgccctgcgacaacctcccagcgacggcggcgcctgcctaaagttcatcacggcgaagcaatttccgttcggccacaggcggctgacggcggcgccccatcaggctcggcgtcccaaactcataggcattgctggcgtctccagattcaatcatcgattcttttctagcaaaaaaaaaatacaggaattctctgcaggagtggttttggtaaacaagcagtgctggaaacaccgctccaaagtcatctactgaaactatcctgagaaggctgaaggagaggatactggcaagagtgttgatagagccgcacacctcctgcgggagtggttttggtaaacaaatagtgctggaaacactgctccaaagatgattattgattttggacgacatccaaacttccgtaaagagttagatatggaaaaactaaaagagtccatacataaatggcctggaattgaatacaatgtttcaaggggcaaatcgatttttataccaataacgcaacta

SEQ ID NO: 14942 - DNA, 692 bp, Triticum aestivum
  unsure (1)..(692): unsure at all n locations
  Clone ID: PAT_TA_14942
gattcggacgaggcgtacgcggggtacctgccgaaccggcccacggtgagccggcgccggatgccggagcccggaagcaaggagtacgaggagctggagcgctacccggagcgcggcttcatccacaccatcacgagccagatccagaccatcatcggcatctcgctcatcgagatcctctccaagcactcctccgacgaggtgtacctcgggcagcgcgacacccccgagtggacctccgacgccaaggcgaaggcggcgttcaagcggttcagcgacgcgctggtggcgatcgagggcaaggtggtgggcgagaaccgcgacccgcagctcaagaacaggaacgggcccgccgagttcccctacatgctgctgtaccccaacacctctgaccacagtggcgccgccgctgggctcaccgccaagggcatccccaacagcatctccatctgagcgactggtaccacctcctccccgcgtgtgctacctgccggctgctccacgccttggctaatatctgcaatcgtgtaaacgggaagagagcggccggcacgagacggaccatgtattttgcgtaaacgtgtgggctggtgaatcgaattantaccacgtaataagtgaantgcttgttgcaatcaaaaaaaaaanaaaaaaaaaaaaaaaaaaaaaaaaaaaaaaaaaaaaaaaactcg

SEQ ID NO: 14943 - DNA, 870 bp, Triticum aestivum
  Clone ID: PAT_TA_14943
cccgtccgcgcgacgcgtggcccaccctctgacctcccccggatctctcccgaggcgcgagcaggaagacgctggcgggcggctccggcgaccggagactctgcggccttccctccgccctttccatattgctgtcagagtggaactaatctgttgctggaaatggcaagtacagcatgtttcgtgattgtaagtaagaatgacatcccaatatatgaggcagaagttggatctgcaccaaagaaagaagatctggcttatcaccatcagttcatcctacatgctgcgttagatgtcgttcaggacctagcatggaccacaaatgcaatgttcctgaggtctgttgatagatttaatgaccttgtggtgtctgtttatgtaaccgccggtcatactagattcatgttgcttcacgattcgcgcagcgaggatggaataaaaagctttttccaagaggtccatgaactttacatcaagatattcctcaaccccctgtacctgcccggctctcgcatcgcgtcgtctcatttcgacaccaaggtgagggctctggcgaggaagtatctgtagcgtgctgccacggagcagcttcactgtcgtaacgcggaagcagggctggcaaacgtgctccaccgcagctgttctcctgtcatctatgcaccctgctgaatcaagtatgcacactctatttttcttcgtgttggattgttgcgtgcgccagtgaatcccgagctttcagaatgtttgtaaaatggactgtgctgcgcatggcaaacctgcactacaaaccgtgtaatctccgtgcagcatacggggcatatactagtgttggtttgatttaaaaaaaaaaaaaaaaaaggcccctagggc

SEQ ID NO: 14944 - DNA, 702 bp, Triticum aestivum
  Clone ID: PAT_TA_14944
gattcggcacgaggcttggtggacaagctcactggacagttggacttgtagcaaccttgatggctattagtagcatcattgctgctgatacatctgctttcctttgtggaagggcatttggtcgtactcctttgactaacataagccctaagaagaccttggaaggtgctttagctggcctagctggctgtgtactgaccactgtgctgctgtcaaccgtctttcgctggccaagatcgctgttgagtgctacagcttatggaatcctgatctttctgggttcattatttggagatcttgttgaatctctgattaagcgtgatgctggtgtgaaggactctggatcactcattcctggtcatggtggaattcttgaccgagttgacagctacgttttcacaggggcactttgttactcttttgtcagagtagctctacccttgtatggggtctgattaaagcacctggctttttgttgctgtctttctcctgccatcagcaatgcagtcaccatattttaacataacgatgagtattgctgaggtgccctagatcagtcttcatctcaggataacgtgctccaactatccaagcgaatttggtggccgagtttctgacaggatagaaccaaagattacggctgctaactcgacatcgacagtagtgtttctttggatttgagatggtctttccagctcaacc

SEQ ID NO: 14945 - DNA, 964 bp, Triticum aestivum
  Clone ID: PAT_TA_14945
gattcggcacgaggcaccagtggttaaccttgagatgtgcatgactggtctggacaagaagaaagcttcagtctttttcaagactaatgctgatggtaacacaacatgtgccaaggaaatgacgaagctctctggtatatctgaaattatccctgagatggagatctgtgattttgactttgaaccctgtggctactccatgaatgcgatccatggctctgcattctcaacaatccatgtgacgcctgaggatggtttcagctacgccagttatgaggttatgggctttgatgccactgctctgtcttatggtgacctcgtcaagagggtccttaggtgctttggccccttggaattttctgttgctgtgaccatcttcggcgggcgtggccaagctgggacgtggggaaagcaacttggtgcagaggtttatgactgtaacaacatggtggagcaggagctgcctggtggcggactcctcatctaccagagcttctgtgctgctgaagacgctgttgctacctcgcccaaatctgttcttcactgcttcgaaggtgtgaacatggagaatgctcctgtgaaggaccgcaaactggctaatcttctctgctgggaggaagtggatgccatggaggagaaggatggagtgcttgatgagtaagatgggcttctggtgtcgatttgcttctgagttgttttttttatctttgcaatttcgttgtcgtcgtttggttattctgtgaagcagccaagccaggctattagagtatgaaaaatgtcgtctgtaagcatgttttcctatgttgccacatgctgaatcaatttgaataagtattaatacagctctaggtggtcagctgcgtctaccacaatgagcatatatgtatggagaaatgtctgtccaagcattttatttaagaataataattttttttcgagttaaaaaaaaaaaaaaaaaaaaaaa

SEQ ID NO: 14946 - DNA, 739 bp, Triticum aestivum
  Clone ID: PAT_TA_14946
attcggacgaggccttatcggcatagatgaactcaagattctccgtggtgatgatactcctggaccatacaaggagcatgatcgcgtctaccgttatgactactacaatgaccttggtgacccagacaagggtgaagacaatgctcggccgatccttggtggcagccaacacccatatccccgtcgctgcagaactggtcggcacccaacagaaaaagacccaaattcagagagcaggcttttcctgttgaacctgaacatctatgtcccgcgtgatgaacgctttgggcatctcaagatgtcagacttccttgggtactcactgaaggcaatcgttgaggctgttcttccaacattagggacttttgtcgatgatacaccaaaggagtttgattcattcgaagatatcctcggactctatgaactgggtccagaagcacccaacaatccactagtagcagaggtcaggaagagaatccccagtgagttccttagaagtattctgccaaatggtagtcatgaccaccccctaaagatgccccttccaaatatcatcaaatcagatgtattgaaaaaggctccagagttcaagtttggctggaggactgatgaagagtttgcgagagagacacttgcaggcgtgaacccagtaatcatcaaacgtctgacggagttccctgctaaaagtaccttggacccaagtcaatatggggaccataccagccagatcactgaagct

SEQ ID NO: 14947 - DNA, 819 bp, Triticum aestivum
  unsure (1)..(819): unsure at all n locations
  Clone ID: PAT_TA_14947
ctcgagtncccctccacaancctcccccccggccccgccgaagaggagcagcgcaccgcgatggaccgcgtccagctcgtgctcctcggcctccccatcctcctcttctgctccgacgtcgttaccctcttcgcgcctctcccgccgccgggccccgggcccganaggngcccccacgcttttnagcccggcgccgaatcctccgccgcggccgacgcttccgcacttgtggagccacaggtggacggacctggctccggcaccaccgtcgacttcaagttctgcgcctcctgctcgtacagggggactgcaatgaccatgaaacggatgctggaaacctcctttcctgggatccatgttgtcttggaaaattatcctccgccgttccccaaacgtgctctcagtaaagctgtaccccttcttcagtttggagcgatggcaacattaatggctggtgatcagatattccctaggtttggaatggttccgcctccttggtactactccccgcctgcgatttggttcggggccatggcggcgttggggctggctggcaatttcgcccattcatttctacagagttctggtgcctttgaagtttattgcaacgggcaactggttttctccaaactgtctgagcagaggtttcctagtgagcttgagctacaagagctcattggcagtaggataccggatcctccgattctggaaaatctggaaaaagatctggtcttagatgatgctgatgctgatgatgccatgagagactagctttgctgtttgttactaaatagacagaacttcagagtttcacaactt

SEQ ID NO: 14948 - DNA, 381 bp, Triticum aestivum
  Clone ID: PAT_TA_14948
attcggacgaggccgaccaccgccgcgacggcagctgcagcatcatcacgattccctccctacgttgttacgacgcaaggcccggcgggctgggttcagaagaatggcttccattcgctggccaggcccacctactagaccaagaactaccacgacccaggcgttcgttcaccgatcgtcttccacggcagagccatcggtcgatcatttgatttgacccaacggcaaaaggagtcctcgaaccactgcacggcggcgacgttaaattttactgccggagaaaacccccccgctttctttccctttacccttgttctgtgttcttgattgggtgagacatggatccgaggatggatggacctgtaaaaaaaaaaaaaaaaa

SEQ ID NO: 14949 - DNA, 670 bp, Triticum aestivum
  Clone ID: PAT_TA_14949
ccacgcgtccgcctcatcacatcgcccgcgtgagcgatttttgttgataaaaacgtccgcggacgcgtgggcctccctccctctgaactggaactggagctcctctctctctctggccgggggcagctctaaaccctagcggcagcggcaggggagccagatcgccgccgcgatggagagccccgtgaaggaggaggtcggcggggagctggccatggagatcgagtccagcgtcacggccgaggactggcgccgcgcgctctcccgcgtcgtgcccgccgtcgccgtcctccgcaccaccgcgccgcgcgccttcgacaccgaggttgccggcgccagctacgccaccggcttcgtcgtcgacaaggcccgcggcatcatcctcaccaatcgccacgtcgtcaagcccggtcctgtggtctcggaggcgatgttcgtgaaccgggaggagatccctgtgtaccccctgtacagagaccctgtacatgattttggttttttccgctatgacccaggtgccataaagttcctcaagtatgaggagatccctctagaccctgaagcagcatctgttgggctagaaatccgagttgtcggcaatgacagcggcgaaaaggtttcaattttggcgggaacacttgctcgactggatagagaagcgcctcactac

SEQ ID NO: 14950 - DNA, 520 bp, Triticum aestivum
  Clone ID: PAT_TA_14950
ttctatggaatggtctggaaaggagcttttgtgtcctcatctgaggaacctttcacagttgatggaaaagaagctggtattctgaaaagctatggacctttgagtttcttgaaggtccacgaatgctggccacatggtaccaatggatcaaccgaaggtcgctcgggagatgctgaagaggtggacctcaggaaacctttccaacgcatcctcgagcttccagaggctcgattttaccatgtgatatacacactgtcctcttgtgacacgatcagaggaacatggtttccccataaattagtataaagtgcttagtaggcacgtcagaatgattttaggtgatgacaagctcactgctaccgtacagatgttatttcccttgtacggtgcttgagtcactgaagtatcggtgacgccactcgattgttagcatgtaataaagcttagaattgttatggacagaagccaatctctttgttatgagggctgtttatgtccaggccttgtatgctattataat

SEQ ID NO: 14951 - DNA, 771 bp, Triticum aestivum
  Clone ID: PAT_TA_14951
gcaagcgcaagcgaccaacgcacgcatcgatttgagcaaacttggggacgacagcaatctcccttcagttccgttccgttccgttccatggacaaggtgctggcgttctcgatcctgagcgcgtcgccggccgacatctccgcgggcgccggctccggcgggagctgggcgcggctgtcgtggcggaggtgcgccgacgaccagcaggccgccgccgccgccgtggcgggacgacaacgggaggagcaggaggaagacaaggacaagcgaggctcgtgctcccgctcccggggaggaggaagagcggctcctgcggcggcgccgcggttcgcgccggagttcgacggcatcgactgcttcggcaccagcgtgtcgcactgtatttcaaccaatcatcactacggctcgggagacgcacgcacacgcccttgatgagttgacctcgtcgtcaccattgattattttttcttcaacatatttttatagactctgatctgacatctgaggatgcagaattgctgatcgatcgatccatcgatggagcgatcagcgtgtgtgtgtgtgtgtgttcattgtctcaacaatagcgtaattgagaccgtgtgttgtgtaggctagtactcacttatcaagaggaacattgttattctcctctgcattcttatgtaaccactaatcaattttgtgtgcacagttcatcgatccctctcgcaaccgcacaagctttgcctccagttccaggcaccgacaaaaaaaaaaaaaaaaaaaaaa

SEQ ID NO: 14952 - DNA, 582 bp, Triticum aestivum
  Clone ID: PAT_TA_14952
aagcgcgtgatgggccggacgggggggacaccgctgccgctgctgcggcggaggagaagaaggcgtgggtgccagaccctgtgaccggctactatcgcccagcaggtagcgctgccaaggaggtggacgccgcggagctgcgcgccaagctgctcacggaggctgcggccaactgattaatcacacggttaccttgtcgagctcgagcatgcatgagttggctgtccaccactccacctagcttctcttgctttaagatccgcgctcgttgatcgcggggctccttggcctagagcatgagggtgctctatacctgttctctgcagcatctattagtatagtatcgtcaggaagtgctccgccccgtgtcttctttttaagaaagaagaagaagaagaaggagaagaaggaaaaagttcccggcttctactacagccatacacgtccaaaccttactatatgtattttatgctcaatcgctgattatctgcacatcatcatcatatcatatatctgaatgatacatatataataagcatttccttcttgtctagccaccaccttcttggctatatagtccag

SEQ ID NO: 14953 - DNA, 596 bp, Triticum aestivum
  Clone ID: PAT_TA_14953
ttcggacgagggcgagagacagacaaccactgcgaacgaatccatcgccatggcgtctcgtctcgttgcggcggcggcggcggcctcctcctcctcctcagcgtcccccctcgcccgcctaatctctcgccgcggccttgccggtgccgctgacggccatggacctgccaaggtgcccttgtggaaagatccgttgagcccgagcaagtggaaggaagagcactttgttctagcaagcctgtctatgtggggggctcttatttatggcggtttcaagctttttggtggaaagaaggaagacaagactgaggtggcaccagcaaaggcatagttgcttgagatggagctctacctatttctgcggtcaggcaacaatgttaaataaaaaagaacgttctatgttgtgctttaaagttgataaattgtggcaaccagagattttgatttatgtaggcaagatacacttactctcatccaccatgaataatcttgctgcagtggaatttcatgtcggcaaacactgcaaatgatgtacttctttcatgtgattgagtagatgttttacttctgttgacatcaaaaaaaaaaaaaaaaaa

SEQ ID NO: 14954 - DNA, 857 bp, Triticum aestivum
  Clone ID: PAT_TA_14954
ataatgtaagtattgagtcagtcagaaaagaactgcagtcaatgcacccagaagataggcacattgttgttctcaagcacaatgtttggcgtgtaaaaggattgattcaggtttgtagatcaattggtgatgcttatctcaaaaagcaagagttcaacagggaacccctatatgcaaaattccgcctccgtgaaccttttaacaagccaatactaagttcagaaccatcaatatgtgtgcaaccactacaaccacacgaccagtttctcatatttgcatctgatggactttgggagcacttaaccaaccaagaggctgttgatattgttcacagtagcccccgcagtggctgtgctaggaggctgataagagccgcactgcaagaggcagccaagaaaagagagatgagatactcggacctcaagaagatcgatcgcggtgttcgccgtcacttccacgacgacataacagtcatagtagtgttccttgactccagcctcgtaagtagggcgagcacgcaccgaggtcccactctttccctgcgaggtggtggcgccagcgctggcctgcgcagcaacacgcttgcacctacgtgactgtaaagtgcctggtggagaggaggctacagccctgactggaggaggttttctttcctcgtgtcgactgtgttatatatgtacttgtaccggccaagatcatccatcccccctcaatggtgtaaaggagaggcgcggaagctcctccccagtgtctttgaatgccctaaatggtgtcaaggtgtggactcaagttgatagctcgtcgctgttcttctgatgatgctctgtggaaagctcaaatcctttccacctgaaaaa

SEQ ID NO: 14955 - DNA, 892 bp, Triticum aestivum
  Clone ID: PAT_TA_14955
tggtgtacaccatagccaccgacggctcgccgttccgccccgagctgcttacgccgtggatggtggcaacactgattgatttttatgtgaatgtaattgcgatctcggcttgggttatctacaaggaagcaaactggattagttctgccgtgtgggtggttctgttggtttgctttggcagtgctgctacttgcgcttatattgttaagaaactttttgaagtaacatctgcagggtcatcccaagatccacttgatcttctgtttatcaggcaaggtaatctatcccaaagaaagtgctcttatattgtaattggaagggttattttcagcattttggggatattcatggttgcggttgtcacatatactgtcatcactgatggactaccttttaggaaggaattgttgacaccgtggatggcggcaaccttaattgatttctacataaatatctttgcaatatcggtctgggttactcacaaggagtcatcttggatatcaactaccatttggattgtcttgttgatatgctttggaagcatcacaacatgcggctacattgtcctccaacttttcaaagtatcatatcaagatccaatctaccacgtgctattgaactctcacagcaagtatggaatttcaacttcactgtgataattcatcttctatgatcctggaagatttgaaaattcattgaagttgtatgtgcagcttggctggtaataccaaaatgttcgttctgtctatatgtaaggtaccacaattaacgggacagcaggatagcaattagagaagttatcttgctttgaataaaataactcatgtgctgacttctctgcaaaatgaaactgtaacctgaagttctttaaaaaaaaaaaaaaaaaaaaaaa

SEQ ID NO: 14956 - DNA, 580 bp, Triticum aestivum
  Clone ID: PAT_TA_14956
tccttcaacaccagctcaagcgagtatgatgtggatatcattgatgagtgcaagggggatgaggccggcaaccagaagacaggagtcactgacccaaccgcgttcaaccttggtgccgctatcctaagtgacaagttccttgtgcagacgcccatgaaggaggagactgcggacgtccagttcatccacaagaggaacgcccccgctgctgctgagccagagctaatgctaaacaaccgagtgtacacctgcaacaacgtccagtgcccacacagtgactacagctatggattccttgaccggaatacccgcaacagccaccagtacacctgtaagtacaatgatccaatccctcagagcactgaaaacaagccgccgccagcaccgccacagtcacaagccttccagccagccttcaaccaacccaatcagccactgaacaatctggatttcagcctgcccatggacgggcagaggtccatcgctgagctgatgaacatgtacgacaacaacttcatgacaaacaagaacatgagcagtgacagcgtcaccatcatggagaggcctaatgcgatgcccc

SEQ ID NO: 14957 - DNA, 658 bp, Triticum aestivum
  Clone ID: PAT_TA_14957
ataatgcaaattatggttacaatgctgccaagaactgctatgaggacttgatggctgctggaatactggacgcatcaaaggttgtgaggtgttgcattgagcatgctgctgtggttgctaagtcctttctcacctccgatgtggtgattgttgaggcaaaagaaggcaaacctattcgaataagacccccaatgcctcctaggaacttaattcccccaatgcccccttcaatttcaggtattcgagtgtagcaggattcctttgcaacaagaatcagcctcaacacacaagaatacatgaccggtacttttttttttcaaatttccaagataacaaagaaaagaaaacatagtgagagtttcacgccaagcgtgttttcgtatgattgctccaagaagctctatgcatggtatcgcatcattggagcagcagcaagggtggatgttgtgtgttatatagggaattaaaggctgaacaattcaaattttggtgttctaatgttccttacctttgtaatcttttttagggatagatactttaatagctccggtcagtttggatggttaacaaatgtttacacgtaacttgcaagtatgtccaggattgttattcattttgtaaatatttcgagcaatcatgtcaaagacatatgtcgatt

SEQ ID NO: 14958 - DNA, 813 bp, Triticum aestivum
  Clone ID: PAT_TA_14958
attcggacgaggaacaatccgccatggcgctcgcctccggcacgtcccgcctcctgctgggtcgccccgccggcaccgcgcggctccacctcgccgtctcctcatcctcccccgcctcttcgatccgcttccgccgcggcgctggtgccggcggcggcagggcggccgtcgtctccctccgcgcccccgcgcctccagcggcggcagcagcagcaacatctggtagcattgctccagcaatttcattgactgaaaaggccttgaaacatctgaacaaaatgagggctgaacggaatgaagatttgtgcttgagaattggagtgaaacagggtggatgctcaggcatgtcttacaccatggagtttgaaagtcgagcgaatgccagccctgatgattctgttgtagagtatgatggttttgcaatagtctgtgaccccaaaagccttcttttcatgtttggaatggagctggactacagtgatgcgctcattggtggtggcttccatttccagaatccaaacgcaacaaaaacctgtgggtgcggcaaatcttttgcgactgggaaagaaaccgaggccgcagcaactgcttgcaacaactagagtagcgaaataatgatagcaaaatgtgatgtaacatgttatatagcttgctcctattgaagtcccgtggctacaccacaatacagaaggcatagaattcaaagaaagtacaccattatcaatggcccccatatttcagcttttcttgtatggcgatcattctgaatctgaagtccttaaacttgtgttaaaaaaaaaaaaaaaaaaaaaa

SEQ ID NO: 14959 - DNA, 1153 bp, Triticum aestivum
  Clone ID: PAT_TA_14959
tgctaccgatctctttaacatgttatcaatggatggaacattagagccagagtcagagtcatcttcaaatgatgataatgcctgggatggattccagtctgcacaaccagtacctagctcagagaaaaaagattctgccaaaccggcagaaagcaagacccagtcaacatccggaatagaagacctatttaaagactcaccagctctgtcaatatcctcagctccagctgtttcccaagtaaatgcgaagaatgatatcatgagtttgtttgagaagtccaatatggtatcgcctttcgctgcccatcaacagcagctggcgtttatgtctcagcagcaagctcttctaatggctgctcttaaagctggaaatgcaccacaaatgattccagggaatgccaatcagctaaatgctaatggttctaatccccctcttggaaccttgcctttccaaaactggacaaatcttggttatcaaaatcctgggttgactccagcagcagcacagaatggtgccaccaaggttgcgaacaacaatcaggacttttcttctggtaccttcggttttggcacacctggggtgtacaacactagttcagctgtcccagcaaatggggccacggcagcaggtgctagcaacaacggcactgcatcaactgcatcttctaatctcccctcacaatctggcaaagattacgatttttcctcgttaactcaaggatttttcaccaaacgatgagtgcctaatgagcttggaaaccaaacagaccaccgggtcatgttggacgaggcatattgatttagggagcacaatggggcttgcatgcttattttgaggcagcttttcttatggtggatatatataatagttattacatgaccttgtagctgtcggacaataagagtggaaatatgccgcaaaatagctcatgttgtttctacaagtgaaggattccttgccggttatgtcaacggcttttactcgaggactacaccttgtcagttatacaagtctaatgcagccttttcattaacacgatacaaacttagctgcgttgccgattcgggttacggtctcttttgtattgtactgtacaacgacgattggatttttatttgtttccacatttgtgtaaaaaaaaaaaaaaaaaaa

SEQ ID NO: 14960 - DNA, 635 bp, Triticum aestivum
  Clone ID: PAT_TA_14960
gattcggacgagggcttgtttcatggtgaatgcagcagtgatcgttattcatctgactggaaagtaaatgaaacagatgaatacagcagagaaactcggccagtttctggaaccaatcgcctcattgatggtgataaatcaaaatttgacttcaatgatgctgaaactaaaactgattcaatgatctacaagctggagataatgacaattgaactgttttccatgtatggcaagcagtttatgattgatccacaagattttcaagattcagaaccagatattcttgcaaattctgcttcagcgattatagaacggatcaaagaaaacagtgaccaatgtgcaatggctctcaggtcgctctgtcgcaggaaaaagggtcttactgtcgaggaggcaagcttgattggtgtcgacagccttggtattgatgtaagggccttttctggcttggaagctaggaccgttcgaatttcattcaatgcacaggcgctctctgaacgttcagctgaaaagaagatcaggcgaatgcttttcccccgttcccagcgtaaaaacgtgaaaacctctactgaagatgtatcctaatatatcagctgattttccttatagaggatgtaaacaccttgttcaaagac

SEQ ID NO: 14961 - DNA, 672 bp, Triticum aestivum
  Clone ID: PAT_TA_14961
gaattcggcacgagggcacgctgtgcaacgcgtgcggcgtgcgggacaggcaggggcggctgctgccggagtaccggccgatagcgagccccaccttcgagccggcggagcacgccaacaggcacagccaggtgctgcagctccaccggcatcggaagagccagagccagagccagagccaccaccagcagcaccctctgcccgtggagcatcaccctccgcgagccatggacgtgctccagtttccaccccagcggtggcacgtgaaggaggagtacccgccgacgccggtccaccagcctctgagcctcgccggcggcgttgggggcctgatggtcgacgcggcggcagatgctgatgcaggacaaggcggcgaccgtggcaagggtagtgacctgaacaacgcgccgagctcgctggactcactgctgctggagggcccgtcggcgccgctgcttgtcgacggcgaccagcccttgatcgactagctagccagaagcctactaggggcaatgcagctgatttgagagaatagtaatcttcttggtctttctccttttctgagatctctcggtaactttatcaactttggttgtgtgtatttgttcgtctttcggcaaatttttcgtgtaactttatcatgaatggcagaatttgtagcaattgctccgg

SEQ ID NO: 14962 - DNA, 324 bp, Triticum aestivum
  Clone ID: PAT_TA_14962
acaaggcagagagtccaagtatgatgatgactggtcttggtgcttttgtacattctagggaaacctatagcagctgacttcagttagggctgagttttaggtttaaagtcgtttagggtacatagaagcagaaaggaaaggaagatagctttttatttagatgccattaatttggagcactccttttcttgctctgcctctgtcctgtttgtaattcccatcgggctttggcaaaactgacaaacgggttgtgctccggcttctgatctgattcaatgggaatgaagctattccttttgttaaaaaaaaaaaaaaaaaaaaaaa

SEQ ID NO: 14963 - DNA, 440 bp, Triticum aestivum
  Clone ID: PAT_TA_14963
tctctccttccgcacgccaacacagccgccgcctcctctgctcgtttatcagcttcgccgaatttggggagccaccggcgcgcgggacgcgccccaccgcgcctcccttcccacccacgcggctgcgggcgagggccctcctgatctccctctgccgaggaccctatcctcctcggcgtcagcgacggctacatgcccctcaagggggtcatctaggtcgagaggcccggccagaccgacgcccagtccaagctggtgaatttcatcatccaccctgcccagagctgactacagtccaaacgatgatctatgggagcaggatttatgctcaagagaagatggtttcagacgaaggacctggaggttcagttttgaacaatgcaagtaggaggataaacaggaaatctgctaggctgatgcgccggagagacgcaccaagg

SEQ ID NO: 14964 - DNA, 735 bp, Triticum aestivum
  Clone ID: PAT_TA_14964
cccctccgagcctcagttcgcatccacgcgcgccgccgccgcctcgcagctcgacgctcaccgcgcagccatggcggaacagactgagaaggctttcctcaagcagccaaaggttttcctcagctcaaagaaatccggcaaaggtaagaagcctggcaagggcggcaaccgattctggaagagcattggccttggcttcaaagactcccagggaagcaattagaagggacctacattcgacaagaaatgcccattcactggcagctgtttctatcatgaggcaagaattattgactgggaacatgccacaggtcctacagtggtcccaggaactacctcctccgcgtgaactacttccacttgtgtgaaaggagtacctccaagcatgccaacgcgcatctccccatgcccccgtctcatctccccgggctcccgttcatcaggtgggtcactacatccccattgcacaatccgtgccctgtcatatcggtgaggtcattcccgctggatctgccgctccgggtaacaagtgctgcaaaacaaggctaaaaaagaccatggtccttgaccaggggagacattgatgccttttttaaagatccctctcgctggggtgtcggtcacttccgattccactccgcagttccctagctccttgaagtcccatcatctgaacatgttactatttattgtaccttgtcgtgcaaagttttgctaaaaaaaaaaaaaaaaaaa

SEQ ID NO: 14965 - DNA, 682 bp, Triticum aestivum
  Clone ID: PAT_TA_14965
cggcacgaggcaataacctccccccatatatgaggttgtcacaggaactgctaagaaagagcccaaagaaaaaactcataaaagcaacaataagactaacaaatctggctcaaagccctcgcgccaggcggaacccaacaactcaagggtcccaaagatgccacctccaaaggacgaggaggagagtgaaggggaggaaggggaaccacaggaagaccatgagactgcgctgtgcggcgcatgtggcctaggttatgacgacttctggatctgctgtgacttatgtgagacatggttccacggcaagtgtgtcaagatcaccccggctaaagcggagcacatcaagcagtataagtgcccttcctgcacaggaagcaagagggccaaggcttgattatatctatggtagatctggattgccgacgatgctccaagaactaaggagcctttgacgagagttgtaagctgaatctttcgggtagggcagctaatagatttgagtactttgtttggatactttggtgcttgagatgcctctaaatctagtgtcagtaattacgagtactgaccaactgtaaactgttgtagtttgtgtggccctcaagcatctatgttctgtagtctactgagttgtgtggtttagattccaacttgccatttgtgatgaagcagtcgttttaaa

SEQ ID NO: 14966 - DNA, 701 bp, Triticum aestivum
  Clone ID: PAT_TA_14966
ggatggccaagatgctcgtctccgacgaggcgcgcaaggagttcaacaccctccgccgcaccttcgaggacgtcaaccaccagctccagaccaagttctctcaggagccccaaccgattgactgggagtactacagaaaaggaattgggtctaaagttgtagatatgtacaaggaagcttatgaaagcattgaaatccccaagtacgttgacaccgtgactcctcagtacaagccaaagtttgatgcgctgcttgttgagctgaaagaagcagaaaaggagtctctgaaggagtcagagaggatagagaaggagcttgctgaattgcaggagatgaagaaaaatatcagcacaatgacagcagatgaatactttgcaaagcatcctgaggtcaagcagaagttcgatgatgaaatccgtaacgacaactggggctactgaagagtggaggaactcattatttccctttcttggaagagttaataattttgtcttgtgtcccagagtgtatgtataggggaatccactatcgcaacaatggtggtttccataccatgtggatggggcctgtttaaactcccaaactgattctaccatgtcgtccgtgctgcagttccaactgaatttgcttgtgttggacctcttcattttctagagggttgacccttaagaagttatgttttattggtttggtgttcatct

SEQ ID NO: 14967 - DNA, 616 bp, Triticum aestivum
  unsure (1)..(616): unsure at all n locations
  Clone ID: PAT_TA_14967
attttcaagtacgctgcctaattcagatactaatacaaagattagcaaggaccagatcgattcagcatccaagagtaacccaggaagccggataattgagtcttatgacgctgattttgagcttgtctataaagcaatcaccgggggagtggttccagcgttctcaacttctggggctggggacgagacccaccttccagccagagagagtagctggagtttactgaggcacaagttcatctccaggtcgctagcccgtgtttattcagattctgctctaatcagggattttgatccgcgggtagaccgtgttcagcacctggctgctgaagcatcgacctcacctcctttcctttctccaagctccttctcaatcggatccaagcgtcagctcgaagtctccccttgctcatctcccttctcctgaggctcctcccgccccttcggccccgccagctatacgatccccctccaagacctctgcttgtccagtcaccncttccaacantaatgaaggggtnaaacctttggccggaacaatancaacctccaaactcttattcaaaaaaaanggggtccactntaaagttcaacnccaaaggccttttgcacaagg

SEQ ID NO: 14968 - DNA, 614 bp, Triticum aestivum
  Clone ID: PAT_TA_14968
ttcgcacgcccttccaacagtctccaaactcgatcacgcagcgagccaaatccaagcaatttcatttctgaacccgaggtaacggccccaaatccaagatgcggctcaccgccgacctcatccgggattccctatcctacctcaacccgctcaaggagcgagagcttgatcttcgaggtgcgttttgaaaagagcagatgctacatttttgatctctagagagcgcagagttgatacaatcgtctttgcggcgtgaacaggccaccgaattcccgcgattgagaacttgggtgtcgctggtcctcacgatgccatcgacttcacagataatgacattcaagtactgggaaactttcccttgtcgcctcgcataacgacccttctcctcgcacgaaaccgcgtttcaagcattcagccctctctggctaaggccattccaaaccttgccaacctggtgttatcgtcgaacaacctgacagagcttgcggacttggatgcgctggcgtcattcccccgcttgacgcacttggttctgtcggacaatcccgtttcgaagaaggagaactatcgatactgggtactatggaagtgtccttccgtgcggtttcttgact

SEQ ID NO: 14969 - DNA, 638 bp, Triticum aestivum
  Clone ID: PAT_TA_14969
ggtgcggcaacacgcccgcaggcagcaggcatcatcaggcgcatggggtgcgacgacaagtgcgggtgcgcggtgccgtgccccggcggcaaggactgcaggtgcacgtcggggagcggcgccggcgggcagcgggagcacacgacgtgcggctgcggggagcactgcgagtgcagcccgtgcacgtgcggcagggccacgatgccgtccggacgccagaacaggagggctaactgctcctgcgggccggcctgcaactgcgcatcctgcgcctccgcctcggcctgatcgtcgtcatcgacgcgcgcagccggcaacagccctgggttgtcttcgtctcgtcgtggatgcaccgcgtgtgctacttctacctagctagtggagttgtctagtgggctgggctgggctggaagctcctagtactagtagtacgtccatactcctacaggataataaagggctcgtgtataggtcgagcctatgtcaccatgcactcatgctcgccagatgcgtcatcacgcgctgcaacttggtatggagtatgtaaacctactttactataaggtggggatatatatatgtatatgaaatgtacgaataaacggttcatgagtgaccaactaaacagatttcttgtg

SEQ ID NO: 14970 - DNA, 680 bp, Triticum aestivum
  Clone ID: PAT_TA_14970
gaaactactagctagtaataagcaagcaagcaagcaaataatccagcaatggcggcgccggcgttcggaggacggcggaggccggcgtcagcagcagctctcctagccgtggcgacccttgttgttgtcttcctcgccgggccagccatggccgcggggaacaagaccggccaggtgacggtgttctggggccggaacaaggcggagggcacgctccgcgaggcctgcgactccgggctctacaccatggtcatcatgtcgttcctcgacgtctacggccccaacggcaagtaccatctggacctgtctggccacccgatcgccggcatcggcgacgacatcaagcactgccagttcgtcggcgtcccggtgtcgctctccatcggcggcttcggctccggctactcgctcccgtccaagcaggcggcgctggacctcttcgactacctctggaacgccttcttcggcgggtctaaacccggcgtccaccgccccttcggcgacgtatggctggacggcgtcgacctcttcctggagcacgggacgaacgccacggacaggtacgacgtgctggcgctggagctcgccaagcacaacatccgcggcggtcccgggaagccgctgcacctgacggcgacgccgcgctgcgagttcccgccggcggggtacctgaagcgggc

SEQ ID NO: 14971 - DNA, 807 bp, Triticum aestivum
  Clone ID: PAT_TA_14971
tttttttttttttttttgacgaaagtcaccacagacaccttgttggtgagggacaaaaatccaagaaaatataagcacccatatcatgtcgggaacttcaacccggatggacaggttccatcacagcaaacctaaccaactcatgtatgatcagtgccgttgtacaacatttcgggtaactccactcctaggggccgtacgatattgctttgctttcccattgacacatatgacgattggattgtatgcattctggtggctatttctttcatgttcatgcggtcgcttggtattggtttcgtacaggaaaatgctacttgtatgaccgataccaagcactgatgaaccgcattttctgatattttctttgcttcagcaaagttcttgtattcttctgttagatgagcatcaaggacctgaaatatttcatgtgggaagtggccctccacaaagttgataatgctgactccgtccttgaacataggatctgttggtctccttccagtcatcatttcaagcagtattatcccaaaaccataaacatcatcggaagttgctgcatggcgaccacctcctgcatactctggagcaatatatcctatagttcccttcatgccgacagatgaagcggtagaactagcgggtgttgatgaaggatgttggtagaaacttgcaatgccaaagtcagccaaaagagcagtcatatcatcgtccagaagaatattgctaggcttcagatcgcaatggatagtgggctttccactgtcatggtgaatatagtcacaatgcatcagcctcgtccgaatc

SEQ ID NO: 14972 - DNA, 609 bp, Triticum aestivum
  Clone ID: PAT_TA_14972
ggcttcatccttcagaagacagcaagaacaactgcactgtagcgctacagcgtggccgagagatagagaaagagatcgagagcaactatggcgtatctgctcaccctgtatggcagcggcggcggccagaggaggacgagccgcgacagtggcacggcggcgccggtgaggcggctgttgaggaggctgaggtccagcttcggccggagcgcggcgcggccgaggcgaagcgcggtgaggttcgggtacgacctgcacagctactcccagaacttcgacgactgcggtgcctcgtcatctccggcggcggccatggcttgttcgtagctaggattctagaaccaggattctgcttcttctgtgtaaataactgtagtcatgatattagtgtggcttagtgtatggttcctcactgagagatttgagtccagggctaattttcgatgattagctatctagctgtaggttcgtcagttcttgtatatgtacaagttatttcgtctgtgtgtaattagccatgcacaagacagtagttctatgtgcctgccatagatcaacaatcacctgattgctttggtcagttcttggatggatttaatctcttgattg

SEQ ID NO: 14973 - DNA, 906 bp, Triticum aestivum
  unsure (1)..(906): unsure at all n locations
  Clone ID: PAT_TA_14973
ttttggaagcctccatggcatatgtctctggcaaccccatcatgacggatcaagaattcgatgaactaaagctgagacttaagaaagaaggaagtgacattgtaacggaaggtccaagatgcagtctacggagtcgaaaggtctacagtgacttgactgttgactacttcaagatgttgctgctatatgttccagcagctgtggtagctctgacactattcttcttcttggatgatttgacgggatttgaaatcacacttcttcttgagttgccagagcctttcagtttcatcttcacatggtttgctgcactgcctttaatattttgggtagcacaggcattcaccaatgtcatagtgaaagactttctgattttgaagggcccatgtccaaactgtgggactgaaaatctttccttcttcgggaccattttatcagtgtctagcggtggttcaacaaacagtgtgaaatgtgcaagttgtggcactgtcttggagtatgactctgcatcccgattgattacactcccagaaccggctgaggcataagtaattaatggtggtttagatttcgctagcaggaaagacggcccacagattcctgatcgacagtacaaagcaagaccgtccttgaatcgggtgacaatcatgtcgtgatgtatgtttgctatgcgagtctatgtatatctttaaacaagtttagacatctatattatatagatttaacgaaatcgatatatgtatatatatgtgcatagagtgtacaaagaaaagtctttagctatgttccattttgtatgaactatcttggcatatgtatagctgtctgaagaacttgacgttctgtgcgatgttcagtaaagtaaaccaggttccatcgtanaaaaaaaaaaaaaaaaaaaaaaaa

SEQ ID NO: 14974 - DNA, 790 bp, Triticum aestivum
  Clone ID: PAT_TA_14974
gcacgaggacaggttccatcagtaccaggtggtgggtcgcgcgctgccaacccccgctgatgagcaccccaagatctaccggatgaagctgtgggctaccaacgaggtccgctccaaatccaagttctggtactttttgaggaagctcaagaaggttaagaagagcaacggtcaggttctcgctatcaacgagatatttgagcgtaaccctaccacaatcaagaactatggcatctggcttcgttaccagagcaggacaggttaccacaacatgtacaaggagtaccgtgataccaccctcaatggtgctgtggagcagatgtacaatgagatggcttcccgtcaccgtgtaaggtcaccctgcatccagatcatcaagacagcaacagttgacttcaagctctgcaagagggacaacaccaaacagttccacaattcaaagatcaagtttcctttggtttaccgcaaagtcaggccaccaaccaggaagctgaagaccaccttcaaggcttcaaggcccaacttgttcatgtgatccaactcatcctggcaccatccgaaaactgtgagcctggcagtctggagggtttctagttcaggttaattaaatctacatgcaaagtttctgaattgtagttgtaggtccatgcagtggcctttattagcttgatgaatatacccatttctttctgtcccttaccatcttctgccttataaattataatagccatttcagatctcatctgctttaggctttattcaaatgtctaaattagtgtttgcttatggc

SEQ ID NO: 14975 - DNA, 1218 bp, Triticum aestivum
  Clone ID: PAT_TA_14975
cgtccgcggacgcgtgggcggacgcgtgggaaaccgtggagaaaaccttccaactttctcgagcggatagggaaacagtcagagatcagaatatgatctccaggtttggtgcattcttatgaatgataaagttcagttcaggatgcagtggccccaatatgcagaattggaagtgaatggttttgctgtacgagtagtgaccagacctggttctcagttgctaggcataaatggacgggatgatgggccattgataaccacatgcagtagagaaggaactaacaagatctgcttacgaagggttgataatcgaacattttgctttggagtccgagttgctaagaggaggagtgttcctcaggttttaaatttagttccaaaggaagctgaaggtgagtcttttgaggatgctcttactcgtgttcggcgctgtctcggaggtggagatactgcggagaatgctgatagtgacagtgatttggaagtggttactgaatctgttacagtcaatcttcgttgccctaatagtggatccagaatgaagactgccgggagcctcccgcctggcttcctcctgggttgttttgatctcgacaccttcgtggaactgaatcagcggtcacgcaagtggcagtgtccaatatgtttaaagaactactctcttgagaatttgatgattgatccttacttcaatcggattacttctctgttgcgtgattgtagtgaagatgtcaatgagattgatattaagccagatggatcttggcgtgtaaagggtgatgtaccaactagggaattatctcagtggcatatgcctgatggcacgctctgtatctcgaaggaagataacaaacctggtgttgagaattttaatgaactcaagatagaaggtacttctgatggccataagagtttaaaaattggaatcaagagaaaaaatggaatttgggaagttagtaacaaagcagatgacaagaagccttctgtggtaggaaatatcacccagaacaatattactttccgtactccaaacactttccctatgagcagtagtcctactgggagttatagagatggggaagacacaagtgttaaccaagagggcagtatgcatattgatttatcattgaacaatggccatgagtttgaaagttttcctctcaattttcgccaaacatataagaacaatgacatctccagcactaagttgttgtgatg

SEQ ID NO: 14976 - DNA, 911 bp, Triticum aestivum
  unsure (1)..(911): unsure at all n locations
  Clone ID: PAT_TA_14976
aataaacttattcattaaaacaaaagttcattacatcatgcccgcacatcaacataactttactgaaataaagcaagagggcacatcaagtcttgacacaaccccagcngaaacaggcaggggggcggaaaaataaacagactaacaccagctaaccggccatcaaaccagacacacttcctttccagtggtgcaaatcctatttggcaccaaagcagagcccatccttgtggtatgctgaaagattgctgcttttgttgtccggagattagaatacaactgaatccccatggcacataaagagtcttccgtacattaaagtaagccattcacgtgccacagtcccaagtctcttcctgcttctgaatcttcctttctcttttcaatacccagtgacatagaagctcatgaggtagatgaagcagcatacgccaactaacaggactagcttttctataatccacaatgtattggtacgaactcctttcttcccgaggaagttcttctgttcgccatccatcaactcaaccgggcgagtatttttctcttgcgcccgacggaggatgttgagtttgaaatcagcaagcagttgatcctgtagactctcaggtagacgtgggtacacttcatttatcagcttagcaaaagcttccttaaatctagtgtcagtaatcaattcatcagtcttgagagcttgagcacacttcactgcctcagccaacacttcggttaaatttagctgcttctttggattccctcttatgtggtcttctgtgggcatcgcctttacccctcgcttaagcatttgtcccgacattgcatcctcctttccatcacaggggccggaagtgtttgcgccgcgccggaggagcggattgaaggtggaagcgccggcgtcccccatctccggc

SEQ ID NO: 14977 - DNA, 1074 bp, Triticum aestivum
  Clone ID: PAT_TA_14977
aagctgtacgcgctgcaggccccggaccggccgacgcgtggccacctgctccgtctagtcgcgacacccgcacagctctggttcgcagcgatggcgagccaccgccgcctgcgcgcgactgctcctcctcgccgcggcgctcctgctctccgcctcctgcgccgccgccgccaacttcgagtactgcaataaggggcgccactatccggtgaaggtgagcggcgtcgagatcgtccccgaccccgtcgatgcgcggccagcccgccaccttcaaggatctccgcctccaccgataaaaccatcaccaaagggaagctggtggtagatgtgtggtacttctttttcacacgtctgattcacgagactcatgacttggtgtgctgggactccctgtcccgcaacgggacaaattcgtactagccatgcgaaacagacattgccatgttacacctccctattttctcacaagtgtccatgttcagtctgctggcgaaacaagaacgaggagctgacctgtatctcgttcgggtacaggcatggtgttgatcgcgcatgtcgccattatgtggactaaataagtgccgcgagctaaacgcaccctaggttttagttgatcaagatctagcacaccactcctgaatgtatcagtataaatctaatcagatcagcatcacccaagggtgtgagcacatttcactgccctagcccacactttcgttaaattttagtgactatcgctgcttatgtatggctgacatgtggaggatgtctcatgggatgcccgccgatgatgcatgggggtgagcgcgttttcgcgtggggcggggccatcggagaggctcggcggcggcggcggcggcggcggcatggttgactcgggggcgttgagggtggaatcctggtggtcggtggtgctccggcccggactcataccgaaatggcccgacacaggtactctgatgtgaaggacctttcgtgggtcgctgcaagcacgctgtccacccaggcagagatagcgccgcactgtcaagcacctaaatgctttgtctatgtagtactctgaaaaaaaaaaaa

SEQ ID NO: 14978 - DNA, 416 bp, Triticum aestivum
  Clone ID: PAT_TA_14978
cggcacgagctatctatccatctatctactcagctttgcgtcctcccgcgaattcaccgcagcaatggcgtccctcgtcgccgtccagccggtcgccgtgaagggcctcgccggcagctccatctccggcaggaagctcgccgtcaggccgtcgccccgggcgctctgccgcaccacccgcaggccgcgcgccgccgtggtggccaagtccggcgagaagagcggctacttcgacctcgaggacatcggcaacaccaccgggcagtgggacctgtacggctccgacgcgccgtccccgtactaccctctccagagcaagttcttcgagacgttcgcggggcccttcaccaagagggggctcctgctcaagttcctgctgctcggcggcggatcgctggtggcctacgtcagcgcgt

SEQ ID NO: 14979 - DNA, 384 bp, Triticum aestivum
  Clone ID: PAT_TA_14979
ggctcctccccggtcgcggagtcgtcgttctcgtcttcggtactcgcgcgcgccagctcacttcacctcctcctccctttcccttccccagatcttcctccatccttccctcagaatcccagatctctctcggccccgtgcccagcgctcccaaacccttgcgccgccgcgggtgccaggccgcgagcgtcgccatgggcatcggctttacgcggctcttctcgtcggtcttcggcaaccgcgaggctcgcatcctcgtcctcggcctggacaatgccggcaagaccaccatactctataggctgcagatgggagaggtcgtctccacgatcccaacaatcgggttcaacgtggagacggtgcagtacaacaacatcaagttcc

SEQ ID NO: 14980 - DNA, 641 bp, Triticum aestivum
  Clone ID: PAT_TA_14980
ccccccctcgccccccactccccccggtgcgcaccgatccgaagagatggcggcgccgccgctgccgacgcagatcgtgaagaagcgggtcaagcagttcaagaggccccacctcgaccgctacaagtgccttaagccaagctggcgcaggccaaagggtattgactcccgtgtcaggaggaagttcaagggatgcaccttgatgcccaacattggttacggctctgacaagtcaaccaggcactaccttcccaacaagttcaagaagtttgtggggcacaatgtctctgagctggagttgctcatgatgcacaacaggacctactgcgccgaggtcgcccacaacgtctccaccaacgaagcgcaaggagattgttgagcgcgccccgcacctcgacattgtgggcaccaacaagctcgctaagctccgcacccagaaggccgtgaaatgggattttttctcttcggctcctgcggggtatccttctgccaagatccacccgcccagccttgtttgtgaaatcttcctccgacgaataaccgtgataccgaccgtgttcacgcaccaagcggcggaactgtggctcaccctgcagttgccttgcggctatccgggtcctctctgcttttaaaaaaaaaaa

SEQ ID NO: 14981 - DNA, 630 bp, Triticum aestivum
  Clone ID: PAT_TA_14981
cctaaatgcaccagccactgttgagcccttgttgtctgaggccaacctcccattcaaccctgccaccgtctttgctccaccttatgacactgtgtcgtccttcactagtgcgaagaacttggtgttctgtgagggcaatctgtaccaagtttggaggaacgcaagctgcactgttactctgcagctgcctgcaggaggtcagcgtcgcgtcgcggaaaatgagatattggtgcttaggtactatcctcgacggcagccttgctgggatgtggtgaaggacctgggaggtcactcgctttttgtgggaaggaacaatgcagtgtcaatgtatgcagagggtgtggcaggactgaggggcaactgtgtatactggattggtgggcgtggtagggatcaaggcatggtttttgacatggaatctgggaggtccacaccatgcagggctcctccggttggctttttacctgggcatccccatagcacaatctgctggtacttcttgagtgatgtaatgagcatcaacaacagttacaacactagcgtcagcagcagcagcagtggaggaagaaaagtttatcagactcgagcaagagcacgagcagatcttgcagacatggaagaatgattgcg

SEQ ID NO: 14982 - DNA, 511 bp, Triticum aestivum
  Clone ID: PAT_TA_14982
gagtgaagaaaatattaaaaaataaaaataagctccgcctctctctcttcctccctcgcgctcgattcacaccacacctcacagcggttcctcctcctcctcctcctggctgcttccccctcaatcccacaatccgccggccgagcaatttccccatgctcccggcctcccggatgacccccgccccgacccgccgctccttctgctgctgcttcgcctgctcgctcaatccccccggagccgccgtcgccgccgccgcccgctagtcctcgcccgggggagcagaagatccggtcttggccgcctccgtcgccaagggctgatcgtggggtggagagcgtgccgagctcgagttccattacatcccgatgagacatattggcattcttctgcacttacgtgcgatatgtacaacccacacgtaggcatgtaccatcctggaaatgttggcgggcaggagcatgacgcagtctatgtagatccgtctagttcctctccataccctggcagt

SEQ ID NO: 14983 - DNA, 971 bp, Triticum aestivum
  Clone ID: PAT_TA_14983
gactatactaaaaactaaaactactctccgcctctctctctttctcccccgcgctccagccaccccacacctcacagcggttcctcctccttcctcctccacccccccacccgccgggcgcgcaacttccccatgccccagggccccagggcctcccgggtgacccccgccccgacccgccgctccctctgctgctgcctcccccgctagctcaagctccccggagtcccggttggcctcaccgcccgctagccctcgcccgggggtgcagaagatgccctcttgggcgcctccgaagccaagggctgatcgtggggtggagagcgtgccgagctcgaggggcagtgcttttgacagagaatttgagcccaacggatgaacatgtgtgagaaagatcaaaatttccactgggcgtacgaccttttccatgacccttttgcagcttccaacagctactatggacatcctaatggttacattgacaacagctattgtgactacagttatgctagagatgcatcacatcccgatgagacatatttgcattcttctgcacttacgtgcgatatgtacaacccacaagtaggcatgtaccatcctggaaatgttggcgggcaggagcatgaggcagtctatgtagatgggtctagttcctcttcataccctggcagtgacgatttgttttgaaatggaggaagatgtagggaagagattgaagcctatgttccaagtgaggaataagtagggaagagattttaccccatggccccagttccccattgtccctgaaattaatggtgaaattccatcactcgacgaagccaccatggaccatgaaaggctgtcagacaggttgaggctctatgaactaactgagaaccaggtgaaaggtgatggccattgtccgttccgtgcactatcagatcagctgtacctgcccccgcgccccctcgagtttgtgagggagcaga

SEQ ID NO: 14984 - DNA, 403 bp, Triticum aestivum
  Clone ID: PAT_TA_14984
ctccaacgtgagggacacccagacacaaaattttctgtcaagggatgcaaagtagaggtgcagaaaaatcatccatccgagagcaacataagcctgctacattagtactaatacgacatccgtatatttttttcttcacaaacactactctgtatacgacaaataaaagggcgtcatgcagtatcctcttgtagccacctaagatgcgaaatcagaaaagaaaagggccgggtgttgtagacagctcaatgttctgagcttgttctgttattgccttttgtctcagactgaacaaacagcaaaaatcttgctcgttgccttgtgtgtatttgaaccagaaggatgaagagcgcctttgtgcactgggctgattaaaattcccaaaaaaaaaaaaaaaaaaact

SEQ ID NO: 14985 - DNA, 398 bp, Triticum aestivum
  Clone ID: PAT_TA_14985
atgcatcgagacaagggaggcatggggcgacgacgcagacgaattcaatccgatgagatttgagaacgggatcacgagagccgcaaaagttcctcacggcctgctggcgttctcaatgggaccaaggaattgcatcggccagaacttttcgatgctggaggccaagtcgacgctggcactgatgctccagaagttctccttcgctctctcccctgactatgtgcatgcgcctgtggatctcttcactctcaaacctaagtttggtcttcccgtgattctgaggccactcaaaatatagattgctcaatcccatgtgtcttttaaacctccatccatatatgtcttttagacatcgtcttactcaatgagttatataattggtagcagaaaaaaaaaaa

SEQ ID NO: 14986 - DNA, 389 bp, Triticum aestivum
  Clone ID: PAT_TA_14986
ggcacgagggaacggcgtcgtcgcgccgcgcgcgctctgtgacgcccggcatggtcgtggagagcagcagggtggtctttctctcggttggtcgctgtgcgatgtgttgtgattgtgaagctggatcctctggggtcggacgaccgacgggagattgccattacaaacaaggagatagagcggcctgtggtcgccgccgtgtgtttgggtgtgggctggatgctctgctctgctctagtgagattcagatcagatgtacttcctccaaggagcagggttctgcactcttgctgctgttttacgttcgttttgtactcgctacagagctattatcacgtaataaagttgcagtttcttccaattcctaaaaaaaaaaaaaaaaaaaaaaa

SEQ ID NO: 14987 - DNA, 1276 bp, Triticum aestivum
  unsure (1)..(1276): unsure at all n locations
  Clone ID: PAT_TA_14987
cttcgctcctacctcccgggctgaaggtgacaacatgattgacaggtccaccaaccttgactggtacaagggcccaaccctacttgacgctctggacttgctcaatgagccaaagaggccttcagacaagcccctgcgtctcccccttcaggatgtgtacaacactggcggtattgggactgtccctgttggacgtgttgagactgggtgtcatttagcctggtatggttgtcacttttgggccctactgggtcttactactgacgttaagtccgttggagatggcaccatgaggctctccgggaggtcctcccccctggactgggtcggcggcccagccctgcttgtggctctggacttgtgcagcgtgcctaagggcccttcagacaagccacggcctctcccccgtcgctgctagtttaacttccaggtcatcgacatgaacaacctggggagtgtggagacgggtttcatcagccctggtatggttgtcacctttggtcctagtggccttacaactgaggttaagtctgttgagatgcaccacgaggctctccaggaggcccttcctggtgacaatgttggcttcaacgttaagaatgttgctgtgaaggatctgaagcgtgggtatgtggcctccaactccaaggatgaccctgccaagggagctgcgagcttcacctcccaggtcatcatcatgaaccaccctgggcagattggcaatggctatgccccagtgctggactgccacacctcacacattgctgtcaagtttgctgagctcgttaccaagattgataggcggtctggcaaggagcttgagaaggagcccacattcctcaagaacggtgatgctggtatggtgaagatggttcccaccaagcccatggtggtgcagaccttctctgagtatcctcctcttggtcgctttgctgtccgggacatgaggcaaacggtggctgttggagtcatcaagagcgtggagaagaaggacccaactggagccaaggtgaccaaggctgccgccaagaagaaatgaggtgtctggctggtcctgtgtttgctcgagggattacctagtgggaacgtaaaatatcgcctctgctgctcgtccgcgtccgacctatccgcgctgcctttgcctggccgatttagcactgttattttcgttaaaaccagagtgttatttaagacttatccgaacatctgggtgagccatatatggttacnattttgttactaccttgttggtgttgtgtgcctcaaaaaaaaaaaa

SEQ ID NO: 14988 - DNA, 397 bp, Triticum aestivum
  Clone ID: PAT_TA_14988
agttgtttccacaatgaagctttacggtgtatccagatcggattattgtgtgtgcaagacaatccagatagtaggccactcatgtcgtcagtggtgaccatgcttgagaatgaaaccacaccagttccggtaccaatacagccaatgtatttctcataccggggaacaacccaagggacagaagaaaatactagtagttctactaataacatgagcctcacaacagtgttagagggacgctagttgtttgtatgtccgtttctggaatagagatgtgcaatagtgcattagagcttatttgttttagagaagttatatattgatattacatgaagatgcaaacagtgaaaatttaaaaattatgatttgaagttaaaaaaaaaaaaaaaaaaaaaaa

SEQ ID NO: 14989 - DNA, 647 bp, Triticum aestivum
  Clone ID: PAT_TA_14989
cacacgacacgaaccaggcagctgcggacggaggaacccgggcggaacctgtgacggcagcgcgctaccggcgacggggggcacggcggcaccgtccccgccgcccgccccggcgccgccgcacccgccgccggccggcgcgctggctgcggagcgcgcaaggtgatctcgatcgccgccaatgtccgccgctgcctgcctctcgtggtgttcaagcggaaaaggatacggcacgatgaggaggtgcccttgattgatccccggaaaggagcttcagcaatgacgggacatgtaaacggttccccctctgtccgttggcttttgccccaaacagaccattctttgctgaaccggctactgttaggaaagggggctcatttcgctggcgccagcccggaggtctaagattcactggtctccataccaaaatgggagtcctctacatttacgagggacctcctgtaacccggaaagaatcaaataacactctcgatgcaaacgttagactgggtcttgtcttaaaccatgttatattgctttgttgccgggcatttaagcaattaaggcctgtgaaactgaacttgttttcccccatggaaggcatttgtatgcccgatttcgtctaccccgtccgggggggtttttaa

SEQ ID NO: 14990 - DNA, 770 bp, Triticum aestivum
  Clone ID: PAT_TA_14990
gcacgaggtagtcgtgtccgtggccgtccacttctgattgatacatctgcaaggatcagtgatgacaaacccaagcctcgacctgtatcatcacgtgaggagcataaagtcaagacaaatggctcggtagagatcaagtctgcttcacctgagaatgctagtttaagcaactctgaaaagcaggaacagaaaaaaatggtacctgaagatgctcgggcgaagaagattaagagtgataatgtgacaccagtaacaccgtctttagatcctgctacgtcaacttctaagactggtaaagggaagacacgtgaagcagagcccactgagcggcaaggtgatgggtcagtctcggtggctaatccaaagaaagaatctagaccagcttttgaagataacattgttctgggcgtagcccttgagggctccaagaggacactgcctattgaagaaggaaatccttatctatcactatctgagactgagctggacaacgaagaggcggcttcatcaccgaaggataagataggtcaaagcccaaaactttgaggtcaagagaaaagccgttcagaggaatctcagataggtcatccgagttcaaactgtatatccttgtgaagatttgtcaccaagcctaccttttttgtgcgcttgtgcaaatgcaatctagtacgacacatcagtgttctatgtttaaggtgtaaattgccactgatgattattcaggggacattacctgttgaaatatatcagtcgcattgctataggcttgt

SEQ ID NO: 14991 - DNA, 733 bp, Triticum aestivum
  Clone ID: PAT_TA_14991
atttcactccatcgtgcgtcggccatgtcgagcttgatggacaaggcgaaagggttcgtggcggagaagatcgcgcacatcccaaagccggaggcgtcgctggacagcttgtcgttcaaggggatgagccgcgagtgcatcaccgtgcacagcaacgtcaacgtctccaacccctacgaccaccgcctccccatctgcgagctcacctacaccctcaagtgcgccggcaacgttgtggcgtccggcacgatgcccgatccggggtggatcgcggcgagcgacacgacgaagctggagataccggccaagatcccctacgacttcctcatctcgctggtgaaggcacgtgggccgggactgggacatcgactaccagctcgacgtcggcctcaccatcgacctccccatcgtcggcaacttcaccatcccgctctccaccagcggcgagatgaagctccccacactcaaggacatgttctaattatcttatctctaatctcatcaaccaactccgatcgatcgaactctctgtatgtgtgatgtgtctcgcgaataatggcagctgctctgcacctgtgttcttcttgccctgcatagtatagcatggctgtatgagcagctgaaaaattacctctattcctaatggttgcaataataagctagagaactgaacttttgcttgtttatgtgctatgtgggattgcttgtgattggcaaaaaaaaaaaaaaaaaa

SEQ ID NO: 14992 - DNA, 313 bp, Triticum aestivum
  Clone ID: PAT_TA_14992
ttcggcacgaggagcaggttcctctcctggaagtggtagaagtaagaaacaacagaggtcaggaattggttactagagtttcaggatactctgggcccatgcattatgttaccttctccttcagcttggttatctgctgctccagcagttgtgtctgtcaaaacaaaagtaggatgcatatcaacttgggcgaacagtatctttgttatcgtctatgtagtaatttcagaggctagggtttatgtgggaggtctggcatgaactaaccttctttcctctgatgacgtgaagactcttcgccagtttaacctcc

SEQ ID NO: 14993 - DNA, 544 bp, Triticum aestivum
  Clone ID: PAT_TA_14993
cattgaagaagacaaggcctgataaagagctataaagaaaagctgggcaagtcaagtcagaaagagataaccctcaaggatgatcttccattgagagatagagctgagctgtatcaaacatatttgatgttctgtatcactggtgagactactaatgtttcattcgggacagcaatctcctcgaagaaagacgattcggagtatttaatgctaaagcaattgggacgcatacttggtttaaccgccaaagaagctcaagatgtccacattaagctggcagaaaaagcatttgtgcaacaggctgaagtggttctagctgatgggaagttgacagaatccaaggctgaccagcttgcaacgatacagacgcaggttggtttgccatctgagcatgcacagaaaatcattaagagcatcacaacgacaaagttgtctagtgcaattgaagcatctatatcgcgaggacagattggtatacagcaggtccgaggattgaaagacgcaaatttcgagctggacagcttgatttcagaaccgttgcgag

SEQ ID NO: 14994 - DNA, 444 bp, Triticum aestivum
  Clone ID: PAT_TA_14994
aatgaacgagagaggatcgaaaaacagtgtggttttgtctctacattccccgagcatttgctgatcagagcctcaaggctcatttgagctcagaacctgatgttaagcatataaagataaactcaagcatacaatttgtcatacttgccagtgacgggttatggaaggtaatgaaaaaccaacaagctgttgatctggtaaagtcaaccaaggacccgcaaacagcagcgaagcgattgacgtctgaggccctagggaggatgagcaaggacgatatctcatgcattgtcatccgtttccgatgctgactgactcctgcgtaatccagctcatccattgaaccttttgccttaagctgcctctgtgcatcagcagtattctcttttttccccatacctgatctgtgtacattgcagttggtagcgtctggatctgttgcagctc

SEQ ID NO: 14995 - DNA, 652 bp, Triticum aestivum
  Clone ID: PAT_TA_14995
gccctttactaggatgcgctcatcagctcctgtgcgtgccgccgtcgtccaacaggtttcactagtgccgagtgccgagtagagcttgcacgtacagagcatggcgagcatcttcttctccgaggtcgcgccgtggcagctcgtccccgccgccgccgtcgccccgccgaggtcggccaagctcgacaccatcgtcgaggacgaggaggacgacgtctccggcgtcagcatggcgcacgacgccgccgttgccgggtgctgcttccagagtggtggggcttcttcttcgtcgtcgtcagcttcggtggcgggcggcggctactcctgaaccggccggcctctacggcgcggcggctggcgcgcaccagagtcatattgttgaggtgaaattatcgtgtgtgcgctcgggataaattaaataaataaagaagaaagtttatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtgtccctagcaattatatttagacgttgcaaaagggcatgacacgtcggcttgtgtaactatatatagtttactatgtt

SEQ ID NO: 14996 - DNA, 630 bp, Triticum aestivum
  Clone ID: PAT_TA_14996
attcaggaacatgtaaaaaatgtacaggttatgtacatttaccaaacacgcacacacacacacacacacacacacacacacacacacacggcctagagtacaaagtgcgtagaaaatggatggctttcatcttcaagggaaatcgatgtggatcaaaagtagtctgaaagaactgatgcagaaaccctcttcaaggatgaggaaagcctggagatgtctgattcagtatgtccagctgatacaaacaggcggattccaaggggaagtttgcacctatccagatttgacttctttgatgtcacaatgaaaactgaatcttccttcaagaccttgtcagcaatagtttcaagaagatctagatcagtggtaggagagccagttgatttcttcagcttaaggaagacgataggtgacagaacatggctggaaatttcaagccctggagtatctgatagttctttatgcaaaagagcaatattgctccttaggtttgcaagaactgagggattctcctccaggtagttgacagcagaaacagcagcgctggcaagataaggtggcagagatgcagagaaaacatacccagagctgcttagacgctgatgatcaacaactctgcctcgtgccgaa

SEQ ID NO: 14997 - DNA, 382 bp, Triticum aestivum
  Clone ID: PAT_TA_14997
ggtagcgctaccgttgaagcaccaagtcgaggcaatatcgagtcaacatctggttcctcactctcagctgatgaaccaattgtagttgggacagaggaaattgcaagagttgcctcattatggtctggaataccagtgcagcagttgactgccgacgataaaaaacttctagtttgactagacgacgagctcagaaaacgtgtcattggtcaagatgatgctgttgtggccatatctcgtgcagtgaagagatcacgtgttggccttaatgaccctgacagacctattgccacgctgcttttctgtggtccaacaggagttggtaaaacagagctcaccaaagctctagcagcttgttattttggatcggaatctgctatgc

SEQ ID NO: 14998 - DNA, 736 bp, Triticum aestivum
  Clone ID: PAT_TA_14998
gcacgaggctcactcgcatcctccaggccatcctcaaggtgatttttgagcatgccaaggataggcctatacttttctctagttttcagcccgatgctgcacagctcatgcgtaaattgcaaggcacatatcctgtctacttcctgacaaacggagggacagagctatacaccgacgtgagaaggaactcgttggaggaggccgtcaagctttgcctcgcgagtggcatgcaaggaatagtttcagaagcccgcgggatattcaggcaccctgctgctgtaccaaagatcaaagaggctaacctctccctgctaacctatggaacattgaataatgtgccggaggcggtgtacatgcagcacctcatgggagtgaatggggtgatcgtcgacctggtgccggagatcaccgacgcagtctcggagctcattgccctgcccgagcctgacctggaagtggacaacttgagcaaccaggcagctagaggagccacaacaccgaatttctcgcagcgcgagatctcgttcttgctgaggctaattcctgagcttgtccaataatgcctagacttccaggatgtctatcatggatgaatcatctaatgtattactgatctagtgatatgcatgtatacaagaaaagaagcccttgtgcagggtatttgtttgtcctggtcccagttttacttttggtgataggaatggggatttgataatgctggcaaaatattcagtgc

SEQ ID NO: 14999 - DNA, 414 bp, Triticum aestivum
  unsure (1)..(414): unsure at all n locations
  Clone ID: PAT_TA_14999
gcacgaggcacaaatcgaggaaaagcgaggaggcgtaggagccgcagcgaagaccccgtccgtctcccaaggccgaagaagccctcgccatgtcctgctccgtcgccatccctagctcgccggtgttctctccgtcgcgccgcccgctctcctgcaaggccgcctccgcctcgcccgagtccgtctccgtgtcgtccccggcgccctccaccgccggctcgccgctccggcccttcgggctgctgcgcgctcagatccgcgaggaggcctccccgtcgcctaagacgtcctctgcggccccctccgtcgccgccggatcggtgctgaagaggcggcggccggcgccgctcatggtgccggtcgatggcgccgcggccgctgctgccccggcnnnnnnnnnnnnnnnnnngtgga

SEQ ID NO: 15000 - DNA, 589 bp, Triticum aestivum
  Clone ID: PAT_TA_15000
cgagtatgatcagatgttatgcgaggatgagacgaagaacagaatgatggagactaaagaactctttgattgggtgctaaagcaaagatgtttcgagaaaacctcattcatgttatttctcaacaaatttgacatatttgagagaaaaatacaaaaggttcctttaagtgcgtgcgagtggtttaaagattaccagcctatcgcacctggcaaacaggaggtggaacatgcctatgagttcgtgaaaaagaagtttgaggaactctacttccagagcagcaagcctgaccgtgtcgaccgagtgttcaagatctacagaacaacagccctggatcagaaacttgtaaagaagacattcaagctgatcgacgagagcatgaggcgttccagagaaggaacttgattgagataagccacaagacaagtaactagaatggtgagaggaacagaaagtttacagtgtcacagctttgcctattgtgattcttttttttacatgaggaacatttgttgatctttttgctccaccacaggccagaaaaagtatctgttttgtgccgtgggctaaggggaagtttggggtcctctc

SEQ ID NO: 15001 - DNA, 598 bp, Triticum aestivum
  Clone ID: PAT_TA_15001
attagctactatttatggatcatttattaatttttcaccctcaacaatttgatctctaggttttattttcttatttacaattggaggattaacaggtgtaatccttgctaattcatccattgatattattcttcatgatacttactacgtagtagctcattttcattatgttttatcaataggaattgtatttgctattattgccagattaattcactgatttccaatttttactggattctcaataaataattttattttaaagattcaatttattttaatatttattggagttaatataactttcttccctcaacattttttaggtttaaatggtatgcctcgacgatacacagattatcctaataattttttattatgaaatataatttcttcaattggatcaataatttcaacatttagaattattattttaatttattgtatttgaaatagaatttttttaaaaaaaacaactatttttaaattaaatttaagtaattcaattgaatgaattcacaatttaccgccattagaacattcatattcagaattacccttaattattagttaaaaaaaaaacaaaaaaaaaaaaact

SEQ ID NO: 15002 - DNA, 2458 bp, Triticum aestivum
  Clone ID: PAT_TA_15002
ccacgcgtccgatcgaaccaacgcgtagcgcgcgcgcgccgcctcccccctcccccctccgccatggactccgccgccgcggggatgagggactcggcgctcgacctgctggcggcgctgctcacgggccgggccccgccggccgccgccgacggggaccagaaccgccgcctgctcgcgctgctcgccacctccctcgccgtgctcgtcggctgcggcgtcgcgctcctcttccgccgctcctcctccggcgccgcgccgctcgcccacaagtccgccgcggccaagcccctcgcagcgaagaaggaccaggagcccgagaaggaatattctcagcggataatcgctagtcaaagaagtctcttagaagttatttcggagtttccatcagcgaaacctccgcttggtgtcttctttgcagctattgctcctcgccttcagccgatcgatctggatgactatgccgcggaggaaatggcacctacaaggaattcatgtaacgtgaacatcgctttcttcttcctccccacgtatggggatgcttagcggagtttgtactacttggatgaagaattcaactccctcggaagagagcaaagaatgcagttgggctccaattttcgtgaggcagtcaaacttcaaattgcctgctgatcctacagtgcctattataatggtgggccctgggactggccttgcacctttcaggggcttcttacaggaaagattagctttaaaagagaccggggtggaactgggccgtgccatcctgttcttcgggtgcagaaaccgccagatggacttcatatacgaggacgagctgaacaactttgctgaatcgggagccctctccgagttagtcgtcgccttttctcgtgagggtcctacaaaagagtacgtccaacacaaaatggcagagaaggctgcagagctgtggagcatcgtttcccagggcggctatgtgtacgtctgcggcgacgccaagggcatggcaagggacgtgcaccgcgcgcttcacaccagtcctgcattcatttggactttgaaattgcaggaactagccttacatatgagactggagatcatgttggtgtgtaccgcagaaaattcaattgagactgtagaggaggcagaaaagctattagattattcaccagatacttatttctcaatttatgctgaccaagaggatggcactccactttttgggggctctttgccacctcctttcccatctccctgtactgtgagggttgcacttgccagatatgccgatctgttgaattcacctaaaaagagtgttttacttgctttggctgctcatgcatctgatcccaaagaggccgagcggctcagacatctagcatctcctgctggaaagaaggagtattctcagtggataatcgctagtcaaagaagtctcttggaagttatttcggagtttccatcggcgaaacctccgcttggtgtcttctttgcagctattgctcctcgccttcagccgagatactactcaatatcttcctcaccaagaatggcacctacaagaattcatgtaacatgttcactagttcatgggcaaaccccaactggaaggatccataaaggagtttgttctacttggatgaagaattcaactcccttggaagagagccaagaatgtagctgggctccaatttttgtgaggcagtcaaacttcaaattgcctgctgatcccacagtgcctattataatggtaggccctgggactggccttgcacctttcaggggcttcttacaggaaagattagctttaaaagagaccggggtggaactgggccgtgccatcctgtttttcgggtgcagaaaccgccagatggacttcatatatgaggatgagctgaacaactttgccgaatccggagccctgtctgagttggtcgtcgccttttctcgtgagggtcctacaaaggagtacgtccaacataaaatggcagagaaggctgcagagctgtggagcattgtttcccagggcggctatgtgtacgtctgcggcgacgccaagggcatggcgagagacgtgcaccgcgcgctgcacaccatagttcaggagcagggatctctggacagctccaaggcggagggctatgtgaaaaaccttcagatggaagggagatacctgagagacgtctggtaacaattgcagaaatgaacaaacgattcaacaccacttaggaaatctagtgaaatgatggaccgaacatgagaaatgcggctctgatttcgaatatgattggcgccgttttttcaggtctctatgaaggatatatatagtagtgggatttttgttgttgtataggaaacctccagctaggtactgctgtagtattatttgtggaacagaggatgacgattcatcgattgttttgtgatgtctggaatgtgaagctaaataaaggtgcccattcgcatgtcagct

SEQ ID NO: 15003 - DNA, 410 bp, Triticum aestivum
  Clone ID: PAT_TA_15003
tcgtcgtgtacacattgttcgtacccgaggaggtaacaagaaatacagagcattaagattggatcaaggaaatttttcatggggttctgaaggtatttctgctaaaactcgtatcattgatgttatctacaacgcatcaaacaatgagttggtcagaaccaaaactttggttaaaaacgcaattgtcgtcatacatgcaacaccattccgtcaatggtatgaaggccattacgcgttgcctattggaagaaggaagactacaaaattaactgaagctgaagatgcagtattgaataagaagcgatcatcaaaggctgaagttaaatacaagaaaaggcaacgttttgccaaagtagaacctgcaatcgatgagcagttccaaaccttacgtttattagcatgcttgggaa

SEQ ID NO: 15004 - DNA, 741 bp, Triticum aestivum
  unsure (1)..(741): unsure at all n locations
  Clone ID: PAT_TA_15004
gcttccgacaatgacactgactactatgatgaccatggtgaagtcaaggtaagggataggctcaattccaccttctggcagcgggtcggtccgatcggatgcgtgcagtcgcgtgtcaagagggtggtgttcgatcagttcaccnggggggacaaacgaggttgggttcctgaagctggtccttgggagagctgtgctgctgcagaaggtgacagtcgtgctggcccgtccggattctgtggcgatgagtgaggccatgtgcaaactccagccgttggcttcgaagagaatgtgggccactcaggttgtggacaatccttcctttgaagtctctgggcgtgtggcaggccatttatgttggtacaaagaagcatctgatctttctatcaccgacccgttcatttctatgttaaggctgtactgatggagcattcgttagaagcgtccgcccacgcgtccggctgtttatgttaaggcagtaccaatggagcgttcaccgccattggctgtttgagtgacttatttctatgttaaggcagtaccgatggagtgttcattagcgttgtcgtttgaatgactcgtatctctttgtgaatggtagtgatgcatcgttcaaaaagcagccttttttgggtgttggagatttgggctgcaaaagacttgtcatggcttggatatgcagttactgtggctgttgctcaaaaaaaaaaaaaaaaaaaaaaaaaaaaaaaaaaaaaaaaa

SEQ ID NO: 15005 - DNA, 778 bp, Triticum aestivum
  Clone ID: PAT_TA_15005
gcacgaggcttctgcatgtgtgacattggtaacagcactggtgtcactttttagtaacagaaaagtcagagcagatactgctatgactggagagatgactctaaggggccttgtattgccagttggtggtgttaaggacaaggtacttgcggcacatcgctatggaatcaagagagtaattttacctgaaaggaacttgaaggacttatcagaggttccatcaccgattctctctggcatggagattctgcttgtgaagcgcatcgagcaagtactcgaccatgctttcgaaggaggatgccaacttagatcacgttccaagttatagcacccaactcgcctttgatatggatatttgcttcggaggatcatcgtcacagtaccacgaatgatcaacagtctgagagtaagagcctagctctcttgccagcacaggtcttggcacgccctctttcgttaggcttcgcatccggaatgtgtatacttgtcagaattcggagagcagtgagaagatctgctcgttcctctgctgggattccctgcatattttttgcgacaccagctgttgatctttatacacatatgcaagacaaatctgggaggaacactggttggttcctctgtcgataatatgggtgtatatgtaatctattccagggaaatatagctaaaacgaggttgtcaaatcaaaactaaagagattgagaatcatcatacgtcctttggggttgggtgacttaattaatatatatcatatataggtcgaatccacttgtgt

SEQ ID NO: 15006 - DNA, 505 bp, Triticum aestivum
  Clone ID: PAT_TA_15006
caccatcccgtcacccacccacccacccacccgtccacagccagccaaatccgcctccgatccagcgcccacccaccacggtttccagtgagttcgagcgaggtaagcttagatctgagcgagttctcgcgcgtcgcaggtaaagttcactcgaccctctcatccttttccctgctaatctcatctccttcttgctttggtctcgtcttcctcgagcagtcagcgagagacccggggccttttagatcctgggcttcagatctgcgatttcttcttcttcttcttcttcggtttggttttagcagtctagggttgttagtaggttggtagccaagaggggttctttttccacacctcccttgtgcaagtaagttcctgctgagcagatctacccaccagtgccatctgtttttactgtggctgttgggttgtgccagtttcttcattttgttcttggtttgctatttgctagagagaaaaaaaaaaaaaaaaaaaaaaaaaaaaa

SEQ ID NO: 15007 - DNA, 450 bp, Triticum aestivum
  Clone ID: PAT_TA_15007
gcacgagggtgaccgcgaccccggccccgtctgccacgacgtcgcgcacggaccctatcgtggccgcgccgagccccgtcactaagcaccactgagcagggagccgtccatgccgcgaccaccaccgggaagctggagccttgctgtgcacacgtcggagccctgtctcacccttcgccgagcgtgacctgggggcaccatcgcctcgatcaccatctgtacagcagcaggcgtccgccaccttcctcgcgttcgtcaaggtcgacctttttgcacctagtcgacgcccttcgcgacgtcgacgaaacccttgttattttctcatacccttgtatgttgatgattcatgatcatagtcatctatccatgtcatacatcttctgtcttgttcgattcaggatttatctatacttgttatatgatctaaaaaaaaaaaaaaaaaaaaaaaaa

SEQ ID NO: 15008 - DNA, 794 bp, Triticum aestivum
  Clone ID: PAT_TA_15008
cgtccggagcatcagggccaataatgccgcaacgcgtctccccctgtctgtctctttcatcccccctctctctggctgtcgtcgtcgtcccttccatccccgccaccacctccttctcctccttcttccaagatctcctacaccactttgtctcttcttctccctccccgcaaactccccttgactccttccaattcgatcccgtttcgcgctgctggtttggccgggtatcttggctgcttccatcggatttggataaaacaaataccgtaacggaaagcgggacgctgctatcctccctcccattgccgctcctgctctgaatcgtgtccaattccacgcatttgttccgggcgggtcggggttcgttggcgccgtgcggatccgttacgggaggtcgtcggcgtgcgttgctgtccgtccttgttcttcttggcatgagcgttggggaagatggggctggattactacagcgtgctcaaggtcaaccggagcgccacggaggacgatctcaagaagtcgtaccgccggctggccatgaagtggcaccccgacaagaaccccggcgacaacaaggcagaggccgaggccaagttcaagaagatctccgaggcctacgaggttctgagtgatccgcagaagaggacaatatatgatcaatatggggaggagggcctgaaggcctccgcggaggccggtagctcgtcgtcatctatgaatggctccaccaaccaccgtttcaatcctcggaatgccgaggacgtctttgctgagttcttcggcagcagcaagcc

SEQ ID NO: 15009 - DNA, 910 bp, Triticum aestivum
  Clone ID: PAT_TA_15009
aatacaatggagtcaaggtcactactgaagatggcacaagctacttcgctgacgcttgcataatctccgtgccacttggtgtgctcaaggcgaacgtaataaaatttgaacctgagctgccctcatggaagagctctgccattgcggacctcggcgtcggcgtcgagaacaagatcgctatgcactttgacagagtcttctggcccaacgttgaggtgctgggaatggttgggccgacgcctaaagcctgtgggtacttcctgaacctgcacaaagcgaccggcaatccggtcctcgtctacatggctgccggaaggtttgcccaggaagtggagaaattgtcggataaggaagccgtcagcttggtcgtttctcacctgaagaagatgcttccagatgcctctgaaccaacgcagtacctggtgtcacgctggggctccgacccgaactctctggggtcctactcctgcgacctggtcggaaagccggccgacgtgtgcgcgaggttctccgcccccgtggataacctgtacttcgccggcgaggcggccagcgccgagcactcggggtcggtgcacggcgcctactcgtcgggcattgccgcagccgaagaatgcaggaagcgcctactgacgctgaagggcatcccggacctggtccaggtcgcggcatgggaggagatggccggagctgtggctcccctgcagatttgcaggacctgactacctgagtgagctggatcagtgattcagtggctgccttggagtggtttgatgacgttgttgctgcttcctgacgatcgcgaaagtcctttatattgtgtaataatgttattatcttgaacgtgtgtattgtctggaataagtcaagatcgactgatactgaacttattaaaaaaaaaaaaaaaaaa

SEQ ID NO: 15010 - DNA, 648 bp, Triticum aestivum
  Clone ID: PAT_TA_15010
gaggccgagggctaagtgagctagccactgatcagaagaacacctcgatctctgagagtgttttttcagctttagcttaagcaggatggagcaccaggggcagcacggccacgtgaccagccgcgtcgacgagtacggcaacccggtcggcaccggcgccggacacggccagatgggcaccgccggcatggggacgcacggcaccgccggcaccggcggcggccagttccagccgatgagggaggagcacaagaccggcggcgtcctgcaacgctccggcagctccagctcaagctcgtctgaggatgatggaatgggagggaggaggaagaaggggatcaaggagaagatcaaggagaagctccccggcggcaacaagggcgagcagcagcatgccatgggcggcaccggcaccggcaccggcaccggcggcgcctacgggcagcagggccacggcaccgggatgaccaccggcaccaccggcgcacacggcaccaccaccaccgacaccggcgagaagaagggcatcatggacaagatcaaggagaagctgcccggccagcactgagctcgacacaccaccacaccatgtgtctgcgctgccggcgacggccgccacgtcaccttcctgaataatagatgagctag

SEQ ID NO: 15011 - DNA, 540 bp, Triticum aestivum
  Clone ID: PAT_TA_15011
tggttatccaaatctctacagggtaggatcggagtactaaataccatgtgaaaaataggaaaattttgatgttttattagccatggaagtaggcgccgtatggttcacaatttcatgtcaataatagcttctctgccaactacctcaacttaacacgtcttggatggaatttaatacgattccaatcaaccagctgatgcgcacatcctttaattagctacgctctaaggtataaagccgtcctcgtgagagagtactactcatcaagctgtagttgtacgtacatggtacatatacgttaccctgtatatatatacctgtatcacgtcgtgtgcatgattacacttacaaagcaactcgtcccaacctgtaaaataaagtattcttgcatgcttctgttcgatcatgtgatccgaaacttcgatctccttggaaatgataagctggactgtaggaggacaaacaataatcttatgtagatcatgcctttgcctggacatgccagttcggtcgaaaaccgatgactgctctgaagatttc

SEQ ID NO: 15012 - DNA, 647 bp, Triticum aestivum
  Clone ID: PAT_TA_15012
tcggcacgaggggccagttaacactccatggagagcctctcagcaaactaatatgtatggtgtgccaaacagtgattttggctcaggtcagtaaaacttcaagttccttcctgctctctctctctctctctctctctctctctctctgtgcgcgcgcgcctggtgtgtctctggtgttaccctacttttcccaaccattagctgcttgtttgagcagggaggccttcatttgcgtcaacacataatgaagctacacctggatcattttcaagatcgtacgttgagacatctgctgcacaccgaggggataataggtcttcagggagtaagccatgggagatgcagcaatactcacagcagaggattggctacggatccaacagccagttgagtgatgacggatgccctgaaactcaggacaactatggcgggggaccttcgtattcgtatcaccagaatcagaatcagaacgggaaggctccggctccggatattcaagcagaggaggccaggccatcggtatacataagtggggctgaggaaaggtcgcctccgcctccgcctcagcgccgctgggttcccccgcagcctccgggcgttgtgatgccggaagctgtggctgccatccgtcaaccaaagtccctcgc

SEQ ID NO: 15013 - DNA, 652 bp, Triticum aestivum
  Clone ID: PAT_TA_15013
tggtgtttttcccggtgataaatgaagcctgccgagtccttgatgagggtattgcaccgaaggcttctgatctacacattgcttcaatcttcagcatggggttcccaccttatacgggcggtgtcatatactgggcagattccatcggtgcaaattacatccatggaaagttggacgagtggacaaagcggtatggtggcttcttcaagccttgctcttacctcgctgagagagctgcgaaagggattcctctgagtgcaccggcaaagaaagctcacgctcggctataagacaaacaccaggtttccttgtggacggaggatactacactgaataatacactccagcgaacgcgcggaatatggagcatccggagtgccctgaagtagaccagcgttgttgcgttgcgagaatgcatggagccgtagatgactgaagtagaccactatcagtcatggaacgcaatatgctactgtgaaataaagtagggaactgtagcacggtggtggtgtcttcctttatattgttgcaagcccagctatagggcacccttcaaaatacaaaaatgttttctgtcacctgtaaaaattaaaacagtttttttttgtgcaatttcatgagattgaggcactgtttcaaattcaaaaaaaaa

SEQ ID NO: 15014 - DNA, 552 bp, Triticum aestivum
  Clone ID: PAT_TA_15014
tttgctttccctctggcttgtctgacagaagaggcaacttctcagtgctattgtatggatggatggtcagcaaaagctgcatgagtactggctatagtcacacgtgaatataactacaaaagtttcatgggtgctacgtgatttggactcgagcctaatatttgtgcacgatcctagtacttattatttcaacatgagcttatatgaatttacctatttgtgcgtcaggttgtttttgtccaatatgtagggagctagcagaggcaaccacggagctcacagtactcgccactacaggataaggagtcttcttcatgttcaagccattagaactaggacatggctagcctctgtgggtttgctatggtgctagttagcaagttggtggatgatttgccactctaagctgatttaggtgctagtctctctcttttggataaccagttacatgagctttatcttacttcgggtagcaagtaggtttacttggagtatgttggtgggacatgtaatatgaaattgttaattagcaagagactattgtatataatt

SEQ ID NO: 15015 - DNA, 975 bp, Triticum aestivum
  unsure (1)..(975): unsure at all n locations
  Clone ID: PAT_TA_15015
caacgctcctctctctctctcccccatctctcgctgtcctccgcggcaagtcaagtggaacgcgaatcgaaaagcagcggccggaggcggaagggagcgtgacgccgccgcccgccatgaggctcctcgtccccgacggcgcgcgccagcactccgaggccgcgacgccgcgccggcaccgcccgccgcccgaggcgccgccggaggccagcggcaggacggtggcggtcgggatcaggtgggacgccgccagccgcgagctcctcacctgggcgctcgtcaaggtcgccaatgccggcgaccgcgtcgtcgccctccacgtcgccgcgggaggcggaggaggggctgggctggaggagaggaggaaggccgcggattcgctcgcgacggtgctcgccgtgtacgacggcttctgcaacctcaagcagatcaatttggagctcaaggtctgcgcaggatcgtctatccggaaaactctggttaaagaggcggcttcatgtggtgctgcgcatctgatcctcggtgtcgcaaagaattctcggtcttttggatcctcctccacttcagttgccaagtactgtgcaaagagagttcccacgagttgctcgggttcttgctgtcaacaatggcaagattttttaccaaagagctgcagcacgcgaagaaccatttaatagcactagcccacccgagactccaaggaggagttaccggaagcttttgacttccctgataggagagagatctcaggatgaatgtataaaggataacaggtccatttctcgggctgtcaccatgccaatgaggtctcacacatcgcnaannnaagtttcgctagcattggttccagttannnnnagccgacgtgaatcgnnagaagtagcaactggctggccattcctnnnnnngaagttattgccaaaccgacannnntgcgttgtctgacaagcccaagntgtctgtggtncagnngnn

SEQ ID NO: 15016 - DNA, 947 bp, Triticum aestivum
  Clone ID: PAT_TA_15016
ttttaacaaagtggtggtggtgtaaatcgcctttggagcagcaacatcatatagcaaaccagcagctccatctataaatccaatgtctggtgcaaagttctttgtgccaactccagctactgttgcttcagaactgatggctgagccaggtgcccacagtgaaaccacgcgacaggatgaaccatcttcctcaccagcgatggagacagcattcagttcgccgccagcactgataccgatgcagtcaaccattcagcggtacccaagtggtgacaacattcagcggtacccaagcggtgacaacattccacagcacccaagcagtgacagcattcagcggtacccaagcggtgacaacattccacagcacccaagcagtgacagcattcagtggtacccaagcggtgacaacattccacggcactcaagtagtgacaacattcagcggtacccaagtatggacaacattgtgtctccctcaggtagcgttaacagctcaatgtcaaggtcaagagcgtcgtcatggagcggaacattaccagagcagttgagcagcactgctgctaccaggtcacctgatggacagatcatgcagtcaccatcgatgcctggaaaaaggcctccgcacagccgttccagcagcacttcttctgcccagttcaatggtttgggtgaagaacttcacgaggtggagctctgacacttggccgcagatttcacctttttgaccatcatgtgatttattactagctggatgtgtgtctagaaagcaaaggaaaggaaattgaaggagaaaaaaaagagtggtatcccttttcaatttttacatgagaagcctgtggatgctgctgcattgtacagatagttcacaagttcgccagatgaaaaatgtataagaagagacgtaggttcaagataggaagttgtagaaaggctgacaatacctc

SEQ ID NO: 15017 - DNA, 774 bp, Triticum aestivum
  Clone ID: PAT_TA_15017
cggcgcgaggcgtgccaggagagcgctgctcctgagatgcttcttgcactgatggacgaggcatatactggttctgcaatagaagaacctagtggtaattcaggctctgatgatagtggtgccctagaccttgctgacccaatgttcttagaccttctaaaagatgagaatgatggcattgctgcaaaacattggatatcccccacgatatcttcaacattacaagcagcatttaactgcccacggtcggggtcgtcgagaccgtcccggcccatggctcctcgccctcctacttggcgtgttgcatcgccttgccgcgatgctttggactcccccttcggtgccctcatccctgcaggcttctcttgacagcccgcggtctgcccggtcaaggctttctctgtcaagggcacctcacgtccttccggtatcttttgcgacagcattgcgggacgtcaacaactcactcttgtgtgctctgattccagtagttatgtcaagatatgctgcgatgttccctcagcaaggatttttcttgcgtggcgcgggtgctgctgtcggatttcttattggctggcattccagcgctcccctgacatcattgcgctactatagaagcctattactgatagactgggggaggcccatggtaatcctgcaaagatagaattagcagtgcatttgtgttgggccattggtgagcatggagcaagagcgtcaaagcacaaagatgtcgcacgtgaactatttgaaaatctggagctgctactatac

SEQ ID NO: 15018 - DNA, 436 bp, Triticum aestivum
  Clone ID: PAT_TA_15018
ttttttttttttttttttgggttataactcaagacatttcacaacatttgcgactggtccgtctaacaaagaacaggagattaaatccgacgtgcggcagaactatgccgctatgacagttcttcatcttacataagcaggttcctagctaagtacaaggtaataaacatacttatccaaacaagttccatagggctctaaactctcgtacaaacattttgttaagttgctgccccccaaagtggcggattttgggtcagccagcttctgtggtgtaatactacaaatgaggcttgtgtggcctcataaaacagagaagctgactcccaagggaaatgagaaacaagcacaccaattaaaccatgataggggggcagttggcatcatgatgctgcccacttttacttttcagttaaacgtctccccgttctgagca

SEQ ID NO: 15019 - DNA, 585 bp, Triticum aestivum
  Clone ID: PAT_TA_15019
tgtattgtaagtagtaattttcaagtagtttcactttagttatgggctgcaggttttagtagtccttgcatctcaggttgcaaatatgctgctcttttttggacacttacataattcctttaccgttttgcaggtgcacaggttcatgtgctgctctattgatttttattgttttaattctagctatataagtccacccaacagcattgcctaattgcagtcaagcgcatatggtaagtgcaattaactaatacttaaatgtagatgaattctttagttcagacatagctatttgcttcatccgacttggtgcttgctttgactgtatttttttttgtggaaccctatcaggattaggggaggtgtgattgcctgtttactttttttggtacctgatttgtacagcaacattggaagccttgttttttctgaaaggttccatgcatataggttgttctaattcagcatgccagattaggggaggagtgattgcctgtttatttttttctacctgaacattgggcgccttgtctctttaaacggttccatgcgtacagtttggcctaattcaacatggctaattga

SEQ ID NO: 15020 - DNA, 617 bp, Triticum aestivum
  Clone ID: PAT_TA_15020
tgctcgcagcctctcttctgcgcgatgtcgcactgccacgcgacgccaggaacctccaccagccggcgactccagactccagtagctagcgccgcatcctcatccttaccgtgaaaaaaacaagcttagtggattgcgagagggcctcggggagtaggcgtcctctccgctgcggcctccgccggcgtcgagcctccttctggggtcgactgaaccgagcaggcagttgcaagagccattatgttgttcttctcctacttcaaggagctcgtggggaaggaggtcacagtggagctcaagaatgacctggcaatacgtgggacgctccactctgttgaccaatacctcaacatcaagcttgagaacacccgtgttgtcgatcaggacaagtatccccacatgctatcagtgaggaactgcttcatcagaggctcggtggtgcggtacgtgatgctcccacaggacggtgtggatatcgacatcctccatgacgccaccaggagggaggcgcgcggaggctgatcggccccgcctgaccagcgctcaccactcaccagctgcttccctgggaccctgatctgatctgattgtacggaacatgcatgcatggtggtgtt

SEQ ID NO: 15021 - DNA, 715 bp, Triticum aestivum
  Clone ID: PAT_TA_15021
gaggctcggacgacccgtatcctccccgtatgtgtcgcaaaaaagcttcactccgttatcctcccccttcacctgttgagatagggtttcgcgacgcggctgcgtccagcgtcgccgtgaggatggcgcggctgcacagaggtggcgtggctgcatcgggcggcgcgagaagggatggcgcgactgcgacgaggaggcagcacagctacgtcgggcggcgcggggagggacgacacagctgctaggaggcagggcagcgagattgttgggttcgtgagctcgccaaggaggacgtcctccactacatctcggcctgaggcggccacgagttctcgcgagctcgccgacaacgaggttctccactacaccatcccatcagtaccagtgtaccaccatcgcgcctccgttatcaattgccgccatcgcccttcgccgaggtcaccgtgcctttactactatgactactaaggctcctcatccccctggctcatgcgcagcaatacaatttgcagagcctggctgggaatcacggcaagatgtttgcgcagcttgtcctcggatggggtctgtagcgtaacactgtggtgatccccatgacctccaaggcatagtaatacattagcacaccactcaaccttcactcattgggacatgtttggtttcaagtgggaacaattgccaagtgaggacaggagctcgcatatgtatgtaactg

SEQ ID NO: 15022 - DNA, 462 bp, Triticum aestivum
  Clone ID: PAT_TA_15022
acctcaggcacgccttcatggtcttcgacgccgacggcaacggcctcatcacccccgccgagctcgcccgcgtcatgcgcgggctcggcgagtccgccaccgtcgcgcagtgccgccgcatgatccagggcgtcgaccgctccggcgagggcctcgtctccttcgatgagttcaagctcatgatggccgccgggggcggcgggttcggcaggatcggtgctgcctagggagaacgacctcctctgctccgctccaacaacattgaattcgtttcatttcattttatgtacatataaacactggaatcacggagattagtaggttcagattacacggccagcagcgctccacataaaaagcgcgatttatttttgtgtataaattgcaaaatctgcatccattgtactgctgtgggatgttcaatggaatgttttggcttcaaattgcactcttttctttttt

SEQ ID NO: 15023 - DNA, 662 bp, Triticum aestivum
  Clone ID: PAT_TA_15023
aatggagaaggttgaacctctttagtgaaatgtgttggcttgatacgaaacaaagtaggtgggtttcggatttgagccactttgaaggggatggtgaatattctgattcgcagctgggtaaactgctaggtcctattcagttgatttctgctgagcaggtgcctttgcagccttaccatagcttttaacctatggaagttagcataccgcttgttgtagcacgcatggagtatagtgtagttcagcaagatacatggttgtttgtcactcaggtgatgtatatagccaagaatggccggccaaagcaaataatattttgcttataaaccactttgtaaatgagaggcgtttatgagagtcatctgatgcgagatgaatgctggtcagttatcctcttcttcctgcgcagtgcgtgtgccccatgaagctgtccgctggacccatgaaactctgcaccaatggttgtggatagcaaatgcgcttctgcgaattcagagcaccagcgtcctttcgtgcttcccagtattcaagaacgccgtggggggagccttggcattcgctggagactagctgtgggcattttttttattttatgtattctattctccagaactttattagcatcagatggactggtaacctggctgccgcgccaatttctt

SEQ ID NO: 15024 - DNA, 533 bp, Triticum aestivum
  Clone ID: PAT_TA_15024
gattcggacgaggccctagccttgtttgcctaccctcccctcgttctcccttgccctggtctagaagaaaagtcgccgcgttccccctttgcctgatgaaatccccttctcgtctagatctgagcctgaacttacttattattcctttctccatgcctagccttgtggtttctggattgcatgcttgtttcgatcgagcaacggtgaatctggctctgttatttgtttgttggaaacgtttgttttttttttttgatgatgatgtgcaggttacgagctagttggttcgaatgatgagatggcgaatcggcttgaagcgagacgaggccgcacggtttgcgtgctcggaggatcctgatctgcgtgattggcgcgttggatctgatgttgagctgggacgttcccgtttccggcgagatctggatcccgatggacgactggaaggcgtccaagcgtggcccgtttgctggatctatcttctgcaccgagcctgtcgatgatctctttgtattgataattattcgatgaaattt

SEQ ID NO: 15025 - DNA, 802 bp, Triticum aestivum
  Clone ID: PAT_TA_15025
gagcagtctccccctcccccctcccaccaccaaaccacctcaccctctcccaccacctgaagccgtagccacaagatcccctcgtcctccccaaccctaaccctatctctgatctgaatctttggttgggctgcaggcttgttgtatcccagatggcgtcctcttcgttatcatcaggagcgcgctcgtcctccaatgctggagatgttggctactatcccaacccatctccgattccttaccgtgagcacgcgctagcatatgagccagcttcgaattgctggtgcgaagagaaaggggcgaggagaatctcttggaccaacgctaaccctggtcgcaggtttctgaactgccaaaaatctcgtgacggaggttgcaagtggtttgaatgaccctactacaccattccttcgccaacttttggtcgatttgcgtgacacggtgcacaacctgcggagggagaacgctcggctcaattgagtcaacgcggaccttgaaatggggattgaggaacgaagctccactaatatttctttgcgggatgcattgcgcaagacgaaggaacgaaataaggctctcgaagaaaagttgggtaagactgaagcccttctcaaggaaaaggcaaatggacagcagaagcggatgctttttagtgtgattttgttagtgttcctcctgtttctagctagcaagcttgcagcttagtatttatcagttgttgttgccctgctcgagctgatgtgctgttcgtgaacaatttaattaatattgtgctatccgctaccaattccttttgtgtaat

SEQ ID NO: 15026 - DNA, 576 bp, Triticum aestivum
  Clone ID: PAT_TA_15026
cagcgaaggtggtggtggcggactggcggagggtatcgaaagcaggggagctggcgctggaggggaaggcggagttgaacgcgcgcgcagagctgttcatccggcagttccgggaggacctccggctgcagaggctcaactccatcctcagccacacccacgccctgggctccccgacggcggcgcggtagccggcgtgcacgccgcggctgccatgatgtgcttgctcgctccgttgttcagacggacatatcctctgacacacaattttggaacattgtttttctttagactcccttactaaattttagctagctaaactttagtcactttagtagctaaagttacaaacatattgactaaaaaaagctaaaatagtttagttccattagtcatccaagagtagctaaaataattttagctaactaaaatttagcgaggggatccaaacgggcctagtttaagtattgttttttttgttattagtttatatgtatacacaagataagaacatcttgttcgcccagctcagcagtacgagacacgtgaaagtgtacaaaatttttaagattccac

SEQ ID NO: 15027 - DNA, 521 bp, Triticum aestivum
  unsure (1)..(521): unsure at all n locations
  Clone ID: PAT_TA_15027
cggcggaagcaaacaactagaaattccccagcccggttccttttcgtgcggtttgatctcgtcggaggcccggccgcagttccgccatcagccatcgaattcgatggcggccaacttcgggaacaagatccgcaacgccaagctggttcttcttggagatgtaggcgctggcaaatctagcttggttcttcggtttgtcaagggacagtttgttgaattccaaggaatcaacaatcggagcagctttcttttcccaagaccttaagcggtaaatgatgagactgttaantttgaaatccggggatactgctggggcaggagaggtatcatagcttggcccccgtgtattatagggggtgcagccgccgccattgttgtccaatgacatcacaatcccgctccttacacccgtgccaagaaaggggtcnagaacttcaaactcaaaggaaacccgaatacaataatggtccttgccgggtaacaaggttgatatccaaatgcaagnacgtggcatnagagga

SEQ ID NO: 15028 - DNA, 1362 bp, Triticum aestivum
  Clone ID: PAT_TA_15028
cccctcctcacctcccggtcgccaccggctctcctctcccttcctcctcctcctcctctccccctccctccgccggcggccctcccctcccccccaccaccccaccccaccccctgcatcgtcgtcggcggccgcaagatgccggagaagggcgggaagagccagagcaagcgggtcacgctcaaggcgaagcacgaggtgctgcgcaaggtcaaggagcaccaccgcaagaagcgcaaggaggccaagaaggacggcaggagcggcaagagcaaggatcgagaaggaccccgggatccccaacgagtggcccttcaaggagcaggagctcaagaacctggaggtccgccgcgccatggccatcaaggagcaggaggacaagaaggaggcccgcagggagagggctaggaagagaaagctcggattacccgacgatgaagacatggctaatgacaatgacgcagcagaggagactgttgctttagcgggtgcctaagaccaatgaccattcggagagagccttctacaaggagctggttaaagtcatcgaagcttccgacgtgattctcgaggttcttgatgcaagggacccactgggcacccgttgcgttgacatggagaagatggtcaggaaggccgatccaactaaaaagattgtgctgcttctcaataagatagatcttgtccccaaagagtcggtagagaagtggctttcatatctaagggaggaattgccaactgttgcattcaagtgcaacactcaagagcagaggaccaagctgggatggaaatcatcaaagctcgataaaacaagcaatatcccacaaagcagtgattgtcttggtgctgagaatctgattaaactgctaaaaaattattccaggagtcatgagctcaagttggcaattactgtgggtattgttggccttcctaatgttggcaagagcagtctaatcaacagtttgaagaggtcccgcgtggttaatgtcggttctactccaggggttactagatcaatgcaggaagttcagttagacaagaaggtgaagttgttggattgtcctggtgttgtgatgctcagatctgccagcagtggtgtgtctgtagcccttcgcaactgcaaaagagttgagaagatggaagatgtaatcactcctgttaaagaaatccttggtctttgcccacaagagaaattgctgtctctgtacaaggtgccaagctttacttcagttgatgatttccttcaaaaacttgctacactcagggggaacttgaacaacggtggtatagtggatgtggaagctgctgcgaacatagcgattcatgactggaatgaaggcaaggtacccctactttacactg

SEQ ID NO: 15029 - DNA, 633 bp, Triticum aestivum
  unsure (1)..(633): unsure at all n locations
  Clone ID: PAT_TA_15029
tctctccctcccttgccttcgtctccgcctccgtcnttcctcaagaagtcgattcccttccccaagaaccccagcccccaccatgacgagctcctcctctccttcccgaaaggcgctgagcaagatcgcttgcaatcggctgcagaaggagctcgccgagtggcagctcagcccccccgccgggttcaagcacaaggtctccgataaccttcaaaggtgggtaattgaggtcaccggagcggcgggcaccctttacgccggcgagacctaccagttgcaggttgacttccctgagcattaccctatggaggcacctcaggtcatttttctcaatccagcgccaatgcatccacacatctacagcaacgggcacatctgcttagatattttgtatgactcgtggtctccagcgatgaccgcgagctctgtctgcatcagtaccctctcgttgtcaattcgcaacaaagaacgtcaatggacaatgaccgctattangaactgcgcaacggaagtcncaaggaacaaatggtggtcatacnacagggtaatgacgcgaanctnctgcgtgaaannctaaggaaatgggagattggcaatgnanaccncacgntgaantactgcggggggtgtaaa

SEQ ID NO: 15030 - DNA, 768 bp, Triticum aestivum
  Clone ID: PAT_TA_15030
aggcacgctcccggcgctcgagctctgctactccatgacccagcgcctccacctggtggacgacgacaaggacaagccgccgctgctgcagcagcagcacgaaggcgctgccgccgcaccggatgcctccgcgccgtcgccgcccgtcaccaactggaagatctccagccccggtgacagcccggacgaggtgaaggcgcggctcaagtactgggcgcaggcggtggcgtgcaccgttcgcctctgcagctgaacgacggcgaccatccacgcggcacaccattcgccgccggcaaacacaccatactatatatcatacatgccgccgccgcagcccgcaagaaacgatcgccgacgaggacaacgaaagagtaaacgacggaccaagaagggacatgccggacgaccagacctcacctgatcgcgaacgcgctgctgctgctgctgccgtcgtaaagtgatggggggcgttggcaactgcatgccatgattgattgcagctggagagtttggtggagcgttgttgcttgttggtagtcgtcggagcagcacacatgggctgggcaggtgggaggcggtttggttggttggttgcccgagttgctgtgtgctcttgttccagctgagcaacctgcgtctccttagcagcagtgatcaaaataatgtgcagagtaattagtaggactactgcaaatctggggatcggagtgattgaatgaatgaataaataaatccacagatctcattatgtttgttgctttcttaatc

SEQ ID NO: 15031 - DNA, 1039 bp, Triticum aestivum
  Clone ID: PAT_TA_15031
gatggggggccgcagaacgatcgtgttgagcctaatccttggcttactggcagctgccaatgcggtgccctttgatttcttttaccttatcctcatgtggcctggagcatactgcgaggacagcgacaatggttgctgcgtgcccaagtacggctacccggcggaggatttcttcgtcgagttcttccaaaccttcgacgtgtccattaacaagcccatagtccgttgcaggaacggcagccccttcgatgctaaaaagctggacaagatcgagaacaacatcaaccactactggaccaggctcaagtgcccgccaaccgacggcgtgaacgcgtggaagagcgcctgggacaactacggcgtctgctcaggcctcaagcagctggactacttcaaggcggcgctcagcctcaggaagcaggccgacatcctcggcgccctcgccgaccagggcatcctgccggactacaagctgtacaacacggcgaggatcaaggcggcggtggccgcgaagctgggcgtcgagccgggtctgcagtgccgggacgggccgttcggcaagaagcagctgtaccaggtctacctctgcgtggacacggacgccaagaccttcatcaagtgccccaaactgccggcgacgctgagctgcccggcgtccgtcgtcttccacccgttctacacctggatgctcaactccaccgccaccttcgactccaagatcctgctccccactcagaccatgctgaactgattaccggatcgatcggactcgattccacaagcgttagctagcctggtttgcaatcctcaacagcttaatttaatctgctctgtcaaaccagccggccgagagcaccatatggatcggtgcttttttattgtccccctaaataataaaccataatgtaatggtatatgtgtaagatcttccagatcgttttttttagtgtgtgagctacatgcatttgcatatacatgtgcaaatgtaataccaataatgaataaacaagagtgttatgcacatgctacgagcttcctt

SEQ ID NO: 15032 - DNA, 670 bp, Triticum aestivum
  Clone ID: PAT_TA_15032
atcaacatgggaaacctgctgtgcataatgttttgcataaggcatcagaaaaatcagcacaggcaaagaaatgggctgaacctcatattgagactgccaagacgaaatggattcctgttaaggaaaaattggttgtcctcaagaaaaatgctgaaccttatgtacaaaaggtatcaacaagatcagtggagttgtatgagtcatcaagggatgctgtgacacctcatgttgtcaaagttaaagagtttgttcatccctactaccaggaagccaagatgttttctaagccttacattgatcaaattgctgagatcactaagccacatgttgagaaagttagaactactctgaagccatacactaagagagcagttcatgcatatgggtcatttcttgagtcggcaaccacataccatagacaggctcaagcaagcatcatggactaccttcaccagcatgacataacaaaatcatttgcaacgaaggagttagtttggtttctggcttctgctttgctagctctgcctgtcttcattatatacaggcttctagttgagacattctgcaccaaaaagaataaaaggcctcgtggtggtaacggtaaccatggccacaagagacagaagcggcgacacgctgacaagtagatcaatttactgaacactttagg

SEQ ID NO: 15033 - DNA, 626 bp, Triticum aestivum
  Clone ID: PAT_TA_15033
ggattcggacgagggtcgaccgcttcgtcccgtcgagcgcctcatcggccaggacctccacggcacctccccctgcgcccaccacctcgtcgacctcgacggcggcgccctggcggcaacagccggcgccggcgccgcgcaccaccaccatcaccaccacgtccacctgcacctcccgcgcttcgtcggctgcttccgcgcctgacgacgacgggcccggccgtcgaggtggttgattagcttttaatttggtttgctcatcctccctccctccctccctctctcgcgttgttttgctttgtgagggttctcatcgatagtagaacacgattggtttgaagctttgtggcgagagacatggatgcatggatgggaggacgcgcgatgcatctagctagctagttgttgacgatgatgacgaaaaatttgtgatgatggtcgatctcaagtgtaaagatctatacagaggatgatgttcatctttagctttagcttttctttttcctttgcttatacgtcaatatatactttgctaatacaactatatatatactctgcgaaagtactattgtagttctgttcctgtagatgaaaccttggcccaaccaaggggataaaaggctctc

SEQ ID NO: 15034 - DNA, 386 bp, Triticum aestivum
  Clone ID: PAT_TA_15034
ttaaaacactgtgtgagaaggccaaggagatattaatggaggaaagcaatgttcacccagttaaaagccctgtgacaatttgtggtgatattcatggccaattccatgatcttgtagaacttttccggattggtgggaagtgtccagatacgaattatttgtttatgggtgattatggggatcgtggctattactctgttgagacagtgacgctgttggttgcactggtagtgcggtacccacaacgcatcacaattcttcgtggaaaccatgagagctggcagatcacacaggtgtatggcttctatgatgaatgcctacgaaaatatggcagtgcaaatgtctggaagatcttcactgatctttttgattattttccgttgaca

SEQ ID NO: 15035 - DNA, 512 bp, Triticum aestivum
  Clone ID: PAT_TA_15035
cgcggcgccggctcacagcttttgttaccctccagcatccgttttctcttttgccgtcgcgaagatcctcatcaaggccctgatggctccccgtgtcgtcgcctccgctctgctcttcgccatggcggccgtcctcgtggcctccgcatcggcgcaggagttcacggcgcctgcgtctgcgccggcgccgggaccggtcgctggagccgcctccgctccggcctccgctgtcgccgtggtgtcgtccgcactgctgtccctgcttgtggccaccctgatgcagtagaagcatatctatgtatatcatctaccgcttatgtatgctactatatacatggtcatggacatgcatggcatggagtagtagtaggttttgtttctagatttgagcgggaatttgatcgatcgatcgagtgtttgctgttcctcattctttttggatcatatatgtctccgacatgtgtatatatatgaataaaggtggttgatctaaaaaaaaaaaaaaaaaaaaa

SEQ ID NO: 15036 - DNA, 1110 bp, Triticum aestivum
  unsure (1)..(1110): unsure at all n locations
  Clone ID: PAT_TA_15036
gcacgaggccgcgacgagccgacgagctctacttcccccttccggccttgggcgaccgtgacgagcgacgacgaccacggcgacgatggccgcttcctccctctgccacgggcacctgctcctgttcctcctcgtggccgtcgcgtcggcctgcctcggcaccgcggcagcgcatcaagccggatctggagaggggtacacgatcgccggccgcgtcaagatcgatggtgcgagtgcgaagggctttggtcttccagccaagacatcaaacacaaaagtgatacttaatggcggccagagggttacatttgccaggccggatggttactttgcattccacaacgtgccagctggaactcatctgattgaggtctcctcaattggttacttcttttccccagttcgagtagatatcagtgcaaggaatcctggttatattcaagcagcattgactgaaaccagaagagttctaaatgagcttgttcttgaacctctaaaagaagagcagtactatgaggttagggagcctttctctgtcatgtcacttttgaagagtcccatggggttgatggttggttttatggtcttaatggtcttcgtgatgcccaagttgatggagaacatagatcccgaggagatgaagcaagctcaagaacaaatgaggaacaaccccgtatcattctctggcttgctatccagagcgcagggctagaagtagagcatgaggatactgcaaaggtctatatactctataatgtgagtaagagcactattaaagtgcttggcacgtcactcactcggggcaatttcctggggataagaaggaaatcctttccccctgtttttaccgtattttagggctagtttggggaacaccaatttcctaaaagatttatattttcccatgggaaaatgaactaattcccttgggaaaataaaatcttttgggaattggggttccaaactagcccttaattgtaattgtctgccgtgtaaaccttctgaaacctctgaactantgatcgtcaaattgagatatttggtcaatgttgcngttgaacaagngaaccttgacacctgctaacacacagacacgggggcggggncaaa

SEQ ID NO: 15037 - DNA, 697 bp, Triticum aestivum
  Clone ID: PAT_TA_15037
attcggacgagggaaaagaaaaaaaatcctattcaaatcgaaacccctctctttgatctcgtcgccgaggaattaggaggagagagagcaatggccgccgaggagggagtcgtgatcgcctgccacaacaaggacgagttcgacgcccagatgaccaaggccaaggaggccggcaaagtggtcataattgacttcactgcttcctggtgtggcccttgccgcttcatcgccccagtgttcgctgaatacgccaaaaagttccctggtgctgtcttcctgaaggttgatgttgatgagctgaaggaagttgctgaaaagtacaatgtcgaggcaatgccgaccttcctattcatcaaggatggtgctgaggctgacaaggtcgttggcgccaggaaggatgacctccagaacaccatcgtgaagcacgtcggtgccactgctgcatctgcttctgcctaagaattctcgcaggcgcaagttatcaaataagggccagcacctggtgttgtagtaggtattagcgttagtcatcgttatcgtcagtttggcttgggtgtcctcgaatatcatgcgaaatcgattccgagttctctttttaaaattcctgatgatgatatatagtttgtggaaatttggatctggctattctgtacgagtttgctgactattaaagcaattattataatatgatgatgct

SEQ ID NO: 15038 - DNA, 316 bp, Triticum aestivum
  Clone ID: PAT_TA_15038
ggccccggcgtcgagcgccagcaagaggtctccaacgcccccgcctacggccgcccgcagtacggtggtccccgccgtgaccgcgtctaggcttcacgctgttatcgccgtggttgcctcttgatctgccattcgtagttactatgctactttgttaaacttatctttggttgcttctgaggcggttaagttttgaacttgtgttatgctataaattcttaagtgtttgggtctgcgtgtgatggacatgagatttatattctcgcgccaatgaagtcttaagatattttataagttaaaaaaaaaaaaaaaaaaa

SEQ ID NO: 15039 - DNA, 733 bp, Triticum aestivum
  Clone ID: PAT_TA_15039
acgaggcttgtctctgctaccaccacgccaccgcgtttaggagagaatagagcaagagcgagagcaagcaagcaagcgagaggtttcagctgatccgatggcggccgcggcggcagcagcagacggggagcggaggatcggggtggccatggactactcggagagcgccaagaaggcgctggactgggccatcgtcaacctgctccaccacggggacaccctcgtcgtcctccacgtcctgcaccacagcggggaggagaccaagcacgcgctctgggccaagtccggatccccgctgatcccgctctccgagttccgggagcccgaggtgatgcagggctacggcgtgcgcaccgacgccgaggtgctcgacatgatcgacacggcggcgcgccagaagcagctcaaggtggtggcgaagctgtactggggcgacgctagggagaagctctgcgacgccgtcggggacctcaagatcgattccctcgtcatgggtagtcgcggcctcggcccgatccagaggattctcctgggaagtgtgacaaactacgttctgtcaaacgcatcatgtccggtgacagtggtcaaggggaagtaatgacctgggcagcctgccagtgatatggctaaagttttttattgtcgtgtcttttcttccccttgaatcttgatgccagtggtcaaggggaagtgatgaccggtgacaacaaaaaacttgttatttagcgttcag

SEQ ID NO: 15040 - DNA, 639 bp, Triticum aestivum
  unsure (1)..(639): unsure at all n locations
  Clone ID: PAT_TA_15040
gcaagatatctctcttcaagttcttaccatttttctcctcttgagcaactttggtgcttccatatgtgaggttgccaatgatgccattgtagcggagtctgggaagaaagcggcctcttcctcaggatcaggtcagcttcaatcgtttgcttggctgttcggctcttctgctggtgctttaggaaacctccttggtggcattgctctcagctatttttctcccaaagtcatgtttctgtttttccgcaatccttctcctgctccagttcttcacaaccgtggctatacctgagggctctctcaaactccctaaggccgctactcctaccaatctatcagcactcaccagcatccgtaagcaagtcaaagagctgtcatgcgccctatctatgcctgaaatgtttgggtcaatcatatggtttacagcgtcttacgccgtcataccttttctacttgggaccatgttcttctatcagactgaagtgctaagactagcccccgctgcggctggcttagcgttggggtgtgggcatggctggncatgtataaacantactcaganaagtcgccggannnctgtagtntgantcgtaaagcnctaggtgcaagtntntctnagataaagagnggaatcaacca

SEQ ID NO: 15041 - DNA, 442 bp, Triticum aestivum
  Clone ID: PAT_TA_15041
ctttggatcagcatcacaatgcagcagtacgaaacctggggaggtagagccagagtacagatgtatacatgtagaggattattcggaccaaataggaaccaaagatgcatctcctggcatgagtcgacgcatcaatgtcttaatatcatcagatggacttattccagattcctcacagcatttaaaatgcctatgcaagtaagaaattacactttcgatggcgcgaatgggcatttagaacttctgagaatagtcatatcaatgccatggagcttgcattcaagttgttccagccagaacacattctgcctcgcccctctacataagcgttaatatctgcaactgctaaaaacaattcatgcagatgtgttttttcgtccagcagggaataaaaggtactgtcttgcagatcagatgggcatctccgccaggacgttgcaag

SEQ ID NO: 15042 - DNA, 487 bp, Triticum aestivum
  Clone ID: PAT_TA_15042
gatactattttcttttgtttcaggtattgccggaacaagtttattcaattcagttagtttaatggcctataacgtccgctacacaagcattcctgttttaactactgttctggacaaggatttatctgaaaagacagtgacacaaaacccagaaattttactatactgccaggctggaaggcttttgaatccaagtacttttgctggttggtttggtcgatcgttatatcatgcaattgttgttttcttaatcaccattcatgcttatgccaatgaaaaaagtgagatggaggagttgtcaatggttgctctctcaggaagtatttggttgcaggcttttgtcgtgacactggagatgagttctttcacttttctgcagtttctggcaatatggggaaacttcgctgctttctacgtcataaatctctgtatcagcaccacaccaactgctgggatgtacaccatcatgttccgcctttgtagacag

SEQ ID NO: 15043 - DNA, 496 bp, Triticum aestivum
  Clone ID: PAT_TA_15043
gaaatattggtgcctaccttgaaggctttctccctgcgcgcctacgacccgaaagaggtgatcatcgccggcggcgaccaggaagccgtggtgctctctccatctggtagcatattggccatgatcgagctcccagcgccccccactcacgcgctgcttctggaggatttctctggtgacggtctcactgacatcattctggtaacgtccggtggaatatgtggattcgtgcagacaaggcagcctggggctcttttcttcagcacgctcgtggggtgcctgatagttgtgatcggcgtgatatttgtgtctctgcacctcaactcgtccaacggcggcaaacccagggcatcctcggctgaatacagatgatgtagagaaacggtttattgtgtggtgtatgagacattgagacgaccgtggttttgatatgatgctaggtaaagagacttttggtaatcctatgttataggctatttaaaaaaaaaaaaaaaaa

SEQ ID NO: 15044 - DNA, 1222 bp, Triticum aestivum
  Clone ID: PAT_TA_15044
aagaagaagcaccagcagcttctcttgatgctaccttgatccatcagcagcagcttcttcgtctgctttttggggagattattaggagtaggagtaggattactagttattattactagtgagtgagtgagtgagtgatcgagcgaggatgttggcggtgttcagcggcggtgtggtggaggtgccggcggagctggtggcggcgggaagccggacgccgtcgcccaagaccagggcgtccgagctcgtcggccggttcctgggtgcctccgagccggccgtctccgtgcagctcggcgacctcggccacctcgcttactcccacaccaaccaggcactcctccgcccaaggtcgttcgcggcgaaagacgaggtgttctgcctgttcgagggtgtgctggacaacctggggcggctgagccagcagcacgggctgtccaccaagggcgccaacgaggtgctcctcgtcatcgaggcctacaagacgctccgtgaccgggcgccctacccggccagcttcatgctcgcccagctcaccggcagctacgccttcgtgctcttcgacaaatccaccaactccctcctcgtcgcatctgatcctgagggcaaggtgccgctcttctgggggatcactgctgatggctgcgtcgccttctctgatgacattgacatgctcaaaggatcatgtggcaaatcgctcgcgcctttcccacaaggttgcttctactctaacgcccttggaggcctcaagtgctatgagaaccccaagcacaaggtcactgctgttcctgcagacgaggaagaaatctgtggtgcaactttcaaggtggaagggtctacagtcctgacagcgctgcatttttaggagatttccgtgtggaagcgtggatggagtgcaatgcaatgcagaactgttgtacatgcatggtggattggtggtgtaacatagtggcaagtcatgttcatgcaactgagtctatctgtgtaatgcatctttcataaaagagtaagtactggaggcacttaagggttgatggttgtgtgtgtaccctgtatccctaggtgttcaacttacatggaacttgggtggttgggtcgtcgtgcttggatcatcctgcgggcgcggcggagacctggtgctgggcatcgctgcccgcttgcatggcgtgctgtctcctgcagtgataacgaacctttgtttctcaaaaaaaaaaaaaaaaaa

SEQ ID NO: 15045 - DNA, 559 bp, Triticum aestivum
  Clone ID: PAT_TA_15045
gggttcgttcggcgttcggcttgcggtcggctgcgcggcgcgccgcggctctgcggcttctggcgaggaagggaggaggagaccggatccatggcgtcgaagcggatcctcaaggagctcaaggacctgcagaaggatccgcccacctcatgcagcgcacgccctgttgccgaagatatgttccactggcaagcgacgattatgggcccatcagatagcccatactctggcggcgtatttttggtctctattcacttcccaccggactacccattcaaaccacccaaggttgcattcaagacaaaggttttccatccgaatatcaacagcaatgggagcatctgtcttgatatcttgaaggaacaatggagccctgctttgacagtttctaaggtcctcctatcaatttgttcccttcttacggacccaaaccctgacgatcctttggtcccagagattgctcacatgtacaagactgatcgcgtgaagtacgaatctactgctaggagctggactcagcaaatatgcaatgggctgatgatattgctggctgccggga

SEQ ID NO: 15046 - DNA, 698 bp, Triticum aestivum
  Clone ID: PAT_TA_15046
ggtttttttttttttctttttattcgaaacttggatacgtgatatccatacatacaggatataagttactaaagtacaacatcaaacgcagaaacatccgtatctcattgctaacaagtcctaataatacaagtgcatcaaactgaaaattccaagtttcttccaaaaacaagggcaactcaaagtctagcatatatttcattcgctaaattcctcacccatctattcatttccatagcaaccctacggcctcacttccaatgaaaaggaaaaccatgaaagataaagcacctaatggggcagacgccaagtaatgtcagtctacttttaccatcacgaggagcccagctgacttgtaaagaaggccatatttcggaccaaaggttttgaccttgcttaggtactgagagcaggttccagtggctcagcaacaccgctgccaccgttcaggactattaccttgccatctgaatccacatcaacgatggcagagtcaccttctttcacctcaccagccagcatcttctctgccagactatcctccagaagcctcatgatagcacgccgcaaaggtctggcaccatagctcgggttataaccttcgtcaacaactctatctcggaacttctctgtaacctggagattaatgtccttggccttcaacctgtcaaacacttctttcagccctcgtccgaatc

SEQ ID NO: 15047 - DNA, 474 bp, Triticum aestivum
  Clone ID: PAT_TA_15047
aactttagatcttctgtatttccttttcaacagttgtctggtggggtaaaaccattttatccaaatgctggaatgcacagtgacaatgtttggatccaaacaactcagatgaatgagacaatgcagctgggcaacacaccttactacacacagcttccaggatatagcactgaagttgtggggagccgttatgaacctgaaggcttgcagatgtccgggtacctgtctggttttgagcctggcattgagtcaataaatcaaagaagtacagtaataggacagcctcctggtagacacatggaaggaagcttccagagttcgatattgactgtagacaacgggggcttgggggtgttttacttgccctctgaatgcctctttggatttttggcattcggttaactgaaaggtgagaaacccaatattgactgtagatgcagggtatcggaagtgccatctcattgcccattggct

SEQ ID NO: 15048 - DNA, 548 bp, Triticum aestivum
  Clone ID: PAT_TA_15048
agcattttttgcacgtgcatatgcacctagtaaaatatcatatgttgttgaattatggcaaagataaattatctcttattagtgaaaaagctggacaaagtttagctgatccagaacaatatgaaaatttatttcctggttatagagaatcattgaaagttgaaaaatttttaaacgaagaaaataaaaaaaaaataccagctgttgcatttccagctgtcaaggcaaatattgatcgtaaaccattagaagaaatgttagaagctgaggcagcatcttcatcatcaattgactatatgtctaacagacttcatgatcttggtattgccaatgaatcaacaacaattcaagaatcaaaacaaaatccaaatcattcatcaagaccacttattgttgatgatgaattggatattgaattagaattggatgaaaatattgatacaactgatgttaatttagatgacgaacttctgactgaagaagaagaataaacccgatcattaatatatttactaaaagaaagacaaactttaattatctttttcatt

SEQ ID NO: 15049 - DNA, 678 bp, Triticum aestivum
  Clone ID: PAT_TA_15049
gattcgcacgaggctgcatcttaatacgcagaatgggtacggatttcattgttctagcaccatggataacagaagtggcatgcctcaaaattctatccaacatcagccggctgaggaggtaattgacgaggttgtgaaagaagcaataaacaagccatggttacccttgcccttaggcctcaagccaccttctactgatagtgtgctagctgagctctctagacaaggcatctccaccatccctcctcgcaatcaacgcctctaaatcctgctgatgtggctccacatcacccggaactgacatgtctggagtttggaccacccaccttcgctgcacctgcatgcacttcccccattaattgaccgatcaacgtttggagctacgcgccttttgggagcgcgtagctttttgttttgtatcgcggacatcatgccaaacgaagaaacaaaagaaagaaaactgatccagtttatcgccacagtgaaaaggatcaagtgcggtcgctttcattggtgacaaaaattgtatggactagaaatagccgcgtagatttgaatgccaccgcagtttcgatatgtggttgtaaatagtttctaacatgagacatggaacccttttgcttattttgtttttgttcaaatattttgtttgaattttgaaaaaaaaaaaaaaaaaaa

SEQ ID NO: 15050 - DNA, 629 bp, Triticum aestivum
  Clone ID: PAT_TA_15050
gtgaaggcaacaagctctcaaaagcagagcagctcctcaatggagagctgtcgatagacgcactgtgaactcccatcattctgtaaaacttttccacgggattgttgagccgggcaatcaagagatacgatgcctgtttccataacatggtcgctttcagctaatttggtaccagcatggtctgagcacatgtcaccatttccctttggttcaacaaagctgttggtcgtaccaattggctcttcatcaaattgagtatcatgtatattagtacctttcccattatccattgatttaaagccaggaggcaccaacgggaacaggtcctgattcgataattcagttatgttctgtgcatcctccaaagttctatcaagcttctcttgcgtaccagaattcagacactcaaatgctaagggacattcttccattggctctgccacttccttgcttcctctctgctggaccctcgtgccgaattcggcacgaggctggaggcccgcgtcgcggcgtggatggacccggcgctcgcggagcagacgtgcccgccggggagcgtggccagcgtggacagcgtggccagggcgtgcctgcacaaggacccgcccaagcgccccagcatggtggac

SEQ ID NO: 15051 - DNA, 634 bp, Triticum aestivum
  Clone ID: PAT_TA_15051
gcttcatcagcggcttcagcaatatgaaaaccgctggttagagtacgagcagaaaatgaaagctatggaggaaatgtggcagaagcaaatgcgttcattccgctcgagcctttccgtagcaaagaagagtcttgctctagatgagacgcctaggatgtcagactcatcagtggatcagagctgggaaagcaatgggaatcatgtcagtagtgggtctcagctggtgccacgcactggtgggcgtgaaatgaacgctggcctgagcgtcattggccgcctaaacgaagaattcgaacaacggagccaggtatttgctgatgacgccaagttcctggttgaggtcaagtctgggcaggcggatgccagcctaaacccagacatggagctccggaggttgaagcagaattttgactcgtggaagaaggatttcagtggccgcataagggagacaaaggtgatcctgaacaagctcgggaatggcaacgagtcatcgcccaactctgtgaagcggaaatggtggggcagactgaacacctccaaggtttcgtgaggttattatgattgattggcaatttgtaggtgtaccggtattttacacgccggtgtggttctagcttcctagagtatctattct

SEQ ID NO: 15052 - DNA, 426 bp, Triticum aestivum
  Clone ID: PAT_TA_15052
gtggccaggcttttggttctcccatgcttggcattggtgttgtgaccctagcagacaagttgcatctactcgttgagcaaaaccatatgtaccgctttgtgctttccctccagtactccacaccaagtgctatcctgcttggagcaattgccaatctcagaggctatggtgttaaggaagcatccgcccttctattctggcagcatatttgtgcagtggtctctctttccctctacctgattgtatacttcaagttgttttctttcatttgaagacagcgcccatccatccaattctggcatatatacatagcaatcatttccggacggcggtggctcagaaataggatactagaagaatgggtttttggtcatgtcccctatcagtcaaaagtgtttataattttggtagttatttaaatttcag

SEQ ID NO: 15053 - DNA, 735 bp, Triticum aestivum
  Clone ID: PAT_TA_15053
cccgacgacttctctcgctggcgctgagtatggaagcggcagttctcgtgattgggctgccaagggtccgatgctcctgggagttaaagctgtgattgccaagagcttcgagcgtatccacagaagcaacttggtggggatgggaatcatgtttttgatgcggccatgagatacaaatctgagggccatgctactataatcctcgctggcgctgagtatggaagcggcagttctcgttgatggggctcctcccggtccggtgctcccgggtgttaccgccgttggggcctcgtgctctgggcgcctccacagaagcaacttggtggggatgggaatcattcctctgtgcttcatcccccccgaggtcgcccgctccctggcccgcgcgcggcacgagcgctgctccctcgccatcccgcccaccatcactgtggcacgtcccagctccccagggctcgcggcctgccgccatggggagaccttgcgctgcctcccgtcgccctgtctcggtgctgcccctggcgtactgcaaccatggaagaatcctcccttaagtcatccgcaactgggtgctgcgcataactgagggaagattacacaccgtttgaccacattggaagtgcgtgcacagcatgccgtggctgcttccgatcctacgtatgccgtgtctggttgcgggtcctggcatcccctcaagccctgtaggttgcaccgcggagaagaactgaaaaaaaa

SEQ ID NO: 15054 - DNA, 415 bp, Triticum aestivum
  Clone ID: PAT_TA_15054
atcggaatagtaggttcaagttgataccatcagttcctaagggctcatggattgttcgccaaagtgttggcagcactccttgtctattaggaaaagctgttgacattacctatatacgtggctcaaattatttagaaatagatgtggatattggctcgtctacagtggcgaatggagtcttggggcttgtgtgtggtgtgataacaacactagttgtcgacatggctttccttgtccaggctaatacatacgaggagctcccagaaagactgattggggcagttcgcatgtcacatattgaactgtcatcggcaatagttccggtgctcgaggattaaccctaataggcactactgcatgcattgggctgacaggatgaagccgctctgcttggatcactgacagtgtacacaat

SEQ ID NO: 15055 - DNA, 609 bp, Triticum aestivum
  unsure (1)..(609): unsure at all n locations
  Clone ID: PAT_TA_15055
tagaataacttcaacagcagccactggtgatcaagctgctttcatattgagtatacccaaaagaaagttaatggatgagacacaggaaactcttagaacatctgcttttccaagcaaccatgtgaaggagaaatgggccaagaacctttacattgcttcaatatgctatggccggacagtgtcatgaggcttgctcggctgcatccctagttgggaagagcatgttctgatgagtatatattgggaaaaaagcagcaatctttgttgctgctctctattaatctctgtatgtgtaggtaacccgttcaagatgaagcaccttacagtggccagagtaggagctcaagaaagaaccgagaggaaggtggaaagcaatcggccaataagcagacgaggagtatgtgatctggctaagtagcgggtacaggcgctaatggcgtcaaatgttttggatcagcatgttttgcttttgcgtcgctcctggcccctgtgcaaggagtagacagcttgtttctttccggaggcaagtcatctgagaaccatcgtgttatancgtatgatgtcaattggaatttccttagtggnggcaaattcatccttccgggactc

SEQ ID NO: 15056 - DNA, 1985 bp, Triticum aestivum
  unsure (1)..(1985): unsure at all n locations
  Clone ID: PAT_TA_15056
cgtccgcggacgcgttaccacacagggcgcggctttactgctctgcctgcaggagtcgtctttcttcccccgctccgccgccgccggcgatggcgcgcaacccctgcgacatccgcctcctcctcgtcgccgccgccgtcgccttcatctacatccaagttcggctcttgtccacccaggttgtatcttcttcttcttctaattcccaccctttcgacgccggacgcctcgcggaagcagagaaatgcgagagccagctgcacgccatgatcgaccaggtcagcgcccagcaggagaagatcgccgctcttgaagagattaatgtacgccggcgtgacgatcgtgtgcagctctgaggattaatacaagatgttggacagagtcactgtgcataaggcaaaaaaccaggtgatggtccgtcttgcaagttttttcatagttgcttacaaacgacttgattattgttttttttttgtccaactttacctgaaccatcagctaggtgtttcttctaaggtaccgctttttatatcccaggatggaacaggtggagctgcaaaatcggctgctttgagttataatcaattaacttttatgcagcatgtgtattctggaggccgtacacaccggaagaccgggagcaaaacatgtatattacgagatcgctcatcactattaatttgaattcaatgagctattcactaagcatgattttcttcgagtattcattctgtaatatgacatggagatcgcatcagcttccttccacctttctctggctgcttgacaagctcttgccaatttcttctcataactggctgtgtcatcttgtattgcaactcgccttatgctgttcttttttgacacaattccacttctccgtacggctctcttccgtggaactagctcgaggcccatgtaggctgcatcgatggagccgtcgccaaagtggcccaatgctgattgcgatgactgggtgaggctaaaggaggtacacagagatcggcagtttattcggccagaagtatgcaggacatacaactttggcgagcatggatcaagcatgggacaattctttgatcaatacttgaaacctatcaagttaaatgatgctcatattgactggaattccgaggacctgagctacctcaaggaggacaagtttttgaccaaattcgggaaagacgtggctagcgccacacctgtgcatggatccgatgctttgttgaaggcccacaatctggatgtggacgtaaggattcagtatgacaatcagggcgacttcgagcgtatagctcgtcagtttggactatttgaagagtggaaggacggtgttccacgggcagcttacaaaggcgtggtggtcttccgatacaagagcagtcgaagacgaatataccttgtcggccctgactctcttcgtcaacttggggtttagcttagcggtgccgagattcacacagcatgctgggcggttgaaaatatgattctcaagttgtagcatcatagggacttgtacgctcagatttttcgatacagatcagcattgtaaagtattaactgaacaacatacgttggtatacgacggccaacagtggtgtgctactctatgagctcatcatgggcaccggcgtgtcgatggggaaccgccctgaggatgacagaaggtgttggactgggtcactgggccaaagcatatgtccaagtgttgatctgaatcctagttaattgangtgcttacatataactgaatccttgttggttttttgccacctatacctggactacactacatatgtgctggggtatgagtgactatccaccaaaagatgcacacgctccagcctctgctggggatggtgattgttgatacaattgtacggggatcgaanggcnatttttanggaagaaagcgcccagactaggggcgggggccagttcaagattttaatccaagatcttgaaaaaagggagttacagacctt

SEQ ID NO: 15057 - DNA, 531 bp, Triticum aestivum
  Clone ID: PAT_TA_15057
ttccattcatgataacaagcaagtgagagaagctgccctcaagccaacggcgttggagtcactctggagcatggcgatgtccctaggggtgcttgctagcctcctgttgtagtgcggcatttgtacatagctcttagtaatgcccctaaccaccttaggctaggtttgctcgacatgttgtaggttatgcgccttttgattctttgcccctccagttttgcccattgtaacttataatatgcgtgccttatgcctctttaccccttttccccctcataaggatgaatgggtggcatgtagttttggccgtgtgtgtatatagcatgcggatgtatgtgtacagcaggcggctatagcaaactgttgttgtaaggcataataagctgatagtgtgtggtcctattctacagcaggtcatgccagatacacctccgaacttactgtcgttttgtattgtatgataagggcacatgtaacataaataaaattttagttgcccttctggttgcaaaaaaaaaaaaaaaaaaaaaa

SEQ ID NO: 15058 - DNA, 509 bp, Triticum aestivum
  Clone ID: PAT_TA_15058
gctaatattacaatgaaactgccagcggtaggccttgatggatcagctgcctattctgttagggatctgtggaagcatgaaacgctatcagaaaatgtggtaggaacttttggcgctcaagttgacgtgcatgacaccaagatgtacatcttttctcctgcaaccagtgtcgcttcaatttgatcggaactcgtgaatccaagatggcagcacgctatattcaaaggatatcacgacaaggaacttcatttttcctgctgcagtctgtcccactcaagtgcagaagcttacttcgtgcagaattgtctcattaatgtttgccatttctcacgaagtagttctctttatgtttattcttttcatgtaagttgtactgccaatgaggtggctcatgtgttggctagactgagcgagctcgcatcttattcgcttgtacgatttgaaactgtctgaaccaatgagccaagtcaaggcgattccacgagaaaaaacgaaaaaaaaaaaaaaaa

SEQ ID NO: 15059 - DNA, 812 bp, Triticum aestivum
  Clone ID: PAT_TA_15059
tcaagatgcgcgacggcaagaacctgaggtgcgtgcagaacaaccctcgggtgctcaggctccgggactcggcgccgcaccacgcgattgtgctcaagatggaagacggcagcgacctcctgctccccatcatcgtctcggacgcgccgagcatcatgttgctggctgctcttcggaacatccgaattccaaggccaactatctacaacgtggtattggagatgactaccaggatgggatatgaggtgcgtttggtgcggattacagaaatggtccatgacgcatactattctcgactgtatcttgcaaagattgggaatgaccaagacactattagttttgacctcaagccatcggatgctatcaacattgctttccgttgcaaggtccctatacaagttaacaggcgtattgcatataacaatggattgaaagtcgtgcaaccaaaggtggctgagagttatgtaggctccgacgacattcaaatcacaaggcttgacaggcctgatgaccaacattgcagtgaggcccaagagtttgatttggtccggaatatgctcatcgctgcagtggaagaacgctacaaagatgctgctcaatacagagaccaactttccacgttgcggtcaaagaaaaagaacgcaatataggatgggtgcacaattcaacttgttaggccttgatgggggtgtacataggaggccttttgctgaagcacatgaagcttcagcaaacatctaagaagcaccatgtaaatacctacagaatatatgtatagacacacggatagtataattctggattctttaatt

SEQ ID NO: 15060 - DNA, 459 bp, Triticum aestivum
  Clone ID: PAT_TA_15060
ccgcgcgtcccatcacaggatgatcacgtccgggttgggataactctcaaccgccagtctgaaaccttccttttaccaagggtgcaggatatgtttgaatccttgctgctttcaccatctgttggaatacaggcagagcccttcgctgaaatgcgacaaaggaaatgcagagaaggatctgagatccttgggagcatcagggagaagctgaggatgttgcctaaagatacacttagcactgagtttcaggagtgctgttctggaatagagaaattgtgactaaagtttcttcaagttactgttgtggattatcgtgaaatcattcttccccttgcgagatcataccaatggatagaattgaagaaacggattcctttttatctaaatcatcctggtaccaggcgtattgaatttgctgatgccaatattgatattatatgcggaacttctggccaatct

SEQ ID NO: 15061 - DNA, 900 bp, Triticum aestivum
  Clone ID: PAT_TA_15061
gattcggacgagggttgaatggcacatcatttatgactcgcattctcaaggtcgtccggcgaagttctcatgaagcagctcacttttatggttggcctggtagtggacggtcatcattatatggtaggcatggtaggatggcatacccaagagctgttctccccggtggttcctttagagggcgtgctccgatgaaagctggcgctagaagtttacagtggaaacgggagccttcaggcactgattcaagtgcaggtgcgaaaactgacatgagtgtgccattttcctctgaacaggtgctcccacctgcaacatagggatattatagttgagctgatataatgagaaccgaatggtatcttactcatcgctcctaatggctgaaaatggacagcaagctgagaagattgttccttcctgctgcactgtaaaaaaaagtccaaaaaaagcatgaaaatacaaaaagctaaaaataaaaaaatgtggggggagtttggcatcagaatatggctatcattggatttggtcctcttcaccatatgcgagtaggctgacagcctgagcaattttctatggactccagcaatctgaagaggattcacatttgaaataatcacaactttttggttgtgttggatggaagatgcttatcaagtagaacaagatgggcagattttggatgaggtatttggtgataatctgggcatcatcgatgtaagcctcaactgtatagaagtaacctatctatttgtaccctaatctgaatcaatctctttcccaacaaaaaaaaaggaaacacaaaaatgtgttgttctctttcatttttctctcatgaactgtttatttattgtactgagttgattttttagttggacattcattttttgtcaaatggtttaa

SEQ ID NO: 15062 - DNA, 740 bp, Triticum aestivum
  unsure (1)..(740): unsure at all n locations
  Clone ID: PAT_TA_15062
acacatcagcagcagcagaagttgcaaggagatcgacgctcttgagttcttgaattgttgttgatcgatggcgctgaggagaatcatcaaggagctcaaggacctgcagagggatccacccacgtcctgcagcgcagggcctgtgtctgacgacatgttccactggcaagcgaccatcataggccccagtgacagcccctactcagggggcgtcttcctggtcaccatccatttccctccggactaccccttcaaacctcccaaggtggcgttcaagacgaaggtgttccacccgaacatcaacagcaacggcaacatctgcctggacatcctcaaggagcagtggagcccggcgctgacggtctccaaggtgctgctctccgtctgctcgctgctcaccgacccaaacccggacgatccgctcgtcccggagatcgcacacatgtgcaagaccgaccgactcaggtacgagtccaccgccaggggatggacgcacaagtacgccatgggatgataatgcatgcagtgaggctgcctggggagcaaacatcgttgtatccaaatccaaatgttctttttaataacgtaatctaacagtaacagcangtggaggagctctgcatttcgttctcaaaattaacaacaggaggagagaggttctatgtatgtacaagaactgtgtccgaatcgatgtaccatcacaatctcatataaaaaatgcaagtgaacaataagatttt

SEQ ID NO: 15063 - DNA, 742 bp, Triticum aestivum
  unsure (1)..(742): unsure at all n locations
  Clone ID: PAT_TA_15063
tcggcacgaggctttgattcttcaccaccctatcagaaaaggtcaaaaagaatggctatcatcaaatcagttgagaaacagctggatttttcagcagatggactggatacttctggttctgagatgaagaactctccttgccataattcccaaggcgcaaattctaacaggacgtaacacatacagctgatttgaatgaatctaattccataatgtgcaggaaccttacgaagccggacaggacttatggaatcccctccgaactaaccagcctcatgcaaatgtcccggttcaagccaaaatccaaaatcaacaccttcagtggagataagagcctcccgcaatggaaatgacgtatggagcacaggccaacagtaccctgtcatctcatgtaatcagggtgtacaaaatactgtctaaatcgaaagcacattccatagaagattacattgtttgctgcattttgtgaacttacagctaggagttcagattgtagaagcccacagctgtgtacaaagaagaaaacatagctctagaaacatatatagctgaataagagcttcccagtggaatgtcaaattgtcttcttagtttcttttattctgtgcgtcccaaatgttgcgaaacagcaagggtctactcattttgtaacaataaaagcctgatttgtgngctaaaccaatcctgccagggtttgtcaagaaactagttatggctgcggcttggttaaaaaaaaaaaaaa

SEQ ID NO: 15064 - DNA, 602 bp, Triticum aestivum
  Clone ID: PAT_TA_15064
gagggtctggcttccgctgcacagaagaaatggccgttgtttgcttgatgctgctggccgtcggcctaatggtcgatgctaccgacaagcccacaagctgcaccgattcggtgaagaatgatagtcctccggacagcgactgcatctgctccaagaactgcgcatgtgccggtaagtgcatccttatggagcctgccagtgttcagtcctgctttatcgactgcgtcctcaaaaacgactgcatctgcgaggacaagaagaacggcgctgaccagccgcagtgaacactaagaaatatcaagtgagcatgcatgcgtgtgccctgctgcctgcctatatatgcatgaattaatatacatctcatgcaggcatgcgccaaccggaagcaaataaacttattaagtatgtgttcattatgtctgtaataatgcatgcatctcatgtgcatgccgtgtcttcgtctgctatacttatgatgattgtccaagtttgtaataaaaggccgcacgtgatggccggtatgtctgtatgatcgagtcttgctgtataccgcttcttttattttcatatataaaatgtatgtgcttgtgtgcacctttaca

SEQ ID NO: 15065 - DNA, 1580 bp, Triticum aestivum
  Clone ID: PAT_TA_15065
cgggcggtgccgcgtcatcccacgcgtccggcaattgactccgcgagaggttggtgttccctggcggagagagagaggcagggagggagaggaaggagagaccgaaggccgcgttgtttttacctcgtctcctcctccgccttcgagctctactgaaactccgatctcagaaaccaagaaaagggggtctgtgaagaggtttctcacggcagaacaatggaggtacttggcaaatctgtgattgctgagcccagcaatgtgattttcttgtccactattctgaacacagaaggggaaatccccagtcacaagtgtgacatgaggtgccagaatgagcacatctttggaaacatgtaccgctgcaaattgactggaatgacacacatttgtgacaaaaactgtaaccacgaggatcctctatgacaaccacaactctctttgcagaaagagtgggcagttgttcgcgctctcaccacctggatgctgcaggcagttgagggggattcgggaggaagcatgaaagctgacagcagccaagtaagggtgctccttcaagcgcaggcgtggtgcacagctgcatccttccccttttgagagatcctagtccgccgtgtctccgataccgagccaagctggagatggcatggacctgagcgagagctaacgagacttccatcttttcttaccccggctaaccttatgcggatgtctaactccatttccccttctttgacaggatggaaactataagagattccttctttatagacttatgaagggatatgagactccttagaggcactaaataatgtctatgtagtatcaattcagttttatgggaccttgttgtaatcgtaacttcgattgaacagcctattctgaattacttagtattaatcatattctacagcctattctgaattacttagtgttaatcatttgctattaccgtttagattatttctctatagcgcggtgctcttgtttgctccaacttttcattattgtagctcctttctttcttatgctctcttgaggttcactatctgctgcatttcagtgcattcaagctgtgcaaatttgcttgacatagttggtgatgtaaatccgttgcagattacattatcctatttcttggggcgtgaacttactaactaaatttccttcataattagtgctttgcatggcaggttgctgatcaggtctcagctatttatggtttgctctcatatagcttatttgtttcagttaaatgttttcttctttgcaggttatgtttctaacatctatattgcttcctcctgttttgtttttgacttgcttctttccttgacccctttctgttttgcagggtgatccaggtgctaacttttttgaaaatattttggtctttatgtaatgttccctttgttaagttgatttcgtttgttctgagtgttcacttgtcttttatgcttgtgcaggtgaattggtgttcgttctttcgctcttcttggtccatgggaggcaggagctatggaagatcattgaaatcctttgcagcagtggaatagcaatgtacctcggccgcgaccacgcta

SEQ ID NO: 15066 - DNA, 676 bp, Triticum aestivum
  Clone ID: PAT_TA_15066
ggctggagactacgatcttcgtagtcgagggccgcctaccctagattaccaggcccttgacagaatctgtatcgtagggcaacttggggcctgcttggttctgtcgccgagcaccattacacatcgccgagtgaggatagcgagtgagtgcgggcgtattgttcttttgccttggcgcttcgaagactgtgtgagcaagatttggcttgctcctgtgggagagccaaatcggctcgcctggccgagcgagctccttgtcacttgtggcaatgcagcgaggcatggcgaggcgagctatgcccagaactaagcagccccttgatctttgttctcagcattaaattgactagataaaaagtatgaacacgtactgaaccaagattatgaacatgcagatggttactgtcttatgaagtggttgtggtaccagaaaattattcgagttttttctgccaccaacttaaagcaaccgagttcattccttcagctcatgttgttcatttcaatctaaatcattctgtgctcccttgacagggaaatagtgctttcaaaagaagacagtggagcaaggcaattgagttttactcagaggccatcagtttgagtgacacaaatgcaacatattactgcaacagagcagcagcttatctggaactgggccgtcttaagcaggccg

SEQ ID NO: 15067 - DNA, 1107 bp, Triticum aestivum
  Clone ID: PAT_TA_15067
gcacgagggtgacaattagcaagagaccagctagctccctcctgcccgccgtggcggccctcgtcgccgtcgccggcctcctctccctcgccggcccagccgcggccacagggaaaaccggccaggtgacggtcttctggggccggaacaaggccgagggcacgctccgcgaggcctgcgacacgggcacctacaccatcgtcgtcatctccttcctcagcgtcttcggccaaggcggcaacaagccgcccactctagacctctccggccaccccatcgccggcatcggcgacgacatcaagcactgccagtccaagagcatcatggtgttcctctccatcggcgggttcggcgaccactactccctccccagcgccaaggccgccacggacctcgccgactacctctggtacgcctacttcccagcgcccacgccgcgcgccggcgtgcaccgcccgttcggcgacgcctacgtcgacggcctcgacttcttcctcgaccgcggctcgccggcgtactacgacgtgctggccaagcgcctgtggagctacaacaggcagttccgcgcccggacgcccgtgcagctgtcggcgacgccgcggtgcgcgttcccggaccgccaggtgcagcgggtgctcgccacggggctcgtcaccagaatcaacgtcaggttctacggcgacgcgcactgcgccgcgtactggcagcaggagtgggacaagtggacggcggcgttcccggaagactccatctacgtcggcctgccggcgtcggagcagacggtcgggtacgtccaccccaagaacctctactacggcgtcgtccccgtggtgcagaaggcggccaactacggcgggttcatgatctgggaccgatacgccgacaagcagaccaactacagtagctacgccattcaatatgcttgaatgcttgatcgatgagcgagctccatccatgacgtgtgctccgtctccgtgtgtatctactctagtgttgtccatctcctcactagcgtgcttgcaagaataaagtgacacgtgtgcatcaataaaccgttgataataaaaaaaaaaaaaaaaaagtaaaaaaaaaaaaaaaaaaaaaaaa

SEQ ID NO: 15068 - DNA, 763 bp, Triticum aestivum
  Clone ID: PAT_TA_15068
gaggctgacaatgatgctgggaccgtggagtctgtccaaaagttagattcttctgaaagatacaaaagtgtctctttctgcaaaccacctgcagaagctgcgtttatcctttcaactaaccacaccgctcgggcacacatttaaacctcaccaggtgttcttgaagttgaagcatgagagtaaggttgaacacttatttgtggtacctggctctgcaaggcagttcaaaattgttcttgatttcctaggtttggtggaaaaattttactacctttctggaagatatgatcttgagcttgccgttggtgatgctgcaatggaaaattcatttctacgatcccttggccatttggacttggacctaccagaagctccagaaaaagccccacgtcctcctgcacaagctgttgacccattctcaaaatttgggccaaaggcagagatagcacatatattccgcgcaccagagaagaggccacccaaggaactctcgcttgctttcacgggtctcacgcttctaccttttatcggattcttgatagggctcatgcgtcttggagtgaacttgaagaacttcccatccttgccaggaccggctgcatttgcctcacttttccatgctggagtaggagcagtcctgctgctctacgttctcttctggctcaagttggaccttttcacaactctgaagtaccttggcttcctcgtcatcttccttgtttttgtgggccataggaccctatcctacctttcctccgtgtcg

SEQ ID NO: 15069 - DNA, 331 bp, Triticum aestivum
  Clone ID: PAT_TA_15069
attcggcacgagggtcttactgattgagtgtggccatgaaactatgttgtaccgaagccttggtgaaggtcgctcagctcctccggtttgctgtttgtgtgtcgtggatgggagttgggaattgtagctttttgaactctaaaagttctctttaatgaggcggaaaaaatagtagatgcagttatgttgcttgtaaagtcttgtattcggtgaataaaccctgccagaactatgaatcctattactatcgttgtagtttcgaatagtaccaaatgataatcgcccgttttgggctgcaaaacaaacaaaaaaaaaaaaaaaaaaaaaaaaa

SEQ ID NO: 15070 - DNA, 654 bp, Triticum aestivum
  Clone ID: PAT_TA_15070
gaggcgttgatggcccgggaggaagttcgagacgtacgtgttctcgctgtttgatgagaatcagaagcctgggccggtggcggagaggaattttggcatctttaacacggatttcacgcccaagtatgatctcggactgcttcgccaaggatcctccggatctccaaacccatctccgaagccaagcccaaacccgtcgccgtcaggaggaggcaagtggtgtgtggccaagtccggcgcgagcgcaaccgacctgcagaacaacatcaactacgcctgtggctacatcgactgtaagccgatccagagtggcggcgcgtgctttgaccccaacaacgtgcagtcgcatgcttcgtacgtgatgaacgcgtactaccaggccaatggcctgcacgactacgactgcaacttcaagggcaccggcgtggtcacctccagtgaccccagttacgggagttgcaaatacgtctcctgacggggcgcagcaagtccaggcagtgcgagggcagaggcaccagcctcgagtccacatcttcctccaggctccagccacggtgatgccgggaggatgatactgccgggcttgcgccaaatacttgtatactcatgtctgacacccatgcttcttgctctcatcactactagtcgtccttc

SEQ ID NO: 15071 - DNA, 448 bp, Triticum aestivum
  Clone ID: PAT_TA_15071
gattcggacgagggagaactaccccctttggaatctcatctgcaacaacaagcagcttctcaaggctgaggttcacccgtggaatagcggcgaggaactggaaaagacactactgaagttggtcagcaaaatgatcgccgcacctgcacaagcttcccagtttgactacagcaaatgcgagatgagcaacccagcaatccagcatccagccctccgtgtgccacactgattactgatcaactcttagttcgcaagtacaggcttgattgcctggtaatttttatatgcctcgattgataagagtccccattctgcattcagcatgatatgtcctcagtctgtgttcagagcgccacaatttagagatgagtgtctatgctttgtactatgtcattcaataaactgtagcatggcatggaagaacatgaattgtgaattaattgatgcc

SEQ ID NO: 15072 - DNA, 697 bp, Triticum aestivum
  unsure (1)..(697): unsure at all n locations
  Clone ID: PAT_TA_15072
agctacagctagctgcagcacacagcagatactcctacttccagctcggattcagagcaaagctcgatcagcataccctgctctacaccgggggagagtgtctgtgacttgtgagaacctagtgagcgatcatatggcggcgtctctgctgggcctgcacaccagcggcggcagcggccggggcaggaggatccacgccaggagcggcggccggcgccggtcggctgcggcggtgaagcagttgctgtcgaggttgagccgctcttggaggagacgcgcggtgcggccgaggcgaaccgcggtgaggttcgggtatgacctgcatagctactaccccaacttcgacgacggacaccatccgcttgtagtagctgtactgtactgtactgtactgtacctagctagtgtacaataattccctcttgccactttctgtacttatggttgcgacttgcgactaactgtcggtgactattattagctcgtgcagtcattgactcatcactgtacaggatcactggtctctttgcttcttctatgtgtagtcaggacttaggagtagtactattctgccatcgattagcagaatgatgctttattgtggaggtatttaaaacttggaatagaaatggttttttttttttgtnaaaaaaaaaaaaaaaaaaaaaaaaaaaaaaaaaaaaaaaaaaaaaaaaaa

SEQ ID NO: 15073 - DNA, 1021 bp, Triticum aestivum
  Clone ID: PAT_TA_15073
gaccaagtcgtggaagaagctagtgaacattgctgtgtcaggcgcggctgggatgatatcgaaccacctgctgttcaaacttgcctctggtgaggttttcggacaagaccaaccaatagcactgaagttacttggttcagagagatcgtttcaagctctcgaaggtgttgctatggaactggaggactcgctatatccattgctgagggaagtcagcattggtatagatccttatgaggtctttgaagatgtagattgggcccttcttattggtgctaagccccgaggtcctggcatggagcgagctgcgttactggatatcaatggtcaaatctttgctgatcaggggaaagcacttaatgccgtggcctcgaagaacgtgaaagtcttagttgttggaaatccctgtaacactaatgcgttaatttgcttgaaaaatgctccagacataccagcaaaaaattttcatgcactgacgaggttggatgaaaatagagcaaagtgccagctagcactcaaagcaggtgtattttatgacaaagtatcaaacgtgactatttgggggaaccattcgacaactcaggttcctgatttcttgaatgccaaaattgatggaagaccagtgaaagaagtcattaaggataccaagtggttagaagaagagttcaccattacggttcaaaagcgtggaggtgcgctcatccaaaaatggggcagatcttcagctgcatcaaccgctgtatcaatagcggatgctattaaatccctggtaactcctaccccagaaggcgactggttctccacaggggtttatacgactggaaatccttatggcatagcagaggatatcgtgttcagcatgccatgcagatcgaagggtgatggtgattacgaactagctactgatgtgtcaatggacgattttctctgggaacggattaaaaagagtgaagctgaattgcttgctgagaagaaatgcgttgcccatcttactgggagaggggaatgcatattgtgatgt

SEQ ID NO: 15074 - DNA, 693 bp, Triticum aestivum
  unsure (1)..(693): unsure at all n locations
  Clone ID: PAT_TA_15074
nntaaaaangggtccctccgccggacctgtgtgggccccccctccgcccccccccgccctcgcctcacctgcagctgctcctccagcttggcctccccaggcccagcccatggtcgctcctgacgccgctccgcctgacgcccatttctcacaaccgtgccgcagaccgaggattggtgaactcgggtatgccgcaaattctacaggcgtcgttatccgtctgttacttatcattatcgttgctaccgcatgttacatgaatccgcggcaaagggtgaagatgttgctattaggcaactgtgcatttgcattgggatcaaaacaagcatgcaccatccaaggataggttcaacataaggtttttattggatggttcttgtgttggtgagacagaagggtgccggattagtttgggggagtgaagtgttggatccctgttccaaattggtctttttttttctttcctctcttcttattttgaataaaatatagtgtcccaaaagaacctgggtggaaacgaagaactcatcatcatcatcatcatttgtgtagccctctgtatatttgatctcatggatgtcattcaggttgaggtgcagataagtgtgttattagcttgcttgtagaaaccttatgcgagttaaatatatatacatcggttccgtattgtacttaaaaaaaaaaaaaaaaaac

SEQ ID NO: 15075 - DNA, 487 bp, Triticum aestivum
  Clone ID: PAT_TA_15075
gcaccacactaccccgccgcgtccccccacccgcacccggagcagaggagagatggcgcacgggaagggaggagcggcgaggaaggaggaggtggtcaccagggagtacaccatcaacctccacaagcgcctccacggctgcacattcaagaagaaggcacccaacgccgtcaaggagatcaggaagtttgcgcagaaggccatgggcaccaccgacgtcaggattgacgtgaagctcaacaagcacatctggagcagcgggatcaggagcgtgccgcggagggttcgtgtgaggatcgcccgcaagaggaacgacgaggaggatgccaaggaggagctctactcccttgtcaccgtcccggcgatccctcctgagggcttgaaagggctggggaccaagggcattgacgttcctgtttatgctcgctcttcttaagcatctttagagagtttttagtttgtatttgcaacagcaaaccttttgtat

SEQ ID NO: 15076 - DNA, 739 bp, Triticum aestivum
  Clone ID: PAT_TA_15076
attcggcacgaggctactccattctttgatttgtaactttgtatactgagacagtgtcgatcgggaacttgtaattgatcaagcccctataaaaaatcatttcgagggatatcgatgagctttgctatacttttggttgacgttcaattttactgcacgagattgcatagtggagacctgaccggagagttcagggggacgcagctatgctccgtgaaccaatcatgaaccgattggaggaagaactttgggaggttggaagggacggaagatcaattggatcttgtaaagctttttggagaacttggatggaagtatgggaaactttcaactgcaacgaaagctcgtggaccgtgtcacctactagctatgcgagcgagaaaattggacgattgacaattggcgcgttctggggcggactaactgcaaagggttgacggttcagaaggtcatgaacaccgcaatttgtttgacagggaatggagacattctggaattgcgttaggtgaagcagatggaggaaggaagggtgaaagtccgacatggttggttattccagacccagtcaagtagtactgcactgaagattcttcaagtgacgaacaagtcgacaaacgtcgcatgctcccactcaaccactacctgtatttgcgcctgacctccatgacaccatttcgaacgtctgcacgacagttgaaagagagatcaaccatcaaagaattttgcaaactgtgagaaa

SEQ ID NO: 15077 - DNA, 398 bp, Triticum aestivum
  Clone ID: PAT_TA_15077
attcggcacgaggggcactcaagctgagcaagtaattgatggactgagacctgcacatgaagggaaactacaaagaatacctgtgttctttgtggcaaagcgactgacgacaaaagtgctgcaactgtttccattggcacagaaagaacaatgaaggatccacagaaacaaatcaaggagagaaagagaaggcactggtgttgtgcttttcacaatgccctccgtccagaacgttgcatccgtaaggtctaaggtgcgcacacgcctctccataatgtggaaggaagcggggcttgccttcacgctgtaaatatcctgtaacattgccgttgtaacaagcacttctgttgaatgtgaaaatatagagaattgcactttgtaaaaaaaaaaaaaaaaaa

SEQ ID NO: 15078 - DNA, 519 bp, Triticum aestivum
  Clone ID: PAT_TA_15078
ggctcccccgcacaccagaaaaaaaaattccccaattgtttgtctctgtcagtgaagaggtcgcggcggcggcggcgatgtcggggcgcggcaagggcggcaaggggctgggcaagggcggcgcgaagcgccaccggaaggtgctccgcgacaacatccagggcatcaccaagccggcgatccggaggctggcgcggaggggcggcgtgaagcgcatctcggggctcatctacgaggagacccgcggcgtgctcaagatcttcctggagaacgtcatccgcgacgccgtcacctacaccgagcacgcccgccgcaagaccgtcaccgccatggacgtcgtctacgcgctcaagcgccagggccgcaccctctacggcttcgggggctaggatgggctgggcgccctctcctcctttgagtctgtttaccggtccgaaacgactgaaatgttagctgatttatcgcgagagaaaatactattggttgacataaaaaaaaaaaaaaaacaaaaaaaaaaaa

SEQ ID NO: 15079 - DNA, 769 bp, Triticum aestivum
  Clone ID: PAT_TA_15079
tctggagcgcagcttgtagccatcctacctctggctattgttcacactatgggcaatctcttcaccaacatgagccttgggaaagttgcagtatcatttacgcacaccatcaaggctatggaacctttcttttctgttcttctttctgcaattttcctcggcgagtttcctactgtttcgggggtagcatctcttcttccaattgttggtggtgttgcattggcatctcttactgaggcatcctttaactggattggcttttggagtgcaatggcttcaaatgttacctttcaatcccggaatgtactgagcaagaagctcatggttaagaaagaggaatccttggacaaccttaatctcttctctatcattacagtgatgtcatttttcgttttggcccctgttaccttctttactgaaggtgtcaaaattactcctacatttttgcaatctgctggtctgaatgtaaaccaggtccttacaaggtctcttcttgctggactgtgtttccatgcataccaacaggtgtcttacatgattttggcgatggtgtctcctgtcactcattctgtgggcaactgtgttaagcgtgttgtggtcattgtaacatcagtgttgttcttcaggacacctgtttctcctatcaactctctcggtactgcgattgcacttgccggagttttcctgtactcacagctcaaaagactcaagcccaagccgaagactccttaaatagctagggattgtattttccatctctcttgtgtta

SEQ ID NO: 15080 - DNA, 454 bp, Triticum aestivum
  Clone ID: PAT_TA_15080
gattcggacgaggcagaaatggggacgctgccatgcccatggagatctggccacctctttgctttcatcaccttcgccttgttgttctcgacttcatttgctgggagacactacagtttcttgacggatcaaggtgccctacgtcaacaaggagaggcagcacgaaaggaagcactagtgccattggtgcaagttcggaggctcaacgtcaagacgaacgattacagcagctatgacccttccccgtccatggacaagccacacttcaagctcataccaaactgatcaatcatgtatatccaggttgcagcaatggagttgccgatgaggaacttaattaacagcttaaatgtgtgcctgatttataaatacagaggcattactaggcttgcttaaactgttcccataacatttaatatcttattatagatgtgataaaaaaaaaaaaaaaaaa

SEQ ID NO: 15081 - DNA, 590 bp, Triticum aestivum
  Clone ID: PAT_TA_15081
cggacgagggtgagaatacttgctagtagacgatgagcgcatctctggtgtttgtttcaaggtcctgaagaatgattggacttgtatatttgctttgggtttgctgctcgatcttctctgcactggtttgcagccttcagatgaacttaaatccacccttgaaccgataaggagctcccatcctgaaaccgcagatgctgatcctgcaaccgttgtttgctgtatcctgcagaaatgtgatcccctgcgggtagaatattggtcttggttcaaggccactatttctcagatgtcctgacttcacatgggttcacccaaccgttgtttgctgtaaacctgcagaaatgtgatcccctgcgggtaaattattggtcttggttcaaggccactctttctcagatgtcttgacttcacatgggttcacccctttttgtcctcgttgggacggactctgagatagacatagatagtttcattgtatctgcatgatgcaaacccaaccttcagtgtgactgaaagcaatacttgtaacgaatttgtttagtaaaatttatcagtgttactgtcccaaaaaaaaaaaaaaaaaaaaa

SEQ ID NO: 15082 - DNA, 1197 bp, Triticum aestivum
  Clone ID: PAT_TA_15082
gccgcgcacgcaggcgccccggccagcggacgccgacggacttttctccccacgcttccttcatgggctgctgcggctcctcgctgcggtcgtgggtccacgcggagaagccgccggcgccccggcggcccgctcctcctcccccgccgccgcaccgcccctccttctccctcaaggcgcagaaggccgccccgccgccgccggccgcgccgcgtggggaggaggagcaggaggtcccggcgctcgcggagttctcgctggcggagctccgcgcggccacggacggcttcgcggcggggaacatcgtgtcggagagcggcgagaaggctcccaacctcgtctacaggggccggctgcggggcgccgcccctcgcgccatcgccgtcaagaagttcgccaagcatgcctggcccgaccccaagcagttcgcggaggaggcgaagggggtgggcaagctgcggcaccggaggctggcaaacctcatcggctactgctgcgacggcgacgagcggctgcttgtcgcggagttcatgtccaacgataccctcgccaagcacctgttccactgggaaaaccagactattgaatgggctatgcgtctgagagttgcatactgcattgccgaagcattgggatattgcagcaatgaggaacgctctttatatcatgacctaaatgcatacagagtcctctttgatgagaatggtgatccacgcctctcatgctttggtctgatgaaaaacagcagggatgggaaaagttatagcacaaatctagcgtacacacctccagaatatctgagaaatggcagggtcacagcagaaagtgtcattttcagtttcggcactgtactccttgatcttctcagcggaaagcgcatacctccttcccatgcacttgatatgataagaagcagaaacatccaagcactaatggattcacatttggaggggaactactcaacggaggaggctactaccttggtgaatcttgcttctcaatgtttgcagtatgaaccaagagaccggcctgatataaagaagttggtttccattctcgaaccactgcaaaccaaatcagaggtgccatcttatgtgatgcttggagttccgaaacctggatgaaccatcaaaggcaccacctagccctactccacagccacagccccctctttctcccatgggagaagcctgttca

SEQ ID NO: 15083 - DNA, 625 bp, Triticum aestivum
  Clone ID: PAT_TA_15083
ttcgtctgcagcagctcctgcaaacccaaccggtgatgttcccatgtccagtgcacctgctgctgcttttgtgccctctgttaatgtgcctatgcctgaagttgtaactcatacaccatcacctgctatgcccgtgctgcctacaactatacctatgtcagctccagtatctgcgcctgcaattgcccctgtgtctgcatctggggctgtgcctgcgcctccacctgttagtgccgtggttcctgagctgtccgacctagatgttcacaatgaggagaagttgctgagggagctggaggaaatgggctttaggcagatcgatctcaacaaagaaatccttaggcagaacaattacaacctggagcagtctgttgatgacctatgtggcgtcaatgaatgggatccactccttgcagagttggaagagatgggatttgatgacacagaggtgaacaaggagctgcttgcgaagaacggaggaagcatcaagcgagctgtgatggacctgattgccagggagaaaaaggacaagtgaagatcgtgtgccagtgtgcgctgtgtgcacatagctatctagacctagcatatatgggtaaataatgagacggctgtgccattgtggtgc

SEQ ID NO: 15084 - DNA, 1057 bp, Triticum aestivum
  unsure (1)..(1057): unsure at all n locations
  Clone ID: PAT_TA_15084
aggaattccgtccgcaccaaccgtccctcgcttctctgcctcctcgccgttgacgtcatggccacctgcaccagagcaccgcccgccgccgccgccgccgcggcggcggtgaccaccgatccagggaaggagaggggcgcgttcctgccggagctggagaaggggaaggatgctgccatcctcccgcccgctattgctcctgctgtcctcgccaagccagggaaggagagtggcgcgttcctgccggagctggagaaggggaaggatgatgccatccttccggccgccgttgctcctgctttcctcgccaagactgggaaggagatggactcgtgcttgccgcccccggaaaaggacaagccactcgcccgccctgcgcccaacaccgctactgagaacctcgtcaatccagggaagaagatgcgccgccctgtgccgatgacggatgaggagaggaacaagatcaaggagttgaaggagcagcaccggtcagggctcgatgagttagaagatcttttccagatacacagggagctgcgcgacgaacttcttttcaggcggaggtgtctggccgcacgtctagtcagccgaatcgtcttccagcgccgtgatgctgcctatgtcaagcgccatcttgacatgggcttgaaggtgggggataagttgccggaggagctcaagcaggctaggccaccaatctcgatggcccttttcttgtggcatgaaatgggcagggccttgcacataggcatggataacttccttgatgagtacagcaacaccgaggagtgccagagaagtatgctagcgttggtgcccggggctgtttgtgatgagaatggagccccgcgtgattctgttgcctcccaagagtaggaattaagtctgtttgctaggtctggatgagtacttgtttaatcctgaaaacgaaatgtttctactgtttcaatccctgaggtttggattgcttgttgtaatcctgaggttttgcatggaattaagtctgtttgttatgtgggatgagtactgctaatcctnagaanaaatgtttcnacng

SEQ ID NO: 15085 - DNA, 581 bp, Triticum aestivum
  unsure (1)..(581): unsure at all n locations
  Clone ID: PAT_TA_15085
ctcgcctcgggcccccaatttcccgccgcctgcgccgcggccggcgcctgggccggggtccggcgcccggcccccgtccccgccctcccccttcgcaccgccgaaggcgccccccccgccccccccggccccccccccccccgtccccggcgtctccgggcgtaccacgcgtgccgcacctggaggaccctgtgccgcctttgcggaggtcgggcatgctcggcttgcgcccgttcgggccggccgggtctctgggggttcgggcggtgttggctttgctacgtccgctgcggctgccgaggcaactgaaggaatggatggaatggacgggaagggccgggttggttgggcggttttcgcggaacccgctccacccgcagcgccgccgcagcaagcagtgctgaccccgccgccacggcaatcatggggtgcttcgccggcaccttaatgaacgatattgtgaaccctccttccagaccgcgccgacccacgctgggtaacagggtttgctccaggttgtctggctcacatctcggttggngccttcccgcagnttaataatgtctngatnagntgaacgn

SEQ ID NO: 15086 - DNA, 1608 bp, Triticum aestivum
  unsure (1)..(1608): unsure at all n locations
  Clone ID: PAT_TA_15086
cgtccgcggacgcgtgggcggacgcgtgggagacaatcgagtgcataaaaggagagccttctattgaggaatattacgatatgtttatagaagccgaagaacacagggaatttgtcccagaagcaattatgcagttgcacactactcagcagttccttgcgcctggaagattggtggttgttaaatccaaatctgatgatgatcacttgcttggcgtaatcgtgaaaaatccatccgctacactaaagcagtatgttgttcttgtactgaccggtgattgcacttcatctgcactagcccctaatttatccagtcaaaatgagaagggaccaggggattctcaaggatattttattatcccgccgaaaggaaaacgtggcatggatgatgattttttctcttcctctagaacacgaaaaagttcaggtgttatcaatataaagctaccatacatgggggacgcatctggaatgggttttgaagtaagagctgtggagaataaagagattattagtatatgtacaagcaaaataaagattgatcaagtcggactccttgaagacattagcaaaacagcttacgctaaaacagttcaaatgcttattaaagagcagacagatggaaagtaccctcctgcgctagatgcaataaaagacctaaaaatgaaagacatggatcaagttaaaagataccatgcacataacaacctactggaagaaatgtctaaaaacaagtgccatggttgtataaaattgaaggaacataagtcaatgatgaaggatcaaaaggtgcacaaggatgagctggatcaactgaaataccaaatgtctgatgaggcacttcagcagatgccacagtttcaaggcagaatcgatgtactaaaggagatccattacatcgattccgatcttgttgtgcaacttaagggccgagtggcatgtgaaatgaactctggtgaagagttaatatcaacagagtgtttatttgagaatcagttggatgaattagaacctgaagaagctgtggctattatgtctgcatttgttttccaacaacggaacgcgtcagaaccatctctcactccgaaactggctgatgccaaaaagaggctctatgacacggcaatcaacttaggacagctccaaaagaggcacgaggtgcctgtggatcctgaagagtatgcacgtgataatctcaagtttggtcttgttgaggttgtctacgaatgggcaaagggaacgcctttcgcggacatatgtgagctgacagatgtatctgaagggctgattgtaagaacaattgtgcggttggatgaaacatgtagggagttcaggaatgcggcttccataatgggtaactctgctttgtacaagaaaatggagatcgcgtccaacgcaatcaagcgtgacattgtctttgcagcaagtttgtatgtcacaggaatatgatgcatgtaggcctaacggtgtttgtaagtagagaatatgtcttagtgaaagtaccatctgataccgttgacagcaggtgcccatgagtgagtagtatcagcaaaatctactgttttgtcaatcaatttcgtaccanctgacaccgttgacaccaggtgnc

SEQ ID NO: 15087 - DNA, 581 bp, Triticum aestivum
  Clone ID: PAT_TA_15087
gattcggacgagggcctttgatcatgcaggatactgaaaggtatttagagctattttttaatacgacacaatctaccgtgttgccgccatgtgttatgctcttgatgctaaataaataggtgtctacatattgggacacatctagcaagactcattatcaatctggctgctcgacttatggatataggctgctcctatgggcctacattcagggctacaacacagatcgtccatcagcccttgtttgatactttatgctgatttttgatcctcggcaattcctcagctatcttcttatttgttctttagatgggtctgagttgggaggactgctgcacccatgaaggcctcattatttttagaggctttggcatctgcctacaaccacggtcgctcagcatgtcttagtcgttggtggaatttggcagcaagcccaagatcttgcatcagcttcctgggcgtgcgaaggtgcgtccattctactaaacacgtcacggtaatgaaactacttcggaactcacagaatcatcaaaccacatttcagattatgatgttacaccacaacgcaattctgatggcta

SEQ ID NO: 15088 - DNA, 1348 bp, Triticum aestivum
  unsure (1)..(1348): unsure at all n locations
  Clone ID: PAT_TA_15088
gggatngatttcgagcggccgcccgggcaggtacacctttcgtgtgcacacctttcttcttattaactaatcatcttaactttgctacaaaaggccatcccaactactcacaaggaaagtagaacatacttcaccggcacaaaagaaaccaagcctgccacatcaaacttgcaaggcttcccaatggatggattctcaaagagaaccaagtcatcgacagctgaccatgttgcaagaagggcttgcgagttagaacttctggatatggggatgaagacgtccacgccgaaggaagacttttgcatgcactaacttgtgagctaaatgcacaggcttatacaaaagaagactgtttctaccaacatggaccccgtagacaaatatacagctgggcccaaattagagttagaattcaacaacaaaaggaattcgccgttacaagagctatctccagcaatctagaaccaagctgcttgtaaggtggtgccaaaatggaacagaaacaattatctacctgacattgaggtaactacaattagcttcagagttaggggatgcggtgcgctatcatctgagcggcttccacggtacctcggccgcgaccacgctatttacaacagaaagcaatgttctgcagaagatatcaacctggagtgattatatcatcatcctgctcccgaatttgaaggatgagcatataagccttgaacatcaggtctctgctgctgctgctgctgagtttgaagttgcagccgagcctgctgttgctgccgctgggtgccaataacatttccatgtataggaacaccnccntgacatttgcctntgcagcatgccttggttaggtgctgacaagaaagcttcatttccaacanagctatcttgaggcgagctagctagctgcgaggtcgaggcaacagcagttggatcttgagatgaatcctgtttccgatgttgtatagatgaaacacctgggctacctgagtctgtactccttgcaactgatgtagacggaattacctgattgacttgatcaacaggcaactcgatcctaacatcgctgttcatatggcggttttgttgcatcatcaatttttggatattattatgtgatggattcatgtgccgctgttgttgctgctgttgtgtagccaattgcgatgatgaatgaactggagcttgttgggaagctaacaaggtctggttgggagaaccctgtattgaaccttgattaccaatatctgatgattgtattggtgactgcggcgtatgagaagcatacatttttggttgattcccaggccgaggcactatggaatcaatccggacgcgtgggcggacgcgtggg

SEQ ID NO: 15089 - DNA, 652 bp, Triticum aestivum
  Clone ID: PAT_TA_15089
ctgttgccaattactgtcatgatctgcgtgagttagacctcagcagaagcttcagacttagtgaccgctccttgtatgcattggcccatggatgcccgcggcttacaagactgaacattagtggatgttccaatttcagtgatactgccttgatttaccttacctgccactgtaaacacctgaagtgcctgaacttgtgtggatgtgggaaggctgctactgacagagctttgcaggctattgctcagaactgtgggcagctgcaatctttgaacctaggctggtgtgatgatgttacagataagggtgtgaccagcttagcgtcaggatgtcctgatctcagagctgtagacttgtgtggttgtgttcttataacagatgagagtgtggttgctcttgccaacggatgtccgcacctgcgctcgttgggcctctacttctgccagaacatcacggaccgtgccatgtactccctcgcaaacagccgcgtgaagagcaagtgtgggaggtgggatgcagtgaaagacgggcttgcgaacctcaacatcagccagtgcaccgccctgacgcccccagcggtgcaggccgtctgcgactcgttcccggcgctgcacacctgccccgagaggcactccctcatcatcagtggctg

SEQ ID NO: 15090 - DNA, 782 bp, Triticum aestivum
  Clone ID: PAT_TA_15090
ttcggcacgaggggacgttctagctagagacgtacgtgacagcgaggaggaaggaagaaaggcagggatcgacatgtcgaggcccaacaggagcgacgcgcacctctccgccgaggacgaggcgacgctggaggccgaggtgcgggggtactacgacgacgcggcgcccaagcgccacaccaagccctcccgcagcgagcactccgccgtgtacgccgacgcgctcgtcccggacgccggcggcaacacccctccggagctcgacaagttccaggagctcgaagcccacaccgagaggttggtgtacgacggcggcaatgtcggagaggagttcgtggagacggagtactacaaggacctcggcggcgtcggcaagcagcaccacacgaccggaacgggcttcatcaagattgacaaagctaagggcgcctcgttcaaattgtctgaagaccccagtgcagaggagcgccatgcttcttgcaagggaaaccctgctaccaatgagtggatcccgtcagctgacacggtgtacccggcgtcagacaagccgagcagaagcgacagctgagcaattcaggcgagtgctttccaccatcagaataaggaaccacactggttgtccacggatcaagaatgcccgtatctttactattctgtgtcgaaattcttgtaatctttacttggaaaaaaaaacgagctatgcactagatttcttgttctggctgtaaatggcaaggaataaagttgtaatcgtggttcagcagtcaaaaaaaaaaaaaaaa

SEQ ID NO: 15091 - DNA, 473 bp, Triticum aestivum
  Clone ID: PAT_TA_15091
gattcggacgagggagtaggcttctagcccttgggattggcctagagatatcagattcaatgaagaacctgatttctcagcaagggtatgacagaagctatggcgcacggccacttagaagagccgttactcagctggttgaggatgttatcagtgaagcaattctctttggacagttcaagcctggtgacacgatattgatggacactgatgccacagggaagccatgcttgagccggctgaatgatcagaccgtccaattgtctgaccccgctccaacaatgtgaacatcccagcaccctgtgtatatagtagcagcttacacatttattccgtacataggatccccatctcagcgtgtacataaccttccagttgttggtttctctccacaatattataatgtaaatttgattcttaaatccaactgtacataatttttattttatcaaaaaaaaaaaaaaaaaaaaaaa

SEQ ID NO: 15092 - DNA, 424 bp, Triticum aestivum
  Clone ID: PAT_TA_15092
tgaagtgactgatgcagactctgcaaacatgctgcgaaggcgctccagaccattcggtgccaatatccacactctggggaacgaggatcatggtccatctgatgaaagaaatgttttctggaatgggaactcgacagagtttggaggcgatgacagaaaataagttgtggcgtggcggggcctggacgacagcaccactttatcagacaatctaagttggagacacctgaaacaaatgcctcaacaggcttgttgaggaatcaagtgttgagtttatagtggcaaaaattatcgctaaattgtgatgttttacatttgtggaaacattgtacggtcgctgcatcagtgtactcgtatagcagatagcgacagatatattaaacccgaaatcattggttcaaaaaaaaaaaaaaaaaaaaaaaaa
